United States Patent 9,782,462 (MODIFIED POLYNUCLEOTIDES FOR THE PRODUCTION OF PROTEINS ASSOCIATED WITH HUMAN DISEASE) - sequence listing, part 101

SEQ ID NO: 197429 - DNA, 2949 bp, Artificial Sequence
  Description of Artificial Sequence: Synthetic coding sequence
atgagcagcaagatggtgatcagcgagcccggcctgaactgggacatttcaccaaagaacggattgaaaaccttcttctcaagggaaaactacaaggaccatagcatggccccctctctgaaggaactgcgagttctgagcaaccggcgcataggggagaacctgaatgcctccgctagtagcgtcgagaacgagccggcagtaagctccgcgacccaagccaaggaaaaggtgaagaccactattggcatggtgctactgcccaagccacgcgtgccctacccacgcttctcccgattttcccaaagagaacagagatcatacgttgatctcctcgttaagtacgctaaaattccagctaattcaaaagctgtgggtattaataagaatgactatctgcagtacctggacatgaagaagcacgtaaacgaagaggtgactgagttcctgaaattcttacagaatagcgccaaaaagtgtgcccaggactataatatgctctctgatgacgcgcgactgtttaccgaaaaaatattgcgtgcgtgcatagaacaggtaaagaagtattctgagttttacacactgcacgaagtaactagtctgatgggattctttccatttagagtcgaaatgggccttaagctcgaaaagacgcttctggcattgggctccgtgaagtatgtgaaaactgtattcccatcaatgccaattaagctccagctctccaaagacgatatcgccaccatcgagacctcggaacaaaccgcagaggccatgcactatgatatttcgaaggatccaaatgccgagaaactcgtttcacggtaccatccacagattgccctgacttcccagtcattattcacactgttgaacaatcacggtcccacatacaaagagcagtgggagatacctgtttgcattcaagtcattcccgttgcagggtcaaaacctgtcaaggtgatctacatcaactcccccctgccacaaaaaaagatgaccatgcgcgagcggaatcagatttttcatgaggtacctcttaagtttatgatgtcaaagaacacaagcgtccccgtgagtgcagttttcatggacaaaccagaggaatttatatctgagatggatatgagctgcgaggtcaacgagtgcagaaaaattgagagcctcgagaacctgtatctggactttgacgatgatgtaacagaactcgagacattcggggtgacaacaaccaaggtgtctaagagccctagccccgcttcgacgtcgaccgtccctaacatgaccgacgcccccacggcacctaaggcaggcactaccacagtggcccctagcgcgcctgacatctccgcgaatagccgttccctgagccaaatcttgatggagcagctgcagaaggagaaacagctggtgaccggcatggatggtgggccagaggaatgcaaaaacaaagacgaccaggggttcgagtcttgcgagaaggtgagcaacagtgataagcccttgattcaggactccgatctgaagacctcggatgccttgcagttggagaactctcaggaaatagagacaagcaataagaacgacatgaccattgacatcctacacgccgacggagagcggcccaatgttctggagaatctggacaattccaaggagaagacggtgggctccgaagcagctaaaaccgaggacaccgtgctctgctcgagcgacaccgatgaagagtgcttaattattgataccgaatgcaaaaataattctgacggaaagaccgctgttgtggggtcaaatttgagcagtaggccagcctccccaaactcctcctcaggtcaggcatccgtgggaaaccagacaaataccgcctgttccccagaagagagctgcgtgctgaagaaacctataaaacgggtgtacaaaaagttcgacccagtcggagagattctgaagatgcaggatgagctgctgaagcccatttcacggaaggtgcccgagctccccctgatgaatctggaaaattctaagcaaccttccgtgtctgagcagttgtcaggcccaagtgattctagtagttggcctaaaagtggctggccctccgcctttcagaagcctaaggggcgactcccttatgagctccaggattacgtggaagacacctcagaatatctagcgccccaggagggaaacttcgtatacaagctattttctctgcaggacctgctgttgctggttcggtgtagcgtgcagcggatcgagacgcgaccccgttccaaaaaacgtaagaaaatacggcgccagtttccagtgtacgtcctgcccaaggtggagtaccaggcgtgttatggggtggaagcgctcaccgaaagtgaactttgcaggctctggacagagtcacttttgcacagtaattcgagcttttacgtgggccacattgacgcattcacttcgaaactgtttctgctggaagaaatcacctccgaagaactaaaagagaaactgagcgccctcaaaatttccaatctcttcaatattcttcagcacattctgaagaagctctcctcattacaggaaggctcctacctcctgtcacatgctgctgaggattctagcctgctaatttacaaggcatccgatgggaaggttacccgcacagcttacaatctgtacaaaacccattgtggcctcccaggtgtaccatccagcttatccgtgccatgggtccccctggatccctcactcctcctcccctatcatatacatcacggaaggatcccctgtacgtttcctccaaaatcactcgacaccactacccagcagaagatcggcgggacgcgtatgcctacccggagccatcggaatccagtgtccatggaaacaaagagctcctgtctcccggcacagcaagtggagactgaaggtgttgcccctcacaaacgcaagatcacttag

SEQ ID NO: 197430 - DNA, 2538 bp, Artificial Sequence
  Description of Artificial Sequence: Synthetic coding sequence
atgaagaagcacgtgaacgaggaggtgaccgagttcctgaagttccttcagaactccgcaaagaaatgtgcccaagactataacatgcttagcgatgatgccaggctcttcactgagaaaattctgagggcctgtatcgagcaggtcaagaagtactctgaattctacacgctgcatgaagtaacctccctgatggggtttttcccattccgggtggaaatgggtctcaagctggagaaaacgttgctggcgctgggatcagtcaagtacgtgaaaacggtgttccctagcatgcctatcaaactccagttgtccaaagatgacatagctactattgaaacatctgagcaaacagccgaagctatgcactatgacatcagcaaagacccaaacgccgaaaagcttgtctccagatatcacccacaaatcgcattgactagccaaagtctcttcactcttctgaataaccacggtccaacctataaggaacagtgggaaataccggtctgtattcaggtaatccccgttgctggcagtaaacctgtgaaggtgatatatataaacagcccacttccccaaaaaaagatgaccatgcgggaacggaaccagatttttcatgaggtgccactgaaatttatgatgtccaagaatactagcgtgcctgtgagcgctgtgtttatggataagcctgaggagttcattagcgagatggatatgtcctgtgaggtaaacgagtgccgaaagatcgaatccctcgagaacctgtatcttgacttcgatgatgacgttaccgagctcgagacttttggagtcactacaacgaaagtttccaagtctccctctcccgccagtaccagcactgtccctaacatgacagacgcccccaccgccccaaaggctggaaccacaacagtagctcctagtgctccagacatcagcgctaattcccgctctctgtcacaaatcttgatggaacagttacagaaggaaaagcagctcgtgaccggcatggatggcgggcccgaagaatgtaagaataaagatgatcaaggcttcgagagttgtgagaaggtttctaactccgataaacccctaattcaggacagcgatctcaagacgagcgatgccctgcagctcgagaatagccaggagatagagacctctaacaagaatgacatgacaattgatatcctgcacgctgatggcgagcggccaaacgtgctggaaaacctggacaatagcaaggagaaaaccgtcggcagcgaggcggccaagaccgaggacacagtgttatgttcttcagataccgatgaagagtgcctgatcattgataccgagtgtaagaataactcagatggcaagactgccgttgtcgggtctaacttatcaagcaggcctgcttctcctaatagctccagtggacaagccagtgtgggcaaccagactaatactgcctgcagcccagaggagtcttgtgtgctgaagaaaccgattaaaagagtgtacaagaaatttgaccctgtgggcgagatattgaaaatgcaagatgagctccttaaacccatctcaagaaaagtgcccgagttgccattaatgaatttagaaaactccaagcagccctcagttagcgaacaactgagcggcccaagtgattctagctcctggcctaaatccggatggccatccgcctttcaaaaacctaaaggcagactgccctacgaactgcaggattatgtcgaagacacatcagaatatctcgctccccaagaggggaatttcgtctataagctgttcagcctccaggatctgctgttgttggtcagatgttccgtccagcgcatcgaaacacgaccccgcagcaagaaacggaagaagatcagacgccaattcccagtgtatgtgcttcctaaagtagagtatcaggcatgctacggtgtggaggccctcactgaatcggaactttgcaggctgtggaccgagtccctcctgcattctaattctagcttttatgttgggcatattgatgcattcactagcaagctgttcctactagaggagattacttcagaagagcttaaagagaaactctcagccctcaagatcagtaatctgtttaacatactgcagcatatactaaagaagcttagctctcttcaggagggaagctatctgctcagccacgccgcggaagacagcagtctgctcatttataaggccagcgacgggaaagtcactcgcaccgcctataacttatacaagactcattgcggccttcccggcgtaccttcttccctctccgtgccctgggtgccactggacccgtccctactgcttccctaccacatccatcatggcagaattccgtgtactttccctcctaaatctttggataccaccactcagcagaagattggaggtacaaggatgccaacgagaagtcacagaaatccagtctccatggagacaaaaagttcctgtctgccagctcaacaggttgaaacggagggagtagccccccataagcgaaagattacctag

SEQ ID NO: 197431 - DNA, 1017 bp, Artificial Sequence
  Description of Artificial Sequence: Synthetic coding sequence
atgagcagcaagatggtgatcagcgagcccggcctgaactgggacattagccccaagaatggcttaaaaaccttcttttcccgagagaactacaaagaccattccatggcgcccagccttaaggaactgagggtgcttagcaacagaagaattggcgaaaacctgaacgcgtccgcttcttctgttgaaaacgaaccagccgtaagctcagccacgcaagctaaggagaaggtgaagaccactatagggatggtgctgctgcccaaaccgcgggtgccttacccccggttttctcgcttctcacagcgggagcagcggagctacgtggacctgctagtgaagtacgcaaagattcccgccaatagcaaagctgtcggaattaataaaaatgattacctccaatacctggacatgaagaagcacgtcaatgaggaggtcaccgagttccttaagtttctccagaattccgctaaaaaatgcgctcaagattataacatgctatctgatgacgcacggctgttcaccgagaagattcttagagcgtgcattgagcaggtgaaaaagtactctgagttttacactctccatgaagtgacatcgctcatgggcttcttcccgtttcgggttgaaatgggactgaaactggagaaaaccttactggctctgggcagtgtcaagtacgtgaagacagtgtttccaagtatgcccataaagctgcagctctctaaagacgacatcgctaccatagaaacttccgagcagactgctgaggcaatgcactatgacatctctaaggacccaaatgcagagaaactcgtttcaagataccatccccaaattgctctcactagtcaatccctcttcacattactgaacaaccacgggccaacgtataaagagcagtgggaaattccggtttgtatccaagtcattccagtggcaggctccaagcccgttaaggtgatttatattaactcaccgcttcctcagaagaagatgaccatgcgggagcggtag

SEQ ID NO: 197432 - DNA, 438 bp, Artificial Sequence
  Description of Artificial Sequence: Synthetic coding sequence
atgagcagcaagatggtgatcagcgagcccggcctgaactgggacattagcccaaagaatggattgaaaaccttcttctcacgggagaactataaagaccacagcatggcaccttctctgaaggaactgagggttctctccaatcggcgcatcggcgagaacctgaatgccagcgcatcatcggtggagaacgagcccgcagttagctccgcgacacaggcgaaggagaaagttaagacaacgatcgggatggtgttactcccaaagccccgggtgccgtaccctcggttctctcgtttcagccaacgggagcaacgctcatacgtggacttgctcgtcaaatacgccaaaatcccggcaaattctaaggccgtcgggattaataagaacgattacctgcaatacttggacatgaaaaagcatgtgaatgaagaatag

SEQ ID NO: 197433 - DNA, 300 bp, Artificial Sequence
  Description of Artificial Sequence: Synthetic coding sequence
atgagcagcaagatggtgatcagcgagcccggcctgaactgggacatcagccccaagaacggtctgaaaaccttctttagtcgggagaattataaagatcactccatggcgccgtccctgaaagagctcagggttctgtcgaataggcgaataggtgagaacctcaatgcatcagctagctcagtagagaacgagccagccgtctcctcagccacccaggcaaaagaaaaagtgaagaccaccatcggtatggtcctgctccccaaacccagggtgccttatcccagattcagtagatag

SEQ ID NO: 197434 - DNA, 285 bp, Artificial Sequence
  Description of Artificial Sequence: Synthetic coding sequence
atgagcagcaagatggtgatcagcgagcccggcctgaactgggacatttctcccaagaatggactcaagacctttttttcccgagagaactacaaggaccacagcatggctccatctctgaaagagctgagggtgcttagcaatagacgaatcggagagaaccttaacgcatcagccagttccgttgagaacgagcctgcagtgagctcagccacccaggctaaagagaaggtgaagaccactatcggcatggtcttgctgcctaagcccagagtgccttactag

SEQ ID NO: 197435 - DNA, 846 bp, Artificial Sequence
  Description of Artificial Sequence: Synthetic coding sequence
atgggccagaagaagcagcggcccgcccgggccggccagccccactcgagcagtgatgcagctcaagcccccgctgaacagcctcacagctcatctgatgccgcccaagccccatgccctagagagaggtgtctggggccaccaacaacccccggcccatatcgttccatctatttttcaagtcctaaggggcacctcacccggctgggcctagagttttttgatcagccagcggtgcctcttgcacgagcatttctgggacaggtgctggtgcgacgtcttcctaacggcacagaactacggggacgaattgtggaaacagaagcctatctgggacctgaggatgaggctgcacacagccgcggcggtaggcagaccccaaggaatcggggaatgtttatgaagcccggcaccttgtatgtatacatcatctacggcatgtacttttgcatgaacatcagtagtcagggggacggtgcctgtgtgctcctgcgcgcactcgaaccactcgaaggccttgagacaatgcgacagctgaggagcacactgagaaaagggacagcttcgcgagtcctaaaagatagggaactgtgttccgggccaagcaagctgtgccaggccctggcaattaacaaatccttcgaccagcgagacctcgcacaagacgaggccgtgtggctggagcgcgggcctctcgaaccctctgagccagccgtggtggccgcggcaagagtgggagtggggcacgctggagaatgggcccgcaagccactgcgtttctacgtacgcgggtcgccttgggtaagcgtggtcgatcgggtggctgagcaggatactcaagcctag

SEQ ID NO: 197436 - DNA, 924 bp, Artificial Sequence
  Description of Artificial Sequence: Synthetic coding sequence
atggaggccgacaaggacgacacccagcagatcctgaaggagcacagccctgacgagtttatcaaggacgagcagaacaaaggacttattgacgagatcactaaaaagaacattcagctaaagaaagagatccagaagctggagactgaattacaggaggcgactaaagagtttcagatcaaggaagatatacccgagactaaaatgaaatttctcagtgtcgaaacacccgaaaatgattctcagctaagtaacatatcgtgttcctttcaggtcagcagcaaggttccctacgagatccagaagggccaagccctcattacctttgagaaggaagaggtagcacagaacgttgtctcaatgagcaagcaccatgtccaaatcaaggacgttaacctcgaggttacagccaagccagtacctctaaactccggcgttagattccaggtttacgttgaggtgagcaagatgaaaataaatgttacagagatccctgacaccctgcgcgaagaccagatgagggacaaactggaactctcctttagtaagtccagaaacggaggaggagaggtcgaccgggtggactatgacagacagtccgggtcagctgtgatcacgttcgtggagatcggtgtggcagataaaattttgaagaaaaaagagtatcccctctacatcaaccagacttgtcaccgcgttactgttagcccctacacagagatccatttaaaaaagtatcagatattctcgggcaccagcaaacgcacggtattgctcaccggcatggagggcattcagatggacgaggagattgtcgaagatctcatcaacatccactttcagagagcgaagaacggaggaggggaagtcgatgtggtgaaatgttcactaggccagcctcatattgcttactttgaagagtag

SEQ ID NO: 197437 - DNA, 90 bp, Artificial Sequence
  Description of Artificial Sequence: Synthetic coding sequence
atggaggccgacaaggacgacacccagcagatcctgaaggagcacagccccgacgaattcatcaaggatgagcagaacaagggcctgtag

SEQ ID NO: 197438 - DNA, 1185 bp, Artificial Sequence
  Description of Artificial Sequence: Synthetic coding sequence
atgagccgggagatgcaggacgtggacctggccgaggtgaagcccttggtcgagaagggtgagacaatcaccgggcttctacaggagttcgacgtacaggaacaggacatcgagacactccacggttcagtccacgtgaccttgtgtggtacacctaaggggaataggcctgtgatcctgacctatcatgacatcggcatgaaccataaaacatgctacaatcctttgtttaattacgaggatatgcaggagattacccagcatttcgcagtttgccatgtcgatgcacccgggcagcaagatggggctgcgtcatttcctgccggatacatgtacccgagcatggaccagcttgccgagatgctgccgggtgttctacagcagtttggcctcaagtcgataattggcatgggaacaggcgccggagcttatattttaacgcgatttgcccttaataatccagaaatggttgaaggcctcgtcctaataaacgtgaatccctgtgcggaaggatggatggattgggcggctagtaaaatttcaggctggacgcaggcactgcccgacatggttgtgagccatctgtttggcaaggaggaaatgcaatctaacgttgaggttgtccacacataccgccagcacatcgtgaacgatatgaatcctggcaacctgcacttgtttattaatgcttataactcccgtcgggatctagaaatagaacgtcctatgccaggtacccacaccgtcacattgcaatgtcccgccttgctagtggttggagacagcagccccgctgtagacgccgtcgtggagtgcaactccaagctcgaccctactaagacaactctcctgaaaatggccgactgtggtggtttgccccaaatcagccagccagctaagctcgccgaagcatttaagtatttcgtgcagggtatggggtacatgccctctgctagcatgacccgtttgatgaggtcccgaacggccagcggcagtagtgttacatccctcgacggtactaggagccggagccacacctccgaagggacgagatctaggtcacacaccagcgagggaacccggagccgtagtcataccagcgagggagcacacctggacatcactcccaactctggcgctgccggaaattccgcaggtccgaaatccatggaggtgagctgttag

SEQ ID NO: 197439 - DNA, 975 bp, Artificial Sequence
  Description of Artificial Sequence: Synthetic coding sequence
atgagccgggagatgcaggacgtggacctggccgaggtgaagcccttagttgagaagggagagacgataaccggcctgctgcaagaattcgatgtgcaggaacaagacattgagacactgcatggcagcgttcacgtcaccctgtgtggaacacctaaggggaataggcccgtgattctgacctatcacgatatcgggatgaatcacaaaacctgtgcatacattttgacccgtttcgcactaaataatccagagatggtggaaggactggttctgatcaacgttaacccttgcgccgaaggctggatggattgggccgcctcaaagatttccgggtggactcaggcactaccagacatggtggtctcgcatctctttggtaaagaagagatgcagtctaacgttgaagtggttcatacttaccgccaacacatcgtcaatgatatgaatccagggaacttgcatctgttcatcaatgcttacaacagccggagagacctcgaaatagagcgtccaatgccaggtacacataccgttactttacaatgccctgccttactggtcgtgggggactcatctcctgctgtggacgccgtggttgaatgtaattcaaagctggaccccacgaaaacaacattactgaaaatggcagactgtggcggcctccctcagatcagccaacctgccaaattggctgaagcatttaaatacttcgtgcagggaatgggctacatgccgtcggcctccatgacaagacttatgaggagccggacagcatcggggtcctcagtcacatcgctcgatggcaccaggtcgagatctcacacaagtgagggcacaagatctcgtagccacacttctgaggggaccagaagccggtctcatacctctgagggagcgcacctggatatcacacctaattctggcgcagctggaaactcggcagggccaaaatccatggaggttagctgttag

SEQ ID NO: 197440 - DNA, 1185 bp, Artificial Sequence
  Description of Artificial Sequence: Synthetic coding sequence
atgagccgggagatgcaggacgtggacctggccgaggtgaagcccctcgtggagaaaggcgagacaattactggcttgctgcaggagtttgacgtgcaagagcaggatatagagactctgcatgggagtgtccatgtgacattgtgtggaactcccaagggcaatagaccagtgatcctgacttatcacgacatcggtatgaaccacaaaacctgctataacccgttgttcaactatgaggatatgcaggagatcacgcaacatttcgcagtgtgccacgttgacgcacctgggcagcaggatggggcagcctcattcccagcagggtacatgtatccgtctatggatcagctagcggaaatgctccccggagttctgcagcagtttgggctgaagtccattattggcatgggcacaggagccggtgcctacattctgaccagattcgctcttaacaacccggagatggtggaagggctggtgctgataaacgtcaacccatgtgccgaggggtggatggattgggcggcgtccaagatctcaggctggactcaggcactgcctgacatggtggtgagtcacctttttggcaaggaagagatgcagagcaacgtcgaagtcgtccacacgtatcgacaacatatagtgaatgacatgaatcctggcaacctgcacctgttcatcaacgcttacaacagccgtcgcgatctggagatcgagcggcctatgccaggcactcataccgtcaccctccagtgccccgccctgttagtagtgggtgactcttcaccggcagtggacgccgtggtggagtgtaattcaaaacttgaccccacaaaaaccacgcttctgaaaatggcagactgcggcggtcttcctcaaataagccagccggccaagctcgctgaagcttttaaatacttcgtccaagggatggggtacatgccctccgcatctatgacaaggctgatgcggtcacgaaccgcctcaggctcatccgtcacctccctggacggtacccgatctcgctcccatacttctgagggcactcgtagtcggagtcacacctccgagggaactcggagcaggtcacacaccagtgaaggagcgcatcttgatatcacccctaacagcggcgccgccggaaatagtgccgggcctaaaagtatggaggtgagctgctag

SEQ ID NO: 197441 - DNA, 498 bp, Artificial Sequence
  Description of Artificial Sequence: Synthetic coding sequence
atgagccgggagatgcaggacgtggacctggccgaggtgaagcccctggtcgagaagggagagacaataacagggctcttgcaagagttcgacgtgcaggaacaagacattgagacccttcatggctccgtgcatgtgaccctgtgcggcacacccaaaggtaatcggcctgttatccttacttaccatgatatcggaatgaaccacaagacctgctacaatcctctgtttaattacgaagatatgcaggaaattacacagcacttcgcagtttgtcatgttgatgccccagggcagcaggacggggcggccagcttccctgctgggtacatgtacccttctatggatcagttagccgaaatgcttcctggggtgttacagcagtttggtttaaaatcgataatcggtatgggcacaggtgcgggcgcgtatatcctgacacggttcgccctgaacaaccctgaaatggtggagggactggtcttgatcaatgtatag

SEQ ID NO: 197442 - DNA, 477 bp, Artificial Sequence
  Description of Artificial Sequence: Synthetic coding sequence
atgagccgggagatgcaggacgtggacctggccgaggtgaagcccctagtggagaaaggagaaacaatcacaggcttgctgcaggaattcgatgtgcaggagcaagatatcgaaactctgcatggttcagtgcatgtgactctgtgtggcacgcctaaaggcaaccgccctgttatcctgacatatcatgacataggtatgaaccataagacctgttataaccctttgttcaactacgaagatatgcaagagattacccagcacttcgctgtgtgccacgtggacgcgcctggacagcaggacggcgccgctagttttccagccggatacatgtatccctctatggatcagctcgccgagatgctgcccggcgtcctgcagcagttcggcctgaagtccattattggtatgggcactggagcaggcgcatatatcctgacccggtttgcgctgaataatcccgaaatggtcgagtag

SEQ ID NO: 197443 - DNA, 402 bp, Artificial Sequence
  Description of Artificial Sequence: Synthetic coding sequence
atgagccgggagatgcaggacgtggacctggccgaggtgaagcccctagtcgagaaaggggagacgattacgggactgctgcaagagttcgatgtacaggaacaggatatcgaaacattacacggatccgtgcacgtgaccctgtgcggtacccctaaagggaacaggccagtaattcttacctaccacgacattgggatgaaccacaagacctgctataatccattattcaattacgaggatatgcaggagataacgcagcactttgcagtgtgccacgtggatgcacccggacagcaggatggtgcggcttcgttccctgccggttacatgtatccctccatggaccaacttgctgagatgcttccaggggtgctgcagcagttcggactgaaatcctag

SEQ ID NO: 197444 - DNA, 477 bp, Artificial Sequence
  Description of Artificial Sequence: Synthetic coding sequence
atgagccgggagatgcaggacgtggacctggccgaggtgaagcccttagtggaaaagggcgaaacgattacgggcctactgcaggagttcgacgtacaggagcaggacattgagaccctgcatggttcagtacacgtcacgctttgcggcactcctaagggcaatcgccctgtgatattaacataccacgacatcggcatgaaccataagacgtgctataaccccctgtttaattatgaagacatgcaggagattacgcagcactttgccgtgtgtcacgtcgacgccccagggcagcaggacggcgccgcttcttttcctgcgggatacatgtacccttcaatggaccagctcgccgagatgctccctggggttctacagcagttcgggctgaagagtattatcggaatggggaccggggccggcgcctacatccttaccaggttcgccctgaataatcccgagatggtggagtag

SEQ ID NO: 197445 - DNA, 669 bp, Artificial Sequence
  Description of Artificial Sequence: Synthetic coding sequence
atggactgggccgccagcaagatcagcggctggacccaggccctgcccgacatggttgtgagtcacctgttcgggaaagaagagatgcaatccaacgtagaagtggtgcacacttacaggcagcacatagtgaatgatatgaatcctggtaatctccatctgttcataaacgcctataactcacgtagggacttagaaatcgaacggcccatgccaggaactcacaccgttactctgcaatgtcctgctttactggtggtcggcgacagttctccagccgtggacgccgtggtagagtgtaactccaaactggaccccacaaagactactctactgaagatggcggactgtggcgggctgccccaaattagtcagccggcaaaattggctgaagcattcaaatacttcgtgcagggcatgggctacatgccttcggcatccatgaccagactgatgaggtccagaacagctagcggttcttctgtgactagtttggacggcacacggtcccgttctcacacgtcggagggcacgcggagccggagccacacttcagagggtacacgttcaaggtcacacacaagcgaaggagcacatctggatatcactcccaacagtggtgccgctgggaactccgccggaccaaagagcatggaagtgtcatgctag

SEQ ID NO: 197446 - DNA, 450 bp, Artificial Sequence
  Description of Artificial Sequence: Synthetic coding sequence
atgagccgggagatgcaggacgtggacctggccgaggtgaagcccctggttgagaagggggaaactatcaccggcctgttgcaggagttcgacgttcaggagcaggacatcgagaccctgcacgggtctgtgcacgtcaccctgtgtgggaccccacccgccaagctggctgaggctttcaagtacttcgttcaagggatgggctatatgcctagcgcatcaatgacacgactgatgagatcacgaaccgcctccggcagctccgtcacatctctggatggaactagatcacgctcacacacatcagagggaacgaggtcccgcagccacactagtgaaggcactcgcagcaggtctcatacaagcgaaggagctcacttggatattactccaaattctggagcagcaggaaactccgccggtccaaaatcaatggaagtgagctgttag

SEQ ID NO: 197447 - DNA, 942 bp, Artificial Sequence
  Description of Artificial Sequence: Synthetic coding sequence
atgcaggagatcacccagcacttcgccgtgtgccacgtggacgcccccggtcagcaggatggcgccgcaagttttccagctgggtacatgtacccttccatggatcagctggccgagatgctccctggagtgcttcagcaatttggactcaaatccattatcgggatgggaactggagccggcgcctacatcttgacccgtttcgcccttaataatcctgaaatggtggaaggtttggtactcattaatgtgaacccgtgtgcggagggctggatggattgggccgccagcaagatatcaggctggactcaggctctgccagacatggtagtttctcacttgtttggaaaagaggagatgcagtccaacgtcgaagtggttcatacttaccgccaacacattgtgaatgatatgaaccctggcaacctccatcttttcataaacgcatataattcacggagagatctggaaattgagcgccctatgccagggactcacactgtgactctccagtgccctgccctgctcgtggtgggcgactcttcacccgcggtcgacgctgtagtggaatgcaatagcaagttggacccgacaaagaccactctcctcaagatggcggactgcggagggctgccccagattagtcaaccagcgaaactagccgaagcttttaaatatttcgtccaaggaatggggtacatgccaagcgccagtatgacaagattaatgcgctcccggacagcctcaggatcttctgtgacgagcctggacggcacgcgatccagatcccacaccagtgaaggaactcgttcgagatcccacacaagcgaagggacgaggagtagatcacatacctctgagggagcacatcttgatattacccctaactctggcgccgccgggaactccgcagggcctaaatctatggaagtgtcatgttag

SEQ ID NO: 197448 - DNA, 288 bp, Artificial Sequence
  Description of Artificial Sequence: Synthetic coding sequence
atgagccgggagatgcaggacgtggacctggccgaggtgaagcccttggttgagaagggcgagacaattacaggtctgcttcaggagtttgacgtgcaaacgaagcctgctactacaccgtcttctacaacccgtacttgccgtcgctcaccgagcacacttcccagcgccacttggacccccctggccagtcgcacagctcaacccccgagtccgcaaggcacatgcacacctccatggatctcatggctgaagtgtttcctcgaaagcttcaatagcctgggctag

SEQ ID NO: 197449 - DNA, 1491 bp, Artificial Sequence
  Description of Artificial Sequence: Synthetic coding sequence
atggccgacgagagcgagaccgccgtgaagccccccgccccccccctgccacaaatgatggaaggcaacggcaatgggcacgaacattgttccgactgtgagaatgaggaggacaattcatacaaccgcggcggtctctcacctgccaacgatacaggcgccaagaagaagaagaagaagcagaaaaaaaaaaaggagaagggcagcgagaccgattctgcccaggatcagcccgtcaagatgaacagcctgccagccgaacgcatccaggagatacaaaaggctattgagctatttagtgtgggccagggccccgcgaaaacaatggaagaagctagtaaacgctcataccagttctgggatacccagccagtgcctaaacttggggaggttgtgaacacacacggaccagtcgagccagacaaagacaacattcgccaggagccatacaccctccctcagggcttcacttgggatgctctggatttaggcgaccgtggcgtgttaaaggaactgtatacactgttaaatgaaaactacgtagaggacgacgacaatatgtttagattcgattattctcccgaatttttgctttgggccctgagacctccagggtggctgcctcaatggcactgtggcgtcagggtggtttcttctagaaagttggttgggttcatcagtgccatcccagccaacattcatatctacgataccgagaagaaaatggtggagatcaactttctgtgtgtgcacaagaaattgaggtcaaaacgtgtcgcccctgtgctgatacgagaaattactcgccgcgtgcatttggagggcatttttcaggccgtctacacggccggcgtcgtgttgccaaagccagtggggacttgtagatattggcacagatccctgaacccccgcaagctcatcgaggtgaagttttcgcacctgagtcgtaatatgactatgcagagaaccatgaagctctacaggttgcctgaaactcccaagacagccggcctacggccaatggagacgaaggatatcccagtcgttcatcagctgctgaccaggtaccttaaacagttccatctcacacccgtcatgtcccaagaggaagttgaacactggttctacccccaggaaaacatcatcgatacatttgtggtggagaatgcgaatggagaggttactgatttcctatcattctacacgcttccgtcaacgatcatgaaccacccaacccataaatctttaaaggccgcttattcgttctataacgttcacacacagacgccgctcctggatctgatgagcgacgcactagtgctggcaaagatgaaaggcttcgacgtgtttaatgctttagacctgatggaaaataaaacatttctagaaaaactgaaattcggtattggagacgggaatctgcagtattacttgtataactggaagtgtccttccatgggcgccgagaaagttgggctcgttctgcagtag

SEQ ID NO: 197450 - DNA, 414 bp, Artificial Sequence
  Description of Artificial Sequence: Synthetic coding sequence
atggccgacgagagcgagaccgccgtgaagccccccgccccccccttgccccagatgatggagggcaatggcaacggacacgaacactgctccgactgcgagaatgaggaggacaattcgtacaacagagggggactgtcaccagcaaacgatacgggagctaagaaaaagaagaagaagcagaaaaagaagaaggagaaaggaagtgagacagatagtgctcaggaccagccagtcaagatgaattccctgccagccgaaagaattcaggaaatacagaaagctatcgaactcttctccgttggccaggggccagccaaaaccatggaagaagccagtaagcgctcttatcaattctgggacactcaaccggttcctaagctcgcaaagcgcactgttcacccacctgagtag

SEQ ID NO: 197451 - DNA, 1491 bp, Artificial Sequence
  Description of Artificial Sequence: Synthetic coding sequence
atggccgacgagagcgagaccgccgtgaagccccccgccccccccctgcctcagatgatggagggaaatggcaatgggcatgagcactgtagtgactgcgagaatgaggaggacaattcatataatagaggagggctgagccccgcaaatgataccggtgctaagaaaaaaaaaaagaagcagaagaagaagaaggaaaaaggctccgagaccgattccgctcaagatcagcctgtcaaaatgaacagtctgcccgccgagcggattcaggaaattcagaaggcaattgagttgttttcagtcggtcaaggaccggctaaaactatggaagaggcgagcaagcgatcttaccagttctgggacactcagccggtgcccaaactaggcgaagtcgtgaatacccatgggcccgtcgaacccgacaaagacaatataagacaagaaccatacaccctgccccaggggtttacttgggacgccctcgaccttggggatagaggggtcctgaaggagctgtacaccctgcttaacgagaattacgtggaagacgatgacaacatgtttcggtttgattactctcccgaatttctgttatgggcgcttagacctcccgggtggctgcctcagtggcactgcggagtccgagtggtaagcagccggaaattggtaggattcatttcagctattccggcgaacattcatatttacgacaccgagaagaagatggtcgaaatcaattttttatgtgttcataagaaactcagatccaagagagtggcccctgttctgattagagaaattacccgaagggttcaccttgagggaatattccaggctgtgtataccgccggagtggtgctccctaagccagtgggcacctgccggtattggcatagatcacttaacccaaggaaacttatcgaggtgaaatttagtcacctgagccgcaatatgactatgcagaggaccatgaagttatacaggctgcccgagaccccgaaaaccgctggcctgcgacctatggaaacaaaagacatccccgtggtgcaccaactgctcaccagatatctaaagcaattccaccttacaccagtgatgagccaggaggaagtggaacactggttctaccctcaggaaaacattatcgacacgtttgttgtggagaacgctaacggtgaggttacagattttctgtctttctacaccctcccatctactatcatgaaccatccgacacacaagtccttaaaagcagcctattctttttacaacgtacacacacagactccattgctcgaccttatgtcagacgcgcttgtgctcgccaagatgaaaggttttgacgtctttaacgcgttagatctgatggaaaacaagacgtttctggaaaagctcaagtttggtatcggagatggcaatctgcagtattacctctacaactggaaatgcccttctatgggtgccgaaaaggtcggtttggtcctgcagtag

SEQ ID NO: 197452 - DNA, 1590 bp, Artificial Sequence
  Description of Artificial Sequence: Synthetic coding sequence
atggccgaggacagcgagagcgccgccagccagcagagcctggagttggacgatcaagacacgtgcggaatagatggcgataacgaggaggagactgagcatgcaaaaggcagtcccggaggatacctcggggccaagaagaaaaagaagaagcagaagcgaaagaaagagaaacctaatagcgggggcaccaagtccgacagcgcttctgattcacaggagattaaaattcagcaaccttcgaaacacaacacaatctggcaacagattagcgctggggcggctatgggttcagcaactatggaaggagagtggaccggaatgcgcaatgaccacaagaacccgtccgtgcccatgcagaagctccaggacatccagagagccatggagctgctgtctgcctgtcagggaccagctcggaacatcgatgaagctgccaagcatcggtaccaattctgggatactcagccagtgccaaagttggatgaggtgataacctcacacggggctattgaacccgacaaggataacgttagacaggaaccgtactcccttccacaaggctttatgtgggatactctggacctctctgatgccgaggtgcttaaggagttgtacaccttgctcaacgaaaactacgtggaggacgacgacaatatgttcaggttcgactattcacccgagttcctcctttgggccttgcgacctcccggctggctcctgcagtggcactgtggcgtgcgtgtgagctcaaataaaaaacttgtgggcttcatttccgccatacctgcaaacatacggatatacgattccgtgaaaaagatggtggagatcaatttcctgtgcgtgcataaaaaattacgctctaagcgtgtcgccccagtcctgatacgtgagatcacgagacgcgttaacctggagggcatcttccaagccgtgtataccgccggcgtggtcctccctaagcccatcgctacttgtaggtactggcaccggtcattgaaccctcgcaaactcgttgaggtgaaatttagtcacctaagccgcaatatgacgctccagcgaactatgaagttatataggctgccagacgtgaccaagacctccggattgcgccctatggaacctaaagacattaagtcagtgagggagctcattaacacatatctcaagcagtttcacctggcacccgttatggatgaagaggaagtggcacattggttcctgccgagggagcatatcattgatacattcgtcgttgagtctcccaatggaaaattgacagactttctttccttttacacgctgccttccacggtcatgcaccaccctgcccacaaaagcctgaaggccgcatatagtttttacaacatacacactgaaaccccgttgcttgatcttatgagcgatgccctgatcctagccaagtccaaagggttcgacgtatttaatgctttggacctgatggagaataagacattcctagaaaagctgaagtttgggatcggtgacggaaacttacagtattacttatataattggaggtgtccaggcactgattccgagaaggttgggctcgtgctccaatag

SEQ ID NO: 197453 - DNA, 1458 bp, Artificial Sequence
  Description of Artificial Sequence: Synthetic coding sequence
atgcggcggcggcggagcacccccaaggaggtgctggagggcatctgggagcccaagcggaagcgacggaacaggcgggagaaaagacgaaatcaaattccggaggctcccagtcagaccaggcatctcatcccaaggagactgaagttcagtagtctccgcaatactacaccgtcaggatctagattccaacgagagcagccctggaacccctcagtgcctatgcagaaactgcaggatatccagagagccatggaactgctgtctgcatgccaggggcctgcccggaacatcgatgaggccgcaaagcaccgataccagttttgggatactcagccagttccaaagttagatgaggttattacatcccacggcgccatcgagccagacaaggacaacgtgaggcaagagccctattcgctccctcaggggtttatgtgggacaccctggatctctccgatgctgaagttttgaaggagctgtataccctgctgaatgagaattatgtagaagatgacgacaatatgttccggttcgattacagtccggagtttctcctgtgggcactgcggcccccaggttggctccttcagtggcactgcggggtgcgggtcagctcaaataaaaaattggtcggattcattagcgcaattccggctaatatcagaatatacgatagtgtgaagaagatggttgagatcaacttcttgtgtgtgcacaagaagctgcgatctaaacgggttgcccctgtcttgataagagagattacccggagggtcaacctggaggggatttttcaggccgtgtacaccgccggagtcgtccttccaaaacctatcgccacatgtcgttactggcacagatcccttaatcctcgcaagttagtggaggtgaagttctcgcacctatctaggaacatgacacttcagcggaccatgaaattgtatcgcctgcctgacgttacgaagaccagtggccttcgaccgatggagccaaaggatatcaagagtgtcagggaactgatcaatacatacctgaaacagtttcacctggcacccgtaatggacgaagaggaggtggcccactggtttttgccccgcgagcacatcatcgacacttttgtggttgagtccccgaacggaaaattgaccgactttctgtccttttatactctacctagtacagtgatgcaccaccccgcccacaagagccttaaggcggcctacagcttttacaacatccacacagaaacacctctgctggacctgatgagcgatgccctgatcttggctaagtccaaaggcttcgacgtatttaacgcacttgatttaatggaaaacaaaactttcctggaaaaactcaaatttggcataggcgatggtaacctgcagtattatctgtacaactggaggtgccctgggaccgacagtgagaaggttgggctagttcttcagtag

SEQ ID NO: 197454 - DNA, 1497 bp, Artificial Sequence
  Description of Artificial Sequence: Synthetic coding sequence
atggccgaggacagcgagagcgccgccagccagcagagcctggagctcgatgaccaggacacctgtggaatcgacggagataatgaggaggagactgaacacgctaagggatcacctggtgggtatctgggcgccaaaaaaaagaaaaaaaaacagaagcgcaagaaagagaagccaaacagtggaggaacaaagagcgacagtgcatccgactctcaggaaattaagatacagcaaccctcaaagaatccctccgtacccatgcagaagctgcaggatattcagcgcgcgatggaacttctgtcagcatgccaagggcccgctcggaatattgacgaggcagcaaaacacaggtatcaattttgggatacccagcctgtccctaaactggatgaggtgattactagccacggcgcaatcgaaccagataaggacaacgtgaggcaagagccttactctctgccccagggatttatgtgggacacattggatctgagcgatgctgaagtgctaaaggagctctatacactgctgaatgaaaattacgtagaggacgacgacaacatgttcaggtttgactacagcccggaatttctcctctgggcactgagacccccagggtggctgttgcagtggcattgcggggtcagagtgagctcaaacaagaaattggtaggatttatctccgccattccagccaacatcagaatatatgacagcgttaagaagatggtcgagattaatttcctgtgcgtgcacaaaaagctgcggtcaaagagggtcgctcctgttttgattagggagattacccgaagggtgaatctcgaagggatctttcaggccgtgtacacagcaggggtggtcctgccaaagccaattgccacatgccgttattggcataggagcctgaacccaaggaaactggtggaggttaaatttagccacctctctcgcaatatgacacttcagaggactatgaagttgtaccgcctgcccgacgtgaccaagactagtggcctgcggcccatggagcccaaggatatcaaatccgtccgggagctcatcaacacctacctaaagcagtttcacctcgcccccgtcatggatgaggaggaggtcgctcattggtttctccccagggaacatattattgacacctttgtcgtggagtcacccaatggaaagttgacagacttcttgtccttctacacgcttccatctactgtgatgcaccatcctgcccacaaatctctaaaggccgcttattccttctacaacatccataccgaaactcctctccttgatctcatgtcagatgccctgatactggctaagtctaagggatttgatgtttttaacgctctggacctcatggagaacaagaccttcctcgaaaagctgaagtttggcatcggagatggaaatctgcagtactacctctacaactggcggtgcccgggaaccgatagcgagaaagtgggtcttgtgctccaatag

SEQ ID NO: 197455 - DNA, 234 bp, Artificial Sequence
  Description of Artificial Sequence: Synthetic coding sequence
atgagcgacgccctgatcctggccaagagcaagggcttcgacgtgtttaatgcgcttgacctgatggagaacaagactttcctcgaaaagcttaagtttggtattggagacgggaatctgcagtactacttatacaattggcgatgccccggtaccgattctgaaaaaggatccgggaactttgtcaacgccaacgggaaacttttacctgacgtctgtcggcgtcccccttag

SEQ ID NO: 197456 - DNA, 1458 bp, Artificial Sequence
  Description of Artificial Sequence: Synthetic coding sequence
atggccagcccctggcggggcgcccacgaggtgctggagggcatctgggaacctaaacgtaaacgacgcaatcgacgtgaaaaacgtagaaatcagatcccagaggccccttctcagactagacacctcatccctcgtagactgaaattcagttcgcttcgcaatacaacaccgtctggaagcaggttccagagagaacagccttggaatccaagcgtgcccatgcagaaactgcaggacattcagagagctatggaactgcttagcgcctgtcaggggcccgcccgcaatatagacgaagccgccaagcatcgataccagttttgggacactcaacccgtgcctaaactagatgaggtaattacatcccacggagcaattgagcctgataaggacaacgttcggcaggagccatactctttgccccagggttttatgtgggatactctggatcttagtgacgccgaggtgcttaaagaactatacacgctgttaaacgaaaattatgtggaagacgacgataacatgtttcgtttcgattactcgcccgagtttttactgtgggcgttacggcctccagggtggctgcttcagtggcactgtggcgtgcgggtttcctctaacaaaaagctggtggggtttatcagtgcgatccctgccaatatcaggatctacgacagcgtgaagaaaatggtggagatcaatttcctttgtgtccacaagaagctccgtagtaaacgggtagcccccgtgttgatccgcgaaatcactagaagggttaacctggaagggatttttcaagcggtctacactgccggagtggtactgcctaagccgatcgctacatgtcggtattggcataggagcctgaacccaaggaagctagtcgaggtcaagtttagtcatctctctaggaatatgacccttcaacgcaccatgaagttgtatcgactgcctgacgtgacaaaaacctccgggctgcgaccgatggaacccaaagacattaaatctgtgcgggagttgataaacacatacctgaaacagtttcatctggctcccgtgatggacgaggaagaagtcgcacattggtttctgcctcgagagcacattatagacacattcgtggtggagagccccaatgggaagttgacagattttctttcattttacaccctccccagcacagtcatgcaccacccagcccacaagagcttaaaagctgcctattctttttataacattcacactgaaaccccccttttggaccttatgtctgatgcactaatcctggctaaaagcaaaggctttgatgtttttaatgcactggatctgatggagaacaagacctttttagaaaaactgaaattcggaatcggggacggcaacctgcagtactatttatacaattggcgctgccccggcacggactcagaaaaggttgggcttgtgttgcagtag

SEQ ID NO: 197457 - DNA, 933 bp, Artificial Sequence
  Description of Artificial Sequence: Synthetic coding sequence
atgttccggttcgactacagccccgagttcctgctgtgggccctgcgtcctcccggttggttgctgcagtggcattgcggggtgcgggtgagtagtaacaagaagctggtgggttttattagcgcgattcctgctaatattcggatctacgactcagttaaaaaaatggtagaaattaacttcctatgtgtgcataagaagctgagatccaagcgagtagcacccgtgctgatccgcgagatcacaaggagagttaatttagagggcatcttccaggcagtgtacactgccggtgttgtgctcccgaagcctattgctacctgtaggtactggcatcggtctcttaatcccagaaagttagtggaggtcaaattctcccacttatcgaggaacatgaccctgcagcggactatgaagctctacagacttcccgacgtcaccaagacttctgggctccgaccgatggagcctaaggacatcaaatccgtgagagagctgattaacacatatctgaagcagtttcacctggcgccagttatggatgaagaggaggttgctcattggttcctgccgcgcgagcacataatcgacacttttgtcgttgaatcaccaaatggaaagctgactgattttctcagcttttataccctcccttccaccgtgatgcaccatcctgcacataaatccctgaaggctgcctattccttttacaatatccacacggagacccccctcctggacttgatgagcgacgctctaatccttgccaaatctaagggcttcgatgtattcaacgccttggacctcatggagaataaaaccttcttggagaagttgaagttcgggataggtgatggcaatctccagtattacctctataactggaggtgccccggcactgactccgagaaggtagggctcgttctgcagtag

SEQ ID NO: 197458 - DNA, 459 bp, Artificial Sequence
  Description of Artificial Sequence: Synthetic coding sequence
atggaggccgtgctgaacgagctggtgagcgtggaggacctgctgaagtttgagaagaagttccaatctgagaaggcggctggttctgtgtccaagagcacccagttcgagtatgcctggtgcctcgtgcgttccaagtataacgacgacatccgcaagggtatcgtccttctcgaggagctgcttcctaaaggatcaaaagaagagcaacgggactatgtcttctacctggccgtgggaaactatcgcctgaaggagtacgagaaagctttaaagtatgttagaggcctactccaaactgagccccagaataatcaggctaaggagctggagcgcctgatcgataaagcaatgaaaaaggacgggctcgtggggatggctatagttggtggaatggctctcggggtggcgggattggccggattgattggtttggccgtctctaaatccaagtcttag

SEQ ID NO: 197459 - DNA, 2076 bp, Artificial Sequence
  Description of Artificial Sequence: Synthetic coding sequence
atggccctgctgctgaccctgaccagccccgacctggagggcacctgggatactagggataaggacggatttaaggctcaggaagggcctcccctggccgtccccgaatttccagtatgcgggctgtacaggatctatggcgtgtgcggatcgttctcaagcttcttcataatcaggtgctctctttgcgccctggaaaccctcaagtctccccaacacgatccattggagatccctgagcaatcactgaagcttattcccctcgtgtctggcaagagagagctgacgcgcgggcagaaggccggcgagaaacccttggctgcaggccccggggaggaagagttgctaaggggcagcgcccctcacgctcaggacacccagagtgaggagctcccccctagctgcactatctctggcgaaaaaaagcctccagcagtctccggagaagctactggggccgatgctggcagactctgtcccccaccaagatcgcgtgcccctcacaaggaccgtactctcgcccgtagcagaccccagacccaaggggaggattgttcactgccagttggtgaggtcaagatcgggaaacgctcctacagtcccgcccccggaaagcaaaagaagcctaacgccatggggctcgcacctacttctagtcccggagcacccaattccgctagagccacacacaacccagtgccgtgcggttccgggaggggtccgtgccacctggcaaaccttctcagtacactggcccagtctaaccaaaacagagaccacaagcagggtccacctgaggtcacgtgtcagattcgaaagaaaacccgcactctctacaggagtgaccagctggaagagctggagaaaatcttccaggaggaccactaccctgactctgacaagcggcgagaaattgcccagacagtaggagttacaccccaacgcattatggtcaagggtgccggctccctcgttgccggctggtccggtgggggacccaccattgaaaccctggagctccagtcagagcgatcagcggtggcatgggtttggttccagaaccggagagcaaagtggaggaagatggaaaagctgaacggaaaggaatctaaggataatcctgccgcacccgggcccgcctcctctcagtgtagcagcgctgccgaaatcctaccggccgttcctatggagccaaagccggaccctttcccgcaagaatccccactcgacacatttcccgagccccccatgttactgactagcgatcaaactctggccccaacacaaccgagcgagggggcacagcgagttgtaacaccaccacttttctctcctcctcccgtgcgcagagcagatttgccctttcctctgggtcccgtccataccccacagcttatgcctctgctgatggacgtcgccggtagtgacagctcacacaaggacggtccttgcggttcgtggggaaccagcattacgctgcccccaccatgcagttatcttgaggagctcgagccgcaggactaccaacagtcaaaccaacccgggcccttccagttctcacaggcaccacaaccccctctctttcaatccccccagccaaagttaccttacctgcctacattcccattcagcatgccttcctccttgaccctgccccccccagaagacagcctcttcatgtttccctgcggccctagtggcggcacaagtcagggttactgccctggtgcatcctccggacagatcctgatgcagcctccagcggggaatatagggacggccagctggtcagatccatgcctaccggagctccccttcccaggaccattctgcccacaggccctgggtcacccacccggcggtgacggatacttcccagatctgtttcccaccccatgtccccaggcactgggaaggcagccctccagtgcgctctcctggatgccagagggcgctcgccctggcactgggcctcttctttccaaagcgaaggaggagcctccagctgcatccctggaccagccatccgccttggaggaggcccgaggtgacgataaaaattcccatgtcccttag

SEQ ID NO: 197460 - DNA, 699 bp, Artificial Sequence
  Description of Artificial Sequence: Synthetic coding sequence
atggagcggtgccccagcctgggcgtgaccctgtacgccctggtggtggttctcggactcagggctaccccagccggcgggcaacattacctgcatattagacccgccccctctgataacctaccgcttgtggatctaatagagcacccggacccaatctttgaccctaaagagaaggatctgaatgagaccctcctacgctcgttgctaggcggacactatgaccccggtttcatggcaacctcaccccccgaggaccggcctggcgggggcgggggcgctgctggaggggcggaggacctggcagagctggaccaacttcttcgtcagagaccaagtggggccatgcctagcgagattaagggcctggaatttagcgaaggactcgctcagggcaaaaagcagcggctgagcaaaaaattacggaggaaactgcagatgtggctctggagccagacattctgccccgtactctatgcatggaatgatctgggatcgcgattttggccgcgatatgtgaaggtgggatcctgtttttcaaaacgctcttgctccgtacctgaagggatggtttgcaagccgagcaagtcagtgcacttgacagtccttcggtggagatgtcagcgccgaggcgggcagaggtgcgggtggatcccgatccagtatcccatcatctcagagtgtaaatgttcctgctag

SEQ ID NO: 197461 - DNA, 990 bp, Artificial Sequence
  Description of Artificial Sequence: Synthetic coding sequence
atgggcaccgccgccgccgccgccgccgccgccgccgccgccgccgccggagagggggctcggagcccatcccctgctgctgtaagtctcgggctgggtgtggccgtggtctcttctttggtaaacgggagcacattcgtgctccagaaaaaaggcatcgtccgggctaaaaggcgggggacctcgtacctgactgatatcgtgtggtgggctggcactatcgccatggccgtcgggcagatcggcaatttcctcgcctataccgccgtcccaaccgtgctggtcactcccctgggcgccctcggagtaccatttggatctatcctcgccagctatcttcttaaagaaaaattgaatattctgggaaagctggggtgcttgcttagttgcgcagggagcgtggttctgatcattcattctcccaagtccgagagcgtcacaacacaggctgaactggaagaaaaactgaccaatcccgtgtttgtcggctatctgtgtattgtcctcctcatgttattactgctgattttctggattgcacctgcccatgggcccactaacatcatggtctacatttctatatgctcactcctggggagctttaccgttccttccactaaaggcattggattggctgcccaagacatcctgcataacaaccctagctctcagcgcgctctgtgcctatgcctagtgctgttggcggtgctcggctgtagcatcattgttcaatttagatatattaataaagccctggaatgcttcgattctagcgtgtttggtgccatttattatgtggtgttcacgaccctggtccttctagcatctgccattctgttccgcgagtggtccaatgttggtctcgtggacttcctggggatggcctgcggcttcactactgtaagtgttggtattgtactgattcaggtctttaaggagtttaatttcaatctgggtgagatgaacaagtcaaatatgaaaacagactag

SEQ ID NO: 197462 - DNA, 765 bp, Artificial Sequence
  Description of Artificial Sequence: Synthetic coding sequence
atggccgtgggccagatcggcaacttcctggcctacaccgccgtgccaaccgttctcgtgacgccattgggtgcgctgggagtgcccttcggatccattctcgcttcctatctactgaaagagaaacttaatatcctgggcaaactgggttgtctgctgtcatgcgctgggtctgtggtcctaatcatccactctcccaagtcggagtccgtgaccacacaggccgagctggaagagaaattaacaaaccctgtgttcgttggatacttgtgcattgtcctgctcatgctgctgctgctgattttctggatcgctccagctcacggaccaaccaacattatggtatatatttctatttgcagcctcttaggctcctttactgtgcctagcacaaaggggatcggcttggccgcacaggacattcttcataacaatccctcgagccaacgcgccctgtgtctgtgccttgtgcttttagctgtgttgggttgtagtataatcgttcagttccggtacatcaacaaggcccttgaatgcttcgattcgagtgtgttcggcgcgatttactatgtggtgtttactactctggtgctgctggcctcagcaatcctgtttagagagtggtctaacgtgggactagtggactttctgggaatggcgtgtggtttcaccacagtaagtgtggggatcgtactcatccaggtctttaaagaattcaattttaacctaggggaaatgaataaaagtaatatgaagacagactag

SEQ ID NO: 197463 - DNA, 480 bp, Artificial Sequence
  Description of Artificial Sequence: Synthetic coding sequence
atgctgctgctgctgatcttctggatcgcccccgcccacggccccacaaacattatggtctatatctctatatgttccctattaggttcctttactgtaccatctactaagggcatcgggcttgcggcgcaggacatactgcacaataatccctccagtcagcgagcactctgtttatgcctggttctgctagcagtcctgggatgtagtattattgtccagtttaggtatatcaacaaagctcttgaatgctttgattcatcagtcttcggagctatttactatgtggtgttcactacccttgtgctgctcgctagtgccatcctgttcagggagtggagcaatgttggacttgtggactttctggggatggcctgcggatttaccaccgtctcagtgggaattgtgcttatacaggtgttcaaggaattcaatttcaatctgggtgaaatgaacaaaagtaacatgaagactgactag

SEQ ID NO: 197464 - DNA, 765 bp, Artificial Sequence
  Description of Artificial Sequence: Synthetic coding sequence
atggccgtgggccagatcggcaacttcctggcctacaccgccgtgcctaccgtgcttgtgacgcccctaggcgccctcggagtgccctttgggtcgatcctggcttcatatttgctgaaggagaaactaaacattctgggaaagctaggttgtctcctgtcctgtgcggggtcggttgtcctgattatccactccccaaagagtgaaagcgtaactacccaggcggagctggaagaaaaactgacaaatcctgtttttgttggctatctctgtatagttctgctaatgcttctgctcttaatcttctggattgccccggcacacggccctacaaacatcatggtctacatcagcatctgctcgctgttgggatcatttacagtcccctcgaccaaaggaatcgggctggcagcgcaggatatcctccataacaatccgtcctcacagagggcgctgtgtctgtgcctcgttctactggctgttttgggctgctccattatcgtgcagttcaggtatatcaacaaagctctggagtgctttgactccagcgtctttggcgccatctattacgtggtatttaccaccttggtgctgcttgcaagtgcaattctgttccgggagtggagcaatgtagggctcgtggactttcttggtatggcgtgcggctttacaacagtttctgtaggaatcgtgttaatacaggtgttcaaagagtttaactttaacttgggggagatgaataagtcaaatatgaaaacggactag

SEQ ID NO: 197465 - DNA, 1083 bp, Artificial Sequence
  Description of Artificial Sequence: Synthetic coding sequence
atgagccagggccggggcaagtacgacttctacatcggcctgggcttggcaatgagctcttctatcttcatcggagggagttttatcctcaaaaagaaaggtttgctccggctcgctaggaaaggctcaatgagagcaggacagggtggtcacgcctacctgaaggaatggctctggtgggccggcctgctgtctatgggtgcaggtgaggtggcaaacttcgccgcctatgcgtttgccccagccactctggtaacacctctcggtgccttgagcgtcctggtgtccgctatcttaagctcgtacttccttaacgagagactgaatctccacggcaaaatagggtgtttacttagcatattgggcagcactgtgatggtcatccacgcccccaaagaggaggagattgagaccttgaacgagatgtcacacaaactgggcgaccctggctttgtggtgtttgccaccctggtcgtgatcgtggcgctgattttaatatttgttgttgggccccgacacggacagaccaatatactagtgtatattaccatctgcagtgtcataggagcttttagcgtgtcatgtgtcaagggcttggggattgccatcaaggagctatttgcaggcaaacccgtactgaggcatccactggcttggatactgctgctaagcctgattgtgtgtgtgagtacccagattaactacctgaacagagctctggacatttttaatacatctatcgtcacccccatctattatgtctttttcacgacttcagtgctgacgtgcagcgcaatattatttaaggagtggcaggacatgccagtcgatgatgtgattggcacactcagcggcttctttaccatcattgttggtattttcttgctccacgcatttaaggatgtgtcattttccttggcgtccctccccgtgagctttcgcaaagacgaaaaggccatgaatgggaacctgagtaacatgtatgaggtgctgaacaacaacgaggagtcgttgacttgcgggatcgagcagcatactggtgagaatgtgtccagaaggaatgggaacctgacagctttctag

SEQ ID NO: 197466 - DNA, 1026 bp, Artificial Sequence
  Description of Artificial Sequence: Synthetic coding sequence
atgagccagggccggggcaagtacgacttctacatcggcctgggcctagccatgtccagctcaatattcattggcggctcatttatactgaaaaaaaagggactgcttcggcttgccaggaaggggagcatgcgcgccgtcggggctggggaggtcgctaacttcgccgcatacgccttcgctcccgccactctggttaccccgctgggggccttgtcggtgctcgtcagcgccatcctgtcttcctacttccttaatgagcggctcaacctacacggcaaaataggctgtttgctgtctatcctggggtctaccgtgatggtcattcacgcacctaaggaggaggaaatcgagaccctcaatgaaatgtcccataagctaggggacccggggtttgtggtctttgctacgcttgtggttattgtggccttaattctgattttcgtagttgggcccagacatggccagaccaacattctcgtgtatattacgatttgctcagtgatcggcgcattttcggtaagttgcgtcaagggccttggtattgctatcaaagagctgttcgctgggaagccagtgctgcgccaccccctggcttggattctgctgctgagcctgatcgtctgtgtgagcacacagatcaactacctgaacagggcactggacattttcaatacctcaatcgtcacccccatctattacgttttttttacaacgtcggtgttgacatgttcagccatactctttaaggagtggcaggatatgccggtggacgacgtgataggtacgttgtctggcttctttacaattatagtcggaattttcttactccacgcattcaaagacgtgagctttagcctcgcgtccctgccagtgagcttccgcaaggatgagaaagctatgaacggaaacctgtcaaacatgtacgaagtcttgaacaacaacgaagaaagcttgacttgtggcattgagcagcacactggcgaaaatgtgagccgccgtaacgggaacctgaccgcattctag

SEQ ID NO: 197467 - DNA, 1083 bp, Artificial Sequence
  Description of Artificial Sequence: Synthetic coding sequence
atgagccagggccggggcaagtacgacttctacatcggcctgggcttagctatgtcatcgagtatcttcatcggaggcagttttatcctaaaaaagaaaggcctgctgaggcttgcccgaaaagggtccatgagggcagggcaaggcgggcatgcgtatctgaaggaatggctgtggtgggccggtctcctatccatgggggccggagaggttgcaaacttcgctgcttacgctttcgcccccgcgaccctagttacgcctttaggagccctgagcgtcctcgtctcagccatcctgtcctcttactttctcaacgaacgcctcaatcttcacggcaagattggttgtctgttaagtatattgggatccaccgtgatggtgatccacgcacctaaggaagaggagatcgagacactcaatgaaatgtcacacaagctgggcgatccaggctttgtggtcttcgcaaccctagttgttatcgtagcactgatcctcatctttgtagtaggcccacgacatgggcagacgaacatcctagtgtacatcaccatctgttcagtcattggtgcctttagtgtctcctgcgtgaaaggtctgggcatagcaattaaagagctgttcgcagggaagccggtattacggcacccactcgcctggattctgcttttgtcactcatcgtctgcgtgtccacccaaataaactatttaaaccgtgcgctagacatttttaacacttccattgtcaccccaatctattacgtcttctttacaacctccgtgttaacctgctccgcaatactcttcaaggagtggcaggacatgcccgtcgatgacgtgattggaactctatccggcttttttacaattattgtcggcatcttcctgttacacgcgttcaaagacgtgtcgttcagtctcgcctcactgcctgtaagcttccgcaaggacgaaaaggcaatgaatggaaacctgagcaatatgtatgaggtcctgaataacaatgaagaatcactcacatgtggcattgagcaacacaccggcgagaacgtgagccggagaaacggtaatctgacggccttttag

SEQ ID NO: 197468 - DNA, 1083 bp, Artificial Sequence
  Description of Artificial Sequence: Synthetic coding sequence
atgagccagggccggggcaagtacgacttctacatcggcctgggcctggcaatgtcgagctctatcttcatcggaggcagcttcatattaaaaaagaagggacttttgcggctggctcgtaagggttccatgcgtgccgggcagggaggccacgcctatttaaaagaatggctttggtgggccggtctgctgtcaatgggtgccggggaggttgcaaattttgccgcctacgcctttgcacccgcgaccctcgtcactccactcggggcactctccgtgctagtttctgctatattatccagctacttcctgaatgagcggttgaaccttcatggcaaaatcgggtgcctgctcagtatccttggctctacagtgatggttatccacgctccaaaggaagaagaaattgaaactcttaatgagatgtcccataaattaggtgatcctggatttgtcgtattcgctaccctggtggtgattgtcgctctgattcttatattcgtggtcggaccgaggcacggacagacaaatatccttgtgtacataactatctgctctgtgatcggagcgtttagtgtcagctgtgtgaagggcttaggcatcgcgataaaggagctcttcgctggtaaacctgtgctgcgacacccgctggcctggatcctcctcctgtcattaatagtctgtgtgagcacacagataaactacctgaaccgcgcgctggatatcttcaataccagcatcgtgacacccatatactacgtctttttcaccaccagtgtgctcacctgttcagccatattgtttaaagaatggcaagatatgcctgtggatgatgttataggcactctttccggattcttcacaatcattgtgggcatttttctgcttcacgcatttaaagacgtttctttctcgttagcgtctctgcccgtctctttcaggaaagatgagaaggctatgaatggcaatctgtcaaacatgtacgaggtactcaataacaatgaagagtccctcacatgcgggatcgaacagcacacaggcgagaacgtctcccgcaggaatggtaacctcacagcattctag

SEQ ID NO: 197469 - DNA, 1026 bp, Artificial Sequence
  Description of Artificial Sequence: Synthetic coding sequence
atgagccagggccggggcaagtacgacttctacatcggcctgggcctcgcaatgagcagctcaatctttatcggcgggtcctttattctgaagaagaaggggttgctccggttggcgaggaaaggatctatgcgtgccgttggcgctggggaagtggccaacttcgccgcctatgcctttgctcctgctacactcgtcacgccattgggtgccctctcagttctcgtttctgccatcttatcttcatacttcctgaatgaaagactgaacctacacggaaaaattggatgcctgctgagcattctggggtccacagtcatggttattcatgctcctaaagaagaggaaatcgagacactcaacgaaatgagtcacaaactaggtgatcccggttttgtcgtctttgcaaccctggttgtgattgttgctctgattctgatctttgtggtgggacctcgccacggccagacaaatatacttgtgtacatcactatatgcagcgttatcggcgcattttccgtctcctgtgtgaagggcctgggcatcgcaattaaggagctctttgccggcaagccagtgctgcggcacccccttgcatggatccttcttctgagcttgattgtttgcgtaagtacccaaattaactatctgaacagggctctggatattttcaatacaagtatcgtgacacccatttattacgtcttcttcacaactagcgtgctgacatgcagcgccatcctgtttaaggaatggcaggatatgcccgttgacgacgtgatcggaacactgtctggcttttttacgatcatcgttggcatattcctgctccacgccttcaaggacgtatcctttagtcttgcttccctgcccgtgagcttccgcaaggatgaaaaggccatgaacggaaatctatccaatatgtatgaagtcctgaataataacgaagagagcctgacatgtgggatagagcaacatacgggggagaacgtcagcagacgaaacggaaacctgaccgctttctag

SEQ ID NO: 197470 - DNA, 180 bp, Artificial Sequence
  Description of Artificial Sequence: Synthetic coding sequence
atgagccagggccggggcaagtacgacttctacatcggcctgggcctggccatgtcaagtagcatctttatcggtggctcctttattttgaagaagaagggattactgcggctggcgcggaaaggctccatgagggccggccaaggagggcatgcctacctcaaggagtggctttggtag

SEQ ID NO: 197471 - DNA, 900 bp, Artificial Sequence
  Description of Artificial Sequence: Synthetic coding sequence
atggaggagctggagcagggcctgctgatgcagccctgggcctggctacagctggcagagaacagcttactcgccaaagtgttcattacgaaacaggggtatgctctgcttgtgtccgatttacaacaggtgtggcatgagcaagtcgataccagcgttgtgagccaacgtgccaaagaattgaataagagactgacggccccacccgcagccttcctttgtcacctagacaatttattacgacctttactgaaggatgctgcccatccctctgaggccaccttcagctgtgactgtgtggccgacgccctgatactgagggtgcgatcagaactgtctggactccctttctattggaacttccattgtatgctggcttctccctctttagtgagtcagcaccttattcgcccactgatggggatgagtctggcactgcagtgtcaggtgagagagctggcaaccctgctacatatgaaagatttagagatccaggactaccaggaatctggtgcgaccctgattagagatcgcctcaagacggaaccgtttgaagagaatagctttctggagcagtttatgattgaaaaactgcccgaggcatgctcgattggcgacggcaagccctttgtcatgaacctccaagatctgtacatggccgtgactacgcaagaggttcaggttgggcagaaacatcagggtgctggggatccccatacttctaacagcgccagtctacaggggatcgactcccagtgtgtgaaccagcccgagcagctagtgtcctccgcacccacactctccgcgcccgagaaggagtccaccggaacaagtggtcctctccaacgcccacagctgagcaaggttaaaaggaagaagccccgtggtcttttttcatag

SEQ ID NO: 197472 - DNA, 951 bp, Artificial Sequence
  Description of Artificial Sequence: Synthetic coding sequence
atggaggagctggagcagggcctgctgatgcagccctgggcctggctgcaattggctgaaaatagtttactggctaaagtttttattacaaagcaagggtacgctctgctggtaagcgacctgcagcaggtgtggcatgagcaggttgatacctctgtggtgtcccaacgtgccaaggaactcaataagcgcttgaccgcacctccagccgcatttttatgtcatttagataaccttctgcggcctttgctgaaagacgctgcacacccatctgaggccacattctcctgcgactgtgtggccgacgctttgattctccgggtgaggtccgaactctccggacttccattttactggaacttccattgcatgctcgcttcgccaagcttagtttcccaacacctgatcagacccctaatgggcatgtcccttgcattacaatgccaggtgagggagctcgccacactgttgcacatgaaagatctcgaaatacaggactaccaggaaagcggcgcaaccctgataagagacaggttgaaaaccgagccatttgaggaaaattcctttctggagcagttcatgatcgagaaattgcctgaggcctgttctattggggacggcaagccctttgttatgaaccttcaggacctgtacatggcagtgacaacacaggaagtccaagtcgggcagaagcatcagggtgccggtgatccacacacatctaatagcgccagcctgcaagggatcgatagtcagtgcgttaatcagcctgagcaactcgtgagctctgcccctacactgagcgcacccgagaaagagtcaaccgcactgtgtagggatttatcgtgccagagatcacggggaaggtcccagggtgtcagttccgtcaatttgctctggccacagctgttacgaatggatcttgaaaactcctttcaggccagtccatag

SEQ ID NO: 197473 - DNA, 690 bp, Artificial Sequence
  Description of Artificial Sequence: Synthetic coding sequence
atggaggagctggagcagggcctgctgatgcagccctgggcctggctccagctggccgagaacagcctgttagctaaggtttttattaccaaacagggctacgcattattggtgtcagacttgcagcaggtctggcacgagcaggttgacacttcagtggttagtcagagggccaaagagttgaataagcgcctgaccgctcctcccgctgcctttctgtgccatctggataacttgctgaggcctcttttaaaggacgctgcacacccctctgaggccacctttagctgtgactgcgtagcagacgctctgattctacgggtccgtagtgagcttagtggcctgccattttactggaacttccactgtatgcttgcctctccgtcactggtgtctcagcatctcatccggcccctaatgggcatgagtcttgcactccagtgccaggtcagggagttggccacactcctgcacatgaaggaccttgaaatccaagattatcaagaaagcggagcaactctcatccgggacagactcaagaccgaaccctttgaggaaaatagctttctggagcagtttatgattgaaaagctcccggaggcctgcagtattggggacgggaagccttttgttatgaacctgcaggatctgtatatggctgtgactacccaggaagtccaagtgggctag

SEQ ID NO: 197474 - DNA, 804 bp, Artificial Sequence
  Description of Artificial Sequence: Synthetic coding sequence
atggccaactgcgagcggaccttcatcgccatcaagcccgacggcgtgcagagaggcctcgtcggagaaatcattaagcggtttgagcagaaaggatttagactcgtcggccttaagtttatgcaggcttccgaggatctgctgaaagagcactacgtcgatttaaaggaccgccccttcttcgccggcctcgttaagtatatgcattccggccctgtcgtggccatggtgtgggagggccttaacgttgtcaaaactggcagagtgatgctgggagaaacaaatccagccgacagtaagcccggcaccatccgtggtgatttttgcattcaggtaggacgaactatggcaaatctcgagcgcacattcattgccatcaaacctgacggcgtccagcggggtctggtaggggagataattaaacggttcgagcaaaaaggattccgactggtcgctatgaaattcttacgcgcatcagaggagcacctgaaacagcactacatcgatttgaaagacagaccgttctttcccggcttagtgaagtacatgaactccggaccagtcgttgctatggtgtgggagggacttaacgtggtcaagacaggcagagtgatgcttggcgagaccaacccggccgacagtaaacctggcactatccgaggagacttctgtattcaagtggggaggaacataattcatggaagcgacagcgtgaagtcagctgaaaaagaaatttctctgtggttcaaacctgaagaactggttgactacaaatcatgcgctcacgattgggtctacgaatag

SEQ ID NO: 197475 - DNA, 234 bp, Artificial Sequence
  Description of Artificial Sequence: Synthetic coding sequence
atggtgtgggagggcctgaacgtggtgaagaccggccgggtgatgctgggggagacaaacccggccgatagtaagcccggtactatccggggcgatttctgcattcaggtgggaagaaacattatccacggcagcgactccgtgaaaagtgctgaaaaggagatatccctgtggttcaaaccagaagaactggtcgattacaaatcttgtgcacacgactgggtttatgaatag

SEQ ID NO: 197476 - DNA, 234 bp, Artificial Sequence
  Description of Artificial Sequence: Synthetic coding sequence
atggtgtgggagggcctgaacgtggtgaagaccggccgggtgatgctgggggagactaacccagcggacagcaagccaggcacaattaggggcgatttttgtattcaggtcggtcgcaacattatacacggctccgactcagtgaaatccgccgagaaggagatctcactttggttcaagcccgaggaactggtcgactataagagttgcgctcacgattgggtatacgaatag

SEQ ID NO: 197477 - DNA, 459 bp, Artificial Sequence
  Description of Artificial Sequence: Synthetic coding sequence
atggccaacctggagcggaccttcatcgccatcaagcccgacggcgtacaaaggggccttgtgggtgagattatcaagcggttcgaacagaaaggtttccggttagtagctatgaagtttctgcgggcgagtgaggagcacctcaagcagcactatatcgaccttaaggatagacctttctttcccggtcttgtgaaatatatgaactctgggcccgtcgttgcaatggtgtgggaagggcttaacgtggtgaaaacaggccgggtgatgcttggagaaacgaatccggcggattccaaacccgggaccatccgaggtgatttctgtatccaggttggtaggaatatcatacatgggagtgactccgtgaagagtgctgagaaggaaatttctttatggtttaaacccgaggaattagttgactacaaatcttgtgcccacgactgggtgtacgagtag

SEQ ID NO: 197478 - DNA, 459 bp, Artificial Sequence
  Description of Artificial Sequence: Synthetic coding sequence
atggccaacctggagcggaccttcatcgccatcaagcccgacggcgtgcaaagggggttagttggagagataattaagcggttcgagcagaagggatttcgactggtcgccatgaagttcctgagagcctccgaggaacacctgaaacagcactacatcgaccttaaggaccgcccatttttcccggggcttgtgaagtacatgaattcgggtccagtcgttgccatggtctgggagggactgaacgtagtgaagacaggcagagttatgctgggggaaactaatcccgccgattcaaaacctggaaccatccggggcgatttctgtatccaagtaggacgcaacatcattcacggcagcgatagtgtgaaaagcgcggagaaagagatcagtttatggtttaaacccgaggaacttgtggactacaagtcctgtgcacacgactgggtctacgagtag

SEQ ID NO: 197479 - DNA, 459 bp, Artificial Sequence
  Description of Artificial Sequence: Synthetic coding sequence
atggccaacctggagcggaccttcatcgccatcaagcccgacggcgtacagagggggctcgtcggggagatcatcaagcgctttgagcagaaaggattcaggttggtagctatgaaatttttacgagcaagcgaggaacaccttaaacaacactatatcgatctaaaagacaggcccttttttcccggtttagtcaagtatatgaattctggcccagtggttgccatggtatgggaaggactaaatgtggtcaaaacaggaagagtgatgctgggggagaccaatcctgctgactccaaacccggaacgattagaggcgacttctgtatccaagtgggacgcaacattatccatggctccgattcagtcaaatccgccgaaaaagagatctctttatggttcaaacccgaagagctagttgactacaagtcctgcgcacacgactgggtctatgaatag

SEQ ID NO: 197480 - DNA, 459 bp, Artificial Sequence
  Description of Artificial Sequence: Synthetic coding sequence
atggccaacctggagcggaccttcatcgccatcaagcccgacggcgtgcagcggggattggttggcgagatcattaagcgcttcgaacagaaaggtttcagactggttgctatgaagtttctgagggcatcagaggaacacttgaaacagcattatatcgatcttaaggaccggccattctttcctgggcttgtcaaatatatgaactcagggcctgtcgttgctatggtgtgggaagggcttaacgtggtgaaaacagggcgggtaatgctgggggaaaccaaccccgccgactcgaaaccaggcactattagaggtgatttttgcatccaggtggggcggaacatcattcacggttcagacagcgtgaagtccgcagagaaagagatttccctttggtttaagccagaggagctagtggattacaaaagctgtgctcacgactgggtgtacgaatag

SEQ ID NO: 197481 - DNA, 459 bp, Artificial Sequence
  Description of Artificial Sequence: Synthetic coding sequence
atggccaacctggagcggaccttcatcgccatcaagcccgacggcgtccagcgggggttagtgggcgaaattattaaaagattcgaacaaaaggggttccggttggttgcgatgaagttcctcagggccagtgaggagcatctgaagcagcactatatcgacctgaaggacagaccgttctttccgggcctagtaaagtacatgaacagcggtccagtcgtcgcgatggtatgggaagggctgaatgtcgtgaagactggccgtgtgatgctgggtgagacgaatccagccgatagtaaacctgggacaatccgcggcgacttctgcatccaagtaggccggaacattatccacggtagcgattctgttaaaagtgccgaaaaagagatctccttgtggttcaagcccgaagagctggtggactataagtcatgtgcgcatgactgggtgtacgagtag

SEQ ID NO: 197482 - DNA, 879 bp, Artificial Sequence
  Description of Artificial Sequence: Synthetic coding sequence
atggtgctgctgagcaccctgggcatcgtgttccagggcgagggcccccccatttctagttgtgatacaggcacaatggctaactgcgagagaacgtttattgcgatcaagccggatggtgtgcagagagggctggtgggggagatcattaagagatttgagcaaaaaggatttagattggtagggctgaagtttatgcaagcctctgaggatcttctcaaggaacactatgtggatttaaaggatcgtccattcttcgcaggccttgtgaagtacatgcatagcgggccagtcgtggctatggtttgggaaggcctcaatgtggtcaaaaccggaagggtaatgttaggagaaaccaatcctgcggactcaaaaccaggcacgatacgcggagatttttgtatccaagtgggcaggacaatggctaatctcgagcggacattcatcgcgattaagccagatggggttcagagagggctggttggagaaattataaaacgtttcgagcagaagggctttcgcctcgtggccatgaagtttctgagggcctccgaagagcatctgaaacaacactacatcgatcttaaggatagaccattctttcccgggcttgttaaatacatgaactccggcccagtagtcgcaatggtgtgggaaggcttaaacgtggtgaagactggacgggtcatgttgggtgaaaccaatcccgccgacagcaagccaggcactatcaggggtgacttttgtatacaggtcgggcggaacatcattcatggcagcgacagcgtaaaaagtgccgagaaggaaatcagtctgtggttcaagccggaagaattagtagattacaagtcttgcgcacacgattgggtttatgaatag

SEQ ID NO: 197483 - DNA, 1188 bp, Artificial Sequence
  Description of Artificial Sequence: Synthetic coding sequence
atggtgagcgccgccggcctgagcggcgacggcaagatgcggggcgtgctgctcgtgctgctgggactgttgtacagcagcaccagttgcggggtgcagaaggcaagtgtcttctatgggccagatccaaaggaggggctggtatcatctatggaatttccatgggtggtgtctctacaggattcccagtatacccatctggccttcggctgtattctttccgaattctgggtgctgagtattgcatccgctattcagaatcgaaaggacatcgtcgttatcgtgggcatttccaacatggatcccagcaagatcgcacacactgagtaccctgtcaataccattataattcatgaagactttgacaacaattccatgagcaacaacattgccctcctgaagactgacaccgccatgcattttggcaatctggttcaatctatatgcttcctgggccgcatgctgcacaccccccccgtgttgcagaactgctgggtgtctggctggaaccccaccagcgccactggtaatcacatgactatgtctgttctccgcaagattttcgtaaaagacctggacatgtgccctctgtataaactgcagaaaacggaatgtggttcccatacgaaggaggagaccaaaactgcctgcttgggggaccccggatccccaatgatgtgccagctccagcagttcgatctgtgggtgctgaggggcgtcctgaactttggtggggaaacatgtcccggcctgtttctctacaccaaagtcgaagattacagtaaatggattactagtaaagctgaacgagcgggacctcccctgtcaagtctgcatcactgggaaaaactcatatcgttttcgcatcatggcccaaatgcaaccatgacacagaaaacatattctgatagcgaactgggtcatgttggaagctatctccagggccagaggaggactattacccattccagacttgggaatagctctagagacagcctggatgtgcgcgaaaaagacgtgaaggagagtgggagatctccagaggcctcagtgcagcccctttattacgactattatggcggagaggtgggcgagggtcgcattttcgctggacaaaataggctatatcagcccgaggagatcattctcgtctcattcgtgctggtatttttttgctcttcaatttag

SEQ ID NO: 197484 - DNA, 639 bp, Artificial Sequence
  Description of Artificial Sequence: Synthetic coding sequence
atggagatcagcatgccccccccccagatctacgtggagaagaccctggcaatcataaagcccgatatcgtcgacaaagaggaggagatccaggacattattctcaggtcaggctttacgattgtgcagagacgtaagttgcgcctgtccccagagcagtgctcgaacttctacgtggagaagtatggaaaaatgttctttccaaatctcaccgcctatatgtcttccggccccctggtcgccatgatcttggcccggcataaggccatttcctactggctggaattgctggggccgaacaacagtctggtcgccaaggaaactcatccagactccctgcgtgctatttacgggacagacgatctgagaaatgccttgcacggttcgaatgatttcgctgcggcggagagagagataagattcatgtttccagaggtgatcgttgaaccaataccaattgggcaggccgcaaaggactatcttaaccttcatatcatgcccactttgctcgagggactgaccgagctgtgtaaacaaaaacccgcagacccgctgatctggctcgccgactggctgctgaaaaacaaccctaataaacctaagttgtgccaccatcctattgttgaggagccgtactag

SEQ ID NO: 197485 - DNA, 561 bp, Artificial Sequence
  Description of Artificial Sequence: Synthetic coding sequence
atggccagcatcctgcggagcccccaggccctgcagctgaccctggcactcatcaaacccgacgctgtcgcacaccccctgatcctagaagcagtacaccagcagatcctctccaataaattccttatcgtgagaatgcgggagctcctatggcggaaggaggattgccagcgtttctatagggagcacgaggggcgtttcttttatcagcggctggttgagttcatggccagtggccctattagagcatatattctggcacacaaggatgctatccagctatggcggacactcatgggcccaacaagggttttccgcgcccgacatgtggccccagactcgattcgaggatcattcggtcttactgacacccgtaatacgactcacggcagtgacagcgttgtgagtgcgtctcgcgaaatcgcagcgttctttcccgacttcagtgaacagagatggtatgaggaggaagaaccccagctccggtgcggccccgtttgctactccccggaggggggggtgcattatgtggcgggcacaggcgggctcggccccgcgtag

SEQ ID NO: 197486 - DNA, 585 bp, Artificial Sequence
  Description of Artificial Sequence: Synthetic coding sequence
atgacccagaacctgggcagcgagatggccagcatcctgcggagcccacaggccttgcagcttacactcgcactgattaaacccgacgcagtagctcacccgcttatactggaagcggtgcaccaacagatcctgtctaacaaattcctgatcgtccgaatgcgagagctcctatggagaaaagaagattgccagcgcttctaccgggagcatgagggccggttcttttaccagagattggttgagttcatggcctccggcccaattagggcatatatccttgcacacaaggatgcgatccaactctggcgaactctcatggggccaactcgggtcttcagagccaggcacgtagctcccgacagtatcagaggaagcttcggcctcaccgacacaaggaatacaacccacgggtccgacagcgtcgtgtccgccagcagggaaattgcagccttctttcctgacttttctgagcaacggtggtacgaggaagaagagccacagctcaggtgtggtccagtgtgttactcacccgaaggcggagtgcactatgtggccggtactggcgggttgggtcctgcctag

SEQ ID NO: 197487 - DNA, 561 bp, Artificial Sequence
  Description of Artificial Sequence: Synthetic coding sequence
atggccagcatcctgcggagcccccaggccctgcagctgaccctggcgctgatcaagcctgacgccgtggcgcacccactcatactggaggcagtccaccaacagattctttccaataagtttctaatagtgcgtatgcgggagctgctttggcggaaggaggattgccagcgattctatcgcgaacatgagggccgattcttctatcagcgcctagtcgagtttatggcgtcagggccaatacgagcttacattctggctcacaaggatgctattcaactctggcggactctgatgggaccaacccgagtattccgcgcacgtcatgtggcccccgattcaatccgtggatcctttggcctgaccgatacacgaaataccacgcacggttccgactccgttgtcagcgcctctcgcgagattgctgcgttttttccagatttcagcgaacaacgttggtatgaggaagaggaacctcagttgcgctgtggtcccgtgtgctatagtcccgaaggtggggtccattacgtggctggcaccggggggttggggccagcctag

SEQ ID NO: 197488 - DNA, 360 bp, Artificial Sequence
  Description of Artificial Sequence: Synthetic coding sequence
atggccagcatcctgcggagcccccaggccctgcagctgaccctggctctcatcaagcccgacgcggtagctcaccctctcatactggaggcagtgcaccagcagatcctttctaataagtttttaatagtgaggatgcgggaactgttgtggaggaaagaggactgtcagcgattctatcgggaacacgaggactccgtggtgtctgctagcagagagattgccgcctttttcccagacttctcagaacagcgctggtatgaagaggaagaacctcaacttaggtgtggtccagtctgttacagcccagagggcggagtccattatgtggccggcaccggagggcttggacctgcttag

SEQ ID NO: 197489 - DNA, 561 bp, Artificial Sequence
  Description of Artificial Sequence: Synthetic coding sequence
atggccagcatcctgcggagcccccaggccctgcagctgaccctggccctcataaaacctgacgctgtggcacaccctcttatcctcgaggccgtccaccagcaaatcctgtccaataagtttctgatcgttcgcatgagggaactcctgtggagaaaagaggactgtcaaagattctatagggaacacgaggggaggttcttttatcagcgcctcgtggaatttatggcgtcaggtcctatccgagcctatatcctggcccataaggacgccatccagctttggcgcactctgatgggtccaactcgcgtgttcagagcccgacacgttgcccctgattccatccggggtagtttcgggttaacagataccaggaacactactcacggtagtgactctgtagtgtcagcctccagggagatcgctgctttcttccctgatttttctgagcaaaggtggtacgaagaagaggaaccccagctgagatgcggtcctgtgtgctactctcctgagggaggagtccactatgtcgctggcactggcggcctgggccctgcctag

SEQ ID NO: 197490 - DNA, 492 bp, Artificial Sequence
  Description of Artificial Sequence: Synthetic coding sequence
atggccagcatcctgcggagcccccaggccctgcagctgaccctggccctgatcaaaccagacgccgtcgcccacccgctgattctggaagccgtgcaccagcagatactgtctaacaagttcctgatcgtccggatgagggaactgctctggaggaaggaggattgtcagcggttttatcgcgaacacgaagcaggccaatcagaaccaacctctctccccacccgcatgccttctagctcaggcgggaggagctgggatccccctgaatgctcagagcacgcaatgtggccacaaattttatctgtcggcgtgtcagccagcttgacccctgccacccccccaatggtgagaaccctgtggtttcaacctgcagagcgcctacagcctagcagcctaacgtctgtgaattccgccgggatgaggagaaaaagccccagctgtgccgtagcgctgtgcgccatcgcccagcgtgaggtgagcaccatgtag

SEQ ID NO: 197491 - DNA, 561 bp, Artificial Sequence
  Description of Artificial Sequence: Synthetic coding sequence
atggccagcatcctgcggagcccccaggccctgcagctgaccctggctcttataaaaccagatgccgttgcccatcccctgattttggaggcagtccaccagcagattctatccaacaaatttttgattgttcgcatgagagaactgctgtggcggaaggaagactgtcagagattctaccgagaacacgaaggacggttcttttaccagcgtctcgtcgagtttatggctagtggccccatccgggcctacatcctcgctcacaaagacgctattcagctctggaggaccctgatggggccgacacgagtgtttagggcccggcacgtcgcaccagactctattagggggtcattcggattgaccgacacccgcaacaccacccatggctctgactcagttgtgtccgccagcagagagattgccgcttttttccccgatttcagcgaacagagatggtacgaagaggaagaacctcagcttcgctgtggacctgtgtgctactcacccgaagggggtgtgcactatgtggctgggaccgggggcttgggccccgcctag

SEQ ID NO: 197492 - DNA, 1131 bp, Artificial Sequence
  Description of Artificial Sequence: Synthetic coding sequence
atgaaccacagcgagcggttcgtgttcatcgccgagtggtacgaccctaacgctagcctgctaaggcggtacgagctcttgttctacccaggggatggttctgtggagatgcacgacgtcaagaatcatcggacctttcttaaaagaacaaaatacgacaacttgcacctggaggatctcttcattggcaataaggtgaacgtgttttcccggcagctggtgcttatagattatggcgaccaatataccgcccgccagctgggcagcaggaaagaaaaaaccctggccctcattaagccggatgctatatctaaggctggagaaataatagaaattatcaacaaggcaggcttcactattaccaaacttaagatgatgatgctgtcacgcaaggaggccctggatttccatgtggaccatcagtctcgacccttcttcaatgaattaatacagttcatcaccacaggacccataatcgccatggaaatccttagagacgacgcgatttgcgaatggaaaaggctgttgggaccagcaaatagcggcgtggctcggaccgatgccagcgagtctatacgggctctgtttggaaccgatggcataagaaatgcggcccacggccctgactcattcgcatctgccgcccgcgaaatggaactgtttttcccttcttccggaggctgcggacccgctaacacagccaagttcaccaactgcacatgctgcatcgttaagccccatgctgtcagcgaaggattacttggcaagattttgatggctattcgggacgcaggctttgagatttccgccatgcaaatgtttaacatggacagagttaacgtggaggaattctacgaggtttacaagggggtggtgaccgagtatcacgacatggtcactgagatgtacagcggcccatgtgtggcaatggagatccagcagaacaatgcaacaaaaacgtttagggagttttgcggacccgctgacccagagattgctcgacacttgcgacccggtaccctgagggctattttcggaaagaccaaaatccaaaacgccgtccactgtaccgacctgccggaggacggacttctcgaggtccagtacttcttcaagattttggacaactag

SEQ ID NO: 197493 - DNA, 1023 bp, Artificial Sequence
  Description of Artificial Sequence: Synthetic coding sequence
atgcacgacgtgaagaaccaccggaccttcctgaagcggaccaagtatgataacctgcacctggaggacctgtttataggcaataaggtgaatgtgtttagtaggcagttagtgctcatcgattacggtgaccagtatacagcccgacagctcggctcgcgcaaggagaagacactggctctgatcaaacctgacgcaatatccaaggccggcgaaatcatcgaaatcatcaacaaagccggcttcacaatcacaaaactaaagatgatgatgctcagtcggaaggaggcgttggatttccacgttgaccaccagtcccggcctttcttcaacgagctgattcaattcataactacggggcctattattgctatggagatactacgtgatgatgccatctgcgaatggaaacggctgctgggcccggccaacagtggtgtcgcacgcacagacgcgtccgagtccatccgagccctgtttggtaccgacgggatacgaaatgccgctcacgggcctgattcattcgcgagtgcagcacgcgaaatggagttgttctttccaagcagcggtggttgtggccccgctaataccgccaagtttaccaactgtacttgttgcatcgtcaaaccccatgctgtcagcgaagggttactggggaaaatccttatggccataagggacgctgggtttgagatatctgccatgcaaatgtttaacatggatcgggtcaatgtagaagaattctacgaggtttacaaaggggtggtgacggagtatcatgacatggtgactgagatgtactctggcccatgtgtggccatggaaatccaacagaacaatgcgaccaagacctttcgagagttctgcggacctgctgaccccgagattgcaagacacctcaggcctggcactctgcgagctattttcggcaaaacaaagatccagaatgccgttcactgcacagacttgccagaagacggcctgctagaggtccagtacttcttcaagattctggacaattag

SEQ ID NO: 197494 - DNA, 1416 bp, Artificial Sequence
  Description of Artificial Sequence: Synthetic coding sequence
atgcagagcaacaagaccttcaacctggagaagcagaaccacaccccccgaaaacatcaccagcaccaccaccagcagcagcaccaccagcaacagcagcaacagccaccccccccaccaatccctgccaatggccagcaagcaagcagccagaacgaagggctgacaatcgatctaaagaactttcggaagccgggggagaaaacatttacacagaggtctcgactgtttgttggcaacctgccccccgatatcaccgaagaggagatgagaaagctgttcgagaagtatgggaaggccggcgaggtgttcatccacaaggacaaaggatttggcttcattaggctggaaacacggaccttggccgagatagcgaaggtggaattggataatatgcctctgcggggcaaacaactgagggtgcggtttgcctgccactccgcgtccttgacagtcagaaacctgccccagtacgtgagtaacgagctgctggaggaagcttttagcgttttcggccaagtggagagagctgtggttattgtggacgaccgcggacgcccttctgggaagggaattgtagagttctccggaaaacccgcagcaaggaaagctcttgacagatgcagcgaaggaagcttccttctgaccaccttccccaggccagtcacggtggagcccatggatcagctcgatgatgaagaagggctgccagagaaactggtaatcaaaaaccagcagttccataaggaacgggagcagcctccgcgattcgcccagccagggagcttcgagtacgagtacgctatgaggtggaaggccctgatcgaaatggaaaagcagcagcaagaccaggttgacaggaatatcaaggaagcacgtgaaaagcttgaaatggagatggaggcagcacggcacgagcaccaagtgatgctgatgcggcaggacctgatgcggcggcaggaggagctccggagaatggaggaactgcataatcaggaagtccagaaacggaagcaactggagctgagacaggaggaggagagacgccgtagagaggaggaaatgaggcgtcagcaagaagaaatgatgagaaggcagcaagaagggttcaaggggacttttcctgacgcacgagagcaggagatacgaatgggacagatggcgatgggaggagcgatgggcatcaacaatcggggggctatgcccccagcacccgtccctgccggaacgcctgccccacccgggcctgcaacaatgatgcctgacggcacactagggttaacacctcccaccaccgagaggttcggccaagccgctaccatggagggcatcggtgccatcggcggcacaccccccgcctttaaccgcgccgccccaggcgctgagtttgccccgaacaagagacggcgatattag

SEQ ID NO: 197495 - DNA, 1416 bp, Artificial Sequence
  Description of Artificial Sequence: Synthetic coding sequence
atgcagagcaacaagaccttcaacctggagaagcagaaccacaccccacgcaaacaccaccagcaccaccatcagcagcagcatcaccagcagcagcagcagcagcctccccctccccctattccggccaatggtcagcaggcttctagtcaaaatgagggtttgaccattgatctgaagaactttcggaagccgggagagaagacctttactcagcggtctcgactctttgtgggaaatcttcccccagacatcaccgaggaggaaatgagaaagctttttgagaaatatggcaaggcaggagaggtcttcattcataaagacaaaggtttcggctttatccggctggaaacacggactctagcggagatcgccaaagtagaattggataacatgccactgcgtggcaagcagctccgggtgagatttgcctgtcattcggcctctcttaccgtgcgcaacctgccccagtatgttagcaatgaactgctggaggaggcgttcagcgtcttcgggcaggtcgagcgggctgtcgtcattgttgacgataggggcagacctagcggaaagggcattgtggagttctctgggaagcccgcagcccgcaaagctctggataggtgttctgagggctcctttctccttaccaccttccctagaccagttaccgtggagccaatggatcaactggacgatgaggagggtctccccgagaaactggtgatcaaaaaccagcaattccacaaggagcgcgagcagcctccacgcttcgcgcagcccggttccttcgagtatgaatatgccatgagatggaaggctcttatcgaaatggagaaacagcaacaggatcaggtggaccgcaatatcaaggaggcaagggaaaaactggaaatggaaatggaggccgcacgtcatgagcatcaagtcatgcttatgcgccaggaccttatgcgcaggcaagaggaactgagacgaatggaggaactccataaccaagaggtacagaaacggaaacagctcgaactccgacaggaggaggagagaagacgccgggaagaggagatgcggcgacagcaggaggagatgatgcgccggcagcaggagggattcaaagggacattccctgacgcacgcgagcaagaaatacggatggggcaaatggccatgggcggggcaatgggcattaacaatcggggcgccatgcccccggcccctgtgcccgctggaacccccgccccacccggacctgcaacgatgatgcccgacgggacgctcggactgacgccacctactaccgaacggttcggccaggctgcaactatggaagggataggagcaattggcggcacgccacctgcattcaaccgagctgcaccgggcgctgaatttgcaccaaataagagaaggcggtattag

SEQ ID NO: 197496 - DNA, 1416 bp, Artificial Sequence
  Description of Artificial Sequence: Synthetic coding sequence
atgcagagcaacaagaccttcaacctggagaagcagaaccacaccccacggaagcaccatcagcatcatcaccaacaacagcaccatcaacaacaacagcagcagccaccacctccacctatccccgccaacgggcagcaggctagctctcagaatgagggtctgacaatcgacctgaaaaacttccggaagccaggcgaaaaaacattcacccagagaagcaggttgttcgtgggcaaccttcctccagacattacagaagaggaaatgcgcaaactgttcgagaaatatggcaaggcaggggaggtctttatacacaaggacaaaggtttcggcttcatccgtctggagacacgcacgctggccgaaatcgcgaaagtggaactggataatatgcccttgagggggaaacagctcagggtcagattcgcgtgccattcagccagcctgactgttcgtaacctgccgcaatatgtcagtaacgagctactggaagaagccttctccgtgttcggtcaggtggagagggcggtagtcattgtggacgatcgcggccggccatctggaaaaggaatcgtcgagttctctggaaagccagccgcacgcaaagcattagacagatgttcagagggaagtttcctactgaccacattcccgagacccgtcaccgtggaacctatggatcagttggacgatgaagagggcctccctgagaagctggttatcaagaaccagcagttccataaggagcgcgagcagccaccccgcttcgcccagcctggcagcttcgaatacgagtatgccatgcggtggaaagccctcatagaaatggagaagcagcaacaggaccaggtggataggaacataaaagaagcacgggagaaactggaaatggaaatggaggcagctcgacacgagcatcaggtgatgcttatgcgccaggatcttatgaggagacaggaggaattacggcggatggaggagcttcataaccaggaagtgcaaaaaagaaaacagctggagcttcgccaggaagaggaaaggagaaggcgggaggaggagatgagacggcagcaggaggagatgatgcgcaggcaacaagaaggcttcaaaggaacattcccagacgcccgcgaacaggagatccgtatgggacagatggccatgggcggcgccatggggattaacaaccggggcgctatgccgcctgcaccagtcccagccggtactccagcgcctcctggtccagccacaatgatgccagacggcactctgggcctaacaccccccacgactgagcggtttggacaggcagcgaccatggagggcattggtgctattggcggtacgcctccagcttttaatcgtgccgcaccgggcgctgagtttgcccccaataagcggcgaaggtactag

SEQ ID NO: 197497 - DNA, 747 bp, Artificial Sequence
  Description of Artificial Sequence: Synthetic coding sequence
atgcagagcaacaagaccttcaacctggagaagcagaaccacaccccacgcaagcaccatcagcatcaccaccagcaacagcatcaccaacaacagcaacagcagccacctccccctccaattcccgccaacggtcagcaggctagcagccagaacgagggtctgaccattgacctgaaaaatttccgtaagccaggggaaaaaacttttacgcagagaagccgactcttcgtgggcaacctcccacctgacatcactgaggaagagatgaggaagctgttcgagaaatatgggaaagctggtgaagtgttcatccataaggacaagggtttcggatttattcggctcgaaacacgcacactggcggaaatcgctaaggtggagctggataacatgcctcttcggggtaaacagctgcgcgttcggttcgcgtgtcactctgccagtctgaccgtgcgaaacctgccccaggaaagagagcagcccccacggttcgcccagcctgggtccttcgagtacgagtacgctatgaggtggaaagccctaattgagatggaaaaacagcagcaggatcaggtggaccgtaatattaaagaggccagagaaaagctggagatggagatggaggccgctcgacacgagcatcaggtgatgcttatgagacaggatctgatgcgccggcaggaggagctgcgaaggatggaagaactccataaccaggaggtgcagaagcggaaacaactgtag

SEQ ID NO: 197498 - DNA, 708 bp, Artificial Sequence
  Description of Artificial Sequence: Synthetic coding sequence
tgacccgacatcaccgaggaggagatgcggaagctgttcgagaagtatggtaaagctggcgaggtgtttatacataaggacaaaggcttcggatttattaggctagttgaaagggccgtggtgatcgtggacgaccgcggaaggccatccgggaagggaattgttgaattttccggcaagcccgcagccagaaaagcactggatcgctgttcggagggatcttttttactcaccaccttcccccgtccagtaacagtcgaaccaatggaccagctcgatgatgaagagggtctgcccgagaaactggtaattaagaaccaacagttccataaggaacgtgagcagccccctaggtttgcgcagcctggaagcttcgagtatgagtacgccatgcgttggaaagctctgatcgagatggagaagcaacagcaagaccaggtcgataggaatatcaaggaagcccgggaaaagctcgagatggagatggaggcagctcgccacgaacatcaggttatgttgatgagacaagaccttatgcgtcgccaggaagagcttcgaagaatggaggagttacacaaccaagaggtccagaagcgaaagcagctggagctgagacaggaagaggagaggagaaggagggaggaggagatgagaaggcagcaagaggaaatgatgcggcggcagcaggaaggtttcaagggcacctag

SEQ ID NO: 197499 - DNA, 375 bp, Artificial Sequence
  Description of Artificial Sequence: Synthetic coding sequence
atgcagagcaacaagaccttcaacctggagaagcagaaccacaccccccgtaagcatcaccaacatcatcaccaacagcagcaccatcagcaacagcagcagcagcctccaccccccccgatcccggccaatggtcagcaggccagtagtcagaatgaagggctcacaatagatctgaaaaacttcagaaaacccggtgaaaagaccttcacccagagatcaaggttattcgtggggaatctgccccctgatatcacagaagaagaaatgcggaagcttttcgagaaatatgggaaggagacaaggacactcgctgagatagcaaaggtggaattggataatatgcctttgaggggaaaacagctcagagtctag

SEQ ID NO: 197500 - DNA, 201 bp, Artificial Sequence
  Description of Artificial Sequence: Synthetic coding sequence
atgcagagcaacaagaccttcaacctggagaagcagaaccacacccccagaaagcatcatcagcatcaccaccagcagcagcatcaccagcaacagcagcagcagccacccccaccgccaatccccgccaacggccagcaggcttcctctcagaatgaagggctgaccattgatttaaaaaattttagaaagcccgggtag

SEQ ID NO: 197501 - DNA, 624 bp, Artificial Sequence
  Description of Artificial Sequence: Synthetic coding sequence
atgcagagcaacaagaccttcaacctggagaagcagaaccacaccccccgtaagcaccatcaacatcaccatcaacagcagcaccaccagcagcagcagcagcagcccccccccccgccaatccccgctaacgggcagcaagcttcaagtcagaacgagggtttgacaatcgacttgaaaaatttcagaaagcctggagagaagacctttactcagagaagtcggctgtttgtcgggaacctgcctcccgacataacagaagaggaaatgaggaagttgtttgagaaatacggcaaagccggtgaggtgttcattcataaggataaaggcttcgggtttattaggttggagacacgaacactggcagaaatcgctaaggttgaactggataatatgccactgcgcggcaaacagttaagagttcgattcgcctgtcactctgctagtcttaccgttcgcaatcttccacaatacgtgtctaatgagctcttggaagaggctttttcagtgttcggccaggttgaaagggccgtggtcatcgttgatgatcgagggcgtcccagcggaaagggcatcgtggagttcagtggcaagccagcggcccgcaaagctttagatagatag

SEQ ID NO: 197502 - DNA, 1149 bp, Artificial Sequence
  Description of Artificial Sequence: Synthetic coding sequence
atgcggaagctgttcgagaagtacggcaaggccggcgaggtgttcattcataaggacaagggttttggctttattcgactcgaaaccagaaccttggcagagatagcaaaagttgagcttgataacatgcccctgcgaggcaagcagttaagggtgcgcttcgcctgccactccgcctccttgaccgtgaggaatctgccccagtacgtaagcaacgagctgctggaagaagctttcagtgtattcggtcaggtggagcgagccgtagttatcgtagatgatagaggtaggccgtctggaaaaggaatcgtggagttttcaggaaagcccgccgctcgtaaagcactggaccgctgctccgagggcagctttcttcttacaaccttcccccgcccagtgacagttgagccaatggaccagctggacgatgaggagggtttgcccgagaagctcgtcatcaaaaatcagcaatttcataaagagcgcgagcagccacccagatttgctcagcccggttcattcgagtatgagtacgccatgcggtggaaggctctcatcgagatggaaaagcagcaacaggatcaggtcgacagaaatattaaggaggcccgtgagaagctcgagatggagatggaggcggcgcgccatgaacaccaggtgatgctgatgagacaggacttaatgcgaaggcaggaggaactccggcgtatggaggagttgcacaaccaggaagtacagaagaggaaacagctcgaattacgacaagaagaggagagacgacggagagaagaggagatgaggcggcagcaggaggaaatgatgcgacggcagcaggaaggcttcaaaggcacatttccggatgccagagaacaagagatccgtatggggcagatggccatgggcggcgctatgggaataaataaccgcggcgctatgccccccgcacccgtgcccgctgggacacctgctcccccaggccctgccacgatgatgcccgatggcactcttggcttgactcctcctacaacggaacgttttggtcaggccgcaactatggagggtatcggagcaataggtgggactcctcccgcattcaatcgcgcagcacccggagcagagtttgcacctaataagcggagacgatactag

SEQ ID NO: 197503 - DNA, 3048 bp, Artificial Sequence
  Description of Artificial Sequence: Synthetic coding sequence
atgggcgccgagcggcggctgctgagcatcaaggaggccttccggctggcacaacaacctcatcaaaaccaagcaaaacttgtggttgctctgtcaaggacctaccggactatggacgataagactgtgttccacgaagaatttattcattatctgaagtacgtgatggtggtgtacaaacgtgagcctgccgtggagcgcgtaatcgaatttgccgctaaatttgtcaccagttttcatcagagcgatatggaagacgacgaggaagaggaggatggcggattacttaactatcttttcacctttttgctgaagtcccatgaggctaattccaacgctgtgcgttttagagtgtgccttctgatcaataagttgctgggtagtatgccagagaatgcccagattgatgatgatgtctttgataaaattaacaaggcaatgctgattcggctcaaagacaagattcctaacgtgcgcattcaagcagtgctagctctgtcgagactgcaagatccaaaggacgatgaatgtccagttgtgaacgcctatgcaaccctgatcgaaaacgacagcaatcccgaagtgaggcgtgctgtcctgtcctgtatcgccccctctgccaaaaccctccctaaaatagtggggagaacaaaggacgtgaaggaagccgtcaggaaacttgcctatcaggttctagccgagaaagtgcatatgcgggccatgtccattgcccaacgggtgatgctactgcagcagggcctcaatgaccggagcgatgccgtgaagcaggcaatgcaaaaacacctgctgcaaggatggctacgttttagcgaaggtaatatcctggagctgcttcataggttagacgttgaaaattccagtgaagtggccgtgtccgtgcttaacgcccttttttcaattacccctctttctgaactggtggggctttgtaagaataatgatggccggaaactcatccctgtcgagactctcacacctgagatcgcgctgtactggtgtgccctgtgtgagtatttaaaaagtaagggagacgaaggtgaagagtttctggaacagatactccccgaacctgtcgtgtatgcagactatctcctatcatacattcagagtataccagtcgttaacgaggagcatcggggagatttttcgtatatcggaaatctcatgacaaaagaatttattggccaacagctcatcctgattatcaagagcctcgacacctctgaggagggaggccgcaaaaaactcctggccgtgctacaagaaattctgatcctcccgactattcccatatctttggtctccttcctggtggaacggctgctgcatatcatcatcgacgacaacaagaggacacagatcgtgactgagatcatttcggagattcgggcacctatcgttactgtcggcgttaacaacgatccagctgacgtgagaaagaaagaacttaagatggctgaaataaaagtcaagttgatcgaagccaaagaggcactggagaactgtattacactgcaggatttcaaccgcgcctccgaattgaaagaggaaataaaggctctggaagacgctcggatcaatctgctcaaggaaaccgagcagcttgagatcaaggaggttcacatcgagaagaacgacgcggagacactgcagaagtgtcttattctctgttatgaactcctgaagcaaatgtccattagcactggattaagtgcaactatgaacgggatcattgaatcattgatcctacccggcattatttcaatccaccctgtcgtgcggaacctggctgtgctttgcctcggatgttgcggccttcaaaatcaagatttcgcacggaaacactttgtgctcctcctgcaagtgctgcaaatcgacgatgttactattaaaatctccgctcttaaagccatcttcgaccaattgatgacatttggcattgaaccttttaagactaagaagataaagacgctccattgcgagggaactgaaattaatagcgacgatgagcaggaaagtaaagaggttgaggagacggccacggctaagaatgtcctgaagctactgagcgactttctggactccgaggtttcagagttgcggactggtgcagccgagggtctggcgaagctgatgttcagcggccttttggtgtcatccagaattctctcacggctcatcttgctctggtacaaccccgtgacagaagaggacgtgcagctccggcattgtttgggcgtgttcttccccgtgttcgcttatgccagcaggaccaatcaagagtgctttgaggaagcatttctgccaacccttcagaccttggccaacgcccccgcctcatctccactagcagaaattgacattacaaatgtggctgagttgttagtcgacctgacaaggccttccggcttgaacccccaagctaaaacctcacaagactaccaggcccttaccgtgcacgacaacctagccatgaaaatttgtaatgagatactgacttctccttgtagccccgaaattagggtgtatactaaggcgctgtcctccctcgagttgagtagtcatttggccaaagaccttctagttctcctgaacgagatcctcgagcaggtaaaagaccggacatgcctgcgtgcactggagaaaattaagattcaattggagaaagggaataaggagtttggcgaccaggctgaggccgctcaggacgcaacattgacaacaaccacctttcagaatgaggatgagaaaaacaaggaagtgtacatgaccccactgaggggcgtgaaagccactcaagccagcaagtccacccaactgaaaacaaaccgcgggcaaagaaaagtcaccgttagtgcccgcaccaatcgccggtgccagacggcagaggcagatagtgagtccgaccacgaggtgcctgagcccgagtccgagatgaagatgaggttacctagaagggccaagaccgcagcgctggagaaatctaaactgaacttggcacagtttctcaatgaggacctttcttag

SEQ ID NO: 197504 - DNA, 951 bp, Artificial Sequence
  Description of Artificial Sequence: Synthetic coding sequence
atgagcggcgacagcagcggccggggccccgagggccggggccggggtagggacccacaccgggacaggacacgctcaagaagccgatctaggtctccattgtcgcctagaagccgcaggggcagcgcgcgagaaagacgggaggcccccgaacgccccagcctggaagacactgaaccctctgatagcggggatgagatgatggatcccgcctcccttgaagcggaagccgatcagggcctatgccgccagattagacatcaataccgcgctctaataaattctgtccagcaaaaccgagaggatattcttaatgcgggcgacaaactgactgaggtccttgaggaggccaatacgctatttaacgaagtcagccgggccagggaagccgtcctcgacgcccactttctcgtccttgcttccgatctcgggaaagaaaaagccaagcagctgagaagcgacctgtcatctttcgatatgttaaggtatgtggagacactcctcacgcacatgggcgtcaaccccctggaggccgaggaattaataagagacgaggacagcccagattttgaattcatagtatatgacagctggaagattacggggcgcaccgccgagaacacgtttaataaaacgcataccttccattttcttctgggcagcatctatggggagtgccccgtgcctaagcccagagttgatcggcccaggaaggtcccggtgatccaagaagaacgggccatgccggcccagttgcgccggatggaggagtcccaccaagaagcaaccgaaaaagaggtcgaacggatccttggccttctacagacatatttccgcgaggatcgggacagccttaccttgtcaccacggctggaatgcagtgggaccatctccactcactgcaatttacatcttctagatagttccaattctccagcatctgcctcctag

SEQ ID NO: 197505 - DNA, 1158 bp, Artificial Sequence
  Description of Artificial Sequence: Synthetic coding sequence
atgagcggcgacagcagcggccggggccccgagggccggggccggggccgcgatccccacagggatagaacccgaagccgctcgaggtccagatctccgctgtcgcctcgttctagacgaggttccgccagagaaagacgggaggcacctgaaagaccatctcttgaggacacagaaccctctgatagcggagatgaaatgatggaccccgctagcctggaagcagaggccgaccaagggctgtgccggcagatccggcaccaatacagagctttgattaactccgtccagcagaatcgcgaagatattctgaacgctggcgacaaacttactgaagtgctggaggaggcgaatactctgtttaacgaagtctccagggctagagaagcagtgttagacgctcacttcctggtgcttgctagtgacttagggaaggagaaggcaaagcagcttcggtccgatctttccagctttgatatgctccggtatgtcgaaactctactgactcacatgggagtgaacccactggaggccgaggagctcatacgggatgaggactctcctgatttcgaattcattgtatatgactcctggaagatcaccggaagaactgccgagaacacttttaataaaacacacactttccatttcttactcggaagcatctacggagaatgccccgtacccaaaccgcgtgtggatcggccccgtaaagtccccgtgatccaggaggaacgcgccatgcctgctcagctgaggagaatggaggaaagccaccaggaagccaccgagaaagaagtagaaagaattctaggtttactgcaaacatattttagggaggatccggacacccctatgtccttcttcgactttgttgtggatccccactcttttcctcggacagtggaaaatatctttcacgtgtctttcatcatcagagatggctttgcccggatccgtttggaccaagaccgcttgccagttatagaaccagtgagcattaatgaggaaaacgaaggcttcgagcataatacacaggttcgcaaccaaggaatcatcgccctatcgtatagagactgggaggaaatcgtgaagacattcgagatttctgaaccggtgataactccctctcagcgtcagcaaaaaccctctgcgtag

SEQ ID NO: 197506 - DNA, 519 bp, Artificial Sequence
  Description of Artificial Sequence: Synthetic coding sequence
atgctgcggtacgtggagaccctgctgacccacatgggcgtgaaccccctggaagccgaggaactgatcagagatgaggattcgccagatttcgagttcatagtctacgactcatggaaaatcaccggccggacagcagagaatacgttcaacaagacccacaccttccactttctgctgggaagtatttacggggaatgtcccgtcccaaaaccacgagtggatagaccccgaaaggtgcctgtcattcaagaagaaagggctatgcctgcacaactgcgcaggatggaagaaagccaccaggaggccaccgaaaaagaagttgagcggatactgggtcttctccagacatatttcagggaggatccagatactcctatgtcattttttgactttgtggtcgacccccatagctttccacggactgttgaaaacatctttcatgtgtcctttatcatcagagacgggttcgccagaatccgtttggatcaggacaggcttccagtgatcggcaaatag

SEQ ID NO: 197507 - DNA, 2574 bp, Artificial Sequence
  Description of Artificial Sequence: Synthetic coding sequence
atggccaaggccaagaaggtgggcgcccggcggaaggccagcggcgctcccgctggcgctcgcggaggacctgcaaaggccaactctaacccgtttgaagtcaaggtcaaccggcagaaattccaaatcttgggcaggaagacccggcatgacgtaggcttgcctggggtatcccgggcccgggctctgagaaaacggacccaaaccctcctgaaagaatacaaagaacgagataaatctaatgtattccgggataagcggtttggggagtacaattccaacatgagccctgaggagaagatgatgaagcgatttgctctcgagcagcagaggcaccatgaaaagaagtctatttacaaccttaacgaggatgaagaactgacccactacggccagtcccttgccgacattgagaagcacaacgacatcgtggattccgacagtgatgccgaagatcgaggcaccctttctgcggaattaaccgccgctcacttcggaggcggcggtgggctcctccataaaaaaacccagcaggaaggtgaggaacgggaaaagccaaaaagtcggaaggagctgatcgaggagctgattgccaaaagcaaacaggagaaaagggagaggcaggcgcaaagagaggatgccctggagttgactgaaaagcttgaccaggattggaaggagatccagactctcttgtcccacaagacccccaagtcagaaaacagggacaagaaggagaaacccaaacctgacgcctatgatatgatggttagagagcttggattcgaaatgaaagcacagccgtccaaccgcatgaagacagaggcagagctcgccaaggaggagcaggagcatctcaggaaactggaggccgaaaggcttaggaggatgcttggtaaggacgaagatgagaatgtgaagaagccaaagcacatgtctgcagatgatctgaatgacggatttgtacttgataaagacgacaggcgtttgttaagctataaagatggcaagatgaatgtggaagaggatgtgcaggaagaacagtctaaagaggcctctgatcctgagagtaacgaggaagagggggattcaagcgggggggaggacacggaagaatccgattcacccgattctcatctcgatctggaaagtaatgtcgagagcgaggaggaaaacgaaaagccagctaaggaacagcgacaaactcccgggaaaggactgatctctgggaaggagagagcgggcaaagccacacgggatgaattgccatacactttcgctgcaccagaatcttatgaggagctacggagcctgctgctgggaagatctatggaagaacaactgcttgtcgttgaacggattcagaaatgcaaccatccttcattggcagagggtaacaaagccaaactggagaagctattcggatttctgctagagtatgtgggagatctggccacagacgatcctccagatctgactgttattgacaaacttgtcgttcacttataccacctctgccagatgttcccagaatcagcttctgatgccatcaaatttgttctgcgagacgcgatgcacgagatggaagagatgattgagaccaagggccgcgctgcccttcccgggctggacgtcctcatataccttaagatcacgggattgctgttccccactagcgatttctggcatcctgtggttactcctgctctggtgtgtctgagtcagttgctgacgaagtgccctatattgtcactacaggatgtagtgaaaggattatttgtttgctgcctcttcttggaatatgtcgcactcagccagagattcatacctgaactgataaattttctgctgggcatcctatatattgcaactcctaacaaagcaagccagggcagcaccctcgttcatccatttagggcacttggaaagaacagcgaactgcttgtggtctccgctagagaggacgtggccacttggcaacaatcaagcctgtccctcagatgggcttcccggctgcgagcacctacaagcaccgaagcaaatcatatccggctgtcctgcttagccgtgggtctggcactgctgaaacggtgtgtacttatgtacggcagcttgccctccttccatgccattatgggcccgttgcaggcactcctgacagatcacttagctgattgctctcacccacaggaactccaggagttatgccagtcaactttaacagagatggagtctcagaagcagctgtgcaggcctcttacatgtgagaagtcaaagcccgtacccctaaagctgttcactcctaggctcgtgaaagtgctggaattcgggcgtaagcagggctcctccaaggaggaacaggaaaggaaacgtcttatccataagcacaagcgtgaattcaaaggcgccgttcgtgagattagaaaagacaaccaattcctagctcggatgcaactgtccgagattatggaaagagatgctgagaggaaaaggaaggtaaagcagctgtttaatagtctggctactcaggagggtgagtggaaagccctgaagcgcaagaaattcaaaaaatag

SEQ ID NO: 197508 - DNA, 2421 bp, Artificial Sequence
  Description of Artificial Sequence: Synthetic coding sequence
atggccaaggccaagaaggtgggcgcccggcggaaggccagcggcgctcccgccggagctagaggaggccccgccaaagcaaattcaaatccatttgaagtaaaggtcaataggcagaagttccaaatcctgggtcggaagacacggcacgacgtcgggttacccggcgtcagcagggcccgggcattgaggaagaggacccagacactcctgaaggaatataaagagcgagataaatcaaatgtgttccgggataaacgcttcggagaatacaattccaatatgagtccagaagagaaaatgatgaagcggtttgcgctggagcagcagcgccatcatgagaaaaagtctatatacaatctgaatgaggatgaggagctgactcattatggacaatcactagccgacattgagaaacataatgacatcgtggattctgattccgacgccgaagatcgtggaactctttccgctgaactgaccgctgctcactttggcgggggaggcggcctgctgcacaaaaagactcaacaagaaggcgaagagagagagaagccaaagtcgagaaaagagttaatcgaagagctcattgccaaatcaaaacaggagaaaagagaacggcaggcccagcgtgaagatgctctggaactgacagaaaagcttgaccaagactggaaagagatacagaccctgcttagtcacaaaactccgaagtctgaaaatcgggataagaaggaaaaaccgaagcccgacgcatatgatatgatggtccgcgagctcggcttcgaaatgaaggctcagcctagtaacagaatgaaaactgaggcggagttagcaaaggaggagcaggaacacctgcgcaagcttgaggcggagaggctccgccgaatgctggggaaagatgaagatgaaaacgtgaaaaagccaaaacatatgtcagccgacgatctcaatgacggctttgtgcttgataaagacgataggcgcctcctgagttacaaagatggaaagatgaacgttgaggaggatgtgcaggaggaacagagcaaggaagcctctgatcctgaaagtaacgaggaagagggcgactccagcggcggagaagacacggaagaatctgacagtcctgattctcacctggacctggaatcaaacgtcgaaagtgaggaggaaaatgaaaagccagcaaaggagcagaggcagactcccggcaagggacttatttcagggaaagagcgcgctggtaaggcgacccgcgatgagctaccgtatacctttgcagctcccgaatcctatgaggagctacgttcactcctactcggccgctcgatggaagagcagctcctcgtcgtcgagcgaatccagaagtgtaatcaccccagcttggctgaggggaacaaggcgaagttggaaaagctcttcggtttcctgctggagtacgtgggcgacttagcaaccgacgatcctcccgatctgaccgtgatcgataagctcgttgttcacttataccacctgtgccagatgttccccgaatccgcttccgacgcgattaagtttgtgctgcgcgacgccatgcacgagatggaagagatgattgagacgaagggaagagccgccctgcccggcctagacgtcctgatatacctcaaaataacaggcctcctatttccaaccagcgacttctggcacccggtagtcacacccgccttagtgtgcctttcacagctgttaactaagtgccccattctgtccctccaggatgttgtgaaaggcctctttgtctgttgcctgtttctggagtatgttgccctatcccagcgttttattccagagctgattaattttttgctagggattctctatatcgctaccccgaacaaagcttcccaggggtccaccctggtacatccctttcgggctctcggcaagaattcagaattgttggtagtgagcgcccgagaggatgtggctacgtggcaacaaagtagtctgtctctgcggtgggcttccagacttagagcgccaacttctactgaagccaatcacatccgcctttcatgtctcgccgttggactggccctgttgaagagatgtgttctgatgtacggcagtctgccctcttttcacgccatcatgggcccactccaggcactgctcaccgatcaccttgccgactgctctcaccctcaggagctgcaggagctgtgccaatctacccttaccgaaatggaatctcagaagcagctatgtcgcccactaacctgtgaaaagtcgaaacccgtccccctgaagctgtttacaccgcggttggtttccaacagccggccccaggttattcatcttccttggcctccaaactataggtgcgaaccacagcatccagctaagaaagtgatctttttccgagtgatcatgctgtag

SEQ ID NO: 197509 - DNA, 2574 bp, Artificial Sequence
  Description of Artificial Sequence: Synthetic coding sequence
atggccaaggccaagaaggtgggcgcccggcggaaggccagcggcgcccccgcgggtgcccggggcggccctgcaaaggcaaactcaaatcctttcgaggtaaaggtcaataggcagaagtttcagatcttgggaaggaagaccaggcatgatgttgggctacccggagtttctagagctcgagctctccggaaacggacacagacactgctaaaggaatacaaagaacgtgacaagagtaatgtgtttcgagacaaaaggttcggcgagtataacagcaacatgtccccagaggagaagatgatgaaacgttttgcattggaacagcagcgtcaccatgagaagaagagcatttacaacctgaacgaagatgaggagctgacgcactacggacagagcttggccgacatcgagaaacacaatgacattgttgactcagactccgatgcggaagatagggggactctgtccgccgagcttactgcagcccattttggcggcggcggcggactgctccataaaaagacacaacaggagggcgaagaaagagagaaaccgaaatcccggaaggagctcatcgaggagctcattgctaaatccaagcaagagaagagagagaggcaggcccagcgcgaggacgcactagagctaaccgagaagctggaccaggactggaaggaaattcagacattactcagtcacaaaacacccaagtccgagaatcgcgacaaaaaagagaaaccaaaaccagacgcctatgatatgatggttcgcgaactcggatttgagatgaaggcccagccatcaaaccggatgaaaacagaagccgaacttgcgaaggaggagcaggaacacttacgtaagctggaggcggaacgcttaagaaggatgttgggaaaagatgaggacgagaacgtgaagaagcctaagcatatgtccgccgatgatttgaatgatgggttcgtcctggacaaagatgatcggaggctcctctcttacaaggacggtaagatgaatgtggaagaagacgtgcaggaggagcagtcaaaggaggccagtgatcccgagtctaacgaagaggaaggggactcttctggtggggaggataccgaggagtcagatagccccgactcccatttggatctggagtccaacgtggagagcgaggaggaaaatgaaaagccggccaaggagcagcgccagacgcccggaaagggcttaattagtggaaaggagcgcgccggcaaagctacccgagacgaattaccgtatacctttgcggccccagagagctacgaagagttgcgaagcctactcctcggacgctctatggaggaacagttgttggtggtggaaaggatccagaaatgcaatcatccttcactagcagagggaaacaaggctaaactcgagaaactgtttggattcttactggagtatgtcggtgacttagctacagacgatccaccggacctcacagtgatcgacaagctggtagtgcatctgtaccacctctgtcagatgtttccagagagtgcaagtgacgccatcaagttcgtcctgagggatgcaatgcatgaaatggaagagatgatcgagactaagggccgcgccgctctgcctggccttgatgtcctgatttaccttaaaatcacaggtctcctttttcctacaagtgatttctggcaccccgttgtgacacccgccctggtgtgcctttctcagctgctgaccaagtgccccatcctaagtttgcaagatgtggtcaaaggactattcgtttgttgcctttttctcgaatacgtggcgctgagccaacgctttatccctgagctgatcaattttctactcgggattctctatatcgccacgccaaacaaggccagccagggctctacattagtgcatccatttagagccctaggaaaaaattctgagcttctggtcgtctccgccagagaggacgtggccacgtggcagcagagctctttgtccctgcggtgggcatcgcgtttgcgagctccaacgagcacggaggctaatcatatccggctgtcatgtctggctgtagggctggcgttgctgaaaaggtgcgtactgatgtatggaagtctgccctcctttcacgcaataatggggcccctgcaggccctcctgacggatcaccttgccgactgcagtcatccgcaagaacttcaggaactgtgccagtccaccctgacagagatggaaagccaaaagcagttgtgtagacccctgacctgcgagaagagcaaacctgtaccactcaagctcttcacaccacggctggttaaggtcctggaatttggtaggaagcagggatcttctaaagaggagcaggaaagaaaaagactgatccacaaacacaagcgggagttcaaaggtgcggtgcgggagatccggaaagacaatcagtttctggcacggatgcaactgagcgaaattatggagcgcgatgccgaaaggaaaagaaaggtcaagcaactcttcaatagccttgcaacccaggagggcgagtggaaagccctgaaacgaaaaaagttcaaaaaatag

SEQ ID NO: 197510 - DNA, 1728 bp, Artificial Sequence
  Description of Artificial Sequence: Synthetic coding sequence
atgaagcggttcgccctggagcagcagcggcaccacgagaagaagagtatttataacttgaatgaagacgaagaactgacccactacggacagagtctcgcggatatcgagaagcacaacgacattgtcgactcggactccgatgctgaagaccgggggaccttatctgctgagttgacagccgcccactttggtgggggcggtgggctcctccacaagaagacacagcaagaaggcgaggagagagagaaaccgaaatccagaaaggaacttatcgaggagctgattgccaaatcaaaacaggagaaaagggaaaggcaagcacagagagaggatgctctggaactgacagaaaagctagatcaggattggaaggagatccagactctcctgagccacaagacccccaagtccgaaaatcgtgacaaaaaagaaaagcccaagccagacgcttatgatatgatggtgagggagctcgggtttgagatgaaagcccagccttccaatcgcatgaagacagaagctgagttggcaaaagaagaacaggagcatctgcgcaagcttgaggctgaacgtctcagacgcatgctcggcaaagatgaagacgaaaatgtgaagaagcctaagcacatgagtgctgatgatctgaatgatggtttcgttctggacaaggatgaccgtcgactgctatcttataaggacggtaaaatgaacgtcgaagaggacgtgcaggaagaacaatcaaaggaagcctctgatcctgaatccaacgaggaagaaggagatagttctggcggcgaggacaccgaagaatcagatagccccgactcacacctggacttagagtcaaacgttgagtccgaagaagagaatgagaaacctgccaaagagcaaaggcagactcccggtaaagggttaatttccggaaaagaacgcgctgggaaggccaccagggacgagctgccctacaccttcgctgcaccagaatcttacgaggagttgagatccctacttctgggacgaagtatggaggagcagctattggtggtcgaacgtatccaaaaatgcaatcacccctctctagcagaaggcaacaaagctaaactcgagaaactgtttgggtttctcctggagtatgtcggggatctggccaccgatgatccccccgatctcactgtcatagacaagctggtggttcatctatatcatctatgccaaatgttcccagagagcgcttcggatgccataaagttcgtcttacgcgacgccatgcacgaaatggaggagatgattgagacgaaggggcgggccgcactgcccgggttggacgtgctaatatacctcaagattacaggcttattgtttcctacaagcgacttctggcacccagtcgtgacacctgcactggtttgtttgtcccaactgttaactaagtgccctatccttagcttgcaggacgtggtgaagggcctgtttgtctgttgtctgtttctagagtacgtcgccctgtcacagcgtttcatccctgaattaatcaatttcctgctcggtatcctgtacattgccacacccaataaagctagccaggggagcactcttgtccacccgttcagagccttaggaaagaattcagaactgctggtggtctcagccagagaagacgtggctacgtggcagcagtctagtctcagtctgcgttggtggagccggatccctgatttgaggtag

SEQ ID NO: 197511 - DNA, 2304 bp, Artificial Sequence
  Description of Artificial Sequence: Synthetic coding sequence
atgggccggcggagccggggccggcggctgcagcagcagcagcggccagaagacgcagaagacggagcagaggggggcgggaaacgcggggaagccggttgggagggagggtacccagagatagtaaaggagaataagttgttcgagcactattaccaagagctgaaaatcgtacctgagggtgagtggggtcagttcatggatgcgctccgcgagccactgccagcaactttgcgcataactggctataaatctcatgctaaagaaatattacactgcctaaagaacaaatacttcaaggagctcgaagatctcgaggtagacgggcagaaagtggaagtccctcagccactatcatggtatccagaagaactcgcctggcacactaatctctcccggaaaatccttcggaaaagcccccatctcgagaagtttcaccagtttttggtgtccgagactgagtcgggcaacatttcccgacaggaagccgtgtccatgattccgccgttgctgctgaacgtccgcccccatcataaaatcctggatatgtgcgccgcaccaggcagcaagaccacccagctgattgagatgctccatgccgatatgaacgttcctttccccgaagggtttgtgatcgccaatgacgtagacaataagcggtgttatctgctggtgcaccaggccaaaaggctttcttctccatgtataatggtagtgaaccatgacgcctccagtattccccggctccagatcgatgtggatgggagaaaagagatccttttctacgacagaattctgtgcgacgtcccttgcagcggggatgggacgatgcgcaagaatatcgacgtctggaaaaagtggactacattgaactcgctgcagttgcatggactgcaactccgcatcgctacccggggggccgagcaactggccgaaggaggcagaatggtctatagcacttgcagcctgaacccaatcgaagatgaggccgtaatagcttcacttctcgagaaatctgagggggcactggagctcgccgacgtgagtaatgagttgcctggtctgaaatggatgcccggtataacccagtggaaggtgatgaccaaagatggccagtggtttacggactgggatgccgtgccgcactcccggcatacccagattcgccctaccatgttcccgcctaaagatccggagaagctgcaagcaatgcatttggagcgctgccttaggatcctgccccaccatcaaaacaccggcgggtttttcgtagccgtcctggtcaagaaatcctctatgccatggaacaagcgtcagcccaagctccagggaaagtctgccgagactcgcgaaagcactcagttatcacccgccgaccttacagaaggaaagcctactgatccctcgaaattagagtccccttctttcaccggaactggggataccgagatcgcacatgccacggaagaccttgagaacaacggtagcaaaaaagacggagtatgcggacctccaccttcaaagaagatgaagctctttggattcaaggaagaccctttcgtttttatcccagaggacgacccactgttcccccccatcgagaaattttacgcattagatccctcatttcctcgcatgaatcttctaaccaggacgactgagggcaagaaacgacagctttacatggtcagcaaggaactcaggaatgtgctgctgaacaattcagaaaagatgaaggtgatcaacacaggcatcaaggtgtggtgtcgtaacaatagcggggaagaatttgactgcgccttccggctggcccaggaaggcatctataccctctaccccttcattaactccagaattatcactgtttccatggaggacgtgaagattctcctcacgcaggagaacccattttttagaaaattgagctcagaaacctattcacaggcgaaggacttggcgaaagggtcaatcgtgcttaagtacgaacccgactcggctaatccggatgcactgcagtgtcccattgttctgtgcggatggcgcgggaaggcatcaataaggactttcgtgccgaagaacgagcggcttcattaccttcgcatgatgggacttgaggtgctcggcgaaaagaagaaggaaggggtgatcctgacgaacgagagtgctgcttcaactggccaaccggacaacgatgtcaccgaggggcagcgtgccggcgagccaaattcacctgatgccgaggaggcaaatagtcccgatgtcactgctgggtgtgacccggcaggggtgcacccgccaagatag

SEQ ID NO: 197512 - DNA, 1596 bp, Artificial Sequence
  Description of Artificial Sequence: Synthetic coding sequence
atggtggtgaaccacgacgccagcagcatcccccggctgcagatcgatgtagacggccgcaaagaaatacttttctatgaccggatcctctgtgatgtgccatgctctggcgatggaaccatgagaaagaacatcgacgtgtggaaaaaatggaccaccctcaattccttgcagttacatgggctacagcttagaatcgcaacccgcggggcagagcagctcgccgagggcggccggatggtctacagcacttgctccttgaatcccatcgaggatgaagctgttatcgccagccttctagaaaagtccgagggcgcactcgaattggccgatgtgtctaatgagttgcctggtcttaaatggatgcctggtattacccagtggaaggtgatgaccaaagatggacagtggtttacagactgggacgctgtgccccactcacggcatactcaaattcggcccaccatgttcccgcctaaggatccagaaaagcttcaggcaatgcaccttgaaaggtgtttgagaatcttaccccatcaccagaatacaggaggctttttcgtggcggtcctggttaaaaagagcagtatgccttggaacaaaagacagcccaaactacagggcaaatccgcggagactcgcgagtcgacccaactgtctccagcagacttgacagaggggaaaccaacagatccctcaaaactggagtcgccgtctttcaccggcacgggagacactgagattgcgcacgcgacagaggatttggaaaataacgggagcaaaaaggatggcgtgtgcggccctcctccttccaagaagatgaagctcttcggctttaaagaggacccattcgttttcataccagaagatgaccccctgttcccacctatagaaaaattctacgccctcgatccatcattcccccgcatgaatcttttaacccgcaccaccgagggaaagaagcgccaattgtacatggtctctaaggaattacgtaacgtcctattaaacaactctgaaaagatgaaagtgataaacaccggaattaaggtgtggtgcaggaataactctggggaggagttcgactgtgcctttaggttagcacaggagggaatatacaccttgtatcccttcattaactctcggattatcacagtatcaatggaggacgtcaagatcctccttacccaggaaaacccctttttcagaaagctgagtagcgagacctattcccaggctaaagatctggccaaggggtctatagtgctcaagtacgaacctgactccgcaaaccctgatgcccttcagtgccccatcgtgttgtgtgggtggcgcggaaaggcatccattcgaacctttgtccccaaaaacgagaggctgcattacctcaggatgatgggcctcgaggttctgggggagaaaaaaaaagaaggagtgatcctaactaatgaatccgcagcatcaaccgggcagccagataatgacgttaccgagggccaacgagccggggaaccaaactcacctgacgcagaagaggctaactccccagatgtgactgccgggtgtgatccagcaggcgtacaccctccccgctag

SEQ ID NO: 197513 - DNA, 2199 bp, Artificial Sequence
  Description of Artificial Sequence: Synthetic coding sequence
atgggccggcggagccggggccggcggctgcagcagcagcagcggcctgaggatgcagaagatggtgctgaaggcggcggtaagcggggagaggctggatgggagggaggatacccagagatcgtgaaagagaacaagctgttcgaacactattaccaggagctgaagatagtccctgagggcgagtgggggcaattcatggatgcccttcgggaacctcttccagccacactgcgcataaccggatataagagatacccagaggagttggcctggcatactaatctttccaggaagattttgaggaaatccccacatctcgagaagttccaccagttcctcgtgtctgaaactgagtccggaaatatctcgcggcaggaggcggtgtcaatgattcctcccttgctgctgaatgtacggcctcaccacaaaatcctggatatgtgtgcagcccccggtagcaagacgactcaactgatcgagatgctgcatgccgatatgaacgttccattccctgaggggttcgtcatcgccaacgatgtggataacaagcgctgttatcttctggtccatcaggcgaaaaggctttcgtccccatgtattatggtggttaatcatgatgcctcttccatccctaggctgcagattgatgtggatggcagaaaggagatattgttttatgaccgcattctctgtgatgttccgtgctccggcgacggaactatgcgcaagaatattgacgtgtggaagaaatggactacgttaaacagcctccagttgcacggcctgcaactccgtatagcaacacgcggggccgagcagttggctgaggggggtagaatggtttatagcacatgcagtttaaaccctatcgaagacgaagcggtgatcgcaagtctcctagagaaatccgaaggagccctggagctggctgacgtgtcaaacgaacttcctgggctgaagtggatgcctggaatcacccagtggaaggtgatgacgaaggatgggcagtggttcaccgactgggacgctgtacctcacagcaggcacacacaaattcgccctactatgttcccacctaaggaccccgagaagctccaggcaatgcatctcgaaagatgcttgaggatccttccccaccatcaaaacacgggaggcttctttgtcgcggtgctcgtaaagaagtcatctatgccatggaataaacggcagcccaagctgcagggaaagtctgccgagacccgggagtctacccagttaagcccggctgatctcaccgagggaaagcccacagatccttccaaactagaatcaccttcctttactggaaccggggacaccgagattgcccacgccactgaggacctagaaaacaatggatcaaagaaagacggcgtttgcgggcctccaccatcaaaaaaaatgaagctctttggctttaaagaggacccattcgtgttcattccagaagacgacccactctttccccctatcgagaaattttacgcactggacccgtcttttccaaggatgaacttactcacaaggacaactgagggcaaaaaaagacagctgtatatggtttcaaaagaactgcgaaacgtgctcctgaacaactcagagaaaatgaaagtcattaacactggcatcaaagtgtggtgtcggaataacagcggagaggagtttgattgtgcctttcgcttggctcaagaggggatttataccttataccccttcatcaattcccgcatcattacagtctccatggaggatgtaaagatactattgacccaggaaaaccctttttttcgaaaactgagctctgagacttactctcaggccaaggatctcgccaagggctccatcgtcttgaaatacgaacccgattcggccaaccctgatgcactgcagtgccccatcgtcctctgcgggtggcgtggcaaagccagtatacgaacctttgtgccgaagaacgagagacttcactatctgcgcatgatgggacttgaagtgttgggcgagaagaaaaaagagggcgtgatcctgacgaacgaatctgccgcgagcactggccagcctgataacgacgtcactgaaggccagcgagccggagagccaaacagtcccgatgctgaggaggctaactcccccgacgtcaccgcgggttgtgatcctgctggcgttcacccacctcggtag

SEQ ID NO: 197514 - DNA, 1785 bp, Artificial Sequence
  Description of Artificial Sequence: Synthetic coding sequence
atggtgctgctgcacgtgctgttcgagcacgccgtgggctacgccctcctggccctgaaagaagtggaagagatctcactgctacagccacaagtggaggaatccgtcttgaatctgggcaaattccactccattgtgcgtcttgtcgctttctgccctttcgcatcctcacaggtggccttggaaaatgcaaatgctgttagcgaaggcgtagttcacgaggaccttaggctcctgctcgaaacccatctcccttcaaaaaagaagaaagtgctgctcggcgttggtgatcctaagataggcgcggccatacaagaggagctgggctacaactgccaaaccgggggcgtgattgcagagatcttacgcggggttcgtctccactttcacaacttagtcaaaggcctgacagatctctcggcctgcaaagcccagctgggactagggcactcctattctagagcaaaggtgaaattcaacgtgaatagagtggacaacatgataatccagtcaatttcacttttggaccagcttgacaaggatattaacacatttagcatgcgtgtcagagagtggtacgggtaccacttccccgaactagtgaaaataatcaacgacaacgccacttattgtcgcctcgcacaattcataggcaaccggcgtgagttgaacgaagacaagctggagaagcttgaagagctgaccatggatggggccaaggcaaaagccatcttggatgcatcgaggagttcgatgggcatggacatttctgccattgaccttattaatatcgaatcttttagttctcgcgtggtctccctgagtgagtaccggcagtcactgcatacatatcttcgaagtaagatgtcacaggtggccccaagcctgagtgccttgatcggagaggccgtaggggcccgattgattgcccatgccggttccctcaccaacctggcaaaatacccggccagcaccgtgcagattcttggggccgagaaggccctcttccgcgcgctcaagacgaggggtaatacacccaagtacggcttgatcttccattccacctttatcggacgcgccgccgccaagaataagggacgcatcagtaggtatttggccaataaatgttctatcgccagccgcatcgattgcttctctgaagtccctactagcgtgttcggagaaaaactccgagagcaggtcgaggaacgcttatctttctatgaaaccggggaaatcccccgaaaaaatttggacgttatgaaggaagccatggtgcaggctgaagaggccgccgcggagatcacacggaagttagaaaagcaagagaaaaagagactgaaaaaggaaaaaaaacgcctggctgccttagcactggcctccagcgagaactcctcatctacccctgaggagtgcgaagagatgtctgagaagcccaagaaaaaaaagaaacagaaaccccaggaggtgccgcaggagaatggcatggaagaccccagcatatcattttcaaaaccaaagaaaaaaaagagcttttccaaggaagagctgatgagctcagatctggaggaaaccgctggaagcacctccatccccaaacgcaaaaaaagcactcctaaggaggagacggttaatgaccctgaggaggcaggtcaccggagcgggtccaagaagaagagaaagttttcaaaggaagaacccgtctcaagtggccccgaggaagctgtggggaaaagtagcagtaaaaaaaagaaaaaattccataaagcatcacaggaggattag

SEQ ID NO: 197515 - DNA, 678 bp, Artificial Sequence
  Description of Artificial Sequence: Synthetic coding sequence
atggacatcagcgccatcgacctgatcaacatcgagagcttcagctcacgcgtcgtgtcactatccgaataccgccagtctctgcatacctacctgcgaagcaaaatgagccaggtggccccctctctgagcgctctcataggcgaagcggtaggagcaagactcatcgcacatgctggcagcctcacaaacctagcaaagtatcccgcaagtacagtgcagatcctgggagcagagaaggctctgtttcgtgccttaaaaactaggggcaatacaccgaaatatggcctgatcttccattctactttcattgggcgtgccgcggcaaagaacaaaggacgtatatctcgctacctcgctaacaaatgctccatcgcctcacggatcgactgcttcagtgaagtgccaacttcagttttcggagagaagctgcgtgagcaggtcgaggagagactgagcttttacgaaactggcgagatcccacgtaagaacctggatgtcatgaaagaagctatggtgcaagctgaagaagctgccgcggagattacacgcaagcttgagaagcaagagaagaagagactcaagaaggaaaaaaaaaggcttgccgcattagctctcgcatccagtgagaacagcagcagcactcctgaagagtgcgaggaaggcgaccgatgttag

SEQ ID NO: 197516 - DNA, 660 bp, Artificial Sequence
  Description of Artificial Sequence: Synthetic coding sequence
tgactgatcaacatcgagagcttcagcagccgggtggtgagcctgtctgagtacaggcaatctttgcatacatatcttaggagcaagatgtcccaggtagcccccagcctgtccgccctgataggcgaggcagtgggggcccggctgatcgcacacgcagggtcactcacaaatcttgctaagtatccagcaagcaccgtgcagattctaggtgctgagaaggccctctttcgagcacttaaaactcgaggcaacacgcctaagtatggcctaatcttccactctaccttcattggacgagccgcagctaaaaacaagggcaggatatctaggtacctagcaaataaatgttcaatagcctcccgcatcgattgcttttccgaggtaccgacatctgtcttcggcgaaaaattacgggaacaggtggaagagagactctcgttttacgagacgggagaaattccgcgaaagaacctggacgtcatgaaggaggcaatggtacaggcagaggaagccgctgccgagattacacgaaaactggagaagcaagagaagaaacgcctcaagaaagaaaaaaagagattagccgcattggccctcgctagtagcgagaactccagcagtacaccagaggaatgcgaggagggcgatcgctgctag

SEQ ID NO: 197517 - DNA, 846 bp, Artificial Sequence
  Description of Artificial Sequence: Synthetic coding sequence
atggtgctgctgcacgtgctgttcgagcacgccgtgggctacgccctgctggccctgaaagaggtggaagagatctcattgctgcaacctcaggtggaagagtctgtgctgaacctcggtaagtttcatagcatcgtgaggctcgtcgccttttgtccctttgcctcaagtcaggtggcacttgagaacgcaaatgccgtgtcggaaggagtggtccatgaggacctgcggctcctgctggagacccacctgccaagcaagaagaagaaggtactactgggagtcggagatccgaaaattggcgccgccatccaagaagagctcggatacaattgtcagacaggtggagtgatcgcagagatcctgaggggcgtgcggctgcacttccataatcttgtcaaaggcctcacagacttaagtgcctgtaaggcccagctgggactgggccactcctacagccgagctaaggtcaaattcaatgtaaacagggtggataatatgattattcagagcatcagcttgctcgatcagctggataaggatataaacactttctccatgcgagtaaggcaatctagatgcggcgagggcaaagctgttgccctgtggttcctcatgaaacagctcggtcagggagtgaccgtggcactgtgcagagaatggtacggttatcatttccccgaactagtgaagattatcaatgacaatgccacctattgccgtttagcccagtttattggtaaccgcagggagttgaatgaagacaagctagaaaagcttgaagaactgacaatggatggcgccaaggccaaggccatactggatgccagtcgatcaagcatgtag

SEQ ID NO: 197518 - DNA, 402 bp, Artificial Sequence
  Description of Artificial Sequence: Synthetic coding sequence
atgcggaagcacgtgctggccgccagcttcagcatgctgagcctgctggtcatcatgggtgacacggacagtaagaccgactcaagctttatcatggacagcgacccaagacgatgtatgcgacaccactacgtcgattcaatctcccaccctctgtacaagtgttctagcaaaatggtcttgcttgctaggtgtgaggggcactgcagccaggcaagccgctctgaacctctcgtctctttcagcacggtgcttaagcagccattcaggtcctcttgccactgttgtaggcctcagacttctaaactcaaggctctgagattaagatgcagtggaggtatgagactgacggcaacttaccgctacattctgtcctgccactgcgaggaatgtaactcttag

SEQ ID NO: 197519 - DNA, 7416 bp, Artificial Sequence
  Description of Artificial Sequence: Synthetic coding sequence
atgcccgccctgcggcccgccctgctgtgggccctgctggccctgtggctctgttgcgcggccccagcccatgctctgcaatgtagagatggttacgaaccttgcgtgaacgagggtatgtgtgtaacttaccataatggcaccggatattgcaaatgtccagagggattcctgggcgagtactgtcagcatagagatccttgtgagaagaaccgatgtcagaacggcgggacatgcgtagcacaagccatgctgggcaaggccacatgcaggtgtgctagcggcttcacgggcgaagattgccagtactctacatcacacccttgctttgtgagtaggccttgtcttaacggtggcacctgtcatatgctctccagggacacctacgaatgcacgtgtcaggtcggtttcacgggaaaagagtgccagtggactgacgcttgtctgagtcatccctgtgctaatggatctacatgcaccaccgtcgcaaatcagttttcctgtaagtgcttgacaggtttcaccggccagaaatgcgaaaccgatgttaatgagtgtgacattccagggcactgtcagcatgggggcacatgtctcaatctaccagggagctatcagtgtcaatgtcctcagggattcacaggccagtattgtgatagcctgtacgtgccatgcgcaccctcaccttgtgtcaacggcggaacatgtcgccagacaggagacttcacatttgaatgcaattgcttacctggtttcgaaggtagcacatgcgagagaaatatagatgactgccctaaccaccggtgtcagaacggcggggtttgcgttgacggcgtgaacacttataactgtaggtgtcccccacagtggaccggccagttctgcactgaagacgtcgacgagtgcttgctgcagcccaatgcctgtcagaacgggggaacttgcgccaatagaaatggcggatacggatgtgtgtgcgtgaacggctggagcggagatgattgtagtgaaaatatcgatgactgcgcgtttgccagttgcacgcccggcagcacatgcattgatcgcgtagcctccttctcctgcatgtgtccagaggggaaggctggcctcctctgtcacctggatgacgcatgcatttcaaatccttgccataagggcgctctgtgtgatactaacccgcttaatgggcagtatatatgtacctgcccacaggggtacaagggagcagactgcacagaagacgtggatgaatgcgccatggccaactccaacccttgtgagcacgccggcaagtgcgtgaacacagacggggccttccattgtgaatgccttaaggggtacgcaggacccaggtgcgagatggacataaatgaatgccattctgatccttgccagaatgacgctacctgcctggacaagattggagggttcacatgtttgtgcatgccaggattcaaaggagtacactgtgagctcgaaatcaacgagtgccagagcaatccatgcgtcaacaacggacagtgtgttgataaagtgaacaggttccaatgtctgtgtccaccggggtttaccggtcctgtttgtcagatagacattgatgattgctcctctaccccatgcctcaatggtgctaagtgcatcgaccacccaaacgggtacgagtgccagtgtgcaaccggatttacaggcgtgctgtgcgaggaaaatatagataattgtgatcccgacccctgtcaccacgggcaatgccaggacggcattgattcctacacctgcatttgcaatcctgggtatatgggagccatatgcagtgatcagatcgacgagtgttatagctcgccatgtctcaacgatgggagatgcattgacttagttaatggttaccagtgcaactgccagcccggcacatccggagtgaactgcgaaattaatttcgacgattgcgctagtaacccttgcatacacggcatctgtatggatggcatcaaccgttactcgtgcgtgtgttctcccggatttacaggtcagcggtgcaatattgacatcgatgagtgtgcttctaacccatgtcgaaagggtgctacatgcatcaacggggtgaacggctttcgttgtatttgtccagaagggcctcatcatccgtcttgctactcacaggtgaatgagtgtttatccaacccctgtattcacggcaactgtacaggggggctgtctggatacaaatgcctgtgcgatgccggctgggtcggcatcaattgtgaggtcgataagaatgaatgtctgagtaatccctgtcagaacgggggtacatgtgataacctcgttaacggttaccgatgcacttgtaaaaaaggatttaaaggttacaattgtcaggtgaatatagacgagtgcgcgtctaatccatgccttaaccagggaacttgttttgacgatatttcagggtatacctgccactgtgtcctgccttatactgggaagaactgtcagaccgttcttgctccatgctcacccaatccatgcgaaaatgccgccgtttgtaaagagtctccaaattttgaaagttatacttgtctgtgtgctccagggtggcaaggacaacgctgcaccattgatattgacgagtgcatttcaaagccttgtatgaatcacgggctgtgtcataatacgcaggggtcttacatgtgtgagtgtcctccaggattttcgggcatggattgcgaggaagacattgatgattgcctggccaacccatgccaaaacggaggctcttgcatggacggcgtcaatacgttcagctgcctttgtttgcccggctttactggcgacaagtgccagaccgacatgaatgagtgtcttagcgagccttgtaaaaacgggggaacctgctctgattacgtcaactcttatacctgcaagtgccaggcaggtttcgatggggtacactgtgagaataacatcaatgagtgcacggagtctagttgttttaacggcggcacttgtgtggacggcatcaactccttctcatgtctctgccccgttggattcacaggatccttttgtttgcacgaaatcaatgaatgttcctcccacccttgtctaaacgagggcacctgcgtcgatggcctgggaacgtatcgttgttcttgcccactggggtacacgggcaagaattgtcagaccctggttaatctgtgctcccgctctccatgtaagaataaaggcacgtgcgtgcagaaaaaagcggaaagccagtgcctttgtccttcaggatgggcaggggcttattgtgacgtacccaacgtgtcctgcgatattgccgctagcagacgaggtgtcttggtggagcacctgtgtcagcattctggcgtctgcataaatgcaggaaacacccactactgccaatgcccactggggtataccggatcgtattgcgaagaacagctggacgaatgtgcaagcaatccttgccagcatggggctacatgtagtgatttcattggaggctaccggtgcgaatgtgttccaggataccagggcgtgaactgtgagtatgaagtagacgagtgccagaatcaaccatgtcagaacgggggcacttgcatcgacctcgtcaatcacttcaagtgtagctgtcctcctggaacacgcggtttgctttgcgaggagaatatagatgactgcgcgagggggcctcactgtttaaatggtggacaatgcatggatagaatcggtggctacagctgtcgctgtctccccggttttgccggggaaaggtgtgaaggcgatattaatgagtgtcttagcaatccatgctcatctgagggttctctggattgtatccagttgacgaacgattatctgtgcgtttgtagaagtgccttcacaggaaggcattgcgaaaccttcgtggacgtgtgcccacaaatgccctgtttgaacgggggcacctgcgcagttgccagcaacatgccagacggctttatctgtcgctgtccaccaggattttccggtgcgcgctgccagagcagctgcggacaggttaagtgcaggaagggagagcagtgcgtgcacactgccagcgggcctcgatgcttctgtccaagccccagggactgcgagtcaggttgtgcctcctctccttgtcagcacggcggtagctgccaccctcagcggcagccgccatactactcgtgccagtgcgcacctccattcagcggatcacgatgcgaactctataccgcgcctccctctacaccccccgctacctgtctgtcacaatactgcgctgataaagccagggacggagtttgtgatgaagcgtgtaactcgcatgcatgtcagtgggacggtggtgattgctcccttacgatggagaacccttgggcaaattgtagctcccccttaccctgctgggactacattaataaccagtgtgacgagctgtgcaacactgtggagtgtctctttgacaactttgaatgccagggtaattccaagacttgtaaatacgacaagtactgtgcagatcacttcaaagataaccactgtgatcagggatgcaatagtgaggagtgcgggtgggatgggcttgactgcgccgccgatcagccagagaatctggcggagggaaccctggtgattgtcgtattgatgcctccagaacaactgctccaagatgcccggtcatttttgagagccctgggtacactacttcacaccaacctgcgaatcaaaagggacagccaaggggagctgatggtatatccatactatggagagaaatctgctgcgatgaagaagcagaggatgacacggcggtccctgcctggcgagcaagagcaagaggtcgcaggttctaaagtgttcctggaaatcgacaatcgacaatgcgtccaagatagtgatcattgttttaaaaacacagacgctgccgccgcactgttggctagccatgccatccagggcacgctgagttacccattggtgagtgtggtctcggaatccttgactcccgagcggacccagttactgtacctgttagcagttgcagtggtgattatactcttcatcattcttctgggagtgatcatggctaagaggaagagaaagcatggctctctctggttgccggaaggattcacactccgccgcgacgctagcaatcacaaaaggagagagccagttgggcaggatgctgtcgggttaaagaacctgtccgttcaggtctctgaggccaatcttatcggaaccggtacttccgaacactgggtcgacgatgaaggtccacagccaaagaaagtgaaggccgaggatgaggccctactttctgaggaggacgatcccatagatagacggccatggacacaacagcacttggaggcagctgacatccgcaggacccctagcctagcactgacaccaccacaggcagagcaggaagtcgatgttctggatgtgaatgttaggggaccggacgggtgtacccctttaatgctggctagcctacgaggggggtcctctgatttatccgacgaagatgaagatgccgaggactcctctgctaatatcatcacagacctcgtgtatcagggggcctcactgcaggcccagacggatcggactggcgagatggcattgcatctggccgcccggtactcccgggcagacgccgcaaagagattgttggatgcgggcgctgacgcgaacgcgcaggataacatggggcgatgccccctgcacgccgccgttgctgccgacgctcagggagtatttcagatcctgatccggaaccgcgtaacagacctcgacgctaggatgaacgatggaaccacccctctgattctcgccgccagattagcagtagagggcatggtcgctgagctgatcaattgccaggcggatgtgaacgctgtcgacgaccacggcaaatccgcattgcattgggctgctgcagtcaacaatgttgaagctacgctcctgttactcaagaatggcgcaaatcgcgatatgcaggataacaaggaagaaactcctctcttcctcgctgctcgggagggttcctatgaggcagccaagattctgctggatcattttgccaatcgggacattaccgatcacatggacagacttccacgggacgttgctagagaccggatgcaccacgacatcgtgagattactagacgagtacaatgttacaccctctcctccaggtacagttctaacaagcgcccttagtccagtgatttgtgggcctaacaggtcatttttgtctttgaagcacacccccatgggtaagaagtctcgcagaccttcagctaaaagcacaatgcccacttcactgcctaatctagcaaaagaggctaaggacgcaaaagggtctcggaggaagaaaagtctgtcggaaaaagtgcagttgagcgaatccagcgtaacactctcccctgtagatagccttgaaagtccccatacctatgtgtcggatacaactagctcccccatgattacatcaccaggcatactgcaggcctcccccaatccaatgctagcaaccgccgctcccccggccccagtgcatgcccagcatgctctgtcctttagtaatttacacgagatgcagcctctggcacacggagcctctactgtgcttcctagcgtcagccagctattatcacatcaccacatcgttagtcccggctctggctctgctgggtctctatctaggctccatcctgtccccgttcctgcggattggatgaaccggatggaagtgaacgagacccagtataacgagatgtttggaatggtgttagcccctgcagagggtactcatcctggcatcgcgccacagtctaggccgcccgaaggcaagcacatcaccacccctagagaacctctcccacccatagtgacctttcaactcattccaaaggggtcgatcgcccaacctgccggagccccccagccccagtccacctgtccgcccgccgtggccgggccattgcctaccatgtaccagataccggagatggcccggctgccatccgtggctttccccactgccatgatgcctcaacaggacggacaggtggcccagacaattcttccagcttatcacccgtttccagcttctgttgggaaatacccaacccctccaagtcaacactcatatgcctccagtaacgccgcagaaagaacccctagccacagcgggcacctgcaaggtgaacatccatatcttacaccatcaccggagagcccggatcagtggtcttcttcatcaccacacagcgcatcggactggtcagacgttaccacatcaccaacaccagggggggctgggggcggccaacgcggacctggcacgcacatgtccgaacctccacacaacaacatgcaggtgtacgcctag

SEQ ID NO: 197520 - DNA, 711 bp, Artificial Sequence
  Description of Artificial Sequence: Synthetic coding sequence
atgtgcgtgacctaccacaacggcaccggctactgcaagtgccccgaaggatttttaggggaatattgccagcacagagacccatgtgaaaaaaaccggtgtcagaatggagggacctgcgtcgcccaggctatgcttggcaaagcgacatgcaggtgtgcctccggattcactggggaggattgccagtactctacctcgcatccctgcttcgtgtcccgcccttgtctgaacggtggaacctgccatatgttaagccgtgatacctacgagtgcacgtgccaggtcggttttacgggtaaggagtgccagtggactgacgcctgcctgtcccacccatgcgctaatgggagtacttgtactacggtggcgaaccagtttagttgcaaatgcctcactggtttcaccgggcagaagtgcgagaccgacgtgaacgagtgcgacattccaggtcactgccaacacggaggcacctgcttgaacctgcctggatcttatcagtgtcaatgcccacagggctttaccggccagtactgcgacagtctgtatgtgccctgcgcacccagcccgtgtgttaacggggggacatgccgacagacaggggacttcaccttcgaatgcaattgcctgcccgagacagtgagacgcggaaccgagctgtgggaacgggacagacaggtctggaatggaaaagagcatgatgagaattag

SEQ ID NO: 197521 - DNA, 720 bp, Artificial Sequence
  Description of Artificial Sequence: Synthetic coding sequence
tgccgggacggctacgagccctgcgtgaacgagggcatgtgcgtgacatatcacaacggaacaggttactgcaaatgtccagaagggttcttaggtgagtactgtcagcaccgcgacccctgcgaaaagaatcgctgccagaacggtggaacctgcgtggcccaggccatgttagggaaggcgacatgtagatgtgcctctggcttcactggcgaagattgtcagtactctacctcacacccttgttttgtgagtcgaccgtgtctcaacggaggaacatgtcatatgctctctagagacacctatgagtgtacatgccaggttgggttcacgggaaaggaatgccagtggacggatgcttgtctaagtcatccctgtgccaatggcagtacctgtaccactgtcgccaaccagttttcctgcaaatgcctgacaggatttacaggccaaaaatgcgagaccgatgtcaacgagtgcgatatcccaggccattgtcagcatgggggcacatgtctgaacttaccaggttcctatcagtgtcagtgtccacagggttttactggccagtactgcgactctctctatgtcccatgtgctccatctccctgcgtcaacgggggtacctgccgccagactggggacttcacttttgaatgcaattgtcttcccgcatgctggccaaggactccggacctgagactgcttctgggcgaaaaatag

SEQ ID NO: 197522 - DNA, 672 bp, Artificial Sequence
  Description of Artificial Sequence: Synthetic coding sequence
atgtggatctgccccggcggcggcggcggcggcggcggcggcggcgaccgcgaggatgctcgtcctccattatgttgcggccgctgctggcggtccggttgcgccgccaggcccccaagaatggtctctattggcctgaggggtgcagtcaggggagcccgcggttgccatctcggaaggccgttcagtccttctgtgttactgtgcgtcggcagaccaggtagtgcagccggtgccgagagggggcactcgctaggatctcaggaattcggtcacagacggggcccccttccctggtgccccgctaatagaagagggtcgcctccctcagctcccagaggtcctggcccgctgacaaggctgctaggtcgccgggaggcgggcagtaaatcacagaaacttctctttcgttccgcccgcgtccaggggggaggccagttttgccccagcggttccgctttcctgggggttgagcgggaaccaacagctgggctgggcggagctgagaggcgcaatgcaaggttttggaggggggagcgagggcagggtcgccaagcaaaaagaccggcaccatctcagccggcttctcctctccccgggggtggcacctgggccggctgtgtcggtttagtctggatgggcaccgggttttgcggggctcctgagttttag

SEQ ID NO: 197523 - DNA, 2592 bp, Artificial Sequence
  Description of Artificial Sequence: Synthetic coding sequence
atgtgcgtgacctaccacaacggcaccggctactgcaagtgccccgaagggttcctaggagagtactgccagcatcgggatccatgtgaaaagaatcgttgccagaacggagggacatgcgtcgctcaagccatgctggggaaggctacgtgtcggtgtgcctctgggttcactggggaagactgtcagtacagcacaagccacccgtgctttgtgtcccgcccttgtctgaatggtggaacttgtcacatgttgtcacgtgatacatatgagtgcacctgtcaagtgggatttacaggcaaggagtgtcaatggacggacgcctgcctttcacacccctgtgccaacggctcaacttgcaccacggtcgcaaaccagttttcatgcaaatgcctgaccggatttaccgggcagaagtgtgaaactgatgtcaacgagtgcgacattccgggccactgccagcatggcggcacatgtctaaatcttcccggctcatatcagtgccagtgtccgcaaggattcacaggtcagtattgcgactctttatacgtcccctgcgcaccttccccatgcgtgaacggcggcacatgcaggcagactggcgactttacatttgagtgtaattgtctgcccggcttcgaggggagtacctgcgaacgcaatatcgatgattgccccaatcataggtgccagaacgggggagtctgtgtggatggagtaaatacctacaattgcaggtgccccccacagtggacaggtcaattctgtaccgaagacgtcgacgagtgcctgttgcagcctaatgcatgccagaacggtggcacatgcgccaacaggaatggagggtacggttgcgtgtgtgtgaacgggtggtcaggagacgattgcagtgaaaacatcgatgattgtgcttttgctagctgcacccccgggagcacctgtatcgatcgggtcgcaagtttcagttgtatgtgccccgagggaaaggccggtctcctttgtcatcttgacgatgcatgcatctccaatccttgccacaagggggcgctgtgcgataccaatccactgaacggccagtatatttgcacttgcccccaaggatacaagggcgctgattgcaccgaagacgtggatgaatgcgctatggccaattctaacccttgcgagcacgccgggaagtgcgtgaacactgacggggctttccattgcgaatgtctgaaaggttatgcgggcccccggtgtgaaatggacatcaatgagtgccatagcgatccatgccagaacgacgcaacttgtctggataagataggcgggttcacctgcctgtgcatgcctggttttaagggcgtacattgcgaactggagatcaacgaatgccagtccaatccgtgtgtaaacaacggacagtgcgtcgacaaagtgaaccggtttcagtgcctctgcccacctggttttacaggtccggtgtgtcaaattgatattgacgactgcagctctaccccatgtctgaatggcgctaagtgcattgatcaccctaacggctacgagtgtcaatgcgcaaccggcttcacgggtgtgttgtgcgaagagaacatcgacaactgtgatccggatccctgccaccatggccagtgccaggatggaattgattcctacacctgcatctgcaaccctgggtacatgggtgctatttgtagtgaccagatcgatgagtgttatagctctccctgtctcaacgatggtaggtgcatcgatctggtcaacggctaccagtgcaactgccagccaggaacctcaggggtcaactgtgaaataaattttgatgactgcgcgtctaatccttgcatccacggcatttgtatggatgggatcaaccgttatagttgcgtgtgcagcccaggattcaccggtcagcgatgtaatatagacattgatgagtgcgcatctaatccgtgccggaaaggcgctacttgcattaatggagtcaatggctttagatgtatatgtccggaaggccctcatcatccatcctgctacagtcaggtcaacgagtgtctgtccaacccctgcatccatgggaactgtactggcgggctgtcgggttataagtgcctttgtgacgcggggtgggtaggcattaactgtgaagtcgataaaaatgaatgcctgtcgaacccctgccagaatggcggaacatgtgacaatctggtaaatggctacaggtgtacttgcaaaaaaggcttcaaagggtacaattgccaggttaacattgatgagtgcgccagcaacccttgtctgaatcagggaacctgctttgacgacattagcggctatacttgccactgcgttctaccttataccggagggtcgtggaggtatcagcagggacctgagggaattttggatctagcgttatccgtcccagagagccagtgccccggcttgtgggggtgtaacgctcccccacgagcccattcaagtgttgtcctccctgcttttaccgattggattctctcttttgaggagactctctggccacccaagatgcaggtggtggatagccatctcccaaccctgtacttttcaatctag

SEQ ID NO: 197524 - DNA, 6966 bp, Artificial Sequence
  Description of Artificial Sequence: Synthetic coding sequence
atgggccccggcgcccggggccggcggcggcggcggcggcccatgtcccccccacctccaccgccaccggtccgggccctgcccctgttgctgttactggccggccctggggctgccgctccaccatgccttgatggtagtccatgtgccaatggcggtaggtgcactcagctgccatccagggaggctgcatgcctctgtccccctggatgggtcggagagcggtgccagctggaggatccatgccactccgggccttgcgccggccgcggagtgtgtcaatccagtgtggtcgccggaaccgccagattctcctgtcggtgccctcgcgggtttcgcggccctgattgttcacttcccgatccgtgtctgtctagcccgtgcgctcatggagccagatgtagcgtcggacccgatgggaggtttttgtgctcttgtccaccaggctaccagggtcgaagctgccgatccgatgttgacgaatgcagggtgggggagccatgcagacacggagggacttgtttaaacacccctggcagctttcgatgtcagtgccctgcaggctacactggcccattgtgtgaaaatccagcggtaccatgtgcaccgagcccctgtcgtaatggtggtacatgtagacagtccggagatttaacctatgattgcgcatgcctgccaggattcgagggccaaaattgcgaggtcaacgtggacgactgtccagggcatcgctgcctcaacggggggacatgcgtggatggcgtgaacacatataattgtcagtgccctccagagtggactggacaattttgtacagaggacgtagacgagtgtcagttgcagcccaatgcttgccataatggcgggacttgtttcaacacactcggaggacattcctgcgtgtgtgttaacggatggactggtgagtcttgttcccagaacatcgacgactgcgcaaccgctgtgtgttttcatggcgctacatgtcacgatcgcgtggcatcattttattgtgcttgtccgatgggaaaaactggactgctatgccatctggatgacgcctgcgtcagtaacccatgccatgaggacgccatatgcgacaccaaccccgtcaacggtcgggccatttgcacgtgtccccccggatttactggtggagcatgcgatcaggacgtggacgagtgttccattggcgctaatccgtgcgaacaccttggcaggtgtgtgaacacccaggggagttttctgtgtcaatgcggccgcggttacaccggtccgcgctgcgaaaccgatgtcaacgagtgtctgagcggtccctgtcggaaccaggctacctgtcttgaccgaataggtcagtttacctgcatttgcatggccggctttaccggaacatattgcgaggtggacatagatgagtgtcaatcttctccttgtgttaacgggggcgtttgcaaggatcgggttaacgggttcagctgcacatgcccctccggatttagtggatcgacgtgtcaactggatgttgacgaatgtgcctccacgccctgccgtaacggcgctaaatgcgtggaccagcctgacggttatgaatgcagatgtgccgaggggtttgagggcacactgtgtgacaggaacgtagacgactgcagtcctgacccatgtcaccacgggagatgcgtcgacggcattgcaagcttctcatgtgcatgcgcaccaggatacacgggaacccgttgcgagagtcaagtcgatgaatgccgcagccagccttgtaggcatggtggcaagtgcttggacctggtggacaaatacttatgcagatgcccttcaggcacaaccggtgtgaattgcgaagtgaacatcgacgactgcgcttccaacccctgcacctttggtgtttgcagggatgggatcaatagatatgattgcgtctgtcagccaggcttcacaggaccactgtgcaatgtagagattaacgaatgcgcctcctccccatgcggcgaaggggggtcatgcgtcgacggtgagaatggattccggtgtctttgccccccgggctccctcccccccctgtgccttccccctagccatccttgcgctcacgagccctgttctcacggaatatgctacgatgcacctggcggatttcgctgtgtttgtgagcctggttggtccggtcctaggtgctctcagtctctggccagagatgcgtgcgagtcccagccctgcagagctggaggcacatgctctagcgacggaatgggcttccactgcacctgtcctcccggcgtccaaggtaggcagtgtgagctgcttagtccctgtacccctaacccctgcgagcacggaggcagatgtgaatccgcccctggacagttaccagtttgttcatgcccacaggggtggcaaggcccccgatgtcaacaagacgtagacgagtgtgccggacctgccccctgcggaccccatgggatatgcaccaacctggccgggtccttcagctgtacgtgtcacggtgggtacacagggcccagttgtgatcaggatataaatgactgtgacccaaacccttgtctcaacggggggtcatgccaggacggggtgggctcattttcatgcagctgtctgcccggttttgccggaccccggtgtgctagagacgttgatgagtgtctgagcaatccttgcgggcccggcacatgcacagatcacgtggcctcctttacatgcacatgccccccaggctatgggggattccattgtgaacaggaccttccggactgttctcctagttcttgcttcaatgggggaacttgcgtggacggggtgaacagcttctcctgcctgtgtcgaccagggtacactggtgcccactgtcagcacgaagctgatccctgcctgtcaagaccgtgtctgcatggaggtgtgtgctccgccgcacatccagggttccgatgcacttgtctggagtcatttacagggcctcagtgtcaaactctggtggattggtgctcaagacagccctgtcagaacggcggcagatgcgttcagaccggtgcctattgcttgtgcccaccaggatggagcggcaggctctgcgatataagatccctcccttgcagggaggcagccgcccagatcggcgtgcgcctcgagcagctttgccaagcaggggggcagtgcgtggatgaggactcttctcattactgcgtctgccctgaaggacggacaggcagccactgcgagcaggaggtggatccctgtctggctcagccatgccagcatggcgggacctgtagagggtatatgggggggtacatgtgcgagtgcctgcccgggtataacggagataactgtgaggacgacgtggacgagtgcgcgtctcagccatgccaacatggaggatcctgcatcgacctcgtggcacgctacctgtgctcttgtcctccagggacattaggagtgttatgtgaaatcaacgaagatgattgcggtccaggcccaccactggactcaggtcccagatgcttacataatggcacctgtgttgatcttgtcggaggattcagatgcacgtgtccacctggttacaccggactcagatgtgaggctgatattaatgaatgccgctccggcgcctgccacgccgcacatacccgcgactgtctgcaggaccccggcggaggctttcggtgcctctgtcacgccggattctccggcccacggtgccagaccgtcctctctccatgtgagagccagccttgtcagcacgggggccagtgtcggccgagcccagggccaggaggcggactaacttttacatgtcattgcgcacagccattctggggaccccgctgcgagcgagtcgctcgctcatgtagggaattacaatgccccgtgggagtcccgtgtcagcagaccccacgtggtcccagatgtgcctgccctccaggtctatctgggccttcttgtaggtcatttcccggctcccccccaggagcgtcaaatgcttcttgtgcagccgccccctgtctgcacggaggatcctgtagacctgcgcccctcgcaccattcttccgctgtgcgtgcgctcaaggttggaccgggcctcggtgcgaagcgcctgccgcggctccggaagtaagcgaagagccacgctgtcctcgcgcagcatgtcaggcaaaacgaggagaccaaagatgcgaccgcgagtgcaattcacccggctgtggttgggatggaggcgactgcagtctgagcgtaggggatccatggaggcagtgcgaggctcttcagtgttggcgcctgtttaacaattcccggtgtgaccctgcctgtagctcccccgcctgtctctatgacaatttcgattgtcacgccggtggccgggagcgaacctgtaaccccgtgtatgagaagtattgtgccgatcacttcgccgacggcaggtgtgatcagggctgtaatacagaggagtgtggctgggacggcctcgattgtgcttctgaggtccccgccttgctcgcaaggggtgtccttgtgcttacagtcttgttaccaccagaagagctgcttcggtctagtgccgacttcctccagcggctgtccgccattctgaggaccagcctgcgatttcgcctagacgcccacggccaggcaatggtttttccatatcaccggccatccccgggatccgagcctcgagcaagaagggagctggcccccgaggtgatcggttctgtcgtgatgctagagatcgacaacagactctgtctgcagtcaccagagaacgatcactgctttcccgacgcacagagcgccgccgactacctgggtgctttgagcgccgtggaaagactggatttcccctatccactgcgagatgtgcgcggcgaacctctagagccacccgaaccgtccgttcccctccttcctttgctggtggccggagcggtcctgcttctggtgatactggtgttaggggtcatggtggcccggcggaaacgcgagcactccacattatggttcccagaggggtttagcttacataaagatgtggcatctgggcacaaagggagaagggagcccgtcggtcaggacgccttgggaatgaaaaatatggcaaagggcgaatcattgatgggagaggtggcaaccgattggatggatacggagtgccccgaggctaaaagactcaaggtcgaagaaccaggaatgggagccgaagaggcggttgactgcaggcagtggacgcaacatcatctcgtcgctgcggatatccgtgtggctccagctatggctctgacccccccacagggcgatgccgatgccgatggtatggatgtgaacgtccggggtcccgatgggtttaccccacttatgctggctagcttttgtgggggagctctggaaccaatgcccaccgaggaggatgaggccgatgacacatctgcgagcatcatttccgacctcatttgccagggggcacaactcggtgcaagaactgaccgcactggtgagaccgctctacacctcgccgcgcgatacgcaagagctgacgcggcaaaaagactgttagacgccggggcggatacgaacgcccaggaccacagcgggagaacccccctgcacaccgccgtcactgcagatgcccagggtgtgtttcagatcttaatcagaaatcgaagcacagacttggatgctagaatggctgacggaagcacagcactgatactggccgccaggctagccgtagaggggatggtggaggagctaattgcatcccacgcagatgtcaacgccgtggatgagctcggtaagtcggccctccactgggcggcagctgttaacaacgttgaagccaccctcgccctgcttaaaaatggcgccaacaaagacatgcaggatagtaaggaggaaacacctcttttcttagccgccagggagggcagctatgaggcagccaaactgctcctggatcatttcgctaaccgcgagatcaccgaccatctggatcgtcttcctcgagatgtggcccaagagcgactccatcaggacatcgtgagactcttagatcagcccagcggaccacggtcaccgccaggaccccacggactggggcctctgttgtgccctcctggcgccttcctgcccggcttaaaagctgctcagagtggatctaagaagagtaggcgaccacctggtaaggccggcttggggccgcaagggcctaggggtcgcggcaagaagttgacactggcatgtcctggccccctcgcagattcttcagttactctgagccctgtggactctctggactctccacgaccttttggcgggcctcccgctagtccaggtggttttccattagagggaccatacgctgccgctacggctaccgcggtgtccctggctcagcttggggggcccggcagagccggattaggcaggcagccacctgggggctgtgttctgagtctggggcttctcaaccccgttgctgtgccactcgattgggcacgtctgccgcccccggctccaccaggcccatcattcttgcttcccctggctcctgggccccagttgctgaatcccggcacacccgtgtctccccaggagcgccccccgccatacctggcagtcccgggtcacggggaagaatatcccgccgcaggagcgcatagctcgccgccgaaagctcggtttttacgggtaccctctgagcacccatatctcaccccgtctcccgaatctcccgagcactgggcttcccctagccctccaagtttgagcgactggtcagaaagtacaccatctcccgccacagccaccggagccatggcaacgactacgggcgctttgcctgcccagccattgcccctgtccgtgccgagttccctcgcacaggcgcagacccagctggggcctcagcccgaagttactccaaaaagacaggtgttggcctag

SEQ ID NO: 197525 - DNA, 3867 bp, Artificial Sequence
  Description of Artificial Sequence: Synthetic coding sequence
gccgccatgggccccggcgcccggggccggcggcggcggcggcggccgatgtcaccaccgcccccccctccacccgtcagagctctgccacttctgctactgcttgctggccctggtgctgctgctcccccatgcctcgacggatcaccttgcgccaacggtggccggtgcacgcagttgccctcccgcgaagctgcgtgtctgtgtcctccaggttgggtgggagaaagatgccaacttgaggacccatgccactccgggccatgtgctggccgaggcgtatgccagtcttcagtcgtggcagggactgcgcgtttctcttgcaggtgtccacggggcttccgggggcccgattgctctttgcccgatccttgcctgtcctcaccatgcgcacacggtgcccggtgttcagtcgggcctgatggccggttcttatgctcttgcccgcccggctaccagggacgctcctgccgtagcgatgtggacgaatgcagagtaggcgagccttgcagacacgggggcacttgcctgaacacacctggatcttttaggtgtcagtgcccggctgggtacactggtcccctgtgcgaaaatcctgccgttccatgtgcgcccagcccctgccgcaatggggggacatgccgccagagtggtgatctgacctacgattgcgcttgtcttccgggtttcgagggccaaaactgcgaagtgaacgtggacgactgcccaggacatcgatgtttaaacggaggtacgtgtgtggatggggtcaatacttataactgtcaatgcccccctgagtggacaggacaattttgcacagaggacgtggatgagtgccagttgcagcctaatgcatgtcacaacgggggaacttgcttcaacaccttgggggggcactcctgtgtgtgtgttaacggatggacaggagaaagttgtagccagaatattgacgactgtgccacagcagtgtgttttcacggagctacctgtcacgaccgggtggccagcttctactgcgcttgtccgatgggaaagacgggactgctgtgccatttagacgacgcctgtgtctctaacccatgtcatgaggacgcaatctgcgataccaaccctgtgaacgggagagccatctgtacgtgtccccctgggttcacggggggcgcatgtgatcaggacgttgatgagtgtagcattggagccaatccctgcgagcatctcggaagatgcgtgaacactcaagggtctttcttatgccagtgcggtcgaggatacacaggaccaaggtgcgaaacagatgtgaacgaatgtttgtccggcccttgccgaaatcaagccacctgtttagatcgcatcgggcaattcacctgtatttgtatggccggatttactggaacctattgcgaagtggacattgatgagtgccagtcctccccgtgtgtgaacggcggtgtctgtaaggacagagtgaacggattcagctgtacttgcccttccgggttctcaggttccacctgccaactggatgtcgacgagtgcgcttctacaccctgccgtaatggcgctaaatgcgttgaccaacccgatggatacgaatgcaggtgtgctgaagggtttgagggcactttgtgtgatcggaacgtggacgactgttcccccgatccatgccaccacggcaggtgtgtggatggaatcgcctcattctcctgcgcctgcgcgcccggctatacaggcacccgatgtgaatcccaggtggacgagtgtaggtcccagccttgccgccacggtggcaagtgtctggacctcgtagataagtatctctgtcgttgtcccagcggaaccacaggagtgaactgtgaggtcaacatcgacgattgtgcctccaatccgtgcacttttggcgtgtgcagagacgggattaaccgatatgattgcgtgtgccaaccagggttcacgggaccactgtgtaatgtggagatcaatgaatgcgccagttctccctgcggggaggggggctcatgtgtcgatggggagaacgggtttcgctgtctatgtcctcccggtagcctgccccctctgtgccttccaccctcccacccatgtgctcacgagccttgctctcacgggatctgctatgacgcccctggtgggtttcgctgcgtctgtgaacccgggtggtctgggccacgttgttcacagtccctggctagagacgcctgtgaatcacagccttgcagagccggcggtacttgtagctccgacgggatggggttccactgtacatgtcctcctggggttcaaggccggcagtgtgagctgttgagcccgtgtacccctaatccatgcgagcatggcggaagatgcgaatcggcgcctgggcagctgcccgtgtgtagctgcccccaaggctggcaagacccgtgtctgaatggcggatcatgccaagatggcgtgggctctttttcgtgttcctgtttgcccggtttcgccgggccccgatgtgccagggacgtggatgagtgcttgtccaatccctgcggcccgggaacctgtaccgatcacgtggcttcctttacatgtacctgcccaccaggctatggcggcttccattgtgaacaggacctgccggattgttcacccagtagctgctttaacgggggcacttgtgtcgatggagttaattcattcagttgcttatgcagaccaggctataccggcgcccactgccagcatgaggcagatccgtgcctgtcccgaccatgccttcacgggggagtgtgctccgctgctcaccccggttttcgatgcacctgtctggagtcattcactggtccccagtgccagaccctagtggattggtgtagccgacagccttgccagaatgggggccggtgtgtccaaaccggggcttactgtctgtgcccaccagggtggtcagggaggctgtgtgacatccggtctcttccatgccgagaggctgctgcacagattggggttcggttagagcagctttgccaggccggcgggcagtgtgtggacgaagactcatctcactactgcgtctgcccagaagggcgcacaggctcccattgtgagcaggaagtagatccttgcctggcacagccatgtcagcacggcggcacctgtagaggatatatgggggggtatatgtgcgaatgtcttccaggctataacggcgataactgtgaggacgacgtggatgagtgcgcttctcagccatgccagcacggaggcagctgcatcgatctggtcgctcgatatttgtgctcttgtccaccaggcacgctgggtgttctatgcgagatcaatgaggatgattgtggccccggaccgcccttggattcgggcccacggtgcttgcacaatggtacttgcgtggacctggtaggaggcttccggtgtacttgtccccccgggtacaccggtcttaggtgcgaggctgatattaacgagtgcagatccggagcttgtcatgctgcccacactagggattgcctccaagaccctgggggaggctttagatgtctgtgtcacgccgggttctccgggccacgctgtcagacggtgctgagcccgtgcgagagtcaaccttgccaacacgggggacagtgtcgcccatctccaggaccgggggggggtctcacattcacatgccactgtgcgcagcctttttggggcccacggtgtgagagagtggcacgatcgtgtcgggagttgcaatgtccggtaggagttccttgtcagcagacaccaagaggaccacggtgtgcctgccctcctgggttgagcggcccatcttgtagaagctttcccgggagcccacctggggccagtaacgcttcctag

SEQ ID NO: 197526 - DNA, 6012 bp, Artificial Sequence
  Description of Artificial Sequence: Synthetic coding sequence
atgcagccccccagcctgctgctgctgctgctgctgctgctgctgctgtgcgtttccgtagtgagacctcgcggattactgtgcggatctttccccgaaccctgtgccaacgggggcacatgcctctctctgagcctcgggcagggaacctgccagtgcgcgccgggatttctgggcgagacctgtcagttcccagatccatgccagaatgctcagctgtgccaaaacggcggatcctgccaggccctcctgcccgcccccttgggcctaccatcaagtcccagccccttgactcccagtttcttgtgtacatgccttccaggattcaccggggaacgatgccaggccaaattagaagatccctgtccaccctcgttttgttcgaaacgcggacggtgccacatacaggccagcggcagaccgcagtgcagctgcatgccaggatggactggagagcagtgtcagttaagagatttctgttcagcgaatccttgtgtgaatggcggggtctgccttgcgacctacccgcagatccaatgtcattgcccacccggcttcgagggccacgcgtgcgagcgggacgtgaacgaatgtttccaagaccccgggccctgtcccaaaggaacttcctgccacaacaccttgggaagtttccagtgcctgtgtcccgtcggccaggagggccctcgttgcgagctacgggctggaccctgtccgccccgaggttgcagcaatggcggcacgtgccaactaatgccagagaaagactctacctttcatttatgcctgtgccctcctggcttcatcggccccgactgcgaggttaacccagataactgcgttagccatcagtgccaaaacggagggacatgccaggacgggctcgatacctatacatgtttatgccccgagacgtggacaggttgggattgctcagaggatgtcgatgaatgcgaaacccaaggaccccctcattgcaggaacggcggcacctgtcagaattctgctggctcattccactgcgtgtgtgtttccggttggggaggcacctcctgcgaagaaaacttagatgattgtattgctgccacctgcgctccaggatccacctgtattgatagagtcggctccttcagctgtctgtgcccacctggcagaaccgggctgctttgtcacctggaggatatgtgtctaagtcagccctgccatggggacgcccaatgctcgacgaaccctttgaccggaagtactctctgtctatgtcagcccgggtactccgggcccacatgccatcaagatttagacgagtgcctcatggcacaacagggaccctctccctgcgagcacggagggtcatgcctgaatacgccagggagctttaattgcctctgtccacccggctacaccggctcccgctgcgaagccgatcataacgagtgcctgtcccagccatgtcatcccggcagcacctgcttggaccttctggctacatttcattgtctttgcccacccgggttggaagggcagctctgcgaagtcgagacgaacgaatgcgctagtgcaccgtgtttgaatcacgccgactgccacgatttgttgaacggcttccaatgcatctgtctccctgggttctccggtaccaggtgcgaggaagacattgatgagtgccgaagcagcccgtgtgctaatggcggccagtgtcaagatcagcccggcgccttccattgcaagtgcctgccaggcttcgaggggccccgctgccagacggaggtggacgagtgtttaagcgatccatgcccagtcggagcttcctgtctcgatctcccgggcgcttttttctgtctgtgtccgtccgggtttaccggccagctgtgcgaggtgcctctatgtgccccgaacttgtgtcagccgaagcaaatatgcaaagaccagaaggacaaggcaaactgcctgtgccctgatggttctcccggatgcgcacctcctgaggacaactgcacgtgtcaccacggtcactgtcagagatcctcctgcgtttgtgacgtcgggtggacaggccctgaatgcgaggctgagctcggcgggtgcatatcagctccctgcgcgcacgggggaacatgctatcctcagccatcgggctacaattgcacatgccctactggctatacaggtcctacttgttccgaagaaatgacagcctgtcatagcggcccatgcctgaacgggggttcatgcaatccctctcctggcggttactactgcacctgtcctccctcacataccgggcctcagtgtcagacgagtacagattactgcgtctccgccccctgctttaatggcggcacgtgtgtaaaccgccccgggaccttttcatgcttgtgtgcaatgggcttccagggccccaggtgtgagggtaaactccgcccatcttgcgcagacagcccatgtaggaatagggccacttgccaagatagccctcaagggcctcggtgtttgtgcccaactggatacactggtggatcctgccaaaccctgatggacctgtgcgcgcagaagccctgcccaagaaatagtcactgcctgcagactgggccctcattccattgcctgtgtttacaaggatggaccggccccctttgcaacctgccactgtcttcttgccagaaggccgcactatcccagggtatcgatgtcagcagtctgtgccataatgggggcctgtgtgttgatagtggaccttcatatttttgtcactgtccgcctggtttccaaggtagcctttgtcaggatcatgtaaacccttgtgaaagtcgtccgtgtcaaaacggagcaacttgtatggctcaaccaagcggttatctttgccagtgcgcgccagggtacgatggccagaactgttcgaaggaactggacgcatgccaaagccaaccctgccataatcatggtacctgcacacctaaacctggtggattccactgcgcctgcccccctggatttgtcggcctcaggtgtgagggtgacgtcgatgagtgtttggaccaaccgtgccacccaactggaactgctgcttgccatagtttagctaacgcattctattgtcagtgcctgcccggccataccggacaatggtgcgaggtggaaattgacccctgtcattcacagccttgtttccacggcggaacgtgcgaggccacagcaggaagcccactagggttcatctgccactgtcctaaggggtttgagggccccacctgtagccatagagcccccagctgtggcttccaccactgccaccatggcggattgtgtttgccttctcctaaacccgggtttccaccacgctgtgcctgccttagcggttacggcggcccagattgcctcactcctcctgcccccaaaggctgcgggccaccatctccctgtctgtacaatggttcctgttctgaaacgaccgggctggggggccctgggttcaggtgcagctgtccgcactccagccccggacctagatgccagaaacctggcgcaaagggatgcgagggacgttccggagatggcgcctgtgatgctgggtgttctggacccggtggaaattgggatgggggtgattgctctctcggtgtgccagatccctggaagggctgcccgtcacattccagatgttggttgcttttccgtgacggacagtgccacccccagtgtgattcggaggagtgcttgtttgatggctacgattgtgagacaccccccgcttgcactcctgcatatgatcagtattgtcacgatcatttccataatggccattgcgaaaaggggtgcaacacggcagagtgcgggtgggatggcggtgattgccggcccgaagacggtgatcccgaatggggaccatcccttgctcttctcgtggtcctctcaccacctgccctggatcaacagctgtttgccctcgcccgcgtcctgtccttaactttacgggttggcctttgggtgagaaaagatagagacgggcgtgacatggtgtatccctacccaggagcgcgcgccgaagaaaaactgggtgggacaagggatcctacctaccaggagagggcagcgccgcaaacacagccactgggcaaggaaaccgattccctgtctgctggctttgtggtggtgatgggtgtcgatttatcgcggtgcggaccagatcatcccgcatctaggtgcccatgggaccctggccttctattgaggttcctcgctgccatggctgctgtaggagcccttgaaccgctgctgcctggccccctgctcgctgtccacccccacgctgggacagcccccccggccaatcagttgccctggcctgttctctgtagtcccgtcgccggtgtaatactattggcactgggggccctgctggtcctgcaactgattcgccgtaggcggagggaacatggtgccctgtggttgccccctggctttactagaaggccccggactcaatccgccccgcataggcggcgaccacccctgggggaagactcaattgggttgaaggctctgaagcccaaggccgaggtggacgaagacggggtagttatgtgctctggacctgaggagggagaagaagtggggcaagccgaggaaacgggcccaccctcaacctgtcagctctggtcgctgtctggaggatgtggtgccttgccccaggctgcaatgctgacccctcctcaagagtccgagatggaagctcccgacctggatactagaggtccagatggtgtgaccccactgatgtctgccgtttgttgcggcgaggtccaatccggaaccttccagggtgcttggctgggttgtcccgagccatgggagccgctgctggatggtggggcctgtcctcaagcacataccgttggcacaggagagacacctctccacctagcggcacggttttctcgtcctactgccgctagacgtctacttgaggcgggagccaatccgaaccagccagaccgggccggccgaacaccacttcacgccgcggtggccgccgatgctagggaggtgtgccagcttctccttcgctctagacaaactgccgtcgatgcaaggacggaagacggtaccacacccctgatgctggccgctaggctggccgtggaagatctcgtcgaggaactgatagccgcacaggcggatgtcggagccagagacaagtggggcaagacggcgcttcactgggccgccgctgttaataacgcaagggccgcacgatccctcctgcaggctggcgctgacaaggacgcccaggataaccgtgagcagactccgctgtttctggcagcaagagagggggctgtggaggtcgctcagctacttcttggcctgggcgccgcgcgcgaactgagggaccaggctgggcttgcacctgcggatgtggcgcatcagcgaaaccactgggaccttctgactctgctcgagggcgctggtccacccgaagcacggcacaaagctacacctggaagagaagccggccctttccctagggctcgcaccgtctctgtgagtgttcctccgcatggtggcggagctctccctcgttgtagaacattatctgccggagcaggacccagaggaggaggcgcatgtctccaggccagaacatggtcagtagatctggccgccagaggtggcggcgcgtacagtcattgtagatccttgtctggtgtgggcgctggcggcggacctacaccccgaggtcgcagattctccgccggcatgcgtggccctagacccaatcccgccatcatgagggggcggtatggggtggccgcaggccggggagggagagttagcactgatgactggccatgcgattgggtggcactcggcgcgtgcggcagtgccagtaatatcccaatccctcctccgtgtcttacgccaagtcctgagagaggttcaccacagctggattgtggccccccagctctccaggaaatgcctattaaccaggggggcgaaggtaagaagtag

SEQ ID NO: 197527 - DNA, 3147 bp, Artificial Sequence
  Description of Artificial Sequence: Synthetic coding sequence
tgcgcccccggctacgacggccagaactgcagcaaggagctggacgcctgtcagagccagccctgtcacaaccacgggacctgtactcctaagccgggcgggtttcactgcgcttgcccaccgggattcgtaggtctgcgctgcgaaggtgacgtcgatgagtgtctggatcagccgtgccatcctacaggcaccgccgcatgtcattccttggccaacgctttttactgccagtgcctgcccgggcacactggccagtggtgtgaggtcgagattgatccctgtcatagccagccatgtttccatggtggcacttgtgaagcgactgctggatctcccctcgggttcatatgccactgccccaaaggattcgaaggtccaacatgcagtcatagagccccgagctgcggctttcatcattgccatcatggaggactgtgtttaccttccccaaaacccgggttcccccccagatgcgcctgtttgagtgggtacgggggcccagattgccttaccccacctgctccaaaaggctgtggccctccttcaccatgcctctataatgggtcttgttccgaaactaccgggctgggcggccctgggttccgttgttcatgtccacattcttcacctggaccccggtgccagaaacctggcgctaaaggatgtgagggccggtcaggggatggagcctgtgatgccggatgttctggccccggcgggaactgggacggtggagactgctccctgggcgtaccggacccatggaaaggctgcccatcccacagccggtgctggttgctgtttagagacggacagtgtcatccgcaatgcgattcggaagagtgcctgtttgacggctacgattgtgagacgccacccgcgtgtacgccggcatacgaccagtattgtcatgatcatttccataacggccattgtgagaagggctgtaacaccgccgagtgcgggtgggacggtggagattgtcgacctgaggacggtgaccccgaatggggtccttctctagcactcttggtcgtgctcagcccccccgcccttgaccagcagctatttgccctggcgagagtgctgagcctcacactgcgcgtgggactgtgggtccggaaagaccgagatggccgggatatggtctatccttaccccggtgctcgagctgaggagaaactcggcggcacaagagaccccacctatcaggaacgggctgcaccgcagacccagccacttgggaaagagactgatagcttgtccgccgggtttgtggtggtcatgggcgtggacctctctagatgtggccccgaccaccctgcatcaaggtgcccttgggacccgggcctgctgttaagatttctggccgctatggccgccgttggtgccctcgagccactgctacccggccccctgttggcggtgcacccacacgccggaactgccccacccgcaaaccagctcccgtggccagtgctctgctccccagtggccggtgttatcttgctggcgctgggagcgctgttggtgctgcaactcattcgacgtcgccggcgtgagcacggggccctctggctacctcccggtttcacccgtcgcccacggacccagtctgcgccacataggcggagaccccccctgggtgaggactcgattggacttaaagccctgaagccaaaggctgaggtagatgaggatggcgttgtgatgtgcagcggaccagaggagggtgaggaggttgggcaagcagaggagacaggcccacctagtacgtgtcaattatggtctctctctggtggctgcggtgcattacctcaagcagccatgcttacacctcctcaggaaagtgaaatggaggccccagacttagataccaggggcccagatggagtgacccccttgatgagcgcagtgtgttgcggggaggttcagtctggcactttccagggtgcatggctcgggtgcccagagccctgggaaccgctcctagacggcggagcttgccctcaggcacatactgtgggaaccggcgaaacgcccttgcaccttgccgcccgattttcacgccctaccgcagcccgccgcttgttggaagcaggcgcaaatcctaaccagcccgatagggccggacgaacacccctgcatgccgctgtggcagccgatgcacgagaggtgtgccagctgttactaaggagccggcagaccgccgtagatgcccgaacggaggacggtaccactcccctgatgctggctgcccgccttgcggtggaagacctggttgaggaacttattgcagcccaggccgatgtgggagcaagagacaaatggggcaagactgctctacactgggccgccgccgtcaataacgccagagcagcccggagtttgctgcaggccggggccgacaaggacgcccaggataatcgcgaacagacaccattgttcctggcggctcgagagggagccgtggaggtcgcccagcttctcttgggcctcggagccgcccgcgagctgagggatcaagcagggcttgcacctgccgacgtcgcccatcagaggaatcactgggacttactcactcttctggagggagccggcccaccggaggcccgacataaggctacgcccggccgcgaagcggggccttttccaagggccagaaccgtttccgtgtctgtgccaccacacggcgggggcgccctccccaggtgtagaacactctcggctggggctgggcctagaggagggggcgcttgcttgcaggcacgaacttggtctgtagatctcgccgctcggggaggaggagcctatagccactgcagaagtctgtcaggagtgggcgccggaggcggaccgacgccacggggtcgccgtttctccgcgggcatgcgcggcccacgccccaaccccgccattatgcgcggccgctatggggtagccgcagggagggggggaagagtatcaacggatgactggccttgtgattgggtggctctaggagcatgtggatccgcgagcaatattcctattccccctccatgcttgacaccttcccctgagaggggctcaccccagctggactgtgggccccctgccttgcaggagatgccaatcaaccaaggaggcgaaggaaaaaagtag

SEQ ID NO: 197528 - DNA, 6018 bp, Artificial Sequence
  Description of Artificial Sequence: Synthetic coding sequence
atgcagccccccagcctgctgctgctgctgctgctgctgctgctgctgctgctctgtgttagtgtggtacggccaaggggcctgctgtgcggcagcttcccagaaccttgcgccaatggggggacctgccttagcctctctctgggccagggcacctgccagtgtgcacctggtttcctgggggagacttgccaattcccagacccctgccaaaacgcccaactgtgccagaatggaggcagctgccaagctttgctgccggctcccctgggtttgccgagctccccttctccgctgactccctccttcctgtgtacctgtcttcctggctttacgggtgaacgttgccaggctcaactagaggacccatgtcctccaagcttttgctcaaagagagggcgttgccacatccaggccagcggaaggcctcaatgcagctgcatgcccgggtggacgggagagcagtgtcagctgagagacttctgtagtgccaatccttgtgtaaacggcggtgtgtgtctggccacatacccacagatccagtgccattgccctccagggtttgaaggccacgcctgcgagagagatgttaacgaatgctttcaagaccctgggccatgtcctaagggaacctcctgccataacaccctgggctctttccagtgtctatgcccagtcgggcaggaggggccacgatgcgagcttcgcgctgggccttgcccccccaggggctgcagtaacggaggaacgtgccagctcatgcccgagaaggactccacatttcacctttgcttatgcccccccggttttatcggcccagactgcgaagtgaaccccgataattgtgtgagccaccagtgtcagaacgggggcacctgtcaagacggcttggacacctacacatgcctctgccctgagacctggacaggatgggattgtagtgaagacgtggacgagtgtgaagcacaaggccctccccactgccgcaacggcggcacctgtcagaatagcgctgggagcttccactgcgtatgtgtctcagggtggggcggtacttcctgtgaggaaaacctggatgactgtatagctgctacttgcgctccgggatccacctgtattgacagagtggggagcttcagttgtttgtgcccccctggcaggactgggttgctgtgtcatctcgaagacatgtgcttgagccagccttgtcatggggacgcccagtgctcaaccaacccactgacaggcagtaccctttgcctatgccagcccggctactccgggcccacttgtcaccaggatttggatgaatgtcttatggcacaacaggggccatccccttgcgagcatgggggctcctgtctgaacactcccggttcctttaattgtctgtgtcctcccgggtacaccggctcacgctgcgaggcggaccacaatgaatgcctgtcgcagccctgtcatccgggctcgacctgtctcgaccttctggccacgtttcattgtttgtgcccccccggattggaaggtcagctatgtgaagtggaaaccaatgagtgcgcctcagccccttgtttgaaccacgccgattgtcacgaccttttgaacggcttccagtgtatctgtctgcctgggttctctggtacccgttgcgaagaggacatcgacgagtgccggtccagcccatgtgccaatggcggtcaatgtcaagaccagccgggggcatttcattgtaagtgcctgcccggatttgaagggccccgttgccaaacggaagttgacgagtgcctctctgatccctgccccgttggcgcctcatgcttggacctgcccggagcattcttctgtctctgcccatctgggtttacaggacagctctgcgaggtgcctctttgcgcacccaacctgtgccagccaaagcagatctgcaaggaccagaaagataaggcaaattgtttgtgtccagacggctccccgggctgtgcacctcccgaggacaattgtacctgtcaccacggacactgccaaaggtcctcgtgtgtgtgcgatgtcggatggacaggtcccgagtgcgaagccgagctcggcgggtgtatcagcgcgccttgtgcccacggggggacatgttatcctcagccctccggctacaactgcacctgtcctaccggctataccggacccacatgctctgaggaaatgactgcctgtcattccggcccgtgtttgaatgggggcagctgtaacccctctcccggcgggtactattgtacatgccccccaagccacactggccctcaatgtcaaacgtccacagattattgcgtgtctgccccctgtttcaatggtggcacctgcgtgaatcggccagggactttcagctgcttgtgtgcaatgggattccaaggtccccgatgtgagggtaaactcagaccatcatgtgcagatagcccatgtaggaacagggcaacgtgccaggatagcccacaggggcctcgatgcctctgtccgaccgggtacactggcggctcatgtcagaccctcatggacctatgtgcccaaaagccctgcccccgcaacagtcattgtctgcagacaggtccaagcttccactgcctgtgcctccagggctggacgggtcctctgtgcaatctgccattgtcatcctgccagaaagccgcattgtcccagggaatcgacgtaagttctctatgccacaacgggggcctatgtgtggattccgggccttcctatttctgtcactgtccccccggctttcaaggatcactgtgccaagaccacgttaacccctgtgaatcaagaccatgtcagaacggtgccacatgtatggcacagccatccggttacctctgtcaatgtgcccccggctacgacgggcagaactgtagtaaggagttagatgcttgtcagtcacagccctgccataatcacgggacttgtacaccaaaacctgggggcttccattgtgcgtgtccccctggattcgtgggtttgaggtgcgagggtgatgtcgacgaatgcctggaccagccttgtcacccgaccgggacagcagcctgccattccctcgccaacgcattttattgtcagtgccttcctggccacaccggccagtggtgcgaagtcgaaatcgatccttgtcatagccagccatgcttccatggcggcacctgcgaagccaccgccgggagtccactcggattcatctgtcactgtccaaaaggattcgagggtccaacctgctcgcacagggcaccttcatgcggattccaccactgccaccatggcggtctctgtctcccgtcccccaagccgggtttccctcctagatgcgcgtgtctctcgggctacggtggtcccgattgccttaccccacccgctcccaagggttgtgggcccccgtcaccctgtctgtacaacggcagctgtagcgagacaacaggtctggggggacctggtttccgttgcagttgcccccattcaagcccaggaccgaggtgtcagaaacccggcgccaaggggtgcgaagggcgatcaggcgatggcgcgtgtgatgctgggtgttccggtccaggcggtaattgggacggtggcgattgttccctcggcgtgccagatccgtggaagggatgccctagtcacagccgatgctggctgctgtttagggatgggcagtgccacccccagtgcgactcagaggagtgcctgttcgatggatacgactgcgaaactcccccagcttgcacgccagcctacgatcagtactgccatgaccacttccataacggacattgtgagaaaggttgcaacaccgctgagtgcgggtgggatgggggagactgccgcccggaggacggtgacccggagtgggggccatccctagcactcttggtggtcctgtctcctcccgccctggaccagcaactgttcgcgcttgctcgcgttctgtctttaacactgcgggtgggcctgtgggtccggaaggacagggacggcagggacatggtgtacccttatcctggagcgcgtgcggaggagaaactcggcggaaccagagatccaacataccaagagcgtgctgcaccccagacgcagcccttaggcaaagaaaccgattcgctctcagcaggatttgtggtggtgatgggtgtcgatctgtcccgctgtggaccagatcatcccgcaagccggtgtccctgggatccaggtttgttgctccgcttcctggctgccatggctgcagtaggtgctctggagcctcttctcccagggcctctgctggcggttcaccctcatgcaggtactgccccccctgctaaccaattgccttggcctgtgctttgcagcccagtggccggcgtgattctcctcgcattaggagccctgctggtgctccagctcattcggcgccgccggagggaacatggagccttatggctgcccccaggatttacccgtagacctcggacccagtctgcccctcaccgccgaagaccacctctgggcgaggatagtattggtttgaaagccctgaagcctaaggcggaagtggacgaagacggggtagttatgtgctccggccctgaggagggagaggaggtcgggcaagcagaggagaccggccctccatctacctgtcaactgtggtcattatcaggtggatgtggagccctcccccaggctgctatgttgacccccccgcaggaaagcgaaatggaggccccagaccttgatacccggggacctgatggcgtgacccccttgatgtccgccgtgtgttgcggcgaagtccagtcaggcacattccaaggtgcctggctgggctgcccagagccctgggagccactgctcgacgggggagcttgcccccaggcccataccgtcgggactggcgaaacgccgttgcacctggcggcgcgattcagcaggccaaccgccgcccgacgtctgttagaggcaggcgccaaccctaatcagcccgaccgcgccggtaggacacccttacacgctgccgtggcagcggacgcccgggaggtgtgtcagttactgctgcggagccgtcagacggccgtggatgccagaacagaggacggtacaactcccctgatgctggccgctcgattggcagtggaagacctcgtggaagagctcatagcggcccaggccgatgtgggagccagagataaatggggtaagactgcactccactgggcagccgcggtgaataacgctcgagcggcccgaagccttttgcaagcaggcgccgacaaggatgcgcaggataatagggagcagactcccctgtttctcgccgccagggagggtgcagtggaggttgcccagttgctcttaggattgggcgctgcccgggagctgagggatcaagccggcctggcccccgccgatgtcgcccatcagagaaaccattgggatctgcttaccctcctggaaggtgctgggcctcccgaagcccgccacaaagctaccccgggacgggaagccggacccttcccacgggccagaacggttagtgtctctgtccccccacacggcgggggcgctctgccccgttgtaggacgctttctgccggcgccgggcctcgcggcggaggtgcatgtcttcaggcccggacatggagtgtcgacttggcagctcgtggcggcggagcgtactcgcactgtagatcgctgtctggcgttggggccggtggtggacccactcctcggggcaggcggtttagtgccgggatgagagggcctcggcccaatccagccatcatgagggggcgttacggggttgctgccggaaggggcgggcgggtcagtacagacgattggccatgcgattgggtggcgctcggagcatgcggcagtgcctctaacatccctatcccacccccatgtctgacgccttcccctgagcgaggctcccctcagctggattgtgggccccccgccttgcaagagatgccaatcaatcaaggaggggagggaaagaagtag

SEQ ID NO: 197529 - DNA, 6012 bp, Artificial Sequence
  Description of Artificial Sequence: Synthetic coding sequence
atgcagccccccagcctgctgctgctgctgctgctgctgctgctgctttgtgtgagcgtcgtgcgaccaagaggcctactttgcggctcatttcctgagccctgcgcgaacggcggaacgtgcctgagcctaagcctcggtcagggaacatgtcagtgtgccccagggttcctaggggaaacatgccagtttccagacccgtgccagaacgcccagctgtgtcaaaatggtggcagctgccaggccttactacctgctcccctgggacttccctcgtctccctcgcctcttactccatccttcttatgtacgtgcctccccggtttcacaggtgagcggtgccaggctcagctagaggatccctgccctccttcattctgctcaaaacgtggcaggtgccacattcaagcttccggcagacctcaatgctcatgtatgcctggctggactggggaacagtgtcagctccgggatttctgctccgccaatccatgtgttaacgggggagtgtgcctggccacctaccctcagatccagtgtcactgtccccccggcttcgaagggcacgcatgtgaacgggacgtcaacgagtgcttccaggaccctgggccatgtccgaaaggaacctcctgccacaatacacttggctcattccaatgcctgtgccctgtcggccaggagggcccacggtgcgagctgcgcgccggaccgtgccctcccaggggctgtagcaatgggggcacgtgtcaacttatgcccgagaaagactcaacttttcatctctgcctatgtcctccaggatttatagggcccgactgcgaggtgaatccagacaattgtgtttcgcaccagtgtcaaaacggagggacttgtcaggacggcctggacacctacacctgcttgtgtccagaaacgtggacgggctgggactgtagcgaagatgtggacgagtgcgaaacacaaggtccgccacattgtaggaatggggggacttgccagaattcagcaggcagtttccactgtgtgtgtgtctccggctgggggggcactagctgtgaagagaacctggatgactgtatagccgccacctgtgctcctggtagcacctgtattgacagagtgggttcatttagttgtttgtgccctcccgggcgaaccggcctgttatgccacctggaggacatgtgtttgagccaaccttgccacggggatgcccagtgctccacaaacccacttacagggtctacgctgtgtttgtgtcagcctgggtatagcgggcctacctgtcaccaagacttggatgagtgtctgatggcccagcagggcccctcaccttgtgaacacggtggctcttgtttaaatactcctggaagttttaattgtctgtgcccccccggatatactggctcacgatgcgaagccgaccacaacgagtgtttaagccaaccctgccatcctggctcaacctgtttagacctgctcgccacttttcactgcctttgccctccagggcttgagggccagctctgcgaagtggagactaatgagtgtgcttctgcaccatgcctgaatcatgctgactgtcacgacctcctcaatgggtttcagtgcatttgcctccccggattctctggaacacgttgcgaggaggacattgacgaatgccgaagttctccctgtgccaatggcggacagtgccaggatcaacctggagcttttcactgtaaatgccttcctggttttgaaggccctagatgccagaccgaagttgatgagtgtctgagcgatccttgtcccgtaggcgcttcttgcttagacctgcccggagcattcttctgtctctgccctagtggcttcaccggccagctctgcgaagtgcctctgtgcgctccaaatctgtgccaacccaagcagatctgtaaagaccagaaagacaaggccaactgtctctgtcccgacggttcacccggttgcgctcctcccgaggataactgtacgtgtcatcacgggcattgccagcggagctcttgcgtctgcgatgtggggtggacaggcccagaatgcgaagcggagctgggaggctgtatctcagccccctgcgcgcacgggggtacgtgttatcctcagccatcagggtataattgtacttgtcctacaggatacaccggcccgacatgctccgaggagatgaccgcttgccactctggaccatgtctgaacggtgggtcttgcaacccatctcctgggggctattattgcacctgcccccctagccatacgggtccgcagtgccaaacctccaccgattactgtgtatccgctccatgcttcaatgggggcacatgcgtgaataggccgggaacattctcttgtctatgtgccatgggattccagggacctcgctgtgagggcaaactgaggccgagctgtgcagacagtccgtgcagaaacagagctacttgccaggactcacctcagggccctcgttgcctctgtcctactggttatacaggaggaagctgtcaaactctgatggacctgtgcgcccagaagccttgtcccaggaacagtcactgtctgcagacaggaccaagcttccactgcctgtgcctgcaaggttggaccgggcctttgtgtaaccttcctctctctagctgccagaaggccgctctctcccaagggatagacgtatcttccctctgtcacaatggcggcctctgtgtcgatagtggcccctcctatttttgtcactgtccccccggcttccagggctctctgtgccaggaccacgtgaatccctgcgaatctaggccgtgccagaatggtgccacttgtatggcccagccttcaggctacctgtgtcagtgcgcacccggatatgacggacagaactgtagcaaggagctggacgcctgtcagtcacagccatgccacaaccatggcacatgtacgcctaagcctgggggattccactgtgcatgtcctccaggatttgtgggcctgagatgtgaaggtgacgtagacgaatgtttggaccagccgtgccaccctacggggacggccgcgtgtcatagtcttgctaatgcattttattgccagtgtctaccaggccacactggtcagtggtgtgaggtggaaatcgacccctgtcatagccaaccttgcttccacggcggcacatgcgaagccaccgccggtagcccattggggttcatttgtcactgtccaaaaggctttgaaggaccaacgtgttcccaccgcgcacccagctgcggtttccaccattgccatcatggcgggctctgtctgccatctcctaagcccggcttccctccgaggtgtgcctgtcttagtggatatggcgggcctgattgcctcacccccccagctccaaaaggctgcggcccaccgtctccttgcttatacaatggttcgtgttccgagacgacaggactgggtggccccggcttccgctgcagctgcccccactcttcccccggaccacggtgtcagaaacccggtgctaaaggctgtgagggccgcagtggtgatggcgcttgcgatgccgggtgttccggtccaggtggcaattgggacggaggagactgttctctgggcgtccctgacccttggaagggctgcccctctcactctcgctgttggctcctttttcgggacggacaatgtcacccgcagtgcgatagcgaggaatgcctcttcgatggctacgattgtgaaacccctcccgcctgtacacctgcgtacgatcagtactgccacgaccacttccataacgggcattgcgagaaaggctgtaatacagcggagtgcggatgggacggtggggactgcaggcccgaggacggcgatcctgagtgggggcccagcctcgcactgctagtggtgttgtcgccaccagctctggaccaacagctgtttgctctggcaagggtcctgtctttgaccctgcgggtgggactgtgggtgcgcaaggacagggacgggcgcgacatggtctacccttatcctggagcccgggcagaagaaaagttgggcggcacccgtgaccccacttatcaggagagggcggccccccaaacacagcctctcggaaaagagaccgactccctaagtgccggtttcgtggtcgtaatgggcgtggacctttcccggtgcggccccgaccaccccgccagccggtgtccctgggatccaggtcttttactacgctttcttgctgctatggctgcggtgggagcgctggaacccttgctccccggaccgctcctagccgtgcacccgcacgccggaacagcacctccagcaaaccagctgccgtggccggtgctctgtagccccgtggcaggagtcattctgctggctttaggcgcactgcttgtactacaactcattagacggagacgtagagaacacggtgctctctggctgccacccgggttcacacgaagaccccgaacccagagcgcacctcatcggagacgccccccactgggagaagatagtatcggcctgaaggctctgaaaccaaaggcggaggtcgatgaggatggtgtggttatgtgtagcggaccagaagagggcgaagaagtgggccaggcagaagaaaccggccctccaagcacgtgtcaactatggtccctgtccggtggctgtggcgctctgccgcaggctgctatgctgacccctccccaagaaagcgagatggaggcgcccgacctagatactcgtggacccgatggggtaactcccttgatgtcagccgtctgctgcggggaagtccaaagtggcacttttcaaggggcctggctggggtgccccgaaccctgggagcccctgttagacggaggtgcatgcccgcaagcacacaccgtggggaccggggagacaccgctgcatcttgccgccaggttttctcgtcccaccgctgcaaggcggctgctggaagcaggagctaaccccaaccaacccgaccgtgcgggaagaacacccctgcacgccgccgtagccgctgatgctagagaggtgtgtcagctcttactgcgatcaaggcagacagctgttgatgctagaaccgaggacggtacaaccccgcttatgctggcagcacggctggcggttgaggatctcgtagaagaactgattgccgcccaggcagacgtcggagcccgtgacaagtggggaaaaactgcactccactgggccgccgcggtcaataacgcccgcgccgctcgttctctgctgcaggctggtgccgataaagatgcacaagacaatcgcgagcagactccgctgtttcttgcagcccgcgaaggcgcagtcgaagtagcccagcttctgcttggccttggagccgcgcgcgagctgagagatcaggctggcctcgcacctgccgatgtggcacaccagaggaatcactgggatctgctcactttgcttgaaggagctggcccacccgaggcaaggcacaaggcaactcccggccgtgaagcgggtccttttccccgagctcgtacagtgtcagtcagcgtccctccccacggcggaggagccttgccacgatgcagaacccttagtgccggcgctggaccaagggggggaggcgcatgcctgcaagctcggacctggagtgtcgaccttgccgcccgcggaggcggtgcttatagtcactgcaggtcattgagcggagtgggggccggaggtggtcctacaccaaggggcaggagattctcagccggtatgcgcggccctaggcccaaccccgctatcatgcgtggcagatacggcgtcgcagcgggacggggcgggagagtctccaccgatgattggccgtgcgattgggtcgcccttggggcatgtggctccgccagtaatatccccattccacccccctgtctgacaccgtcccccgagcgcggaagcccccagttggactgtggcccacctgcactgcaggagatgcccattaatcagggcggagagggcaaaaaatag

SEQ ID NO: 197530 - DNA, 561 bp, Artificial Sequence
  Description of Artificial Sequence: Synthetic coding sequence
atgagcgccgtgtgctgcggcgaggtgcagagcggcaccttccagggggcatggctcggatgccccgaaccctgggagccactgttggacggcggagcatgcccgcaagctcataccgttgggaccggcgagactccgcttcaccttgccgcccgcttctcaagacccacagcggccaggcggctgctggaagccggcgcgaaccctaatcaacccgatcgggctggtcgcaccccacttcacgctgctgtggccgctgatgctagagaggtctgccagctgctgctcagatccaggcagacagccgtcgacgcgaggacggaggatggcactaccccacttatgctagccgcccgcctcgcagtggaggacctggtggaagagctgattgccgcccaagctgacgtgggcgctcgtgacaaatggggtgccgacgctgccattccaggaggagctggtcgctcaggcgggagtagccccgcaaccgctggtgccggtggcagcccaagagccgctggtccgggatgggcttctgctgggggacgtaggtcgcctacgtag

SEQ ID NO: 197531 - DNA, 6009 bp, Artificial Sequence
  Description of Artificial Sequence: Synthetic coding sequence
atgcagccccccagcctgctgctgctgctgctgctgctgctgctgtgcgtgtcagtagtgcgaccacgcggacttctgtgcggttcatttccggaaccttgcgcaaacggcggaacatgtttgtctctttccttaggtcaggggacgtgccagtgcgcccccggcttcctgggggagacctgccagttccctgacccttgccagaatgctcaactctgccagaacggaggaagctgccaggccctcctgccagccccgctgggcttgccatcgtccccaagtcccctcaccccaagttttttgtgcacatgtctacccggcttcaccggggagagatgtcaggcccagctcgaggatccatgtccaccaagcttttgtagtaagcgcggtcggtgtcacatacaagccagtggacgtcctcagtgcagctgtatgccagggtggacaggtgagcagtgtcaactgcgagacttttgctcggccaacccatgtgtcaatggcggagtctgcctggctacctatcctcagatccagtgccattgccccccaggattcgagggacatgcctgcgaacgggacgtaaatgaatgtttccaggacccaggcccttgtcctaaaggaacgtcgtgtcacaacaccctgggatcttttcagtgcctgtgtcccgtcgggcaagagggtcctcgctgtgaactccgcgcgggcccgtgtccaccccggggctgtagtaatgggggaacttgtcagctcatgcctgagaaagattctaccttccacctctgcctatgtccaccaggctttatcggtcctgactgcgaggttaatcctgacaactgcgtctctcatcagtgccagaacggagggacctgtcaggatgggctagacacctacacatgcctttgccccgagacctggactggctgggattgtagcgaggacgttgacgagtgtgaaacacagggtccaccgcattgcagaaacggaggaacctgtcagaacagcgcgggctcatttcactgtgtgtgtgtgagtggatggggcgggacctcatgcgaggagaacctggacgactgtattgcagctacctgtgcaccgggaagtacctgcatcgatagagtgggtagcttttcatgcttgtgtccgcccggtagaactggcctgctgtgtcatcttgaggatatgtgtcttagtcaaccctgtcatggagacgcccagtgttcaacaaaccccctcaccgggagcaccctttgcctgtgccagcccggatattctggacctacatgtcatcaggacctcgacgagtgcctaatggcacagcaaggaccaagcccctgcgaacatggcggcagctgcctgaacaccccaggaagcttcaactgcctctgcccccctggatacacaggatcccgttgcgaggcagaccataatgagtgtttgagtcaaccctgccaccctgggtctacctgcctggatctcttggccacatttcactgcctatgtcctccgggacttgaaggacagctctgtgaggtcgagacaaatgagtgtgcaagcgccccatgcctcaaccatgcagactgccacgatctgttaaacggctttcaatgtatctgtctgcccggcttcagcggcacccgctgtgaagaggacatcgacgaatgtcgctcctctccatgcgctaatggcggacagtgtcaggaccagccaggggcttttcattgtaaatgcctaccggggttcgagggccccagatgccagacagaggtagatgaatgtctctccgacccctgccccgtgggggccagttgcctggacctccctggtgccttcttctgcctgtgtccaagtgggttcacgggtcagctgtgtgaggtccctctctgcgctccgaacttgtgtcagcctaagcaaatctgcaaagaccaaaaggacaaggctaattgcctctgtccggacggaagccccggctgcgcgcctcccgaggacaactgcacctgccaccacggacactgccagcgcagctcctgcgtctgcgatgttggctggacaggtccagaatgcgaagctgagctcggcggatgtatcagcgcaccttgcgcgcatggcggaacgtgttatcctcagccctccggctataattgtacttgccccacaggctacacaggccccacctgctccgaggaaatgaccgcctgccactcagggccatgcctgaacggaggcagttgtaacccctctcctggtggatattactgtacatgtcccccttcacatacaggcccccagtgccaaaccagtacggactactgcgtcagtgctccttgcttcaacggagggacatgcgttaacagacctggcactttctcttgcctgtgtgcaatgggattccagggccctcgctgcgagggtaaattacgcccttcctgtgccgatagcccatgccgcaaccgcgctacttgtcaagacagcccacaaggtcctagatgtctgtgcccaactggctacaccggaggctcttgccagactctgatggacctgtgtgctcagaagccatgtcctcggaatagtcactgtctgcagaccggcccctccttccattgtctttgccttcaagggtggaccggcccactatgcaacctgccgctgtcttcttgtcaaaaagctgccctttcacagggaatcgacgtgagctcactttgccataatgggggcctctgcgttgacagcggcccatcttatttctgccactgcccccctggatttcaggggagcctgtgtcaggatcatgtgaatccttgcgaatcacgaccctgtcaaaacggagctacctgcatggcacaaccttccggttatctttgtcaatgcgctcccggttacgacggtcagaactgctctaaagagctggatgcatgccagtcccagccttgccacaatcatgggacctgcacccctaaacccggcgggttccactgcgcctgccctcctgggtttgtggggctgcgctgcgagggtgatgttgacgagtgtctcgatcagccctgtcatcccacaggcaccgctgcctgtcattctctcgccaacgccttttattgccagtgcctgccgggtcacaccgggcagtggtgcgaagtcgaaattgacccatgtcactcccagccctgcttccacggcgggacctgcgaggctacagcgggcagcccacttggatttatttgtcattgccccaaaggttttgaggggccaacttgctctcaccgagctccatcctgcggatttcatcactgtcaccatggcggactgtgcctgccctcccccaaaccaggttttccacccaggtgcgcttgtttgtctgggtacggaggccccgattgtttgacccctcccgctccaaaggggtgtggccctccaagcccttgcctctacaacggttcctgttcagaaacaacaggcttaggcggtcctggcttccgctgttcttgtccccacagctcgccgggcccccgctgtcaaaagcccggcgctaagggatgcgaggggcgcagcggggacggagcttgtgatgctggttgttctggcccagggggtaattgggatggcggtgattgtagcctgggagtccctgatccatggaagggctgcccctcccactcaaggtgttggctactcttcagagatggacaatgtcacccacaatgcgacagtgaggagtgtttgtttgacggatatgactgcgagaccccccccgcgtgcacacccgcctacgaccaatactgccatgatcatttccacaatggtcactgcgagaaggggtgtaacacggccgagtgtggctgggacggcggggactgccggccggaagacggcgatcctgagtggggtcccagcttagcactactcgtggttctgtcccctcctgccctggaccaacagctctttgccctcgccagggtattatcgctgacattgagggtgggtctgtgggtgagaaaggaccgtgatggcagagacatggtgtatccttacccgggagcgcgggcagaggagaagctgggcggtacccgggatcctacctaccaggagcgggcggcacctcagacccaaccattgggcaaagaaacagacagtctctcagccggtttcgtcgtggtgatgggagtagacctgtcaaggtgtggccctgatcatcccgcctcccgttgcccttgggatcccggtctcctgctacgtttcctggccgccatggctgcagtcggggccctggaacctctactgccgggtcccctgctggctgtgcatccccatgctgggacggcacctccggccaaccagctaccgtggccagtgctctgttcccccgttgccggcgtgatcctattggcactgggcgccttactagtgcttcagttgataaggagaaggaggcgggaacatggcgctctatggctgccacccggcttcacaagaaggccccggacgcaatcagcaccacatcggcggagaccaccactgggagaggacagcatcggcttaaaggccttaaagcccaaagcagaagtggatgaggacggggtcgtgatgtgctcaggacccgaagagggagaggaagtcggccaggccgaagaaacggggccaccttccacgtgccagctctggagcctctccggcggttgtggcgccctgcctcaggccgccatgctgacaccgccccaggagagtgaaatggaagcccctgatctggataccaggggtccagacggcgtcactcctttgatgagcgcggtgtgctgtggagaagtccagtccggcacctttcagggggcctggctaggctgtcccgaaccctgggagcctttgttagacggcggcgcatgccctcaggcccataccgtggggacaggcgagactcctctgcacctcgctgccagatttagcaggcccacagctgcaagacgcttgctggaagcgggagcgaaccccaatcagccggatagagctggacgcacccctctccacgccgctgttgctgctgacgcgagagaggtgtgccaattgttgctgagatcaaggcagactgcagtggacgctaggacagaggatggcaccactcccctgatgctggcggctaggctggcagtcgaggacttagtcgaagaactaatcgcagctcaggccgacgtgggtgctcgcgataagtgggggaagacggctctccattgggcagcagcagtgaacaatgcacgggcggctagaagcctgctgcaggctggcgccgacaaagatgcccaggacaaccgcgaacagactccactgtttctggctgctagggagggtgccgtcgaggttgcacagttgcttctgggtctgggagctgccagggaactcagggaccaagcgggattagcccctgccgacgttgcacatcaaagaaaccactgggatctccttacattactcgagggcgccgggccccctgaagccagacacaaggccacgccaggacgcgaagctggcccatttcccagggccaggacagtctccgttagtgtcccaccccacgggggaggtgctctcccccggtgtcgcaccctctccgctggcgcaggacccagaggcggaggagcctgcctgcaagctagaacatggagcgttgatctggctgcccggggtggcggtgcttattctcattgcagatctctgtctggcgtcggcgccggcggtgggcccacgcctcggggacgaagattttctgccgggatgaggggcccccggccgaaccctgctattatgcggggcaggtacggcgtggcagccggccgagggggccgggtctccacagatgactggccctgcgactgggttgcactgggtgcctgcgggtccgcaagtaacattcccatcccccctccttgtttgaccccgagtcctgagcgcgggtccccacagttggattgcgggccgcctgccctacaggaaatgcccatcaaccaggggggagaaggtaagaagtag

SEQ ID NO: 197532 - DNA, 6012 bp, Artificial Sequence
  Description of Artificial Sequence: Synthetic coding sequence
atgcagccccccagcctgctgctgctgctgctgctgctgctgctgctctgcgtgtccgttgtgcgtccgagaggtctgctgtgtggttcatttcccgaaccctgcgccaacggcggaacatgtctctccctgtcgctcggccagggcacctgtcagtgtgctcctgggtttttgggggaaacatgtcagttccccgacccatgtcagaatgctcagctctgccagaacgggggttcctgccaagcactcctacctgcgcccttgggtctgccgtcgtcaccatcccccctcaccccctctttcctctgcacttgcttacccggctttacaggggaaaggtgccaggctaaactggaagatccttgccctccttctttttgttccaaacgcgggaggtgtcatatccaggccagcgggcgcccccagtgtagttgtatgcccgggtggaccggcgagcaatgtcaactcagggatttttgcagcgccaatccctgtgtgaacggaggcgtgtgtctggccacttatcctcagatccagtgccattgtccaccaggttttgaagggcacgcatgtgaacgcgacgtcaacgaatgctttcaagatcccggaccatgcccgaaaggaacttcatgccacaatacacttggttcattccagtgcctgtgtccagtcggacaggagggaccgcggtgcgagttgcgggccgggccgtgcccgcctcgcggctgctccaacggtggcacctgccaactaatgcccgagaaggacagtacattccatttgtgtttatgcccccctggatttatcggcccagattgtgaggtgaaccccgacaattgcgtttcacatcaatgtcagaatggaggaacttgccaggacggcctcgacacatacacttgtctttgtcccgagacatggactggctgggactgttctgaagatgtggacgaatgcgaaacccagggtcctccgcactgtcgcaacgggggcacatgccagaatagtgcaggatccttccattgcgtgtgtgtttctggatggggtggcacctcttgcgaggagaatctggacgattgtatagccgcgacctgtgcacctgggagcacctgtatcgatagagttgggagcttttcttgtctttgccctcccggccggactggacttctgtgccacctcgaagatatgtgcctgtcccaaccttgtcacggcgatgcgcagtgttcaacaaatccgctcacaggttctactttgtgtctgtgccaaccagggtattctggccccacatgccatcaggacctggatgaatgtctgatggcccaacagggcccgagcccttgcgagcatggtggcagctgcctgaacactcctggttccttcaattgtttgtgcccacccggatataccgggtctaggtgcgaggcggatcataatgaatgtcttagtcagccatgccatccaggcagcacatgcttggacctgctcgcaaccttccattgtctctgcccacctggactggagggccagctgtgtgaggtggagacaaacgagtgcgccagcgctccatgccttaaccacgccgactgccatgatcttctcaacgggttccaatgtatatgtctccctggcttttccggaacgagatgtgaggaggatatcgatgagtgtcgctcttctccttgcgcaaatgggggacagtgccaagatcagcccggtgcctttcactgtaagtgcctgcctggcttcgagggcccaaggtgccagacggaagtggacgagtgcctgtctgatccatgccccgtgggtgcatcatgtctcgatttgcctggggcatttttctgtctgtgtccgagtggtttcacaggacagttgtgcgaggtccccctgtgtgcccctaacctctgccaacccaagcagatatgtaaagatcaaaaggacaaagcgaactgtctgtgtcccgacgggtcacccggctgcgctcctcctgaagataattgcacatgtcaccacggacactgtcagcggagctcttgcgtatgtgacgtggggtggacgggcccggaatgtgaagctgaactgggcggctgtatctctgccccctgtgctcacgggggcacctgctacccccagccatccggatacaattgtacgtgcccaacaggatacactggacccacttgcagcgaagaaatgacagcctgccattccggtccctgtctcaatgggggatcatgtaacccaagcccaggtgggtactactgcacctgtcctcctagtcacaccggacctcaatgccaaacatccacggactactgcgtgtctgccccatgcttcaacggtggcacctgcgtaaaccggccaggcaccttctcctgcctctgcgccatgggttttcaaggtcccaggtgcgaagggaagctgcggccttcctgcgcagactccccctgccgaaaccgggctacttgtcaggacagcccacagggacctcggtgtctctgcccgacgggatatactggcgggagctgccagactttaatggacctgtgtgcccaaaagccctgtcctcgaaactcccattgtctgcaaactgggccctctttccattgtctatgcttacagggctggacagggccactctgcaatctgccactgtcttcctgccaaaaggccgccctctcccaggggatagacgtgtcaagtctttgtcacaatggaggactctgcgttgacagcggaccgtcgtatttttgccactgcccaccgggattccagggttctctgtgccaggatcatgtcaacccctgtgaatctaggccatgtcagaacggcgcaacttgtatggctcagccttctggttatttgtgtcaatgtgctccaggatatgatgggcaaaactgctccaaggagttagacgcatgtcagagtcagccctgtcacaaccacggcacttgtaccccaaaacctggaggtttccactgcgcctgcccccccggttttgtgggcttgcgatgtgagggggacgttgatgagtgcctggaccagccctgccatcccacagggacggctgcctgccatagcctcgctaacgccttctattgccagtgtctgccaggccatactggtcagtggtgcgaggtggagatcgatccttgccattcccaaccctgtttccacggaggcacctgtgaggcaaccgcaggaagtcctctagggttcatctgccattgtcccaagggatttgagggccccacttgtagccacagggcaccatcatgtgggttccatcactgccaccacggaggcctatgcttaccttcgcccaagccgggatttccaccacgttgtgcttgcctgtccggttacggcggacccgattgcctaaccccgcctgcccctaaaggctgtggaccccctagcccgtgcctgtataatgggtcctgttccgagacaacaggtctgggtggacccggtttccggtgctcttgcccccatagcagccccggaccacgctgtcagaaacccggggctaagggatgcgagggccgaagcggcgacggtgcatgtgacgccggctgttcaggcccaggcggcaattgggatggcggcgactgtagtctgggtgtgccggacccatggaaagggtgccctagccactcaagatgctggttactgttccgagatggacagtgtcaccctcagtgcgactctgaggagtgtctgtttgacggatacgactgtgagacaccccccgcctgcacccccgcctatgatcagtattgtcatgatcatttccataatggccactgcgagaaaggatgcaacaccgccgagtgcggatgggacgggggggattgtcggcccgaggacggagatccagaatggggaccgagtctggccttactggtggttcttagccccccagctttagatcagcagctttttgccctggccagggtgttgtccctcactctccgggtcgggctgtgggtgcggaaggaccgcgacgggagggacatggtatatccgtacccaggcgcccgtgccgaagaaaagctgggagggacacgcgatccaacctaccaagagcgagccgcccctcagacacaacccctcgggaaagagacagattccttgtctgctggattcgtcgtagtgatgggcgttgatttgagccgctgtggaccagaccatccagcttcaagatgtccttgggacccggggctgttgctgagattcctggccgcgatggctgctgttggggccctcgagccactcctccccgggcctctcctcgccgtgcatccccatgctgggaccgcccctccggctaaccaattgccatggccagttctatgttccccagtggccggggttatcctcttggctttgggggccctgctggttctgcaacttattcgtaggcgaagacgggaacacggcgccctgtggcttccccccggttttacacggagaccacgcacccaaagtgctccacatcgtcggcgaccacccttaggcgaggatagtattggattgaaagctctcaaacccaaagcggaggttgacgaagacggagttgtgatgtgcagtggcccagaagagggcgaggaggtggggcaggcagaagagactgggccccccagcacatgtcaactgtggtccttgagtgggggttgcggagccctgccccaggccgccatgttaacaccaccacaggaatccgaaatggaggcgcctgatctggacactcgaggacccgatggtgtcactccactgatgtctgccgtgtgttgcggggaggtccaaagtggtactttccaaggcgcatggctcggctgcccggagccctgggaacctctgctggatggtggcgcttgtccacaggctcatactgttggaactggagaaactcctctgcatttggccgctcggttttctaggccaactgctgcccggcggctgttagaagcaggagcaaatcctaaccagcccgatcgggctgggagaacccctctacacgccgctgtcgctgcagatgctcgggaagtctgccagctgctgctgcgcagtcggcagacagcggtggatgcccgtacggaggatggaacaactcccttaatgctggccgcaaggcttgcagtcgaggacttggttgaggaactgattgctgcacaagctgacgtcggagcacgcgataaatggggtaaaactgccctgcattgggctgctgctgtgaacaatgctcgcgccgcccgttcactgttgcaggccggtgccgataaagacgcccaagataatagggaacaaacaccactgttcctcgccgctcgggagggcgcagtagaggtggctcaactgctactaggcctgggagcagctcgcgaactgagagatcaggctggtttagcccccgctgacgtggcccatcagcggaatcattgggacttgctcacgctgcttgaaggcgctggtccaccggaggctagacacaaggcaacacccggacgcgaggcaggaccttttcccagagcccgcaccgtttcagtgagtgtcccaccccacggcggcggtgcccttcctaggtgccgcactctctccgcaggagcaggccctagggggggcggagcctgtctgcaggctcgcacatggtctgtggatctcgcagcccgcggaggtggggcatacagtcattgcagatctctctctggggtgggggcgggcgggggacccacaccccgagggcgacggttctcagccggaatgaggggaccaaggccgaacccagcaatcatgagaggacggtacggggtagccgccgggagaggcggccgtgtcagtactgatgactggccttgcgactgggtagctctgggagcttgcggatctgcaagtaatatccctatcccgcctccatgtctcacaccaagccccgagcggggaagccctcaactcgactgcggcccccccgcactgcaagagatgccaatcaatcaggggggcgaaggtaaaaaatag

SEQ ID NO: 197533 - DNA, 561 bp, Artificial Sequence
  Description of Artificial Sequence: Synthetic coding sequence
atgagcgccgtgtgctgcggcgaggtgcagagcggcaccttccagggtgcttggctgggatgtcctgaaccttgggaacctctgttggacgggggcgcttgcccacaggcccacaccgttggtaccggtgaaactcctctgcacctggctgcacgtttttcccgtcccactgccgcgaggagattacttgaggccggcgcgaatcctaatcagcctgatagagccggacgcactcctctgcacgccgccgttgcggccgatgctcgcgaggtctgccagcttctgctgaggagccgacaaaccgccgttgatgcgcgaacagaggatggaacaacccctctgatgctggcagcacggctggcagtggaggacctggtcgaagagctgatcgcggcgcaagctgacgtgggcgctcgcgacaagtggggagctgatgccgctattcccggcggcgccggccgaagcgggggaagcagccccgcgactgcaggagccggtggctcaccccgcgcagctggaccagggtgggccagcgctggcggcaggcgcagcccaacctag

SEQ ID NO: 197534 - DNA, 561 bp, Artificial Sequence
  Description of Artificial Sequence: Synthetic coding sequence
atgagcgccgtgtgctgcggcgaggtgcagagcggcaccttccagggcgcttggcttggttgccctgagccgtgggaacctctgctggacggtggggcttgccctcaggcgcacacagtaggcacaggggagactccgctgcacctggccgctagatttagccggcccacagccgcccgacgcctgctcgaggccggagccaacccaaaccagccagatcgagccgggaggactcctctccatgccgccgtggcagctgatgcccgagaggtgtgtcagttacttttgcgaagccggcagactgccgtggatgcacgcaccgaagacggaaccacaccgctgatgcttgcagctcggcttgcagtggaggatctcgttgaagagctcatcgccgcacaagctgatgtgggggcacgggataagtggggggccgatgccgccataccaggaggagccggccgttcaggtggtagctccccagccacagccggagcaggcgggagtccaagagcggccgggcccgggtgggcttccgccgggggacgaaggtcccctacatag

SEQ ID NO: 197535 - DNA, 561 bp, Artificial Sequence
  Description of Artificial Sequence: Synthetic coding sequence
atgagcgccgtgtgctgcggcgaggtgcagagcggcaccttccagggcgcttggctcggatgccctgagccctgggagcccctgctggatggaggggcatgtccccaggcgcacaccgtgggcacaggggagacccccttacacctggcagcccggtttagtagaccaaccgcagctaggcgacttttggaagcaggcgctaatcccaatcaacctgatcgggctggtcggaccccgttgcacgctgccgttgctgcagacgctagggaggtgtgccagttgttactcaggtctcgccagactgcagtggacgcccggacagaggacggtacaaccccattaatgcttgctgccagattggccgtggaagatctggtggaagagcttatcgccgcccaggccgacgtgggggctcgtgacaaatggggggctgatgcagctatccccggcggcgctggtcggagcggaggctcgagccccgccaccgctggcgccggaggctctcccagagccgcggggcccggttgggcctccgccggcggaaggaggtccccaacatag

SEQ ID NO: 197536 - DNA, 561 bp, Artificial Sequence
  Description of Artificial Sequence: Synthetic coding sequence
atgagcgccgtgtgctgcggcgaggtgcagagcggcaccttccagggggcttggctggggtgccctgaaccgtgggagcccttgctggatgggggagcgtgtcctcaggcccacactgtcggaaccggtgaaactcccctccatttggcagcaaggttttctcgccccactgcagcaagacgattactggaggccggcgccaaccccaatcagccagatcgggccggtcggactccactccacgcagccgtggctgccgatgccagggaagtgtgtcagctgctgctcaggtctagacagacggctgtagacgctcggactgaagatggcaccacacccctgatgttagcagctagactcgctgtcgaggatttggtcgaagaattaatcgcggctcaggcagatgtgggcgcacgggataaatggggagcagatgccgcaatccctggaggcgccgggcgaagcggcggatcttctccggccactgctggagcgggaggatctccccgggcagccggtcctgggtgggcttccgctggaggacggcgctcgccaacctag

SEQ ID NO: 197537 - DNA, 561 bp, Artificial Sequence
  Description of Artificial Sequence: Synthetic coding sequence
atgagcgccgtgtgctgcggcgaggtgcagagcggcaccttccagggtgcttggctggggtgtcccgaaccctgggagccgctgctcgacgggggtgcctgtccccaggctcacacagtgggcacaggtgagacacctctacatctggctgcacggttttcgaggccaaccgccgctcggcggctgttagaagcaggagccaatccaaatcagccagacagagctgggagaacgccactgcacgctgccgtggccgccgacgcacgcgaggtgtgccagttgctcctccgcagcaggcaaaccgccgtagacgcccgcacagaggatgggacaacccccctgatgctggctgccagacttgccgtcgaggatttggtggaggagttgatcgccgcccaagctgatgtgggagcacgtgataagtggggagcggatgccgctatcccaggtggcgccggacggtccgggggaagctcaccggccactgccggggccggtgggagccccagggctgcaggacctggatgggcttccgctggcggacggcggagccctacatag

SEQ ID NO: 197538 - DNA, 1491 bp, Artificial Sequence
  Description of Artificial Sequence: Synthetic coding sequence
atgggccggggcgtgcgggtgctgctgctgctgagcctgctgcactgcgcgggcggatcagaggggagaaagacctggagaagaaggggacagcagcccccaccaccacctaggaccgaagctgcacccgcagccggccagcctgtggagagttttccgcttgatttcacggcagtggagggtaatatggattcattcatggcacaagtgaaaagcttagctcagtcgctctatccttgttcagcccaacagctgaatgaagacttaaggctgcacttactgctaaatacatcagtaacgtgcaatgatggatccccagccggttactatctcaaagagtccagaggatctcggagatggttactgttcctggagggcggctggtattgtttcaaccgcgagaactgtgactcacggtacgacacaatgagaaggctaatgtcgtcccgagactggccgaggacccgaactggcaccgggattctctcttcacaacctgaggagaatccctactggtggaatgcaaacatggtgtttatcccttattgctcgtctgacgtctggtctggcgcctcttcgaaatcagaaaagaacgagtatgcattcatgggcgccttaatcatccaggaagtagtaagagaacttcttggtcgcggactctctggagctaaggtgctcctccttgccgggtcatctgcgggcggaactggagtattacttaacgtcgacagggtggccgagcagcttgagaagcttggatacccggctattcaggtcagaggactggcagatagcggatggttcttagacaacaagcagtacaggcacaccgactgcgtggataccatcacatgtgcccccacagaggcgattcgaagaggaattcggtattggaatggggttgtgccagagagatgtaggcgccagtttcaggagggggaggagtggaattgtttcttcggatacaaagtttatcctactttacgatgccctgtgttcgtggtacagtggctgtttgacgaggcccaacttacagtggataacgtgcatttaaccggacagcctgtacaggaggggcttagactctacattcaaaatttgggccgggagctgcggcatactctcaaagatgtgccggcttctttcgcccctgcctgcctgtctcacgagataattatcaggagtcattggactgacgtacaagtaaaagggactagcctgccccgcgcattgcactgctgggacaggtccctgcatgacagccataaagccagcaagacaccactcaaaggctgtccggtacatctcgtcgattcatgcccatggccgcattgcaacccaagctgtccaacagtaagggatcagttcacgggccaggagatgaacgtagcgcaatttctgatgcatatgggatttgacatgcagaccgtcgcacagccgcaagggcttgagccgtccgaactgctcggaatgctgtctaatggatcttag

SEQ ID NO: 197539 - DNA, 888 bp, Artificial Sequence
  Description of Artificial Sequence: Synthetic coding sequence
atgggccggggcgtgcgggtgctgctgctgctgagcctgctgcactgcgctggcggaagtgagggccgcaagacgtggagacgacgaggacagcagccgccccctcccccgagaactgaagcagcgccagctgctgggcagcccgtggaatcattccccctcgattttacagccgtagaagggaacatggattcttttatggcgcaagttaagtctttggcacagtcgctatatccctgcagtgcccaacagctgaacgaagatcttagactacacctgctgctgaacacatcggtaacctgtaacgacgggtccccagctggttattatttaaaggagtccagaggttcacgtcgttggctcctatttcttgagggggggtggtattgctttaaccgtgaaaattgtgactccagatatgacacgatgcgtagactgatgtcctctcgcgattggcccagaacacgaacgggaaccggcattctctcctcacaaccagaagagaatccatattggtggaatgccaacatggtatttattccctattgcagtagtgatgtgtggtccggggctagttcaaagagcgagaagaatgaatatgctttcatgggcgccctcatcatccaggaagtagtcagggagctccttggccgaggtctgtcgggcgcaaaggtgctgctcctggccggatcctctgctggagggaccggcgtgctgctcaacgtggaccgagtggcagaacagctagagaagttggggtatccagccattcaggttcggggcttagctgactcgggatggtttctggataataaacagtatcggcacaccgattgcgtggacacgattacctgcgcgccaaccgaagcaattcggcgcggcatctag

SEQ ID NO: 197540 - DNA, 4080 bp, Artificial Sequence
  Description of Artificial Sequence: Synthetic coding sequence
atggccgaggccggcctgcggggctggctgctgtgggccctgctgctgcgcctggcccagagtgaaccctacactaccatacaccagccagggtattgtgctttctatgacgagtgcggcaaaaatccagagctgagtggctccctgatgactctgagcaacgtcagttgtctgtcaaatacaccagcgagaaagataactggagaccacctgattctgcttcagaaaatttgcccccggctatacacaggaccaaacactcaggcgtgctgcagcgcaaaacagctggtgtcactggaggcatctttaagtatcactaaggccctccttacccgctgtcccgcctgttcagacaacttcgtcaaccttcattgccataacacctgctcccccaatcagtcgttgtttatcaatgtgacccgcgtcgctcagcttggggcgggccaactgccagcagtcgtggcctatgaggccttctatcaacactctttcgcagagcagtcatatgacagctgctccagagttcgggtccctgcagccgccacactcgccgtgggaaccatgtgcggggtgtacggctctgccctctgtaatgcgcagcgctggctaaatttccagggagataccggtaacggcctggctcccctcgatatcactttccatctgttagaaccggggcaagctgtgggcagcggtatccagccccttaatgagggcgtagctaggtgtaacgaaagtcagggcgatgacgtggccacgtgttcatgccaggattgtgctgcttcatgtccagccatcgctaggccgcaggccctagactcaactttttatcttggacaaatgcctggcagcctggttcttattatcatcttatgcagtgtgttcgctgttgtgactatattattagtgggatttcgcgtagcacccgcacgggataagtccaagatggttgatcccaagaaaggaacatctctatccgataagcttagcttctcgacgcatacattgctaggacagttcttccaggggtggggaacttgggtggcttcctggcccctgacaattctggtgctgtcggtaatcccagtcgtggccttggccgcaggactcgtttttaccgagctgaccaccgacccagtggaactttggtcagctcctaatagccaggcgcggtcagaaaaagccttccatgaccagcacttcggaccctttttcaggacgaaccaagtgattttaactgcgcccaaccgcagcagctacagatatgactccctgctcttagggccaaagaatttcagcggaatcttggatttggatctgctgttagaactcttggagcttcaggagcgcctacgccatctgcaggtctggtctcccgaagcacagaggaacattagcctacaggatatatgctatgccccattaaaccctgacaacacttcactgtacgactgctgcatcaacagcttgttgcagtactttcagaataatcggacccttctactcctcacagccaatcagactctgatggggcagacaagccaggttgactggaaagaccacttcctgtattgcgcaaacgctcccctgacctttaaggatggcacagcgctcgcgctgagttgtatggcggattatggggctccggtgtttccctttctggcgattggaggatataaagggaaggattactccgaagctgaggcactaattatgacatttagcctcaataattacccagccggggaccccagactggcccaggccaaactatgggaagaggccttcctggaggaaatgagagcattccagaggaggatggcaggcatgttccaagtcaccttcatggctgagagaagcctggaggacgaaatcaacaggaccaccgcggaagatctcccaatatttgccacgagttacatagtgatattcctatacatatccctggcactcgggtcctattcttcttggagcagggtgatggttgacagtaaagctaccttagggctgggaggtgtcgcagtggtacttggagctgtcatggcggcaatgggcttcttcagctaccttggtatccggagctcactggtaattctgcaggtagtgccattcctggttctgtccgtgggtgctgacaacatttttatattcgtgctggaataccagcggttgcctaggcgacctggcgagcctcgggaggtacatatcggccgtgcactgggccgggtcgccccatctatgttactgtgcagcctgagcgaggcaatctgctttttcctcggggcccttactccaatgcccgccgtgagaacctttgctctcactagcgggctagcagtcattctagactttttgctacagatgagcgcatttgtggccctgctctccctcgactctaagcgccaggaggcttcccgcctagacgtgtgctgttgcgtgaagccccaggagctcccgccccccgggcagggagaaggtttgctccttgggttcttccagaaggcctacgctccgtttctgctgcactggattacaagaggcgttgtcctcctgcttttcctggcgctttttggagtttctctgtactcaatgtgccatatttcagtgggtctcgatcaggagcttgccttacccaaggactcctatctgttagattattttctcttcttgaataggtattttgaggtaggggcccctgtttacttcgttacgactcttggctacaacttctcgtcagaggccggtatgaatgccatctgctccagcgcaggatgcaacaactttagcttcacccagaagatccagtatgctaccgaatttcccgagcagtcctacttagctattcctgcctccagttgggttgacgactttatcgactggttgactccctcgtcatgttgtagactctacatctccggtccgaacaaagacaagttttgtccttccacggtgaatagcctgaattgtctcaaaaattgtatgagcattaccatgggaagcgtccgcccttccgtagaacaatttcacaagtacctgccttggttcttgaacgaccgcccgaatatcaaatgtcccaagggcgggctggccgcgtattctacatccgttaatttaacttcggacggccaggtgcttgatacggttgccatccttagccccagattggagtactccgggaccattagcgcccattgtaacctttatctgttggatagcacaagcagattcatggcctatcacaaaccactgaagaactcgcaggattacacggaggccttgagagctgcgcgcgagctcgcagcaaacattaccgccgaccttaggaaagtcccaggaaccgatccagcttttgaagtgttcccctataccattaccaatgtgttttatgaacagtatctcaccatactaccagagggtttattcatgctgtccctgtgtctggtgccgacattcgccgtgagttgtttgttgcttgggttggatctgcggagcgggttgttgaatctccttagcatcgttatgattttagtggacacagtcggcttcatggcattgtggggtatatcgtacaacgccgttagcctcataaacctcgtttcggccgtgggaatgtctgtcgaattcgtgtcccacattacccgctccttcgccatcagtacgaagcctacctggttggaaagagccaaagaggccactatcagcatggggtctgccgtgtttgcgggcgtagccatgaccaacttgccaggaatcctagtccttggtctggccaaggcccagctgatccagatatttttcttcaggcttaacctgctgatcaccttactagggctcttacacggcctcgtgttcttgcccgtgattttgagctacgtgggaccagatgtgaatccggctctcgctctggagcaaaagagagcagaagaagctgtggcggcagtgatggtcgctagttgccctaatcacccctcccgggtatcaacggccgacaacatctacgtgaatcactcctttgagggctcgatcaagggtgccggagccatttctaatttcttacccaacaacggaagacaattctag

SEQ ID NO: 197541 - DNA, 3999 bp, Artificial Sequence
  Description of Artificial Sequence: Synthetic coding sequence
atggccgaggccggcctgcggggctggctgctgtgggccctgctgttgcgcctcgcccagagtgagccatacactacaattcatcagcccgggtattgcgccttttacgacgaatgcggtaaaaacccagaactcagcggcagcttgatgaccttgagcaacgtaagttgtctgagtaacacgcctgcacgaaaaatcaccggtgaccatctcatcttactccagaagatttgcccccggctgtatactggcccgaacacacaagcttgctgctcagccaagcagctggtctccttagaagcctcactttctattacgaaggcgttgctgactcgctgccccgcatgcagcgacaacttcgtaaacttacactgtcacaatacatgcagtcctaaccagtccctgtttatcaatgtgacccgcgttgcacagttaggggctggccagttaccagcggtggttgcatacgaggcattttatcaacactcatttgctgagcaatcatacgactcatgctcgcgggtgcgggtacccgctgctgccacactcgccgtcggcactatgtgcggggtctatgggtccgctctctgcaacgctcagaggtggctgaacttccagggggacacagggaacgggctggcccctctcgatatcaccttccacctgctggagcccggccaagccgtgggatccgggatccagccgctgaacgaaggagttgccagatgtaacgagtcccagggggacgacgtagccacttgcagctgccaagactgcgccgcatcatgtccggccattgcccgaccccaggctctcgactcaactttctatttggggcagatgcccggctccttggtgctcatcattatcctgtgttctgtttttgctgttgttacaattcttctcgttggattccgcgttgcacccgcccgtgacaaaagtaagatggtcgatccaaaaaagggtactagcctgtcagataagttgagcttctcaacccataccctgttgggacagttctttcagggttggggtacgtgggtcgctagctggcccctgaccatccttgttctcagcgttatccccgtcgtcgcgctggccgcagggctcgtgttcaccgagctgactacagatccggtcgaactctggtcagcaccaaatagccaagcgcgcagcgaaaaggccttccacgatcagcatttcgggcccttttttcgaactaatcaggtgatccttacagcccctaatcgatcatcctatcgatatgactcccttctgttgggtcctaagaactttagcgggatcctggatctggatttactcctagagctactggaactgcaggaaaggctccgacatctccaggtgtggtctccggaggcgcagcggaacatatctttacaggatatttgttacgctcctctgaatccagataacacatctctctatgattgttgtatcaactccctgctgcagtacttccagaacaaccgcactctgctgcttctcacggccaatcaaacgcttatggggcaaaccagtcaggtcgattggaaggatcatttcctgtattgtgctaatgcacccctgactttcaaggacggaacagccttggccctttcttgcatggctgactacggagcacccgtgtttccgttccttgccataggcggctacaagggtaaggactattccgaagcagaagcattgatcatgacgttcagcctcaataactatccagcaggcgatccccgcctggctcaggccaagctctgggaagaggctttcctggaggaaatgcgtgcgtttcaacgccggatggccggaatgtttcaggtcaccttcatggctgaacggtcactggaagatgagattaatcgaacaacagcagaggacctgcccattttcgccacttcctacattgtgatttttctatatatcagcctggcattggggagctattcttcatggagtcgcgtgatggtggactccaaagcaactcttggcttgggtggcgtggcagtggtcctcggtgccgtcatggccgccatgggcttcttttcctatctgggcataaggagctcgctggttatactgcaggttgttccgttcctggtgctgtcagtaggggctgataacatcttcatcttcgtcctcgagtaccagaggctgccacgcaggcccggcgagcctcgagaagttcacattggaagagcattaggacgcgtcgcccctagtatgctgttgtgttcacttagtgaggccatttgctttttcttgggagcactgaccccaatgcctgcggtgcgcacattcgcgctgacgtctgggctcgcagtgatactggatttcctgctgcaaatgagcgctttcgtcgctctgctgagcttggactctaagcgtcaggaagcgagccgtctcgatgtctgttgctgcgtgaagcctcaggagttacccccacccgggcagggtgaaggcctcctgcttgggttctttcagaaagcatacgctcctttcttactccactggattactagaggcgtcgtccttctgctgttcctcgccctcttcggagtctcactctactctatgtgccacataagcgtgggactggatcaggaactggcgctcccaaaagattcctacttgcttgattatttcctgttcctgaaccgatatttcgaggtcggtgcgcctgtgtattttgtaactacactgggatataactttagctctgaagcaggcatgaacgcaatttgctcatcagccggctgtaacaattttagtttcacccagaaaatccaatatgcaacagagtttcctgaacagtcctatctagccatccccgctagttcttgggtggacgattttatagactggctcacccccagttcctgctgcaggctatacatttccgggccgaataaggataagttctgtccttccacggttaattcacttaactgcttgaaaaactgcatgtccataaccatggggagtgtcagacccagcgtcgagcagtttcataagtacctgccgtggttcctcaatgatcgacccaacattaagtgcccgaaggggggtctggccgcctactctaccagtgtgaacctgacatctgacggccaggtgctggccagtagattcatggcgtaccacaaaccgcttaaaaattctcaggactacacggaagctctacgagccgcacgcgagttagcagcaaatataaccgccgatttgagaaaggtgcccggaacagacccagctttcgaagtctttccctatacgatcactaatgttttctacgagcaatatcttactatactacccgagggcctgtttatgctttccctctgtctcgttccaactttcgccgtcagttgcttgctgttgggtctcgatctgcgctcagggctgctgaacctgctcagtatagttatgatactcgtggataccgtggggttcatggctctttggggcattagttacaacgccgtatctttgattaaccttgttagcgctgtcggcatgagcgtcgagtttgtgtcccacataacccgtagctttgctatctcaacgaaacctacatggcttgagagggctaaagaagccacaatctccatgggatcagcggtgttcgctggagtagcgatgacaaatctcccgggcatattagttctcggtctcgctaaagcacagctgatccagatcttcttcttcagattgaacctgttaattacactccttggcctattacacgggttggttttcttaccagtgatactcagttatgttgggccagacgtgaacccagccttggctttagagcagaaaagggccgaggaggcagtggcagcagtgatggtggcctcatgtcccaatcatccaagccgcgttagcactgctgataacatctacgtgaatcacagttttgagggatccatcaagggggccggagccattagcaactttcttcccaacaatggaagacagttctag

SEQ ID NO: 197542 - DNA, 3861 bp, Artificial Sequence
  Description of Artificial Sequence: Synthetic coding sequence
atggccgaggccggcctgcggggctggctgctgtgggccctgctgttgagacttgcacaatcagagccatacactacgatccatcaacctggctactgcgccttttacgacgagtgtggcaagaacccagaattgtcagggtccttaatgactctgtctaacgtgagttgcctcagcaacactcccgcccggaaaatcaccggagatcacctgattctgttgcaaaagatctgtccacggctgtacacaggaccaaacacccaggcatgctgcagcgcgaagcaactcgtgtctcttgaggcgtccctttcaattacaaaggcactgttgacccgatgtcctgcttgctcagataactttgtgaatctacattgccataatacgtgtagcccaaatcaatcactgttcattaacgttacacgagtcgctcagctaggtgccggccagctcccggctgttgttgcttatgaggccttttaccagcatagctttgcagagcagtcttacgattcatgctcccgggttcgcgtaccggctgcagccacgctggccgtcggcactatgtgcggggtctatggcagtgccctctgtaatgctcaacgctggctcaacttccagggagatacagggaatgggttagcgccattggacatcacctttcatttattggagcctggacaagctgtgggctcagggatacagcctctcaatgaaggagtcgcccgttgcaatgagagccaaggcgacgatgtggccacctgttcatgtcaggattgtgccgctagctgccccgctattgcccggccacaggcgctcgactccacgttttacctaggacagatgcccggatcattggtgttgataatcatcctctgttccgtttttgctgtcgttaccattctcctggtaggatttcgggtcgcccccgcaagggacaagagcaagatggtggacccgaagaaaggcacttctctgagcgataaactttctttctccacccatactctgttaggtcaattttttcaggggtggggcacttgggtcgcctcctggccacttactatcctggtgctcagtgttattcccgtagtggcgttggccgcaggtctggttttcactgaactgactaccgatcccgtggaactctggagcgccccaaactcccaagccagatccgaaaaggcctttcacgatcagcatttcggaccttttttcaggacaaaccaagttatcctcaccgccccgaatagaagcagctacaggtatgactcactcttgttggggcccaagaatttttctgggatattagaccttgacctgctgctggagttgctggagctccaggagagactgcggcacctccaggtgtggtcgcctgaagcgcagaggaatatctctctgcaagacatctgttacgcccccttaaatccagacaatacttctttatatgattgttgtatcaactcactcctgcaatactttcagaacaaccgaactttactgctcttgacagccaaccaaacgctcatgggacagacatctcaggttgattggaaagaccactttctgtattgtgcaaatgccccgctgacatttaaagacggcactgctctcgccctgtcttgtatggcagactatggcgcccccgttttcccctttttagctatcgggggatacaaaggcaaggactacagcgaggcggaagctcttattatgaccttttccctcaacaactacccagctggggaccccagactggcacaggccaaactttgggaagaggcatttctggaggaaatgcgagcttttcagagaagaatggcgggaatgttccaggtgacattcatggcggaaaggtctctggaggacgaaataaacaggactactgccgaagatctgccaatttttgccaccagctacatcgtcatttttctctatatctcacttgcgctcggcagttattccagctggagccgcgttatggttgatagtaaggccactcttgggctaggaggcgtcgcagtagtgctaggcgctgtaatggccgccatgggtttcttttcttacctaggcatccgctccagtctagtcatcctccaggttgtgcctttcctcgtcctgtccgtgggagctgataatatcttcattttcgtgctcgaataccagcgtctgccacgtcggcccggtgagccacgggaagttcacatcgggagggccctgggacgggtggccccatcaatgcttctctgctccctgtccgaggccatatgtttctttctgggtgcattaacccccatgcccgctgttcgaacgttcgccctgacttcaggcctggccgttatattggacttcctccttcagatgtccgcttttgtggcattgctgtccctggacagtaaacggcaggaggcgtcaaggctggatgtatgctgctgtgtcaaacctcaggagctaccccctccgggccagggggaaggactgttattgggcttcttccagaaagcgtatgctcccttcctgctgcactggatcacacgcggggttgtggtcggggccccagtctacttcgttacaacattggggtacaatttttcgtctgaggcagggatgaatgctatttgctcaagcgccggatgtaacaatttcagtttcacgcagaagattcagtatgccaccgagtttcccgagcaaagttaccttgccataccagcttcttcgtgggtggacgatttcatcgattggttgacccctagctcctgttgtaggctctacatatccggcccaaacaaggacaaattctgcccctctactgtcaattccttgaactgtctgaagaactgtatgagcatcaccatgggtagtgtacgcccatccgtggagcagtttcataagtacttaccctggttcctgaacgaccgccctaacataaagtgcccaaaggggggactggctgcctattctactagtgtgaatttaacatctgacgggcaggtcctcgcgagccgatttatggcctaccacaagccccttaagaatagccaggattatacggaggctttgcgcgccgcccgagagctggccgccaatattacagcagacctgcggaaagttccaggaaccgacccggcctttgaggtgttcccttacactattactaatgtgttttatgaacaatacctcacaattctgcctgaagggctttttatgctgagcttatgtctagttccaactttcgcagtgagctgtctccttctgggactggacttaagaagtggcttgctgaacttacttagtattgttatgatcctggtggataccgtgggcttcatggccctgtgggggatcagctacaacgcagtgtccctcatcaacctggtgtctgctgttggcatgtcagtggaattcgtaagtcacattacaagatctttcgctattagcacaaagccaacatggctcgagcgggcgaaggaggcaacaatatcgatgggctccgccgtctttgctggagtggccatgacaaatctccccggtatcctggtcctgggcctggcgaaggctcaactgattcagatcttctttttccgcctgaacctcctgattactctactggggcttctccacgggttagtgttcctgcctgtgatacttagctatgtggggccagacgtaaaccccgctcttgcgctcgaacagaagcgagcagaggaagctgtcgcagctgtgatggtcgcctcatgtccgaaccatccctctagagtctctaccgccgataacatctatgtgaaccactccttcgaggggagtatcaaaggtgcaggagctatttccaacttcttgcctaacaacgggcggcagttctag

SEQ ID NO: 197543 - DNA, 783 bp, Artificial Sequence
  Description of Artificial Sequence: Synthetic coding sequence
atgccccagaacgagtacatcgagctgcaccggaagcggtacggctatagactggactaccacgaaaagaaacgcaagaaagagagcagggaagcccacgaacggagtaaaaaggccaaaaagatgattggccttaaagccaagttgtaccataaacagaggcatgcagaaaaaatccagatgaaaaagacaattaagatgcacgaaaagagaaatacaaaacagaagaacgacgagaagacaccacagggcgcagtgcccgcataccttctcgatcgcgagggtcaatccagagccaaggtgctatctaatatgattaaacagaaacgaaaagagaaagcaggcaaatgggaggtccctctccctaaggtgcgcgctcagggtgagaccgaggtcctgaaggtcatacgcaccggtaagagaaagaagaaagcctggaagcggatggttacaaaggtctgcttcgttggcgatggttttacccggaagccaccgaaatatgaaagatttataagacctatggggctgaggtttaaaaaggcccacgtgacacaccctgaactaaaggccaccttctgcttgcccatactgggagtgaagaagaaccccagcagtcccttatatactacgctgggcgtgatcacaaaggggacagttattgaagtgaacgtgagtgagctgggactcgtcactcaaggtggcaaagttatttggggtaagtacgcacaggtcacgaacaaccctgagaacgacggctgcattaatgcggtgctcctggtttag

SEQ ID NO: 197544 - DNA, 1509 bp, Artificial Sequence
  Description of Artificial Sequence: Synthetic coding sequence
atgagctgccccgtgcccgcctgctgcgccctgctgctggtgctgggcctctgccgggcgcggccaaggaacgctctcctgctgctagcagacgatggaggatttgaatccggcgcatacaacaactctgccatcgcaacacctcatctggacgctctggcccgccggagcctgctttttaggaatgccttcacctccgtatccagttgttctcccagtcgggctagtttactcaccgggctgccccagcatcagaacggtatgtatggtctgcaccaggacgttcatcattttaacagcttcgacaaagtgcggtctcttccattgttgttgagccaggccggggtgagaaccggcattataggcaaaaaacatgtcggccctgaaacggtttatccatttgacttcgcatatacggaagagaacggaagtgtacttcaggtgggacggaacatcactcggatcaagctgcttgttaggaaattcctccaaactcaggacgataggccatttttcctatatgtcgcttttcacgacccccacaggtgcggacattcccagccccagtatggaactttctgtgagaagtttggcaacggagagtctggaatgggccgcatccccgactggactccccaggcctacgatcctctggacgtgttggttccttacttcgtgcccaacactccagctgcgcgggccgatttggctgcgcagtatacaactgtgggcaggatggatcaaggcgtggggctggttctacaagaactgagagatgccggcgttctcaacgacactctggttattttcacttccgacaatggcatccccttcccaagcgggcggaccaatctatactggcctggtacagcagaacctttgctcgtctctagcccagaacatccgaaaaggtggggccaagtcagtgaagcatacgtctcactgctcgatcttactcccaccattttggactggttttctatcccatatcccagctacgctatattcggtagcaaaacaattcatctcacgggcaggagcctgttgcctgctttagaggcagaacccctgtgggccactgttttcggtagccagagccatcacgaagtcactatgagctatcctatgagaagtgttcagcatcgacattttcgcctcgtgcacaatctcaattttaaaatgcccttcccaattgaccaggacttttatgtgagccctacgttccaggacctcctgaatcgaactaccgcagggcagcctaccgggtggtataaggacctccgccactactattaccgtgcaagatgggaactatacgatcggtcaagggacccccatgagactcaaaatctggccactgacccgaggttcgcacagcttctcgaaatgcttcgagaccagctcgccaagtggcaatgggaaacacatgatccatgggtatgtgcacctgacggtgtactggaggagaagctttctcctcaatgccagccccttcacaatgagctttag

SEQ ID NO: 197545 - DNA, 900 bp, Artificial Sequence
  Description of Artificial Sequence: Synthetic coding sequence
atgggccggatccccgactggaccccccaggcctacgaccccctggatgtgctggtaccttacttcgtgcccaatactccagccgctcgtgccgacttagccgcccaatacaccaccgtggggaggatggaccagggggtggggttggttctgcaggaactcagggacgccggagtgctaaatgatacactagtgatctttacctcggacaacggtattcccttcccatctggcaggaccaatctctactggcccggaaccgccgaacctctcctcgtgtcttctccggaacatcctaagcgatggggccaagtgtccgaggcttatgtgtccctactggacctgacaccaacaatcctggactggttttccatcccctatccatcttatgccatctttggctcaaaaaccattcacctgacggggcgctcgcttctcccagcactggaggccgaacctctctgggctacagtctttgggtcccaatcacatcacgaggtgaccatgagctaccctatgagaagtgtgcagcatagacactttcggcttgtacataacttgaattttaaaatgccatttccaatagaccaggatttctacgtgagtcccacgttccaggacctgttaaaccgtactacagcaggacagccaacaggttggtataaagatctccgccactattactatcgtgcacggtgggaactttatgaccgcagcagagatccccatgagactcagaacttggccactgaccccaggttcgctcaactgctagagatgctccgcgatcagctggcgaaatggcagtgggagactcatgacccgtgggtatgcgcccccgatggggtccttgaagaaaaactcagtccacagtgccagcccctacacaatgaactgtag

SEQ ID NO: 197546 - DNA, 618 bp, Artificial Sequence
  Description of Artificial Sequence: Synthetic coding sequence
atgagctgccccgtgcccgcctgctgcgccctgctgctggtgctgggtctttgcagggcccgaccacggaacgccctgctgttactcgccgatagagcgctttccgtcagtcatctcacgcagaggatgacagaagccctgcgcgtggctagaacaacaactgcacctagcccacccagaacctggactccctggcctgccgccgccagtagctttgcaatgccctccccccgctcagctgccgcactccccgcggcccctgctagctctcttgcctgtcccagcattaggatgggctgtactggttgtaccagaacgtgtacaacctcaactccttcaaccaggtgtggagcatgcaggtgttgttctgctaaactggtttgcgcccaggctagtagtggccgttctacttgggggaggagaccgtgcacccgccttacactccggacacgacgacgcatggccccctctagccgctggggaggcacttctctggagctctcatgctccagcggcaattcatgtcgtctgcggatgacagggctctcctcaagcacttcccccagcacaaccccaacactctgggctcttcccgcgccagtgagaaatctactgtag

SEQ ID NO: 197547 - DNA, 1191 bp, Artificial Sequence
  Description of Artificial Sequence: Synthetic coding sequence
atggcctgcgccggcctgctgaccgtgtgcctgctgcggccccccgctcctcagccacaaccgcaaacaccacgccatcctcagctggctcctgatcctggtcccgctggccacactctcttccaggatgtattccgccgtgctgacaagaacgatgatgggaagttaagttttgaggagttccagaattatttcgccgacggcgtattgtctctgggtgagctgcaggaactgttttctggtatagatggtcacttgacagataacctcgagacagagaagctatgcgattacttctctgagcacttgggcgtctatcgccccgtcctggctgccctggaatcactgaacagggctgtgctggctgcaatggacgccaccaagttggaatacgaacgcgcgagcaaggtggaccagttcgtcacccggttcctgcttcgggagaccgtgagccagctccaggctcttcaaagtagcttggaaggggcttccgacaccctggaagctcaggcccatggttggcgatccgacgctgagtctgtcgaagctcagagcagattatgcggaagccggcgtgccggacggcgcgccctcaggagcgtgtcgcgctcaagtacctggagtccagggagctctgacacaggaagatcttccgaagcggaaatgcagtggaggctgcaggttaaccgcctgcaggagctaatcgatcagctggagtgcaaggtgagggcggtcgggcctggtccacacaagggagggccctcctggtacccacccgagcccggcccttgttggagaccgggcccgcactccgtcccctcgcaggcacccagattagagcctctgagggaggaagatctagctaaagggccggatctacacatccttatggcccagaggcaggttcaagtggcagaagaaggcctgcaggattttcaccgcgctctgaggtgctacgtggactttacgggcgcacaatcacactgtttacatgtttcagctcagaaaatgttggacggagcctcctttacactttacgagttttggcaagatgaggcttcatggagacgacaccaacagtctccaggcagtaaagctttccagcgcatcctgatcgaccatcttagagctccagacactctgacgacggttttttttccagcctcatggtggataatgaacaataattag

SEQ ID NO: 197548 - DNA, 1089 bp, Artificial Sequence
  Description of Artificial Sequence: Synthetic coding sequence
atggcctgcgccggcctgctgaccgtgtgcctgctgcggccccccgctcctcagcctcagcctcaaactccccgtcacccacagcttgcacccgacccagggcccgccggccacaccctttttcaagacgtgtttaggcgggcagacaagaatgatgatggcaagctgagctttgaggagtttcagaattacttcgccgacggggtactctccctgggtgaactccaggaactgttttccggaattgatgggcacctcacagacaacctggaaacagagaagttgtgtgattacttttctgagcatctcggcgtgtacagaccagttctggccgcgctggagtccttgaatcgggcagtgctcgctgccatggacgcaacgaaactggaatacgagcgtgcctctaaagtggaccagtttgtgacccgattcctgctgagagaaacagtgtcacagttgcaagccctgcaaagttctttggagggagcatctgataccctggaagctcaagcccacggctggcggtccgatgctgaaagcgttgaagcccaatctaggctctgcggctcccggagggccggcagaagagctctgaggagcgtatctcgctcttcaacctggtctccaggctccagtgataccggccgaagttctgaggccgaaatgcagtggaggctgcaggttaacaggcttcaagagctgatcgaccaactggagtgcaaggctccccggctcgagcccctcagggaggaggatttagcaaagggaccagacctccatatcctgatggcccagcgccaagtacaggtggccgaggaaggcctccaggactttcaccgggcactgcgttgctatgtggactttacaggtgcccagtctcattgcctgcacgtgtcagcgcagaaaatgctcgatggggcctcattcactctctacgaattttggcaggacgaagcgagctggaggcgacaccagcagtctcccggatccaaagcgtttcagcgcatcctgattgatcacctgagagctcctgacaccctaacaactgtcttttttccagcaagttggtggatcatgaataacaattag

SEQ ID NO: 197549 - DNA, 870 bp, Artificial Sequence
  Description of Artificial Sequence: Synthetic coding sequence
atggcctgcgccggcctgctgaccgtgtgcctgctgcggccccccgccccacaaccccagccccaaacccccagacaccctcagctcgcccccgatcctggccccgccggtcataccctatttcaagacgtcttccgtagggcagataagaacgacgacggcaaactttctttcgaagagttccagaattactttgctgatggggttctgtcgctaggcgaactgcaggagttgttttctggcatcgatggacacctgacggacaatcttgaaaccgagaaactgtgtgattacttcagcgagcaccttggggtctaccggcccgtccttgctgctcttgagagccttaacagagcagtgctcgccgcgatggatgctactaagctggaatacgaaagagccagtaaagtagaccagttcgtgacccgcttcctactcagagaaaccgttagtcagctccaggccttgcagtctagccttgagggcgcttcagataccctggaggctcaagcccacggctggcggagcgacgcagagagcgtggaggctcaaagccgtttgtgcgggagtcggcgagcaggtagaagggccctgcgaagcgtatctagatcttccacttggagcccaggaagcagcgataccgggagaagtagtgaagctgaaatgcagtggcgtctgcaggttaaccgtcttcaagaactgatagaccaactggaatgcaagcatattctaatggctcagcggcaggtccaggtggccgaggagggtctgcaagactttcatagggctctgcggtgttatgtcgactttaccggggcgcaaagtcattgcctgcacgtgtccgcccagaaaatgcttgatggggcctag

SEQ ID NO: 197550 - DNA, 423 bp, Artificial Sequence
  Description of Artificial Sequence: Synthetic coding sequence
atggccagcgtggacttcaagacctacgtggaccaggcctgccgggctgcagaagaattcgtaaacgtctactatacaactatggacaagaggagacggctgctgagccggctgtacatgggcacggcaactctggtgtggaacgggaatgcggtgtctggacaggagtccctaagcgagtttttcgagatgctgcccagttccgaattccaaatatcagttgtggactgccaacctgtccacgacgaagccactccctctcaaactacagtcctggttgtcatatgcggtagcgtgaaattcgaaggcaacaaacagagagactttaaccagaactttatcctcaccgcccaggcctcaccaagtaatacagtttggaagatagcatcagactgctttaggtttcaggattgggccagctag

SEQ ID NO: 197551 - DNA, 984 bp, Artificial Sequence
  Description of Artificial Sequence: Synthetic coding sequence
atggccgtgcccgccaagaagcggaagatgaacttcagcgagcgggaagtggagattattgtcgaggagctcgagttaaaaaagcacctgttggtgaaccactttaacgcaggcgtgccactcgccgctaaatctgccgcctggcacggaattctaagacgggtgaacgcagtggctacttgcaggagggagctgcctgaggtgaagaaaaaatggtccgacctgaaaactgaggtcaggaggaaagtggctcaagtacgcgctgctgtggaagggggcgaggcccctgggccgactgaggaagatggagctgggggaccaggcactggcggtggtagtggtggcggaggccctgcggtggcgcctgtgctgctgacacctatgcaacaacgcatctgcaacttgctgggggaagccacaataatctcacttccatccaccaccgagatccaccccgtggcactgggaccctctgccacagctgcggcagccacagtcactctgacacaaatccccaccgaaactacatatcatactttggaggaaggtgtagtggaatactgcacggctgaggctccgcctccactgcctcccgaaacaccagtggatatgatggcgcaacatgctgatacctcggttaagccccaggcgttgaaatctcgaatcgcattaaacagcgccaaacttatacaggagcaacgcgtcactaatctccacgttaaagaaatagcccaacacttagaacagcagaacgatctgctacaaatgatccgacggtcacaggaagtgcaggcctgtgcccaagagcggcaggcccaagccatggagggcacccaggcagcgctttctgtgctgattcaggtcctgagacctatgatcaaggactttcggcgatacctgcaatccaacaccgcaaacccagctccagcctctgaccccggccaggtggcccagaacggtcagcccgactccattattcagtag

SEQ ID NO: 197552 - DNA, 1485 bp, Artificial Sequence
  Description of Artificial Sequence: Synthetic coding sequence
atggaggtggtggaggccgccgccgcccagctggagaccctgaagttcaacgggacagacttcggcgtgggcgagggccctgcagccccctctcctgggtccgctcccgtgcccggcacacagccccccctgcagtcttttgagggatccccagatgccggacagactgtggaagtgaaacccgccggcgaacaacccctccagcccgttctcaacgccgtggccgccgggacccccgctcctcagccacagcctcctgcggagagccctgcatgtggggactgcgtcacgtcccccggcgccgctgagccggccagagccccagattccctcgaaacctccgactctgattccgattcagacagtgaaaccgactctgactcctcttcgtcttcttcgagttcctcttcctcttccagtagtagcagtagttcgtgcatatcactgccccccgttctgagcgacggcgacgacgacctgcagattgagaaagagaacaaaaacttccctctgaagacaaaagatgagctgttgctgaacgaattaccttcagtggaggagctgaccatcatcctgcccgaagatattgaattaaagcccttgggaatggtcagcagcatcatcgagcaactggtgatcattgaatctatgactaatctgcctccagtaaatgaagaaacagtgattttcaaatccgatagacaggccgccggaaaaatatttgaaatttttggtcctgttgcccaccccttctacgtgttaaggttcaatagttccgaccacattgagtctaaagggattaagattaaagagactatgtactttgccccaagcatgaaggattttacccagtatatttttacagaaaagctcaagcaagataagggcagcgacgccagctggaagaacgatcaagagcctcctccggaggccctggacttctcagatgacgagaaggaaaaagaggccaagcagaggaaaaaaagccagatccaggggcgcaaaaagttgaaatctgaattcaatgaacctggagaagattttaccgaggtgcaccagaactggaacgcacactcttcagccagcgaacacgccaagggctaccgcaatagggagtttacccgcggcttcagtcgtgcaaggtacccaaggagctgtcatggtcgtccaccgcctcaacacttctacaattctgaacatatggtgtcccaggagacgtctgggttcccatctcagagacagaacaacccaattatgcctcagtatcctttccccctgcccgtctttgatatgcataactttccgctccgaccgccccctccccctcccccgccaccggtgaacatgggctgggctaccccgaacatggccgcacaccctcttctcaacttgccctattccttgcctcctcccccgcctcccccacccttacctccccctccttcgtctggagatagcaactcccattttggaccttattactag

SEQ ID NO: 197553 - DNA, 1170 bp, Artificial Sequence
  Description of Artificial Sequence: Synthetic coding sequence
atggaggtggtggaggccgccgccgcccagctggagaccctgaagtttaatggcaccgactttggagtgggagagggtcccgctgccccctctccagggtccgctccagtccctggaacccagccgcccctgcagtcatttgagggtagccccgatgctggacaaactgtcgaggtcaagcccgccggcgagcagcctcttcagccagttttgaacgccgtcgccgcaggcacacccgcaccccaacctcagccccctgctgaatcgccagcttgcggagattgtgtgacaagtccaggtgcggctgagccagccagggctccggacagcctggaaacatctgactccgactcagattctgattcagagactgactcggatagtagctcttcctcttcctcgtcctctagctcaagtagttcatcctcctcatcctgtatatccctgccccccgtcttgtcagacggagacgatgacctccagatagagaaggagaacaagaactttccgctgaagacaaaggacgagctgctcctgaatgagctgccaagcgtggaggaactaacgatcatcctgccggaagatattgaactcaagccactcggcatggtgtcaagtattatcgaacagctggtgatcatcgaaagtatgactaaccttccccccgttaacgaagagacagtgatctttaaatcagatcggcaggcggctggtaagatatttgaaattttcgggcctgtggcacaccccttttacgtcctccgtttcaacagcagtgatcacatagagtcaaaggggattaagattaaagagacaatgtatttcgcaccctctatgaaagatttcactcagtacatcttcacagagaagctcaaacaggataaggggagcgacgccagctggaaaaacgatcaagaacctccacctgaggcactcgattttagtgacgatgaaaaggaaaaggaagccaagcagcggaaaaagtcacagattcagggaagaaagaaactgaaaagtgaattcaacgagccaggaacagggatatcccatcggtattgcgggctgggatcgcggccattacagtctagcgagagccacaaactatttgggtttcaaatgcatatcaaggtcacttttacatgttattttagcttgctgagtatgcagtag

SEQ ID NO: 197554 - DNA, 345 bp, Artificial Sequence
  Description of Artificial Sequence: Synthetic coding sequence
ctggccagccggctgggccccgtgagcaccgccaacatgagccggcctgtgcgtaacaggaaggtggttgactactctcagttccaggagtccgacgatgccgatttcgaaagcgaagatagtgaggataaggatgtaaaaacaaaaaaagatgattcacattccgcagaggattctgaagatgagaaagaggatcacaagaatgtgcgtcagcagcgccaggctgccagcaaggctgcaagtaagcaacgggagatgctgatggaggatgttggctcggaggaggaacaagaagaagaagatgaggctccttttcaagaaagaaaagattccttcagccagtag

SEQ ID NO: 197555 - DNA, 732 bp, Artificial Sequence
  Description of Artificial Sequence: Synthetic coding sequence
atgagccggcccgtgcggaaccggaaggtggtggactacagccagttccaagagagcgatgacgctgacgaggattacggccgcgactctggcccccctacaaaaaagatccggtccagtcctcgcgaggcaaagaacaaacggcgctccggcaagaacagccaggaggattccgaggactcagaggataaggatgtcaaaactaaaaaggatgacagccactccgccgaggacagtgaggatgagaaagaagatcacaaaaacgtgagacaacagcgtcaggccgcctccaaagccgcctcaaagcagagggaaatgctgatggaagacgtgggcagcgaagaggagcaagaagaggaggacgaagcgcctttccaggaaaaggattctggctccgacgaggatttcctaatggaggatgatgatgacagcgactacggcagctctaaaaagaagaacaagaaaatggtaaaaaagagtaaaccagagcgaaaagagaaaaagatgcctaagcccaggctgaaggccacagttacacccagccctgtaaaaggtaagggcaaagtcggacgaccgaccgcatctaaagcctccaaagaaaaaacccccagtcctaaagaagaagacgaggagccagagtcccccccagaaaaaaaaactagtacgtcaccaccaccagaaaagtccggggacgagggctctgaagacgaagctcccagcggagaggattag

SEQ ID NO: 197556 - DNA, 1122 bp, Artificial Sequence
  Description of Artificial Sequence: Synthetic coding sequence
atgagcccctgccccccccagcagagccggaaccgggtgatccagttgagcacatccgagttaggtgagatggaactgacctggcaagagataatgagtataaccgaattgcagggtctgaatgcgccctctgaacctagcttcgagccacaggctccggctccgtatctggggcctccacctccaaccacctattgtccttgctcaatacaccctgattcggggtttcctctgcccccccctccatacgaacttccggcgtcaacatctcacgtccctgaccctccatatagttatggaaatatggctatcccagtgtccaaacctctgtcactatccgggcttctgtctgaacccctgcaggaccccctggccctgctggatattgggttacccgccgggcccccaaaacctcaagaggatccagaatccgattcaggactgtcattgaattactcagacgccgagtctctcgagttggaagggactgaggcaggtcggaggcgctccgaatatgttgagatgtaccccgtggagtatccttattctttaatgccgaactcattagcccacagtaactataccctccccgctgccgagactccattggcccttgaaccctctagtggaccagtacgggcgaagcctaccgcccggggagaagcaggctctcgagacgagaggagggctctcgcaatgaagatcccgttccctacagataagatcgtcaacctgcccgtagatgacttcaatgaactgttagcacgctaccccctaaccgagagccagctggctctcgtgcgcgatattcgaaggagggggaagaacaaggtggctgcgcagaattgccgcaagagaaagctggaaaccattgtccagctggagagggagttggagcggctgaccaacgagcgcgagcggctgttgagggcacgcggggaggcggatagaacgctcgaggtgatgagacaacagttgaccgagctgtaccgcgacatttttcagcacctgcgtgacgaatccggcaactcttacagtcccgaagagtatgcactccaacaggccgccgacggcactatattccttgtgcccagggggacgaaaatggaagcaaccgattag

SEQ ID NO: 197557 - DNA, 1122 bp, Artificial Sequence
  Description of Artificial Sequence: Synthetic coding sequence
atgagcccctgccccccccagcagagccggaaccgggtgatccagctgagcacctcggaactaggcgagatggaactgacctggcaggaaattatgtctatcacagagctccaggggcttaacgctcccagcgaaccaagctttgagccgcaggcccctgccccttacttgggccccccacctccaacaacttactgcccttgttctatacaccctgatagcggcttcccccttccgccccctccttatgagctccctgctagcacatcgcatgtccccgatcctccctactcgtacgggaatatggcaatcccggtttcaaaacctctttcgctctctggcctgttaagcgagccattgcaggaccccctggcgctccttgacatcggactgccggccggtccccccaaaccacaggaagacccagagagtgactctggcctgtctctgaactattctgacgcagagagccttgagctggagggcaccgaagccgggagacgaaggtccgaatatgtggagatgtatcctgtcgagtatccatactccctcatgccaaactccctcgctcacagcaactacaccctccctgccgcagaaacccccctggccctggaaccctcgagtgggccggtgcgggccaaacccactgctaggggagaggcgggcagtagagacgagcggagggcattggcaatgaaaataccctttccaactgataaaatcgtgaatctgccagttgatgatttcaacgagctgttagcaagatacccccttaccgaaagccagctcgccctggtgcgagatatccggaggagagggaaaaacaaggtcgccgcccagaactgtagaaagcggaagctcgaaaccattgtgcagctggagcgagagctggaaaggcttactaatgagagagagcgactgcttcgagcccgaggcgaggcagaccggacactcgaagtgatgcgtcagcagcttaccgaactgtatagagacatctttcaacaccttagagatgagagtggcaatagctattctccagaggagtatgcacttcagcaggccgcagatggcaccatcttcctcgttcctcgaggcaccaaaatggaggccacagactag

SEQ ID NO: 197558 - DNA, 1122 bp, Artificial Sequence
  Description of Artificial Sequence: Synthetic coding sequence
atgagcccctgccccccccagcagagccggaaccgggtgatccagctctctaccagcgagctgggggagatggagctgacctggcaggaaatcatgtctatcaccgaacttcaaggactgaacgccccaagcgagccgagctttgagccacaagctcccgcgccttacctcggccccccacctcccacgacgtattgtccatgcagtatccaccctgactcagggtttcccctacctccacccccatatgagctccccgcgagcacttcacatgttccagaccccccttactcctacggcaatatggccattccagtgtccaagccactgtccctgagtggactgttatccgagccactgcaggaccccttggctctgctcgacatcggtctccctgcagggccccctaagcctcaggaagatcctgaatccgattcagggctctcactcaattactccgacgcagaatccctcgagctggaaggtaccgaggccgggcggcgccgctctgaatacgtggagatgtaccccgtggaatacccttatagcctgatgcccaatagcctggcccacagcaactacacactgcccgcagctgagacaccactcgcattggagccttcctccggcccagtaagggctaagcctactgctcggggcgaagctggctcccgggacgaaagaagagcgctggcaatgaagataccattccccaccgataagatcgttaaccttccagtggacgattttaatgaactgttggcccgctatcctttgacagaaagccagctggctctggtgcgcgacatcaggcgtcgtggtaagaataaagttgctgcacagaattgtaggaagcggaaactcgagactatcgttcaactagaaagagagttggagcggctgaccaacgaacgcgagagacttttacgggcacggggcgaggcggaccgcactctggaagtcatgcgtcagcagctcactgagctgtatcgtgatattttccagcatctgcgagacgaatccggcaacagttactcccccgaggaatatgccctccagcaagctgctgacgggactattttccttgtaccaagggggaccaaaatggaggccacagattag

SEQ ID NO: 197559 - DNA, 1122 bp, Artificial Sequence
  Description of Artificial Sequence: Synthetic coding sequence
atgagcccctgccccccccagcagagccggaaccgggtgatccagctctcgaccagcgagcttggcgaaatggagcttacatggcaggaaatcatgtctattaccgagctgcaaggcctcaacgcaccaagtgaaccctctttcgaaccacaggccccagctccatacctcggccctcctccaccaacaacctactgcccttgcagcatacaccccgactccggattccccctcccaccacccccgtacgagctgccagcatcaaccagtcacgtaccagatcccccatattcatatggaaatatggcaattccagtcagtaagccattgagcctgtctgggctgctgagtgagcccttgcaggaccccctcgcattgttagacatcggactcccagcagggccacccaagccccaagaggatcctgaatccgactcaggccttagtctgaattactctgacgctgagagtctggagctcgaaggcactgaggctggccgccgccggtctgagtacgtcgagatgtatccagtcgagtacccttactcgctcatgcctaactccctggcacactcaaattacacactgcctgcagctgagacaccactggccctcgagccttcttccggcccagtccgtgctaaacctaccgccagaggggaggctggaagtagagacgaacgccgagcccttgcgatgaagatccctttccctaccgataagattgtcaatctccccgttgacgactttaacgagcttctggcgagatatcctctgactgaaagtcaactggctctggtccgggacattcgccgacgcggcaagaacaaagttgcggcacagaactgcaggaagcgcaaactggagaccattgtgcagctcgaaagagagcttgaaaggcttacaaacgagagggaacgtctgctgcgtgctcgaggggaggcggaccgcaccctagaggttatgcgccaacagctgacagaactataccgggacatattccagcacttaagagatgagtccggcaacagctactctcctgaagaatacgccctccaacaagcagcggacggcaccatatttctggtgcctcgcggcactaagatggaggcaaccgattag

SEQ ID NO: 197560 - DNA, 1032 bp, Artificial Sequence
  Description of Artificial Sequence: Synthetic coding sequence
atgagcccctgccccccccagcagagccggaaccgggtgatccagctcagcactagtgagctgggggagatggaactcacatggcaagaaatcatgtctatcaccgaactgcaggggctgaatgccccatccgaaccgtcgttcgaaccacaggccccagcgccctacctcggcccacctcccccaacgacctattgtccatgtagcattcacccagatagcggatttcccttgccacctcctccatatgagctgcccgcttcaacctcccacgtgcctgacccaccttactcatatgggaacatggcaattcccgtgtccaaacccctgtctctatcaggtctgctcagcgaacccctacaagacccgcttgcattactggatattggactgcctgcaggccccccaaagccccaggaggacccagagtctgattcaggccttagcctgaattattccgacgcagaaagtctcgaactggagggcacagaggccggcaggcgcaggtctgaatatgttgagatgtaccccgtggaatacccatatagtctaatgcctaactcgctcgctcatagtaattatacactgccagccgccgagacccctttagctctagaaccctctagtgggccagttagggcaaagcccactgcccggggcgaagccggtagccgagacgagaggagagcactcgccatgaagatccctttcccgaccgacaaaatagtgaacctgcccgtggatgatttcaacgagttactcgcacgctaccctctcactgagtcacagctggcgctggtccgcgatatcaggagaagaggaaagaacaaagttgctgcccagaactgccgcaaaagaaagcttgagaccatcgtccagctggagcgcgagctggagcggctgactaacgagagggagcggttgctgagggcacggggagaggccgataggacactggaagtgatgcgacagcagttaacagaactgtaccgtgatatctttcagcacctccgagacgagtccgggaattag

SEQ ID NO: 197561 - DNA, 2229 bp, Artificial Sequence
  Description of Artificial Sequence: Synthetic coding sequence
atgctgagcctgaagaagtacctgaccgagggcctgctgcagttcacgatcttgctgagcttgattggggtcagagtggatgttgacacatatctgactagccagctacctccactccgagaaattattctgggtccatcctccgcgtacactcaaactcagttccacaacctgcggaacactctggatggctatggaatccacccaaagtctatagatctggataactatttcacggcccggagattgcttagtcaggtacgcgccttggacagatttcaggtgcctactactgaggtcaacgcctggctggtccaccgcgatcccgagggaagtgtttctggctctcaacccaactccgggctagcactcgaatcctcctccgggttgcaagatgtgaccggcccagacaatggcgtccgtgagtctgagacagaacaggggttcggcgaagatctggaggacctgggagccgtcgcccctcctgtctctggcgatctgaccaaggaagatattgatctgatcgacattctgtggaggcaagatattgatctgggtgccgggcgagaggtgtttgattattcccaccgccagaaagaacaagacgtggaaaaagaattaagggacggtggagagcaggatacttgggctggtgagggggccgaggccctagcccgaaatcttctggtggacggtgaaaccggtgagtcattccccgcccaatttcccgccgacatttcgtccataaccgaggctgtcccttcagagagtgaaccgcccgcactacagaacaatctcctaagccccttgctcaccggaactgaatcccctttcgacctcgaacaacagtggcaagaccttatgtcgattatggagatgcaagcaatggaggtgaatacaagcgcctccgaaatcctctattcggctcctcccggagatcccctctccaccaattactctctggcgcctaacacaccaattaaccagaacgtgtcactccatcaggcctccctgggaggttgttcacaagatttcttactttttagtcccgaagtggagtctctccctgtcgccagctcgtcaaccctgttgcccctggctccctccaactcaacctcactcaacagcacttttggttctactaatctcacgggcctgttttttccaccacagctgaacggaactgctaacgacactgccggaccagagctgcctgatcctctgggcggcctgcttgacgaagccatgcttgatgagatctccctgatggacctggcaatcgaagagggctttaacccagtgcaggcgtcccagttagaagaggaatttgattcagactcaggattgtcactggactcctctcactcgccgagcagtctctcaagctcagagggctcttcctccagttcttctagctcttcaagttcaagcagctccgcctcttcttcagcatcctcttccttttctgaggagggagcagtgggatattcatcggactccgagactctggatttggaagaggctgagggtgcagtcggataccagcctgagtacagcaagttttgcagaatgtcatatcaagacccggcacaactgtcctgcctgccatacctggaacatgtgggccataaccatacctataatatggccccctctgccttggattccgccgacttaccccctccttctgccttgaaaaaggggtccaaagagaagcaggctgacttcctggacaaacagatgtctcgggatgaacatcgagcacgggctatgaagataccatttactaacgataagatcataaatctccccgttgaggaattcaatgagctgctgagtaagtaccagctgtcagaggctcagttatccctgattcgagatattaggcggagggggaaaaataagatggcagctcagaattgcaggaagagaaagcttgacacaatcctgaatttggagcgcgacgtggaagatctacagagagataaggcacgactgcttagagagaaagtggaattcctgcggtctctcaggcagatgaagcagaaggtgcagtccctttaccaggaagttttcgggcgcctgcgggacgaaaatgggaggccatactcaccttctcagtatgccctgcagtatgctggtgacggctcggtactacttatacccaggactatggccgatcagcaggcccggagacaggaacggaaacctaaggaccgacgtaagtag

SEQ ID NO: 197562 - DNA, 2319 bp, Artificial Sequence
  Description of Artificial Sequence: Synthetic coding sequence
atgctgagcctgaagaagtacctgaccgagggcctgctgcagttcaccattctcctctccttgatcggagtgcgagtggatgtcgatacttacctcaccagtcagctgcccccgctgcgcgaaatcattttgggcccctcaagcgcctacacacagacccagtttcacaacctgagaaacaccttagatggatacggcatccaccccaagagtattgacctggacaattacttcaccgcgcggcgcctactgtctcaggtgagggctctggaccgattccaagtccccacaacggaggtaaacgcgtggctggtccacagagatcctgaaggctctgtgtccggtagccagcccaatagcggactggcactagagagcagctctggactgcaggatgtgaccgggccagacaatggagtgcgcgaaagcgagacagaacagggctttggagaggatctcgaggatctgggcgcggtcgcacctcccgtgtccggtgatttgacaaaagaggatatcgacctgatcgatattttgtggagacaggacatcgacctaggtgctggaagggaggtgttcgactatagtcacaggcagaaggaacaggacgtagaaaaggagctgagagacggcggagagcaagacacatgggcgggagagggcgcagaagccctggcacggaacttattggtcgatggtgaaacaggtgagtcattcccagcccaggttccttctggcgaggatcagaccgccctaagcctcgaagagtgcctccgcctgttggaagcaacatgccccttcggcgagaacgctgaattccccgctgatatctcttctatcacggaggctgtgcctagcgagtcagagccccccgctctacagaataacctgttgagtccactgctgaccggcactgaaagcccttttgacttagaacagcagtggcaagacctcatgagtataatggaaatgcaggccatggaggtgaatacctccgcctcagagattctttactctgcacccccaggagaccctctgagtacgaactactcattggccccaaacactccaatcaatcagaatgtctctctgcatcaggcaagtcttggcggttgttctcaggacttcctcctcttttcccccgaggtcgaatcactgcctgtcgctagctcctcaacattactgcccctggctccttcaaattccaccagcctgaatagtacattcggatccaccaatcttactggattgttctttcccccccagttgaacggaactgccaatgacactgctgggcctgaacttcccgaccccttggggggactgctggatgaagcaatgttggacgagatctctctgatggatctagcgattgaggagggcttcaatcctgtccaagctagccagctggaggaggaatttgatagcgactctgggctgtccctcgattccagccactcacccagttccctgtcctcatcggaaggttcatcttcaagctcatcttcctcatcgagctcatcatcctctgcctccagttcagcaagctcatctttcagtgaggagggagcagtggggtactcttcagattctgaaacccttgatttagaagaggccgaaggagctgttggctaccagccagagtactcaaagttctgtcggatgtcctaccaggatcctgcgcagctgtcctgtcttccctatctggagcatgtaggccataaccatacatataatatggcaccttctgctctggatagcgctgatcttccaccacccagtgcgctgaagaaggggtcaaaagagaaacaggcagatttcctcgacaagcagatgagccgcgacgaacacagggcacgcgccatgaagataccattcaccaacgataagataattaaccttccagtagaagagttcaatgagttacttagtaagtatcagctgtccgaagcccaactctctctcattagagatataaggcggcgcggcaaaaacaagatggcggcccaaaactgcaggaaacggaagctcgacacaatactgaacctggagcgggatgtcgaggatctgcaaagagacaaagcaagactgcttcgtgagaaagtggagttcttgcgttctctgcgtcagatgaagcagaaagtgcaatctttgtatcaggaggtctttggtcggttgagggacgagaatggaaggccatactcaccatcccaatatgccctgcagtatgcgggtgacggctctgtcctccttatccccagaacaatggctgaccagcaggcacgacgccaggaaaggaagcccaaggatagacgcaaatag

SEQ ID NO: 197563 - DNA, 2376 bp, Artificial Sequence
  Description of Artificial Sequence: Synthetic coding sequence
ttcgtgttctggaagatcctgaagaccaagaagcacaagcacagcggaccgagtgccatgctcagtctgaagaaatacctcaccgaagggctccttcagtttactatactgctgtcacttattggagttcgcgttgacgtagacacttatttgacttctcagctacctccgctcagggaaatcatactaggcccgtccagcgcctatacccaaacccagtttcacaatctgaggaatactctagatggctacggtatccaccctaagagcatagacctggacaattactttacagccagaagactactttcccaggtccgtgctctggataggttccaagtgcccaccacagaggttaatgcttggctggtgcacagggacccagaaggatccgttagcggcagccagccaaactccggactagctctggaaagttcctctgggctacaggatgtgacgggtcctgataacggcgtgcgagagtccgaaacagaacagggatttggagaagacctggaggacctgggggcagttgcaccaccggtttctggagacctcactaaggaagatatcgatttaatcgacatcctctggaggcaggatattgacctgggcgccggaagggaggtgtttgattactcccataggcagaaagaacaggacgtagaaaaggaacttagggatggaggtgaacaggacacttgggctggagagggcgcagaggccctcgccagaaaccttctggtcgacggagagaccggcgagagtttcccggcacaggtgccctctggcgaggaccagactgccctgagtcttgaagagtgtctgcgcctgctcgaagctacttgtccgttcggtgagaacgcagaattcccagctgacatcagttcaattactgaagccgtaccatccgaatctgagcccccagccctccagaacaatctcctgtcccccctgctgacaggaacagagtcaccgtttgaccttgaacagcagtggcaggatttgatgtctatcatggaaatgcaggcaatggaagtaaatactagtgcctcggaaatcctatactccgccccaccgggcgacccattgtctacaaactacagtttggcacctaatacccctattaatcaaaacgtgtcccttcatcaagcctcgctgggtggctgcagtcaggacttcctgctgttctcacctgaagtggagagcctgcccgtcgcgtctagctccaccttgttacccctggccccttctaatagcactagcttaaattccacttttgggagcactaatctgactgggctcttttttccaccccagctcaatggaactgccaacgacacagccgggcctgaacttcctgatcccttggggggcctactggatgaagccatgctggacgagatttctctgatggacctggctatcgaagaaggcttcaatcccgtgcaggcctctcagcttgaagaggagtttgatagcgatagcggtttgtcactcgacagctctcattcaccaagctccctcagctcatccgaggggtcgtccagttccagcagttcatcgtctagttcctcatcatcggcttcatccagtgctagcagcagtttcagcgaggagggcgcggtcggatacagcagtgattccgaaacactggatttagaggaagcagagggagccgttggctaccagccagagtatagcaaattctgccgaatgagttatcaggatccagcccagctgtcctgcctcccctacttagaacatgtgggccataaccacacttataacatggctccatccgctttggactctgccgatctgccgcccccatctgcccttaagaaggggagcaaagaaaagcaggccgattttcttgacaaacagatgtctcgagatgagcacagagcaagagccatgaaaatcccatttaccaacgataaaattatcaacctacctgttgaagagttcaacgaattgttgtcgaagtaccagctgtcagaagctcagctctctttgattcgcgatatccggcggaggggtaagaacaaaatggcggcccagaactgccgaaaacgcaagcttgataccatcctgaatctggaacgtgatgtggaggacctacagagggacaaagctcgcttgctccgagagaaggtcgaattcttacgaagtctgcgccaaatgaagcagaaagtgcagtctctgtatcaagaagtgtttgggcggctgcgcgacgagaacggaaggccgtatagccctagccagtatgccctgcagtatgccggagacggcagtgtgctgctgatcccacgcaccatggcagaccagcaggcccggcggcaagaaagaaagcccaaggaccggagaaaatag

SEQ ID NO: 197564 - DNA, 1851 bp, Artificial Sequence
  Description of Artificial Sequence: Synthetic coding sequence
atgacccggctggaccggagcagccacagcggcggcggccacgccaaggggtcccggcccctgaatagtctgctggccggtcatcgggtcgcacagcccgcaagcgctcccggctcacgagcatctgttcaagacatagacctgatcgacatcctttggagacaggatattgatctcggcgcagggagggaggtgtttgactactctcatcgccaaaaagaacaggatgtggaaaaagagctgcgggatggtggagagcaggatacctgggcaggggagggtgcagaggctcttgcccgcaacctgttagtggacggagagaccggcgagtcgttcccagcccagttcccagccgatataagctctataacagaggcggttcctagcgagtccgagcccccggcgctgcagaacaatctattatctcccttactgaccggcacagagtcacctttcgaccttgaacagcagtggcaggatttaatgtccattatggagatgcaggccatggaagtgaatactagtgcatctgaaatcttgtattctgccccacccggcgaccctctgtctaccaactacagcttagctccaaacaccccaataaaccagaacgtgagtctgcaccaggcatctctgggaggttgctctcaagatttcttgctgttcagccccgaggtggagtcactgcctgttgctagcagcagcaccctgctgccactggccccttcgaatagtacttcccttaacagtacgtttgggagcactaatctgacagggcttttctttccgccccagttgaacgggaccgccaatgataccgccggtccggagcttcccgaccctctcggtggactcctggacgaagcaatgctggatgaaatcagtctgatggatctagccatagaggagggtttcaatccagtgcaggcctctcagctcgaggaggagttcgattctgacagtggtctgtcactggattccagccatagtccttctagcctttccagctccgaagggtcaagtagttctagctctagttcatcatcttcgagtagcagcgcatcttcatccgcgtcgtctagcttctcagaagaaggagcggtcggatacagttccgatagtgagacactggatctcgaggaggcggaaggggcagttgggtaccagccagagtattctaaattctgtcggatgagttatcaggatcctgcgcagctgtcctgcttaccgtacctggagcacgtcggccataaccacacatacaacatggcccctagtgctctggatagtgcagacctacccccaccctctgctctgaagaagggctccaaagaaaagcaggcggatttcctggataagcagatgagcagagacgagcaccgagcccgagccatgaaaatcccttttactaatgacaagatcattaatttgcctgtggaagaatttaatgagctcctaagcaagtatcaactaagcgaagctcagctctctctgattagagacattcggcgacgagggaaaaacaagatggctgctcagaattgtcggaagcggaagctggacacaatactgaacctcgaacgtgacgttgaggatctgcagcgcgataaggctcgactgcttcgggagaaggtcgagttcctccgatcccttcgtcagatgaaacagaaggtgcaatctctgtaccaggaagtgtttggccgcctgcgcgatgagaatggtagaccttacagccctagtcagtacgccctgcagtatgcaggagatggtagcgtgctgctgattcctcggacgatggctgatcagcaggcccgcagacaggaaagaaagcccaaagataggcggaagtag

SEQ ID NO: 197565 - DNA, 1818 bp, Artificial Sequence
  Description of Artificial Sequence: Synthetic coding sequence
atgatggacctggagctgcccccccccggcctgcccagccagcaggacatggaccttattgacattttgtggaggcaggatatcgacctgggcgtatcccgcgaggtcttcgatttcagccagcggcggaaggaatacgaactggagaaacagaagaaactggagaaagaacggcaagaacaactgcaaaaggagcaggagaaggccttttttgcacagctgcagctggacgaggagacaggggaattcctgcctatccagcccgctcagcatatccagtctgagaccagtggtagcgccaattactcccaggtagcacatattcctaagagcgacgccttatacttcgacgactgtatgcaactcctggcccagacattcccgtttgtggacgataatgaagtgagctctgccacattccagagtttggtcccagatatccctgggcatatcgagtctcccgtgtttatcgctacaaatcaagctcaatcccccgagaccagtgtcgcacaggttgcaccagttgacctggacggcatgcagcaggacatcgaacaagtttgggaagaactgctgtccatccctgagcttcagtgtctgaacattgaaaatgacaagctagtcgaaacaaccatggtacctagtcctgaagctaaactgaccgaggtggataactatcatttctacagcagcattccgtctatggaaaaagaggttggtaactgctccccccactttttaaatgccttcgaggacagtttttcctccatattgagtaccgaggaccctaatcagctgacagtaaattctcttaatagcgatgccactgtcaatacggattttggagacgagttctactctgccttcatcgccgaaccctctatcagtaacagtatgccctccccagctacgctaagccacagtctgtcggagctcctaaatgggccaatcgatgtaagcgatctgtccctttgtaaggcctttaaccagaatcatccagagtcaaccgctgaatttaacgattcagactctggaatctctctgaataccagcccttctgttgccagccccgaacactccgtggagagctctagttatggcgacacactgctggggttgtcagattcagaggtggaggagctggactctgcgcctgggtccgtaaaacaaaatgggcctaagacaccagtccactctagtggagacatggtgcagcccctgagcccttctcagggccagtccacccacgtgcacgacgcacagtgtgagaacaccccggagaaggaactgccagtttcaccgggtcaccggaagaccccctttaccaaagacaaacactcatcccgactcgaggctcacctgactcgagacgagctgagagcaaaggccctccacattcctttcccagttgaaaaaatcattaatctgccagtggtggattttaatgagatgatgtcgaaagaacagtttaacgaggcccaactggcactgattcgggatatacgacgacggggcaaaaataaggtggcggctcagaattgcagaaaaagaaaattagaaaacatcgtagagctggaacaggaccttgaccacttaaaagacgaaaaggagaaactgctgaaggagaaaggcgagaacgataagtcgctgcatctactgaagaaacagttgagcactttgtacctggaggtcttcagtatgttacgggacgaagatggtaaaccatacagtccatccgaatattccctccagcaaaccagggacgggaacgtgtttttagtaccaaagtctaagaaacccgatgtgaaaaaaaattag

SEQ ID NO: 197566 - DNA, 1770 bp, Artificial Sequence
  Description of Artificial Sequence: Synthetic coding sequence
atggacctgatcgacatcctgtggcggcaggacatcgacctgggcgtgtctcgtgaggtcttcgacttctctcagcggagaaaggaatatgaactggagaaacagaaaaaacttgaaaaagagaggcaggagcagctccaaaaggaacaggagaaggccttctttgcgcaactccaacttgatgaggagaccggtgagttcttgcccatccagcctgcccagcatatccagtctgagacttccggctcagcaaactatagccaggttgcgcacattcccaagtcagatgcactatactttgacgattgtatgcaattgttagcccagacctttcccttcgtggatgataatgaggtctctagcgccacttttcaaagcttggtccctgatatccctggccacatagaatcgcccgtctttattgcaactaaccaggcccaaagtccagagacctctgtggcccaggtggcccctgtagatcttgacggtatgcagcaggatattgagcaagtttgggaagaactcctgagtattcctgagctacagtgtctgaacatagaaaacgacaagctggttgagacaacaatggtgcctagcccagaagccaaactgacagaagtggacaattaccatttttattcttctattccttcaatggagaaggaggtcggcaactgcagtcctcatttcctcaacgccttcgaagactcgttctcatctattttgtctacagaggatcctaatcaactcactgtcaactctctcaattcagacgccaccgtgaacaccgacttcggtgacgaattctatagtgcctttatcgcggaaccgtctattagcaattcaatgccgtctcctgcaactctgagtcattcactgagtgaactactcaacggtccgatagatgtaagtgatttatcactatgtaaggcttttaatcagaatcaccccgagtcaactgctgaatttaacgattccgattccggaattagcctgaatacgtccccgtcagtagcgtctccagagcactctgtggaaagctcctcctacggggacacactactggggctcagcgattcagaagttgaagaactagatagcgcccccggcagtgtcaagcagaacggtccgaagactccagtgcatagcagcggagacatggtgcaaccactctccccctcccaggggcaatcaactcatgtgcacgacgcacaatgcgagaacacgcccgagaaggaactgcccgtttccccaggccatcggaagacaccctttacaaaggataagcactcttctagattagaagcccatctgacccgggacgaattaagggcgaaggcactccacatcccatttcctgtcgaaaagatcatcaacctccccgtggtagattttaacgagatgatgtcaaaagagcagttcaacgaagcccagctggccttaattcgggacatcagacgaagggggaagaacaaggttgcggcccagaactgccgaaagagaaaactcgaaaacatagttgaattggagcaggatttggaccacctaaaagatgagaaggagaagctgctgaaggagaaaggcgaaaatgacaagtctttgcatctcctgaagaagcagctgagtactctgtacctggaggtgtttagcatgcttcgcgacgaagacggaaagccatacagcccttcagaatacagcctgcagcagacccgggacgggaacgtgtttcttgtgccgaaaagcaagaagccagacgtgaaaaagaactag

SEQ ID NO: 197567 - DNA, 705 bp, Artificial Sequence
  Description of Artificial Sequence: Synthetic coding sequence
atggacctgatcgacatcctgtggcggcaggacatcgacctgggcgtaagtagggaagttttcgactttagtcagcgcaggaaggagtatgaactcgaaaagcaaaaaaagctggagaaggaacgacaagagcagctgcagaaggaacaagagaaagccttttttgcacaactgcagctggatgaggagacaggagagttcttgcctattcagccagcgcagcatatacagagcgaaaccagcggctcagcgaactactcccaagtcgcgcacattcctaaaagtgacgcgttgtacttcgacgattgtatgcaattgctagcacaaactttccctttcgttgacgataacgaggtctcctccgcgacatttcagtctttggttcctgacatccctggccacattgagagtcctgtatttatcgccaccaaccaggcacagagccccgagacctccgttgcccaggttgccccagttgatcttgatgggatgcagcaggatatcgagcaggtatgggaagagctgctatctattcccgaactgcagtgtctaaacatcgagaatgacaagctagtcgagacaacaatggtcccttcccccgaagcaaagctcacagaagtcgataactaccacttttactccagcatcccctccatggagaaagaagtgggaaactgctctccacattttctgaatgccttctag

SEQ ID NO: 197568 - DNA, 843 bp, Artificial Sequence
  Description of Artificial Sequence: Synthetic coding sequence
atggacctgatcgacatcctgtggcggcaggacatcgacctgggcgtgagtcgagaagtctttgatttctctcagaggagaaaagaatatgaactggagaagcagaagaagctcgaaaaggagagacaggaacaactgcagaaggaacaggaaaaggccttctttgctcaactgcaattggatgaggaaaccggtgagttcctgcccatccagcccgctcaacacatccaatctgagacaagcggctctgccaactattcacaggtcgcacacatccctaagtcagatgctctgtatttcgacgactgcatgcagctgcttgcacagacctttccatttgtcgatgataacgaggtatcctctgcgacttttcagtcgctcgtccctgacatcccaggccatattgaaagccccgtgtttatagctactaatcaggcccagtctcccgagacatccgtggctcaggtcgcaccagttgatctcgacggcatgcaacaggatattgagcaggtgtgggaggaactgctgtcaatcccggagctgcaatgtttgaacatcgagaacgataaactggtggagacgaccatggtgccaagccccgaggcaaagctgaccgaagttgataattatcacttctactcgtcaattccctctatggaaaaagaggtggggaattgcagccctcacttcctcaatgcattcgaggatagtttctcgtctatcttaagcacagaggacccgaatcaactcacggtcaactctttgaactctgacgctaccgtcaatacagactttggcgatgagttctattccgcgttcatcgcggaaccaagcataagctag

SEQ ID NO: 197569 - DNA, 1749 bp, Artificial Sequence
  Description of Artificial Sequence: Synthetic coding sequence
atggacctgatcgacatcctgtggcggcaggacatcgacctgggcgtatctagagaagtgtttgacttctcacagcgtcggaaagagtatgagttagaaaagcaaaaaaaactggagaaagagcgacaagagcagctccaaaaagaacaggagaaggcattcttcgcgcaactgcaattggatgaagagaccggcgaatttctgccaatacagcccgcccagcacatccagtctgagactagtggctccgcaaattactctcaggtggcacatatccccaagtctgatgctctttactttgacgactgcatgcagctgctggcacagactttccccttcgtggatgataacgaatcccttgttcccgacatcccgggccacatcgagagtccggtgttcatcgctacaaaccaggcccagtccccagagacttcggttgcgcaagtggcaccagtggatctcgatggcatgcagcaggatatcgaacaggtgtgggaagaattactgtccatcccagaactgcagtgtctgaatatcgagaatgataaactcgttgaaaccacaatggtacccagtcccgaggctaaactcactgaggtagacaactaccatttttactcctccatacctagcatggagaaggaagtgggcaattgttcacctcattttctgaacgcgtttgaagactcttttagctcaattctgtctaccgaggatccgaatcagctcacggtgaacagcctgaactctgacgccacagtgaatacggacttcggggacgagttttactcagcttttattgccgagccttccatctctaactctatgccgtctcctgccactctatcacactcactgtctgaactattaaatgggccaattgacgtgtcagacttatccctgtgtaaggcttttaaccaaaaccatccagagagcactgctgagtttaatgacagcgattccggaatcagcttgaacaccagcccaagtgtcgccagcccagagcattctgtggagagtagctcttatggggatactttactgggcctctccgatagtgaggtagaggaactggattccgcacctggaagtgtgaagcagaatggccctaagactcccgtgcacagtagtggcgatatggtgcagccactctcccccagccaaggacaaagcactcatgtccatgatgcccagtgcgagaatacacctgagaaggaactccccgtgtctcccggccacaggaagaccccctttaccaaagataaacacagcagccgtctggaagcacatctgacgagggatgagctgcgcgcgaaagcgctacacattccgtttcctgtggagaaaattatcaatctgcccgtcgtggactttaacgaaatgatgagcaaggaacagtttaatgaagcacagctcgctctgattcgagacattcggcgaagaggcaaaaataaggtagcggcccaaaactgccggaagagaaaacttgagaatatcgtggaattagagcaggatctggatcacctgaaggacgaaaaagaaaagctgttgaaggagaaaggcgagaacgataaaagcctgcatctccttaaaaagcagttgagcacgttatacttggaagtgttcagcatgctgcgagatgaggacgggaaaccatactcaccctcggagtatagtctccaacagacacgtgatggcaatgttttcttggtacctaaaagtaagaaaccggacgtgaagaagaactag

SEQ ID NO: 197570 - DNA, 2085 bp, Artificial Sequence
  Description of Artificial Sequence: Synthetic coding sequence
atgaagcacctgaagcggtggtggagcgccggcggcggcctgctgcatctgacacttcttctgtctctggccggcttacgagtggacctggacttgtatttgttactacctcccccaacccttctgcaggatgagctgctctttttaggaggtcccgcctccagcgcctacgcgctgtcaccattctctgctagtggcggatggggtcgcgcgggacatctccaccctaagggtagagaactcgatccagccgctccccccgaggggcagctcctcagggaggtgagagctcttggcgtacccttcgtgccccgaactagcgtcgatgcatggcttgtgcattctgtagctgccggctcagccgacgaggcacacggactgctgggagcagcggctgcatccagcaccggcggcgccggtgctagtgtagacggcggctcacaagccgttcaagggggcggaggcgacccgcgggccgcaaggagcggcccactcgacgctggcgaggaagagaaagcgcccgccgaacctacagcacaggtaccggacgccggagggtgtgcctccgaagaaaatggcgtgctgagagagaagcacgaagccgtggatcacagtagccagcacgaggagaacgaggagagggtgtcagcgcagaaagagaattcgttgcagcagaatgatgatgatgagaataagatagcggaaaagcctgattgggaagcagaaaaaacgactgagtcccgcaatgagcggcacttaaacggcaccgatacttccttctctttggaagatcttttccagttgttgagcagccaacccgaaaactctctcgaaggcatttcccttggagacattcctctgccaggtagtatcagcgatggcatgaatagtagcgcacattaccatgtgaatttttctcaggctatatcacaggatgtgaatctgcacgaagctatcctgctttgcccaaacaatacctttaggagagatcccacagcacgaaccagtcagtcacaggagccatttctgcagctgaactctcacaccacgaatccggaacagactctgcccgggacaaatctgacagggtttctgtctcctgttgataaccacatgagaaacctaaccagccaggatctgttatacgaccttgacatcaacatctttgatgaaattaatttgatgtctctggcgaccgaggacaactttgatccaatcgacgtttcacagctctttgatgagcctgattcagattccggcctttctcttgacagttcgcataataacacaagtgtcattaaatccaatagcagccattccgtttgcgatgaaggtgccattggctactgcacagaccacgagtcttccagccatcatgacttggaaggcgcggtgggtggctattacccggagcccagtaagctgtgtcacctggatcagtccgattccgactttcatggggatctgaccttccagcatgtgtttcataatcacacttatcacttacagcccaccgctccagagagcacgagtgagccctttccatggcctggaaaaagtcagaagattaggagtcgttacttggaagataccgacaggaacctgagccgcgacgagcagcgagccaaggcccttcatattcctttctctgtggacgagattgtgggcatgccagtagacagttttaactcaatgctaagccgatactatctgaccgatctacaagtctctttaattcgcgatattcggcggagaggaaagaataaggtggctgctcagaattgccgaaagcggaagctagatattatcctgaaccttgaagacgatgtctgtaacttgcaagctaagaaggaaaccctcaagcgggagcaggcccaatgcaataaagctatcaatataatgaagcaaaaactgcacgatctgtatcacgacatcttcagtcgcttacgggatgatcaaggaaggcctgtgaaccccaaccactacgcccttcagtgtacgcatgacgggtcaatcctcatcgtgcccaaagaacttgtggccagtggacacaagaaggagacacagaaaggcaaacggaaatag

SEQ ID NO: 197571 - DNA, 1200 bp, Artificial Sequence
  Description of Artificial Sequence: Synthetic coding sequence
atgaacagcagcgcccactaccacgtgaacttcagccaggccatcagtcaggacgtgaatcttcatgaggctatcctgctctgtcctaacaacaccttccggagggatccaactgcgcgcacatcacaaagccaggaaccctttctccagctgaattcccacactacaaaccccgagcaaaccctgcccggaacgaatctcactggattcctgagccctgtggataaccacatgcgtaatctgaccagccaggatctgctctacgacttggacatcaacattttcgacgagataaatctgatgagcctggccaccgaggacaactttgatccgatcgatgtgagccagctgttcgatgagccggattcggatagtggcctcagtctggattcctcccacaacaatacaagcgtgattaaatcaaattcttctcactctgtgtgcgacgaaggggcaatcgggtattgtaccgaccacgagtcctcatcgcatcacgacctagaaggggcggtcggggggtactatccagaaccttcaaagctgtgccacctggatcaaagcgattcagattttcacggggatctgaccttccaacacgtgttccacaaccacacatatcatcttcagcctaccgctccagaaagtacctccaatctgttcaggccaggaaagagtcagaagatccggagtaggtacctcgaggataccgacagaaatttaagcagggacgaacagcgcgccaaagccctgcatatccctttcagcgtcgacgagatagttggcatgcctgttgactctttcaattcaatgctctcaagatactacttgacagatctccaggtaagcctgattcgagatatccgtcgaaggggcaagaacaaggttgcagcccagaattgccgaaagcgcaaactcgacattatcctgaacctggaggacgatgtgtgcaatttacaggctaaaaaagagacactaaagagggagcaggcccaatgtaataaggcaatcaacattatgaagcagaaattacacgatctttaccatgacatattctccagattgagagatgaccagggaaggcccgtgaaccccaaccactacgccctgcaatgcacccacgacggcagcattcttatcgtacccaaggaacttgtggcctctgggcacaagaaggagactcagaagggtaaacgcaagtag

SEQ ID NO: 197572 - DNA, 1143 bp, Artificial Sequence
  Description of Artificial Sequence: Synthetic coding sequence
atgtacagccccctgtgcctgacccaggacgagttccaccccttcatagaggcactccttcctcacgtccgcgcatttgcttacacatggttcaatctccaggcccgtaaacggaaatactttaaaaagcatgagaaaagaatgtccaaggaagaggaacgagcggtcaaggacgagctgctcagtgagaagccggaagtgaaacaaaagtgggcttcccggctattggcgaaactcagaaaggacattcgccctgagtaccgcgaggattttgtcttaactgttactggtaaaaagccaccatgttgtgtactttcgaaccccgaccagaaagggaaaatgaggcgcatagactgcctaaggcaagcagataaggtgtggcgcctcgacctcgtgatggtgatactcttcaagggtattcctctcgagtccacagatggggaacgtcttgttaaatctcctcagtgctccaacccaggactatgtgttcagccccaccatatcggcgtgtcagttaaggaactggacctctatctggcctatttcgtgcacgctgcgggcatgccgtcacctaccacgctgaaaaaatcggaaaaaagtgggttctcaagtccttctcccagccaaacatcatccttagggactgcctttacccagcaccaccggccagtgatcacggggccacgtgccagcccccacgcaactcccagcacgctacactttccaacatcccccatcattcaacagccaggcccatacttcagccatcccgccattcggtatcatccacaggagaccttgaaggaatttgttcaacttgtgtgtccagatgcaggtcagcaagctgggcaagttggttttctgaacccaaacgggagctcccagggaaaggtgcacaatccttttctccctacacccatgctgcccccacccccacctccccccatggcgcgtccagtgccgctccctgtccccgacaccaaaccaccgacaacatcaactgagggaggcgctgccagccctacttcgcctacttattcgacccccagcactagtccggccaatagattcgtgtccgtgggtcctagagacccttctttcgttaacattccccaacagacccagtcctggtacctcggatag

SEQ ID NO: 197573 - DNA, 1464 bp, Artificial Sequence
  Description of Artificial Sequence: Synthetic coding sequence
atgtacagccccctgtgcctgacccaggacgagttccaccccttcatcgaggccttgctgcctcacgtgagggcattcgcttatacttggtttaacctgcaggcaagaaagcgcaagtattttaagaaacatgaaaagagaatgtcgaaggaagaggaaagggctgtgaaggacgaactgctaagcgaaaaacctgaggttaaacagaaatgggcctcacgccttttagccaaacttcgcaaggacattaggcctgagtatcgcgaagattttgtgctgacagtcaccggcaaaaagcctccgtgctgcgtgctctctaatcccgatcagaaaggcaaaatgcgacgcatcgactgccttcgacaagctgacaaggtttggcggctcgatctggttatggttattctattcaagggcatccccctggaaagcacagatggtgagcgcctggtgaaatcaccacaatgcagtaatccaggattgtgtgtccagccacatcacattggggtatcagtaaaagaacttgatctgtacctggcctacttcgttcacgccgcgggccatctgggttttcaggattcttttgttacttcgggagtcttctccgtgaccgagctggtaagggtctcacaaactccaatcgcggcaggaacaggccccaatttttcactgagtgacctggagagctctagctattatagtatgtctccaggcgccatgagaaggtccctacctagcactagcagcacgagctcaaccaagaggttaaagtccgtggaagacgagatggacagtcccggtgaagagcccttttacaccggtcaaggacggtctccagggagtgggagtcagtcttctggatggcacgaagtggaaccaggaatgccttctccaacaactttgaaaaaaagtgagaagtctggcttcagcagtccatcgccttcacagacctcatctttagggacagcattcactcagcaccacaggccagtaatcacagggcctagggcgtcacctcacgccaccccttcaacattgcactttccaacgtctcccataatccagcagcctgggccatacttcagtcaccccgctatacgataccacccgcaggagacattgaaagaatttgtgcagctggtatgccccgatgccggccagcaggcaggtcaagtgggattcttaaatcctaacgggtccagccagggaaaggttcacaaccctttcctgcctactcccatgctcccccctccaccgcctccacctatggctcgacccgttcctctacccgtcccagatactaagccaccaaccacatcaacagagggaggagccgccagcccaacctcgcccacgtacagcaccccaagcacgtcccctgcaaatcgattcgtgagcgtcgggcccagagatccatcttttgttaatatccctcagcaaactcagtcttggtatctgggatag

SEQ ID NO: 197574 - DNA, 1401 bp, Artificial Sequence
  Description of Artificial Sequence: Synthetic coding sequence
atgtacagccccctgtgcctgacccaggacgagttccaccccttcattgaggctctcctgccgcacgttcgggcctttgcttacacgtggtttaacttacaggcgcggaaaagaaagtattttaagaagcatgagaaaaggatgagtaaggaggaggaacgggctgtgaaagacgaactgcttagtgaaaaacccgaggtgaagcagaaatgggccagcagactgctggcaaaactgagaaaagacattcgacctgagtacagagaggactttgtcttgaccgtgactggaaagaagcctccctgttgtgtgctgagtaacccagatcagaagggaaaaatgcgacggatcgactgtttacgacaagccgataaagtctggcgactagacctggttatggttatcctctttaaaggaatcccactggagtctactgacggggaaaggctcgtgaagagtcctcaatgctcaaacccgggcttgtgcgtgcagccccatcacatcggcgtgagcgtaaaggagctcgatctttacctagcctactttgtgcatgcagccgactcgtcccaatctgagagcccgagtcagccctcagatgccgatatcaaagaccagcctgaaaatggtcacctgggatttcaggacagttttgtcacctccggcgtgttctctgtcacagaactagtccgggtttcccagactccaatcgcagctggcacagggccaaacttctccctatcggatctagagagtagcagctactactcaatgtctcccggggcaatgaggagaagtctgccctccacatcaagtacaagtagcaccaagaggcttaaaagcgtcgaggatgagatggattcccccggtgaggaaccattctataccggccaaggcaggtccccgggctccgggtcccaaagttcaggatggcacgaagtggagcccgcttctccccacgccacgccatccactcttcacttccctacaagccctatcatccagcagcctggaccgtatttcagccaccccgccattagatatcaccctcaggagactctgaaggagttcgttcagctggtgtgtccagatgctggacagcaggcaggccaggtgggcttcctcaacccgaatggaagctcgcaaggcaaagtacacaatcccttcctgcctaccccaatgctgccaccgccgcccccaccgcccatggccaggccagttccattgcccgtacccgacactaagcctcctaccacctctaccgaaggtggggcagcctctccaacctctccaacctattcaaccccttctacgagcccggcaaatcgcttcgtgtctgttggtcccagagatccttccttcgtcaatattcctcagcagactcagtcatggtaccttggctag

SEQ ID NO: 197575 - DNA, 1665 bp, Artificial Sequence
  Description of Artificial Sequence: Synthetic coding sequence
atgcagatgtgccggcccgccagcagcagcgtgctgtacgtgcccacgagatggcctgggggctgtggagccacatggcaatcttgtccatcacccccccctcgccgaacgcgcatcccccagcggccagctgtgatgtattcccctctatgccttactcaggatgagtttcatccattcatcgaggctctcctcccccacgtgagggcatttgcttatacctggtttaaccttcaagcgcgcaagcgtaagtactttaagaaacacgaaaaacgcatgtcgaaagaggaggaaagagcggtgaaggacgagctcctgtcggagaaaccggaggtcaaacagaaatgggccagcaggcttttggcaaaactgcggaaggacatacggcccgagtatcgagaggatttcgttcttactgtaactgggaaaaagccgccttgttgtgttcttagcaatcctgatcagaaggggaaaatgagacgaatagactgcttgaggcaggccgacaaggtctggaggctagatctggtgatggtgatcctatttaagggaatccctctcgagagtactgatggcgagcgcttggtcaaaagtcctcagtgtagcaatccaggtctctgtgtgcagccccaccatatcggggtcagcgtgaaagaactcgatctgtacttggcatatttcgtgcacgccgccgactcaagccagagcgagagcccaagtcaaccttccgacgccgacatcaaggatcagccagagaacggccatctgggatttcaggattcttttgtcacctccggggtatttagcgtgacagagttagtgcgagtgagccagacacctattgccgcaggcactggacctaactttagcctatccgacttggagtcaagttcctactattctatgtcccccggtgcaatgagacgatctctcccatctacatccagcacaagctctaccaaacgactgaagagcgtcgaggatgaaatggactctccgggagaagagccattttacacaggccagggacgctcccccggtagcggctcgcagtcttcaggctggcatgaggtcgagcccggaatgccaagcccgactaccctgaaaaaaagtgaaaagagtggcttcagttctccaagccccagccaaacatcctctcttggcactgccttcacccagcaccaccgtccagtcatcactgggccgcgcgcaagccctcacgcgaccccgtcgaccctgcactttcccacttcaccaatcatacaacaaccagggccttactttagtcaccccgccatccggtatcacccccaagaaacactgaaggagtttgtccagctggtgtgtcctgatgccggccagcaagctggacaagtgggtttcctcaatcctaacggtagcagccaggggaaagtacacaacccattcctgcctacccctatgctaccaccgcctcctccacccccaatggctagacctgtccccctgcctgtgccagatacaaagccgccaaccacctccacagagggaggtgctgcgtcccctaccagccccacctacagcacaccatctacttcccctgcaaatcgtttcgttagcgtgggccctagagacccctcttttgtcaacattccacagcaaacccagagttggtacctgggttag

SEQ ID NO: 197576 - DNA, 1599 bp, Artificial Sequence
  Description of Artificial Sequence: Synthetic coding sequence
atgaagctggccgacagcgtgatggccggcaaggccagcgacggcagtatcaagtggcagctctgctatgacatctcagcaaggacttggtggatggacgagttccatccattcatcgaagctctccttccccacgttcgtgcatttgcatacacatggtttaacctccaggcccgtaaacgtaaatactttaagaagcatgagaaaagaatgtctaaggaggaagagcgagctgtgaaggatgaactcctgtcggaaaagcccgaggtgaaacagaagtgggcatctcgcctcctggctaagctgcgtaaggatattagaccagagtaccgggaagattttgttctgaccgtgacagggaagaaacctccatgctgcgttctgagtaaccctgatcaaaaaggcaagatgcggagaatagattgtctgcgccaagctgataaggtgtggcgcctcgacctggtgatggtaatcctgttcaaaggcattccccttgagagtacagatggagaacgcctggtgaaaagcccgcagtgctccaatcctggcctttgtgtgcaaccccatcacatcggagtttccgtgaaagagctcgatttgtatctcgcttacttcgtgcatgccgccgacagcagccaaagcgaatcaccgtctcaaccttccgacgccgatataaaggaccagccggaaaacggacatctgggctttcaagactcattcgtgaccagcggcgtcttcagcgtcactgagttggtcagagtgtcacaaaccccaatagctgcagggaccggtcccaacttttccctgagcgatctggaaagcagcagttactacagcatgagtcccggagccatgcgccgctccttacctagcacctcatcaacttcaagtaccaagcgcctgaaatcagtcgaggatgagatggactcccccggggaagaacccttctatacaggacagggccggagcccaggatctgggagtcaaagttctggctggcacgaggtcgaacctgggatgcctagcccgacgaccctcaagaaatctgaaaaatcaggcttctcctccccaagcccgagccagaccagctctctcggtaccgcgtttacccagcaccacaggccagtgattacaggaccaagggcttcacctcatgcaactccctccaccctgcatttcccaacatcacctattattcagcaacctggcccctatttctcacatccggcaattcgctatcacccccaggagactctcaaggaatttgtccagctagtctgtcctgatgccggtcagcaagccggccaggttggtttccttaaccccaatggatcctctcaaggcaaggtgcataatcctttcctgcctaccccaatgctgccaccccctcctccacctccgatggcccgaccagtgcctctcccggttccagatacgaaacctcccaccacgtccaccgaagggggcgctgctagtcctacttcaccaacatactccactccatccacctcacccgcaaacaggtttgtgtctgtgggccccagagacccgtcattcgtcaatatcccacaacagacccagtcttggtacctcggatag

SEQ ID NO: 197577 - DNA, 1530 bp, Artificial Sequence
  Description of Artificial Sequence: Synthetic coding sequence
atgtacagccccctgtgcctgacccaggacgagttccaccccttcatcgaggcccttctgccccacgtcagagcgtttgcatacacttggtttaacctacaggcaaggaagcgcaaatattttaaaaaacacgaaaaacgcatgtctaaggaggaggagcgtgctgtaaaggatgagctcctctcagagaaacccgaggtcaagcagaaatgggcatcacggctgctggcaaaactcagaaaggatatcaggcccgaatacagggaggatttcgtcctgacggtgacagggaaaaaaccaccatgctgcgtcctgtccaaccccgaccagaagggcaaaatgcgccggatcgattgcctccgtcaggcagataaggtgtggcgccttgacttggtgatggttatcctgttcaaagggatcccgttagaatctaccgacggcgagcgactggtcaagagtcctcagtgtagtaatcccggcctgtgcgtgcagccccaccacatcggcgtttctgttaaagagctcgacctatacctggcttatttcgttcacgccgccgattctagccagtccgaatcaccaagccagccctcagacgctgacatcaaagatcaacctgaaaatggtcatctcggattccaagattcctttgtgacatctggcgtgtttagtgtaactgaattggtcagagtgtcccagacaccaattgctgcaggcactggccccaacttttcattgtccgatctggagtctagcagctattactctatgtctccaggagctatgcggagatcacttcctagcacaagcagtacaagttcaacaaaacgcctgaagtctgtggaagacgaaatggatagccccggcgaagaaccattctataccggccagggacgaagccctggatctggctcacagtccagcggctggcacgaggtggaaccgggcatgccgtctccgacaactctcaagaagagtgaaaaaagcggattttcttcaccgtcgccttcccagaccagctctttgggaacggctttcacccaacatcatagacctgtcatcactggcccgagggcatctccacatgcaacaccgagcactcttcactttcccactagtcccattattcaacagcctggtccttatttcagccacccggctatacggtaccacccccaggagactctcaaggagtttgtacaattggtctgccccgatgcgggccagcaggcaggccaagtggggttcctgaatccaaacggctcgtctcaaggcaaagtccataatccgttcctccccacccctatgttgcctcccccccccccacctcccatggctcgtcctgtaccgctacctgtgcctgacacaaagccccccaccacaagcacagaagggggagcagcctccccgactagcccaacctatagcaccccgtccacgtcgcccgccaatcgctttgtttccgtgggaccccgcgacccctcctttgtaaatatacctcagcagacacaatcttggtacctaggctag

SEQ ID NO: 197578 - DNA, 1506 bp, Artificial Sequence
  Description of Artificial Sequence: Synthetic coding sequence
atggacgagttccaccccttcatcgaggccctgctgccccacgtgagagccttcgcatacacatggttcaatctgcaggcgcgaaaacggaagtactttaagaagcatgagaaaagaatgtcaaaggaggaggagagggcggtcaaggacgaactcctgagtgaaaagccagaggttaaacagaagtgggcctctagattgttggcaaaactcagaaaggatatacgaccagagtacagagaagactttgtgctgacagtgaccggcaagaaaccgccttgttgcgtgttatccaaccccgaccagaaaggtaaaatgcgtaggatagactgtctgcgacaggcagataaggtgtggcgcctggacctcgttatggttatactgttcaagggcatccctctagagtccacagacggagaacgtttggttaagtccccacagtgctcgaaccccggcctgtgcgtacagccgcaccatattggtgtctctgtgaaagagctggacctatacctggcttacttcgtccacgcagctgacagctctcagtctgagagcccttcccagcctagcgatgctgacatcaaagaccagcccgaaaacggccatctaggattccaggacagcttcgtcactagcggcgttttttccgtaactgagctcgtccgtgttagtcaaactcccattgccgccggaactggcccaaacttctccttaagcgaccttgaaagcagctcctactactcaatgagcccaggcgccatgaggagatcattgccttccaccagctcaactagcagtacgaaacgactgaaaagcgttgaggatgaaatggattcccccggcgaagagccgttctacaccggccaaggaaggtcgcctggttccggcagccaatcctcagggtggcatgaggttgagcccggaatgccaagtcctaccacgttgaagaaatccgagaagtctgggttctcaagccctagcccctcacaaacatcatccctgggaactgcatttacccaacatcatagacctgtgataacgggcccccgtgcaagtcctcatgctaccccgtccacccttcatttccccacctcccctattatccaacagcctggcccttattttagccacccagcgattagataccatccacaagaaaccttgaaggagttcgtgcagctggtgtgtcctgatgccggacagcaggcaggacaggtgggcttcctgaaccccaacgggtccagtcagggcaaagtacataatcctttcctgcctacccctatgttgccacccccccccccgccccccatggcccgccccgtgccacttcccgtgccagataccaaacctcctaccacatcaaccgaaggcggggcagccagcccaactagccctacctattccacaccctctacttccccagccaatcggtttgtctcggtgggcccaagagacccttcttttgtgaatattccacagcaaacccaatcctggtatctcggctag

SEQ ID NO: 197579 - DNA, 1497 bp, Artificial Sequence
  Description of Artificial Sequence: Synthetic coding sequence
atgtacagccccctgtgcctgacccaggacgagttccaccccttcatcgaagcactattacctcatgtgagagctttcgcttacacctggttcaacttgcaggcgaggaaaagaaaatatttcaagaaacacgaaaagcgtatgtcaaaggaggaagagagggcggtaaaggatgagctgctctccgaaaagcccgaggtcaaacagaaatgggccagcaggttgctggctaagttgcgtaaagacatccggccagaatacagagaggacttcgtactgaccgtgactggaaagaagcccccttgttgcgtcttatctaaccctgatcagaagggcaagatgcgacggattgactgtctcaggcaagcggacaaagtctggcgcctggatcttgtcatggtgatactgtttaaaggcatccccttagaatcaacagatggtgaaagactggtgaaaagcccacagtgttctaaccccggcctgtgtgtgcagccacaccatatcggagtctctgtgaaggagctggatctgtacctagcctacttcgtacatgctgccgactcttctcagagcgaatccccaagccagccatctgatgcggacatcaaggaccagccggagaatggccatctcgggttccaggacagtttcgtcacttccggggtattttcggtgacggagcttgtacgcgtttcccagactcccatcgccgccggtacagggcctaactttagtctgtccgacctggagagctcctcttactactctatgagtccaggagcaatgaggcgaagccttccgtccacatcgagtacatctagtaccaaaaggctaaagtccgtcgaggatgagatggattctcctggtgaagagcctttttataccggacagggaagaagtcctggatccggatcccagtcctccgggtggcacgaggttgagcctgggatgccatccccaacaaccctcaaaaagtccgaaaaatccgggttctcatcaccaagtcccagccagacttcttccctaggtacggcgttcacccagcatcaccggcccgtcataaccggacctcgtgccagcccccacgccacaccctcgactcttcatttcccaaccagccccattatccagcagccaggaccttatttctcacatccagcgatccgctaccatcctcaagaaactcttaaagagtttgtgcaactagtgtgtccagacgcagggcagcaggctggtcaggttggtttcttaaacccaaatggttccagccagggcaaggttcataatccctttctcccgacccccatgctcccaccaccccctcccccaccaatggctagacctgttccactgccagtacctgacacaaagccaccaacgacctccactgaggggggggcagccagtcccactagtccaatccttgtccccgggattaaggtggctgcgtcacaccatccccctgataggccaccagaccccttttctactttgtag

SEQ ID NO: 197580 - DNA, 603 bp, Artificial Sequence
  Description of Artificial Sequence: Synthetic coding sequence
atgatgtacagccccatctgcctgacccaggacgagttccaccccttcattgaggccctgctgccccacgtccgagccatcgcatatacttggttcaacctgcaagctagaaagcggaagtactttaagaagcacgagaaaaggatgagcaaggacgaggaacgcgcagtaaaagacgagctgctcagtgaaaagcctgaaatcaagcaaaaatgggcaagtaggctgctcgccaaactccggaaggatatccggcaggaatatagagaagatttcgtgcttacagtcaccgggaaaaaacacccttgttgcgtgctgagcaatccggaccagaaaggtaaaattagaaggatagattgtcttaggcaggcggataaagtgtggcgactggatctggtcatggtgattctatttaaggggattccccttgagtctaccgacggcgagagacttatgaaaagccctcattgcactaacccagccctgtgcgtgcagccacatcatataaccgtttctgtcaaggagctcgatctattccttgcctattatgtgcaagagcaaggtaagaacttcttttcttctaataaatgcatcaagatctag

SEQ ID NO: 197581 - DNA, 507 bp, Artificial Sequence
  Description of Artificial Sequence: Synthetic coding sequence
atgaacagcggcgtgaacctgcagcggagcctgagcagcccccccagcagcaagaggccaaaaactatttcaatagacgagaacatggaaccaagcccaaccggcgatttttacccttctccttccagcccagctgccgggagccgcacctggcatgaaagagaccaggacatgtcaagtccaactaccatgaagaagcctgagaagccactgttctcaagcgcctccccgcaggattcctccccgcggctgtctacattcccccaacatcatcatcctggtattcccggggtggcccatagtgtcatttccacaaggacgcccccacccccctccccgctgcccttccccacccaggcgatcctgccccccgccccctcaagctacttctcacaccctacaattcggtatcccccccatcttaatccgcaggacactctgaaaaattacgtgccgtcatatgatccatcctcaccacaaacctctcagtcctggtacttgggctag

SEQ ID NO: 197582 - DNA, 1341 bp, Artificial Sequence
  Description of Artificial Sequence: Synthetic coding sequence
atggagcggatccccgtgagcgtggacttctgggtggtgtgctgcgctgtactgaaatgtaatcctggtattcccaaaagaatgagtaccctgtgcttcgggttttctgacgagttccatccgtttattgaagccctgcttccacatgtacgagcaatcgcctacacatggtttaacctgcaggctcgaaagagaaaatacttcaaaaagcacgaaaaaagaatgagtaaggatgaagagcgagctgtaaaggatgagctcttgtcagagaagcctgagattaagcagaagtgggcctccaggttgcttgccaaactacgtaaggacataagacaggaatatcgtgaagattttgtgcttactgtaacggggaagaaacacccatgctgtgtgctttccaatcccgaccagaaggggaagatcaggaggatagattgccttaggcaggctgacaaggtgtggagactcgacctagtcatggtgatcctgttcaagggaatccctctcgagtcaaccgacggcgaacgactcatgaagagtcctcattgcacaaaccctgccctttgtgtccagcctcatcatatcaccgtgtcagtcaaggaacttgacttatttttggcatactatgtgcaggagcaggattccggccagtcaggttccccatcccataatgaccctgctaagaaccctccggggtaccttgaggactcctttgtgaagagcggcgtctttaacgtatcagaattagtgcgggtctcccgcacaccaataacacaaggaaccggggtcaatttccctataggggagattccctcccagccctattatcatgacatgaacagtggggttaatctgcagcggagtctgagttcacctccttcctccaagcgtcctaagaccatttctatcgacgagaatatggagccatcccccactggcgatttctatccctccccttcttctcctgcagcaggaagcaggacatggcacgagcgtgatcaggacatgtcaagccccacaaccatgaaaaagcctgagaaacccctgtttagcagtgcctcccctcaggactcttccccccgcttgtccactttcccgcagcaccatcatccaggcataccaggcgtggcccatagcgtgatttcaacacgtacacccccgcctccgagtccgcttcctttccccactcaggctattctcccgcctgcaccatccagctacttttcgcacccaactatccgctatcctccacacctcaatccacaagatacgctgaaaaattatgtgccttcgtacgatccgtcctccccacagacctcccagtcttggtacctcgggtag

SEQ ID NO: 197583 - DNA, 1485 bp, Artificial Sequence
  Description of Artificial Sequence: Synthetic coding sequence
atgatgtacagccccatctgcctgacccaggacgagttccacccctttatcgaagcgttgctaccgcacgtgcgagcaatcgcttacacctggtttaacttgcaagccaggaagagaaaatactttaagaagcatgaaaaacgcatgtctaaggacgaggagagggcagtgaaggacgaactgcttagcgagaagccagaaatcaaacagaagtgggctagccggctactggcaaaattgagaaaagatatcaggcaggagtaccgggaggattttgttctgacggtgaccggcaaaaagcacccatgttgtgtgttgtctaacccagaccagaaggggaaaattcgtcgcatagattgcctaaggcaggctgataaagtgtggaggctagacttggtaatggtgattctgttcaaagggatccccctggagtcaacagacggtgagcgcttgatgaagtctcctcactgtaccaacccagccttgtgcgtgcagccgcatcacataacagtgtctgttaaagaactcgatttgttcctggcctattacgttcaggaacaagactctggacagagcggctccccttctcacaacgacccagccaaaaacccccccggctatctcgaggactccttcgtgaaatctggagtcttcaatgttagcgagctcgttcgcgtgtctcgaaccccgatcacccaggggaccggcgtgaatttccctattggtgagatacccagtcagccttactatcacgacatgaattcaggcgttaatcttcagagaagtcttagttcacctccatcctctaagcgacctaaaactatcagtatcgacgaaaacatggaaccatcacctacgggtgatttttacccttccccttcctcacctgccgctgggtctcgcacgtggcacgagcgtgatcaggatatgtccagtccaactaccatgaaaaagcccgaaaaacctcttttctcctccgcttccccacaggattcttcgccaagactgtccaccttcccacagcatcatcatccaggaattcccggcgtggcccactccgtcatcagcactagaacccccccacccccgtcccccctgccctttcccacccaagctattctgcctccagcgccgagttcttacttttcccatcccactatccgctatccccctcacctaaatcctcaggataccctgaagaactatgttccttcatacgatccttcttccccgcagacaagtcagccaaacgggagtggccaggtggttggcaaagttccaggccatttcacaccagtactcgcgccctctccgcacccttcagccgtgcgcccggtgaccctgtctatgactgacacgaagcccattacaacctccaccgaagcctacacagcatctggcactagccaggccaaccgctatgtggggttgtcaccgagagacccatcttttctgcatcagcagcaatcctggtatctggggtag

SEQ ID NO: 197584 - DNA, 1263 bp, Artificial Sequence
  Description of Artificial Sequence: Synthetic coding sequence
atgatgtacagccccatctgcctgacccaggacgagttccaccccttcattgaagcactgttaccccacgttcgcgcgatagcttacacttggtttaatttgcaggctcgcaaacgaaaatatttcaaaaagcacgagaagcgcatgagcaaggatgaggagagggccgtgaaggacgaactgctgagcgagaagccggaaattaaacagaaatgggcctcgcgcttgttggcaaagcttaggaaggacatccgccaggagtaccgcgaggacttcgtgctgaccgttactggaaaaaagcacccttgttgtgtgctgagcaacccggatcagaagggcaaaattcgcagaatcgattgcttgaggcaggcagacaaggtgtggaggctagatctggtgatggtcatcctgtttaaaggcatccccctcgagagcaccgatggcgaaagactgatgaagagcccgcattgtactaatcccgctctgtgcgtgcaaccgcaccacatcacagtgtccgtgaaagagcttgatctcttcctcgcctactatgttcaggagcaagattccggacagagcggctcacctagccataacgacccggctaagaacccacccggttacctggaggacagttttgtgaagagcggagtcttcaacgtgtctgaactggtgagggtgtcccggacgccaataacccagggaactggcgtgaactttccgatcggagagatcccgtcccagccatactaccacgacatgaacagcggggtcaacctccagcggagcctcagctcaccaccctcgtctaaacgaccaaagactatttctatagacgaaaatatggagccctctccaacgggagatttttacccttcacccagcagtcctgccgccggcagccgcacctggcatgaaagagaccaagacatgtcgtcaccgacaactatgaagaaaccggagaagcccctcttttcatctgctagcccgcaggatagttctccccggttgtctacatttcctcagcaccaccatccgggaatcccaggagtcgcccactccgtcatctccaccaggacaccccccccacctagccctctccccttccctacccaagccattctaccacctgcgcccagctcatacttcagccacccaaccatccgttacccaccccatctgaatcctcaggatacgctcaaaaattatgtgccctcgtacgatccatcctctccccagacttcgcaatcgtggtatttggggtag

SEQ ID NO: 197585 - DNA, 1686 bp, Artificial Sequence
  Description of Artificial Sequence: Synthetic coding sequence
atgatgtacagccccatctgcctgacccaggacgagttccaccccttcattgaggccctacttcctcatgtgagggccatcgcttacacgtggttcaatcttcaggcacgtaagcgcaaatatttcaaaaagcacgaaaaaagaatgagtaaggacgaggaacgggcagtgaaggacgaattactttctgagaagccagagatcaagcagaaatgggcctcacggctactcgcgaagctcaggaaggatattcgtcaggaatatcgggaagatttcgtgcttacagtgacaggtaagaaacatccttgctgcgtcctttccaaccccgatcagaagggcaaaatcagacggatcgattgcctgagacaggccgacaaagtgtggagacttgatctcgtgatggtgatcttgttcaaaggaatccccttagagtcgaccgatggggagagattgatgaagagcccccactgcaccaaccctgctctgtgtgtccagcctcatcatatcaccgtgagcgtgaaggaactcgaccttttcttagcctattacgtgcaggagcaggactctggtcagtccgggtccccgagtcataacgatccagctaagaacccgcctggttacctggaagactcctttgtaaagagtggtgtttttaacgttagtgaattggtccgcgtgtcacggacccccattacgcagggtacaggcgtcaacttccccatcggagaaatcccgtcccagccatattatcacgacatgaactctggagtcaacctgcaacggtctttatctagtccaccttcctctaagcggcctaaaacaatcagtatcgatgagaacatggaaccctccccaactggagacttctacccctcaccctcctcccccgccgccggatcccgcacttggcacgagcgtgatcaggacatgagctcaccaactacaatgaagaaacctgagaaacctctgttctctagtgcctccccgcaggacagttcgcccaggttaagcactttccctcagcatcatcaccccggtatccctggcgtagcccattccgtcatttctacgagaactcccccgccaccatcccccctgcctttccctacacaagctatactccctcctgcgccatcttcatatttttctcacccaaccatccgatacccacctcacctgaatccacaggatacactgaaaaactatgttccttcttacgacccatccagtccccagacctcccagccgaacgggtctggacaggtggttggtaaggtgcctggacacttcacccctgtgctcgcaccatctccccacccttctgcggtgagacccgtgaccctgtctatgaccgataccaaaccaataaccactagtacagaagcctacaccgcctccggcactagtcaagcgaacagatatgttggtttgtcaccacgcgatccatcttttctccatcaacaacaactgcgcatatgtgactggactatgaatcagaatggtaggcatttataccccagcaccagtgaggacactctggggatcacatggcaatctcccggcacatgggctagtcttgtgcctttccaggtatccaatagaacccctattctgcccgctaacgtacagaattacggcctcaacattataggcgagccctttctgcaggcagagacctctaactag

SEQ ID NO: 197586 - DNA, 1464 bp, Artificial Sequence
  Description of Artificial Sequence: Synthetic coding sequence
atgatgtacagccccatctgcctgacccaggacgagttccaccccttcattgaggccctgttgccccacgtgcgcgccatcgcctatacatggtttaacttgcaggcccgcaaaaggaagtacttcaagaaacatgagaagcgaatgagtaaggatgaggagcgcgccgtgaaggatgaactgctgtctgagaaaccggagattaagcagaagtgggcttcaagattgctcgccaagctcaggaaggacatccgccaggagtacagggaagatttcgtcctgaccgtgacaggcaagaaacacccatgttgtgtcttgtcgaatcccgaccagaagggcaaaattagacgaattgactgccttagacaggccgataaggtgtggcgcctggatctggtgatggtgattctcttcaaggggattcccctggaatccaccgatggagagcggctcatgaaatcgccccactgcaccaatccagctttgtgcgtacagccccatcacattacagtgagtgtgaaggagctggacctgttcttggcatactacgtccaggaacaagacagtgggcagtctggatcaccttcgcacaacgaccctgctaagaatccgcctggatatctcgaagatagtttcgtgaaatccggagttttcaatgtgtccgaattggttcgggtctcacggacccctatcacacaaggcactggtgtaaactttcccattggggagataccttcacagccctactaccacgatatgaactcaggggtgaatttacaaaggtcactgtcttcacctccctctagcaaacgtccaaaaaccatatcaatcgacgagaatatggaacccagtcccaccggggatttctatcccagccccagcagccccgcagccggtagccgcacctggcatgagcgagaccaggacatgagctcgcctaccacaatgaagaagcccgagaaacctctatttagcagtgccagcccccaagatagttccccaaggctcagtacgttcccccagcaccaccaccccggcattcctggggtcgcccactctgttatcagtactaggacccctccaccgccaagtcccctgccgtttcccacgcaggccatcctcccgcccgcaccatcctcatacttttcacacccaacaatcaggtatccaccgcacttgaatcctcaggataccttgaagaactatgtgccaagctacgatccttcatcccctcagacatcacaactgaggatatgtgattggactatgaatcagaacggacgacacctctacccctcaacgtctgaagataccctgggcatcacatggcagtcccctggcacgtgggccagcctcgtgcctttccaggtctcaaacagaaccccaatcctgcccgcgaacgtgcagaactatggcttgaacattataggagagccttttcttcaggccgagacctccaattag

SEQ ID NO: 197587 - DNA, 1713 bp, Artificial Sequence
  Description of Artificial Sequence: Synthetic coding sequence
atgatgtacagccccatctgcctgacccaggacgagttccacccctttatagaggccttgctccctcatgttagagctatagcatacacttggtttaaccttcaggcaagaaaacggaaatacttcaagaagcacgaaaagcgcatgagcaaggacgaggagagggccgtcaaggatgaactcctgtcagaaaaacccgaaataaagcaaaagtgggccagccgactcctcgccaagttaaggaaagatatccggcaagagtatcgcgaagatttcgtgctgactgtgacgggcaaaaaacatccttgttgtgttctctccaatccagaccagaagggcaaaatccgccggattgactgtctgcgccaggccgataaagtttggcgcctggatctcgttatggtgatactttttaaaggcatacccctggagagtaccgatggagaacgccttatgaagtccccccattgcactaaccccgcactttgcgtccagccgcaccacatcactgttagcgtgaaggaactcgacttgtttttagcctattacgttcaggagcaggattcaggacaatcagggtcccctagccataatgatccagcaaaaaacccccccgggtacttagaagattccttcgtgaaaagcggagtgtttaacgtaagcgagctggtccgtgtaagcagaactcccatcacccaagggacgggggttaatttccccatcggagaaatcccaagtcaaccgtactatcatgatatgaattcaggagtgaacttacaacgcagtctctcctccccccccagcagtaagcgccccaagactatcagtatcgatgaaaatatggaaccttcacctaccggcgacttctatccgtctccctccagccccgccgccgggtccaggacctggcatgaacgggatcaggacatgagctcacctaccaccatgaagaagcctgagaagcccctgttttcttcagccagcccccaggactcctctcccaggctgagcactttcccccaacaccatcaccccgggatccctggagtggcccattccgtcatatcaacaagaacgcctccgccacctagtccgcttcccttccccactcaagccatcttgccaccagccccatctagctacttttcacatccaaccatcaggtacccacctcaccttaatccacaggatacacttaaaaactacgtaccttcatatgacccgtcctccccgcagactagccagcccaacggatcaggccaggtggtggggaaagtgcctggccatttcacaccagtactggctccgagtccacaccctagcgccgtgaggccagtgactctgagcatgaccgacacaaagcctatcaccactagtacagaaggtgaggccgctagccctacagccacaacctacactgcatctggaacgagtcaggcaaacagatatgtgggcctttcaccgcgggacccaagttttctgcatcagcagcagctgcggatttgtgattggactatgaaccagaacggacgacacctctacccaagcacatccgaggacacactcggcataacatggcagtccccgggtacttgggctagcctggtgccgtttcaagtatccaacagaaccccgattttgcccgcgaacgtccaaaattatggacttaatatcatcggagaacctttcctccaggccgagacttctaattag

SEQ ID NO: 197588 - DNA, 930 bp, Artificial Sequence
  Description of Artificial Sequence: Synthetic coding sequence
atgaacagcggcgtgaacctgcagcggagcctgagcagccccccctcttccaagaggcctaagacaatctcaatcgatgaaaatatggaaccgtcacccaccggagatttttatcccagtccctcgtcgcccgccgcgggttcacggacctggcatgagcgggaccaggatatgtcaagtcctaccacaatgaaaaagcccgagaagccgttgtttagttcagcgagccctcaggattctagtccccgactttccacatttccacaacatcatcaccccgggatccccggcgtcgctcactccgtgattagcacacgcacacccccgccgcccagcccccttccttttcccactcaggctattctgccacctgctccctcttcttatttctcacacccgacgattagataccctcctcacctgaatccccaggatactcttaagaactacgtgccttcttacgatccttcaagtccccagacctctcaacctaacgggtcaggacaggtggttggcaaggtgccagggcacttcacccccgttcttgccccgagccctcatccatctgcagtgcggcccgttacactgagtatgactgacacaaagcccatcaccacatctacagaagcctataccgcaagtgggacctcccaggccaatcggtacgttggactttcacccagagacccatcattcctccaccaacagcagttgcgcatctgcgactggacgatgaatcagaacggacgacatctgtacccttcaaccagtgaagacactctaggaattacatggcagtctccaggcacatgggccagcctggtaccatttcaggtatctaataggactccaatacttcccgccaatgtgcagaattatggtctgaacattatcggggaacccttcctgcaggcagagaccagtaattag

SEQ ID NO: 197589 - DNA, 1272 bp, Artificial Sequence
  Description of Artificial Sequence: Synthetic coding sequence
atgtacagcagccccctgtgcctgacccaggacgagttccacccctttatcgaggccttactgccccacgtacgtgctttcgcatatacctggtttaacctgcaagcccggaaaagaaaatactttaaaaaacacgaaaaaagaatgtcaaaggacgaagaaagagctgtgaaagatgagttgctgggtgagaagcctgaggttaaacagaagtgggcaagcagactgttagccaagcttcgaaaagacatcaggcccgagtgtcgcgaagacttcgtgttgagcataacaggtaaaaaggccccagggtgcgtcttgtccaatcccgaccaaaagggtaaaatgaggcgaattgactgcctcagacaggccgacaaggtttggcggctggatctcgtaatggtgatcctattcaagggtattcctcttgaatccaccgatggtgagaggctggtgaaggccgcccagtgtggccatcccgttctctgcgtgcaaccacatcacatcggggtcgccgtcaaagagctggatctttacctagcctacttcgtccgggagcgagatgcagaacagtccggcagtccaagaaccggcatggggtctgaccaggaagactctaaacccataacactcgacactacggatttccaggagtctttcgtgacgagcggcgtgttttccgtgacagaactgattcaggtttctcggacaccagttgtgacagggaccggtcccaatttcagtctcggggagcttcagggacacctggcctatgatctcaacccggcaagtacgggtctgcggcgcacgttgccctcgacctccagtagcggcagcaaaaggcataaatccgggagtatggaggaagatgtggacaccagcccgggaggcgactattacacatccccatccagcccaacaagctcttccaggaattggacagaagatatggagggtgggatcagctcacctgttaagaagaccgagatggacaagagtccattcaattcaccgtctcctcaagactcaccacggttatctagctttactcaacaccaccggcctgtgatcgccgtgcattctggaattgcccgaagccctcatccatcttcagctctacacttccctacaacatctatcctcccccagactgctagtacttattttccccacacagccattaggtaccccccccacctcaacccccaggaccctcttaaggatcttgttagcctcgcgtgcgatcctgcaagtcagcagcctggtccctag

SEQ ID NO: 197590 - DNA, 1287 bp, Artificial Sequence
  Description of Artificial Sequence: Synthetic coding sequence
atgtacagcagccccctgtgcctgacccaggacgagttccaccccttcattgaggccctgttgcctcacgtccgggccttcgcttacacatggttcaacttacaggctagaaagagaaaatactttaaaaaacacgagaaacgcatgagcaaggacgaggagcgcgctgtgaaggatgaactgttgggcgaaaaacccgaggtgaagcagaagtgggctagccgcctcttggcaaagctacgaaaagacatccggcccgaatgccgcgaggactttgtgttgagtatcacagggaagaaggccccgggttgcgtcctctccaaccccgaccagaaaggcaagatgaggcgcattgactgtctcaggcaggccgacaaggtgtggcgcctggacctagtcatggtcattctcttcaaaggcatacccttggaaagcaccgacggagagcgcctggtgaaagccgcacagtgcgggcatccggtgctctgtgtgcagccacaccatatcggagtggcagtaaaagaattagatctgtacctggcgtattttgtacgagagcgtgatgccgagcaatcagggtcccctaggaccgggatggggtctgaccaagaagacagtaaacccatcaccctggataccaccgatttccaggagagcttcgtgacttctggggtgtttagcgttaccgagcttattcaggtgtccaggactccagtcgtaacgggcacgggacctaacttttccttgggggaactgcaggggcatctcgcttatgacttgaatccagcatcgactggcttacggagaaccctgccctctaccagttccagcggcagcaaaagacataagagcggatcaatggaagaggatgttgacacttcccccggcggggattactataccagtccttccagtcctacatcatcatcacgcaactggaccgaagacatggaggggggtatctcgagccctgtgaagaaaaccgagatggacaaatccccttttaattccccttcaccgcaggactcaccacgcctcagcagcttcacgcaacaccatcggccagttattgctgttcacagcgggatcgctcggtccccacacccttcttcagcactgcactttcccactacttccattttacctcagactgcatccacttacttcccacataccgctattcgctatcctccccatttaaatccacaggatcctcttaaagatcttgtctcactggcctgcgaccctgcaagccagcagcccgggcccagctggtatctcggctag

SEQ ID NO: 197591 - DNA, 1527 bp, Artificial Sequence
  Description of Artificial Sequence: Synthetic coding sequence
atgtacagcagccccctgtgcctgacccaggacgagttccaccccttcatagaggcactcttgcctcacgttagggccttcgcctacacctggttcaacctgcaggctaggaagagaaagtatttcaaaaagcacgagaaacgaatgagtaaagatgaggagagggctgtgaaggatgagttgctgggtgagaaacccgaagtgaagcagaaatgggcctctcggctgctggccaagctccgtaaggatatccggccagaatgccgagaggacttcgtattgagtattaccgggaagaaggcccctggctgcgtgctgtcaaatccagatcagaaggggaaaatgcgtagaattgactgtctcagacaagcagacaaggtgtggcgcctagatctcgtgatggttatcctgttcaagggcattcccttagaaagtaccgatggagaacgattggtgaaagccgctcaatgtggccacccagtcttgtgtgttcagccacaccacattggggttgccgttaaagaactggacctctacctggcatactttgtcagagaaagggatgcggagcagtcaggttcgccaaggacaggcatgggctctgaccaggaggacagcaaacccatcaccctggacaccaccgattttcaggagtctttcgtaacatccggggttttttctgtgaccgagttaatccaggtttcaaggaccccagttgttacaggtacaggccctaactttagtctgggcgaactccaagggcatctcgcgtacgacttgaaccctgctagcacaggtctaaggcgcaccctcccctcaaccagttctagtggatctaaaaggcacaagtcaggtagtatggaggaagatgttgatacatcaccagggggcgactactatacctcaccctcctcgcctactagctcttcccggaactggacggaagacatggagggcggcatttcctcccctgtaaaaaaaactgaaatggacaaatctcctttcaatagcccttcacctcaggattcccctcgtctgtctagctttactcaacaccatagacctgtgattgctgtacatagcggaatcgcacgcagcccccatccctcttctgccctgcacttcccaacaaccagcatactacctcaaacagcaagtacgtacttcccacacactgccattcgatatcccccccaccttaatccccaagaccccctgaaagacctggtctccctcgcctgtgaccctgcgagccagcagcctggaccccttaacgggtcaggtcaactgaaaatgcccagtcattgtctctctgcccagatgttagccccccccccacctggcctgccaaggctggcgctgccccccgctacaaaacctgccacaaccagcgagggaggagcgactagccctacatcacctagctattcccctcccgatacgtcgcctgcaaacaggagcttcgtaggcctcgggccgcgggaccccgccggaatctatcaggcccagtcatggggggatggttag

SEQ ID NO: 197592 - DNA, 1221 bp, Artificial Sequence
  Description of Artificial Sequence: Synthetic coding sequence
atggacgagttccaccccttcatcgaggccctgctgccccacgtgagagccttcgcctatacgtggttcaatctgcaagcccgaaaaagaaagtatttcaaaaagcacgaaaaaaggatgtccaaagatgaggagcgagcggtcaaagacgaattactgggcgagaagcccgaggtcaaacagaagtgggccagccgcctgcttgccaagttaaggaaggacattcggcccgagtgtcgcgaggattttgtcctgtctatcaccgggaaaaaagcaccgggctgtgtgctgtctaacccggatcagaagggaaagatgcggcggatcgattgcctgcggcaggctgataaggtatggcggctcgatttggtcatggttattttattcaaagggatcccattggaaagtacggacggcgagagactggtgaaggcagcccagtgtggccatcccgtactctgcgtgcagccccaccatatcggtgtcgctgttaaggaattggatctctacttagcctactttgtcagagagcgcgataccaccgacttccaggaatccttcgtcacctccggagttttttctgtgaccgagctgatacaggtgagtaggacccctgtggtgaccggcaccggacccaacttttccctgggagagctgcaaggacatctcgcttacgacctcaatcccgccagcacagggttgaggcgaactctcccctccactagctcttccggctccaaacgacacaagagtgggtccatggaagaagatgtagacacatcacccggcggagattactatacttcccccagtagccctacttcttcctcgcggaactggacggaagatatggagggcggaataagctccccagtcaagaagaccgagatggataaatctcccttcaattccccatcacctcaagacagccctagactttcatcatttacccagcaccatcgaccggtgatagccgtccacagcgggatcgcccgctcaccacatccttcatccgcactacacttccctacgacaagcatactgccccaaactgcctccacgtatttcccacataccgccatccgctatcccccccatctgaatccacaggacccattgaaggatctggttagtctcgcttgcgatccggcctcccagcagcccgggcccccaactcttcgcccgacccgacccctccagacagtccccttgtgggactag

SEQ ID NO: 197593 - DNA, 1293 bp, Artificial Sequence
  Description of Artificial Sequence: Synthetic coding sequence
atggacgagttccaccccttcatcgaggccctgctgccccacgtgcgagctttcgcttacacgtggttcaacctgcaggccagaaagcggaagtatttcaagaaacatgaaaagcggatgtccaaggatgaggaacgcgctgtaaaagatgagctgttgggcgagaagcccgaagtcaagcaaaaatgggcctcaaggttactagccaagctgcgtaaggatatcaggccagaatgtcgtgaggacttcgtcttgtccatcaccgggaaaaaggcccccgggtgtgtcctcagtaatcctgaccagaaagggaaaatgagaaggattgactgtctccgacaggccgacaaagtgtggcgcctcgaccttgtgatggtgattctcttcaagggaataccattggagagtaccgacggcgagagattagtcaaagcagcacagtgcgggcaccccgtgctgtgcgtgcagcctcaccacattggcgtggccgtaaaggaactagacctgtacctggcttacttcgtgcgagagagagatgcagagcagtctgggtcaccccgcaccggcatgggaagcgaccaagaggactcgaagcccattaccttggatacgaccgacttccaggagtcttttgtgaccagtggggtgttttcagtgacagaactgatccaggtgtcgagaacgcccgtcgtcacagggaccggacccaactttagtctcggcgagctacaggggcatttggcatacgaccttaacccagcctctacgggcttgagaagaacacttcctagcacttcttcaagcggcagcaaaaggcacaagtccggaagcatggaagaagacgtggatacttccccaggtggagattactacacatcgccaagctccccaacctcatcctcgagaaattggacagaagacatggaggggggcatctcaagtcctgttaaaaagaccgagatggataagtctcccttcaattctccttccccacaggatagtcctaggttatctagtttcacacagcatcaccgcccagtgattgctgtgcattcggggatcgctcggtccccccacccaagctccgcgcttcattttcccacaacgtccatcctgccgcagactgctagtacgtacttcccacatacagcaatcaggtatcccccccatctcaacccccaggatccactgaaagacctcgtgtccctggcatgtgaccctgcgtcgcaacaaccgggaccacctaccctgcgccccacgaggcctctgcagacagtacccctatgggactag

SEQ ID NO: 197594 - DNA, 1500 bp, Artificial Sequence
  Description of Artificial Sequence: Synthetic coding sequence
atggacgagttccaccccttcatcgaggccctgctgccccacgtgcgagctttcgcatacacttggtttaacctgcaggcccgcaaacggaaatactttaaaaagcacgagaaacggatgtctaaagacgaagagcgggccgtgaaagacgagttactgggggagaaaccagaggttaaacagaaatgggcatcaagattgttggccaagctgcgaaaggacattagaccagagtgtcgggaagacttcgttctgtcgatcacaggcaagaaagcaccaggctgtgttcttagcaatccagatcaaaagggcaaaatgagaagaatcgattgtttgaggcaggcggataaggtgtggcggctggatcttgtgatggtcatcctgtttaagggaataccgctggagtcaaccgacggggaacgcttagtgaaagcagcacagtgcggacacccagtgctgtgtgtccagcctcaccatatcggagtggcagtgaaggagttggacctgtatttggcctactttgttagggaacgagacgcggagcagagcggttccccaaggacgggtatgggctcggatcaagaagatagtaaaccaatcaccctggatacaacggacttccaagaatccttcgtgacatcgggagtattcagcgtgacagagttaattcaagtgtctcggacgcccgtggtgacaggcaccggcccgaatttttccctgggggagcttcagggacatctggcatatgatcttaaccccgcctccacaggcttacgcaggactctgccttccacatcctcttcaggctccaaaaggcataaatctggatctatggaggaagatgtggacacctctccggggggggattattacacctccccctcgagccccacctcgtcgagccgcaattggaccgaggacatggagggaggcatttcctctcccgtaaagaagactgaaatggataaatctccctttaactcgccctcgccacaggattccccacggctatctagttttacccagcatcacaggccggtgattgccgtgcactcagggatcgctcgcagccctcatccttccagtgctctgcattttcctacgacctctattttgccccagacagcaagtacttactttccgcacacagcaatccgctacccgccccatctcaacccccaggatccattgaaggacctcgtctcactggcctgtgaccccgcttcgcagcagcctgggccactgaatggctctgggcagctgaagatgccaagccactgcctgagcgcccagatgctcgctcctccgccccccggtctgccccgacttgccctgccccccgccaccaagcctgccacaactagcgagggaggagccaccagccctacatcccctagctatagcccccctgatacctcccccgcaaatagaagttttgtcggactcggccctagggacccagcaggcatttaccaggctcagtcttggtatttgggttag

SEQ ID NO: 197595 - DNA, 1500 bp, Artificial Sequence
  Description of Artificial Sequence: Synthetic coding sequence
atggacgagttccaccccttcatcgaggccctgctgccccacgtgagagcatttgcctatacctggttcaacctccaggcgcgcaagcggaagtatttcaaaaaacacgagaagcgcatgagcaaagacgaagagagggccgtcaaggatgaactcctgggtgagaagcccgaggttaagcagaaatgggccagtaggcttctcgccaaattgcggaaggacatcaggcctgagtgcagagaagacttcgttctttccattactggcaagaaagcacctgggtgcgttctgtccaacccggatcagaagggaaagatgcggaggattgactgccttaggcaggcagataaggtgtggaggctggatcttgtcatggtgattctgttcaaggggataccgctggagtcaacagacggagaacgcttggtcaaagcggcacagtgcggacatccagtactatgtgtgcaaccccaccacataggggtggccgtaaaagagctggacctatacttagcatattttgttcgggaaagggacgccgagcagtcaggctcaccaaggaccggaatgggatcagatcaagaagactctaaaccaattactctcgacacaactgatttccaggaaagctttgtaacctcaggtgtcttctccgtgactgagctgatacaagtcagcagaacgccagtcgtgaccgggacaggccccaacttctccctgggcgagcttcaaggccatctagcgtacgacctgaaccctgctagcaccggcttgcggcgtactctcccatccacatcaagtagcggtagtaagcgccacaaatcaggctcgatggaagaagacgtcgacaccagtcccggcggagactattatacctcccccagcagccccacatcgagttctcgcaactggaccgaagacatggagggagggataagcagcccagtgaagaagacagaaatggataagagccctttcaacagtccatccccacaggacagtcccagattaagcagctttacccagcaccaccgacccgtgatcgctgttcacagcggaatcgccaggagccctcacccctcaagcgccttgcactttcccacaaccagcattctgccccagacagcatccacgtacttccctcatacagctatccggtatcctccacatctgaaccctcaggatcccctgaaagatcttgtatctttggcttgtgatcctgcctcacaacaaccaggtcccctcaatggctccggccaactcaagatgcctagtcactgcctgagcgctcagatgctagcaccgccccccccggggctaccccgcctggccctgcctcccgctactaagcccgcaactacatcagagggcggggccacatccccaacttcaccatcctacagtccgccggatacttcccctgctaataggtctttcgtcgggcttggccctagggacccagctggcatttatcaggctcagagttggtacctgggctag

SEQ ID NO: 197596 - DNA, 1212 bp, Artificial Sequence
  Description of Artificial Sequence: Synthetic coding sequence
atgggcgccaccgagcccggcggcgacaccagcagcgacgagttccatccatttatagaggcgctcttaccccatgtgagagcgttctcctatacttggtttaatcttcaagctagaaaaaggaagtatttcaagaaacacgagaaaaggatgtctaaagacgaggagcgcgccgtcaaggatgagctgttaggcgagaaaccagagatcaaacagaaatgggctagccgtctactcgccaaattgcgtaaggacattcggcctgaattcagggaggacttcgtcttgacaatcacgggcaaaaaaccaccttgttgcgtattgtcaaacccagatcagaaaggcaagattcgaagaattgactgcctgcggcaggctgacaaagtctggcggctggacctcgtgatggtgatcttatttaagggaattccccttgaaagcaccgacggtgagcgcctttataaaagtccacagtgtagtaaccccggcctgtgcgttcagccccatcatattggcgtaaccattaaagagttggatctttacctcgcttacttcgttcataccccagaatcaggtcagagtgacagctcaaatcaacaaggagacgccgacattaaaccactgcctaatggccacctgtcgtttcaagactgttttgttactagcggcgtatggaatgtcacggagctagtccgcgtaagccagacaccagtcgcgacagcttcaggtccaaatttttctttggctgaccttgagagtccctcctactataatatcaatcaggtgacgcttggtagacgcagcataacatcccctccttccacatctacaaccaaacgccctaagagcatcgatgatagtgagatggaatcccctgtggatgatgttttttatcccggaaccgggaggtctcctgcagccggatcttctcagtctagcggctggcccaacgacgtggatgctggatccccgcgtgccacagccagcgccctgcactttccgtctacatcaatcatccagcagagcagtccatactttacacatccaaccatcaggtatcaccatcatcacggtcaggactcgcttaaggaatttgtgcagtttgtgtgtagcgacggttctggccaggctacgggtcagcattcacagaggcaggctcctccgttacctaccggtctgagcgcatctgacccaggcaccgcaactttctag

SEQ ID NO: 197597 - DNA, 1383 bp, Artificial Sequence
  Description of Artificial Sequence: Synthetic coding sequence
atgctgcccgcctgccggctgcaggacgagttccaccccttcatcgaggcacttctgcctcatgtgcgggccttctcgtatacttggttcaacctgcaggcccggaaacgcaaatactttaagaagcacgaaaaacgaatgtccaaggacgaggagcgcgcagtcaaagacgagttactgggtgaaaaaccagaaataaagcaaaagtgggccagtcgcctcttagctaagctcaggaaggacatcaggcccgagttccgcgaagatttcgttttgaccattactggaaagaagccgccatgttgtgttttaagtaatcccgatcagaaaggcaagattaggaggatcgactgcctgagacaggctgacaaggtatggagactcgacttggtgatggtcatactttttaagggaataccactggagtctaccgacggggaacgcctctacaagagtcctcagtgcagcaatccagggctgtgcgttcagccacaccacatcggggtgaccattaaagagcttgacttatatctggcatatttcgtccacacacctgagtccggccaatccgattcgagcaatcagcagggggatgctgacattaaacccctcccaaatggccatctctcctttcaagactgtttcgtgacctcaggcgtgtggaatgtgacagaattggttagggtatcacagacccctgtcgctactgcatcggggccgaactttagcctagcagatctggagtccccaagttactataatatcaaccaggtgactctgggacgtcggtctatcacatcaccaccaagcacttccaccaccaagcgtccaaaaagtatcgacgacagcgaaatggaatctccagtcgacgacgtattctaccccgggactggccgaagtcctgctgccggctcctctcaaagcagcggatggccaaatgacgtggacgcaggatcacctcgagccaccgctagcgccctacacttcccaagcacttcaatcatccagcaaagtagtccctactttactcatcccacaatccggtatcatcatcaccatgggcaggacagcttgaaagagtttgtgcaattcgtgtgttccgacggttccggtcaggccacaggtcaaccaaacggctccggacagggtaaggtgcctggcagcttccttctgcccccacccccacctgtggccaggcctgtgccgctgccgatgcccgactccaagtccacgtcaacggcccctgatggagcagccctcacgccccccagcccttctttcgccaccaccggcgccagcagcgcaaatcggtttgtatctattggtcctagagatggcaacttcttgaacattccacagcaatctcagtcctggtttctctag

SEQ ID NO: 197598 - DNA, 1326 bp, Artificial Sequence
  Description of Artificial Sequence: Synthetic coding sequence
atgtacagcccctactgcctgacccaggacgagttccaccccttcatagaagccctgttgccccatgtgcgcgccttcagttacacatggtttaacttgcaagctaggaagcggaaatatttcaaaaaacatgagaagaggatgtccaaggacgaagaaagagccgttaaggatgaattgctaggagagaaacctgagattaaacagaagtgggcatctcgcctgctggccaagcttcgcaaggacattcgccccgagttccgagaagattttgtattaacaattactgggaaaaagccaccatgttgcgtgctgtcaaaccctgaccagaaggggaaaataagacgcattgactgcctccgacaggcagataaggtctggcgtttggatctggttatggtaatcctttttaaagggatcccgctggagtctaccgacggagagcgactctacaagagcccccagtgtagcaaccccggtctgtgtgtgcagccacaccacattggagtaactataaaagagctagatctctaccttgcatactttgttcataccccagaaagcgggcagagcgatagcagtaatcagcaaggcgatgccgatatcaaacccctcccaaacggacacctgtcatttcaagactgctttgttacttccggggtatggaatgtcaccgagcttgtccgagtgtcccagacgcccgtcgctaccgcttcgggccccaatttcagtctcgctgatttggaatcccccagctattataacatcaatcaggtcacactgggcaggcgctcaatcactagcccaccaagtacctctacaacgaaacggcctaaatctatagacgatagcgagatggagagcccagtggacgatgtgttctacccaggcactgggagaagccccgcggcaggcagttcccaatcttcaggctggccaaacgacgtggatgccggccctgctagcctcaagaagagtggaaaactagatttctgcagcgcactctcaagccagggatcatcacccagaatggcttttacccatcatcccctgcccgtgctggccggagtcagaccaggctcgcccagagcaactgctagcgctctccactttccatctacatctataatccagcaatccagcccatattttactcatcctaccatcagataccatcaccaccacggacaggactcactgaaggagttcgtgcaattcgtgtgcagcgacggatctggccaggctaccggacagcacagccagagacaggcacctccactgcctaccgggttgtccgcaagtgatccgggaacagccacattctag

SEQ ID NO: 197599 - DNA, 1509 bp, Artificial Sequence
  Description of Artificial Sequence: Synthetic coding sequence
atgtacagcccctactgcctgacccaggacgagttccaccccttcatcgaggctctccttccgcacgtgcgggcatttagctatacctggttcaacctgcaggctcggaagcgaaagtacttcaagaagcatgagaaaagaatgagcaaggacgaggagcgtgccgttaaagacgagctactaggggaaaagcctgagatcaagcagaagtgggcctcccgccttctggctaagctccggaaggacataagaccggagtttcgggaggacttcgtgctgacaataaccggcaagaagcccccgtgttgcgtgctcagcaatcctgaccagaaaggaaagattagaaggatcgactgtctacggcaagccgacaaggtttggaggctggacctggtgatggttatcctttttaagggcatccccttggaatccacagacggggagcggctgtacaagagcccacaatgttccaaccctggcctctgcgtgcagccccaccatattggcgtcaccatcaaggagttggacctctatttggcttactttgtgcatacaccggagtctgggcaaagcgattcctccaatcaacaaggcgatgccgatatcaagccgctgccaaatgggcacttatccttccaagattgtttcgtgactagcggtgtgtggaatgtgaccgagttagtaagggtctcacagactccagtagctaccgcttctggccctaacttttccctggccgatctggagtcgcctagctactataacatcaatcaggtgactctcggtcgtcgatcaataacatcccccccttccacctccacgacaaaacggcccaagagtattgatgacagtgagatggagagtccagtggacgatgtgttttaccccgggaccgggcgctcccccgcagccgggtcatcacagtcatcgggatggcctaatgatgtcgacgctggccctgccagtctcaaaaagtcaggtaagctggatttctgtagtgccctctcctcccagggcagctcgccaagaatggccttcacgcaccatcctctgcctgtgctggcgggtgttcgcccaggtagccctagagcaaccgccagtgcgcttcatttccccagtaccagtataattcaacagtcaagtccatactttactcatcccaccatccgatatcatcaccaccatgggcaggactcgctcaaggagttcgtgcagttcgtgtgtagtgacgggtcggggcaggctacgggacagccgaatgggtctggacagggtaaagtgccgggtagtttcctattacccccaccccctccagttgcacgacctgtcccgctgcctatgccagactcgaaaagtacttcaaccgctccggacggcgccgctctgacgcccccaagcccgtcatttgcaaccactggggccagcagtgccaacaggtttgtttccatcgggccacgcgacggaaattttctaaacatcccgcagcagtcacaatcgtggttcctgtag

SEQ ID NO: 197600 - DNA, 633 bp, Artificial Sequence
  Description of Artificial Sequence: Synthetic coding sequence
atgagcaaggacgaggagcgggccgtgaaggacgagctgctgggcgagaaaccagagattaagcagaagtgggcaagcaggctgctggccaaactgcggaaggacattagaccagaatttcgggaagattttgtcctgacgattacgggaaagaaaccgccttgttgcgtgctctctaatccggaccagaagggcaaaataaggaggatagattgtttgcgccaggcagataaagtgtggcgtcttgatctggtgatggtgattctgtttaaggggatcccactggaatctacagacggagagaggctgtataaatcccctcagtgttccaatccagggttatgcgtgcaaccgcaccacatcggtgtcacgattaaggagctggacctctacctcgcctatttcgtacatacccccgaatcggggcagagcgatagttccaatcagcagggagatgccgatatcaagcctttacccaatggacatttaagctttcaggactgtttcgtgacgtctggagtctggaacgtcaccgagctcgtatatcaccggctcctgctccaacaacatcaaggacctactagtccatggagaacctggcgagtgcctgccaccaccactagcactaggtag

SEQ ID NO: 197601 - DNA, 1071 bp, Artificial Sequence
  Description of Artificial Sequence: Synthetic coding sequence
atggccggcgtggcctgcctgggcaaggccgccgacgccgacgagtggtgcgactccggtctaggctctctgggaccagacgctgcggcccctgggggccctgggctcggagccgaactcggcccaggcctaagctgggctcctctggtctttggctatgttacggaggacggggacacagcactgcatctggccgtgatccaccagcatgagccttttctagactttcttctcggcttctcggctggcactgagtacatggatcttcaaaatgatctggggcagaccgccctccatctggcagcaatcctgggcgagacctcaactgttgagaagttatacgctgctggagcgggcttatgtgtggcagagcgccgggggcacacagctttgcacctggcttgcagggttggggcacatgcctgcgcaagggcgctcctccagccaagacctaggcggccaagagaggcacctgatacataccttgcccagggcccagatcgtactcctgatactaaccacacacctgtcgcgctttaccccgactctgatctggagaaagaagaggaggaatcagaagaggactggaaactgcaactggaagccgaaaactatgagggacacaccccattacacgttgccgtcatccacaaggatgtagagatggtccggctgctgcgggatgctggcgcagatctggacaagccagagcctacttgtggtcgatcccccctgcatctggccgtagaggcacaagccgccgacgtgctggagctgctgctccgggccggtgctaaccccgctgcgcggatgtatgggggcaggaccccccttggatctgctatgctccgcccaaatcctatcttggcaaggttgctgcgagcacatggggccccagagcccgaaggtgaggacgaaaaaagcggaccttgcagttcgtcttccgactctgacagtggggacgagggcgacgaatatgacgatatcgtggttcatagcagtcgttctcagacaagattgcccccaaccccggcctccaagccactgcctgacgaccctagacccgtgtag

SEQ ID NO: 197602 - DNA, 921 bp, Artificial Sequence
  Description of Artificial Sequence: Synthetic coding sequence
atgaacggcgccaccgccgcctgggccccctgggtgcggacccagaggccacctgaggacctgggctgggctagatcttgggcgaggggttgcagaggcctcccttcctctagcgctacctccttaagaatgggcacccggttctctgccgggaccgaatacatggatctgcaaaacgatctgggtcagacggccctgcacttagcggctatcttgggtgagacttccaccgttgaaaagctctatgctgcaggagccggtctttgcgtggccgaacggcgaggacatacagccctacacttggcatgcagggtgggggcgcatgcatgtgctcgtgccctgttgcaaccacgcccgcgacggcccagagaagcccccgacacttatcttgcccaggggcctgatcgcactcccgataccaaccatactcctgttgccctctaccctgatagcgatctggagaaggaagaagaggaatcggaggaggattggaaacttcaactggaggctgagaactatgagggccacactcccctgcacgtggctgtgatccataaggatgtggagatggtacgccttttgcgagacgcaggggccgatcttgataagccagaacccacttgcggccgctccccactgcatttagctgtggaggcccaggcagccgacgtgctcgaactgctcttgagggccggggcgaatccagctgccagaatgtacggcggaagaaccccactgggatccgccatgctgcggcctaacccaatcttagcacgacttcttcgggcccatggggcccctgagcccgagggtgaagacgaaaaaagcggtccctgctcctcctcatccgattccgacagcggagatgagggtgtgagccaagaggaaagacagggaagcccagcaggtggttctggatag

SEQ ID NO: 197603 - DNA, 1086 bp, Artificial Sequence
  Description of Artificial Sequence: Synthetic coding sequence
ctgcagaacagccggcagagccccgccaccggcggccggctgcggggagcccccgaggctgctggagcgatggctggggtggcatgcctcggaaaagctgccgacgctgatgagtggtgtgacagcggcctggggagtcttggccccgacgcagctgcacccggagggccagggctaggcgccgaattgggacccggattatcttgggcccccttagtgttcggttacgtgacagaggacggcgacaccgcactacatcttgccgtgatccatcagcacgagcctttcctggatttcttgttaggtttttctgccggaacagaatatatggatctgcagaatgatctcgggcaaacagcattgcatcttgcggcaatacttggggagacttccactgttgagaaactctatgccgctggagcaggcctgtgtgtggctgaaagaaggggtcacactgctctccatcttgcatgccgcgtgggcgcacatgcgtgcgcacgtgcactactgcagccacggcctagacggcctagggaggccccagatacctatctcgcccaggggccagataggacccccgacaccaaccatactcccgtagctttgtatcccgactctgacttggagaaagaagaggaagagtcagaggaggactggaaattacaactggaagcagagaattacgaaggccacacaccgcttcatgtggctgttattcacaaggatgttgagatggtgcgcctgctccgagacgctggcgcagacctggacaagcccgagcctacctgtgggagaagcccccttcatctcgctgtggaagcccaggcagcggacgtgctggaactattgcttcgggccggggcaaaccccgcagcccggatgtatggcggacgaactcctctgggtagcgctatgctgagacccaaccccattctcgcccgcctgctccgggcccacggcgctccagaacccgaaggtgaggacgagaagtccggtccgtgtagttccagtagcgattctgacagtggtgacgagggcgtttcacaagaagaaaggcagggcagcccggctggtggctcaggatag

SEQ ID NO: 197604 - DNA, 1791 bp, Artificial Sequence
  Description of Artificial Sequence: Synthetic coding sequence
atgatcgtggacaagctgctggacgacagccggggcggcgagggccttagggatgcagctggaggctgtgggctgatgacaagccctctgaatctatcctacttctatggtgcttccccccctgcggctgcacctggagcttgcgatgcctcttgttccgtgctggggcccagtgcacccggatctcctggctccgacagctctgatttctcctcagcgagctctgtctctagttgtggagctgtcgagagccggtctagaggaggggccagagctgagcgacagcccgtcgaacctcacatgggcgtcggcagacagcagaggggtcccttccaaggagtgcgtgtgaagaactctgtgaaggagcttctgctccatattcggtcgcacaaacagaaagcctctgggcaggctgttgatgattttaaaacccagggtgtgaatattgagcagtttcgggagctgaagaatactgtctcctacagtgggaaacgtaagggacccgattcactcagtgacgggcctgcctgtaagcgacctgccttattgcatagccaattcttaacaccaccccagacacccacaccaggggagagtatggaggatgtgcatctgaatgagcctaagcaggaaagtagtgctgatctgctgcaaaatattatcaacattaagaatgaatgttcacctgtgagtcttaacacagtacaaactagctcgagtgtccagcagcagaacgatgcccatttgcatagcttttcaatgatgccttcatctgcttgtgaggccatggtgggacacgagatggcctctgattctagtaacacatccttgcctttctctaacatgggaaacccaatgaataccactcagctgggcaagtcactgtttcagtggcaggtggagcaggaagagagcaagcttgctaatatctcacaggaccagttcttgtcgaaggatgctgacggcgatacgttcctgcacatcgctgtcgctcagggtagacgggccctttcctacgttcttgcccggaagatgaacgccctgcacatgttggatataaaagagcataatggacagtctgcattccaggtggcagtggctgcaaaccagcatctcattgtccaagacttggttaacatcggagcccaggtgaacacaaccgactgctggggacgaacccctctgcacgtctgtgccgagaagggacactcccaggtgcttcaggctatccagaagggagccgtcggctctaatcaatttgtggacctggaggcaaccaactacgatggattgacaccattgcactgcgctgttatcgcccataacgccgtcgtccacgaactccaacgaaaccagcaaccccatagcccagaggtgcaggaattgctgctaaagaataaatcgttagtggataccatcaaatgcctgattcagatgggagcggccgtggaggccaaggataggaaaagcgggcgcacagcactccatctggctgccgaggaagccaatctggagctgatacggttgtttctggaactgccaagctgtctctctttcgtcaacgcaaaggcctacaacgggaatacagcgctgcacgtcgctgcaagccttcagtaccgcttgactcagctggacgctgttcgtctgctgatgcgtaagggggctgatccttctacccgaaatctggagaacgagcagccagttcacctggtgcccgatggcccggtgggggaacaaatccggcgcatcctcaaaggcaagagcatccagcagagagctccaccctactag

SEQ ID NO: 197605 - DNA, 2157 bp, Artificial Sequence
  Description of Artificial Sequence: Synthetic coding sequence
atgatcgtggacaagctgctggacgacagccggggcggcgagggcctgcgagacgcagctggcgggtgtggactcatgacttccccattgaatctgagttatttctacggagcttcaccgcccgcagcggctcccggtgcatgcgacgccagttgcagcgtgctgggtccatcagcccccgggtcacctgggtccgatagtagcgacttctcgagtgcatcttccgtctccagttgcggagccgtggaatcaaggagcagggggggagcccgagcggagcgccaacctgtggagccacatatgggcgtcggcaggcagcaacgtggaccatttcagggtgtacgggtgaaaaatagcgtcaaagagctccttttacatattcgttctcataagcagaaggcaagtgggcaggcggtggatgactttaagactcagggcgtgaatatcgagcagtttcgggaactaaagaatactgtgtcatactctgggaagagaaaggggccggatagcttgtctgacggcccggcgtgtaagagaccggccctccttcattctcaattcctaacgccgccacagacaccaaccccaggagaatcgatggaggatgtgcacttgaatgaacccaagcaagaatcatccgcagacctccttcaaaacataatcaacatcaaaaacgagtgcagccccgtctccttgaacactgtacaggtctcttggctcaatcccgtcgtggtgccccagtcttccccggctgaacagtgccaggacttccacggaggccaggtgttcagccccccacagaagtgccagccctttcaggtgcgcggttcgcagcagatgatagaccaggcttctctgtatcagtactccccacaaaaccaacacgtcgaacaacagccacactatacacataaacccaccttagagtacagtccttttccaattccacctcagtcacccgcctatgaacccaacctatttgacgggcctgagtcccagttttgtccaaaccagtcacttgtaagtctcctcggggatcagagggagtctgaaaatattgcaaacccaatgcaaaccagttcgtcggtccaacagcaaaacgacgcccacctccactccttctccatgatgccctcttctgcgtgtgaggccatggtggggcacgaaatggccagcgacagctcgaatacttcgctcccatttagcaatatggggaaccctatgaataccacgcagctagggaaaagcctctttcagtggcaagtggagcaggaggagtcaaaattggcaaatatatctcaggatcagtttctctccaaggacgcagatggcgatactttcctgcacatcgcagttgcgcaggggcgaagagccttatcttatgtacttgcacgaaagatgaacgcgctccatatgttggacataaaagaacacaatggccagagtgctttccaggttgcagttgctgctaaccaacatctcattgttcaggatctggtgaacatcggggcccaggtgaacacaacggattgctggggacgaacacctttacatgtatgtgccgagaagggacactcccaggtactccaggctattcagaagggagccgttggatccaaccagtttgtggacctcgaggctaccaactatgatggactaacaccactacattgtgctgtcatcgcacataatgcagtcgttcacgagttgcagagaaaccagcagccacactctcctgaagtgcaggagcttttgctcaaaaataaatcccttgttgacacaattaaatgtctgattcagatgggggctgccgtggaagccaaggacaggaagtcagggcgcactgcacttcatctggccgccgaggaagcaaatttggaactcatccgactttttcttgagctcccatcatgtctatctttcgtgaatgccaaagcctacaatggcaacacagcactacatgtcgcagccagtctccagtaccgtttgactcagctggacgctgtacggctcctgatgcggaaaggagccgacccctcgacgcgtaacctcgaaaacgaacagccagtgcacctggttcccgacggccccgtgggagaacagatccgtcgcatcctgaagggtaaatctattcagcaaagggcaccgccatattag

SEQ ID NO: 197606 - DNA, 1857 bp, Artificial Sequence
  Description of Artificial Sequence: Synthetic coding sequence
atgggcgtgggccggcagcagcggggccccttccagggcgtgcgggtgaagaactctgtgaaggaactgctcctgcacatcagatcccacaaacagaaagcctccggccaggccgtcgatgatttcaagacccagggtgtgaacattgagcagtttagggaattgaaaaacacggtgagctactcaggaaagcggaaaggtccagatagtctcagtgatggaccggcttgcaagagaccagcactactccacagccagtttcttactccacctcagacgcccacccccggcgaaagcatggaggatgtgcacctgaacgagccaaagcaggagtcctcggctgacctgctgcagaatataattaacattaaaaatgagtgttcaccggtttcgctgaacactgtgcaggtttcatggcttaatcccgttgtggtgccacagtcctctcccgccgaacaatgtcaggatttccacggtggacaggttttctccccaccacaaaagtgccagcctttccaagtcaggggatcccaacagatgatagaccaagcttctctgtatcaatactccccacagaatcagcacgtggaacagcagcctcactatactcataaaccaacattagagtattctcccttcccaatcccccctcaaagccctgcttatgagcccaacctctttgacgggcctgagagtcaattttgtcccaatcaatcactagtgtcccttctgggagatcaaagagagtccgaaaacatcgcaaaccccatgcagacttcttctagcgtgcaacaacagaacgatgcccacctccactcttttagtatgatgccgagcagtgcgtgtgaagctatggttggtcatgaaatggcctctgacagttcaaacactagtctaccatttagcaatatgggtaatcctatgaacactactcaactgggcaagagtctgtttcagtggcaggtggagcaagaggagagcaagcttgccaatattagccaggatcagtttctcagtaaggacgccgacggtgataccttcctgcatattgctgtagcccaaggcagaagagcattgtcctacgtcttggcccgaaaaatgaacgcacttcatatgctagatatcaaggagcacaacggacaatccgcattccaggtggccgtcgcggccaaccagcatctcattgtccaagatcttgtgaatattggagctcaggttaataccacagactgctgggggaggactccactccatgtatgtgccgagaaagggcactctcaggtgctccaggccatccagaaaggtgcggtggggtctaatcagtttgtggatctagaggcaacaaattacgacgggctgacgccgctgcactgtgccgttattgcacacaatgcagtggtacacgagttgcaacgtaatcagcagcctcatagtccagaggtccaagagctgcttctaaaaaacaaaagcctagtggacacaattaaatgtctgatccagatgggcgctgccgtggaggcaaaagacaggaaaagtggaaggactgccctccatctggcggcagaagaggcaaacttggagcttattagactgttcctggaactgccgagttgtctcagtttcgtaaacgcaaaggcctataacggcaacaccgccctgcacgtggccgcatccttacagtacagattaacccagcttgatgccgtgaggctactgatgcggaagggggccgacccatcgacgcggaatctcgaaaatgaacagcccgtgcatctggtaccagatggcccagtgggcgagcagatccgacggatcttaaagggtaaaagtatacagcagagggctccaccttattag

SEQ ID NO: 197607 - DNA, 333 bp, Artificial Sequence
  Description of Artificial Sequence: Synthetic coding sequence
atgatcgtggacaagctgctggacgacagccggggcggcgagggcctgcgggacgcggctggtgggtgcgggctgatgacctctccattgaacctctcttacttttatggcgccagcccccccgcggcagctcctggcgcctgcgacgcctcgtgcagtgtgctaggccctagcgcgcctggctccccggggtccgactccagcgatttctcttctgcttccagcgtttcttcttgtggcgcagtggagtctaggtccagaggcggagctagagctgaaagacagccggtcgagccccatatgggtgttgggagacagcagcggggaccatag

SEQ ID NO: 197608 - DNA, 1806 bp, Artificial Sequence
  Description of Artificial Sequence: Synthetic coding sequence
atgggcgtgggccggcagcagcggggccccttccagggcgtgcgggtcaagaactccgtgaaggagctcttactacatattaggagccacaaacagaaggcctcggggcaagctgttgacgactttaagacccaaggcgtgaacatagagcagttcagagaattgaagaataccgtttcctacagcggcaagcgaaagggtcctgacagtctctccgatggcccggcctgtaaacgccccgccctgttgcactcccagttcttaacaccacctcagacccctactcccggcgaatccatggaggatgtgcacctaaacgagcctaaacaagagtcttccgccgaccttctgcagaacattatcaacataaagaacgagtgttcaccagtaagcctgaacactgtccaagtctcctggctcaaccctgtcgtggtaccacagagctctcccgccgagcagtgccaggacttccatgggggacaagttttttcccctcctcagaaatgtcagcccttccaggtgagagggtcccagcagatgatcgatcaagcaagtttataccagtattcaccacagaaccagcacgtggagcagcagccacattatacacacaagccgacgcttgaatattccccattccccattcccccccagagcccggcgtacgagcctaacctgtttgatgggccagagagccagttctgtccaaatcagagcctagtctcccttctaggcgatcagcgggaatctgaaaacattgccaatcccatgcagacttctagttcggtgcagcagcaaaatgacgcacatctccattccttctctatgatgcccagttctgcatgcgaggcaatggtggggcacgagatggcctccgactcatctaacacatctctccccttttcgaacatgggaaacccaatgaatacgacacagctagggaagtcactattccagtggcaagtggaacaggaggagtctaagctggcaaatattagtcaggatcagttcctcagcaaggacgctgatggggacacgtttctgcatatagcagtcgcccagggcaggagggccctgagctacgtgctcgcccgaaaaatgaacgctttacacatgcttgatatcaaggagcacaatggacaaagtgccttccaggtcgccgtcgccgcgaaccagcatcttatcgtccaagacttagttaatattggagcacaggtgaacactacagattgctggggtcgtacccccttacacgtctgcgccgagaaaggccactcccaggtactgcaggcaattcagaagggagccgtgggtagtaaccagttcgttgatttagaagccacaaactacgatggcttgaccccgcttcattgcgccgtgatcgcacataacgcagttgtgcacgaactccagagaaatcagcagccccattctcctgaagtgcaagagctgctgctgaaaaacaagtccctggtggacactatcaagtgcctgattcaaatgggcgcagctgtggaggccaaggataggaaatcagggcggactgctctgcatttggctgctgaagaagctaatttggaactcattagactgttccttgagcttccctcatgtctctccttcgtgaacgccaaggcatataacgggaatactgccctccatgtggccgcctcgctacagtatcgcctgacccagcttgacgcggtgaggcttctaatgcgcaagggtgctgacccatccactcggaacctggagaacgaacagcctgtacatttagttcccgacgggcccgttggcgagcaatag

SEQ ID NO: 197609 - DNA, 393 bp, Artificial Sequence
  Description of Artificial Sequence: Synthetic coding sequence
atgggcgtgggccggcagcagcggggccccttccagggcgtgcgggtgaagaattccgtaaaagagttgctgcttcacatcagatctcataaacagaaagcttctggccaggccgtcgacgacttcaaaacgcagggcgttaacatcgagcagtttcgcgagttaaagaatacagtaagctatagcggcaagcgcaaaggtccggatagcctgtcggatggtcctgcctgcaagcgcccagccttgttacattcgcagtttctgacccccccccagactccaactcccggggagagcatggaggacgttcatctcaacgagccgaagcaggagtccagcgctgacttactgcagaacattatcaacatcaaaaacgagtgttcacccgtgtag

SEQ ID NO: 197610 - DNA, 1101 bp, Artificial Sequence
  Description of Artificial Sequence: Synthetic coding sequence
atgagcaaccccagcccccaggtgcccgaggaggaggccagcaccagcgtttgccggcccaagagcagtatggcttctacaagcagaaggcagagaagggagaggaggttccggagatacctgagcgccggaaggttggttcgcgcccaagcactgctccagcgccaccccggactggatgtggacgcgggtcaacctcctcctctgcatcgggcatgtgcgcgccacgacgcccctgccctctgcctgcttcttagactcggtgccgatcctgcccaccaagacagacatggggatactgcccttcacgcagctgccaggcagggacccgatgcctacaccgactttttcctgcccctgttaagcaggtgtccaagcgctatgggaatcaaaaacaaagacggagaaacccctggacaaatcctagggtggggccctccttgggacagcgcagaagaagaagaagaggatgatgcctcgaaggagagagaatggagacagaaactgcagggcgatgctagtcatgaaacccaggagcccgagtccttcagcgcatggtccgataggctcgctcgggagcatgcccagaaatgtcagcagcaacagcgcgaggcagaaggcagtcggaggccacctagagcagagggaagtagccaaagctggaggcagcaagaggaagagcagcggctgttcagggagagagcgcgagcaaaggaggaagagttgagagaatccagggcccggagggcgcaggaagcgctcggagaccgggaacctaaaccaacacgcgcgggcccccgtgaggagcatccaaggggggccggcagaggatctctgtggcggtttggagacgtgccatggccttgcccaggcggtggcgatccagaggctatggctgccgctttagttgctcggggtcctccactggaggaacagggtgccttacgacggtacttgcgagtccagcaggtgcgatggcaccctgaccggtttctgcagcggttcaggtctcagattgagacctgggaactcggcagggtgatgggcgctgtgacggccctctcccaggccctgaatagacacgcagaagccctgaagtag

SEQ ID NO: 197611 - DNA, 1077 bp, Artificial Sequence
  Description of Artificial Sequence: Synthetic coding sequence
atggccagcaccagccggcggcagcggcgggagcggcggttccggagatacctgagtgccggaagactagtgcgagctcaggcgcttctgcagagacacccggggctggacgtggatgctggccagccgccgccactgcatagggcctgcgctagacatgacgcccccgccctgtgtttgctgcttcgtctgggcgccgatcccgcccaccaggaccggcacggagatacggctctccacgctgccgcgaggcaagggcccgatgcctacacagatttttttctgccgctactgtctcgctgtccttctgccatgggcatcaaaaataaagacggagagacaccaggccagatattggggtggggtcccccctgggactctgctgaggaggaagaggaggatgacgcttcaaaagagcgcgaatggcgtcagaaattgcaaggggagctagaagacgagtggcaagaagtaatgggaaggttcgaaggggacgcctcccatgagactcaggagcccgaatcttttagcgcttggtcagataggctcgccagagaacacgctcagaagtgtcaacagcagcagagagaagccgaagggtccaggcggccaccacgggccgaaggatcaagtcaatcttggaggcaacaagaggaggagcagcgcttgtttcgggaacgggctcgggccaaggaagaggagcttagagaatcacgcgcccgcagggcccaggaggccctaggcgatcgggagccgaagcccacccgggccggtccacgcgaagaacatccacggggagctggtcgcgggtcattgtggaggttcggagacgttccatggccttgtcctggcggtggtgatcccgaggcgatggctgcagccctggttgcaagaggaccgcccctcgaggaacagggagccctcaggcggtacctccgcgttcaacaggtccggtggcatccggatcgattcttacagcgttttagatcccagattgagacttgggagttaggcagagtcatgggggcagtaacagccttgagtcaagccctaaataggcacgccgaggcactaaagtag

SEQ ID NO: 197612 - DNA, 1146 bp, Artificial Sequence
  Description of Artificial Sequence: Synthetic coding sequence
atgagcaaccccagcccccaggtgcccgaggaggaggccagcaccagtgtttgtagaccaaagtcttccatggcctccacttctcggaggcaacgccgtgagcggcgttttcgacgctatctgtctgctggtaggctcgtcagagcgcaagctctgctgcagcgacacccggggctggacgtcgacgcagggcagccacctcctctccacagagcctgtgcaagacacgatgcgcccgcgctctgcctcctgctccggctcggagctgaccccgcgcaccaagataggcacggcgacactgcactgcatgccgctgcacgccagggacccgacgcctataccgacttctttctgccactgctgtcaaggtgtcctagcgcaatgggtatcaaaaataaagacggtgaaacccccggtcaaatactgggctgggggcccccttgggactctgccgaggaagaggaagaagacgacgcctccaaagagagagagtggagacagaagctgcaaggcgagttggaggacgaatggcaggaggtgatgggaaggtttgaaggggacgccagccacgagacccaggagccagagagcttttctgcatggtctgacagactggccagagagcacgcccagaagtgccagcagcagcagagggaagctgagggttctcggcggccaccgcgcgctgaagggagcagtcagagttggagacaacaggaggaagaacagagactgttcagagaacgagcccgagctaaggaggaagaactgagggagtcccgggcacgtagagcccaggaagctctgggcgacagggaacctaagcccacaagggcggggccgcgggaggaacatcccaggggggcgggacgcggctccctatggagattcggcgatgtcccatggccctgccctggcggcggcgacccagaggctatggctgctgctctcgttgctagagggcccccacttgaggaacagggtgcattgcggagatatctgcgggttcagcaagtgagatggcacccagacaggtttctgcagcgctttcgatcacagattgagacctgggaactcggacgcgtgatgggggccgtgaccgcgcttagccaggccctgaacagacatgccgaggctcttaagtag

SEQ ID NO: 197613 - DNA, 1101 bp, Artificial Sequence
  Description of Artificial Sequence: Synthetic coding sequence
atgagcaaccccagcccccaggtgcccgaggaggaggccagcacctctgtttgcagacctaagtcaagtatggcttccacatcacgccggcaacggcgcgaacggaggtttcgacggtacctgagcgctgggaggctggtacgtgcccaagctcttctgcaacggcaccctgggctggacgtagacgcgggccagcctccaccgttacatagggcctgtgcgaggcacgacgccccggccctttgcttgcttctgaggttgggcgccgatcccgcccaccaggacaggcacggggatacagcgcttcacgcagcggccagacagggccctgacgcctacaccgacttctttctccccctgctgagccgctgcccttctgccatgggcattaagaataaggatggtgagacccccggacagattctaggttgggggccaccgtgggattccgctgaggaggaggaagaggacgacgcctcaaaagaacgcgagtggaggcaaaagctccaaggggacgccagtcacgaaacccaggagcctgagtcctttagcgcctggtctgacagactcgctagagagcacgctcaaaaatgccagcagcagcagagagaagccgaggggtcatgtcgcccccctcgcgccgaagggtcttcccagtcctggagacagcaggaagaggagcagagactttttcgagaacgagccagagccaaggaggaggaactccgggagtctagagcccggagggctcaggaagctcttggggatcgtgaacccaagcccacccgcgcgggcccgagagaggaacatccacgtggtgccggccggggaagcctttggcgctttggagacgttccgtggccctgtccgggcgggggggaccccgaagccatggctgccgcgttggtggctaggggaccacccttagaagagcagggggccctaaggcgctacttgcgggtccagcaagttcggtggcaccccgatcgatttctgcaacgctttcgatcacagatagaaacgtgggagctgggtcgggttatgggcgccgtgaccgccctatcacaggcactgaacagacacgccgaggctttaaaatag

SEQ ID NO: 197614 - DNA, 1077 bp, Artificial Sequence
  Description of Artificial Sequence: Synthetic coding sequence
atggccagcaccagccggcggcagcggcgggagcggcggttccggaggtacttgtccgccggtcgtctggtgcgggctcaggctctcctgcagcggcatcctggcctcgatgtcgatgcgggccagcccccccccctgcacagagcgtgcgctcgtcacgacgcgcctgcactgtgtcttctgctgcgactgggcgctgaccccgcccaccaggatcgccacggggatactgcacttcacgctgcggcccgccagggacctgacgcctataccgacttcttcctcccgttgctgtcacggtgtccatccgctatggggattaagaacaaagatggagaaacgcccggtcagattcttggttggggccccccatgggattctgcggaggaggaagaagaggatgacgcatccaaggagcgtgagtggcgccaaaaactccagggcgagcttgaggacgaatggcaggaggtaatgggacgctttgagggtgacgccagtcatgagacacaggaaccagagtcattctcagcgtggtctgaccgcctggcacgggaacatgctcagaagtgtcagcagcagcagcgggaggctgaagggtcttgccggcccccccgtgcagaaggcagttctcagagttggcgccaacaggaggaagaacagcgcctgtttcgggagagagcacgggctaaggaagaggaactcagggagtcccgcgctcgacgcgcgcaagaggctctgggtgaccgggagcctaagccaactcgggcgggtccgagggaggagcatccaaggggtgctggacggggcagtctgtggcgctttggggacgtcccatggccatgtccaggcggcggcgaccccgaagctatggccgcagccttggttgcccgcggaccacccctggaagaacaaggcgctcttagaaggtacctgcgggtccagcaggtacgctggcatccagaccggttcctccagagattccgctcccagatcgaaacatgggagctggggcgcgtcatgggcgccgtcacagctctgtctcaagccctgaatcgacacgccgaagcccttaaatag

SEQ ID NO: 197615 - DNA, 1146 bp, Artificial Sequence
  Description of Artificial Sequence: Synthetic coding sequence
atgagcaaccccagcccccaggtgcccgaggaggaggccagcaccagtgtctgtcggccgaagagttcaatggcctctaccagccgcagacagagacgcgaacgtcgtttccggcgatatctcagcgcgggaagactggtcagggctcaggctctgctgcagagacaccctggcttggacgtggacgctggacagccccccccgctgcaccgggcatgtgccagacatgacgcacccgccctgtgcctgcttctgaggttaggcgccgatccggcccatcaggaccgccatggggacacagcattacacgccgccgctcggcagggccccgatgcctataccgacttctttttacctctgctctcccgctgcccgagtgcgatgggtatcaagaataaagacggagagactcccggccaaatcctcggatggggccctccctgggacagtgcggaggaagaggaggaggatgatgctagtaaagaacgggagtggcggcagaaactgcagggggagctggaagacgaatggcaggaggtgatggggcgctttgaaggcgatgcctcccacgagacccaggagccagagtctttctctgcctggtctgataggctggctcgggagcatgcccagaagtgtcagcagcagcaaagggaggccgagggctcatgtcgaccacctcgggcagaaggttcttcccagtcctggcgtcaacaagaggaggagcaacggctttttcgagagcgcgcccgcgctaaggaggaagaactacgggaaagtagggcccgccgggcgcaggaggctctgggcgaccgggagccaaaacctactcgtgccggcccccgtgaagaacaccctcgcggagccggacgaggatccttatggagattcggtgatgtgccgtggccctgccctgggggaggggatcctgaggctatggccgcggcactcgttgctagaggcccaccacttgaggaacaaggggcccttaggcgctatctgagggtacaacaggtcaggtggcacccagatcgtttcctgcagaggttcagaagccagattgaaacctgggagttggggagagtgatgggagcagtgaccgctctgtctcaggctttaaatcgacacgccgaggcacttaaatag

SEQ ID NO: 197616 - DNA, 1101 bp, Artificial Sequence
  Description of Artificial Sequence: Synthetic coding sequence
atgagcaaccccagcccccaggtgcccgaggaggaggccagcacctctgtgtgccgtccaaagagttctatggcttcaacatctcgcagacagcgtagagaacgccgattccgacgatatttatcggcaggtcgcctggtgcgcgcccaggccctgttacagagacaccccggactcgacgttgacgcaggccagcctcctccactgcatagggcctgtgcgaggcacgacgcgcctgcgctctgtttactgttacgactcggggcagacccagctcatcaggatcggcacggtgacactgccctgcatgcagcagcaaggcagggtcccgacgcctatacggacttcttcctacctctcctgagtcgatgcccttctgctatgggaatcaagaacaaggatggggaaacaccgggccagattctaggatggggacctccctgggactcagccgaggaggaggaagaggacgatgctagtaaggaaagggaatggagacaaaagctgcagggcgatgctagccacgagacccaggaaccggaatcctttagtgcctggtcggataggctcgccagagaacacgcgcaaaagtgtcagcagcagcaacgggaggctgagggaagctgccggccacctcgggccgagggcagttcacaaagctggagacagcaggaggaggaacagaggctgttccgcgaaagagcacgcgctaaggaggaagaactaagggagtcccgagcccgccgagcacaggaagctcttggggaccgggaacctaagcctacccgggccggccctcgcgaggagcaccctcgcggtgcaggaagaggctccctgtggcggtttggagatgtaccctggccatgtcccggaggtggagatccagaagcaatggctgcagctctggtagcccgcggtccacccctcgaagaacagggcgcactgcgccgatatttgagagtgcagcaggtacggtggcacccagatcgctttctgcagcgtttccgatctcagatcgaaacatgggaattagggcgcgtcatgggcgcggtgacagcactgagtcaggcattgaaccgacacgccgaggcgctcaagtag

SEQ ID NO: 197617 - DNA, 1146 bp, Artificial Sequence
  Description of Artificial Sequence: Synthetic coding sequence
atgagcaaccccagcccccaggtgcccgaggaggaggccagcacctcagtctgcaggcccaagtccagtatggcctccacgtctagaagacagcggcgggagagaagattccggaggtacttgtctgcaggcagattagttcgggcccaggcattgctgcagcgacatcccggcctggatgtcgacgccggtcaaccaccacctctacacagagcttgcgcacgccacgacgctcctgccctatgcctattgctgcgcctgggcgctgaccccgcccatcaagatcgccatggcgataccgctctccacgccgctgccagacagggacccgacgcttacacagattttttcctcccattgctgagcagatgtccgtcagccatgggtattaaaaataaggatggtgagacacccggccaaatactgggctgggggccaccttgggactcagcagaggaagaagaggaagatgacgcctctaaggaacgggagtggcgccaaaaactgcagggcgagttagaagatgagtggcaggaagtgatggggaggtttgaaggtgatgcatctcatgaaacccaggaacccgaatcattctccgcttggagtgatagattagcccgggagcatgcccaaaaatgtcaacagcagcagcgtgaagctgagggttcctgtaggcctccccgggctgagggctcttcccaatcatggcggcagcaagaggaagagcagcggttgtttcgcgagcgggctcgggcaaaggaggaggaactgagggagagcagggcccggcgcgctcaggaagctctgggcgatcgcgagcccaaacccacacgagctgggcccagggaggagcaccctagaggcgcaggacgtggatcattatggagattcggagacgtcccatggccctgtcctggcggtggcgacccggaggcaatggccgcggccctggtggccagaggaccccctctggaagagcaaggagcacttaggcgctacctccgggttcaacaggtccggtggcacccagatcgtttccttcaaaggttccggtcgcagatcgagacttgggagctcggcagagtcatgggggctgtaaccgctctcagccaggctctgaaccgacatgcggaggctttaaagtag

SEQ ID NO: 197618 - DNA, 1101 bp, Artificial Sequence
  Description of Artificial Sequence: Synthetic coding sequence
atgagcaaccccagcccccaggtgcccgaggaggaggccagcacctcggtgtgtcgaccaaagagcagtatggccagtacctctcgtcgccagaggcgagagcgcaggtttcgcaggtatctgtctgccggccgccttgtcagggcccaagccttgctgcaacggcatcctggcctagatgtggacgctggccagcctcctccgttgcacagagcatgtgccaggcacgacgcaccagccttatgtctgttactgcgcttgggcgcggatcctgcacaccaggaccggcacggagacaccgcattgcacgccgccgcccggcagggtccagatgcttatacagattttttcctgccattgttgtcacgttgtccgtctgcaatgggcattaagaataaagacggggagacaccggggcaaatccttggctggggcccaccctgggacagcgcagaagaggaggaggaagacgacgcgtctaaggaacgcgagtggcggcagaagttacagggggatgcttcacacgaaacacaagagccagaaagtttttcggcatggagcgaccgacttgctcgagaacatgcacaaaagtgccagcagcagcagcgcgaagctgagggatcttgcaggcctccccgcgcagaagggagcagccagagctggcggcaacaggaagaagagcagagactttttagagagagggcccgtgctaaagaggaagagctgcgggaatctcgggccaggcgggcacaggaggcacttggagacagggaaccaaaaccaacccgggccggcccacgggaagagcatccacggggtgccggcaggggcagcctgtggagatttggtgacgtgccttggccctgtcccggcggaggggacccagaggccatggcagctgccttggtggccaggggacccccactcgaggagcagggtgccctgagacggtatctaagagtgcaacaagtacgatggcaccccgatcggtttttacaacgcttccgctctcagatagagacttgggaactgggtcgggtgatgggggctgtgactgccctgtcacaggccctgaataggcatgctgaagcactcaagtag

SEQ ID NO: 197619 - DNA, 1101 bp, Artificial Sequence
  Description of Artificial Sequence: Synthetic coding sequence
atgagcaaccccagcccccaggtgcccgaggaggaggccagcacctctgtgtgtcggccgaagagcagcatggcgtccaccagcagacggcaacgccgggagcgccgattccgacggtatttaagcgctggaagactggtgagggcccaggccctcctgcagcgccacccagggctggatgtggacgctggtcaaccgcctcctcttcatagggcatgtgccagacatgacgcccctgcactctgtcttctcctgcggctgggcgcagaccccgcccatcaggatcggcatggcgataccgcactgcacgccgcagctagacagggccctgatgcctataccgacttcttcctcccacttctctcgagatgtccctcagcaatggggatcaaaaacaaagatggcgagacacctggccagatcttagggtgggggcctccctgggactcggccgaagaggaggaagaagatgatgcgtcaaaagaaagagagtggagacagaagttacagggagatgcgagtcacgagacccaggagcccgaatcgttttcggcctggtcagacagactggccagggagcatgcgcaaaagtgtcagcagcaacagcgggaagccgaaggctcgtgtaggcctccaagggctgagggatcatctcagtcttggagacagcaggaggaagaacagagactatttcgggagagggcaagggccaaggaggaggaattaagagagagtcgtgccagacgcgcacaggaagcactcggggacagggagcccaaaccaactcgggcaggaccgagagaagagcacccgcgcggcgcaggacgtgggagtctgtggagattcggcgacgtgccctggccctgccctggtggaggcgaccctgaggcaatggccgccgctctagtagcacgcggtccgccactggaggaacagggtgcacttcgcaggtatcttcgagtgcagcaggtccggtggcaccctgacagattcctccaacgttttaggagccagatcgagacttgggagctgggtcgtgtgatgggggccgtgaccgcattgagccaggctctgaataggcatgcagaggctctcaagtag

SEQ ID NO: 197620 - DNA, 1146 bp, Artificial Sequence
  Description of Artificial Sequence: Synthetic coding sequence
atgagcaaccccagcccccaggtgcccgaggaggaggccagcaccagtgtgtgtcggcccaagagctccatggcaagcaccagccggcgtcaacgtagagagaggcgtttcaggcgatatctttccgctgggaggcttgtaagagcccaggctttactgcagaggcacccaggcttagatgttgacgccggacagccccctcctctgcaccgggcctgtgcacgccacgacgcgcctgcactgtgcctcctgttgcgtctcggcgccgacccagcccaccaggatcggcatggcgacacagctctccatgccgctgcccggcagggcccagacgcatacacagatttctttcttccgctgctttctcgctgcccttccgcaatgggcataaagaacaaggacggcgaaaccccaggtcaaatcttgggctggggtcctccttgggacagcgccgaggaagaagaagaagacgatgcatctaaggagcgcgagtggcggcagaagctgcagggcgagctggaagacgagtggcaggaagttatgggcagattcgaaggtgacgcatcccatgagactcaggaaccggagagcttcagcgcctggtccgatcgcctagctagggagcacgcacagaagtgtcagcagcaacagcgagaagccgagggctcctgtcggcctccgagagcagaagggtctagccagtcctggaggcagcaagaagaggaacaacgcctgtttcgggaaagagctcgggctaaggaggaagagctcagggagtcccgggcacggagggcccaggaagcattaggcgaccgcgaacccaaacctacccgggccggccctagagaagagcaccctaggggggcaggcagaggtagcctatggagatttggagatgtcccttggccctgtccaggtggtggcgatccggaagctatggcagctgcacttgttgctcgtggccccccattggaggaacagggcgctctgcgacgttacttaagggtgcagcaggtccggtggcacccagatcgttttctgcagcgcttccgctcacagatcgaaacctgggagcttggcagagtgatgggcgcagtcaccgccctatctcaggcccttaaccggcacgcggaagcgttaaagtag

SEQ ID NO: 197621 - DNA, 1077 bp, Artificial Sequence
  Description of Artificial Sequence: Synthetic coding sequence
atggccagcaccagccggcggcagcggcgggagcggcggttccggagatatcttagcgcaggacgcctggtacgtgcccaggcattactccaaaggcatcccggcctggatgtggacgccggccagccaccccccctccaccgggcctgtgcccgccacgacgcccctgccttgtgcctgctactaaggctcggggcagatccagcccaccaggatcggcatggggatacggccctgcatgctgcagcccgacagggccccgacgcttataccgacttttttctgccactcctttcacggtgtccctctgccatgggcattaagaataaggacggagaaactcccgggcagattctgggctggggaccaccatgggactcagccgaggaggaagaggaggacgatgcttctaaggaacgtgagtggaggcagaaactgcaaggcgaattggaggacgaatggcaagaggtcatgggcagattcgagggggatgcctcacacgagacacaggagcctgaaagcttcagcgcctggtcagaccgactggcccgagaacatgcacagaaatgccaacagcaacaacgcgaagccgaagggagctgccgtccaccgcgggctgagggcagttcgcagtcatggcggcagcaggaggaagagcaaagactgttcagggaaagggcccgtgcgaaggaagaggagctgagggaatccagggctaggcgggcccaggaggcactgggggatcgcgagcctaagccgaccagggccggtccacgagaggaacacccaagaggagctgggagaggatccctctggcggttcggagatgtgccatggccatgtccaggagggggggatccggaagcaatggccgccgcactggtagcgcgagggcccccactagaggagcagggagccctcaggagatatctgagagttcaacaggtgagatggcaccctgacaggttcctgcagagattccgcagtcagattgagacctgggagttagggcgggtgatgggagccgtaacagctttgtctcaggcacttaatcgccacgccgaagcactgaagtag

SEQ ID NO: 197622 - DNA, 1101 bp, Artificial Sequence
  Description of Artificial Sequence: Synthetic coding sequence
atgagcaaccccagcccccaggtgcccgaggaggaggccagcacctccgtgtgcaggccgaagagctccatggccagcacctcgcgtcgccagcgccgggaacggagattcaggcgatacctgagtgctggacggcttgtcagagcgcaagcgttattgcagaggcacccgggcctggacgtagatgccggacagcctcccccactacaccgcgcctgtgcacggcacgacgccccagccttatgtcttcttctgagattgggggccgatcctgctcaccaggatcggcatggggacacggccctccacgcagccgccaggcaaggcccagacgcctacacagatttctttctgcccctactgtctaggtgcccaagcgctatgggtatcaagaacaaagatggcgagacacccggtcagatcctggggtgggggccaccttgggactcggctgaagaggaagaggaggacgatgcctccaaagagcgggaatggagacagaagttgcagggcgatgcttcacatgagactcaggaaccagaaagcttttccgcgtggtcagaccgactcgctagagaacatgcgcagaagtgtcagcagcagcaaagagaggccgagggttcttgtagaccaccacgggctgaaggcagcagccagtcctggaggcagcaggaagaggagcaacgactcttccgtgaaagagccagagccaaagaggaagagctgcgggagtcccgcgcacggagagcacaagaggcactcggagaccgcgagccaaagcctacacgcgcgggcccccgggaggaacacccacggggagctggtcgcgggtccctatggagatttggtgatgtgccatggccatgccctggcgggggcgaccctgaggccatggctgccgctttagtcgccagaggcccccctctcgaagaacaaggagcactccggcgatatttgagggtgcagcaagttcgctggcacccggatcgttttttgcagcggttcaggagtcaaattgagacatgggagctgggccgggttatgggggcagtgacagcgctgtcacaagcgctgaataggcatgctgaggccctgaaatag

SEQ ID NO: 197623 - DNA, 1077 bp, Artificial Sequence
  Description of Artificial Sequence: Synthetic coding sequence
atggccagcaccagccggcggcagcggcgggagcggcggttccggcgatacctctccgctgggcggctggtgcgcgctcaggcactgctgcaacggcacccaggactggacgtggacgccggacagcccccacctcttcatagagcatgcgcaagacatgatgcccctgctttgtgcctgctgctgcgcctcggagccgaccccgcccaccaggatcggcatggggacaccgctctccacgcggccgcacgtcagggtcccgatgcatacactgatttttttttacctctacttagtaggtgcccgtccgccatgggaattaaaaacaaggacggagagactcctggtcagattcttgggtgggggcccccctgggatagtgctgaagaggaggaggaggatgacgcttccaaggagagagagtggcgtcagaagctgcaaggtgagttggaggatgaatggcaggaggtgatgggtagattcgaaggcgatgcgtctcatgagactcaagagccagagtctttttccgcctggtccgatagattggcccgggaacacgcacagaagtgccagcaacaacagcgcgaagctgaggggtcctgccgccctcccagggccgagggctcctcgcagtcctggcgccagcaggaggaggaacagcggctgtttagggagagagcacgggctaaggaggaagagctccgagagagcagagcaagaagagcccaggaggccctcggcgatcgtgagcccaaaccaacccgggccggccctagagaggagcatcctagaggcgccggccggggctctttatggaggtttggtgatgtaccctggccatgcccaggtggcggagacccagaggctatggccgccgcccttgtcgcaagggggccacccctcgaagaacagggcgcactgaggcggtatttacgagtgcaacaggttcgctggcatcccgaccggttcctgcaacgctttcgctcacagatcgagacctgggagctggggagggtgatgggcgcggtgaccgctcttagtcaggcactgaatcggcacgccgaggcacttaaatag

SEQ ID NO: 197624 - DNA, 1146 bp, Artificial Sequence
  Description of Artificial Sequence: Synthetic coding sequence
atgagcaaccccagcccccaggtgcccgaggaggaggccagcaccagtgtgtgccgacccaagagctctatggcctccaccagtcgcagacaaagaagggagcggcgctttcgtcggtatctttcagccggaagactggttcgggctcaggcactgttgcagcgtcacccgggcctggatgtcgacgccgggcagcctcctcctcttcacagggcctgcgcaagacacgatgcccctgccctctgcttgctgctgagattgggcgcagatcctgcccaccaagatcgccatggcgatactgccctgcatgccgccgccagacagggccccgacgcctatactgattttttcctgccgttgctgtctcgttgcccttccgccatgggtattaagaataaggatggagaaaccccggggcaaatcctgggctggggcccaccctgggattctgccgaggaggaagaagaggatgacgcgtctaaagagagagagtggcgccagaaactccagggggagctcgaggatgagtggcaggaggtcatggggcgtttcgagggcgatgcttctcatgaaacccaagagcccgagagctttagtgcctggagcgatagacttgcgcgggagcacgctcagaagtgccagcagcagcaacgagaggccgagggttcatgcaggccaccccgagctgaagggtccagtcagagctggcggcagcaggaagaagagcagcggctatttagagagcgcgcgcgggctaaagaagaagaactgcgcgagagtagagcgcgcagagcccaggaagcactgggcgaccgggagcctaagcccacaagggcaggtccgagggaggaacacccacgaggggcaggaagaggaagcctttggcgctttggagatgtcccatggccgtgtcctggtggaggggaccccgaagcaatggccgcggccttggtggcccgtggacctccgctcgaagagcagggagctctgcggcgatatttaagagtacagcaggtgcggtggcatcctgaccgcttcctgcagcgattccgtagccagatcgagacttgggagctgggaagagtgatgggtgctgtcactgccctgagccaggctctcaacagacatgctgaggcactgaagtag

SEQ ID NO: 197625 - DNA, 1077 bp, Artificial Sequence
  Description of Artificial Sequence: Synthetic coding sequence
atggccagcaccagccggcggcagcggcgggagcggcggttccggcgatacctttctgctggtcgcctcgtgagggctcaggcgctgctccagcgtcatccaggtctggacgtcgatgccgggcagcctccccctctgcacagggcctgtgcccgccatgacgcaccagccctgtgcctgctgctgagactcggcgccgatccagctcatcaagacagacacggcgatacagctctgcatgcagcagcccgacaaggcccagacgcctacacagacttctttctccctttgcttagtaggtgcccctctgcgatgggcatcaaaaataaggatggcgaaacaccaggtcagatattaggttgggggcctccgtgggattcagcagaggaggaagaagaggatgacgcatccaaggagagagaatggcgccagaagctgcagggagaactcgaggatgaatggcaggaagtgatgggcagattcgagggggacgcctcacacgagacccaagaacctgaatctttcagcgcatggagtgacaggctggcccgcgaacacgcacagaagtgccagcagcagcagcgcgaggcagaaggaagttgccggcctcccagggcggagggttccagccagtcttggcgccagcaggaagaggagcagagattgttccgggaacgggcccgggcaaaagaagaggaactccgggaaagcagggcccgtagagctcaagaagcccttggtgatcgcgaacctaaaccaacccgcgctggcccccgggaggaacacccacgaggtgctgggagaggatcattatggcggtttggcgacgtcccatggccctgccccggagggggcgatcccgaagcaatggctgcggcgttggtcgcacgaggccctccattggaagagcagggcgccctccggcgctacttacgggttcagcaggtgcgatggcacccagataggttcttgcaaagatttcgatctcagatcgaaacatgggaactgggtcgagtgatgggggcagtgaccgctctatcgcaagccctgaacaggcacgctgaagccctgaagtag

SEQ ID NO: 197626 - DNA, 1146 bp, Artificial Sequence
  Description of Artificial Sequence: Synthetic coding sequence
atgagcaaccccagcccccaggtgcccgaggaggaggccagcacctctgtctgtcggcccaaatcctccatggcatccacctcccggcgtcagcggcgtgaaaggagattccgacggtacctgtctgccggtcggcttgtgcgggctcaagcattactccagcgacaccctggactcgacgtagacgccggccagccccctcctctgcaccgagcctgcgctagacatgatgcgccagctttatgtctgctcctgcgtctgggagctgatcctgctcaccaggataggcacggtgacacggccctccatgcggccgcaaggcaaggacccgacgcgtatactgatttcttcctgccattgctgtcacgatgtccaagcgccatgggcataaaaaataaggatggagagactccgggacagattctgggttggggccccccttgggacagcgctgaggaggaagaggaagacgatgcctccaaggagcgggagtggcgacaaaagctccagggtgagctggaggatgaatggcaggaggtgatggggagattcgaaggtgatgcaagccacgagactcaggaacccgagagcttttcagcgtggtcagataggcttgctcgcgagcacgcccagaagtgccagcaacagcaacgtgaggccgaaggtagttgccggcccccgagagccgagggcagctctcaatcatggagacagcaagaggaagagcagcgtttatttcgcgaacgggcacgagctaaagaagaagagctcagggaaagcagggcaagacgagcacaggaagccctaggtgatagggaaccgaagcctacacgtgcaggaccgagggaggagcacccgaggggggcgggacgcggctccctctggcggttcggcgatgtgccatggccttgtccaggtggaggggatcccgaagcaatggctgcggctctggtggcgcgaggccctcctctggaagagcaaggcgcactgagacggtacctgcgagtacagcaggtgcgatggcaccccgatcggtttctgcagagattccggagtcaaatcgaaacatgggagctgggaagggtgatgggggccgtgacagccctgagccaggctcttaatagacacgccgaggcgctaaaatag

SEQ ID NO: 197627 - DNA, 1101 bp, Artificial Sequence
  Description of Artificial Sequence: Synthetic coding sequence
atgagcaaccccagcccccaggtgcccgaggaggaggccagcaccagtgtgtgcagacccaaaagctcgatggcctcaacatctcggcgacagaggcgggagagacgattccgccgatatttgtctgccgggcggttggtgagggcccaagccctattgcaacgacaccctggactggatgtcgatgcaggacagcctccgccgctgcatagggcctgcgccagacatgatgcaccagccctctgtctgctgctccgcttgggcgccgatcctgcccatcaggatcggcatggagatacagccctccacgctgctgcacgccaaggtccggacgcttacactgatttctttctgccattactgagccgatgcccatcagccatggggatcaaaaataaggacggagaaactccgggtcagatactgggctggggcccaccctgggattccgcagaggaggaagaagaggacgacgcttcaaaggaacgcgagtggaggcagaagctgcaaggcgacgcttcccatgaaactcaggaacccgaaagtttctctgcctggagcgatcggttggctagagagcacgcccagaagtgccagcagcagcagagggaggccgagggcagctgtcgcccacctagggctgagggatccagccagtcctggagacagcaagaggaggagcaaagactcttcagagagcgggctcgagccaaggaggaagagttacgggagtcccgcgcccgaagggcgcaagaggcccttggagacagggaacccaagcccactcgagccggcccccgcgaggaacatccacggggcgcaggacgggggtctctttggcgctttggcgatgtgccctggccctgtccaggtgggggagacccagaggccatggccgcagctctggttgcaagaggccctcctctggaagagcagggggcgctcagacgctatctccgtgttcagcaagtccggtggcaccccgatagatttcttcagagatttagatctcagatagagacttgggaattgggtagggtgatgggtgccgtgaccgccctgagccaggccctgaacagacacgcggaagccttgaaatag

SEQ ID NO: 197628 - DNA, 1077 bp, Artificial Sequence
  Description of Artificial Sequence: Synthetic coding sequence
atggccagcaccagccggcggcagcggcgggagcggcggttccggagatatctctccgcaggtcgcctagttcgcgcccaggcactccttcagaggcatcctggtctggacgtggatgccggtcagcctccacccctgcatcgggcatgcgccaggcacgacgcaccagcactgtgcttattattgagactcggtgcagatccagcacaccaggataggcacggtgataccgccttgcacgcagccgcccgacagggacccgatgcttacaccgatttcttcttacctttgctgtcccgctgcccaagtgcgatgggtattaagaataaagacggggaaactcccggtcaaatcctaggttggggccctccatgggatagcgccgaagaagaggaggaggatgacgccagtaaagaaagggagtggaggcagaaacttcaaggtgagttggaggatgagtggcaggaagtgatgggtagatttgagggggatgctagccacgagacacaggaacctgagtctttctctgcctggagcgatcgtctagctagggagcatgcccagaagtgtcagcagcagcaacgcgaagctgagggctcctgccgcccgccccgagcagaagggagctcccagagttggcggcagcaggaagaggagcagcggctcttccgcgaacgtgctcgtgccaaggaggaggagcttcgcgagtctagggccagaagagcacaagaggcacttggagatagggagcccaagccaactagggctgggccccgtgaggagcatccacgcggcgccggacgcggctcactgtggaggtttggcgacgttccttggccctgcccgggcgggggagatcctgaggccatggccgcagctctcgtggcccgcgggcccccactggaagaacagggcgccctgcgacgatacctgagagtccagcaggtgagatggcaccccgatcggtttttacaacgctttagatctcaaattgagacctgggagctgggccgggtcatgggagcagttactgctctatcccaggcacttaaccggcacgccgaagccctcaagtag

SEQ ID NO: 197629 - DNA, 1146 bp, Artificial Sequence
  Description of Artificial Sequence: Synthetic coding sequence
atgagcaaccccagcccccaggtgcccgaggaggaggccagcacctccgtatgccggccgaagtcaagcatggcatcgacgtcacggcggcagcggcgcgaaaggagatttagacgatatctgtctgcaggccgtctcgtcagagcgcaggctctgctgcaacgccacccggggttggacgtggacgctggccagccacctcccctccacagagcctgcgccagacatgacgcccccgccctgtgtcttcttctccgtctcggtgccgacccagctcaccaggatcgtcacggggacacggcactgcacgctgccgcccggcaaggtccagacgcctacaccgacttctttcttccactgctgagccgttgcccatcagcaatgggaattaagaataaagacggcgagacacccgggcagatcctggggtggggacctccgtgggatagtgcagaggaggaggaggaagatgatgctagtaaagaacgggagtggcggcagaaactgcagggcgaactggaagatgaatggcaagaggttatgggaagattcgaaggagatgcttcccacgaaactcaggaacctgagtctttctctgcttggagtgacaggctggcccgagaacacgcacaaaaatgccagcaacaacagagagaagcagaaggaagttgtagaccccctcgtgccgaaggcagtagtcaatcctggcgccagcaggaagaggagcaaaggttgtttagggagcgggctcgggcaaaggaggaagaactcagggaatcgcgcgcccgtcgcgctcaggaggccctcggggatcgcgagcctaaaccaactcgcgcgggacctcgcgaagaacatcctcggggcgcaggaagaggatcactctggagattcggggacgtcccgtggccatgtcctgggggtggagatcctgaagctatggctgctgcgctcgtagcccgcggaccacccctagaagagcaaggtgccctccgcagataccttagggtccagcaggtccgctggcatccagacaggttcttgcagagatttcgctctcagatcgaaacatgggagcttggtagagtcatgggagcagttacggccctcagccaggccttgaaccggcacgccgaggccctcaagtag

SEQ ID NO: 197630 - DNA, 1077 bp, Artificial Sequence
  Description of Artificial Sequence: Synthetic coding sequence
atggccagcaccagccggcggcagcggcgggagcggcggttccggcgatatctgtcagcaggcaggctggtgagagcccaggctttgttgcagcggcatcccggacttgatgtagatgccgggcagccaccccccttgcacagagcctgcgcccgccatgacgcacccgcgctgtgcttgcttctgcgtctgggagctgacccggcacatcaggataggcacggagataccgcactccatgcagctgcacggcagggccccgatgcatacaccgacttctttctccctcttctgagtagatgtccgtccgccatgggcattaaaaataaggatggcgagacaccgggccaaattctcggctgggggccaccttgggactctgcagaggaagaggaagaagatgacgcaagtaaagagagagaatggaggcagaagcttcagggtgagctggaggacgagtggcaagaggtcatgggccgattcgaaggcgacgcatcacacgagacccaggaacctgagagttttagtgcttggtctgatcgactcgcaagggagcatgctcagaagtgccagcaacagcaacgtgaggccgaaggaagctgtagaccaccacgggccgaagggtctagccagagctggaggcagcaggaggaagagcagcgcttgttcagggaaagggcccgtgccaaagaggaggagcttcgggagagccgcgcccgacgcgcacaggaggcgctgggcgatcgagagcccaagcccacgcgtgcaggaccccgggaggagcatccccggggggctggccgtggatccctgtggaggttcggcgatgttccatggccttgtcccgggggaggggacccagaagcaatggccgccgccctcgtcgcaaggggcccaccccttgaggagcagggcgcccttcgcaggtatctgcgtgtgcagcaagtgagatggcaccccgacagatttctacagcgcttcaggagccaaatagagacatgggagctcggtcgtgtcatgggggccgtcacagccctgagtcaggctctgaataggcatgctgaggctctgaaatag

SEQ ID NO: 197631 - DNA, 699 bp, Artificial Sequence
  Description of Artificial Sequence: Synthetic coding sequence
atggccagcaccagccggcggcagcggcgggagcggcggttccggagatacctgtccgctggcagacttgttagggcacaggcattgctgcagaggcaccctggactggatgtcgatgcgggccagccacctcccttacacagagcgtgcgccagacacgacgcccctgctctgtgtctgttgttgcggctcggtgccgatccagctcaccaagatcgtcatggtgacaccgctctgcatgctgccgcaaggcaggggcccgatgcctacactgacttcttcctccccttactctcccgctgcccttcggccatggggattaagaacaaagatggtgaaacacccggtcagatcctcgggtggggacccccttgggatagcgccgaggaggaggaggaagacgacgcgtccaaggagagggagtggcgccagaagctccaaggcgaacttgaagacgagtggcaggaagttatggggcgtttcgagggtgatgcatctcatgaaacccaggagccggagagcttctctgcgtggagtgaccgactcgctcgtgaacacgctcaaaagtgtcagcagcagcagcgcgaagctgaaggctctaggagaccaccccgggccgagggcagcagccagtcttggcggcagcaggaggaggagcagagactgtttagggaacgcgccagagcaaaggaggaatag

SEQ ID NO: 197632 - DNA, 699 bp, Artificial Sequence
  Description of Artificial Sequence: Synthetic coding sequence
atggccagcaccagccggcggcagcggcgggagcggcggttccggcgctacctgagcgccgggagattggtgagggctcaagccctgttgcaacggcaccccggtttggacgtagacgccggccagccgcccccacttcatagagcttgcgcacgccacgatgcaccagccctgtgcctcctccttcgcttaggcgccgaccctgcccaccaggaccgacacggcgatacagcactacatgcggctgctagacagggacctgacgcttatactgacttctttttgcctctgctgtcccggtgcccgtccgctatgggtatcaagaataaggacggagagaccccagggcagatcctcggctggggccctccatgggactcagctgaggaggaggaagaagacgacgcaagtaaggaaagggagtggcggcagaaacttcagggagaactcgaagacgagtggcaggaagtaatgggtagattcgagggggatgccagtcatgagacacaggagccagagtccttctccgcatggtccgacaggttggcaagggagcatgctcagaagtgtcagcagcagcagagagaggcagaaggctcttgtagacccccccgggccgaaggttcttcacagagttggcgccagcaggaagaggagcaaagactctttagggaaagggcccgggcgaaagaagagtag

SEQ ID NO: 197633 - DNA, 699 bp, Artificial Sequence
  Description of Artificial Sequence: Synthetic coding sequence
atggccagcaccagccggcggcagcggcgggagcggcggttccggcggtatctctccgccggtagacttgtgcgcgctcaggcgttgctgcagagacatccggggctagatgtcgacgccggtcagccacctccactacatcgtgcatgtgcgagacacgacgctccagctctgtgtctgctgctcagactgggggccgatcctgcccatcaggacagacacggcgacactgctcttcacgccgccgctcggcaaggaccagatgcatacacggactttttcctgcctctcctgtctcgctgcccatcagccatgggcatcaagaacaaggacggggaaacacctggtcagatcctgggttgggggcctccatgggactcggccgaggaggaggaagaggacgacgcatctaaggagcgcgaatggaggcagaagctgcagggggagcttgaagacgaatggcaggaagtaatggggcgctttgagggagacgccagccatgagacccaggaaccagagtctttctctgcgtggagtgatcggcttgcaagagagcacgcccagaagtgtcaacaacagcaacgcgaggcagaaggttcatgtagaccccctcgggccgagggctccagtcaatcgtggcggcagcaggaggaggagcagcgtttatttagagaacgtgctcgggcgaaggaggagtag

SEQ ID NO: 197634 - DNA, 699 bp, Artificial Sequence
  Description of Artificial Sequence: Synthetic coding sequence
atggccagcaccagccggcggcagcggcgggagcggcggttccggcggtatctctctgcgggtagactggttcgggcccaggctctcctccagagacaccctggcttggacgtggacgctggacagcctcccccactgcatcgtgcgtgtgcacgacacgatgcccccgctttatgtctgctcttgagactaggtgcagacccagcccaccaagataggcacggggacaccgctctgcacgcagccgcccggcagggcccagatgcctatacagattttttcctacccctgctttcacgctgcccatccgctatgggcatcaaaaataaagacggggaaacccccggccagattctgggctgggggcctccttgggacagcgcagaagaggaggaggaagacgacgccagcaaagagcgagagtggcggcagaaattgcaaggcgagctggaagatgagtggcaggaagtgatggggaggtttgagggagacgcctcgcatgagactcaagagcccgaatctttctctgcctggagtgacagactggcccgggagcacgcacagaaatgtcaacagcagcagagggaggccgagggatcgtgtcgtccacccagagccgaaggctcatcccaatcttggcggcagcaggaggaggagcagcgactgtttcgcgagagagctcgggccaaagaggaatag

SEQ ID NO: 197635 - DNA, 699 bp, Artificial Sequence
  Description of Artificial Sequence: Synthetic coding sequence
atggccagcaccagccggcggcagcggcgggagcggcggttccggagatatctgtctgctggacgcctggtgagggcccaggctttgctgcagcggcaccccggattagacgttgatgccggccaacctcccccgctgcaccgggcttgcgcgagacacgacgcaccagcactgtgcttactcctgcgacttggagctgacccggcgcaccaggaccggcacggggacacagcgctgcatgccgcagcaagacagggccccgacgcctatactgatttttttcttcctctgctgagtcggtgccccagcgccatggggataaagaataaggatggcgaaacacccggtcagattcttggatggggcccaccctgggattccgctgaagaggaagaggaggatgatgctagcaaagagagagagtggagacagaaattgcagggtgaactcgaggatgaatggcaggaagtaatgggtcgctttgaaggcgatgcgagtcatgagacacaggaacccgagtccttctcggcctggtcagataggcttgcaagggaacatgcgcaaaaatgccagcagcaacaaagggaagctgaaggcagctgtcgccctcctcgagccgaggggagtagtcagtcttggagacagcaggaggaagaacagcgcctgtttcgtgagagggcaagggcgaaagaggagtag

SEQ ID NO: 197636 - DNA, 699 bp, Artificial Sequence
  Description of Artificial Sequence: Synthetic coding sequence
atggccagcaccagccggcggcagcggcgggagcggcggttccggcgttatctgtccgcaggccgccttgtgcgcgctcaggccctgctgcagaggcatcccggactggacgttgatgccggccagccacctccactgcaccgggcttgtgctagacacgatgccccagcactctgcttgctgctcaggctgggtgccgacccggctcaccaagaccgacatggtgacaccgccctgcacgcggctgcacgacagggaccagacgcatatacggacttctttcttcccttgttgagcaggtgtcccagcgcaatggggatcaaaaataaggatggggaaacccctggacaaattctaggctggggtcctccttgggactctgctgaagaggaggaggaggacgatgcaagcaaagagagagagtggcgccagaagctgcagggggagctggaagacgagtggcaggaggtgatgggccggttcgagggagacgcttcacacgaaacacaggaacctgaaagttttagcgcctggtctgacaggctggcaagagaacacgcacagaagtgtcaacaacagcagagagaggccgagggtagttgcaggccaccacgcgccgaagggtcttcccaatcatggagacagcaggaagaagagcaaaggctgttcagggaaagggcccgggctaaggaggaatag

SEQ ID NO: 197637 - DNA, 699 bp, Artificial Sequence
  Description of Artificial Sequence: Synthetic coding sequence
atggccagcaccagccggcggcagcggcgggagcggcggttccggaggtatctctccgccggaagactagttcgcgcccaggctcttcttcaaagacatcccggcctcgacgttgatgcagggcagccacccccactgcatcgagcctgcgccaggcacgatgcacccgccctttgtctgttgctcagactgggcgccgaccccgcccaccaggacagacacggcgacactgctctgcacgcggccgcccgtcagggtccagacgcgtacaccgatttctttttaccactcctgtctagatgtcctagcgccatgggcataaagaacaaagacggggaaacacccggacagattctgggttgggggcccccatgggatagcgctgaagaagaggaggaggacgatgcgtctaaggagcgcgaatggagacagaagctccagggggagctggaagacgaatggcaggaggtgatgggtcgcttcgagggggatgccagccacgagacccaagagcccgaaagcttctcggcctggagcgaccgattggccagagagcatgcacagaaatgtcagcagcagcaaagagaagccgagggtagctgtagacctcctcgagccgagggttcgagccagtcctggcggcagcaagaggaggagcagcggctgttcagggaacgcgcaagggccaaggaagaatag

SEQ ID NO: 197638 - DNA, 3900 bp, Artificial Sequence
  Description of Artificial Sequence: Synthetic coding sequence
atggacagcctggaccacatgctgaccgaccccctggagctgggcccatgtggagatggccacgggacccgaatcatggaagactgtctcctgggggggacgcgagtgtcgctgccggaagacctgctggaagacccggaaatttttttcgatgtcgtgtccctttcaacctggcaagaagtgctctctgacagccagcgagagcacctgcagcagttcctgcctcaatttcccgaggatagtgccgagcagcaaaacgaattgatcctggcactcttcagtggcgagaacttcagattcggtaatcctctccacattgcacagaagctgtttcgggacggtcactttaaccccgaggtggttaaatatcgccaactctgtttcaagtcccagtataaacgctatctcaactcgcagcaacagtactttcaccggttgcttaagcagattctggccagccgctccgatcttctggaaatggctcggaggagcggcccagccctcccatttagacaaaaaaggccatcgccctcacgaacacccgaggagcgggaatggcgaacacaacaacggtacctgaaagtacttcgggaagtgaaagaagaatgcggagataccgcgttgtcttcggatgaagaggacctgtcgtcctggttgccgagtagtccagcaaggtccccttctcccgcagttccgctgcgcgtcgtgccgacgttatctaccaccgacatgaaaacggcggataaggtggagctgggcgactctgacttgaagataatgctgaaaaaacaccatgagaaaaggaaacatcagccagatcatccagacctgctgactggagacctgacacttaacgacatcatgactagagtgaatgccggacggaaaggctctttggccgctctgtacgatctcgctgtgctcaagaagaaggtcaaagagaaggaggaaaagaaaaagaaaaagatcaaaacaattaagagcgaggccgaagatctggctgagcccttaagttccacagagggcgtcgctcccttgtcgcaggccccttcccctctggccataccggcgattaaggaggagccgcttgaggacctgaagccctgcctgggcataaacgaaatttccagttccttcttctccctgctgctggagatcctccttctggaatcacaggcttcgcttcctatgttagaagaaagggtgcttgattggcaaagtagcccagctagcagtcttaatagctggttcagcgcagcccccaactgggccgagctggtgctgcctgcccttcaatacttagccggcgaatcacgggcagtcccatccagcttcagcccattcgtggagtttaaggagaagacacagcagtggaagctgcttggccagtcccaggacaacgaaaaggaactggccgctctgttccagttatggttggagaccaaggaccaggcattctgtaagcaggagaacgaggattcatccgatgccaccactcctgtgccccgggtccggaccgactacgtcgttcggccctctaccggggaagagaagcgtgtattccaagaacaagagagataccgctactctcaaccccacaaggcattcaccttccgtatgcatggattcgaaagcgtggtcggtccggtgaaaggcgtgttcgacaaggaaacatccctgaacaaggcacgcgaacacagtctcctacgatccgacagacccgcatatgttactatcttgtccctggtccgagatgcagccgcccgcttaccaaacggggaggggaccagggccgagatctgcgagttactgaaggactcccaattccttgcccctgacgtgacaagcactcaggtgaacacagtcgtgagcggtgccttggatcggctccactacgagaaagatccatgtgtgaagtacgacatcggtaggaaactgtggatctatttgcaccgcgacaggtccgaggaagaatttgagcgcatccaccaggcccaagctgctgccgccaaagcccgtaaggccctgcaacagaagcctaaacctccttcaaaggttaagagttcatccaaagaaagctcaatcaaggtcctttcgagtggtccgagtgaacagagtcaaatgtctctgtccgacagttctatgccacccacccccgtaacgcccgtcactcctaccacccctgctttgcctgccatacctattagtccaccaccagtctcagccgtcaacaaatctgggccctctacggtgtcagaacccgccaaatccagttccggcgtcttgttggtcagttcacctaccatgccccacctgggcacgatgctgagtccggccagttcacagaccgctcctagcagccaggccgctgctagagtagtgagtcactccgggtcagcaggactgtcccaggtgcgggtggttgcacagccatcccttccagcagttccacagcaaagtgggggccctgcccagactcttccacagatgcccgccggcccccagatccgggttcctgctacggccactcaaaccaaagtggtaccgcagaccgtcatggccactgttccggtgaaggcacagactaccgctgcaactgtgcagcgaccaggaccaggccaaaccgggctcaccgttacgagcttgccagcaacggcttccccggtgtcaaagcctgccaccagctctcccgggacctcagctccctccgcctcgaccgcagccgttatccaaaatgtaactggtcagaacatcattaaacaggtggctataacgggccaactgggggtaaaacctcagaccgggaactccatccccctgactgctaccaattttagaatccaaggcaaggatgtactccggctgcctccaagttctattaccacggacgctaagggccagacagtgctccggattaccccagacatgatggccactctcgccaaaagccaagtgactacagtcaagcttacgcaggacctgttcggcactggtggaaacacaacaggcaaagggatttcagctactctccacgttacatcaaacccagtgcacgcggctgactcgcccgctaaagcctctagcgcgtcggctcccagtagcactccaactgggacaacggtggtgaaggtcacccctgaccttaagccaaccgaagcctcttccagtgctttcaggctgatgcccgctcttggtgtctctgtagctgatcagaaggggaagagcaccgtggctagcagcgaggcaaaacccgcggcaactattaggattgtccaagggctgggcgtgatgccccctaaagctggtcagaccatcaccgttgccacccatgcaaaacagggggcatccgtcgcgagcggcagcggtaccgtgcacactagtgccgtgagcctaccttctatgaatgccgcagtgtcgaaaacagtggctgtagcctcaggcgccgcgagtacaccaatctcgatttcaacaggggcacctacggtaaggcaggtgcctgtgtccactacagtggtgtctaccagtcaagccggcaaattgccaaccagaatcacggtgccactctccgtgataagccagcctatgaagggaaagagcgtcgtcacagcccccattattaaaggcaacctgggcgccaacctcagcggactaggcaggaacattattctcaccacaatgccagctgggacaaagctcatcgccggcaataaacccgtgagtttccttacagctcaacagttgcagcagctgcagcagcagggtcaggctacccaggtccgaatacagaccgtccctgcctcccacttgcagcagggtacagcctccgggtcctctaaagccgtgtccacggtagtggtcaccaccgcaccatcacccaagcaggcacctgagcaacagtag

SEQ ID NO: 197639 - DNA, 3900 bp, Artificial Sequence
  Description of Artificial Sequence: Synthetic coding sequence
atggacagcctggaccacatgctgaccgaccccctggagctgggcccctgtggcgacggtcatggtacccgcattatggaggattgtctgctgggcggcaccagggtgagtttacctgaagatttactggaagacccagagatcttttttgacgtagtgagcctgtctacatggcaggaagtcctgagcgactcacagagagagcatctccagcagttcctgccccagtttcccgaggactctgcagagcagcagaacgaactgatcctcgcattgttctcgggcgagaactttaggttcggcaacccattgcatatagcccagaagctcttcagggacgggcactttaatccggaagtggtgaaataccggcagctgtgttttaaaagccagtataagcgctatttgaattctcagcagcagtacttccaccgtctcctgaagcaaatcctggcttctaggtctgacttgctggaaatggcaaggcgctctggccctgcactgccctttcgccagaagcgccctagtccaagtcgaacccccgaggagagagaatggcggacccaacagcgctacctgaaagttctcagggaggtcaaagaagaatgcggcgacaccgccctatcaagtgatgaagaagatctttcgagctggttgccgagcagccctgcccgcagtccttctccagcagtaccactcagggtcgtaccgaccctatcgacaacagacatgaagaccgccgacaaagtagagttaggcgatagcgatctgaagatcatgctgaagaagcaccatgagaagagaaagcatcagcccgatcatcccgacctgctgacaggagacctgacactgaatgacatcatgactcgcgttaacgccggacgaaaaggctccctggctgctctgtacgacctcgccgtgctgaaaaaaaaggtcaaggagaaagaggaaaagaagaagaagaaaattaaaacaattaaatccgaagcagaggatcttgctgagccattgtcttccactgagggagttgctcctctgagccaggcaccatcacctctcgcgattcccgcaattaaggaagagccacttgaagacctgaagccatgtctcggcataaacgaaatatctagttcgttctttagtctgttactggagatcctgctgcttgaatcacaggccagtctcccaatgctggaggaacgcgtgcttgactggcagagctcacccgcctccagtttgaacagctggtttagcgcggcccctaactgggcggaactggtgctcccagctctgcaatacctggccggagaatcgcgtgccgtgccatcctccttttctccattcgtcgagtttaaagagaaaacccagcaatggaagctgctggggcagagtcaggataatgagaaagagctggcagctttgtttcagttgtggctggagacgaaagaccaggccttctgcaaacaggagaatgaggatagcagcgatgccactaccccagtgcccagggtacgaacagattatgttgtgcgcccatcaacgggcgaagaaaagcgcgttttccaggagcaggagagatatagatactcccagccacacaaggcatttacattcaggatgcacgggtttgagagcgtggtaggccctgtgaaaggagtgttcgataaggagacctctcttaataaggcccgcgagcattctctccttcgaagcgatcggcctgcgtacgttaccatcctctcccttgtcagggacgctgctgcccgcctccccaatggtgaggggacgcgagctgagatctgcgagttactgaaagattcgcagttccttgcacccgacgtgacatcaactcaggtaaacactgtggtgagtggggcacttgaccgacttcattacgagaaggacccttgcgtgaaatacgacataggccggaagctgtggatatacttgcatagagaccgtagcgaagaagagtttgaaagaattcaccaggcgcaggctgcagccgccaaggccaggaaagctctacagcagaagcctaagcctccaagcaaggtgaagtcctcatcaaaggagtccagcatcaaagtgctctcatccggtccctccgaacagtctcagatgagcctgagcgactcctcaatgcccccgactccagtaacacctgtcacaccgaccacacccgctttgcccgctattcctattagcccaccacctgtcagcgccgttaataaaagcggcccgtctactgtttcggaacccgctaagagtagctccggcgtgctactcgtctccagccccacgatgccccacctgggcacaatgctgagcccggcctcgtcccagaccgcaccatcgtcacaggcagctgcgagagttgtgagtcactctggctctgccggcctgtcccaggtccgggtggtggcacagccttccctgcctgcggtgccccagcaaagcggtggtcccgcgcagacactcccccaaatgcccgctggcccgcagatccgcgtgccagctactgccacccagacgaaggtcgtaccccaaaccgtaatggccacagtgccggtgaaggcccagacaaccgctgcaactgttcagcgtccaggccctgggcagaccggactaaccgtgacctcccttcctgctaccgcgagccccgtctccaaacctgctacgtcgtcgccagggacatcagcaccttccgcttcaactgcagccgttatacagaatgtgactggccaaaacatcattaagcaagtcgctatcaccggtcaactaggggtcaaaccgcagactggcaattccattccccttaccgccacaaacttccgcattcagggtaaggacgtgctgcggctgccgcccagctctatcaccaccgatgctaagggccagacagttctgcgaatcactccagacatgatggcaacactcgctaaatcacaggttacaaccgttaaactgacccaagacctgtttgggactgggggaaacacaacaggaaaagggatcagcgctacactgcacgtgacgtccaaccctgttcacgcagcagattctcccgcgaaggcaagcagcgccagcgcaccatcgtccaccccgactgggactactgtcgttaaagtgacacccgaccttaagcctactgaggcttcttcatccgctttcaggctcatgcctgctctgggcgtgtccgtggctgatcagaagggcaagtccaccgtggcctcgtcggaggcaaaaccagcagcgactattagaattgttcagggactgggggtcatgccacccaaggccgggcagaccattaccgtggccactcacgctaagcaaggcgccagtgtggcctcgggatcaggaacagttcatacttcagcagtaagcctcccttccatgaacgccgccgtctctaaaacagtggctgttgccagcggagccgcctccactcccattagcatatcaactggagcccctaccgtgcggcaggtacccgtaagcacaacggtcgtatccacaagtcaagcggggaagctgccaacccggatcaccgtgccgctgagtgtgatatcccaaccaatgaaggggaagagcgtggtgacagccccaatcattaagggtaatctgggggcgaacttatcagggctagggcgaaacatcatcctgacgactatgcctgccggtactaaacttattgctgggaataagccagtttcctttttgaccgcacaacagctacagcagctccagcagcagggccaggccacccaagtgaggattcagaccgtgcccgcctcacacctgcagcagggcacagcctccggcagcagcaaagctgtgagtacggtcgtggtgactaccgcaccaagccccaaacaggcaccggaacaacagtag

SEQ ID NO: 197640 - DNA, 3900 bp, Artificial Sequence
  Description of Artificial Sequence: Synthetic coding sequence
atggacagcctggaccacatgctgaccgaccccctggagctgggcccctgcggagacggacacgggactaggataatggaggattgtctgctcggcggtacccgtgtcagtctcccagaggacctgttggaagacccggagatttttttcgatgtggtatcgctgagtacatggcaagaagtactatccgatagccaacgtgaacaccttcagcagtttctgccacagttccccgaagactctgccgagcagcagaacgagctgatcctggccctcttcagcggtgagaatttccgattcggtaaccctttgcatattgcccagaagctgtttcgtgacgggcacttcaatccggaagtggtgaagtacaggcagctgtgctttaagtcgcaatacaaacgctatttgaactcgcaacagcagtactttcataggctcctgaagcagattctggcaagcaggtcagacctcttggaaatggcacggagaagtgggcctgctctcccatttaggcagaagcggccatcaccctctaggacaccagaagagcgggagtggcggacccagcagcggtatctaaaagtgttgagagaagtcaaggaggaatgcggggatacggcactgtctagtgatgaagaggatttgagcagttggctccccagttccccagcccgaagccccagccccgcagtgcccttgcgtgtagtcccgacactgtctaccactgacatgaaaactgcagacaaagtagaactcggcgatagcgatctgaaaataatgcttaagaaacaccatgaaaaaagaaagcaccagccggatcatccggacctgctgaccggggatctgaccctaaacgatatcatgactcgcgtcaacgccggaaggaagggaagcctggccgccctctacgatctcgctgtgctgaagaaaaaagtcaaagagaaggaagaaaagaaaaagaaaaagattaaaaccattaagtccgaggccgaggatctggccgaacccctgtcctcgaccgagggagtcgcccccctgtcccaggccccctcacctctggccattcccgccatcaaagaagaacccctcgaagacttgaagccttgtctgggaatcaatgagatctccagtagctttttttcacttctgctggaaattctgctcctggaaagccaggcaagtctgcctatgctggaagagagggttctggattggcagagttcacccgctagctctttaaacagttggtttagcgccgctccgaactgggctgagctcgtgctgcccgcattgcaatatttggcaggcgaatcccgagccgttcccagttcttttagcccattcgttgagttcaaggaaaaaactcaacagtggaagctcctaggacagagccaggacaatgagaaggagctcgccgcactgttccagctgtggttggagacgaaagaccaagctttctgcaaacaggagaatgaggattcctcggacgccacgactcctgtgccccgggtgcgaactgattacgtcgtccgaccctccaccggagaagagaaacgagtttttcaagagcaggagcggtatcgctattctcagcctcataaagcgtttacattcagaatgcatgggttcgagtcggtggtgggccctgtcaaaggagtgtttgacaaggagacttctctcaataaggccagagaacactcactgttgcgctcagaccgccctgcctatgtgaccattctgtcattggtgcgcgatgcagccgcccgtctgccaaacggggagggtacccgcgcagaaatttgcgagctgctcaaggactcccaatttcttgctcccgatgtgacttccacacaggtcaataccgtggtgagtggggcccttgatcgactccattatgagaaggacccatgtgttaaatatgatattgggaggaaactgtggatctatcttcacagagaccggtccgaagaggagttcgagcgcatccatcaggcccaggcggccgccgctaaggcccgtaaggcgctccagcagaaacccaagccccccagtaaggtcaagtcgagctccaaggagtcatcaatcaaagtgctgtccagtgggccaagcgagcagagccagatgtcactgagcgacagctctatgccaccgaccccagtgacacccgtgacacccactacgcccgcgcttcctgccatccccatatctccgccccccgtgtctgccgtaaataaatccggtcctagcaccgtgtcagagcctgcaaagtcatccagcggagtccttttagtaagctccccgactatgccccacctcggtactatgctgagccccgctagctcgcagacagcaccgtcttcgcaggccgcggctcgggtcgttagccatagtggtagcgccggactgtctcaggtacgagtggtggcacagccgagcctgccggccgtgccacaacaaagcggcggacctgcacaaaccctaccacaaatgcccgcaggcccccagatacgtgtgccagctactgcaacccaaactaaagtggtgccccagactgtcatggcaaccgtgcctgtgaaggctcaaactaccgccgcaaccgtgcagagaccaggccccggccagacaggactaaccgttacctccttgccagccacagcgtccccggtgtccaaacctgccactagctcccccgggacgagcgctccttcagcctcaacagccgctgtgattcagaacgtaactggacagaacattatcaagcaagtggcaataacgggccagttgggcgttaaacctcaaactgggaactctatccctttgactgcaacaaactttagaatccaagggaaggatgtcttgcggctgccaccatcatcaatcactaccgatgccaagggtcaaaccgtgctgaggattacacctgacatgatggcaacactggcaaaaagccaggtgactacggtgaaactaacgcaggatctgtttggaacaggcgggaacaccaccggcaagggcatctccgctactctgcacgtgacttctaatcccgtgcacgccgctgactcacctgctaaggcgagtagtgcctcagccccaagctcaactcctactggcaccactgttgtaaaggtgaccccggaccttaagccgactgaggccagcagcagcgcctttcgtttaatgcccgcgctcggagtcagcgtggcggatcagaagggaaaatccacagtagcctcaagcgaagctaagcccgcagccaccatacgaatcgtgcaggggctcggcgtgatgcctcccaaagcaggccagactattacagtggcaacccacgccaagcagggcgcatcagtagcttcgggtagtgggacagtgcatacctccgccgtttccctgccgtccatgaatgctgctgtcagtaaaacagttgctgtggctagtggggctgcctcaacaccaattagtatatctaccggcgctccaaccgtccggcaggtacctgttagtactaccgtggtgagtaccagtcaggcaggcaaattaccaacacgtatcacagtgccgctgagcgttatttcacaacctatgaaaggaaaatcagtggttacggctccaattattaagggcaacttgggcgcaaacctgtccggcctgggacggaacatcattctgaccaccatgccggctggcacaaaacttatcgccgggaataagccagtgtcatttttgaccgcccagcagctgcagcagctgcagcagcagggccaggctacacaagtgcgcattcaaaccgtgcctgcctcccaccttcagcagggaactgcctctggctcaagtaaagccgtgtctactgtggtcgtgactactgctccctctcctaagcaggcaccagagcagcagtag

SEQ ID NO: 197641 - DNA, 3975 bp, Artificial Sequence
  Description of Artificial Sequence: Synthetic coding sequence
atgcacgtgttcgtgcagagcacctgcggcgaggagaccatggactcactagatcacatgctcactgacccgctcgagctaggcccatgcggcgacgggcacgggactagaataatggaagattgcctcctgggtggaacaagagtgagcctgcctgaggatttactggaagatccagagatcttctttgacgtcgtcagtctatccacttggcaagaggttctgtcagatagtcagagagaacatctgcaacagttcctaccacagttccccgaagactccgctgagcagcagaatgagctgatccttgcgttattctcaggggagaatttcaggttcggcaacccactccatatcgctcagaaactgtttagagacggtcatttcaatcctgaggttgtcaagtaccggcagctgtgctttaaatcccaatacaagaggtacctcaactctcaacagcaatacttccatcgcctgctcaagcaaatcctggcttcacgttctgaccttctggagatggccagacgtagcggacccgccctgccgttccggcagaagaggccatcaccctctcggacacccgaagagagggaatggaggacacaacaacggtacttgaaggtgctccgggaagtgaaagaggaatgcggtgatacagcgctgagcagcgacgaggaagccaccctcgatctccaggagcaattttcattcgaggacctgtcgagctggctaccaagctccccagcacggagtccctcgccggccgtcccattgagggtcgtcccaacactctctacaacggatatgaaaactgccgataaggtggaactgggggacagcgaccttaaaatcatgttgaagaagcaccacgagaaacgcaagcatcagcccgaccacccagacctcctgacgggagacctaactctcaatgatatcatgacaagggtgaatgcggggaggaaggggtcgttagcagcactttatgacttggccgtcctaaagaagaaggtcaaagaaaaagaggagaagaaaaaaaaaaaaataaaaaccataaaaagtgaggccgaggaccttgctgagccattaagttcaacagaaggagtcgcccctctttctcaggccccctctcctctggcgattcctgctattaaagaggagcctctggaggatctcaagccttgcctgggcatcaacgagatatcatcgtcttttttcagcctgcttttggagatactcctcttggaatcccaggcgagcctgcccatgctggaggagcgggttctggattggcagtcttccccagcgagcagcctaaacagttggttctccgccgctccaaactgggccgagctagtgttgcctgctctgcagtacctcgccggagagtcgagagccgtcccgtcatctttttccccctttgtggaattcaaggagaaaacccagcaatggaagttgcttggtcagtcccaggacaatgaaaaggagctcgctgcccttttccaactgtggctggagacaaaggaccaggccttttgcaaacaagagaacgaggatagcagcgacgctacgactccggtgcccagagtgcggacagactacgtggtgcgcccttccaccggcgaagaaaagcgagtattccaggaacaggagagatacaggtactcccagccccataaggccttcacctttcgtatgcatggctttgaatcagtggtaggaccagtgaagggcgtttttgacaaagagacatccctgaacaaagccagggagcattcccttctgcgctctgacagaccagcttacgtcaccatcctgtccctggtgcgcgatgcagccgcgcggcttccgaacggggaaggcacacgggccgaaatttgcgaactgctgaaagacagccagtttttagcccctgatgtaaccagtacccaagtaaataccgtggttagcggggctctcgatcgactccactacgagaaagacccgtgcgtaaagtatgatatcggaaggaagctatggatttatttgcaccgggacagatcggaagaggagtttgaacggatccatcaggcacaggccgccgctgctaaggcccggaaggctctgcagcagaaaccgaaacctccgagcaaagtcaaaagtagctcaaaggaatcaagcatcaaagtgctctccagcggcccatccgagcagagccagatgtcattatccgacagcagtatgccccctacgccggtgaccccagtaactcctactacacctgcgctaccagccatccctatcagccctcctccagtgtctgctgtgaacaaatccggccccagtactgtctccgaacctgccaaatccagttccggcgtgctcctggtgagttcccctacaatgccccacctggggaccatgctgagtcccgctagttcccagaccgcaccgtccagccaggccgctgccagagttgtgtcccatagcgggagcgctggactgtcacaggttcgagtggttgcacagccaagtctgccagccgtccctcagcagagtggcggaccagctcaaaccctgccccagatgcccgctggtccgcagatcagagtgccagcgaccgccacgcaaaccaaggtggtcccccaaactgtgatggcaaccgtgccagttaaggcgcagacaactgctgccacagtgcagaggcccgggccaggacagaccggccttactgtaacatccctgcccgcgactgcctcaccagtttctaagcctgcaacaagtagcccaggaacaagtgccccttccgcatctacggctgccgtcatccagaacgtcactggacagaatatcatcaaacaggttgctattactgggcagcttggtgtgaagccccagactggcaactcaatcccactcaccgcgaccaacttccgcatacagggcaaagacgtcctgaggctgcccccaagcagcatcacaacagacgctaaagggcagactgttttacggatcacccccgacatgatggctacattggcgaagtcccaggtcaccacagtaaagttaacacaagatctgttcggaacaggcggtaacaccaccggaaagggcatctcagccaccttgcacgtgacgtctaatcccgttcacgccgccgatagccctgcaaaggcctcaagcgcctctgccccatcttccactcccacaggcaccaccgtagtaaaggttactccagaccttaagccaacggaggcctccagttctgctttccgcctgatgcctgcccttggagtcagtgtagccgaccagaagggcaagagtacagttgctagctcggaggctaagcccgccgctaccatcagaattgtccagggattgggggtcatgcctccaaaggctggccagactattacagttgccacccatgctaaacagggagcttccgtcgcatctgggtctggcaccgtacatacgagtgccgtgtctctgcctagtatgaacgccgcagtctctaagacagtcgcagtggccagtggcgctgcctccacccctatttccatctctaccggagcccctacagtgcggcaggttcctgtgagcacaaccgtcgtaagcaccagccaagccggaaaattgcccacaaggatcaccgtgcctctcagtgtaatctcacaacccatgaagggaaaatccgttgttactgcgcccatcataaagggtaacctgggcgccaacctgagcgggttggggagaaacataattcttaccaccatgcctgccggtaccaagctcatcgcaggcaataagcccgtcagctttctgaccgcccaacaacttcagcagctccagcagcagggtcaggcaacccaggtgaggattcagaccgtccccgccagccacctgcagcaaggcacagcaagtggctcttcaaaggcagtgagcaccgtggtcgtcaccactgcaccttctcctaaacaggctccggagcagcagtag

SEQ ID NO: 197642 - DNA, 1389 bp, Artificial Sequence
  Description of Artificial Sequence: Synthetic coding sequence
atgcagctgcggaagatgcagaccgtgaagaaggagcaggccagcctggacgccagttctaacgtggataagatgatggtgctgaatagcgcattgaccgaggtgtctgaagacagcaccaccggggaggaactcttgttgtctgaaggtagtgtgggcaaaaacaaatcaagtgcttgtcggagaaagagggagttcatccctgatgagaagaaggacgctatgtactgggaaaagcggagaaagaacaatgaagctgcaaagcggagcagagagaagcgccgtctcaacgacttggtgctcgaaaataagctcatagcactcggagaggaaaacgctacattgaaagccgaacttttgagcttgaagctcaagttcggtctgattagcagtacggcttacgctcaggagatacagaagttgtctaattccacagcagtttatttccaggattatcagacttccaaatccaacgttagcagttttgtggacgagcacgagcccagtatggtctcatcctcctgtataagcgtaattaagcattctccacagtcaagcctgtctgatgtgtccgaggtctccagcgtagagcacacacaggagagctccgttcaaggatcctgtcggagccccgaaaacaagttccaaattattaaacaagagccaatggagctggagtcttacaccagggaaccaagagacgacagagggtcatacactgctagtatttatcagaactatatggggaattctttcagtgggtattcacactcgccaccccttctacaggtgaatcggagcagctctaacagcccccggacatccgaaactgatgacggcgtcgtggggaaaagtagcgacggcgaggacgagcagcaggtacccaagggtcctattcactcccctgttgagctgaaacacgtacacgcaactgtcgtgaaagtgccagaggtgaattcctctgcccttccccataagcttaggattaaggccaaggcaatgcaaattaaggtggaagccttcgacaatgagttcgaggccacccaaaagctaagttcccccatcgatatgacatccaagcgccacttcgagctcgagaagcactcagctccatccatggtccattctagtctgacgcctttctcggtccaggtaaccaacattcaggattggtccttgaaatctgaacactggcaccaaaaggagctgtctgggaagactcaaaattcgttcaaaacgggcgtagtggagatgaaagattctggctacaaggtgtccgatccggaaaatctctacttgaaacagggcatcgccaacctgtcggccgaggtcgttagcctgaaacgtctcatcgccacccagcctatttcggcctcagacagcgggtag

SEQ ID NO: 197643 - DNA, 1389 bp, Artificial Sequence
  Description of Artificial Sequence: Synthetic coding sequence
atgcagctgcggaagatgcagaccgtgaagaaggagcaggccagcctggatgcctcttcaaatgtcgataagatgatggtgctgaatagtgcccttaccgaggtcagtgaggacagtacgacgggggaagagctacttctgtctgaggggagtgtcgggaaaaataagagtagcgcttgtcgtaggaagcgcgagttcataccagacgaaaaaaaagatgccatgtattgggaaaaacgccggaaaaacaacgaagcggccaaaaggagccgcgaaaagcgccgcttaaacgacctagtgctggagaacaagctaatagcactcggagaagaaaacgctacccttaaggccgagctgctcagcctgaagttgaagttcggcctgatttctagtaccgcttacgcacaggagattcagaagctgagcaatagcactgcagtgtacttccaggactatcagaccagcaagtccaatgtgagctcattcgtcgacgagcacgaaccctctatggtgtcaagcagctgcatctctgtgataaagcactctcctcaaagcagcctgtccgacgttagtgaggtatcctcagtcgaacacacccaagaatcttccgtgcaaggatcttgccgaagcccagagaacaaattccagatcattaaacaagaaccaatggagcttgagtcttataccagggagccacgagacgacaggggttcctacactgccagcatatatcagaactacatgggaaactcgttctcaggatactcacattccccaccactgctccaggtgaatcggagtagctccaactcccccagaacgagtgagaccgacgatggcgtagtgggaaagtccagtgacggggaagacgagcaacaggtgcccaaaggccctatccactccccggtcgagttgaagcatgtccatgctactgtagtaaaggtgccagaagtgaacagctcagccctgcctcacaagcttcggattaaagcaaaggccatgcagattaaagttgaggccttcgataacgaattcgaagcgacccagaaactgagctccccgatcgacatgacatcgaagcgtcactttgaattggagaagcactccgcccctagcatggtgcactcctcactaactcccttttctgtgcaggtgactaacatccaagattggtcactgaaatcggaacactggcaccaaaaggagctttccggaaaaacacagaatagcttcaagacaggggtggtggaaatgaaggactccggttacaaggtgagcgaccctgagaacctctatctcaagcaaggaattgccaacttatcggccgaggtggttagtctgaagagactgattgcaactcagcctatcagcgctagcgactccggctag

SEQ ID NO: 197644 - DNA, 1488 bp, Artificial Sequence
  Description of Artificial Sequence: Synthetic coding sequence
atggccgagcccaccagcgacttcgagacccccatcggctggcacgcctccccagagcttacacctaccttaggccctttgtctgatactgcaccacccagagattcttggatgttctgggctatgctacccccacccccccccccactgactagttctctgccggccgcaggaagcaaaccaagctcagagagccagcctcccatggaggcacagtcactccccggggctccacctcctttcgacgcccagattctgcccggggcacagccccccttcgatgcacagtccccactggattcccagccccagccatccggtcagccctggaacttccacgctagtacctcttggtattggcgacagagctctgatcgtttcccccgtcaccagaaatcttttaacccggcagtcaaaaatagctactatccaaggaagtacgacgccaagtttactgatttctccctaccaccctctcgtaaacagaagaaaaaaaaaagaaaggaacccgtcttccatttcttctgtgacacatgtgacagggggttcaaaaaccaagaaaagtacgacaagcacatgagcgaacatactaaatgtcccgaactggattgctcattcaccgcacatgaaaagatcgtgcagttccactggcgcaatatgcacgccccgggaatgaagaagatcaaacttgatactcccgaagaaatagcccgatggcgggaggaacggcgcaagaactaccccactctcgccaatatcgaaagaaagaagaaactcaagctggaaaaagagaaacggggggcggttctgaccactacgcaatatggtaaaatgaaagggatgagcaggcattctcaaatggccaagatcaggagtcctggaaagaatcacaagtggaaaaacgacaattcccgtcaacgagcggtgaccggaagcggatctcatttatgtgacctaaagctggaggggcctccagaagccaacgccgacccgctgggagtcctgataaactctgactcggagagtgacaaggaggaaaaacctcagcactctgtgattcccaaggaagtaaccccagccctgtgctcactcatgtcttcctacggatctctttctggatccgaatcggagcctgaggagactcctattaagaccgaggctgacgtcctggctgagaaccaggtcctagacagctccgcccccaagtctccaagccaagacgtcaaggctactgtgcggaactttagtgaggcaaaatctgagaatagaaaaaagtcttttgaaaagacaaatccaaagagaaagaaggactaccacaattatcagaccctcttcgaaccaaggacccaccacccttaccttctggagatgcttctggcacctgatatcagacatgagcgaaacgttatactgcagtgtgtgcgctacatcatcaagaaggatttctttgggttggatactaatagcgcgaagagcaaagatgtgtag

SEQ ID NO: 197645 - DNA, 648 bp, Artificial Sequence
  Description of Artificial Sequence: Synthetic coding sequence
atggagacccaggccgagcagcaggagctggagaccctgcccaccactaagatggcccagacgaacccgactcctggcagtttgggcccatggaaaatcactatctacgatcaggaaaatttccagggcaagaggatggaattcacatcgtcctgtccaaatgtgtctgagcgttctttcgacaatgttaggagcctgaaggtggaaagcggcgcttggatcggttatgaacatacctcgttctgtggccaacagttcattctcgaacgcggcgaatacccccgatgggatgcttggtccgggagcaatgcttaccatatcgagcgactgatgtcgttcaggcctatttgcagcgccaatcacaaagagtcaaagatgactatttttgagaaggagaatttcatcggacgccagtgggagatcagcgatgattaccctagcctgcaggcgatgggctggtttaacaatgaggtcggaagtatgaagatccagtcaggcgcatgggtatgctaccaatatcctggctatagaggttaccagtatattctggaatgtgaccatcatggaggcgattacaaacattggcgagagtggggctctcatgcccaaacttcccaaattcagtccatccgccgaatccagcagtag

SEQ ID NO: 197646 - DNA, 2940 bp, Artificial Sequence
  Description of Artificial Sequence: Synthetic coding sequence
atgaccctgcacgccacccggggcgccgccctgctgagctgggtgaacagtctccatgttgcagatcccgtcgaggccgttctgcagctacaagattgctccatattcatcaaaattatcgatcgcattcatggtactgaggagggccagcaaatcctaaagcaacctgtcagcgaaaggcttgatttcgtgtgttcgttcctccagaaaaatcgcaaacacccttcaagcccagaatgcctcgtgtctgcacagaaagtgctggagggaagcgagctggaacttgctaagatgactatgctccttctataccactcaactatgtcctccaagtcaccgcgagattgggaacagttcgagtacaagatacaagccgagctggccgtcatactcaagttcgtattggatcacgaagacggcctgaatcttaatgaagatctggagaattttctgcagaaagcccctgtgccatccacatgcagctcaaccttcccagaggagttgagcccaccaagtcaccaagcgaagagagagataaggtttctagaactgcagaaggttgccagttccagctccggcaacaacttcttgagcggatctcccgctagtcctatgggggatatcctgcagacccctcagtttcaaatgaggagactgaagaaacaactggccgacgaaagatcaaatcgagatgaacttgagctggaactagccgagaacagaaagctgttgactgagaaagatgcacagatcgctatgatgcagcagcggattgaccggcttgccttgctgaacgaaaaacaggctgccagtcccctcgaaccgaaggaattggaggaactgagggacaagaatgagagtctgaccatgcgcttgcacgaaactcttaagcaatgtcaggacctgaagaccgagaaatctcagatggacaggaagatcaaccagttaagcgaggaaaacggtgacctctctttcaagcttcgcgaattcgcttcacacctccaacagctgcaggatgcactgaacgagctgaccgaggaacactccaaagctacccaggagtggctagaaaaacaggcgcagttggaaaaagaattatctgctgccttgcaggacaagaaatgtctcgaagaaaagaacgaaatactgcaggggaagttgagtcagttggaggagcacctgtcacagcttcaggacaatccacctcaggagaaaggggaggtattaggtgatgtcctacaggtggaagagctctccaagaaactcgccgactcagaccaggcatccaaggttcagcaacagaaactgaaagcagtgcaggcccagggaggtgagtcacagcaggaggcacagcggctgcaggcccagctcaacgaacttcaagcccagctgagccagaaggaacaagctgccgagcactataagctccagatggaaaaggctaagacacactacgacgctaagaagcaacagaaccaggaactacaggaacagctgagatccctggagcagttacagaaggagaacaaggaacttagagcagaggccgagaggctggggcacgaacttcagcaggcagggctgaaaactaaggaagcagaacagacatgcaggcacttaacagcccaggtaagatctctcgaagcccaggtggcccatgccgaccagcagctgagggatctagggaagtttcaagtcgctaccgatgccctgaaatcacgggagcctcaagccaagccccagttggatttatccatcgattcacttgatctctcttgcgaagaagggactcctctctcaataacttccaagctgccacggacccagcccgatgggacgagcgtacccggtgaacccgctagccccattagtcagcggttgcctccaaaagtggaatctctcgagagcctctatttcacccctatcccagctcgcagccaggccccactggaatcttccctggacagcctcggcgacgttttcctcgacagtgggagaaaaacacgcagtgctcgaaggcgaaccacacaaattataaatatcactatgactaagaagctcgatgtggaagaacctgacagtgcgaactcctccttctactcgacacgtagcgcccctgcgtcccaggccagccttcgggcaacaagttctacccaaagtctcgccagacttggctcacctgattacggcaatagtgcgctgctgtcccttcctggatacaggcctacaacccgctcaagtgctcggagaagtcaggccggcgttagcagtggggctcccccagggcgaaactccttctacatggggacctgtcaagacgagcctgaacagctggacgactggaatcggatagcagagctccagcagcgaaacagagtatgccccccacacctgaagacttgctaccctcttgagagtcggccttcgcttagcctgggaactatcacagacgaggaaatgaaaactggagatcctcaggaaaccctgagacgggcctccatgcagcccatacagatagctgagggcactgggattacgaccaggcaacagcgaaaacgcgtctctctcgagcctcaccagggaccaggaaccccagaaagcaaaaaggccacttcttgctttccacgcccaatgacgccgagagataggcatgagggccgtaagcagtcaaccacagaagctcaaaaaaaagccgccccagcatccaccaaacaggcagatcgacggcagtcaatggccttttcaatcctcaacactcccaaaaagctgggaaactctctgcttcgtcgtggagcgtccaaaaaagccttgtcaaaggctagccccaatacacgatctggaacgcggcgtagtcccaggatcgcgaccaccacagcctccgccgctacagccgcggcgatcggcgctacgcctcgtgccaagggtaaagccaaacactag

SEQ ID NO: 197647 - DNA, 6306 bp, Artificial Sequence
  Description of Artificial Sequence: Synthetic coding sequence
atgaccctgcacgccacccggggcgccgccctgctgagctgggtgaattctctacatgtcgctgacccagtggaggctgtcctccaactgcaggattgctcaatcttcataaagattatagaccggatccacggcaccgaggaaggtcagcaaatattaaagcagcctgtttcagaaaggctggattttgtgtgctcatttctacagaagaataggaagcacccgagcagccctgagtgtctggtgtccgcgcagaaggtcctcgaaggctccgaactggaacttgctaagatgaccatgctccttctgtaccacagcactatgagtagcaagtcccctagggactgggagcaattcgaatataagatacaggcggagctggccgtcattctgaagttcgtgttggatcatgaggacggacttaatctaaacgaagacctggaaaatttcctacagaaggccccagtccctagtacatgctctagcaccttcccagaggagctctctcccccaagccaccaggccaaacgtgagattagattcctcgaactacaaaaggtggcctcctccagcagcggaaataatttcctaagcggatcacccgcttctcccatgggtgacatcctgcagacccctcagtttcagatgcgccggctgaagaagcagttagctgacgagaggtctaaccgcgacgaactggaactcgaactagctgagaataggaagttgctcactgagaaagatgcacaaatcgcaatgatgcagcaacgaatcgataggctcgcattgctcaacgagaagcaggcagccagcccactggagcccaaggagcttgaggagctgagagataagaatgaaagtcttacaatgaggctacacgaaaccctgaagcagtgtcaagaccttaagaccgagaaaagccagatggatcgaaaaatcaaccaactctctgaggagaacggggacctctcctttaaactcagggagtttgcgtcccatctgcagcagctacaggatgcactgaatgaattaacagaagaacatagcaaagccactcaggagtggctcgaaaaacaggcccagctggaaaaggagttgtctgccgcactccaggacaaaaagtgtcttgaagagaaaaacgaaatcttgcaggggaagcttagtcagcttgaagaacatctgtctcagttgcaggataacccaccacaagagaagggtgaagtgctgggtgacgttttgcagcttgagacactgaagcaggaggctgcaaccctggccgccaacaatacccagcttcaggccagagtggagatgttggaaaccgagcgcgggcaacaagaagctaaactgctggctgagcgcggccacttcgaggaggaaaagcagcagttatcttccctaattacagacctacagtcttccatctccaacctttcccaggctaaggaagaactggagcaggcttctcaggcacatggggcacgcctgactgcccaggtcgcctctctgacttcagagctgacaacattgaacgctaccattcagcagcaggatcaggaactggccggcttaaagcagcaggcgaaagagaagcaggcccagctggcccagaccctgcagcagcaggagcaggcctcccagggcctacgccatcaggtggagcaactgagctctagcctgaagcagaaggaacagcagttgaaagaggttgccgagaagcaagaggccacaaggcaagaccacgcgcagcagctggcgactgccgcagaggaaagagaggctagcttgcgtgagagagatgcggctttgaaacagttggaagcgctggagaaagagaaggctgctaagctggagatcctgcagcagcagcttcaggtggctaatgaggcgcgagacagtgcacagactagcgtaactcaagctcagagagagaaggccgagctctctcgcaaagtggaggagcttcaggcctgcgtcgaaaccgcccgtcaagaacaacatgaagcacaggcccaggttgctgagttggagctacagctccggtccgagcaacagaaagccaccgagaaggagagggtggctcaagagaaggaccagttacaggaacagttgcaagcactgaaggagagtctgaaagttaccaaaggttcactggaggaggagaaacggcgcgccgcagacgcactcgaggaacagcagagatgtatcagtgaactcaaggctgaaacgagaagcctggtggaacagcacaagcgtgagaggaaggagctcgaggaagagcgggccggtcgaaagggcctcgaggctagattgcagcagttgggtgaagcccaccaggcggaaacagaagtcctccgaagggaactggctgaagctatggccgctcagcatactgccgagtccgagtgtgagcagctcgtgaaagaagttgccgcctggcgggagcgctacgaagacagtcagcaggaggaagcacagtatggggcaatgtttcaagaacagcttatgacgctgaaggaagaatgcgagaaggcacgccaggaactgcaggaagcgaaggaaaaagtcgctggcattgaatcacattccgaattgcagatctctaggcagcagaacgaactggccgagctccatgcgaatctggcccgggccctgcaacaggtgcaggagaaggaggtccgagcccagaagttagcggatgatctcagtacactgcaggagaagatggccgctacatcgaaggaagtggcccgcctggagacgcttgtgcgaaaggccggagaacaacaggagaccgcaagccgggaattagtgaaggagccggcccgggccggggatcgccagcccgagtggttggaagagcaacagggtagacagttttgcagcacccaggccgcccttcaggccatggaacgggaagccgagcaaatgggcaacgagctggaacggctgcgagctgcgctcatggaaagtcagggacagcagcaggaagaacgtggtcagcaagagagagaggttgctaggctcacccaagagagagggcgggctcaggccgacctggcactagagaaggccgcacgggccgagctggagatgcgcctgcagaacgccctgaatgaacagagagtcgagtttgcgacactgcaggaagcattggcccacgcccttacggagaaggagggcaaggatcaggagctcgcgaagctgagggggctggaagcggctcagatcaaagaattagaggagctccggcagaccgttaagcagctgaaggaacagctggctaagaaagagaaagagcatgccagtggtagtggggcccagagcgaagcagccggccgaaccgagccgactggtcctaaactggaagcccttcgggctgaagtcagtaagctggaacaacagtgtcaaaaacagcaggaacaggctgattcgcttgagcgcagcctcgaggccgagcgggcatcccgagccgaacgtgattccgctctcgagacactccagggccagctggaagagaaagcgcaggagcttggacactcacagagcgctctggcctcagctcagcgggagctggccgcctttcgaacaaaggtgcaggaccactcaaaggctgaagatgagtggaaggcacaggtggcgagggggagacaggaagcagagagaaaaaactctctgattagctctctcgaggaggaagtcagtatcctgaatcgacaggtgctggaaaaagaaggagagagcaaagagctgaagcgactggtgatggccgagtctgaaaaatcgcagaagttggaggaaagacttcggctcctgcaggcagaaacagcctcgaactccgcgagggctgctgagcggtcttccgccctgcgggaagaagtgcaaagcttgcgggaggaggccgagaagcagagagtggcatccgaaaatcttaggcaagaactcacttcgcaggctgaacgcgctgaagaactgggacaggaattaaaggcttggcaggaaaaatttttccaaaaggagcaggcccttagtactctacagctggagcacacctccacccaagccctggtcagcgagttgctgcctgcaaaacacttgtgtcagcagctgcaggctgaacaggccgcggctgagaaaagacatagggaagagcttgagcaaagtaagcaggccgccgggggtctgcgagccgaattactccgggctcagcgagagctgggggagttgatccccctacggcaaaaggttgccgagcaggagagaacagcccagcagctgcgggctgaaaaggccagttacgcggaacagcttagtatgctgaagaaagcccacggactgcttgcagaggaaaacagggggctgggcgagcgggccaacttgggccgccagttcctggaggtggagctcgatcaggcccgggagaagtacgtgcaggaactggcggccgtccgggccgacgctgaaacaagacttgctgaggtgcagagggaggcacagtccaccgcacgtgagcttgaggtgatgacagccaaatacgagggtgcaaaagtcaaagtgctggaagagagacagcgcttccaggaggaacgccagaagttgaccgcacaggtagaagagctctctaaaaaactcgctgattccgaccaggcttctaaagtgcagcagcagaagcttaaggccgtgcaggcccagggcggagaatctcagcaggaagctcaacggcttcaggcacagctgaacgaattacaagctcagttgtcccagaaggaacaggccgccgaacactacaaactccagatggaaaaagccaaaactcattacgacgctaaaaaacaacagaaccaggagctgcaggaacagttgcgctctctggagcagctgcaaaaagaaaataaggagttaagggctgaagctgagagactcggtcatgaactgcagcaagccgggctgaaaaccaaagaagctgagcagacatgcaggcacctgactgctcaggtacgctcactggaggcgcaagtcgcccacgcagaccagcagttgcgtgacctgggcaagtttcaagtcgcaactgatgctctgaaatctagagagccccaggctaaaccccaacttgacctatccatcgactctttggatctttcctgcgaggagggaaccccactgagtattacctcaaaactcccccggacccagcctgacggtacctccgtccctggagagcccgcatctcccatttcccagcgcctgccccccaaggtcgagagcctcgagtccttgtatttcaccccaatccccgctagatcacaggcccccttagaaagcagcttagactccttgggagacgtgtttttagatagcgggcgtaaaacgaggagtgcccggagaaggacgacacagattatcaacattactatgacaaagaaacttgacgtggaagaaccagacagcgccaatagctccttctattcaactcggtcggctccagctagccaagcgagccttagagccacctcaagcacccagagcctggcacgtctggggagtcccgactacggaaactctgccctgctgagcctaccaggttatcgccccaccacgagatcttctgctcggcggtcgcaggcaggggtgtcttcaggggcacctcctggaaggaattctttctatatgggcacatgtcaggacgagcccgaacagctggatgactggaacaggattgcagagctgcagcagagaaacagggtgtgccctcctcatttaaaaacatgctacccacttgagtctaggccatctctctcattgggaacgatcactgatgaagaaatgaagacaggggatcctcaggaaaccctgcgcagggcctctatgcagcccattcagatcgcggaaggcaccggaattaccacccggcagcagagaaagagggtgagcctagagccccatcagggcccagggaccccagagtcaaaaaaggctacgtcttgtttcccaagacccatgacccctagagatcgacacgaagggaggaagcagtccacaaccgaggcgcagaagaaggcggcccccgcaagcacaaagcaggctgataggcggcagagcatggcattttcgatcttgaatacacctaagaagctgggaaactcactgttgaggagaggagcctcaaaaaaagctttgtccaaggccagtccaaatacaaggtcagggacgagacgcagcccgcgcattgccactaccaccgccagcgctgccacagctgccgccataggggcaacgcccagagctaaaggaaaggccaaacactag

SEQ ID NO: 197648 - DNA, 4995 bp, Artificial Sequence
  Description of Artificial Sequence: Synthetic coding sequence
atgctggagaccgagcggggccagcaggaggccaagctgctggccgaacggggacactttgaggaggagaagcagcagttgagcagtctcatcaccgatctgcagtctagcatttctaatttatctcaggctaaggaagaactggagcaggcaagccaggcacatggggctaggcttaccgcccaagtggcaagcctgacatcggaactgactaccctcaatgccaccatccagcagcaggaccaggagctggccggcctgaagcaacaggccaaggaaaagcaggcccaactcgcccaaactctgcagcagcaggagcaggccagccaggggcttagacaccaagtagaacagttgtcaagtagtcttaagcagaaggagcagcagctgaaagaggtagccgagaagcaagaggcgactagacaggaccacgctcagcagttagcaaccgccgctgaagagagggaggcgtcgctgcgtgaacgtgatgccgccctgaagcaacttgaagcacttgagaaagagaaagccgctaaactagagatcctgcagcaacagctccaagtagccaatgaggcaagagactctgcccagacctcagtgactcaggcccagagggaaaaggccgaactctctcgaaaggttgaagagctccaggcctgtgtggaaactgccaggcaggagcagcacgaggcacaggctcaggtcgccgagcttgagttacaacttagatcagaacagcaaaaggccacagaaaaggaacgggtcgcccaggaaaaggaccaactccaggaacagctacaggcactaaaagagtcactgaaggtaactaaaggctcattggaagaggagaagcggagggctgctgatgccctggaggagcaacagaggtgtatcagtgaactgaaagcggaaactagaagcctagttgaacagcataaacgcgagcggaaagaactggaggaggagcgggcagggagaaagggcctcgaggccagactccaacagttgggagaggcccaccaggcagaaacagaggtgcttcgccgggaactagctgaggctatggctgcccagcataccgccgaatccgaatgcgaacagttggttaaggaggtggccgcgtggcgcgaacggtatgaggatagtcagcaggaggaggctcaatatggcgcaatgtttcaggaacagctcatgacacttaaggaggagtgcgagaaggcgagacaagagctgcaggaggcaaaagaaaaggtagctggcatcgaatcgcattccgagctacagatcagcaggcaacagaatgagctggctgagctgcacgctaacttagctcgagcacttcaacaggtacaagagaaagaagtgagggctcagaaattggctgatgatctcagcacactgcaggaaaaaatggccgccacctccaaggaagtcgccagacttgaaaccctggtgcgcaaggcgggggagcagcaagaaaccgcttctagggagctggtcaaagaacctgctagagccggggatcgccagcctgaatggctggaagagcagcaggggaggcagttctgcagcactcaggcggccctgcaggccatggagagagaggctgaacagatgggtaacgagctcgagcgccttagagcagcgttaatggaatcacagggtcagcagcaggaggagcgtgggcagcaggagcgagaggtggctcgactcacccaggagagaggcagagcacaggctgatctggccctcgagaaggcagccagggctgagttggagatgcgcctgcagaacgccctgaacgagcagagggtggaattcgccaccctgcaggaggctcttgcacatgccctgactgagaaagagggcaaggatcaggagctagccaaacttcgcggattggaagccgcccagattaaggagctcgaggaactacgccagactgtgaaacaactaaaagagcagctggccaagaaagagaaggaacatgccagcggctctggcgcacagtcagaggccgcaggccgcactgaaccgacgggacctaagctcgaagcgctgcgagcggaggtctctaaactggaacagcagtgtcagaaacaacaggaacaggcagattctctggagcggagtctggaggcagaaagggccagtcgagccgagcgggacagcgcacttgaaaccctccagggccagctggaagagaaagcccaggagttgggtcattcccagtctgccctggccagcgcccagcgagagctggctgcctttagaacgaaggtacaggaccattctaaagcagaagacgaatggaaagcccaggtggcccgagggcgacaggaggctgagcgtaagaactccctcattagttcactcgaggaagaggtctcaatactgaaccgccaggtgcttgagaaagagggcgagtccaaagaactgaaaagactcgtgatggccgaaagcgagaaaagtcagaagctggaggagaggcttcgcctgctgcaagctgagaccgcctcaaattccgctagggctgcagagagatcgagtgcgctgagagaggaagttcagagtttgagagaggaggccgagaagcagagagtggcttctgagaacttgcggcaagaattgaccagccaagccgagcgcgcagaggagcttgggcaggagctgaaagcctggcaggagaaattcttccagaaagaacaggctttgagcaccctgcagctggagcacacaagcacccaagcactcgtctccgaattgcttccagctaaacatctgtgtcagcagctacaggcagagcaggctgcagctgagaagaggcaccgcgaagagttagagcagagtaaacaggctgcaggggggcttcgggccgaactcctaagggcccagagggaattaggggaattaatcccattaaggcagaaagtggccgagcaggagcgcacagcccagcaacttagagctgaaaaggcgtcatatgctgagcaactgtcaatgttgaaaaaagcgcatggcctcctcgccgaagaaaatagaggccttggcgaaagggctaaccttggacgtcaatttctcgaggttgagttagaccaagcaagagaaaagtatgtgcaggagcttgctgcagtccgcgcagatgccgaaactaggctcgccgaagttcaacgggaagcccagtctaccgcaagagagctggaagtcatgaccgcgaaatacgagggcgcaaaggtcaaagtactggaggaaaggcagagattccaggaagagagacagaagctcacagcacaggtggaagagctgtccaagaaactcgctgactctgatcaagccagtaaggtccagcagcagaaactgaaggcagtgcaagctcaaggcggtgagagtcaacaggaggcgcaacggttacaggcccagctcaatgagttgcaggcacaactttcacaaaaggagcaagccgcagagcactacaagctgcagatggagaaggccaaaactcattacgacgccaagaagcaacagaaccaggaattgcaggagcaattacgctccctggagcaacttcagaaagagaacaaggaactcagagcggaagctgagagacttgggcatgagcttcagcaggcgggactgaaaaccaaggaagccgagcagacctgtcggcacttgaccgctcaagtaagatccctcgaagcacaagttgcacacgctgaccagcagctgcgcgacttaggcaagttccaggtcgccactgatgccctgaaatcccgcgaaccccaagctaagccacagctcgatctgagcattgacagcctggatctgtcttgcgaggagggtacccctctctccataacttccaagttaccgcggacccaacctgacgggacatccgtccccggggagccggcttccccaatcagccagagactgccgcctaaggttgaaagcctcgaaagtctttacttcactccaatcccggcccggtcccaggcgccgcttgagtcttctcttgactccctgggcgacgtgtttctggattccggacgcaagactcgtagtgctagaaggcgaaccacacaaatcattaatatcacaatgactaagaagctggacgtggaagaacctgactcagctaactcttccttttactccacgcggagcgctcctgcaagccaggcaagtcttagggcaacatcttccactcagtctctggcaaggctgggctcgcctgattacggtaatagcgccttgctttcactccccgggtaccggccaactacgcgctcctccgctcgccgttctcaggccggagtctcctccggagcacctccaggccggaacagtttctacatggggacctgtcaggatgaaccggagcagctggacgactggaacaggatcgctgaactgcaacagcgtaaccgagtctgtcctccccatttgaagacctgctaccctctcgaatccagaccatcgctctcgctgggaactataactgatgaagaaatgaagactggggacccccaagaaaccctgagacgagcaagcatgcagcctattcagatcgccgaaggaactgggatcaccactagacaacagagaaaaagagtatccctggaaccacaccagggcccagggacaccagagagcaagaaagccacgtcgtgttttcccagaccaatgactcctcgcgatcgccacgaggggaggaagcagtctacgaccgaagcccagaaaaaggctgctcccgcaagtacaaagcaggcagacagacgacagtcaatggccttcagtatattgaacacccctaagaagctggggaactccctcctgcggcgcggagcttcgaagaaagctcttagtaaggccagtcctaatacacgctcgggcacaagacgatcccctcgtatagcaaccacgaccgcatcggctgccaccgccgccgctattggggccaccccaagagcaaagggcaaggcgaagcactag

SEQ ID NO: 197649 - DNA, 228 bp, Artificial Sequence
  Description of Artificial Sequence: Synthetic coding sequence
atgaccctgcacgccacccggggcgccgccctgctgagctgggtgaatagcctccatgtcgctgacccagtcgaggccgtgttacagctgcaggactgtagcatcttcatcaagattattgatcgcattcacggtacagaagagggccagcagatcctgaaacagcccgtgtcggaacgcctggatttcgtctgttcgttcttgcaaaaaaataggaaacacccctag

SEQ ID NO: 197650 - DNA, 276 bp, Artificial Sequence
  Description of Artificial Sequence: Synthetic coding sequence
atgaccctgcacgccacccggggcgccgccctgctgagctgggtgaacagcctacacgtcgccgaccctgtggaggctgtgttgcaattacaggactgtagcattttcattaaaataatcgaccggatccacggcactgaggaggggcagcagattttaaaacagcccgtcagtgagcgcctagacttcgtttgctcctttttacagaagaatcggaaacacccgtcttctcccgagtgtttggtgtccgcacagaaggtgttggagggtagttag

SEQ ID NO: 197651 - DNA, 6348 bp, Artificial Sequence
  Description of Artificial Sequence: Synthetic coding sequence
atgaccctgcacgccacccggggcgccgccctgctgagctgggtgaacagcctccacgtcgcagatcccgtggaggcggtgctccaactgcaggactgttccattttcattaaaatcatcgatagaattcatggtaccgaagaggggcagcagatactaaagcagccggtatcagaacggctggactttgtctgtagctttctccagaagaaccgtaaacacccatcatctccagagtgcctggtctctgcacagaaagtgctagagggcagtgagcttgaactcgctaaaatgacaatgctgctgctctatcattctactatgagctctaagagcccacgcgactgggagcagttcgagtacaagatccaggctgagcttgctgtcatactgaagtttgtgctggatcatgaagatggccttaatctcaacgaagacctcgaaaactttctacagaaagcacccgtaccttcgacatgctccagtacctttcccgaagagctgagtccgccctctcatcaagcaaagagggaaatacggttccttgaattacagaaagtcgcaagctcgagctccggcaacaatttcctgtccggctctccagcttcacctatgggcgacattctgcaaacacctcagttccagatgaggcgtctaaagaagcaactggctgacgaacgctcaaatagggacgaactcgagcttgagctcgcggagaatcggaagctcctgactgaaaaggacgcacagatcgccatgatgcagcagcgaatagatcgtttagctcttctcaatgaaaaacaggcagccagtcccctggaaccaaaggagctcgaggagctgcgggacaaaaatgagtctttgactatgcgacttcacgaaacactgaagcagtgtcaggacttaaaaacggagaagagccagatggaccgtaagatcaatcagttaagcgaggagaacggcgatctctccttcaagttacgggagttcgcttctcatttgcagcagttacaggatgctctgaatgagctcacggaagaacattcgaaggctacacaggaatggctggaaaagcaagctcagctcgagaaagagctatccgccgcactgcaggataagaagtgcctggaagagaaaaacgaaatactgcagggcaaactttcacaactcgaagagcacttatcacagttacaagataaccccccacaggagaagggagaagtgctcggagacgttctgcaattagagacgctgaaacaggaggcagctacgctcgccgccaataatactcagctgcaggccagagtggagatgttggaaacagaacgcggacagcaggaggccaaactcctggccgaacggggtcactttgaggaggagaagcaacagctctcttccttaattacggatctccagtcaagtatcagtaacctatcccaggccaaggaagagttagagcaagcaagccaggcacacggcgctcggcttactgctcaggtggcatctctgactagtgagcttactacactcaacgcaacaattcagcaacaggatcaggagctcgcaggcctgaagcagcaggctaaggaaaaacaggctcaactggcccaaacactgcaacagcaggaacaggccagccagggtttgcgccaccaagtagagcagctcagtagctcactaaaacagaaagaacaacagcttaaagaagtggctgaaaaacaggaagctaccagacaggatcatgctcaacagctggctacagctgccgaggagcgtgaggcatccctgagagaacgtgatgccgccctaaagcagctcgaagccctcgagaaagaaaaagcagccaagctggagattcttcagcagcagctccaggtcgcaaacgaagccagagacagcgcccagacctctgtgacccaggcgcagagagagaaggctgagcttagcagaaaggttgaagaacttcaggcttgcgttgagactgcaaggcaggaacaacacgaagctcaagcgcaggttgccgaactggaacttcagctgaggtccgagcagcagaaggccaccgagaaggagagagtcgctcaagagaaggatcagctgcaagagcagcttcaggcgctgaaagagtcactgaaagtcactaaaggctcgctagaggaggaaaaaagaagagctgcagatgcattagaagaacaacaacgatgcatctccgagctgaaggcggagacccgatcacttgtcgaacagcacaaaagggagcgtaaagaacttgaagaggaaagggccggccgtaaaggtctcgaagctcggctgcagcagctgggggaggctcaccaagcagaaaccgaagtcctgagaagagagctagccgaggctatggccgcacagcacaccgctgagagtgaatgtgagcagctggtcaaggaagtagccgcttggcgggaacgttacgaggactctcaacaggaagaagcccagtacggcgcgatgtttcaggaacagctcatgactctgaaagaagagtgcgagaaagccaggcaggaactgcaggaagccaaagagaaggtggcaggtatcgaaagccattctgaactgcaaatttcacgacagcaaaacgaactagcagagctacatgcaaacctcgcgcgggccttgcagcaggtccaggaaaaggaggtcagggcccagaaactcgcagacgatctgagcacccttcaggagaagatggcagctacgtccaaagaagtggctcgcctggagaccctggtgcggaaggcgggggaacaacaagagaccgccagcagggagctcgtaaaagaacccgcccgagccggtgacagacagcccgagtggctggaggagcagcagggtagacagttctgtagcacccaagccgctctgcaggctatggagagggaagctgaacagatggggaatgagctggaaagactcagggcagccctgatggaaagtcagggtcagcagcaggaggaacgtggccagcaggagcgagaggtagccagacttactcaggagaggggtcgcgcacaggcggacctggctcttgagaaggcagctagagctgagctggaaatgcgtttgcaaaacgccctcaatgaacagcgtgtcgaattcgccacactacaggaggcactcgcccacgcgctgactgagaaagaaggtaaggaccaagaattggccaaactgcgagggctggaagctgcccaaatcaaggagttggaagagctgaggcagactgtgaagcaactgaaagaacagttggcaaagaaagagaaagagcatgctagcggttccggggctcagtctgaggcagctggccgcaccgagccaacggggccaaagctggaggcactgagggctgaggtgtcgaaacttgaacagcagtgccagaaacaacaggaacaagccgactccctggagcggtctttggaagctgaacgggcgtcaagagcggaaagagactctgccctggagaccctccaaggacaacttgaggagaaagcccaagagcttggtcactcacagtctgctttggcctccgcccagcgcgagctggccgcctttcggacaaaagtgcaggaccactctaaagcggaggatgagtggaaggcacaggtagctcgaggcagacaagaagcggagaggaagaactctctcataagctccctggaggaggaagtgagtatcctcaaccgccaggttctcgagaaagagggtgagagcaaagagcttaagaggcttgtgatggccgaatctgaaaagtcccagaagctggaggagcggctgaggttgttacaggcggaaaccgctagcaacagcgcccgtgctgcagagcgttcctcggccctgcgcgaggaagtgcaaagccttcgcgaggaagcggaaaaacaacgagtggcctccgaaaatttgagacaggagcttaccagccaggctgagagagcggaagagcttgggcaagaactgaaagcatggcaagagaaattcttccagaaggagcaggctctttccacactgcaactggagcataccagcacacaggccctcgtgagcgagctgctccctgccaagcacctttgccagcagttacaggccgagcaggcggcggcagagaaacgccacagagaggaactggagcagagtaagcaggcagcaggcggtctaagggctgaattactccgtgcccaaagagagctcggagagttgatcccattgcggcagaaagtggccgagcaggagcggaccgctcagcagcttcgcgctgaaaaagccagctatgctgagcagcttagcatgctaaaaaaagcccacggccttcttgccgaggagaacagaggcctgggcgagagagcaaacttaggacgacagttcctggaggtggagttggaccaagctcgcgaaaagtacgtgcaggagctcgccgctgtacgggcagacgctgagactcgccttgccgaggtacagagggaggcacagtcaacagccagagaactcgaggtgatgacagctaagtacgaaggggcaaaggtgaaagtcctggaagagagacagcggtttcaggaggaacggcagaagctgactgcacaggtggagcagctggaagtgtttcagcgtgagcagactaaacaggtggaggaattgtcaaaaaaattggctgattccgatcaggctagcaaagtgcagcagcagaaactcaaagccgtccaggcacagggtggggagtcacagcaagaggcacagagattgcaggcacagcttaatgagcttcaggctcagctgtcacagaaggaacaggcggccgagcactacaagctgcagatggaaaaggcaaaaacacactacgatgcgaaaaagcagcagaatcaggagctgcaggagcagctgcgctccctagaacagctacagaaggaaaataaagagctgcgcgctgaggctgagagattgggccatgaactccagcaggccggcctaaagaccaaggaagcagaacagacgtgtaggcatttaacagcccaggtccgtagtctggaggcgcaggtggcccacgcggaccagcagctccgagatctcggcaaatttcaggtggccaccgacgccctgaagagccgagagccacaagctaaaccccagctcgacctctccattgattcattggatctgtcatgcgaggagggaacacctctgagcatcacttctaaactgcccagaacacagccagatgggacctctgtgcccggagaacctgcatctccaatttctcagcgcctcccgcctaaagtggaatccttagagagcctgtacttcacccctattcccgcccgctcccaggctcccctggagagttcattagactctctgggggacgtatttcttgatagcggcaggaagactcgctctgcacggcggcgcactactcagatcattaatatcactatgacaaagaaattggacgttgaagaacccgactcagccaatagctccttctattccactcgttccgcgcccgcgtctcaggcgtccttacgcgctacaagttctacccagtcgttagccagattgggtagccctgactatggaaatagtgcactgctgtcactcccaggctacaggcctactacaagatcaagtgccagacgctcccaagcaggagtctcatctggcgccccccccgggcggaactcattttacatgggaacttgccaggatgagccagagcagctggatgattggaacagaatcgctgagctgcaacaaaggaacagagtctgccctccccatctgaagacatgttatcccctcgaatccaggccatcactgagtctggggaccatcacggacgaagaaatgaagacaggagaccctcaggagacgctgcgccgtgcttcgatgcagcctatccagatagccgagggtactgggatcactacccgccagcagagaaaacgcgtgagcttggaaccccatcaaggacctggaactcccgagtccaagaaggccacttcatgtttccctcgccctatgacaccccgagaccggcacgaaggcagaaagcagtcaacaactgaggcccagaagaaggccgctccagccagtactaagcaagcagaccggcgtcagtctatggcatttagtatactgaatacccccaaaaaattagggaactcgttgctgagacgcggggccagtaaaaaagccctctcaaaagctagtcccaatacccgatctggaacacgccggagccctagaattgccaccacaaccgcttctgcagccacagctgcagcgatcggtgcaacaccccgcgccaagggcaaagccaaacattag

SEQ ID NO: 197652 - DNA, 330 bp, Artificial Sequence
  Description of Artificial Sequence: Synthetic coding sequence
atgaccctgcacgccacccggggcgccgccctgctgagctgggtgaacagcttacacgtcgcggatcccgtcgaagccgtactgcaactccaagattgttcaatcttcattaaaatcatcgataggattcacggtaccgaggaggggcagcagattctgaaacagcctgttagcgagcgccttgacttcgtctgtagctttctgcagaagaatagaaagcaccccagttcacccgagtgtctcgtgtctgctcaaaaggtgctggagggatcggaactggaacttgcgaaaatgaccatgcttctcttatatcactccacaatgagctag

SEQ ID NO: 197653 - DNA, 186 bp, Artificial Sequence
  Description of Artificial Sequence: Synthetic coding sequence
atgaccctgcacgccacccggggcgccgccctgctgagctgggtgaactcactccacgttgccgatcccgtcgaagctgtgctgcagttgcaggattgtagtatcttcataaagattatcgatcgcatccatggcaccgaagagggccagcagattctgaaacagcccgtgagtgagaggctgtag

SEQ ID NO: 197654 - DNA, 180 bp, Artificial Sequence
  Description of Artificial Sequence: Synthetic coding sequence
atgaccctgcacgccacccggggcgccgccctgctgagctgggtgaacagcctccacgtcgcggatcctgtggaggcagtgctgcagctccaggactgctctatcttcattaaaattatcgaccgcatccacgggaccgaggagggacagcagattctgaagcagccggtttctgaatag

SEQ ID NO: 197655 - DNA, 441 bp, Artificial Sequence
  Description of Artificial Sequence: Synthetic coding sequence
atgaccctgcacgccacccggggcgccgccctgctgagctgggtgaatagtttacatgtagcggatccggtggaggctgtactgcagctgcaagattgctctatcttcattaaaattatagatcgcattcatggaactgaagaagggcagcagatactgaaacagcccgtaagcgagcgactggacttcgtgtgctcttttcttcaaaagaacaggaaacacccgtcttcaccagaatgtctagtgtccgctcagaaggtcctcgagggctcagagctggaattggccaagatgactatgctcctgctctaccattccacaatgtccagcaagagtccccgcgattgggagcagtttgaatacaaaatccaagccgaacttgctgtgattctgaaatttgtgctggatcacgaggatggactcaatttgaacgaagattag

SEQ ID NO: 197656 - DNA, 3267 bp, Artificial Sequence
  Description of Artificial Sequence: Synthetic coding sequence
atgcggctgcagaacgccctgaacgagcagcgggtggagttcgccacactgcaggaggcccttgcccacgctctaaccgagaaagagggtaaggaccaggagcttgccaagttacggggcctggaagctgcccagatcaaggagctcgaagaactgaggcagacagtgaagcagctcaaggagcaacttgctaaaaaggagaaggaacacgcttccggctcaggcgctcagtctgaggcagccggccgtacagagcctacaggtcctaagctcgaggctctgcgggctgaggtttcgaagctggagcagcagtgccagaagcagcaggaacaggccgatagcctggagcgcagccttgaagccgaacgcgcatcccgggctgagcgcgactctgccctcgaaacactccagggccaactggaagagaaggcccaagagctcggccatagccagtccgccttagcctccgcacagcgcgaactggccgcttttagaacgaaggttcaagatcacagtaaagccgaagacgagtggaaagcacaagtagctcgcggtcgtcaggaggccgagaggaagaacagcctgatttcatctcttgaggaggaggttagtatcttaaacaggcaagtactagagaaagagggtgaaagtaaagaactgaaacgtctcgtgatggccgagtctgagaaatcacagaaactagaagaacgcctgcgcctcctccaagcagaaacggcctcaaatagcgcccgagctgccgagaggtcctcagctttgagggaggaagtacagtcattgagggaagaagctgaaaagcagcgggtggcttcagaaaatctccgtcaggaactcaccagccaggccgaaagggctgaagaactgggacaagaattgaaagcttggcaggagaagtttttccagaaggagcaggcactgtctaccctgcagctggagcatacgtccacccaggccttggtgagcgaattgctgccagcaaaacacctctgccagcagctgcaggcagagcaggcagctgctgagaaacgccaccgagaggagctcgagcagtccaagcaggccgccggaggactccgcgccgagttgttaagggcccagcgagaacttggtgaattgatacctctgagacaaaaagtggcagagcaagaacggactgcacagcagctgagggctgagaaggccagctatgccgaacagctgagcatgctgaagaaggcccacggcctgctggcggaggagaatagaggacttggtgagagggccaacctgggccggcaatttcttgaggtggagttagatcaggccagggaaaaatacgtacaggagctggctgctgtccgggccgacgccgagacccggttggctgaggttcagcgcgaggcccagagcacagcccgcgaactcgaggtaatgaccgccaaatatgaaggcgctaaagtaaaggtgctagaagagaggcaacgattccaagaggagcgccaaaagctgaccgcccaggtggaggagctctccaagaaactagctgactccgaccaggcctccaaggtgcagcagcagaagctgaaggctgtgcaggcccagggcggggaaagtcaacaggaggcacaaaggcttcaggcccagcttaacgaactccaggctcagctctctcagaaggagcaggctgctgagcactataagctgcagatggagaaggccaaaactcattatgacgcaaaaaaacagcagaaccaggagttacaggagcagttacgaagcctagaacagctgcagaaagaaaacaaggagcttagggctgaggccgaacggctcggccatgaactccagcaggccgggctgaaaacaaaggaagccgaacaaacatgtaggcacttgactgcccaggtcaggagccttgaagcccaggtcgctcacgctgaccaacagctgagggatctaggaaagtttcaagtcgccacagacgccctgaagtccagagaacctcaggcaaaaccgcagctggacctatccatcgactcactggacttgtcatgcgaggaaggcacgcccctcagtattacccgacataaggcactcatgactattatccctgacctgtcccctaataacccccttagcaagctccccaggactcagcctgatggtacaagcgtgcccggggaacccgcgtctcccatttcccagaggctgccacccaaagtggagtccttggaatcactgtattttacacccatccccgcccgttcgcaggcgcccctggagtctagccttgattcactgggggatgtttttttggactcgggccggaagacccgcagtgccagaaggagaacaacccaaattatcaatatcaccatgactaagaaactagatgtggaggagcctgattccgccaactccagcttttactccacaaggtcagctcccgcctcacaggcttcccttcgggcgacaagcagcacccagtctctcgccagactgggatcacctgactatggcaattccgccctcctctctctccccgggtaccggcctaccacccggagttctgcacgcaggagccaagccggtgtgagcagtggcgcaccccctgggcgaaacagcttttacatgggcacttgtcaagacgagcccgaacagctggatgattggaaccgaatcgcggagttgcagcagaggaaccgcgtgtgtcctccacacctcaagacttgttacccactcgagtcccggcccagccttagtctgggcactataacagatgaagaaatgaagacaggagaccctcaggagaccctgagacgtgcgtctatgcagccgatccagattgccgaagggacaggtattaccactagacagcaacgaaaaagagtatcacttgaacctcaccaggggccagggactccagagagcaaaaaagctacgtcctgtttcccaagacccatgacgcccagagatcggcacgaaggccgcaagcaatcaactactgaggctcagaaaaaggccgcccctgcctccaccaaacaggcggaccgtcggcagagtatggccttctcaattctgaacacccccaagaaactgggaaatagcctcctccggcggggggccagcaagaaagccctctcgaaggcatcccctaatacgaggagtggaactcggcggtccccacgaatcgccaccacgaccgcgtctgccgcgactgcagccgcaattggcgctaccccgagggcaaaagggaaggcaaagcactag

SEQ ID NO: 197657 - DNA, 2076 bp, Artificial Sequence
  Description of Artificial Sequence: Synthetic coding sequence
atgaccctgcacgccacccggggcgccgccctgctgagctgggtgaacagcctgcatgtggcagacccggtggaggctgtgctacagctccaggactgcagtatatttattaaaattattgaccggattcacgggacagaggaaggtcagcagatactgaaacagcccgtctcagagagacttgactttgtgtgcagctttttgcagaagaataggaaacacccttcatcgccagaatgcctcgtttccgctcaaaaagtcttggaaggctctgagttagagttagccaagatgactatgctgttgctgtatcacagtaccatgtcatccaagagcccacgcgactgggaacagttcgaatacaaaatccaagccgaattggctgtgattcttaagtttgttctcgatcatgaagacgggctaaatctcaacgaagatctggaaaattttctgcaaaaagcccctgtcccttcgacatgttcctccacatttcctgaggaactgagccctccatcacatcaggccaaaagagagatcaggttcttggagcttcagaaagtagcatcaagcagcagtggaaataatttcctttccggctcccctgctagcccaatgggcgatatcctgcagactccccagtttcagatgcgtcgcctaaagaagcaactggctgacgaacgttcgaatagagatgaactagaactcgagctcgcagagaataggaagctccttactgaaaaagatgctcaaatcgccatgatgcagcagcgaatcgatcggttagcactgctcaatgagaaacaggctgcgagccccctggaacccaaagagttggaagaattaagggacaaaaatgagagcctcacaatgcgtcttcacgaaaccctgaagcagtgccaggatcttaaaacggaaaaaagccaaatggaccgcaaaataaaccagttgagcgaggagaacggagacctgagttttaagctgcgggaatttgcctctcacctgcagcaattgcaggacgctcttaatgagctgaccgaggagcattccaaagctacccaggaatggctggagaaacaggctcagctggaaaaagaactgagtgccgctctacaggacaagaaatgccttgaggaaaagaacgagattctgcagggcaagctgtcgcaacttgaagagcacctcagccagttgcaggataaccctccccaagaaaagggtgaagttctgggggacgtcctacagcttgagacgctgaaacaggaggccgcaacactggctgccaacaatacacagctgcaggcacgagtggaaatgctcgaaactgaacgcggccagcaagaggctaagctgctggccgagaggggccactttgaggaggagaagcagcagctcagcagcctgattactgatctgcagagctccatcagtaacttgagccaggccaaagaagagctggaacaagcatctcaggcccacggcgcaagattgacagcgcaggtggcatcacttacgagtgagctcaccaccctgaatgcaaccattcagcagcaagatcaggagctggcaggactgaaacagcaggctaaggagaagcaggcccagctagcacagaccctgcagcagcaagagcaagctagccaaggcctgcgtcaccaagtagagcagctatcatccagcttgaagcagaaggaacagcagctcaaagaggtggcagagaaacaggaggcgacacggcaggatcacgctcagcagctggctaccgctgccgaagagcgcgaggctagtttaagggagagggacgcagcgctgaagcagctggaggcccttgagaaagagaaggcagccaagctggagatcctgcagcagcagctgcaggtggctaacgaggcccgggattctgctcagacgtccgtaacgcaggctcaacgcgagaaagcggagctgagcaggaaagtggaagaattgcaggcctgtgtcgaaaccgctcgccaggagcagcatgaggcccaagcccaggtagccgaacttgagcttcagctgcgctccgaacagcaaaaggccactgaaaaagagtag

SEQ ID NO: 197658 - DNA, 480 bp, Artificial Sequence
  Description of Artificial Sequence: Synthetic coding sequence
atgaccctgcacgccacccggggcgccgccctgctgagctgggtgaattccttacatgtggccgatccagttgaagctgttctgcagcttcaggattgctccattttcataaagattatcgacagaatacacggaacagaggaggggcagcaaatattaaagcagccagtcagcgaacggttagactttgtttgcagttttctccagaaaaaccgcaagcacccgtcatcaccagagtgtcttgtgagtgcacagaaggtgctcgagggatccgagctggagctcgccaagatgacaatgctcctgttgtatcattcgacgatgagtagcaagtctccacgagactgggagcagttcgaatacaaaatacaggctgaactggccgtgatcctcaagttcgttcttgaccacgaggacggtcttaacctcaacgaagacctcgagaactttctgcagaaggcccccgtgcccagcacctag

SEQ ID NO: 197659 - DNA, 219 bp, Artificial Sequence
  Description of Artificial Sequence: Synthetic coding sequence
atgaccctgcacgccacccggggcgccgccctgctgagctgggtgaatagcctacatgtggccgacccagtggaagctgtcctccagctccaggattgctctatcttcataaaaattatagaccgtatccatggtacagaggagggccagcagatcctaaaacaacccgtgtccgaacgactggatttcgtctgcagttttttacagaaaaaccggtag

SEQ ID NO: 197660 - DNA, 252 bp, Artificial Sequence
  Description of Artificial Sequence: Synthetic coding sequence
atgaccctgcacgccacccggggcgccgccctgctgagctgggtgaactccctccacgttgccgatcccgtggaggccgttcttcagctacaggattgtagcatctttatcaaaatcattgaccgcatccatgggacagaagaaggtcaacaaatcctaaagcagccggtgtccgaacggctggattttgtatgtagtttcctacaaaagaacaggaagcaccccagttccccagaatgtcttgtgtcatag

SEQ ID NO: 197661 - DNA, 2559 bp, Artificial Sequence
  Description of Artificial Sequence: Synthetic coding sequence
atgaccctgcacgccacccggggcgccgccctgctgagctgggtgaactcactgcacgttgcagatcccgtggaggccgtcctgcaactccaggattgtagtatcttcattaagattatcgatagaatccatggtactgaagagggccagcagatactaaagcagcctgtttctgagagactcgacttcgtatgtagtttccttcagaagaaccgaaagcatccatcctcacctgagtgcttggtgtctgcccagaaggttttggagggcagtgagctcgaactggccaaaatgaccatgttgctgctttatcacagcactatgagcagtaaaagcccacgggattgggagcagtttgaatacaaaatccaggcagagcttgccgtcattttgaagttcgtgcttgaccacgaggatggactgaatcttaatgaggacctggagaacttcctccagaaagctccagtgccatcaacatgcagttccacctttcccgaggagttgtctcctccttcccaccaagccaagcgcgaaatacggttcctggagcttcagaaagtggcttccagcagttcgggtaacaacttcctgtcaggaagcccggcgagtcctatgggagacattctgcagacccctcagttccagatgcggcggttgaaaaaacagttagcagacgaacggagcaacagagatgagctcgagctcgagctggctgagaataggaaacttcttaccgagaaggatgctcaaatagctatgatgcagcagcgtatcgatcgacttgccctcctcaacgaaaagcaggccgccagtcccctggaaccaaaggagttggaagaattacgagacaagaacgaaagcctaaccatgagactgcacgagactttaaagcagtgtcaggaccttaagaccgagaaatcacagatggaccggaaaattaatcagctgtccgaggaaaacggagacttgagttttaagcttagagagttcgcctctcacctgcagcagctgcaggacgccctaaacgaactgactgaggaacactcgaaggcgacacaggaatggttagagaaacaggctcagcttgagaaggagctgtcagccgccttacaggataagaagtgcctggaggaaaagaacgagatcctccagggcaaactgagccagctcgaagagcatctctcccagcttcaggataaccccccacaggagaagggcgaagtgttgggggatgtcctgcagctggagacgctgaagcaggaggcagccacacttgcagcgaataatacccagctccaggccagagtcgaaatgctggagacggagagaggacagcaggaagccaaattgctcgccgagaggggccacttcgaggaagaaaagcagcagttatcctctctcattaccgacttgcagtcatccatatccaacctatcccaggcaaaggaggaactggaacaggcctcccaagctcacggtgcacgcctgacggcccaagtcgcttctctgacctcagagctgaccactctgaatgcgacaatccagcagcaggaccaggaactggccggtcttaagcagcaggcgaaggaaaaacaggcacagctcgcccagaccctgcaacaacaagagcaagcttcccaggggttgagacaccaggtagaacagcttagttctagtttgaagcaaaaagagcagcagctcaaagaggtggctgagaagcaggaagctacaagacaggatcatgctcagcaattggcgactgccgccgaggagcgtgaagccagcttacgcgaacgggatgccgcactgaagcagctcgaagcgctggaaaaggaaaaggctgcaaagcttgaaatcctgcaacaacagctgcaggtcgccaacgaggctcgcgactcagcccaaaccagcgtgactcaggcccagagggagaaggcagagctgagtagaaaggttgaggagcttcaggcctgtgtagaaaccgcccgacaggagcagcacgaggcacaggcccaggtggcggagctcgagctgcagttgcgatccgaacagcagaaagccactgaaaaggagagagtcgcacaggaaaaagaccagctccaggagcagcttcaggcccttaaagagagcttgaaagtgaccaaagggtcattggaggaggagaaacgtcgtgctgcagacgctttagaagaacagcagcgctgtatttcggaactgaaagccgagacccggtcactggttgaacagcataaaagagaaaggaaggagcttgaggaagagagggcgggccgaaaaggacttgaggcccgactacagcaactgggagaggcccaccaggccgagaccgaggtgctgcggagagagctggccgaggctatggcggcacaacacacggcggaaagcgagtgtgagcaactggtgaaagaggtggctgcttggagagagcggtatgaagatagccagcaagaggaggctcagtacggcgccatgttccaggagcaattgatgacgctgaaagaagagtgcgaaaaggcccgccaggagcttcaggaggcctag

SEQ ID NO: 197662 - DNA, 525 bp, Artificial Sequence
  Description of Artificial Sequence: Synthetic coding sequence
atgaccctgcacgccacccggggcgccgccctgctgagctgggtgaacagtttgcacgttgcagacccagtggaggcggtgctgcaactccaggattgttcaatatttatcaagatcatcgaccgcatccacggcacagaggaaggacagcagatcttgaagcagcccgtgagcgaaagactggactttgtttgtagcttcctacagaaaaatcgcaagcaccccagcagccccgaatgcctggtgtctgctcaaaaagtgctggagggatcagagttggaactcgctaagatgacgatgcttcttctgtaccacagcacaatgtcatcaaaaagcccacgagactgggaacagttcgagtataagattcaagccgagctagctgtgatcttgaaattcgtactggatcatgaagacggcctgaatctcaatgaggatctcgaaaatttcttgcagaaggcacccgtccccagtacatgttcatccaccttccctgaggaactctcacccccgagtcatcagtag

SEQ ID NO: 197663 - DNA, 606 bp, Artificial Sequence
  Description of Artificial Sequence: Synthetic coding sequence
atgaccctgcacgccacccggggcgccgccctgctgagctgggtgaactctctgcacgtcgcagaccccgtggaggcggtgctgcagctgcaggattgttctatcttcatcaagattatcgaccgcatccatggcactgaagagggccaacagatcctgaagcagccagtctcggagcggctggacttcgtgtgctcattcctgcagaaaaacaggaaacatccaagcagtcccgaatgtctagtatctgcccaaaaagtcctggagggctctgaacttgagctggctaaaatgacaatgttgcttctgtaccattcgacgatgtcatctaaatcacctagagattgggaacagttcgagtacaaaatacaggccgagctcgccgtgatcctcaaatttgttctggaccacgaggatgggctcaatctcaatgaagatctggaaaactttctgcagaaggcacccgttccatccacgtgtagtagcaccttcccagaggaactgagcccaccttcccatcaggctaaacgtgagatcagatttcttgagctgcaaaaggttgcatcctcatcatctggcaataattttctatctggttccccttag

SEQ ID NO: 197664 - DNA, 480 bp, Artificial Sequence
  Description of Artificial Sequence: Synthetic coding sequence
atgaccctgcacgccacccggggcgccgccctgctgagctgggtgaactcccttcatgtggccgacccagtggaagcggtcttgcagctccaggattgctcgattttcattaagatcatcgatcgcatccatggtacggaggaggggcagcagattcttaagcagcccgtctctgagcgcttggatttcgtctgctcattccttcagaagaaccggaagcacccctcctctcctgagtgccttgtgtcagcccagaaggtgcttgaaggttccgagctggaacttgcaaagatgaccatgctcctgttataccacagcaccatgagcagcaagagcccaagggactgggaacaattcgaatataaaatccaagccgagctggctgtcatactaaaatttgtcctggaccatgaagatggcttaaatctgaatgaggacctggagaacttcctccagaaggctccggtgcccagcacctag

SEQ ID NO: 197665 - DNA, 663 bp, Artificial Sequence
  Description of Artificial Sequence: Synthetic coding sequence
atgaccctgcacgccacccggggcgccgccctgctgagctgggtgaactcactgcatgttgccgaccctgtggaggcagtcctacagctgcaggactgctcaatcttcatcaagatcatcgaccgaatacacggcacagaggagggtcagcagatcttgaaacaacctgttagtgaaaggcttgattttgtgtgctccttcctccagaagaatagaaagcatccttcttcacctgaatgcctggtatctgcgcaaaaagtcttagaaggctctgagctggaactggccaagatgactatgctcttgctataccattcaactatgtcaagcaagtccccaagggactgggagcagtttgaatataaaatccaggcagagctggctgtcatcctgaagttcgtgctggaccacgaagacggtctgaacttgaacgaagacttggagaattttctccagaaagcccctgtcccaagcacctgctcctctaccttcccggaggaactgagtcctccgtcacatcaagctaaacgggaaatccgctttctagaactacaaaaagtggcatcttccagctctggcaataacttcctcagcgggtcccccgcgtctcccatgggagacatcctgcagactccgcagtttcaaatgcgaaggctgaagtag

SEQ ID NO: 197666 - DNA, 171 bp, Artificial Sequence
  Description of Artificial Sequence: Synthetic coding sequence
atgaccctgcacgccacccggggcgccgccctgctgagctgggtgaactcactgcacgtagcagatccggtggaagcagttctgcaacttcaggattgttcgatattcatcaagattattgaccgaattcatggcaccgaggagggccagcaaatactcaagcaaccctag

SEQ ID NO: 197667 - DNA, 1053 bp, Artificial Sequence
  Description of Artificial Sequence: Synthetic coding sequence
atgttctgctgcctgggctacgagtggctgagcggcggctgcaagacctggcattcggcatgggtcatcaataccttagccgaccaccgacacagagggactgatttcggaggttcaccctggctgctcattatcacagtgttccttcggagttacaaattcgctatcagcctgtgcaccagctatctttgtgtctccttcctaaaaaccatttttccttcacagaacggtcacgatggaagcacggacgtgcagcagcgggcgcgtcgcagcaacagacggcggcaggagggcatcaagatcgtgctggaggatatatttacactgtggcggcaagtggaaacaaaggtgcgggctaagatccgcaaaatgaaagtgactacaaaggtgaacaggcatgacaagatcaatggtaagaggaagacagcgaaggagcacctaagaaaactatccatgaaggagcgggagcacggcgaaaaagagagacaggtgagtgaagcagaggagaacggcaagcttgacatgaaggagattcacacctatatggaaatgtttcaaagagctcaagcccttcgcagaagggcggaggattactacagatgcaagatcacgcccagcgctcggaagcctctttgtaatcgggttcgcatggctgcggtggagcataggcattcctctggcttgccctactggccatacctgactgctgagacccttaaaaacaggatggggcaccaaccacctcctccaactcagcaacacagcattatcgacaacagcctgtcccttaaaacaccttccgaatgcctgctgaccccccttccccctagcgcattaccaagtgcagacgacaacctaaaaacacccgcagaatgtctgctgtatcccctgccacccagtgccgacgataaccttaaaactcccccggagtgtctcctgacgccactgccccctagcgcaccaccctctgtagatgacaaccttaagacacctcccgaatgcgtgtgttctcttcctttccaccctcagcgaatgatcataagcagaaactag

SEQ ID NO: 197668 - DNA, 1053 bp, Artificial Sequence
  Description of Artificial Sequence: Synthetic coding sequence
atgttctgctgcctgggctacgagtggctgagcggcggctgcaagacctggcattccgcatgggtcattaacacattggctgaccataggcacagaggtacagatttcggtggcagcccctggttactgattatcacggtctttttgagatcctacaagtttgcgatctccttgtgcaccagctatctgtgcgtcagtttccttaagactatcttcccatcccagaacggccacgacggtagcacagacgtgcaacagagggctcgcagaagcaatagaaggcgtcaggaaggaatcaaaatagtgctagaagatatcttcactctgtggcgccaagttgagactaaggtcagggctaaaattaggaaaatgaaggtcacaaccaaagtgaatagacacgataagatcaatggtaagagaaagaccgccaaggagcacctgcggaagctctctatgaaggaaagggaacacggggaaaaggaacgacaggtttccgaggccgaggaaaatggcaaactggacatgaaagagatccatacctacatggaaatgttccaaagagcccaggccctgagacgaagggccgaggattactacagatgcaaaatcacacccagtgcacgtaaacctctgtgcaaccgggtgcgcatggccgccgtggagcatcgccacagcagtggactaccctactggccctatttgactgctgaaacgctcaaaaataggatgggacaccagccccccccaccaacccagcagcatagtataatcgacaactccctctctctgaagacaccgtccgaatgcctgttgacacccctgcctcctagtgccctgccttctgctgatgacaaccttaagacccccgccgagtgcctactttacccccttcccccgtcagccgacgacaatcttaagaccccccccgagtgtctactgacacctcttccaccttcagctccaccctccgttgatgacaaccttaaaactccccccgaatgcgtttgctccctcccattccacccacagcgaatgatcatttccaggaactag

SEQ ID NO: 197669 - DNA, 1431 bp, Artificial Sequence
  Description of Artificial Sequence: Synthetic coding sequence
atggccagccccttcagcggcgccctgcagctgaccgacctggacgacttcattggcccgtcgcaggagtgtatcaagcctgtgaaagtggaaaagcgagcagggtctggggtcgccaaaattcgcatcgaagatgacggctcctattttcaaatcaaccaggacggcggcacacgtaggcttgaaaaagcaaaggtgagcctcaatgactgcctggcctgtagtggatgtataacatccgccgagacagtcctcattacgcaacaaagccatgaggaacttaagaaggtcctcgatgcgaacaagatggccgctccctcccaacaacggctcgtggtggtcagcgttagccctcagagccgggcgtctctggcggcacggttccagttaaacccaaccgatacggccaggaagcttacctcgttttttaaaaagatcggcgtgcacttcgtgttcgatactgccttctctagacacttctcattactcgagagtcaacgcgagttcgtgcggagatttaggggacaagccgattgtcggcaggccctgcctcttttggcgtccgcttgccctggctggatatgctatgctgagaagactcatggtagttttattttaccacacatttctaccgctcggtctcctcaacaagtgatggggtctctggtaaaagactttttcgcgcagcagcagcacctgaccccagataagatatatcatgtgaccgtgatgccatgctacgataagaagctggaagcctccaggccagacttttttaaccaggaacatcagacaagagacgtggactgcgtcctcacaacgggtgaggtgttccggctcctcgaagaggaaggcgtaagcttaccggacctcgaacccgcccctttagactccctctgttcaggagcaagcgcggaggaaccaacttctcacagaggggggggcagcggtgggtacctggagcatgtcttcaggcacgcagctcgcgaactatttggcatccacgtagcagaggtaacttacaagccactgcgcaacaaggactttcaggaagtaacactggagaaagagggccaggtcctcctccacttcgccatggcgtacgggtttcgaaacatacaaaatctggtccagcgactgaagagggggcggtgtccgtaccactacgtggaagtgatggcttgccccagcggatgcctcaatgggggagggcagttgcaggcccccgatagacctagcagggaacttctgcagcatgtagagagactgtacggaatggttagggcggaagcaccggaggacgcacccggagtgcaagagctgtacacccactggcttcaggggacggacagcgagtgcgccgggagactgcttcacactcagtaccatgcagttgagaaagcctctactggtctaggcattcgctggtag

SEQ ID NO: 197670 - DNA, 567 bp, Artificial Sequence
  Description of Artificial Sequence: Synthetic coding sequence
atggccagccccttcagcggcgccctgcagctgaccgacctggacgattttatcggccctagtcaggagtgcatcaagcctgtgaaggtagagaaaagagctggttccggcgtcgcgaaaatccggattgaggatgacggtagctattttcagatcaaccaggacggaggcacccggcggctggagaaagctaaagtgagtctcaatgattgcctcgcctgttcagggtgtatcacctctgctgagacagttctgattacccagcagagccatgaggagttaaagaaagtgttggatgctaataagggctgtacctctagcagtacacctccttcccagggcacctcagcatcgtggagggctagcgaatcactatgtggcgattcggaggataggcccaccgcggaccgaaggtgtccttgttggccccttcccgcacaggccggttccgccatgcccaggagattgactgcagcctcatcgtccccaacatctgcaccccctggccctagatctagatcctgggcgccttggagtaggacatcttcaccctcaagcagcacttag

SEQ ID NO: 197671 - DNA, 1125 bp, Artificial Sequence
  Description of Artificial Sequence: Synthetic coding sequence
atggccgcccccagccagcagcggctggtggtggtgagcgtgagcccacagagccgggcctcgcttgcagcgagattccaactcaatccaaccgacaccgctcgcaaactcacgagctttttcaaaaaaatcggggtgcactttgtgttcgacaccgccttctccaggcacttctcccttctcgagtctcagcgagagtttgtccgaagatttagggggcaagcagactgcaggcaggccctgcccctgctcgcgagtgcttgccccggatggatctgttatgccgagaaaacacatgggagctttatcttacctcatatttcaactgcccgcagcccccagcaagttatgggcagtctggtgaaggacttcttcgctcagcagcagcatctaacccccgacaagatctaccatgtcacagtgatgccgtgttatgacaagaaattggaggcgtctaggccggacttctttaaccaggagcaccagacccgtgacgttgattgtgtcctgaccaccggcgaagtattcagactgttagaagaggaaggcgtatcattgccagaccttgagccagcccctttggatagcctgtgtagcggggcctccgctgaggagcccaccagtcatcggggcggagggagtggtggatatttggaacacgtcttccggcacgcagccagggagcttttcggcatacacgtcgccgaggtgacctataagccactgaggaataaggacttccaggaggtgacactggagaaagagggccaagttctgttacacttcgccatggcatacgggttcagaaatattcagaacctggttcaaaggttaaagagaggaaggtgcccataccactatgttgaggtcatggcatgtcccagcggctgtctaaatggtggcgggcagcttcaggctcccgacagaccttccagagaactcctacagcatgtggagagactgtacggaatggttagagcagaggcccccgaggatgcacccggagtccaggagctttacactcactggctccagggtaccgattctgaatgcgctggacgactgctgcatacacagtaccacgctgtggaaaaggcatccacaggtctagggatcaggtggtag

SEQ ID NO: 197672 - DNA, 4284 bp, Artificial Sequence
  Description of Artificial Sequence: Synthetic coding sequence
atgctgctgcccagcgacgtggcccggctggtgctgggctacctgcagcaggaaaatctcatcagtacatgccaaacatttattcttgagtccagtgatctcaaggagtacgccgaacactgcactgatgagggtttcatcccagcctgtctgctgtcgttattcggcaagaatcttacaaccattctgaacgagtatgtcgcgatgaaaacaaaagagacttccaacaatgtgccagcaataatgagctctctgtggaagaaactggaccacacactatcccaaatccgttccatgcaaagtagccctcggttcgctggttcccagcgggcaagaaccaggaccggcatcgctgagatcaagcgccagcgcaaactcgcgagtcagactgctcctgcctccgcggaactgcttaccttgccatacctgtcaggacagttcacgacccccccttccacgggaacccaggtgactaggcccagcggccagattagcgacccctccagaagttatttcgtggttgttaaccactctcagagccaagatactgttaccaccggcgaggcactcaatgttatccctggagcccaggagaagaaagctcacgcatccctaatgtcgccagggaggagaaaaagcgagagtcagcgcaaaagcacaacgctgtctggcccacattctaccattcgcaatttccaggatcccaacgcgttcgccgtagagaagcagatggtaatcgagaatgcaagggagaaaatcttatctaacaaatccctgcaagagaaactggctgagaacattaataaatttcttaccagtgataataatatagctcaagtccccaagcaaaccgataacaatcctacagagcccgaaacatcaatagacgagttcctgggattgccgtctgagattcacatgagcgaagaggctatccaagacattctggaacaaaccgaatcggaccctgcatttcaggccttgttcgacttatttgattatgggaaaacaaagaacaacaaaaatataagccagagtattagcagccagcccatggagtccaatcctagcatcgtattggccgacgaaactaacctggcagtcaagggctcctttgagactgaggagtctgacggacagtcagggcaaccggcattctgcacgagttaccaaaatgatgacccgctgaacgcacttaaaaatagcaataatcacgacgtcctgcggcaggaggaccaggagaatttttctcagattagcacttctatccaaaagaaagcttttaaaacggctgtgcccactgaacagaagtgcgacattgacattacattcgagtcggttcctaaccttaatgatttcaaccaaagaggcaatagcaacgctgagtgcaatccacattgcgcagaactctataccaaccagatgagtacggagacagagatggccataggcatcgaaaagaatagcctctcttctaatgtgccaagcgagtctcaactccagccagatcagcccgatataccaattacaagttttgtgagtcttggctgcgaagcgaacaacgaaaatctgattctgtccggtaaatccagtcagcttctctctcaggacaccagcctaacaggcaagccatctaagaaaagccagttttgcgagaactcaaatgataccgtgaaactcaagattaatttccacggaagcaaatcttctgattctagtgaggtgcataagagcaaaatcgaaataaacgtgcttgaacccgttatgtcacaactctccaactgtcaggacaattcctgcttacagtccgagatactacctgtgtcggtagagtcttctcatttgaatgtgagcggccaagtggagatccacctaggagactcactttcaagtaccaagcagccgtcgaacgattccgctagcgtggagctcaatcacacagagaatgaggcccaggccagcaagtccgagaactctcaggagccgtcaagcagcgtgaaagaggaaaataccatcttcctgtctttgggcggaaatgcaaattgcgagaaggtcgccttgactccaccagaaggcacccctgtagaaaactcacatagtctgcctccagaatccgtctgtagtagtgtaggcgactctcaccctgagtcccagaataccgacgacaaaccgtcatctaataattccgcggaaattgatgcaagtaacatcgtgtcacttaaggtaatcatcagcgacgatccattcgtgagcagcgatacagagctgaccagtgcagtgtcctctatcaacggagaaaacctgcctaccataattctctcttcacccactaagagtcctaccaaaaacgctgagctcgttaaatgcttgtccagcgaagaaacagtgggcgccgtggtttacgctgaggtgggcgatagtgctagtatggagcagtctctgctgaccttcaagtcagaagactccgcggtaaataatacacagaacgaagacggcatcgcctttagcgccaacgttacaccctgtgtttcaaaagacggtggctatattcaactcatgcccgcaacttccacagcgttcggcaattccaataacatcctgatcgccacttgcgtgaccgaccctaccgctctagggacgtcggtctcccagtccaacgtcgttgtccttccaggtaattctgcgccgatgaccgctcagcccctcccacctcagctgcagacaccacccagaagcaatagtgtatttgccgtgaatcaggctgtgagccctaacttctcccagggctccgctattattatcgcctctcctgttcagccagttctacaggggatggtcggtatgatcccagtctctgtagtgggtcaaaacgggaataacttttctacccctccccgccaggtgcttcatatgcccctgacagccccagtgtgcaatcggagtattccacaattccccgtgccccccaaatcccagaaggcccaggggcttcgtaataaaccctgcatcggcaaacaggtaaataatttggtagacagctcaggacattccgtggggtgccacgcccaaaaaaccgaggttagcgataaaagtattgcgaccgacttaggcaagaagagcgaggagaccaccgtcccattcccggaggaaagcattgtgccagctgcgaagccgtgccacaggagggtactctgctttgactcaactaccgcgcctgttgctaatacacaaggtcccaaccataagatggtgagtcaaaacaaagagagaaacgcagtaagctttcccaatcttgacagtccgaatgtcagcagcaccctgaaaccaccatccaacaatgcaatcaagcgcgagaaggagaagccacccctgcctaagatcctttccaaatcagagtccgcaataagccgccacactacgattagagaaacacagtctgagaaaaaggtctcacctactgagatcgtcctggagagcttccacaaagccactgccaataaagagaacgagctctgtagtgacgtggagagacagaagaatcccgagaattccaaattgagcattggccagcagaacggaggactgcggtctgagaagagcattgcttctttgcaagagatgacaaaaaagcagggcacatccagcaacaataagaacgtgctctctgtcgggaccgccgtgaaggatctgaagcaggagcagaccaagtcagcttcatcactgataaccaccgagatgctacaggatattcagagacatagcagcgtctccagactggcagacagcagcgacctacctgtcccaaggacgcctggaagtggtgccggagagaagcataaggaagagccgatcgatatcatcaaagccccctcatcccggagattttctgaggatagttctacctcaaaagttatggtaccgcctgtaactccagatctgcccgcctgctcaccagcctccgaaaccggctctgaaaacagcgtgaacatggcagcacacaccctaatgatcctgagtagagcggccatcagccggactacctcagctaccccactgaaagacaatactcagcagttccgggcgtccagcagatcaaccacaaaaaaaaggaaaattgaagagttagacgagcgagagcgaaactcaagaccctccagcaaaaatctcacgaatagttcaattccaatgaaaaagaagaaaattaagaagaaaaagctgccaagttcctttccagctggtatggatgttgataaattcctactttcactgcactacgacgagtag

SEQ ID NO: 197673 - DNA, 7284 bp, Artificial Sequence
  Description of Artificial Sequence: Synthetic coding sequence
atgcccctgaagacccggaccgccctgagcgacgaccccgacagcagcacctccaccctgggcaatatgctagaactaccggggacgtcgagctcttccacctcacaggaactccctttttgccagcctaagaaaaaatccacccccctgaagtatgaagtgggggacttaatttgggcgaagtttaaacgccgtccctggtggccttgtcgcatttgctccgatccgctcataaacactcatagtaaaatgaaggtcagcaaccggagaccctatagacagtattacgttgaagcttttggcgatccgtccgagcgcgcttgggtggccggcaaagctatcgtgatgtttgagggtcgccaccagtttgaggagcttcctgttctaaggcgaagaggtaaacagaaagagaaagggtatcggcacaaagtaccccagaagatcttaagcaagtgggaagcttctgtgggtctggccgagcaatacgacgtgccaaaaggctctaagaataggaaatgcatccctgggtctattaaactggattccgaggaggacatgccttttgaggattgcaccaacgacccagaatcagagcatgacctgctgctcaacggatgcttgaaaagcttagcattcgattcagagcattcagccgacgagaaggagaagccttgcgcaaagtctcgcgcaaggaaatccagcgacaacccaaagagaacctccgtcaaaaaggggcacattcagtttgaggcgcataaggacgagcgccgcggaaagatacccgaaaacctgggactaaatttcatcagtggggatattagcgacacgcaggcctctaatgagctctccaggatagcaaactccctcactggctctaatacagctccgggttccttcctgttctccagctgtggcaagaacaccgcaaagaaggagttcgaaacctctaacggtgattcactccttgggctacccgaaggcgccctaatctctaaatgttcccgagagaagaacaaaccccagcgaagcctcgtgtgtgggagcaaggtgaagctgtgctacatcggggccggcgacgaggagaagaggtccgattctatctccatttgtacaacatccgacgacggctcaagcgacctggaccctatcgagcacagttctgaatccgataactctgtgctggaaattcctgatgcttttgacagaactgaaaatatgctgtccatgcaaaagaacgagaaaataaaatactcaagatttgccgccaccaatactagagttaaagcaaagcaaaaacccttgatttccaactcacacacagaccaccttatgggatgcactaaaagcgcagaacctggaacggagacctcccaggtgaatctctccgatctcaaggcttctactctagtgcataagccccagtccgacttcactaatgatgctctctcacccaagttcaatctcagcagtagcatcagctccgaaaactctcttatcaaggggggggccgccaatcaggcattgctccattcaaagagcaaacagcctaaattccgctctataaagtgcaagcacaaggagaaccctgttatggcggagccaccagtaattaacgaagagtgctcactgaagtgttgctcctcagacacaaagggctctcctctcgctagtattagcaagtctggcaaagtcgacgggcttaaacttctcaacaacatgcatgagaagactcgcgattccagcgatatcgagacggccgtggtcaaacatgtcctgtctgagctgaaagagctgtcctacaggagtctgggcgaggatgtcagtgacagcggtacctcaaagccgtctaaaccactcctattttcaagtgcctcgagccaaaaccacatccccattgagccagactataagttcagcaccctacttatgatgttgaaagacatgcacgactcaaagacgaaagaacaaagacttatgaccgcccaaaatttggtgagctataggtccccaggtcgcggagactgttctacaaactctcctgtaggcgtaagcaaggtgctcgtttctggggggagcacccacaatagcgagaagaagggggatgggactcagaatagcgctaacccctcgcctagcggaggggatagcgccctttcgggggagctgtccgcctctctgccagggcttctctctgataagagagatctacctgcttctggtaagagccggagcgactgtgtgacgcgcagaaattgcgggaggtctaagccatcctccaagctcagggacgccttctctgctcaaatggtaaagaataccgtcaaccggaaagctctgaagactgagagaaaacggaaactcaatcagttgcctagcgtgactctcgatgctgtgcttcaaggggaccgcgaaagagggggtagtcttcgcggcggcgcagaggatccctcaaaggaggacccactacagataatgggccatctgacctccgaggatggggatcacttttccgacgtgcacttcgattctaaggtgaagcagagtgatccaggaaagatcagcgagaagggtttgagtttcgagaacggcaagggaccggagctcgattctgtgatgaactcagagaacgatgaacttaacggggtaaatcaagtcgtgcctaagaaaaggtggcagcggctgaatcaaaggcggactaaaccgcggaagcggatgaacaggttcaaggaaaaggaaaatagcgaatgcgctttcagagtgttgttacctagcgaccctgtgcaagagggccgggacgagtttcctgaacaccggactccctcagcatctatactggaagaaccattgaccgagcagaaccacgctgactgtcttgactccgccggcccacgactgaacgtgtgcgataaaagcagcgctagcatcggcgacatggaaaaggagccaggcatcccaagcctgactccacaggctgagctgcctgaacccgctgtcagaagcgaaaagaagcgcctcaggaagcccagtaagtggttgctagagtacaccgaagaatacgatcaaatattcgcacctaaaaagaagcagaaaaaggtgcaggagcaggtgcacaaagtctcatcaaggtgcgaggaagagtccctcctggcccgcgggaggagcagcgcacagaacaagcaggttgacgagaactccttgattagtactaaagaggagccgcccgtgctggaaagggaggctccattcctcgagggaccactcgcacagtccgaactcggaggtggacatgctgagctgccacagctgactctgtctgtgcccgtagcaccagaagtgtccccacgccccgccctggagtccgaggaactgctcgttaagactcctgggaactacgagtccaagaggcagcgaaaaccaacgaaaaaacttctggagagcaatgatctggatcctggatttatgcccaaaaaaggggacctgggtcttagtaaaaagtgttatgaagccggccacctggagaacggtatcactgaatcttgcgccaccagttattccaaggattttggagggggaacaacgaaaatcttcgacaagcctcgcaagcgtaagaggcagcggcatgcagctgcaaagatgcagtgtaaaaaggtgaagaacgacgactctagcaaggaaatcccagggtctgagggagagctgatgccacaccggaccgctaccagtccaaaagaaacagtggaggaaggagtggagcatgatccgggaatgccggcctccaaaaagatgcagggggagaggggaggaggcgctgccctgaaggagaacgtctgccagaattgcgagaagctgggagaattattactttgcgaggcacaatgctgtggcgcctttcatctggaatgcctgggactcactgagatgcctagaggcaagttcatatgtaacgaatgccgtaccgggatccatacttgttttgtctgcaagcagtctggggaagacgtgaagagatgtcttttacccctgtgtgggaagttttaccatgaggaatgtgtgcagaaatacccgcccacggtcatgcaaaacaagggcttcaggtgctctttgcatatctgtataacctgccacgctgcgaacccagccaatgtctccgcatctaaaggtaggttgatgcgctgcgttagatgccccgtcgcttaccacgccaatgatttttgtttggccgctgggagcaagattctcgctagcaattccatcatatgcccaaaccactttactccccggcgaggatgtcgtaaccacgagcatgtcaacgtgtcatggtgctttgtgtgcagtgagggtggtagcctcctctgttgcgactcttgtcctgctgcatttcatagagagtgcttaaacatcgatattccagagggtaactggtattgtaatgactgcaaagcgggcaaaaagccgcactatcgcgaaatcgtgtgggtgaaagtcggtagataccgatggtggcccgccgaaatatgtcacccacgagccgtgccttcaaacattgataaaatgcgacacgacgtaggagaattccctgtgctattcttcggaagcaacgattacctatggactcaccaggcccgggtctttccctacatggaaggagacgtttcaagcaaagacaagatgggaaaaggtgtcgacggcacatacaaaaaggcgctacaggaggccgccgcgcggttcgaggagctaaaagctcagaaggagctgcgccaactgcaggaagaccgcaaaaatgacaaaaaaccacctccatataaacatatcaaagtgaataggcccattggaagagtgcagatttttaccgctgatttgtccgaaatacctcgatgtaattgtaaggcgaccgacgagaacccatgcggcatcgactcggaatgtattaataggatgcttctctatgaatgtcacccaacagtgtgccctgcgggagggaggtgccaaaatcagtgcttctccaagagacaatatccggaggttgagattttcaggacacttcagagaggttggggcctccggactaagaccgatattaagaaaggggagttcgttaacgagtatgtgggcgagctgatcgatgaggaagaatgtcgtgcgcggattaggtatgctcaagagcacgacataactaacttctatatgcttaccctggacaaagatcggattatcgatgccggtcccaaagggaattatgccaggttcatgaatcattgttgccaacctaactgcgaaacccagaaatggagtgtgaatggggatacacgggtgggactgtttgcactgagcgatatcaaagcagggacagagttaactttcaattataatctcgaatgtctgggcaacgggaaaaccgtgtgcaaatgcggggcccccaattgctcaggcttcctgggagtgaggcctaaaaatcaacccatcgcaactgaagaaaaatcaaagaagtttaaaaagaagcaacaggggaagcgaaggacacagggagagatcactaaggagagggaagatgaatgtttctcttgcggcgatgccggccagttagtctcctgcaagaagcccggctgtccaaaggtgtaccacgccgattgtcttaatctcaccaaacgcccggccggaaagtgggaatgcccttggcaccagtgtgacatttgcgggaaagaagccgctagtttttgcgagatgtgtcccagctccttctgtaagcagcacagggagggaatgctttttatctcaaagctggatggccggctgtcttgtaccgagcatgacccttgtggccccaaccctctagaacctggcgaaatcagagaatacgtgccaccacccgtgcctctgccccctggaccttccacacatctcgccgaacagagcacaggtatggcggctcaagcgccaaagatgtcagacaagccccccgctgatacaaaccagatgttatcattgtccaagaaagcgctggccgggacctgtcagcgcccactactgccagagcgccccctcgagcgaaccgacagtaggcctcagcccctggataaggtgagggatctggcggggtcaggcacaaaaagccaaagtctggtctcaagccagagaccactcgaccgccccccggcagtggctgggcctcggccacagctctcagataaaccgagtcccgtcacttctcccagctcctccccgagcgtcaggagccaacctttggagagaccacttggcactgccgaccccagattagacaagtcgataggagctgcatctccacggcctcaaagcctggagaaaacatctgttccaacaggattacgcctgccccctccagaccggcttctcatcactagttcccctaagcctcagaccagcgatcgtcccacagataagccacatgcgagcttgagtcagaggttaccacctcccgaaaaagtgctcagcgccgtggtgcaaacccttgttgccaaggagaaagcgctccggccagtggatcagaatactcagtcaaaaaatagagccgcgctggtcatggaccttattgatttgacaccacgccaaaaggagcgtgccgcgtcaccacaccaagttactccccaggccgatgaaaaaatgcctgtactggagtcgtcctcttggcccgcgtctaagggcctgggacacatgcctagggccgtggagaagggttgtgtatccgaccctttgcagacaagcggcaaggcagccgcccccagcgaggacccctggcaggcagttaaatctttgacccaggcccgcttgttgtcacaaccccccgctaaggccttcttgtacgagccaacaacccaagcctcaggccgcgcgtcggcgggtgcagaacaaacccctggacccctgtctcagagccccggtctggtcaaacaagccaaacagatggtgggcggccagcagcttccagcattagcagccaagagtggccaatcattcagatccctaggcaaggcaccggctagcctgccaactgaagagaaaaagcttgtgactactgaacagtctccctgggcgttggggaaagcaagctcaagggcaggactgtggcctattgtcgccggtcagacactggctcagtcatgctggtccgcaggctccactcagacactagcacagacatgctggagtctgggccgtgggcaggaccccaagcccgaacagaacactttaccagccttaaaccaggcaccctccagccataaatgcgccgaatccgaacagaaatag

SEQ ID NO: 197674 - DNA, 7284 bp, Artificial Sequence
  Description of Artificial Sequence: Synthetic coding sequence
atgcccctgaagacccggaccgccctgagcgacgaccccgacagctccacatccacactcggtaatatgctggaactacccggaacatcctcttccagtaccagccaggaacttccattttgccagccaaaaaagaagagtaccccgttgaaatatgaggtgggcgatctgatttgggccaagttcaagcggaggccttggtggccctgccgtatctgcagcgatccccttataaacactcattccaagatgaaggtttcaaatcgaaggccctacagacagtactacgtcgaggcctttggcgacccttcagagcgcgcctgggttgcgggaaaggcaattgtgatgtttgagggaaggcaccagttcgaagagctgccagtgctgcgcagaaggggcaaacaaaaagagaagggctaccgtcacaaggtgccccaaaagatattgagcaagtgggaggcaagcgtcggactggccgaacagtacgatgttcccaagggttccaaaaaccgaaagtgtatacccgggtccataaagcttgattccgaagaagatatgccattcgaggactgtactaatgatcctgaaagcgaacacgatttgctgctgaacggatgtctgaaatctctcgcctttgattcagaacactctgctgacgagaaggaaaagccttgtgccaaatctagagccagaaaatcctctgacaatcctaagcggacaagcgtcaagaaaggccatatacagtttgaggctcacaaagacgaacgacgtggaaagatacctgaaaatttgggactgaactttatctccggcgacatcagtgacacccaggcctctaacgagctttctaggattgcaaactcactcaccggaagcaacacagccccaggttcgtttctatttagcagctgcggaaaaaatacagccaaaaaggagttcgaaacttctaacggagacagtctgttaggccttcctgagggcgcactgatctctaagtgctcacgggagaaaaataaaccccagcggtctctggtttgtgggtctaaagtgaagctgtgctacataggggccggagatgaagagaagcgctccgattcaattagtatctgtactacttccgatgacggcagcagtgacctcgatcctattgagcactctagcgagtcagataacagtgtgttagagatacctgatgctttcgacaggacggagaacatgctgtctatgcagaagaacgagaagatcaagtactccaggttcgctgctacaaacactagggtaaaggctaagcagaaacctcttatcagtaactctcatactgaccacctcatgggctgcaccaaatctgctgagccgggaacagagacatcgcaagtaaacttaagcgatctcaaagcaagcacactcgtgcacaagccacaatctgacttcactaacgatgctctgtccccgaaatttaacctctcgtcctctatcagtagtgaaaattctcttatcaaaggcggggccgccaaccaagcgctgctgcacagtaagtcaaaacagcctaagttccgtagcatcaagtgcaagcacaaggaaaaccctgtgatggccgagccaccagtgatcaacgaggaatgcagtctgaaatgttgttccagcgatactaagggctccccactcgcctctataagcaaatcggggaaagtggacgggctgaagctccttaacaacatgcacgagaagaccagggattccagcgatattgagaccgccgtagttaagcacgtactctctgagctgaaggaattgagttaccgttctctaggcgaagacgtgtcggattccgggacgagcaaaccctcgaagccacttttgttttcaagtgcatcgagccagaatcacattccgatagagcccgattacaagttttcaacactgctgatgatgctgaaggatatgcacgactccaaaacgaaagagcaaagactgatgactgcccagaatctggtgtcttatcgctcccccgggcgaggtgactgttctacgaatagcccagtcggagtcagtaaggtgctcgtgagtggcggaagtacacataattcggagaaaaagggcgatggaactcagaattcagcgaatccgtctccttcgggcggcgacagtgcactctcaggagaactgagcgcctctctgcctggacttctgtctgacaaacgggacctgcctgcttctggcaaatccaggtctgactgcgttactaggcgtaactgtgggagaagtaagccatcctcaaagctcagggatgcattttctgcccagatggtgaagaacactgttaacaggaaggctctgaagaccgaaagaaaaaggaaactgaatcagcttccttcagtgactctcgacgccgttcttcaaggcgatcgggaacgtgggggctccttgcggggcggtgcggaggacccctccaaggaagaccctcttcagatcatgggtcatctgacatcagaggatggcgaccatttctcagacgtccactttgattccaaggtaaaacagtcagaccccggaaagatcagcgaaaaggggttgagcttcgagaacggcaagggccccgagctggattccgtgatgaattctgagaacgatgagcttaacggcgtgaaccaggtcgttccaaagaagcgctggcagcgtctaaatcagagaaggaccaaacctcggaaaagaatgaatagattcaaggaaaaggagaatagcgagtgtgcattccgtgtgcttctgcccagtgaccccgtccaggagggcagggacgagtttcccgaacaccggacaccctccgctagcattctggaagagccactcacagaacaaaaccatgccgactgcttggattcagccggtcctcgtctgaacgtctgcgacaagtcaagcgccagcattggtgacatggagaaggagccaggcattccatccctgacccctcaggccgaattacctgagccagcagtccgtagtgaaaaaaaacggctgaggaaaccctccaaatggctgctcgaatacacggaggaatacgaccagatcttcgcaccaaagaagaagcagaaaaaggttcaagagcaggttcacaaggtgtcatctcggtgtgaggaggagagcttgctggcaagagggcgcagcagcgcgcagaacaagcaggtcgatgaaaacagtctcattagtacaaaggaggagcctcctgtgctggagcgcgaagcgccgttcttggaggggcccctcgcgcagtcggagctcggcggaggacatgccgagctcccacaattgacattgtccgttccagtggccccggaggtcagccctaggcctgcgcttgagagtgaggagctcctcgtcaagactccagggaactatgagtcaaaaagacagcgcaaaccgacaaaaaagctgctggaatctaacgacctggatcctgggttcatgcctaagaagggagatcttggattgtccaaaaaatgctatgaggctggacacctggagaacggcattaccgagagctgtgccacaagctactccaaggactttggtggaggcacaacgaaaattttcgataagccccggaaacggaagaggcagaggcatgcagctgctaaaatgcaatgcaagaaggtgaaaaacgatgactcatctaaggagatccccggatcagagggtgagctgatgccacaccggacggcaacttctcccaaggaaactgtcgaggaaggggtcgaacatgaccccggtatgccggcttctaagaagatgcagggagaaagaggcggaggggccgctctaaaagaaaacgtgtgtcagaattgtgagaagctaggggagctgctcctctgtgaggcccaatgttgtggcgcattccacctggaatgtctcggacttacagaaatgcccagagggaaatttatttgtaatgagtgtagaaccgggatccatacgtgctttgtctgcaagcagagcggcgaggacgtcaagcgctgtctgctacccctatgtggcaagttttaccatgaagaatgtgtccaaaagtatccgcctacagtcatgcaaaacaagggctttcgctgttctctgcacatctgcatcacctgccatgcagccaaccctgcaaatgtgagcgcttccaaggggaggttaatgagatgcgtccgctgccctgttgcataccatgcaaatgatttctgcctcgcggctggatctaagattttggcttccaattctatcatttgccccaaccactttacccctcgtcgagggtgcaggaaccacgaacatgtaaacgttagttggtgttttgtgtgctccgagggaggatcgttactatgctgcgacagttgtccagccgcttttcaccgggaatgtcttaacatcgatatcccagaaggtaactggtactgtaatgattgcaaggcaggcaaaaagccccattatcgggaaattgtgtgggttaaagtgggccgctacagatggtggcctgccgaaatttgccaccccagggcagtgccttccaacatcgataaaatgcgacacgatgttggcgagttccccgtgttgttttttggatccaacgactatctgtggacgcaccaggccagagtgtttccatacatggaaggtgatgtgagttcaaaagacaaaatggggaagggcgtagacggcacctataaaaaggctctgcaagaggcagccgcaaggtttgaagaactgaaagcccaaaaggagttgcggcagctgcaggaagatcgtaagaacgataagaaaccaccaccgtataagcacatcaaagtaaatcggcccattgggcgcgtccaaatttttaccgccgatctgagtgaaatcccccggtgcaactgcaaagctaccgacgaaaacccctgcggcattgattccgagtgtataaatcggatgctcctctatgagtgtcaccccactgtttgtccggctggcggaaggtgtcagaaccaatgtttctctaaaagacagtaccctgaagtggaaatatttcgcaccctgcagcgaggttggggcctgagaacaaaaaccgacatcaaaaaaggagaattcgtgaacgagtatgtcggggagctgattgatgaggaggagtgcagagcgcggatccgatacgcacaggagcatgatattaccaatttttatatgctcacccttgataaagaccggatcattgatgccggccctaaaggcaattacgcacggttcatgaaccactgttgccagcccaattgcgaaacacagaaatggtccgtgaacggtgatactcgggttggcctgttcgccctcagtgatattaaggccggcacagagctgacttttaactacaacctcgaatgtcttgggaatggcaaaactgtttgtaaatgtggagcgccgaactgcagtgggttcctcggggtgcgaccaaaaaaccagcctatcgcgaccgaggaaaaatctaaaaaatttaaaaagaagcagcaggggaaacgacgaacccaaggcgagatcactaaagagagagaagatgaatgtttctcttgcggcgatgcgggccaattggtatcttgcaaaaagcccggctgtccaaaggtttatcatgcggactgtctgaacctgacgaaaaggcctgcaggtaaatgggaatgcccctggcatcaatgcgatatatgtggaaaagaagcagcctctttttgcgagatgtgtccatccagcttctgcaaacagcaccgcgagggaatgctattcattagcaagctagatggtagactgagttgcacagagcatgatccttgcggcccgaaccctctagaacctggagagatccgtgagtatgtgccgccccccgtgccattaccccccgggccttccacccacctcgcagagcagtctacaggaatggcagcgcaagcgcccaagatgtccgacaagccccccgcagatacaaaccagatgctatcattgtcgaagaaggctttagccggcacatgccaacgtccactgctcccagagcggccactagaaaggacagacagcaggccccagcccttggacaaggtgagggacttggcaggaagcggtacgaaatcccaatcactggtttcctctcagaggcccttggaccgacctcccgcggtggccgggcctcgacctcagctcagcgacaaaccttccccagttaccagtcctagttcttcaccatccgtcagatcacagcccctcgagaggcctcttggaacagccgaccctcgcctggataagtccataggagctgcatccccccggccccagagtttggagaagacctccgttcccaccggcctgagacttcctccaccagacagactgttaatcacaagctcaccaaaacctcagacgagcgatagacctacagataagcctcacgcttccttaagtcagaggttacctccgcccgagaaggtgctttcagcggtggtgcagaccttggtcgctaaagaaaaggccctgaggcccgtcgatcagaatactcaatccaaaaacagggccgcactggtaatggatctcattgacctgacgcctcggcagaaagagcgggcagcttccccacatcaggtgacacctcaggccgatgaaaagatgcctgtgctcgaaagcagttcctggcctgcttcgaagggtcttggtcacatgccccgggctgtagaaaagggctgcgtgtctgaccctctccaaaccagcggaaaagccgccgcaccttcagaagacccctggcaggcggtgaaaagcctaacccaggcaagactgttgtcacagcccccggccaaggcttttctatacgaacctacgacacaggccagcggccgtgcgtccgccggcgcagagcaaactccagggccgctctcccaatctcccggactcgtgaaacaggcaaagcagatggtcggaggccagcaattgcccgcactggccgctaagagtggccagtcattccggtcgttagggaaagccccagcttccttaccaactgaggagaagaagctagtgactacagaacaatcaccctgggctctggggaaagcctcaagcagggcaggactctggcctatcgtagccggtcagactttagcccagagctgttggtccgcagggtctacgcagactctcgcccagacctgctggtcccttggacgcgggcaggaccctaagcctgagcagaacactcttccagcactgaaccaggccccatccagccataaatgcgccgagtccgagcagaagtag

SEQ ID NO: 197675 - DNA, 1692 bp, Artificial Sequence
  Description of Artificial Sequence: Synthetic coding sequence
atgcccctgaagacccggaccgccctgagcgacgaccccgacagcagcacctccactctgggtaatatgctggaactgcccggcaccagcagctcaagtactagccaggaactcccattctgccagcccaagaaaaaatcaaccccactgaagtatgaagtaggcgatctcatatgggcgaagtttaagcgacggccttggtggccatgtaggatctgcagcgacccgctcataaacacacattccaaaatgaaggtgtccaaccgccgaccatatagacagtactacgtggaagccttcggcgacccatctgagagggcttgggtagctggtaaagctattgtgatgttcgaaggcaggcaccagttcgaggaactaccagtgctgagacgaaggggcaaacagaaggagaaaggatataggcataaggtgcctcaaaaaatcctgagtaagtgggaggcatccgtcggcctggcagaacaatatgatgtccctaaaggttccaagaatagaaaatgtattcccggcagcatcaaactcgacagcgaagaagacatgccctttgaggactgcactaacgatccggagagtgaacatgatctgctgttgaatgggtgcctgaagtcgctggcttttgattctgaacattcggccgacgaaaaggagaagccttgtgccaagagccgcgcaaggaaaagcagcgacaacccgaaacggacatccgtgaagaaggggcacattcaatttgaggcccacaaggatgagcgcaggggcaagattcccgaaaatctcggtctgaattttatctctggtgacatatccgacacccaggcttctaatgagctcagtcggatcgcaaatagtctgacaggttctaatacagcccctgggagctttctattctcctcctgcgggaaaaatacagcgaaaaaagagtttgaaacgagcaacggagatagcctgttaggacttccagagggggcgctaatatccaaatgttcaagggagaagaacaaaccacagcgatcgctcgtatgtggtagcaaagtgaagttatgctacatcggagccggcgacgaggagaaacgcagtgattctatcagcatctgtaccacaagcgacgatggcagctccgatttagatcccattgagcattcctccgaatcagataactctgtacttgaaatcccggacgcgtttgatcgcacggagaacatgttgtccatgcagaagaacgagaagataaaatacagtcggttcgcagccactaacacccgggtgaaagccaaacagaaacccctgatttccaatagtcacactgaccacctcatgggctgcactaaatctgcagagcccggcacagaaacatctcaggttaatctgagcgacctgaaagccagtactttagtgcacaagccccaaagtgactttaccaatgatgctctgtcaccgaaattcaacctctcatcatcaatcagcagtgagaactctttaattaagggaggggcggcaaaccaggcacttctccattcaaaatccaagcaaccaaaatttcggtctatcaagtgtaaacataaagaaaaccccgtcatggctgaacctcccgtgatcaacgaggaatgctcccttaaatgttgtagttctgataccaaagggtcaccactggccagcatatccaagacgcccccttag

SEQ ID NO: 197676 - DNA, 7782 bp, Artificial Sequence
  Description of Artificial Sequence: Synthetic coding sequence
atggaccagacctgcgagctgccccggcggaactgcctgctgcccttttccaatccagtcaacctggatgctccagaggataaggactccccattcggaaatggtcagagcaacttttccgagcccctcaacgggtgcactatgcagctgagcaccgtttctgggacctcccagaacgcctatgggcaggactcaccaagctgctacattcccctgcggcggctccaggacctcgcatctatgattaatgtagaatacttaaacggatcagcagacggtagtgagtcttttcaggaccccgaaaagtcagattctcgagctcagacacccatcgtttgcacgagcttgtcccccggtggaccaaccgctttggcaatgaaacaggagcccagttgtaataacagccctgagttgcaagttaaggttaccaaaactatcaagaacggtttcctgcacttcgagaacttcacatgtgtggacgatgccgatgtggacagcgagatggaccctgagcagcccgtgacagaggacgagagcatcgaagaaatttttgaagagactcaaacaaatgccacatgtaactacgagacaaagagcgagaatggtgttaaggtggctatgggctctgaacaggactccacacccgagtcaagacacggcgcagttaagtctccctttttgcccctcgcccctcaaacagagacgcagaaaaataagcaacgaaatgaggtcgacgggagcaacgagaaagcagcccttcttcctgcccctttttctctgggggacaccaatatcacaatcgaggagcagctgaattccatcaatctgagtttccaggacgacccggatagctcaacctcgactcttggcaatatgctggaactaccaggcacttcatcaagttcaacaagccaggagctgccgttcgtcccacagaaaatcctgtccaagtgggaagcctctgtgggattagctgagcagtacgacgtgcccaaaggaagtaaaaacaggaaatgcattcctgggagtatcaaactggatagtgaggaagatatgccttttgaggattgcacgaacgaccccgagagcgagcatgaccttctgctcaatggatgcctgaaaagtctggcctttgactctgagcattctgccgacgagaaagagaaaccatgtgcaaaatcccgcgcacggaaaagctctgataatcccaagaggacttccgttaagaaaggacacattcagtttgaggctcacaaggatgaaagaagaggcaagattccagaaaatcttggactgaactttatttcgggcgacatctctgacacgcaggcttccaacgagctgtcccgaattgcaaactccctcactgggagcaacacggctcctggcagcttcctattcagctcttgtggaaagaacaccgccaagaaggaatttgaaaccagcaacggggacagtttgttagggcttccggagggggcactgatctccaagtgcagccgtgagaagaataagccacagcggtccctggtgtgtggctctaaggttaagctatgttatattggggctggggacgaggaaaagaggagcgactcaatatcaatttgtaccacctccgatgatggcagtagtgaccttgaccccattgagcattcgtccgaaagcgacaatagtgttttagaaattccagacgccttcgatagaactgagaatatgctcagcatgcagaagaacgagaaaatcaaatactcccgctttgccgccactaatacaagagttaaagccaaacaaaagccattgattagtaattctcacacagatcatcttatgggctgtaccaaaagtgccgaacctggaaccgagactagccaggtgaatctctcggatctgaaggccagtacccttgtgcacaagccgcagagcgatttcacaaacgatgcactgagcccaaagttcaatctgtctagtagcatctcctccgagaattctctcatcaaggggggagctgctaaccaggccctgctccacagcaagagcaagcagcctaagttccgttccattaagtgcaagcataaggaaaaccctgtcatggctgaacccccagtaatcaacgaggaatgctccctgaagtgttgcagcagtgataccaagggcagtcccctggcctcgatttccaagtctggaaaagtggatggtctcaagcttctgaataatatgcacgagaagacccgggactccagcgatatcgaaacagcagtggtgaaacacgtactgtccgaactaaaagaactaagctaccggtccctgggggaagacgtgagcgactcagggacatctaagccaagtaagccactgcttttctccagtgcttcttcacagaatcatattcccattgaacctgactataaattctctacccttctgatgatgctgaaggatatgcatgattctaagaccaaagagcagaggctgatgacagcccagaatcttgtgagctacagaagtccgggtaggggagattgctcaacaaactctcccgtaggcgtgagcaaggtactggtatccggggggagtacccacaattcagagaagaagggtgacgggacgcagaattccgctaacccgtctcctagcgggggcgattccgccctctcgggcgaactgtccgcctcgctgcccggattactctcagacaaaagagatctcccggcaagcgggaagagcagaagtgattgcgtcacccgtagaaattgtggacgcagcaagcctagttccaagttaagggatgcattctctgcgcagatggtaaagaacactgtcaatcggaaagccctgaaaactgaaaggaagagaaagctcaatcaactgccatcggtcactttggatgccgttttgcagggcgatcgcgagaggggcgggtcgctgaggggcggcgctgaagacccttcgaaggaggacccgctgcagataatgggccatcttaccagcgaggatggggatcacttttcagatgtgcatttcgatagcaaagttaagcagtcggatccaggaaagatcagtgaaaaaggtctatctttcgagaacggcaaagggcccgagcttgattccgtcatgaacagtgagaacgatgagttgaacggcgtcaaccaagtcgtgcccaaaaagagatggcaaagattaaaccagaggagaactaagcctcggaagagaatgaataggttcaaggagaaggaaaattcagagtgcgcatttagagtgctgctcccaagcgatccagttcaagaaggacgcgacgagtttcccgaacatcgcactccctcagcatctatcctggaagaacccttaacagagcagaatcacgccgactgtctcgatagtgccggaccccgcctgaacgtttgcgataagagtagcgcgtccatcggggatatggagaaggagccaggcatcccctccctgacaccccaggcagaactgcctgaaccagctgttcggagtgagaaaaagcggttgagaaaaccgagcaagtggctgctcgagtacacggaagagtatgatcagatattcgcccccaagaagaagcagaaaaaggtgcaagaacaggtgcacaaggtgtcttctcggtgcgaggaggagtctctgctggccagaggtagatccagcgctcagaataaacaggtagatgagaactctttaatctctacgaaagaagaaccacccgtcctggaacgtgaagcccctttccttgaagggcctctggcacagagcgagttgggaggcggacatgcagagttgccgcagctgacgcttagtgtgcctgtagcacctgaggtgagccccaggcccgcactggagtctgaggagctgctcgttaagactccaggcaattacgagtccaaacgacaacggaagccaacaaaaaaactacttgaatctaatgatctcgatcccggcttcatgcccaagaagggagacctcggactgagtaagaagtgttacgaggccgggcatctagagaacggcataaccgaaagttgtgcaacctcatacagcaaggacttcggagggggaactacaaagatatttgataaaccacgcaaaagaaagagacaacggcacgccgccgctaaaatgcagtgcaaaaaagtgaagaacgatgattcctccaaagaaatacctggaagtgagggggaactgatgccacacaggacagcaacgtcccccaaggagaccgtggaggaaggcgtcgagcatgatcctggcatgcccgcttcgaagaaaatgcagggggagagaggcggcggagccgctctgaaagaaaatgtttgtcagaactgcgaaaagttgggggagttgttactgtgtgaggcacagtgctgcggggctttccatttggagtgcctgggcttaacagagatgcctagaggaaaatttatctgcaatgagtgtagaacgggcatccacacgtgttttgtctgtaagcagagtggggaagacgtaaagcgatgcctgctcccactgtgtggtaaattctatcatgaggaatgcgtgcagaaatacccacccactgtgatgcagaacaaagggttccgttgcagccttcacatctgcattacttgtcatgcagccaaccccgctaatgttagcgcctctaaaggtaggcttatgcgatgtgtccgctgcccagtggcctaccacgctaacgatttctgccttgctgctggtagcaaaatcctcgcatccaatagtatcatctgtccaaaccattttactccccgaaggggctgccgcaaccacgaacacgtgaacgtatcatggtgtttcgtgtgtagcgaaggaggtagcctcctttgttgtgattcttgccctgctgcctttcacagagagtgcctgaacattgatatacctgaagggaattggtactgcaatgattgcaaagccggaaagaagccacattaccgagaaatcgtttgggtaaaagtggggaggtaccgctggtggcccgcagaaatctgccacccaagggccgtgcccagcaatattgacaaaatgaggcacgacgtaggcgaattcccagtgttattcttcggctccaacgactacctatggacccaccaagctagggtgttcccttatatggagggcgacgtgagtagcaaagataagatgggcaagggtgtcgacgggacttacaaaaaagccctgcaggaagccgcagccagatttgaagagctgaaagcccagaaggagctcagacagctacaagaagacagaaagaacgacaagaagccacccccatataaacatattaaggtcaatagacccattggacgggtccagatcttcactgccgatctctcagagatcccaagatgtaactgcaaggctaccgatgagaatccctgtggcattgattccgagtgcatcaatagaatgctactgtatgagtgccacccaactgtgtgtcccgccggaggtcgttgtcaaaaccagtgtttctcaaagagacaatacccggaggtggaaatctttcgaactctgcaacgcgggtggggcctgaggaccaaaacggacattaaaaagggagagtttgttaacgagtatgttggcgagctgattgacgaggaagaatgccgagcgaggattcgttatgcccaggaacatgatatcacgaacttttacatgctaactctcgataaggataggatcattgatgccggccctaaaggcaactatgcacgatttatgaaccactgttgtcagcccaattgcgagacacagaagtggtccgtgaacggcgacacgcgggtgggtctatttgccctcagcgacattaaggccggtaccgagctgaccttcaattacaaccttgagtgcctgggcaatggaaaaacggtgtgtaagtgtggggcccccaactgtagtggcttcctaggagtaaggccaaagaaccagcctattgcgaccgaagagaagtctaagaagtttaagaagaagcaacagggaaagagacgtacccagggagagataacgaaggagagagaagatgaatgtttctcgtgcggtgacgctgggcagctcgtatcctgcaagaaacccggatgtcccaaggtgtaccacgcagactgtcttaacctcacaaagcggccagccggaaagtgggaatgtccatggcatcagtgtgacatctgtggaaaagaagccgcaagcttctgcgagatgtgtcctagcagcttttgcaagcagcaccgcgaggggatgctgttcataagtaagttggacggcaggctttcttgcactgaacacgacccgtgtggccccaacccgctggagccaggcgagatacgcgaatacgttcccccccctgtccccctaccgccaggcccgagcacgcatctggccgagcagagcacaggtatggctgcccaggcgcccaaaatgagtgataagcccccagcagatacgaatcaaatgctgtctctttccaagaaggccctggctggcacctgtcagaggcctttgctgccagagagaccattggagcgcactgactcacgcccccaacctctggacaaggtcagagatctggccgggtctggaactaaatcacagtcactggtgtccagtcagaggcctctggataggccgcccgcagtggctggaccacggccccagttatccgacaagccctctcccgtcacctctccttccagcagtcccagtgtgagatcgcagcctttagagcgacctctgggaacagccgatcccagactcgataagagcataggggcagcttcccctcggccccagtcacttgaaaaaacatcggtccccacaggacttcgcctcccccccccggacagattactgattacttccagtccgaagcctcagacctccgaccgccctaccgataagcctcacgccagcctgtcacaaagactgcctccccctgaaaaggtcctgagcgccgtagtgcaaactctggtggccaaagagaaagcgttgcggcccgtagaccagaacacacagtcaaagaatcgggccgcccttgtgatggatttgatcgatctaactcctcgccagaaggaacgagcagcctcaccacatcaagttacacctcaagccgatgagaagatgcctgtgctagaaagcagcagctggcctgcgtccaagggtttagggcatatgccacgtgctgtggagaagggatgtgtctctgatcctctccagactagtggcaaagcggctgccccctctgaggatccatggcaagccgtaaagagccttacccaagctaggctgctgtcccagcccccagcaaaagcctttctgtacgagccaacgactcaggcttccggcagggcgtcagccggcgccgagcaaacacccggccctctgtctcaaagtcctggtcttgtaaaacaggccaaacagatggtcgggggacaacagttacccgcgctggcagccaagagtgggcagtccttccggtccctggggaaagctcctgcctcactccccaccgaggaaaaaaagcttgtgactacagagcaatctccttgggcactaggaaaggcatccagccgagccgggctgtggccgatcgtggcaggccagacattagcacaatcttgttggagcgctggatccacacagaccctcgcccagacgtgctggagcctcgggcgcggccaggacccaaaaccggagcagaatacactccctgcactgaaccaggccccatcatcccataagtgtgcagagagtgaacagaaatag

SEQ ID NO: 197677 - DNA, 8091 bp, Artificial Sequence
  Description of Artificial Sequence: Synthetic coding sequence
atggaccagacctgcgagctgccccggcggaactgcctgctgccctttagcaatcctgtcaatctggacgcccccgaggacaaagactcacccttcggtaacggccaatccaatttctcggagcctctgaacggctgcaccatgcagttgagcaccgtgagtgggaccagtcagaacgcctacggtcaggactctccttcttgctatattcctctgaggagacttcaggatctggcatctatgatcaatgttgaatatttgaacggctccgcagacggctccgagtctttccaagacccagaaaaatctgacagccgagcccagaccccaattgtctgcacctccttgtctccaggcgggccgaccgccctggcaatgaagcaggaaccgtcatgtaataattccccagagcttcaggtgaaggtcactaagactattaaaaacgggtttctccactttgagaactttacttgcgttgatgacgccgatgtggacagcgagatggatccagaacagcccgtgactgaagacgagtcaattgaggaaatatttgaagaaactcagactaacgccacctgcaattacgaaaccaagtccgaaaatggggtgaaagtggccatgggatcagagcaagactcaactccggagagtcgacacggagctgttaaatccccatttctcccgttggccccacagaccgaaacccagaagaacaaacagagaaacgaggtggacggatctaatgagaaggcggctctccttcccgccccattctcgctgggtgatacgaacattacaatcgaagaacagttgaattccataaatttgtctttccaagatgatcctgattcatctacttctactcttggcaatatgctcgaactccctggaacgtcttcttcttctactagccaggagttaccgttctgccagcctaagaagaagtccacgccactgaaatacgaagtgggcgaccttatctgggcaaagtttaagagacgaccttggtggccctgcaggatatgttcagaccctctcattaatacccattctaagatgaaagtcagtaatagaaggccttaccgacagtattacgtggaggcctttggcgacccatcagaaagagcctgggtggccggtaaggctattgtgatgttcgagggaaggcaccagttcgaggagctcccagtgcttcgtcggagaggaaaacagaaagagaagggctatcggcataaagtgccacagaagatactgagcaagtgggaagcttctgttggactggcagagcagtatgatgtgccgaaggggagtaaaaacagaaaatgtatccccgggtcaatcaagctcgatagtgaagaggatatgcctttcgaagattgtacaaatgaccccgagtcggagcatgatctcctgctcaatggatgtctgaagtcccttgcgttcgatagtgagcactctgcggatgagaaggagaagccctgcgctaagtcacgcgccaggaaaagctccgacaacccaaaacggacgtctgtcaagaaaggacacatccaattcgaagctcataaggatgagaggcgtggtaaaattcccgagaacctcggactcaacttcatctcaggcgatattagcgacactcaggcctccaacgagctgtctcgaatcgccaatagcctgacaggaagcaacaccgcacccggctcgtttttgttctcgtcatgcggaaaaaatactgccaaaaaagagttcgagacatcgaatggagacagtttgctggggctcccagaaggcgcgctgatttcaaaatgttcccgagaaaagaataagccccagcgttctcttgtctgcgggagcaaagtgaaactgtgctatataggggctggtgatgaagagaaacgatcagactcgatctctatatgcaccactagcgatgatggctcctccgatctggatcccatcgagcactcctctgaaagtgacaacagtgtcttagagatcccggacgccttcgatcggaccgagaacatgctttcaatgcagaagaatgagaagatcaaatacagtcgatttgcggccaccaatacacgcgttaaggctaagcagaagcctctgatctccaattctcacactgatcacttgatgggctgcaccaagagcgcggagcccggtaccgagaccagccaggtaaatctctcagatctcaaggcaagtacattagtgcataagccacagagcgacttcaccaacgatgcactatcacctaagtttaatctctctagctccatctcctccgagaattccctgatcaagggcggcgccgcaaatcaggctttgttacattccaaatccaagcaacccaagttcagatcaattaagtgtaaacataaagagaatccagtgatggcagagccccctgtgattaacgaggaatgctccctgaagtgctgtagctccgatacaaagggctcccctctggctagcatttctaaatcagggaaggtcgacgggctaaaactgctcaataacatgcatgagaagacaagagactcatctgatatcgaaaccgctgtggtcaagcacgttcttagcgagcttaaagagctgagctaccgctcccttggcgaagacgtgagcgactcgggtaccagtaagcccagcaagccgctcctttttagctctgctagctcgcagaaccacatccctatcgagccagattataagttttctacgttgctgatgatgctgaaagatatgcatgactccaaaacaaaggaacagagactgatgactgcacaaaatctcgtgagctaccgtagccctggccggggagactgctccaccaactctcctgtgggggtgagcaaggtcctggtgtctgggggttccacccataacagcgaaaagaagggcgatggtacgcagaactcagccaatcctagtccttctggcggcgattctgcgctctccggcgagctcagtgcttcgctgcctggccttctctctgacaaaagggatttaccggccagtgggaagtccagatcagactgtgtgaccagacggaactgcggcaggtctaagccatcttccaaacttcgtgacgctttctctgctcagatggtgaaaaacactgttaatcgaaaagctctaaagactgaacgcaagagaaaacttaaccaactgccttccgtcacattagacgccgtgcttcagggcgaccgcgagcgcggcggctcgctgagaggcggcgccgaggatccatccaaagaggatcccctacagattatgggacatcttacctccgaggacggagaccactttagcgacgtgcattttgatagcaaggtgaaacagtcagaccctggtaagatttccgagaagggactgtccttcgaaaacggcaagggtcctgaacttgattctgtcatgaattcagagaacgacgagctcaacggggtaaaccaagtggtaccaaaaaaacgctggcaaagactaaaccagcggcggactaaaccccgtaaaaggatgaacaggttcaaggagaaggagaattctgaatgtgcttttcgggtcctattgccatcagatcccgtccaagagggcagagacgagtttcctgagcatcgcaccccttcggcttctatactcgaagagccgctcactgaacagaaccacgctgactgcttggactcagcaggccccagacttaacgtttgcgacaaaagctccgcatccataggtgatatggaaaaggagccagggatcccatcactaactccacaggcggagctaccagaaccggctgtgagatccgagaagaagaggctgagaaaaccctcaaagtggctgctcgaatatacagaggaatacgaccagattttcgcccctaaaaagaagcagaaaaaagtccaagagcaggtgcacaaggttagttcacgctgtgaggaggaatctttgctcgcaagaggccgaagctctgcccagaacaagcaggtagatgaaaatagtctgataagcaccaaagaggagccccccgttctcgaaagggaggcgcctttcctggagggcccactggcgcagagtgagctcggcggcggacacgcagaactcccacaacttactttaagcgtgcctgtcgccccagaggtctccccacgacctgctcttgaaagtgaagagcttctggtgaagacaccagggaattacgaatctaaaaggcaaagaaagcccacaaagaagctgttggagagtaatgatctcgatcctggcttcatgccgaaaaagggggatctaggcctgtccaagaaatgctacgaggctggacaccttgagaatggcattaccgagtcttgtgccaccagctatagcaaagattttggtggtgggaccactaaaatcttcgataaaccccggaagcgcaagaggcagagacatgccgctgctaaaatgcagtgtaagaaggtcaagaacgacgactcgagcaaagaaatccctggtagtgagggcgaactgatgccgcaccgtacagccacgtctcctaaggaaacggtcgaggagggcgtcgagcacgaccccggcatgcccgccagcaaaaagatgcaaggtgagcgcggaggtggcgctgcactcaaggagaacgtgtgccagaactgcgagaagctgggggagctcctgctttgcgaggcccagtgctgtggcgcctttcacctcgaatgtctgggcctaactgaaatgcctcgggggaagttcatttgcaacgaatgccgtactggcatccacacctgctttgtttgtaaacaatcaggcgaggatgtcaagcgatgcctattaccactgtgtggaaagttttatcacgaggaatgtgtccagaaatacccccccaccgtgatgcagaataaaggcttcagatgctcactgcacatctgtatcacctgccatgcagccaaccccgcaaatgttagcgcgtctaagggcagactaatgcgttgcgtacgatgccccgttgcctatcacgcaaatgacttttgcctcgctgctggctccaagatccttgcgagcaactccattatttgtcctaatcacttcacaccgcggagaggatgtagaaaccatgaacacgttaatgtctcatggtgctttgtgtgctcggaggggggcagcttattgtgttgtgacagctgtcctgctgcgtttcatcgcgaatgcctgaacatcgatatcccagaaggcaattggtattgtaacgactgtaaagctggtaagaagccgcactatcgtgaaatcgtctgggtcaaagtcgggcgctacagatggtggcctgccgagatttgtcaccccagagcagtcccctccaatatagataagatgagacacgacgttggagaatttcctgtcctgttttttggatccaatgattatctctggactcaccaggcaagggtctttccgtatatggaaggggacgtatctagtaaggataagatgggaaaaggggtggatggcacgtacaagaaggcactccaggaggccgccgcgcggttcgaggaactaaaagcccagaaggaactgcgccagctgcaagaggataggaaaaatgacaaaaaaccaccgccttataagcacatcaaagtgaatcgccctattggacgggttcagattttcactgccgacctctccgagatccctagatgtaactgtaaggccactgacgagaacccctgcggaatagactccgagtgcattaacagaatgttgctgtatgagtgtcacccaactgtgtgtcctgccggcgggagatgccagaaccagtgtttttctaagagacagtaccctgaagtggagatctttcgcaccttacaacggggttggggacttagaacgaaaactgatatcaaaaaaggcgagttcgtgaatgagtacgtcggtgagcttattgatgaggaggagtgcagggcccgcatccgctatgcgcaggaacatgatattacaaatttttacatgctgactctggataaggaccgaattattgacgccgggccaaaaggcaactatgcccgatttatgaaccattgttgccaaccaaattgcgaaacacagaagtggagcgtgaacggggatacccgggtcggcctgtttgccctgtctgacatcaaagccggcactgagctcacatttaactacaatctggagtgtttaggaaacggcaaaacggtctgtaagtgtggcgccccgaactgttccggctttctcggcgtgcggcccaaaaaccaacccattgctaccgaggaaaagtctaaaaaatttaaaaaaaaacagcagggaaagcggcgtactcagggggagatcaccaaggagcgagaagatgagtgtttcagttgtggcgacgccggccagctggtgtcttgcaaaaaacctggatgccccaaggtataccacgccgactgcttgaacttaacgaagaggcccgctggaaagtgggaatgcccttggcatcaatgtgatatctgtgggaaggaggccgcttcattctgtgaaatgtgtccttcctctttctgtaagcaacatagagaaggcatgctcttcatcagcaagctggatggtaggctaagttgcacagaacatgacccatgcggtcctaacccactggagccaggagaaatccgcgagtatgtgccccctcctgtgcccctgccgcccgggcctagcacccatctggccgaacagtctactgggatggctgcccaggctcccaagatgtccgacaagccccccgcagacacaaatcagatgctgagcctgtccaaaaaggccctcgcaggaacatgtcagcggcccctgctccctgagcggcccttagagcgcaccgactctcggcctcagccactagacaaggtgcgtgacctggcagggtccggtaccaagtcacagtcgctggtatctagccagcggcctcttgatcggcctccggctgtggccggccctagaccccaactctcggacaaaccctcgccagtgaccagtcctagctcctccccctccgtgcggagtcagcctctggaacggcctctgggtaccgccgatcccaggctagataagagtattggagctgcttcccctagaccgcaatccctagagaaaacatctgtcccaactgggttgcggctgcctccccctgatagattattgattacaagcagtcccaaaccccagacttccgatagaccgacagacaaaccacacgcctcactcagccagagactccccccaccagagaaggtgctgtccgcagtcgttcaaacccttgtagccaaggagaaggccctgaggcccgtggaccagaatacccaaagcaagaatagggccgccttagtgatggatcttatagacctgaccccacgccagaaggaaagagctgccagtcctcaccaggtcaccccacaagccgacgagaaaatgcctgttttagaatctagttcgtggcccgcttctaagggacttggacacatgccccgtgctgttgaaaaaggttgcgtgtccgaccccctgcaaacttcagggaaagctgccgcaccgtctgaagatccatggcaggcagtcaagtccttaacccaggcccggcttctctcacaaccccctgccaaggcctttctgtacgagcctaccacacaggcttcaggtcgcgcctcggccggcgccgagcaaacgcccggacccctttcccagtcaccaggcctggttaaacaggccaagcagatggtgggtggtcagcaactgcccgccctcgcagccaagtctggacagtctttccggtctctgggcaaggctcctgcctcgctcccgacagaggagaagaagctagtgacaactgaacagtctccgtgggccttgggaaaagcgagttcccgtgccggtctgtggccgatcgtcgcagggcagacacttgcgcagagctgttggagtgctgggtctacgcagacattggcccagacctgttggagccttggacgcgggcaggaccccaagcccgaacagaatactctgccggccctgaatcaggcgccctccagtcacaagtgcgcggagagtgagcagaaatag

SEQ ID NO: 197678 - DNA, 468 bp, Artificial Sequence
  Description of Artificial Sequence: Synthetic coding sequence
atgcccctgaagacccggaccgccctgagcgacgaccccgacagctctaccagcaccctcggcaatatgttggaactgccaggtacgagctcatcctcaacgtctcaggaactacccttctgtcagcctaagaaaaaaagcactccactgaagtatgaggtcggcgacttaatttgggctaagtttaaaagacgcccttggtggccttgccggatttgcagtgatccactgattaacacgcactctaagatgaaggtatccaatcgaaggccatacaggcaatattatgtcgaagcatttggcgatccttctgaacgggcctgggtggcaggcaaagctattgtgatgtttgagggccgccatcagtttgaagagttgcccgttctgaggcggaggggtaaacagaaggagaaggggtaccggcacaaggttccacagaagatactcagcaaatgggaggcttcatag

SEQ ID NO: 197679 - DNA, 375 bp, Artificial Sequence
  Description of Artificial Sequence: Synthetic coding sequence
atgcccctgaagacccggaccgccctgagcgacgaccccgacagctccaccagcaccctgggtaacatgctcgagttgcctggtaccagttcttccagcacctctcaggagcttccattctgtcagcctaaaaaaaagtctacacctctgaaatatgaagtcggcgacctaatttgggcgaagtttaaacgacgaccgtggtggccctgcaggatttgtagtgacccactgatcaacacacactcaaagatgaaggttagtaaccgtcgcccataccgtcagtactacgtcgaagccttcggggaccccagtgagcgtgcttgggtggcaggaaaagcaatcgttatgttcgagggccggcaccaatttgagtag

SEQ ID NO: 197680 - DNA, 4200 bp, Artificial Sequence
  Description of Artificial Sequence: Synthetic coding sequence
atgagcggcctgggcgacagcagcagcgaccccgccaaccccgactcccataagcgcaaaggaagcccctgcgacacgctggcctcgtctacggagaaaagacgacgggaacaggaaaataaatacttagaggagctggctgagttgctttcggcaaatattagcgacattgactccttgagtgtgaagcctgataaatgcaagattctcaaaaagaccgtggatcagattcagttgatgaagcgtatggagcaggagaagtccactaccgatgacgatgtgcaaaaaagcgacatcagcagttccagtcaaggagttatcgaaaaggaaagcctcggacccctgttgctggaagcacttgacgggttcttcttcgtggttaattgcgagggaagaatagtctttgttagcgaaaatgtgacctcttatttaggctacaatcaagaagaacttatgaatacctctgtgtattctatcttgcatgtcggcgaccatgctgaattcgtaaagaatttgctgccaaaaagcctggtgaacggagtgccttggccgcaagaggcaactaggcgcaacagccatacatttaactgccggatgctcatccatcctccagacgagccggggacagaaaatcaggaggcatgccagagatatgaagtgatgcagtgctttacagtgagccagccaaaaagtatacaggaagatggggaagatttccagagttgtctgatctgtatagctagacgtctcccccgccctccagccatcactggcgtggagtcgttcatgactaaacaggacacaactgggaaaatcatatcaattgatacctctagtctgagggcagctggaagaactggatgggaggacctcgttcggaaatgcatttatgcctttttccagccccagggcagagaaccatcatacgcccggcagctatttcaggaagtgatgacccgcggtactgcatctagcccttcttatcgcttcattctaaacgacgggacaatgttgagcgcccacacaaagtgtaagctctgttatcctcagtcccccgacatgcagcctttcatcatggggatacacattatcgatagggagcactccggcctgtctcctcaggatgacactaactcggggatgtccatcccaagagtgaatcccagcgtgaatccttccatcagccccgcccatggcgtggcacgctcatcaacactccccccttcgaactctaacatggtatccacccgcatcaacagacaacagagttctgacttacactcaagtagtcacagtaatagcagtaattcccagggcagctttggctgcagtccaggctcccagatagtcgccaacgtggcactaaatcagggtcaggctagctcccagagttccaacccctccctgaatctgaacaatagcccgatggagggtaccggtatcagcctcgctcagtttatgagcccaagacggcaggtgactagtggactagcgaccaggccccggatgccaaacaacagttttccgcctaatatttccacactgagttcccccgtgggtatgactagttctgcctgcaataataataataggtcttacagcaatatcccagttacgtcactgcaggggatgaacgaaggcccaaataacagtgtcggcttctcagcatcatctcccgtactgcgccagatgagctcacagaattcgccctcacgcttgaatatccagcccgcaaaggccgagtcaaaagataacaaggagattgcgtctatcttgaacgagatgatacagagcgacaatagctcaagcgatggcaagcctctcgactccggcctgctgcataataatgaccggttgagcgacggtgactcaaagtatagccagacaagtcataaactggtgcagctgctgactaccacggctgagcagcagctccgtcacgccgatattgacacgtcctgtaaagatgtgctcagctgtaccggaacatcaaattctgcctccgccaattccagcggtggcagctgtccaagttcccacagctccctgaccgagcgtcacaagatcctgcaccgcctcttgcaagagggtagtcctagtgatattacaaccctctccgtggagcctgacaagaaggattcagcgtcgacttcagtctcggtgaccgggcaggtgcaggggaattcatctataaaactcgaattggacgcaagtaagaaaaaggagtccaaggaccaccaacttctgcgctacttgctcgataaggatgagaaagatctgagatcgacacccaacctgagccttgacgacgtgaaagtcaaggtggagaagaaagagcagatggatccttgtaacaccaacccaactccaatgacaaaacctactccggaagaaatcaaactggaggcccagtctcagtttactgcagatctagaccagtttgaccagctgcttccgacactggagaaggccgctcagctgccaggcttgtgtgagaccgaccgaatggacggagccgtgacttccgtgaccattaaatccgagatccttcctgcctcactccagtccgccacagcacgcccaacatccaggcttaatcggctgccagaattggagctggaagctatcgataaccagtttggacagcccggcaccggcgatcaaatcccctggaccaacaacaccgttacagccataaaccagtcaaaatccgaagatcagtgtatctcaagccagctggacgaattgctttgtccccctacgaccgtagaggggagaaatgacgaaaaggctctcctcgagcaactggtgtcgtttctgagtggcaaagacgaaaccgagctagcagagttggacagagctttaggcatcgacaaacttgtgcaaggtggaggtctcgatgtgttgagtgagcgcttccctccacagcaggctacccctccgttgatcatggaggagcgacccaacttgtacagccagccatattctagcccgtctcctactgctaacttaccatctcctttccagggcatggtccgacagaagccgtctcttggaactatgcccgttcaagtgacacctccccgaggagctttttcaccggggatgggcatgcaaccaagacagacgcttaaccggcccccagctgctcccaatcagttgcgcctgcaactacaacagcggttacagggacagcaacagctgattcaccagaataggcaggccatattgaaccagtttgcagccacggccccagtgggtatcaacatgcgatccggaatgcaacagcagattacgcctcagccccccctgaatgcccaaatgttggcacagcgccagagagaactctattcacaacagcatcgtcaacggcagctcatacagcaacagcgcgcaatgctgatgcgccagcagtcttttgggaacaatctccccccttcttcgggcttgccagttcaaatgggcaatccacgcctcccacagggcgcaccccagcagttcccttaccccccaaactacgggaccaatcctggaacgccgccagctagcacaagccctttctcccagctcgctgccaatcctgaagccagtttagccaaccgcaactccatggtttcccgaggtatgactggtaacattggaggacagttcggcactggaataaaccctcagatgcagcagaatgtttttcagtaccctggcgccggcatggtgccacaaggagaagcgaacttcgccccgagtttgtctcctggtagctctatggtgcctatgcctattcctcccccacagagcagcctgctccaacagacgccgcctgcgtcaggctatcagtccccagatatgaaagcttggcagcagggcgctattggaaataataacgtgttttctcaagccgtccagaaccagcccacaccagcccagcccggcgtttataacaatatgtccatcacagtctctatggcgggcggaaataccaatgtccagaatatgaatcctatgatggctcagatgcagatgtcatccctgcaaatgccaggcatgaacaccgtttgccctgagcagattaatgatccagcgctgcggcacacaggattatattgcaatcagctgtccagcacagacctgcttaagactgaagccgacggcacacaggataaaaaaacagaggaattcttttccgtggtgaccacagattag

SEQ ID NO: 197681 - DNA, 4326 bp, Artificial Sequence
  Description of Artificial Sequence: Synthetic coding sequence
atgagcggcctgggcgacagcagcagcgaccccgccaaccccgacagtcataaacggaagggctcaccctgtgacactctggcttcgtcgacagagaagcgacgccgggagcaggagaataaatatctggaggaactggccgagctgctttctgcgaacattagcgacatagacagccttagcgtaaagcctgacaagtgcaagattctgaagaaaactgtggaccagattcagctgatgaagcggatggagcaggagaaatctaccacagatgacgacgttcaaaaatccgacatctcttcatcgtcccagggggtaattgaaaaggaatctttaggacccctgctgttagaagccttagatggtttcttttttgttgtgaattgtgaggggcgcattgtctttgtgtccgaaaacgtcaccagctatctaggatataatcaagaagaacttatgaacacgtccgtttatagcatactccatgtgggcgatcacgcagagtttgtgaagaacctgcttcctaagagcctggtgaacggcgtgccctggccccaggaagccacccgacgaaatagccacacctttaattgccgcatgctgatacatcccccagacgaacctgggacagagaatcaggaggcctgtcagcgctacgaggtgatgcaatgctttaccgtgtcacaacccaaatccatacaggaggacggcgaggattttcagtcctgcctgatttgtatcgcccgtaggctgccacggccacccgctatcactggggtggagagtttcatgacgaaacaggatacaaccggaaagattatcagcatcgatacatcgtcactgcgagctgcaggaagaacagggtgggaagatctcgtcaggaagtgtatctacgcgtttttccagcctcagggccgagagccctcatacgctcgtcaactgttccaagaggtcatgacccgcgggactgcgagctctccctcctatcgcttcatacttaatgacggcactatgctgagcgcacatactaaatgcaaactctgctatccgcagtctcccgacatgcagcctttcatcatgggtattcatatcattgaccgggagcattcaggcttgtctccccaggacgataccaactccggcatgtccattcctcgggtcaacccgagcgtgaatccatctatctccccagcacatggcgtggctaggagttccacccttcctccatcaaattcaaatatggtgtctacgcggatcaaccgccagcagtccagtgatcttcactccagttctcacagtaattcgagcaactctcaaggctcctttggatgtagcccggggtcgcagattgtagcaaatgtcgccctgaaccagggtcaggctagttcacaatcctctaatccaagtctgaatctgaacaacagtcctatggagggcacaggcatctccctcgcgcagtttatgtcccctaggagacaggtgacttcaggactggccaccagacctagaatgccgaacaacagcttcccccccaacatcagcaccttatcaagccccgtgggcatgacctcctccgcatgcaacaacaacaaccgctcctacagcaatatcccggtgacctctttgcagggaatgaatgaggggccaaacaatagtgtggggtttagtgcctcctccccggtgttaaggcagatgtcaagccagaacagcccgagccgcctgaacattcagcccgcaaaagctgagtccaaagataataaggagatagccagtattctcaacgaaatgatccaatccgacaatagctcctctgatggaaagccactggatagtgggttactccacaacaacgaccgcctatccgacggggactcaaagtatagtcagacaagtcataaactggtgcagctcctgaccacgactgcagaacaacagctcaggcatgcagacatagacacatcttgtaaagacgtcttgagctgcaccgggacctccaatagcgcaagcgccaactcctctggcgggtcatgcccatcaagccattcatccttaaccgagagacacaagatcctacatcgattgcttcaagagggttcaccatctgacatcaccacgctgagcgtagaaccagataaaaaggactccgcttctactagcgtgtccgtcacagggcaagtacaggggaactcaagcattaagctggagctggatgcctccaaaaagaaggagagtaaggatcaccagttattgcgatatctgctagacaaagacgaaaaagatttaaggtcaactccaaacctctcactagacgatgtaaaagttaaagtcgaaaagaaagagcagatggatccctgcaataccaatcccacacccatgaccaaacctacaccggaagaaataaagctggaggcccagagtcagttcacagccgacctcgaccagttcgaccagctccttcctacactcgaaaaggcagcacaattaccagggttgtgcgaaactgatcggatggatggagccgtgacaagcgttactattaaaagcgaaatcctgcctgcaagcctgcaatctgctactgccaggccaacttcacgtcttaatcgcttacccgaacttgaactagaggctattgacaatcagtttggacaacctggcaccggagaccagatcccgtggacaaataataccgtgaccgcaatcaaccaaagcaaatctgaagatcagtgcatcagttcccagctcgacgagcttctttgccccccaacaaccgtggaggggagaaatgatgaaaaggccttgctcgagcagcttgtcagttttctatcaggcaaagatgaaacagagctggctgagctggatcgcgcgctgggaattgacaaattagtgcagggcggcggacttgatgttctgagtgagagattccctcctcaacaggcgaccccacctttaatcatggaggagagaccgaatctctacagccagccatattcatcgccctcaccgacagcaaatctcccctcacctttccagggcatggtccgacaaaaaccatctttaggcacgatgcctgtacaggtaacccccccacgcggggcattcagccccggcatgggcatgcaacctcgccaaacgctgaaccgccctcccgccgcacccaaccaattacggctgcagctgcagcagcgcctccaagggcagcagcaactgattcaccagaaccgccaggccattcttaaccagttcgcggccacggctccagttggtataaatatgcggtctggtatgcagcagcagattacccctcagcctcccctgaacgctcaaatgttggctcagagacaacgcgaactgtactctcaacaacacagacagagacaacttatccagcagcagcgagcaatgttgatgagacagcagtccttcggcaacaacttgcccccctccagcggcttacccgtccagatgggcaacccacggttgccccagggcgcccctcaacagttcccatacccacccaattatgggaccaacccgggcacacccccggcatccacaagccctttctcacaactagcagccaaccccgaggcctcgttagccaaccggaattccatggtatccagaggaatgacagggaacatcggcggccagttcggtacgggcattaatcctcagatgcagcagaacgttttccaataccccggcgctggaatggttcctcagggagaagcgaattttgcacccagcctgtctcctggttcaagtatggtccctatgcccatccctccgccacagagttcgctgttgcagcaaacccctcccgcatctgggtaccagtcccctgacatgaaggcttggcaacagggggcaattggcaacaataatgtgttctcgcaagcagtccaaaaccagcctaccccggcccaacccggcgtctataacaacatgagtatcactgtcagcatggctggcggaaacaccaatgttcagaatatgaaccccatgatggcacagatgcaaatgtctagcctccaaatgcccgggatgaatactgtgtgccccgagcagataaacgatcctgccttacggcatacagggctgtactgcaaccagcttagtagtaccgacttgctaaagacggaggcagatggcacccagcaagttcagcaagttcaggtgtttgccgacgtgcagtgtacggtgaacctcgttggcggagacccatatctcaatcagccagggcccctggggacccagaaacccacttctggaccgcaaaccccccaggctcagcagaagtctctattgcaacagctgcttactgaatag

SEQ ID NO: 197682 - DNA, 4323 bp, Artificial Sequence
  Description of Artificial Sequence: Synthetic coding sequence
atgagcggcctgggcgacagcagcagcgaccccgccaaccccgactcccacaagcgcaagggcagcccgtgcgacactctcgcgtccagtaccgagaagcggaggcgggagcaagagaacaaatatctagaggaactcgccgaattactctccgctaacatttcagatatcgattctctatccgtgaagccagataagtgcaagattttgaagaagacagtggatcagattcagttgatgaagcgtatggaacaagagaagagcactactgatgatgacgtccagaaaagtgacatcagctcctcctctcagggcgttatcgaaaaggagtcgctcggcccccttttactggaagccctggatggattcttcttcgtcgtgaattgcgaagggagaatcgttttcgtgtctgagaatgtcacctcatacctgggatataaccaagaggagctgatgaatacatctgtgtattctatcctccacgtcggcgaccacgccgaattcgtgaagaacctgttacccaaaagtctagtgaacggtgtgccctggccgcaggaggccaccagaaggaactctcacacttttaactgccggatgctgatccatccaccagacgaaccaggaactgaaaaccaggaagcgtgtcaacgatacgaggtgatgcaatgctttactgtttctcagccaaagagcatccaggaagatggagaggattttcaatcttgtctgatatgtatcgccaggaggctaccacgcccccctgctattacaggcgtggagtctttcatgacaaaacaggacacgaccggcaagattatctccattgacacgtcttctcttagagccgccggtcgcaccggctgggaagatttggtgcggaagtgtatatatgcattctttcagccccaaggtagggaaccatcctacgccagacagctgtttcaagaagtgatgactagggggactgcatccagcccctcttatagattcattcttaacgatgggactatgctgtctgcccacactaagtgtaagctgtgctatcctcagtctccagacatgcagccattcatcatgggaatccatattatcgaccgcgagcactctggcctgagcccccaggatgacacaaacagtgggatgtctattccccgcgtgaacccatcagtcaacccttctatcagccctgcccacggggtcgctcggtcatcgactctcccaccatccaacagcaacatggtgtcgacccgcattaacaggcaacagagcagcgacctgcactcaagctcacattccaacagtagcaattcccaaggctcttttgggtgcagcccggggtctcaaattgttgccaacgtggctttgaaccagggccaggctagctcacaatcttctaatccttctttaaacctaaacaactccccaatggagggaacaggaatatcgttggcccagttcatgagtcccaggagacaagtcacatccggcctggccaccagaccaagaatgccaaacaactctttcccaccaaatatttcaactttgagctcacctgttggtatgacttcctccgcatgcaataataacaaccgatcatactccaatattcctgtgacctcccttcagggcatgaacgagggacccaataactccgtcggtttcagtgcttcgtcaccagtgctgcggcaaatgagcagtcagaatagcccctctcgcttgaacatccagccggcaaaagctgagtctaaagacaacaaggaaattgctagcatcctaaacgagatgatccagtcagataactcaagcagcgatggaaagcctttagattccggactgctgcacaataatgaccgcctgtcagatggcgacagtaagtactctcagacctcccacaagctagttcagttgctgacaactacagctgagcagcagctgcgtcacgccgacattgacacctcatgcaaagacgttctttcttgcacgggtacctctaatagcgccagcgctaattcgagtggcggctcttgtccaagctcccatagctcccttaccgagcgacacaaaatcctgcaccggctgctgcaggaaggctccccctctgatattactacgctgagcgtggaacctgacaagaaggactcagcttctacaagcgtttccgtgacaggtcaggtgcagggaaattcttcgattaaattagagttggacgcgtctaaaaaaaaggagtcgaaggatcaccagctgctccgatacttactagacaaggatgaaaaggatctccgatcgacacctaatctgtcactggacgacgttaaggtgaaggttgagaagaaggagcagatggacccctgcaatacgaatcccaccccgatgaccaagcccacccccgaagagataaagctggaggcccaaagtcaattcacagccgacctggatcagtttgaccagctattgccgaccctcgaaaaggctgctcagctgcctgggctctgcgagaccgaccgcatggacggggccgtgacatcagtcacaatcaagtcagaaattttacccgctagccttcagtcggccactgccaggcccacgagtcgcttgaacagactgcctgagctggagctcgaagctatcgacaaccagttcggccagcccgggacgggcgatcagatcccatggactaacaatacggtgacggcaattaatcagtccaagtcagaggaccaatgtatcagtagccaactagatgaactactatgccctcccaccactgtggaggggaggaatgatgagaaggctctgttggaacaactggtttcattcctgtccggaaaagatgaaactgagcttgccgagttagacagggctctggggatagacaagttggtccagggcggcggtcttgatgtgctctccgagcgtttcccaccgcaacaggccacaccgccactgattatggaggagaggccaaatctgtactctcaaccctattccagtccatcgcccacagctaatcttccaagccccttccagggcatggtcagacagaagcccagccttgggactatgccagtgcaggtcacccctcctcgcggcgctttctcgccgggtatggggatgcaaccccgacagacattaaatcggcccccagcagctcccaaccagctgagactccagttacagcagcgcctgcaaggccagcagcaacttatccatcagaataggcaggctattctgaaccagttcgctgcaactgctcccgtgggtatcaatatgcgctcaggcatgcagcagcagattaccccacagcccccactcaacgctcagatgctcgcccagaggcagagagagctctactcccagcaacaccgtcagaggcagcttatccagcaacagagggccatgctcatgaggcaacagtcctttggaaacaacctgccgccctcctctggcctccctgtgcagatgggaaacccacgcctgcctcagggcgcgccgcagcagttcccctatcctcccaactacggcaccaatccaggaaccccgcctgcgtccacctcaccattttcccagcttgccgccaaccccgaagcctccctggcaaacagaaattctatggtgagcagaggaatgactggaaatatcggcggacagtttggtactggtataaatcctcagatgcagcagaacgtgttccagtatcccggagcagggatggtcccacagggagaagcaaacttcgccccatctctctcccccgggagctctatggtgccgatgccaataccacccccgcagagcagccttttgcagcaaacacccccggcctcaggttaccagtcccccgacatgaaagcttggcagcagggagctatcgggaataacaatgtcttttctcaagcagtgcaaaaccagccaacccccgcacaacccggagtatataataacatgtctattacagtctcaatggcgggggggaacaccaacgtgcagaacatgaaccccatgatggcacagatgcagatgtccagcctgcaaatgcccgggatgaatacagtgtgccccgaacagattaacgatccagccctacgacatacagggctctactgcaaccagctttcatccacagacctgcttaaaactgaggcagacggaacccaggtgcagcaggtgcaggtgttcgcagacgtgcagtgcacagtcaatttggtggggggggatccatacctgaaccagccggggccactggggactcaaaaaccgaccagcggccctcaaactccccaggcccagcaaaaatctctgctgcagcaactgcttacggagtag

SEQ ID NO: 197683 - DNA, 4200 bp, Artificial Sequence
  Description of Artificial Sequence: Synthetic coding sequence
atgagcggcctgggcgacagcagcagcgaccccgccaaccccgacagtcacaagcgcaagggttcaccttgtgacactttagcaagttctactgagaaacggagacgcgagcaggagaacaagtatctggaggaactcgccgaattactgagtgcaaacattagcgacatcgattctctatccgttaagccagacaagtgcaaaattctgaagaaaactgtggaccaaattcagctgatgaagcggatggagcaggagaaaagtaccactgacgatgacgtacagaaatccgatatctcttcgtctagtcaaggcgtgatcgagaaagagtcccttggcccacttctgctcgaagcgctggatggctttttctttgtcgttaattgtgaaggaaggatcgtgttcgtttccgaaaacgtgacaagctatttaggctataaccaagaggaacttatgaatacaagcgtgtattccatactgcatgtaggcgaccacgctgaattcgtcaaaaacctgttgcccaagagcctggtgaatggtgtgccgtggccgcaggaggctacaagaaggaactctcacacctttaactgtaggatgttaatacacccacccgacgaacccgggactgagaatcaggaagcctgtcagaggtacgaagtgatgcaatgctttacagttagtcagcctaagtcgatacaagaagacggcgaagacttccagtcttgtctgatctgcatcgctcggcggctccccagacctcctgcaatcacaggagtggagagctttatgacaaaacaggacaccactgggaaaattattagcatagacacctcctcccttagggctgccgggcggacagggtgggaagacttagttcgcaaatgcatatatgcattctttcaaccacaaggaagagagccttcctacgcacgacaattattccaggaggtcatgacgcgaggtacagctagctctccttcctatagatttatcttgaatgacggcacgatgttgtccgcccacactaagtgcaaactgtgctacccacagtccccagacatgcagccgttcataatgggtatccacattatcgatagagagcacagcggcctcagcccccaggacgatactaactcaggaatgtctatccctagagtgaacccctctgtgaacccatcaatcagtccagcgcatggagtcgcaaggtcgagtaccttgcctccctccaacagcaatatggtgtccactaggataaacaggcagcagagctctgatctgcactccagtagtcattccaattcatccaactcacagggtagcttcggatgtagtcccgggagccagatcgtagcaaacgtggcacttaaccagggacaagcctcttctcaatcaagtaacccgtcattgaacctgaacaacagtccaatggaaggaactggcatttcattagcacagtttatgagcccccggcgccaggtaacttcagggctggccactcgccccaggatgcctaacaattcatttccacccaacatcagcacgctgtcgtcgccggtggggatgacatcttccgcatgcaacaacaacaatagaagctatagcaatatccctgtgacctctcttcaaggcatgaacgagggacctaataattcagttggattctcagcctctagcccagtactaagacagatgtcctctcagaactcgccatctagattaaacatacagcctgctaaagctgagtccaaagacaataaggaaattgcctcaattctaaatgaaatgattcagtcagacaattcctcatcagatggaaagccactggattccggactgctgcataataatgaccgccttagcgacggggacagtaaatacagtcagacgtcccacaaattagttcagctcctgactacaactgctgaacagcaacttcgacacgccgatatcgatacatcatgtaaagatgtgttgagttgcacgggaaccagtaacagcgcgagcgcgaattcttccggcggcagctgtcctagcagtcattcttccctgaccgagcgacataagattttgcacagactgttgcaagagggaagcccttctgacatcaccacactctcagtcgaaccagataaaaaggattctgcctccaccagcgtttctgtgaccggccaggtccagggaaactcttctataaagctggaacttgacgcatccaaaaagaaggagtcaaaggaccaccagctgttacgatacttactagataaagatgagaaagatctcagatcaacccccaacttgagcctggacgacgtgaaggtgaaagttgagaaaaaagagcaaatggacccatgtaacaccaaccccactccaatgaccaagccaactcctgaggaaatcaagctggaagctcagagccagttcacggccgacttggatcaatttgatcagctgttgccaaccctggagaaggctgctcagcttcctggcctctgtgaaacagaccgaatggacggcgccgttaccagcgtgacaattaagtctgagattctccccgcaagtctccagtcagctaccgcccggccgacatcgaggcttaatcgtctccccgagctggaactcgaagcgatcgacaaccagttcggccagcccggtacaggggatcagatcccctggaccaacaatacagtaactgccatcaaccagtctaagtctgaggaccagtgcatttcttcccagcttgacgagctgctctgtcctccgacaacagtagagggccggaatgacgagaaagcactattggagcagctggtgtccttcctgagtggcaaagatgagaccgagcttgcagagctggatagagctctgggaattgacaagctcgtccaggggggcggcctagacgtcctttcagaacggtttcctccacagcaggcgacccctcctctgataatggaggagaggcccaatctgtacagccagccctactcctctcctagcccaacagccaatttaccatcccctttccaggggatggtgcggcaaaagccgtccttgggaacaatgcctgtacaggtgacgccaccacgcggggcattttctcctggcatgggcatgcaacccagacagacactgaacaggcctcctgctgctccaaatcagctaagattgcagttgcagcaacgcctgcaaggacagcagcaactgattcatcagaatcgtcaggccattctgaatcagttcgctgccacagcccctgttgggataaacatgagatctgggatgcaacaacagatcaccccccagccaccccttaacgcccagatgctagcacagcgacaacgcgaactatatagccagcagcatcgacagaggcagctgatacaacagcagcgagcaatgctaatgcgccagcagtcctttggaaataatcttcctccctcctctggcttgccagtccagatgggcaatccccgcttgcctcaaggagcaccacagcaattcccatacccgcccaactatgggactaaccctggaaccccccccgcctctacttcgccattttctcaactggctgccaaccccgaggcctctctagccaacaggaacagtatggtgtctcgcggcatgacaggaaatattggtggtcagtttggcaccggtatcaacccccagatgcagcagaatgtgtttcaataccccggcgcaggaatggtgccacagggggaggcgaactttgccccatctcttagtcccggctcatccatggtcccaatgcccattccccctcctcagtccagccttctgcagcaaaccccccccgctagtggatatcaaagtccggacatgaaagcttggcaacaaggggcgatcggcaacaataacgtgttttcgcaagccgtccaaaatcagcctacaccggcccaacccggggtctacaataacatgtctatcacagtctcaatggccggagggaacactaatgtccagaacatgaatcccatgatggctcagatgcagatgtcctctctccaaatgccagggatgaataccgtgtgccccgagcaaatcaacgatccagctctgagacataccgggctttattgtaatcagctgtcctcaaccgaccttctgaagacagaggcagatggaacccaagacaagaaaacagaagaatttttctccgtggtcaccacagattag

SEQ ID NO: 197684 - DNA, 4326 bp, Artificial Sequence
  Description of Artificial Sequence: Synthetic coding sequence
atgagcggcctgggcgacagcagcagcgaccccgccaaccccgactctcataaaaggaagggcagtccatgtgacaccctggcctccagcaccgaaaagcggcggagggagcaggagaataagtatctggaagagctggccgagctgcttagtgccaacatatctgacatagatagcctgagtgttaagccggataagtgcaagattctcaaaaagacagttgaccagattcaattaatgaagagaatggaacaggagaagtctaccaccgacgatgatgttcaaaagtcagacataagcagctcatctcaaggcgtcatcgagaaggaaagtttaggccccctgctactggaggccctcgacggctttttctttgttgtcaactgcgaaggcaggatagtgttcgtttctgagaatgtcacatcctatctggggtataaccaggaagaattaatgaacaccagtgtgtacagtattcttcatgtcggcgaccacgccgagtttgttaaaaatctcttgccaaagtctctggtgaatggcgtgccctggcctcaggaggccaccagacggaactcccatacttttaactgtaggatgctaatccacccacccgacgagcccggtaccgaaaaccaagaggcttgccagcgctacgaggtcatgcagtgttttactgtgagtcagcctaagtctatccaagaagatggtgaggattttcaatcctgtctgatctgcattgctcggcggttgccccgcccacccgccattaccggggtggagtcattcatgacaaagcaagacactacaggtaaaattatctcaatcgatacttctagtctgcgagccgctggacgcaccggatgggaagatcttgtgcgtaaatgcatatacgccttcttccagcctcaagggagggaacctagctatgctcgtcaattgttccaggaagtaatgacgaggggtaccgccagctccccatcctacaggttcattttgaatgacgggacaatgctgagtgcccacaccaagtgtaagctgtgttatccccagagtcccgacatgcagccatttataatgggaattcacatcatcgatagagaacactccggcctgtcaccccaggacgataccaattccggcatgtcaatccctcgcgtgaacccatcggtcaacccatctatttctcctgcacacggtgtcgctcgtagtagtacgcttccgcctagcaacagtaatatggtgtctactaggatcaacaggcagcagtccagcgacctccactcctcctcgcactccaattcctctaatagtcagggatctttcgggtgcagccctggaagccagatcgtcgccaatgtggcactgaatcagggacaggcgtcatcccagtcatccaatccttctctgaacttgaataactcacctatggaggggaccggcatatctctggctcagtttatgtctccgaggcgccaggtgactagcggacttgcaacccgccccagaatgcctaacaattcttttccaccaaatataagtacacttagctccccagtaggaatgacaagcagcgcctgcaataataataacagatcctactccaacattcctgtgacgagcctgcaaggaatgaacgagggccctaacaatagcgtgggcttctccgccagctctccagttcttcgccagatgtcttctcaaaattctccatcaagacttaacattcagccagcaaaagccgagagtaaggataacaaggaaatcgcctctatcttaaacgagatgatccagtcagacaactccagtagtgatggcaagccactggactcaggacttctgcataacaatgaccgactttcggatggagacagcaagtacagtcagacctcccataaactcgttcaactgctgaccaccacagccgagcagcagctgcggcacgcagatattgacacatcctgtaaggacgtactgagctgtacaggaacctcaaattcagcgtctgccaattcttcaggcggctcctgcccctcgtctcactcctccctcactgaaagacataagatccttcaccgtttgctgcaagaggggagcccttccgatataaccacgctgagtgtcgagcccgataagaaagattcggcttccacatctgtgagcgtaacaggacaggtgcaggggaattccagcattaagcttgaactggacgcgtctaaaaaaaaggagtccaaagaccaccagctgctgcgctacctcctggacaaagatgaaaaagacctccgcagcacgcccaacctcagcctggacgacgttaaggtgaaggttgagaaaaaggaacagatggatccttgcaacacaaacccgacacctatgacaaaaccgacacccgaagaaatcaaactcgaggcccaatctcagtttaccgccgacttggaccaattcgatcagctgttgcctactctcgagaaagctgcgcaactgccaggtctgtgcgagaccgaccgcatggatggcgccgttacaagtgtgaccattaaatctgagatccttcccgcctctctgcagtcagcaacagccaggcctacctctcggctaaataggctgcctgaactggagctggaggcaatcgataaccaatttggccaaccggggacgggagatcagattccatggaccaacaatacagtgacagccattaaccaaagcaaatcagaggaccagtgtatctcttcgcagctggacgaactcctgtgtcctccaacaacagtggaggggaggaacgacgaaaaggcacttctcgagcaattggtcagcttcctgagcggaaaggatgaaacagagctggcagagctggacagggcgctggggatcgataagcttgtgcagggaggagggctcgatgtgttgtctgagagattccctccacaacaggccaccccacccctcattatggaggagcggccaaatctctattcccaaccatactcctcacctagtccaacggctaatctgccgtccccctttcagggcatggtgcgacagaagcccagtctgggtacgatgccagtgcaggtgacaccgcctaggggggcattttctccggggatgggcatgcagccgcgtcaaaccctgaatcgccccccagcggcccccaatcagctgagactgcagttacaacagcgccttcagggtcagcaacagctgattcaccagaaccgccaggccatccttaatcagttcgccgccacagcacctgttggtattaatatgaggtctggtatgcagcagcaaatcaccccacagccgcccctcaacgctcagatgctcgcccagcgacagagagaactttattctcagcagcaccgccagaggcagctcatacaacagcagagagccatgttgatgcgacagcagtccttcggaaacaacttacctccaagctctgggctgcccgtgcaaatggggaatccacgcctgccccaaggcgcgccacaacagtttccttacccccctaactatgggaccaacccgggcacaccccctgctagtacgagccctttcagccagctcgcagccaaccccgaggccagcctcgccaaccggaactcgatggtatcacgaggcatgaccggcaatataggagggcagttcggtacaggtataaatccgcagatgcagcagaacgtttttcaatacccaggagctggaatggtgcctcagggagaggccaattttgcgccctcactcagtcccggctcttccatggttcccatgcctattccaccacctcagtcttcgctactccagcaaaccccaccagcctctggctatcaaagtcctgatatgaaagcatggcagcagggagcaataggaaacaacaatgtattctcacaggccgttcagaatcagcccacgcctgctcagcctggggtgtacaataatatgagcatcacagtgtcgatggccggagggaatactaatgtccaaaacatgaatccgatgatggcacaaatgcaaatgtcatcactccagatgcccggcatgaacacagtttgccctgagcagataaatgaccctgcattgcgccatactggtctttactgcaatcagctgtcttcgaccgacctcctcaagactgaagcagatggcacgcaacaggtccagcaggtccaggtgttcgctgacgtccagtgcacagtcaacctggtgggaggtgatccttatctcaatcagcctgggcccctgggaacacagaagcccacctccgggccacagacaccacaggcgcagcagaaaagcttacttcaacagctcctcaccgagtag

SEQ ID NO: 197685 - DNA, 4200 bp, Artificial Sequence
  Description of Artificial Sequence: Synthetic coding sequence
atgagcggcctgggcgacagcagcagcgaccccgccaaccccgactcgcacaagcgaaaggggagcccctgtgatacccttgcaagttccaccgaaaaacgacggcgggaacaggagaacaagtatctcgaggaactcgccgaactcctgtcagcaaacatttctgatatcgatagtctgtcagtgaaaccagacaagtgcaagattctgaagaagacagttgaccagattcagctcatgaagaggatggaacaggagaaatccactaccgatgatgatgtccagaagagcgacatctcaagctcaagtcaaggtgtgatagagaaggagtcactggggccgctgcttttggaggctctggacggctttttctttgttgtgaattgtgaggggagaattgtcttcgtgagcgaaaacgtgacctcctacctgggatacaatcaagaggaactgatgaacactagcgtctactctatactccacgtcggggaccacgccgaattcgttaagaacttgctacctaagtcactggtgaacggggttccttggcctcaagaagcaacccgcagaaattctcataccttcaactgtcgcatgctcattcaccccccagatgaacccggaacagagaaccaagaggcttgtcagcggtacgaagtgatgcagtgttttaccgtatctcaaccgaaaagcatacaggaggatggggaagactttcagtcttgtcttatctgtattgcccgccgactgccccgccccccagctattacgggggtggaaagtttcatgacaaagcaggataccactggcaaaataatcagcattgatacgagctctctccgcgctgcggggcgaaccgggtgggaggatttagtgcggaagtgtatttacgcattcttccagcctcaggggcgggagccatcttatgccagacagctattccaggaggtaatgactcggggaacggcctcgtccccaagctaccgctttattctcaacgacggcaccatgctgtcggcccacactaagtgcaagctgtgctatcctcagtcccctgatatgcagccctttatcatgggaatccatattatcgacagggagcatagcggcctaagtccacaggacgataccaactctggcatgtcaatcccgagagtcaatccctcggtgaatcctagtataagcccagcccacggcgtcgcaaggtctagcacactcccgcccagcaattcaaacatggtatccactcggataaacaggcagcagtcctccgatctgcattccagtagccattcgaacagttccaactcacaaggatcttttggatgctcacctggttcccagatagtcgccaatgtggcactcaatcaaggccaggcttcgagccaatccagcaacccttcccttaacctcaataactcaccaatggagggaaccggaatcagcttggcccagttcatgtctcctcgcagacaggttacatcaggcctggcaaccagacctcgcatgcccaacaattccttcccgcccaacatctcaactctgagctccccagtcggaatgaccagctccgcctgcaataacaacaatcggtcctactcaaacatacccgtcacctctctgcaaggaatgaatgaaggaccaaacaacagcgtggggttctctgcatcgagcccagtcctccgccagatgtcatcccagaactctccgagccgcctgaacatccagcccgctaaagcagaatccaaggacaacaaggagattgcttctattttgaatgagatgatacagagtgacaattcctccagtgacggcaagccactggacagcggcctcctccacaacaatgatcgtctgtccgacggagattccaagtatagccagaccagccacaaactggttcagctgttaacaaccaccgcagagcagcagttacgccatgctgacatcgacacttcctgcaaagacgtcctgagttgcacagggacctccaactccgcatctgccaactcgagtggaggttcttgcccaagtagccactctagcctcaccgagagacacaagatcctccaccgactgttacaggagggaagccctagtgacattacaactctgagtgtggaacccgataagaaagatagcgcctcaacttccgtaagtgtcaccggccaagtccaggggaatagctccatcaagcttgagcttgacgcttctaagaagaaagaaagcaaggaccaccagctccttagatacctgctagacaaagatgaaaaagacctgcgaagcaccccaaatttatctctggacgatgtgaaggtgaaggtggaaaagaaagaacagatggatccttgcaatactaaccccaccccaatgaccaaaccaactcccgaggagatcaaattggaagcgcagagccagtttacggccgacctggatcagttcgaccagttactacctacacttgaaaaggcagcgcaactccccggcctgtgcgaaactgacaggatggacggagctgtgacttcggtgaccatcaagtccgagatacttccagcctccctgcagtcagctaccgccagacccacaagcaggcttaaccggttgccagagttggaactggaagcgatagataaccagttcggccagcccgggaccggcgatcagattccctggacgaacaataccgttacagccataaaccagtcaaaatcagaggaccagtgtattagctcacaactagacgagttgctttgcccccccactaccgtagaagggcgcaacgatgaaaaagccctcctggagcaacttgtttcttttttgagcggaaaggacgagacggaacttgcggagttggaccgggctctgggcattgataaacttgtccagggcgggggactcgatgttttgagcgaacgattccctccacagcaggcaactcctcctttaatcatggaggagcggcccaacttgtatagccagccttattctagcccctcccctacagcgaacctcccctcaccttttcaagggatggtcagacagaagccttcactgggaaccatgcctgtgcaggttacacctccccgcggggcattcagccctgggatggggatgcagcccagacaaacgctgaaccgcccacctgcggctccaaatcagctaagactccagcttcagcagcgccttcaaggccagcagcagttgatacatcaaaataggcaggcaattcttaaccagtttgctgccacagctcctgtgggaattaatatgaggagcgggatgcaacagcaaattactccccaaccgcctctcaatgcccaaatgctagcccagaggcagcgggagctctatagccagcagcaccggcagcggcagctaatccagcagcagagggcgatgttgatgcggcagcagagcttcgggaacaatcttcctccaagttctggtcttcctgtccaaatgggaaatccgaggctcccccaaggtgccccgcagcaatttccctacccgcctaattacggaaccaacccagggaccccccccgcctcaaccagtcccttcagccagctggcagcgaatcccgaagctagcctcgccaataggaattctatggtctctagagggatgacaggcaatatcggagggcagttcgggaccggcataaatccacaaatgcagcagaacgtgtttcagtaccccggtgccggcatggtaccccagggggaagctaacttcgcaccgagtctctcaccagggtcatcaatggtgcctatgcccattcccccaccccagagctcgctacttcagcaaaccccacctgcttcgggctaccaatctccagatatgaaggcgtggcagcaaggagcaattgggaataacaacgtgtttagccaggccgtccagaatcaaccgacacctgcccaacctggcgtatacaacaacatgtccattaccgtcagtatggcgggcggtaacacgaacgtgcaaaatatgaatcccatgatggcccaaatgcagatgagcagccttcaaatgcccggcatgaacaccgtatgtcctgagcaaataaatgaccccgctctgagacacacaggtttatattgcaatcagctgtcttcaaccgacctcttaaaaacggaggccgacgggacccaggacaaaaaaacagaagagtttttcagcgtggtaactaccgattag

SEQ ID NO: 197686 - DNA, 1659 bp, Artificial Sequence
  Description of Artificial Sequence: Synthetic coding sequence
atgcagctgaccgccgagaacagccccgtgacccccgtgggcgcccagaagacagcattacgcattagtcaaagccggatgattggaaattccgcaagtagacctactatgccgtctggggaatgggccccgcaaagttctgctgtccgcgtcacatgtgccgctaccacttctgccatgaatcgaccagtccaggggggcatgattcgaaaccctgccgcgagcattccaatgcgacccagttcccaaccaggtcaacgtcagacactgcagtctcaggtcatgaacatcgggccatccgagttagaaatgaatatgggcggtccccagtactctcagcagcaggccccccccaatcagactgccccttggcctgagagcatcctgcccatagaccaggcttcatttgcctcccagaacaggcagccatttgggtcttctcccgacgacctgctctgccctcacccggcggctgaatccccaagtgacgagggggcactcttggaccagctatatctggctctgcgcaatttcgacggcctcgaagaaattgatcgagctctgggcattccagaactggtgagtcagtctcaggccgtggatccagagcagttctcaagccaggatagtaatattatgctcgaacagaaggcccctgtcttcccccaacagtacgcgtcccaagcccagatggcacaagggtcatactcacctatgcaagacccaaatttccataccatggggcagagaccatcgtatgcaactctgaggatgcaacccaggccaggtctgcggccgacaggcctcgtgcagaatcagccaaaccagttgaggctccaactgcaacaccgtttgcaggcccaacagaataggcagccccttatgaaccaaataagtaatgtgtccaatgttaacctgacattgagaccaggcgtgccaacacaagccccaatcaatgcacagatgctcgcgcagcgccagcgcgaaattctcaaccagcatctcagacagcggcagatgcaccagcagcagcaggtgcagcagagaacgctgatgatgcgcggccaggggctcaatatgaccccgagcatggtggcaccctcaggaatgcccgctacaatgagtaacccacgaattcctcaagccaacgctcagcagtttccctttccaccaaattatggcatctcccagcagccggatcctggcttcactggcgccaccactccccaatccccccttatgtctccccggatggctcatactcaatcccctatgatgcagcagtcccaggccaatcctgcatatcaggccccctctgatattaatggctgggcccaagggaatatgggcgggaattctatgttctctcagcagtctccaccacactttggccagcaggcaaacacaagcatgtattccaataatatgaacattaatgtttctatggccacaaataccggaggaatgagctcaatgaaccagatgaccggccaaatctcgatgacgtccgtcacttccgtgccgacatcaggcctctcaagcatggggccggagcaagtgaatgatccagcactgcgcggcggcaatctcttcccaaatcagctcccagggatggatatgattaagcaggaaggcgacaccactcggaaatattgctag

SEQ ID NO: 197687 - DNA, 4395 bp, Artificial Sequence
  Description of Artificial Sequence: Synthetic coding sequence
atgagcggcatgggcgagaacaccagcgaccccagccgggccgagacacgaaagcgtaaggaatgcccagatcagctgggcccttccccgaaaaggaacactgagaagcgaaaccgcgagcaggagaacaagtacattgaggagctggccgagttgattttcgccaactttaatgacatagacaatttcaacttcaagccagacaagtgcgctatccttaaggagaccgtgaagcagatcaggcagatcaaggaacaggagaaggccgcagccgcaaatattgacgaggtgcaaaaatcagacgtaagcagcaccggccagggagtaatcgacaaagacgctctggggccaatgatgttagaggccctggatggtttcttcttcgtagttaatctcgaaggtaacgtcgtgtttgtgagtgaaaatgtaacccagtatctgaggtacaatcaggaagaactgatgaataaaagcgtatattccatactccacgtcggcgaccacacggagttcgttaagaatcttctacccaaaagcatcgtgaacggaggaagttggagcggggaacctcctagacggaacagccacacttttaattgtcgtatgctggtgaagccattaccagacagcgaagaggaaggccatgacaatcaggaagcccaccaaaagtatgagaccatgcaatgtttcgcagtgtctcagcccaagtctataaaagaagagggagaggacctgcagtcttgcctgatatgcgttgcacggcgggtgccgatgaaggaaaggcccgttcttcctagttccgagtctttcactacaaggcaagacctccagggtaaaatcacctcacttgatacttccacaatgagggcagcgatgaagccaggatgggaggaccttgtgcggcgctgtatacagaagttccacgcccagcatgagggagaatcagttagctacgcaaagcggcaccatcacgaagttcttcgccagggtctggcattctcccagatttacaggttctccctgtctgatggcactctggtggccgcccaaacaaaaagtaaactgatccggtcccagacaactaatgagcctcaattggttatttctttgcacatgttgcatagagaacagaatgtttgcgtcatgaatcccgatcttacaggacagaccatgggaaaaccgctaaatccaatcagttcaaattccccagcccaccaagcgctgtgttctggcaatccaggacaggacatgacccttagctccaatatcaacttccctatcaatggaccaaaggaacaaatgggaatgccgatgggaagattcggcggctccggcggcatgaaccatgtatctggaatgcaggccactactccccagggctctaattatgcactcaagatgaacagcccgagccaatcttcccccggaatgaatccaggacagccaacatcaatgctatcgcccaggcatagaatgtctccaggcgtagccggcagtccaaggattccaccctcgcagtttagcccggcagggtcactgcactctccggtaggagtgtgctcatctaccggcaatagccacagttatacaaactccagtttgaacgccctgcaggcactttcagagggccacggagtgagcctgggaagctcattggcttctcccgacttaaaaatgggcaatctccaaaattcccccgtaaacatgaaccctccaccgctatcgaaaatgggcagtttggatagtaaggattgcttcggactgtatggagaaccatcagagggaacaacaggtcaggccgagtctagctgccatcccggtgagcaaaaagagacaaatgatcccaatttacctccagctgtgagtagcgagagggccgacggtcagtctagactgcacgactccaaggggcagactaagctcctgcagctgctgacgacaaagtcagatcagatggagcccagtcctttggcaagtagtctgagcgacacaaacaaggacagcaccggtagtctgcccggatctggctccacccacggtacaagcctgaaggagaagcacaagattctgcaccgcctacttcaggacagttcttctccagtggatctcgcaaaactgaccgccgaagctactgggaaggacctgtctcaggagagttcatccaccgcccctggctcagaagtcacaattaagcaagaacccgtgagtccaaaaaagaaggagaacgcactgctccgatatctattggataaagatgacacaaaggacattggccttcctgagatcactccgaagcttgagcgcctggactcgaagacagatcctgctagcaacaccaaactaatcgctatgaagacggaaaaagaagagatgtcgttcgaacctggggatcagcctggatccgaattggataatctcgaggaaattttagacgacctccaaaactcccagctcccccaactctttccagacactaggccaggggcaccagccggaagtgtggataagcaagccatcattaatgaccttatgcagttaaccgctgaaaacagtcccgtgacacccgtgggggctcagaagactgcactacggatctcacagagcactttcaacaatccgcggcccggtcaacttggtagactcctgccgaatcagaaccttccactcgacattactctacaaagccctactggcgcaggaccttttccccctatccgcaatagctctccgtattccgtaattcctcagcctggcatgatgggcaaccagggcatgatcggaaatcagggaaatcttgggaacagcagcactgggatgatcggtaactcagcaagtaggcctacaatgcctagcggtgaatgggccccccaaagctccgccgtgagggtgacatgcgcggctactacatccgctatgaatagacccgtacagggcgggatgattcgtaatcccgccgctagtatccctatgaggcctagctcacagcccggacaacgacagactctgcagagtcaggttatgaacattggcccatcagagctcgagatgaacatgggcggaccgcagtacagccaacagcaggcgcccccaaatcagaccgcgccctggcctgagtctattctgcccattgaccaagcatcatttgcgtctcaaaacagacagccctttggttcctcgccagacgaccttctgtgccctcatcccgccgctgagagtccatctgacgagggggcgctgctggaccagctgtatttggcactgaggaacttcgatggactcgaggaaatagaccgcgccctcggcattcctgaactggtttcgcagagccaggctgtcgatcccgagcaattttctagccaagattccaacattatgctggagcagaaggccccagtcttcccgcagcagtacgccagccaagcccagatggcacagggctcatactctcccatgcaggatccgaattttcatacaatgggccaaaggccgagctacgcaacattacgtatgcagccacgcccggggctgaggcctaccggcctcgttcaaaatcagcccaatcagttgcgcctccagctgcagcacagacttcaggctcagcagaatcggcagccactcatgaaccaaattagcaatgtttccaacgttaatctcaccctcagacctggagttcctacgcaagcgccaataaatgctcagatgctagctcaaaggcaaagagaaatcctcaaccagcacctgaggcagcggcagatgcatcagcagcagcaagtgcagcagcgaactttgatgatgcggggtcagggcctcaatatgactcctagcatggtagccccttccggtatgccagctacaatgagtaatcccagaatcccgcaagcaaatgctcagcaattcccttttcctcctaactatggaattagccagcagcctgaccctgggtttacgggggcaaccaccccacagtcaccactgatgagccctaggatggcccacactcaatcccctatgatgcagcaatcacaggccaaccccgcctatcaggcgccctcggatataaatggatgggctcagggtaatatgggcggtaattctatgttctctcagcagagtcctccccactttggacagcaggccaacactagtatgtactccaataacatgaacattaatgtgagcatggctacaaacacaggcgggatgtcttccatgaaccagatgaccggccagatctctatgacaagcgtcacgtccgtgcccacttccggactgtcaagtatggggcctgaacaggtcaatgacccagcactgcggggcggcaacttgttcccaaaccagttgcccggtatggatatgataaaacaggagggagacacaaccaggaagtattgttag

SEQ ID NO: 197688 - DNA, 51 bp, Artificial Sequence
  Description of Artificial Sequence: Synthetic coding sequence
atgagcggcatgggcgagaacaccagcgaccccagccgggccgagacctag

SEQ ID NO: 197689 - DNA, 27 bp, Artificial Sequence
  Description of Artificial Sequence: Synthetic coding sequence
atgagcggcatgggcgagaacacctag

SEQ ID NO: 197690 - DNA, 4263 bp, Artificial Sequence
  Description of Artificial Sequence: Synthetic coding sequence
atgagcggcctgggcgagaacctggaccccctggccagcgacagcagaaagcggaagttgccttgtgatacccctggacagggcttaacttgctccggcgagaaaaggagacgcgagcaggaaagcaaatatatcgaagaattggctgagctgattagtgccaacctgagcgacatcgataattttaacgtgaaaccggacaagtgcgccatccttaaggagaccgttcgccagatccgacagattaaggagcagggaaagacgatctctaacgacgacgatgttcagaaggcggatgtcagctctaccggccagggggttatcgacaaagactccctgggtcctctattattacaggcgcttgacggattcctattcgtggtgaaccgcgacggaaacatcgtgttcgtcagcgagaacgttacccagtacctacagtacaaacaggaagatttagtcaatacgtctgtctacaacattctgcacgaggaggatcggaaggacttcctgaagaacttgcccaagtcaaccgtgaacggggtttcatggactaacgaaacacaacgccagaagtcacacacattcaattgtagaatgttgatgaagactccccatgacatattggaagatatcaatgcttctccagagatgcggcagcgctatgagacaatgcagtgctttgctctgagtcaaccccgggccatgatggaggagggggaggatctgcagagctgtatgatctgcgtggctcgaaggataactacaggagaaaggactttcccaagtaaccccgaaagctttattactcgacacgacctgtctggaaaggtggttaacattgataccaattccctcagatcttccatgagaccgggatttgaagacatcattcgacggtgcatccagcggtttttttctttgaacgatgggcaatcgtggtcacagaaacgtcactaccaggaggcatacctgaacggacatgcagagacccccgtctacagatttagcttagcagatggcaccatagttacggcccaaaccaagtctaaactctttaggaatcctgtaacgaacgaccggcatgggttcgtctcaacccacttcttgcagagagagcagaatggctatcgcccaaatcctaaccctgtgggacagggcattagacccccaatggctggatgcaatagctctgtaggggggatgagcatgagcccaaatcagggcctgcagatgcctagtagccgcgcttacggtcttgccgacccatctaccacaggccaaatgagcggtgccagatatggcggaagtagcaacattgcctcgctcactccgggaccgggcatgcagtctccttctagctatcagaataacaattatggcttgaatatgtcatcacccccccatggatcaccggggctagctccaaaccagcaaaacattatgatttctcctcggaatcggggctcacccaaaatcgcttcccaccagttctcccctgtagctggggtacacagccccatggcaagctcgggcaacacaggaaaccacagttttagcagctcctctctctcagccttgcaggccatttcggagggcgtgggcactagcctgctaagcaccttgagcagtcccggcccaaagctagataactcgcccaatatgaacatcacacaaccttccaaggtttcaaatcaggatagcaagtcccctctggggttttactgtgatcagaatcccgttgaatcttctatgtgtcagtcgaactctcgcgaccacctaagcgataaagagagcaaggaatcatccgtggaaggcgcagaaaatcaacggggcccacttgagagcaagggccataagaagttactccagctgttgacctgtagctctgacgaccgcggtcactccagtcttacgaactccccactggattcttcctgcaaagaatcgtcagtgtccgtgaccagtccctccggcgtgtcctcatctactagcggaggtgtctcctccacaagcaacatgcacgggagcctgctgcaggagaagcaccgtattctgcacaaattgcttcaaaacggtaactcccccgccgaggttgccaagattacagctgaggccacaggaaaggacacttccagcatcaccagctgcggggacggaaacgtggtgaaacaggaacagcttagccctaagaagaaagaaaacaacgcactgctgcggtacctgctagaccgagacgacccgagcgacgcattaagcaaagagctccaaccccaggtcgagggtgtagacaataagatgagccagtgtacaagttctaccatccccagctcctcccaggaaaaggacccgaagatcaagaccgagacctcagaagagggatccggcgatttagataacctggatgctatcctgggtgatctgacaagcagcgatttttataataacagcatatccagcaacggaagtcatctgggaaccaaacagcaagtgtttcaagggaccaactctctgggactgaagtcttcacagtccgttcagagtattcgtccaccctacaatcgggccgtgagcctggactcccccgtaagtgtcggtagctcgcctcccgtaaagaatatcagcgccttccctatgcttcctaaacagcccatgctcggcggaaatcctcggatgatggactctcaggagaactatggatcttccatgggcggtcccaatcgaaatgtaactgtcactcagaccccttctagcggcgattggggcctcccaaattccaaggccggacgaatggagcccatgaactctaactcaatgggacggcccgggggagactacaacacctcccttcctagacctgcactgggcgggagcattcccaccctaccactgcgatctaattcaatccccggcgcaagacccgtgctccaacagcagcagcagatgctgcagatgcggcctggagagattcctatggggatgggggctaacccatatggccaggctgctgcatcaaaccagctgggaagttggccagacggaatgttaagcatggaacaggtctcccacggaacccagaaccgccctctcttgcggaacagcttggatgacctggtagggcccccctccaatctggagggacagagtgacgagcgcgcactgcttgaccaactgcacacccttctctctaatacagatgccactggtctggaggaaatcgacagagctctgggcatccctgagttggtgaaccaggggcaagcgctggaacctaaacaggacgcgtttcagggtcaggaggccgccgttatgatggaccagaaagctggactgtacggtcaaacctacccagcacagggcccccctatgcagggcgggttccatctgcagggtcagtcccccagctttaattctatgatgaatcagatgaaccagcaggggaattttccccttcagggcatgcacccgagagccaacatcatgagacctcggaccaatacacccaaacagcttcggatgcagctgcagcagaggttgcaggggcaacagttccttaatcagagccgccaagccctagagctgaagatggagaaccctacagcaggcggtgccgcggtcatgcgccctatgatgcagccacagcaggggttcctaaatgcccagatggtagcccagcgcagtcgcgagctactgtcccatcacttcaggcagcagagagtcgccatgatgatgcagcaacagcagcagcagcagcagcagcaacagcagcagcagcaacagcagcagcaacagcagcagcagcaacaacagcagcagcagacacaggctttttctcctccaccgaacgtcaccgcctctccttccatggatggtttgctggcggggccgaccatgccccaggctccaccacagcagtttccctaccagccaaactacgggatgggccagcagcctgaccccgcgtttggaagagtgagcagccccccaaatgctatgatgtcttccagaatgggccccagtcagaaccccatgatgcagcacccacaggcagcatcaatctaccagagttccgagatgaaaggctggccgagcggtaacctcgctagaaattcttccttcagccaacagcaattcgcccaccaaggcaacccggcggtttacagcatggtacacatgaacggatcgtccggacatatgggtcaaatgaatatgaaccccatgccaatgtccggaatgcctatgggccccgatcagaagtattgttag

SEQ ID NO: 197691 - DNA, 4053 bp, Artificial Sequence
  Description of Artificial Sequence: Synthetic coding sequence
atgagcggcctgggcgagaacctggaccccctggccagcgacagcagaaaaaggaaacttccttgtgataccccaggccaagggctcacctgctccggagaaaaaaggcgccgggagcaggaaagcaaatatatcgaagaactcgccgagctcatctccgctaacctgagcgatatcgataattttaacgtgaagcctgacaaatgcgccatactcaaagaaaccgtccggcaaataaggcagattaaggaacaggggaagacaattagtaatgacgatgacgttcagaaagccgatgtgtcttcgacaggacagggagtgattgacaaagatagccttgggccactccttttacaggccctggacggtttcctgtttgtggtcaatagagacgggaatatcgtgttcgtctcagagaatgtgacacaatatctgcagtacaaacaggaagacctggtcaatacctccgtctacaacatccttcacgaggaagaccgaaaggacttcctgaaaaacctgcctaaatcaaccgtgaatggggtgtcatggactaatgagacccaacggcaaaagtctcacacttttaattgtcggatgctgatgaagacacctcatgatatcttagaggacattaacgcctccccggagatgagacagcgatatgagactatgcagtgtttcgcccttagtcagccgagggccatgatggaggaaggtgaggatctgcagagttgcatgatctgtgttgccagaagaataacgactggtgagaggacattcccctctaacccagagtcgttcatcacccgtcacgatctttctggtaaggtggtgaacattgacaccaactccctgagaagctccatgcgacctgggttcgaggatatcattagaaggtgcatccagagattcttctcgttaaatgatggccagagctggagtcagaagcggcactaccaggaggtcacatcagacggcattttttccccaactgcatatctgaatggtcacgccgagaccccagtgtatcgtttcagtttggccgacggaaccatcgtaacggcgcagacgaaatccaaactgttcaggaacccagtgactaacgaccggcacggcttcgtttcaacacacttcctgcagcgtgaacaaaacgggtatcggcccaatcccaatccagtaggccaaggcatccgcccacccatggcaggatgcaattcatcagtaggggggatgtccatgtcccccaaccagggtttgcagatgccatcttccagggcatatgggctggcagatccaagcaccactgggcaaatgagtggggcgcgttatggagggtcctccaacatcgcctctctcaccccgggccccggcatgcagtctccgtcttcctaccagaacaataattacggcttgaatatgagctcccctccccacgggagccccggactggcccctaaccagcagaatataatgatctctcctagaaatcggggctcacccaagatcgcatcacaccagtttagcccagtggccggggtacattcccctatggcctcaagcgggaataccgggaatcacagtttctctagttccagcctttccgccttgcaagctatatccgaaggagttgggactagtctgctctcgacactcagctcacctggtccaaagctggataactccccaaacatgaacattactcaacccagtaaagtgtctaaccaggacagcaaaagcccactgggcttctactgtgatcaaaatcccgtggaaagctcaatgtgccaatcaaactccagagatcacctgtctgacaaagaatcaaaggaatcatctgttgaaggcgccgagaaccagcgagggcctctggagagcaaaggccacaagaaattattacagctactgacttgtagttctgatgaccgaggccacagcagtcttacaaactcccccctggatagtagctgcaaagagagttccgttagcgttactagtcccagcggagtgagctcttccacatcaggcggtgtgtcctctactagtaacatgcacggctctcttttgcaagagaaacatagaatcctgcacaaactcctccagaatgggaacagcccagccgaggtagctaaaataacagcagaggcaaccggaaaagatacgagtagtatcacttcttgcggcgatgggaatgttgtcaagcaggagcaactctctccaaagaagaaggagaataacgctctcctgcggtacctactcgatcgggatgatcctagcgatgccctcagtaaggagctgcagcctcaggtggaaggtgtggacaacaaaatgtcacagtgcacgtcctccacaattccaagttcaagccaagaaaaagaccccaagataaaaaccgagacttccgaagaaggctctggggatctggacaatctcgacgctatcctcggagatctcaccagctcagacttctataataactctattagttccaacgggtcccacctagggactaaacagcaggttttccagggcactaattccttgggcgattgggggctccccaacagtaaagccggccgaatggaacccatgaattccaattcaatggggaggcctggcggggattacaacaccagcttgcccaggccagccctgggcgggagcatccccactctgccactccggagtaacagtatccctggagcacggcctgttcttcagcagcagcagcagatgctgcaaatgcggcctggcgagataccaatggggatgggagcgaatccttatggccaggctgccgcctccaaccaactcggctcttggccagacggcatgctcagcatggaacaagtaagccacggtactcaaaatagacccctgctgagaaattctctcgatgacctggtgggacctccctccaaccttgagggtcaaagcgatgaacgggcgctcctggatcagttgcatacacttctgagtaacacagacgcgaccggacttgaggaaatagacagggcactgggaataccagagctcgtcaatcaggggcaggcactggagccaaagcaggacgccttccaggggcaggaggctgcagtgatgatggatcagaaggctggactgtatggacagacttacccagctcagggcccacctatgcaaggcggattccacctccagggacagtccccttcctttaacagtatgatgaatcagatgaatcagcaaggtaacttcccactgcagggcatgcaccctagggccaatatcatgcgtcctcgaacgaatacccctaaacagctgaggatgcagctccaacagcgcctgcagggccagcagttccttaatcagtcccgacaggctctggaattgaaaatggagaatcccacagctggaggtgccgctgtgatgcggccgatgatgcagccacagcagggatttctgaacgctcagatggtggcccagcgaagccgagagcttttaagccaccacttcaggcagcagagggttgccatgatgatgcagcagcagcagcagcagcagcagcagcagcagcaacagcaacaacaacagcagcagcaacagcagcagcagcagcagcagcagcagactcaggccttctccccacctccgaatgtgaccgcctccccaagcatggatggcctactagccggccctaccatgcctcaggcgccccctcagcagtttccataccagccaaattacggtatgggtcagcaacctgatccggcattcgggagggtgagctcgccgcccaacgctatgatgtcctctcgaatgggccccagccagaacccaatgatgcaacatccacaggccgcgagcatctatcaaagttcggagatgaagggctggccttccggtaacctagccagaaacagctcttttagccagcaacaatttgcccaccaaggcaatccagccgtgtacagtatggtacatatgaacgggtcatccggacacatgggccagatgaacatgaaccccatgccaatgtccggaatgcctatgggcccggaccagaagtattgctag

SEQ ID NO: 197692 - DNA, 4248 bp, Artificial Sequence
  Description of Artificial Sequence: Synthetic coding sequence
atgagcggcctgggcgagaacctggaccccctggccagcgacagcagaaaacgtaagcttccatgcgacacgcctggtcaggggctgacgtgctcaggagagaaaaggcggagagaacaagagtccaagtacatcgaggagttagccgagctcatttccgcgaacctgtcagatatcgataattttaatgtcaagccagataaatgtgctatactgaaagaaactgtgagacagataaggcagattaaggaacagggcaaaaccatctccaatgacgacgacgtccagaaagccgatgtaagttcaactggtcagggcgttatagataaagatagcttggggcctctattgctgcaagctttggatggctttttattcgtggtcaaccgtgacggtaatatcgtgttcgtttccgagaacgtcacccagtatctgcagtataaacaggaggacctagtgaacacatctgtttataacatcctgcacgaagaggaccgcaaggactttctgaaaaacttgccaaagtctactgtgaatggtgtttcatggactaatgaaacacaacgccagaaaagccatacgttcaactgtcgtatgctgatgaaaactcctcacgacattctggaagatatcaacgcgtcccctgagatgcgccagagatatgaaacaatgcagtgctttgcactttctcaacccagggccatgatggaagagggtgaggatttacaaagctgtatgatttgtgtggcgagacggatcacaacaggggaacggacgtttcccagcaacccagaatctttcatcacgcgccacgacttgtcgggaaaagtggttaacatagataccaacagtctccgcagctcaatgaggccaggattcgaggacatcatcaggcgctgcatacagcgctttttcagtctgaatgacggccagagctggagtcagaagcgccattaccaggaggtcacaagcgacgggatctttagccccactgcctacttgaatggccatgccgaaacccctgtttaccggtttagcctggccgacggcacaattgtaacggcgcagactaaatccaagttatttcgaaaccccgtgactaacgataggcatgggtttgtgagcactcactttctgcagcgggaacagaatggatatagacctaatcccaatccggtcggccaggggatcagacctcccatggcaggctgtaactctagcgtgggcgggatgtcaatgagccctaaccaagggcttcagatgccctcttcccgggcatacgggcttgcggatccgagcaccaccgggcaaatgtctggagcccgctacggagggtcctccaacatagcatctttgacccctggccctgggatgcagtccccgtcaagctatcaaaacaataactacggtttgaatatgagctctccaccccacggttcacccggacttgctcccaatcagcagaatataatgatctcccccaggaaccggggatccccaaaaatcgcgtctcatcagttttcccccgtggctggagtgcattcccccatggctagttctggaaacacagggaatcactcattcagttcatcttcattgagtgcacttcaggctataagcgaaggagtagggacctctctactaagcaccttgtccagtccagggccaaagctggataactctcccaacatgaacattacccagccttcaaaggtttctaatcaggatagcaaaagccctcttgggttctactgcgaccaaaaccccgtggagtcaagtatgtgtcagagcaactcccgcgatcatttatccgacaaggaatccaaggagtcaagcgtcgagggggccgagaaccagagaggccctctggagtctaagggccataagaagttgctacagcttcttacttgctcctccgatgacagaggtcactcctcccttactaattcaccactcgattcatcatgcaaggagtcatccgtgtccgttaccagcccttctggtgtgagttccagcacatccggcggagtctcatccacaagcaacatgcatggatcgttgctgcaggaaaaacatagaatattacacaagctgctacagaacgggaatagccccgccgaggtggccaagatcacagcagaggcaactgggaaggatacaagcagcatcacatcctgtggggacggcaatgtcgttaagcaggagcaacttagtcctaaaaagaaggaaaataatgctctgcttaggtacttattagacagggacgacccatccgacgccctgtcaaaggagttgcagcctcaagtcgaaggggtcgacaataagatgtcgcagtgtacaagctccactattccaagttcaagtcaggagaaggacccgaagatcaagacagagacgagcgaagaagggtcaggagaccttgataatctcgacgctatactcggtgatttgaccagcagcgatttctacaataattccatcagctctaatggcagtcacttagggaccaagcaacaagttttccaaggaaccaacagcctcggcctgaagagctcccaaagcgtgcagtccataaggcctccgtataaccgggccgtttcgctggactcccccgtgagcgtggggagctcccccccagttaagaacatttctgcgttccccatgcttcccaagcagcctatgctgggtggcaaccctcggatgatggactcgcaggaaaactatggctcctccatgggggattggggcctgcctaacagtaaggccggacgcatggaacctatgaacagcaacagtatgggccggcccggaggcgattacaatacaagcctgcctcggcccgccctagggggctccattcctactctcccattgcgatcaaatagcattccaggagccagacccgtcctccagcaacagcagcagatgctgcagatgagaccgggtgagataccaatgggtatgggtgccaacccttacggccaggctgccgcgtctaatcagctcggttcttggccagacggtatgctctctatggagcaggtgagccatggcacccagaacaggccgctgctccggaactccttagatgacctcgtcggccctccctcaaacctggagggccagtctgacgagcgggccctgcttgatcaactacacaccctgctgagcaataccgacgccactggcctggaggagatcgaccgcgccctcggcatccccgagctggttaaccagggacaggctttggagccaaagcaagacgcatttcagggtcaggaggccgccgtgatgatggatcagaaagccggtctctacggacagacctatccagcacagggacctcctatgcagggaggattccacttgcagggccagagccctagcttcaactcaatgatgaatcaaatgaaccaacagggtaatttcccgcttcaaggcatgcatcctcgggccaatataatgcggccccgtaccaatacacccaagcaactacgaatgcagctgcagcagagattgcagggacagcagttcttgaaccaatctcgtcaggccctggaattgaaaatggagaaccctacagccgggggagcagccgtgatgcgacctatgatgcaacctcaacagggattcctgaatgcccagatggtggctcagaggagtagggagctgctctcccaccacttccggcagcaacgcgtcgctatgatgatgcaacagcaacagcagcagcaacaacagcagcagcagcagcagcagcagcaacagcagcagcaacagcaacagcagcaacagcagcaaacccaggccttctccccaccgcccaatgttactgcttccccctcaatggacgggctgcttgctggccccaccatgcctcaggcgccccctcagcagtttccttatcagcccaactatggcatgggtcaacagccggatccagcattcggccgggtctccagcccaccaaatgcaatgatgagttctagaatgggaccctctcaaaatcctatgatgcagcatccacaggccgcttctatttatcagtccagtgagatgaagggctggccatccggtaacctagcacggaacagcagtttctcacaacaacagtttgcccaccagggtaaccccgccgtgtattctatggtacacatgaatggatccagtggtcacatggggcagatgaacatgaatccaatgcccatgagcggcatgcctatgggcccggatcagaagtactgctag

SEQ ID NO: 197693 - DNA, 4275 bp, Artificial Sequence
  Description of Artificial Sequence: Synthetic coding sequence
atgagcggcctgggcgagaacctggaccccctggccagcgacagccgcaagagaaaattgccctgcgacactcctggccagggcctaacatgctccggggaaaaacggcggcgtgagcaggagtcgaagtatatcgaagagctggctgaactgatttcggccaacctaagtgacattgataacttcaatgtgaagccggataaatgcgccattctcaaggaaactgtccggcagatacggcagatcaaggagcagggaaaaaccatatccaacgacgatgatgtgcagaaggcggatgtgtcaagtacaggtcagggtgtcatcgataaggatagcctggggcccctcctgctgcaggcactcgacggcttcctgttcgttgtcaacagggacggcaatatcgtgtttgtgagtgagaacgtgacccagtacttacagtacaagcaggaagacctagttaatacaagcgtgtataacatcctgcacgaggaggacaggaaggactttctgaagaatctgccaaagagcaccgtcaatggggtgtcctggaccaacgagacccaacggcagaagagccatacctttaattgtcgaatgttgatgaagactcctcatgacatcctcgaggacattaacgcctcccctgaaatgaggcagcggtacgaaacaatgcagtgctttgcgctctcgcagccaagggctatgatggaggaaggggaagatctgcagagctgtatgatttgcgtcgcccgtagaatcaccacaggggagcgcacgtttccgagtaatccagagagcttcatcacccgccatgatctctcaggcaaggtcgtgaatatcgatactaactcactgaggagctctatgaggcctggtttcgaagacatcattagacggtgcattcagagatttttctcgcttaacgacgggcaatcctggtcccagaagcgtcattatcaggaggcatatttgaatggacatgctgagactccggtgtacaggttttctcttgcggatggcaccatcgtgaccgcccagaccaagagcaagctttttcggaatccggtgaccaacgatcggcatggatttgtaagcacacatttcctgcagcgcgaacagaatgggtatcggcctaaccctaaccctgtagggcaggggatcaggcctcccatggctggctgcaattcgtccgtgggcgggatgagtatgtcaccgaatcaagggctgcagatgcctagctctcgggcatacggactggccgatccatccaccacaggccagatgagcggagcaaggtacggcggctcctctaatatcgccagtctgacacccggacctggtatgcagtcccctagctcttatcagaataacaattacggactcaatatgagtagcccaccacacgggtctcctgggttggcacccaaccagcagaacattatgatctcaccccgcaatcggggttcgcctaaaatcgcctcccaccaatttagccctgtagcgggggtgcattctccaatggcctccagcggtaacacaggtaatcactcattttccagctcctccctgagcgccctgcaggccatatctgagggagtgggaacttctctgctatccaccctctcatctcctggccctaagctggacaattcacctaatatgaatatcactcagccatccaaggttagcaaccaggacagtaagagccctctaggcttctactgcgaccagaatccggtcgaatcatccatgtgccagtcaaacagtagggaccatctctcagacaaagaatcgaaggagagtagtgttgagggagctgaaaaccaaagaggaccattggaatccaagggacataagaagctgctgcagttgctcacttgctctagtgacgatagagggcactcatcgctgaccaatagcccactggacagtagctgcaaagagtcctccgtgtcagtgacgagtcctagtggggtcagcagcagcactagcggtggcgtgagttccacttcaaacatgcacggctcactgttacaagaaaaacacagaattctccataagctcctacagaatgggaatagcccagccgaggttgctaagattacggccgaagccaccgggaaagataccagctctatcaccagctgcggcgacggaaatgtagtgaagcaggaacagctttcaccgaagaaaaaggaaaacaacgctctgctacggtacctcctagatcgtgacgaccctagcgacgcgttgtctaaggaactccagccgcaagttgaaggggttgataataaaatgtcccagtgcacatccagcacaattccatcctcaagccaggaaaaggaccctaagattaagacagagaccagcgaagagggttccggggacttagataaccttgacgcaatcctgggtgacctcacaagctcagacttttataataattccatcagtagcaacgggtcccatctcggtactaaacagcaggtgttccagggaaccaactccctcggacttaaatcctcccagtctgtgcagtcaatcaggccaccctataaccgagctgtctctttagattcacctgtgtctgtaggctccagtcctcccgtaaagaatattagcgcgtttccaatgctgcctaagcagccaatgttgggaggtaaccctcgcatgatggattctcaggagaactacggatcaagcatgggggggccgaaccgcaacgtgacggtcacacaaacacccagttctggagactggggattaccaaattctaaggctggtaggatggagccaatgaattcaaattccatgggaaggccagggggtgattacaacacaagcctcccccgccccgcccttggaggctcaattcccacgctgccactgcggtccaactctatcccaggggcgaggccggttctgcagcagcagcagcaaatgctccaaatgaggcccggagagattcccatgggcatgggcgcaaatccgtatggccaagctgcagcttccaatcagttaggatcttggcctgacggtatgctgagcatggagcaggtgtcccacgggacacagaaccggccattgctgcgcaattccctcgatgacctagtgggacccccatctaacctggaagggcagagcgacgagagagccctgctggaccagttgcataccctcctttcaaataccgatgcaacggggttggaggagatcgacagggccctgggcattccggagctggtgaaccagggtcaggccttagagcccaaacaagatgcctttcagggtcaggaggcggccgtgatgatggaccagaaggctgggttgtacggccagacttatccggctcagggcccaccgatgcaaggcggatttcacctgcaggggcaatcacctagctttaattctatgatgaatcagatgaaccagcagggtaatttccctctacagggtatgcatcctagggccaatattatgcgacctagaaccaacacacctaagcagctgagaatgcagctccagcaaaggctacagggtcagcagttcctcaatcagagcaggcaggctctcgaactgaaaatggaaaatcctactgccggaggcgctgcggttatgagacccatgatgcagccgcaggtatcctctcaacagggtttcctaaatgctcagatggtggctcagcggtctcgcgaacttctgtcacaccattttaggcagcagagggtggctatgatgatgcagcagcagcagcaacagcagcagcagcagcaacagcagcagcagcaacagcagcaacagcagcagcaacagcagcagcaacagcagactcaagcattttctcctcctcccaacgtgactgccagtcccagcatggatgggcttctcgccggcccaaccatgccacaggcgcctccacaacagttcccctaccagcctaattacggaatgggacagcagcctgaccccgcctttgggcgggtaagttcccctccaaacgcgatgatgagcagcaggatgggccccagccaaaaccctatgatgcagcatccccaggcagcatccatataccaatcttccgaaatgaaggggtggccttctggtaacttagccaggaattcctcttttagccagcagcaatttgcccaccagggtaaccctgccgtgtactccatggttcacatgaacggcagctctgggcacatgggccaaatgaatatgaacccgatgcccatgtcaggaatgccaatgggaccagatcagaaatactgctag

SEQ ID NO: 197694 - DNA, 4263 bp, Artificial Sequence
  Description of Artificial Sequence: Synthetic coding sequence
atgagcggcctgggcgagaacctggaccccctggccagcgacagccgcaaacggaaactcccttgtgacacgcccggtcaagggctgacgtgcagtggcgagaaacgcagacgagagcaggagtctaagtacatagaagagctcgcagagctcatttctgctaatctctcagatattgataacttcaatgtcaaacctgataagtgcgctatcctgaaagaaacagtgagacagatcaggcagatcaaagagcaggggaaaacgatctctaatgacgacgatgttcagaaggcagatgtgagtagtactggccaaggagtgattgacaaggactcactgggaccactgctgctgcaggctctggacggttttctgttcgtagtgaacagagacggaaacatcgtgtttgtgagcgagaacgtgacacagtacctccaatacaagcaggaggatctggtcaataccagcgtgtacaatatcctgcacgaggaagatcggaaagattttttgaagaacctgcctaagagcacagtcaacggcgtaagttggacaaatgaaacacaacgccagaaatcccacacgttcaactgtcgtatgctgatgaaaaccccccacgatattctggaggatatcaatgcgagtcccgagatgaggcagaggtatgagacaatgcaatgctttgctctttcccagcctagggccatgatggaagaaggcgaggatcttcagagctgcatgatttgcgttgccaggaggatcaccaccggcgagcggactttcccaagcaatcccgagagctttataacgcgacacgatctgagtggcaaggtggtgaacattgacacgaattcactcagatcgtcaatgcggcccggcttcgaagacatcattaggaggtgcatccagcggttctttagtttgaatgatgggcagagttggagccaaaagcggcattaccaggaggcatatctcaacggacacgccgaaacccccgtgtatcgcttctcacttgctgatggtacaatcgtaaccgcacagaccaaatcaaagctcttccgaaaccctgttacaaacgataggcatggctttgtttccacccattttttacagcgggagcaaaatggctatcgccctaaccccaaccccgtaggccaaggcattcgaccaccaatggcagggtgtaattctagtgttggagggatgtctatgagccccaatcagggcctgcagatgccgtcaagtcgcgcatatggcttagccgacccatccaccactggacaaatgtcaggcgccaggtatggcggatcgtccaacatcgctagcctaacacctggacctggaatgcagagcccctcgagttaccaaaataataattatggactcaatatgtcgtctccaccgcacggcagccccgggctcgcgcctaatcaacaaaatatcatgatatcacctcgcaacagagggtcccccaagatagcttcacaccaatttagtccagttgccggggtccatagtcccatggcctcgtctggtaatactggtaaccattcttttagtagctcctctttatctgcattacaggcgatctctgaaggcgtgggaacctcactgctgtcgacactctcctctcctggccctaaacttgataatagcccaaatatgaatattacgcagcccagcaaggtgtccaaccaagattccaagtcaccattagggttttactgcgatcagaatcccgttgagtctagcatgtgccaatccaactcccgggaccacctgtcagataaagagtctaaagagtccagcgtcgaaggggcagaaaaccagcgagggccattggaatctaagggccacaagaaattgcttcagttactgacatgtagttccgatgacagaggtcattcttctcttaccaattcaccactggacagctcatgcaaggagagttccgttagcgtaacctccccatcaggtgtgtccagttccacatctggaggagtttctagcaccagcaacatgcacggcagtctgctacaggagaagcacaggattctccataagctgttacagaacggcaactctccagctgaagtggcaaagatcacagccgaggctactggcaaagacacaagctctattacttcatgcggtgacggcaacgttgtaaagcaggagcagctgtcccctaaaaagaaggagaacaatgcgctgttacgttacttgctagaccgggacgacccaagcgatgctctttccaaagaactgcagccgcaggtggagggagtggataataagatgagccagtgcacttcatccaccattccaagttccagtcaagaaaaagacccgaagatcaaaaccgaaacatcagaggaaggatctggagaccttgataacctggacgccatcctgggggatcttacctcgtctgacttttataacaacagcatttccagtaatgggtcgcacctgggtactaaacaacaggtattccagggtactaactcgctaggcttgaagtcctcccagtcagtgcaaagtatcagacctccttataatcgggctgtgtccctcgatagtcctgtgtccgtggggagctccccacctgtgaaaaacatctctgcattccctatgttgcctaaacaacctatgctgggtggaaacccacgcatgatggactctcaggaaaactacggcagctccatgggggggccgaatagaaacgtcactgtgacccagactccgagcagcggcgattggggcttgcccaatagcaaggctgggaggatggagcctatgaattccaattcaatgggacggcccggcggagattacaatacgtccctgccacggccagccctgggaggttcgattccgaccctcccattgagaagcaacagcattcctggggccagacctgtgctccagcagcaacagcaaatgcttcaaatgcgccctggggagatccctatgggcatgggcgcgaatccctatgggcaggccgccgcctccaatcagctcggctcctggcctgatggaatgttgtctatggaacaagttagccatggcacccaaaataggccgctgctgcggaattcattggatgaccttgtcggcccaccgagtaatctcgaaggccagagcgacgagagggcactcttagaccagctccacactttgctctcaaacaccgatgctacaggactggaagagatcgacagggctttggggatacccgagctggtgaaccagggtcaggcgttagagccgaaacaggacgcttttcaggggcaggaggcagccgtcatgatggaccagaaggcaggtttgtacggacagacatacccagcacagggtccacctatgcagggcgggttccacctccaggggcagtccccctcctttaatagcatgatgaatcaaatgaatcaacaggggaattttcccctccaggggatgcatccacgggccaacatcatgcgcccccgcaccaatacgcctaagcaactccggatgcaactacaacagagacttcaggggcagcagttcctaaatcagtcacgtcaagcactggaactgaaaatggagaatcctaccgcaggcggagctgcagtaatgagacccatgatgcagccccagcagggatttcttaatgcacaaatggtcgcacagagaagtcgcgagcttctctcgcatcatttcaggcagcagagagtggcaatgatgatgcaacagcagcaacagcagcagcagcagcagcagcaacagcagcagcagcagcaacaacagcagcagcagcagcagcagcagcaacagactcaggccttctcacccccaccaaatgttactgcttcccctagcatggacggtctgctggccggacccactatgccccaggcacctccgcagcaattcccgtaccagccaaactacggaatgggacaacagcctgaccccgcatttggacgtgtgagctcccctccgaacgctatgatgagcagtcgtatgggtccttcccagaacccaatgatgcagcatccacaggccgcaagcatctaccaatcttccgagatgaagggctggccaagtggaaacctggcgagaaattcctctttctctcagcagcagttcgctcaccaggggaaccccgcagtatacagtatggtccatatgaacggctcctcagggcacatgggtcagatgaatatgaaccctatgcctatgtcaggcatgccaatggggcctgatcaaaagtattgttag

SEQ ID NO: 197695 - DNA, 774 bp, Artificial Sequence
  Description of Artificial Sequence: Synthetic coding sequence
atgatggaggagggcgaggacctgcagagctgcatgatctgcgtggcgaggaggattacaaccggcgaaagaactttcccaagtaatccggagagcttcataacccgccacgacctatcaggcaaggtagttaatattgacaccaattctctacgttccagcatgcgaccgggcttcgaggacattattaggcgctgcattcaacgcttctttagcctcaacgacggtcagtcatggagccagaaaagacactaccaggaggcctaccttaacgggcatgccgagactccagtctacagatttagtctcgccgatggcaccatcgtcactgcacagacaaagtcaaagttatttcgtaacccagttacaaatgacaggcatggcttcgtgagcacacatttcctgcagcgcgaacagaacgggtacaggccaaaccccaatcccgtgggacaaggtatccggccaccgatggccgggtgcaattcgagcgtaggaggaatgtccatgtcgccgaatcaaggactgcagatgccttccagccgcgcgtatggcctggctgacccctcaacaacaggacaaatgagcggtgccaggtacggcggctcctcaaacattgctagcctgacaccggggccaggcatgcagagcccatcaagctatcagaacaacaattatggtctaaacatgagctccccaccacacggatcgcccggcctagcccccaaccagcaaaacattatgattctactggtcatcgtgggcgtacaaagatag

SEQ ID NO: 197696 - DNA, 864 bp, Artificial Sequence
  Description of Artificial Sequence: Synthetic coding sequence
atgaacaccttccaggaccagagcggcagcagcagcaaccgggagcccttgctccggtgtagcgatgctcggcgtgacctcgagctggcgattggaggggttctgagagcagagcagcagatcaaggacaacctcagagaggtgaaggcccaaattcatagttgcatatcaaggcatctggagtgcctcagaagtcgagaggtgtggctctatgaacaagtggacctgatatatcaactgaaagaagaaactctgcagcagcaggcccagcagttgtattccctacttggccagttcaactgtctgacccatcagttagaatgcacacagaacaaagacctggccaaccaggtcagcgtatgcctcgaaaggctgggatccttaacgctaaagcctgaagactccaccgtcttattattcgaagcggacactatcacactgaggcagaccattacaacatttggctctctcaaaactattcagattccagaacacttaatggcacacgcttcatccgctaacataggtccgttcctggagaagcgtggctgcatctcaatgccagaacagaaatccgcctccggtattgtagccgtgcccttttcggaatggttactggggtccaagcccgcctcaggctaccaggctccttatatcccatccactgacccacaggactggctaacacaaaaacagactctcgaaaacagccagcaagaggtccttttaaacagccccttgcaagaggagcataacttccccccggatcattatggattgccagcagtttgcgatctcttcgcgtgcatgcagttaaaagtggacaaggaaaaatggctatacagaaccccccttcaggtctag

SEQ ID NO: 197697 - DNA, 1845 bp, Artificial Sequence
  Description of Artificial Sequence: Synthetic coding sequence
atgaacaccttccaggaccagagcggcagcagcagcaaccgggagcccctgttaaggtgctcagatgcgaggcgcgacctcgagttggccatcggcggagtcttacgcgctgaacagcagattaaggacaacctgcgggaggtaaaagcccagattcacagctgtatttcgagacatcttgagtgcctccgtagtagagaggtgtggctctatgagcaggtggatctaatctatcagctgaaagaagagacactgcagcagcaagcccagcagctctacagtttgctcggtcagttcaattgtctgacccaccagctggaatgcacccagaacaaggaccttgctaaccaggtcagcgtctgtttggagcgccttggctccctgaccttgaagccggaagacagtactgtgctgcttttcgaggccgacaccattacactccggcagacaattaccactttcgggagcctcaagaccattcagatccccgaacatctgatggcacacgctagctcggcaaacatcggaccctttttggagaagaggggctgcatcagtatgcctgaacaaaaatccgccagcggaatcgtggcagtacctttttcagagtggctgcttggatctaaacctgccagcggctatcaggccccatatatcccgtcaactgacccccaggactggctgacccagaagcagaccttagagaattcacaaacttcctctcgggcctgtaatttttttaataatgtgggcggcaatctgaagggacttgagaattggttgctaaaatcggaaaaaagcagttaccagaagtgcaacagtcacagtaccacgtcatcgttttccatagagatggagaaagtaggcgaccaggagctaccagaccaagacgagatggacctctctgattggctcgtaaccccgcaggaatcccataagctccggaaacctgagaacggtagtagggaaaccagtgagaaattcaagctgctcttccagagctacaacgtgaatgactggctggtgaagacagatagctgtaccaactgtcaagggaaccagccgaaaggagtcgaaatagaaaatctaggcaatctcaaatgtcttaacgaccatttagaagcaaagaaacctctttccaccccctctatggtcaccgaggactggctggttcagaatcaccaggacccctgcaaggttgaagaagtctgtcgcgcaaatgagccttgcacctcgtttgcagagtgtgtgtgcgatgagaactgtgagaaagaagccctgtataagtggctactgaaaaaggagggaaaggataaaaacggcatgcctgtcgaaccaaagcctgaacccgagaaacataaggactctttgaatatgtggctctgtccgcggaaggaagtgattgaacagactaaagcacccaaagctatgaccccaagccggatagccgacagctttcaagtaattaagaatagccctctatccgagtggctaatccgtcccccctataaagagggatcaccaaaggaagtgccaggcactgaggaccgtgcaggtaagcagaagttcaagtcaccaatgaacacttcctggtgcagctttaacactgcggactgggtgctgccggggaaaaagatgggaaacctgagccagctgagtagcggcgaggacaagtggctgttacgaaaaaaggctcaggaagtgctcttgaacagtccactgcaggaggagcacaacttccccccagaccactatggattaccggcagtctgcgatctcttcgcttgtatgcagctaaaagtagacaaggaaaagtggttgtacaggacacctctgcaaatgtag

SEQ ID NO: 197698 - DNA, 1728 bp, Artificial Sequence
  Description of Artificial Sequence: Synthetic coding sequence
atgaacaccttccaggaccagagcggcagcagcagcaaccgggagccactgctgaggtgttcagacgctcgcagagatctggagcttgcaatcgggggcgtattgcgggcggagcagcaaattaaggataatctgcgggaagtaaaagcccagatacactcttgtatttcgagacaccttgagtgccttaggagtcgtgaggtgtggctctacgagcaagtggatctgatttatcagctcaaggaagaaactctccaacagcaggctcagcagctctatagcttgcttggacagtttaattgccttacccatcagctcgaatgtacccagaataaagacctggctaatcaagtaagcgtctgtctggaacgcctcgggtctcttacactcaaaccagaggactctacagttttgctcttcgaggcggacaccataactttgagacaaacaatcacgacattcgggtcgctcaagacaatccaaatcccggagcatctgatggcccacgcttctagtgccaacattggccccttcctcgagaaacgtggctgcatttcaatgcccgaacagaaaagcgccagcggcattgtagccgtgcccttttcagagtggcttctgggatcaaagcccgccagtgggtaccaagctccatatattccctcaacagaccctcaggattggctcacacagaaacagacacttgagaatagccaaacgagtagccgggcatgcaatttctttaacaatgtgggtggcaatctgaaggggctggagaactggctcctcaagtctgagaaatccagttatcagaagtgcaatagtcactctaccacctcttctttcagtatcgagatggaaaaggtgggagaccaggagttgcccgaccaggatgagatggatctttccgactggttggttacccctcaggaatcccataaactgagaaagcctgagaatggatcccgggaaacatctgagaaattcaagctgctgtttcagagctataatgtgaatgactggctggtcaagacagacagctgtactaattgtcagggtaaccagccgaagggtgtggagattgaaaatcttggaaacctgaaatgcttgaatgatcacttagaagcaaagaagcctttgagcacaccctcgatggtgaccgaggactggctcgtccagaatcaccaagatccatgcaaagtcgaagaggtgtgcagagcgaacgagccatgcacttcgttcgccgagtgtgtgtgcgatgagaactgcgagaaagaggctctgtacaagtggctgctcaaaaaggagggcaaagataaaaacggaatgcctgtcgagcccaagcccgaaccagagaaacataaggattcgctgaatatgtggctctgcccaagaaaggaggtgatagaacagaccaaggccccaaaggccatgacaccttcccggatcgccgactctttccaggtaatcaagaactcacctctctccgagtggctaattcggcctccctacaaagagggcagtcccaaagaggttcccggcacagaggaccgggccggtaagcagaaatattatctgattcatctctatcggagaaatatcacaagtcctcagaccattatggccagtctccagtttgtgataagtctcccagtttgtagtctgaagctgattaaaagaagtgggtacatcgaactcctgtatcgatgcgaggggatggataagagttag

SEQ ID NO: 197699 - DNA, 1845 bp, Artificial Sequence
  Description of Artificial Sequence: Synthetic coding sequence
atgaacaccttccaggaccagagcggcagcagcagcaaccgggagccactgctcaggtgcagtgacgcccgtagagatcttgagctggccattggcggggtgctgagggccgagcaacagatcaaggacaatcttcgtgaggtgaaagcacagattcactcgtgcattagtagacatctggagtgtctgcgttcccgcgaagtttggctgtacgagcaggttgacttaatttaccagctcaaggaagaaactctccagcagcaggcacaacagctttatagtctgttaggccagtttaattgcctaacacaccagctcgaatgcacccaaaacaaggacctcgcaaatcaggtgagtgtgtgcctggagagattaggctcactgacgcttaagcccgaggatagtacggtgctgttattcgaggccgacacaattaccctgagacagaccattactacattcgggtccttgaagacaattcagattccagaacaccttatggcacatgcctcatctgcaaatatcggcccattcctcgagaagcggggatgtatcagtatgccagaacagaagtctgcatccggaattgtggccgttcccttcagcgagtggctgctcggcagtaaacccgcctccgggtaccaagccccgtacatccccagtactgacccccaggattggttgacgcaaaagcagacgctcgaaaattctcagaccagcagcagggcatgcaacttttttaataatgtgggcgggaaccttaaaggtttagaaaactggttgctgaagagtgaaaagagctcctatcagaaatgcaatagtcactccacaacgtcatctttttcaatagagatggagaaggtgggtgaccaggaactgccggaccaggacgagatggatctgtccgattggctagttactccccaggagagccataaactgagaaagcccgaaaatggcagtcgggaaacctcggagaagtttaagctcctcttccagtcatataacgtgaatgactggctggtgaagaccgatagctgtactaactgtcaggggaaccagcctaagggagtggagattgagaacctcgggaacttaaagtgtctgaacgaccatttagaagccaaaaagcccttgagcaccccatcaatggtaacagaggattggctggtgcagaaccaccaagatccatgtaaagtggaagaggtttgccgtgctaacgagccatgcacgtcgttcgcggaatgtgtatgcgatgagaattgcgagaaagaagcactgtacaagtggcttttgaaaaaagaggggaaggacaaaaacggcatgcctgttgagccaaagcctgagccggaaaagcacaaggactccctcaacatgtggctctgtccaaggaaggaggtgatcgagcagacaaaggcccctaaagcgatgacgccgagccgcatcgccgactcatttcaggtcattaaaaactcgcctttaagcgagtggctgattcgtccgccatataaggagggctcccctaaggaagtgccaggaaccgaagatcgagctgggaagcagaaatttaagtcccccatgaacaccagttggtgttcgttcaatacagcagactgggtgctgcctggtaagaagatgggaaatctgagtcaactatcgagcggcgaagacaagtggctcttgaggaagaaggcccaggaggttctgctcaattctccactgcaggaagagcacaactttccgcccgatcactacgggcttccagctgtgtgcgatttgttcgcatgtatgcagctgaaagtggacaaggaaaaatggttatatcggaccccactgcagatgtag

SEQ ID NO: 197700 - DNA, 1347 bp, Artificial Sequence
  Description of Artificial Sequence: Synthetic coding sequence
atggcccacgccagcagcgccaacatcggccccttcctggagaagagaggatgcatatccatgcccgaacaaaagagtgcttcaggtattgtggcagtacctttctccgaatggctcctgggatcgaaacctgcttccgggtaccaggcgccatacatacccagcactgacccacaggattggctgacacagaaacaaactctggagaactcccaaacctcttcacgggcctgcaatttcttcaacaatgtgggcggcaacctgaaaggtcttgagaattggctcctgaaaagcgagaaatctagttatcagaagtgcaacagccactccactacgtcttctttctctatcgaaatggagaaggtcggggatcaggaactccctgatcaggatgagatggatctgtctgattggctggtcactccccaggagtcccacaagttgaggaagccagaaaacgggagtcgggagacaagcgaaaaatttaagcttctgtttcagagttacaatgtgaatgattggctcgttaagactgactcttgcacaaactgccagggcaatcagcctaagggcgtggagattgagaatttagggaacctgaagtgcttgaacgatcatctggaggctaaaaaacctctgagtaccccaagcatggtaacagaagactggttagtgcagaaccatcaagatccatgcaaagttgaggaagtgtgcagggcaaatgaaccgtgtacctccttcgcagagtgtgtatgcgacgaaaattgcgaaaaggaagcgctctacaagtggctgttgaaaaaggaaggtaaggacaaaaatggcatgcctgtggagcctaaaccagaacccgaaaaacacaaagactcgttgaatatgtggctgtgtcccagaaaggaggtcatcgaacagaccaaggcccccaaagccatgactccctctcgaatcgctgattctttccaagtcatcaaaaacagcccactgtctgaatggctcattcgcccaccttacaaggaaggctctcccaaagaagttcccgggaccgaggatcgcgctggcaagcagaagttcaagtctccgatgaacacctcctggtgttcctttaacactgccgattgggtgctgccaggtaagaagatgggcaatctaagccagctctcaagtggtgaggacaaatggcttctgaggaaaaaagcgcaggaggtgctgttgaacagccctctccaggaggagcacaattttcctcccgaccactatgggctaccggcagtttgcgacctttttgcatgtatgcagttaaaagtggacaaggaaaagtggttgtaccgcacgcccctgcagatgtag

SEQ ID NO: 197701 - DNA, 1545 bp, Artificial Sequence
  Description of Artificial Sequence: Synthetic coding sequence
atgaaccggtggaccctgttcatcagcctgaagcggcggcacttcaattcacggctctcgtcaagcacccgcttggggtctctgactctcaaacccgaagacagtacggttttgctgttcgaggcggacacaatcacgctgcgtcaaacaataactacctttgggagcctgaagaccatccagattccagagcacttgatggctcacgccagtagcgcgaacatcggcccttttctggagaagcgggggtgcataagcatgccagagcaaaagagcgcatccggcatcgtcgccgtccccttctccgaatggctgctggggtcaaaacctgcttcaggatatcaggcgccttatataccttcaacagatcctcaggactggctcacacagaagcagactctggaaaatagccagacctcctctcgagcctgcaatttcttcaataacgtggggggtaacctgaaggggctggagaattggcttttgaaaagcgagaagtcatcctaccagaagtgcaatagccacagtacgactagcagtttttctattgaaatggagaaggtcggagaccaggaattgccggaccaggatgagatggacctgagtgactggctggttacacctcaggagtcccataaactgcgaaaacccgaaaacggctcccgagaaacaagtgagaaattcaaactactcttccagagttacaatgtgaatgattggcttgtcaagaccgactcctgtactaattgccagggcaaccagcccaaaggggtggagattgagaaccttggtaatcttaaatgcctgaatgatcacttggaggctaagaaacctctgtcaacgcctagtatggtgaccgaggactggctcgtgcaaaatcatcaggacccctgcaaagtggaagaggtctgtagggcgaatgagccatgcacctcgttcgcagaatgcgtatgtgatgaaaattgcgagaaggaagctctgtataagtggctgctgaagaaagaaggcaaggacaagaacgggatgcccgtcgagccaaagcctgaaccagagaaacacaaggacagcctgaatatgtggttgtgtccacggaaggaggttattgagcagacgaaggcccctaaagccatgacaccctccaggatagctgacagctttcaggtcattaaaaattctccactgagtgaatggctgattcgccccccatacaaggagggcagccccaaggaagtgccaggcaccgaagatcgggctggaaagcaaaaattcaaatctcctatgaacacctcatggtgctctttcaacacagctgattgggtacttcctggcaaaaaaatggggaacctgagtcagctgagctctggagaggacaagtggttacttcgaaagaaagcccaggaggtactgctcaactcacctctccaggaggaacacaacttcccacctgaccactatggactgcctgccgtctgtgacttatttgcctgtatgcagcttaaagtggataaagagaagtggctgtatcgcactcctttgcagatgtag

SEQ ID NO: 197702 - DNA, 795 bp, Artificial Sequence
  Description of Artificial Sequence: Synthetic coding sequence
tgatgcacccccgcctgggccgccgagctggacagcgtgagcaagcagaagaaaaatccaaaaccgacattcaaaaagaagacagaagaaaggacctgtgaagttaagaaggtctcccgtctgggatcactcacacttaaacccgaggactccactgtcttgttgtttgaggccgacacgatcacattgcgccaaacaattactacgtttggcagtctgaaaacaattcagatccccgagcatctgatggcccacgcaagctccgcaaacatcggcccctttttagagaagcgcggctgtataagtatgcccgagcaaaagagtgcttcaggcatcgtggccgtacctttttccgagtggttgctgggttccaagcccgcgagcggctaccaagccccctatatcccatctactgacccccaggactggctcacccagaaacagacgctggagaacagccaaacttcctcccgggcctgtaatttcttcaacaacgtcggcggcaacctcaagggtctggagaactggctactgaagtctgaaaagtcctcttatcagaagtgcaacagccactcaaccacaagctccttttctatcgaaatggaaaaagtaggcgaccaggaactcccggatcaggacgagatggatttgtcggattggctcgtgacccctcaggagagccacaagctgaggaagcctgagaacggctcaagagagacaagcgaaaagtttaaacttctttttcaaagttataatgtgaatgactggttggtcaagactgacagctgcacttag

SEQ ID NO: 197703 - DNA, 1893 bp, Artificial Sequence
  Description of Artificial Sequence: Synthetic coding sequence
atgggcgcccagctgaccaccttcgccctggccggcgccgtgcggcgcatgaacactttccaggatcagtccggctcaagctcaaacagggagccactgttgcgctgttctgatgcaagacgcgatctggaactggcgatagggggagttctcagagctgaacagcagatcaaagataatcttcgtgaggtgaaggcacagattcacagctgcatcagcagacatctggaatgcttacgtagtcgggaggtgtggttgtatgaacaagtagaccttatctatcagctgaaggaggagacgctccagcagcaggcccaacagctgtactctctccttgggcagtttaactgtttaacacatcagctagagtgtacccagaacaaagacctggccaaccaggtatcagtgtgtcttgagaggttggggtctttgacactgaaacccgaggattccaccgtactcctgttcgaggctgacacgattaccctcagacagactatcaccacgtttggatcactgaagacgattcagatcccagaacacctgatggcccacgcctcaagcgcgaacatcggaccctttctggaaaaaagagggtgcataagcatgcccgaacagaagagcgcgtcgggcatcgtcgcagttccattcagtgaatggttgcttggctccaagcccgcctccggctatcaggctccatatataccctcgactgaccctcaggattggctcacacaaaagcagaccctggaaaatagtcagacctcaagccgggcttgcaactttttcaacaatgtgggcggcaatctgaaaggtttggagaactggctcctgaaaagcgagaaatcctcataccagaaatgcaatagccattccactactagctctttttcaattgagatggagaaggtgggcgaccaggaactgccagatcaagatgagatggacctgtcggattggttagtgactccccaggaatcccataaactgaggaagccggaaaacggttctcgtgagaccagtgagaagtttaagctgttgttccagtcctacaacgtcaatgactggcttgtcaaaactgattcttgtacaaattgtcaggggaaccaacctaaaggggttgagattgaaaatctcgggaacctcaaatgtctcaatgaccatctcgaggctaagaaacccctctcgaccccctctatggttacagaagactggcttgtgcaaaatcaccaggatccatgcaaggtggaggaagtgtgcagagccaacgaaccttgcacgtctttcgccgaatgcgtctgtgacgagaattgcgaaaaagaggccctctacaagtggcttctgaagaaagaaggcaaagacaagaacgggatgcctgtcgaaccaaaacctgagccggaaaagcacaaggactccctgaacatgtggttgtgccccagaaaagaggtcatagagcagactaaagcacccaaggccatgacaccatctcgaattgctgatagcttccaggttatcaaaaactctcccctgtccgaatggttgatccgccctccttataaagaggggtctccaaaagaggtacctggaactgaagacagggccggtaagcaaaaatttaagagtccaatgaacacgagttggtgttcattcaacaccgccgactgggtattacctggcaagaaaatgggcaatttatcacagcttagctcgggggaggacaagtggcttctccggaaaaaagcccaggaagtcctgctgaattcacccctccaggaggagcataattttcctccagaccactacggtctgcctgcagtgtgcgacctgtttgcttgtatgcagctgaaagtggacaaggagaaatggttgtaccggacccccttgcaaatgtag

SEQ ID NO: 197704 - DNA, 1845 bp, Artificial Sequence
  Description of Artificial Sequence: Synthetic coding sequence
atgaacaccttccaggaccagagcggcagcagcagcaaccgggagccattacttcgatgctctgacgcaaggagggatcttgaactggctatcggcggcgtgttgagagcagagcaacagattaaggataatctgcgggaggtaaaggcacagatccacagctgcatctctcggcatctggagtgtctaagaagtagggaagtgtggttgtatgagcaggtagatctgatctaccagctgaaggaagaaaccctccaacagcaggcgcagcagctgtactccctcctggggcaattcaattgcctgacccaccagctagaatgcacgcagaacaaagatctggccaaccaagtatctgtctgtctggagcgcctggggagcttgaccctgaagcctgaggatagcaccgtgctactgttcgaagcagacactattaccttaagacaaacaatcaccacctttggtagcctgaaaaccatccagattcctgagcacttaatggcgcacgcctctagtgcaaatatcggccccttcttggaaaagcggggctgtatatcgatgcctgagcagaaatctgcgagcggcatcgtagccgtccctttttccgaatggttattggggagcaagccagcatcgggatatcaggccccctatattccatcgaccgacccacaagactggctgacccaaaaacagacattagagaactcccagacatcgtcccgggcttgtaacttcttcaacaacgtgggtgggaacctgaaaggcctggaaaattggctgcttaaaagtgaaaagagctcataccaaaaatgcaactcacattccacgacatcttccttttccattgagatggagaaagtgggtgatcaggaattacccgatcaggatgagatggatctgtcagattggctggtgacgcctcaggagtcccacaaactgcgcaaacccgagaacggtagccgggaaaccagtgaaaaattcaaactcctattccagtcctataacgtgaacgactggctggtgaagacggactcttgtactaactgtcagggcaaccagccaaagggagtagaaattgaaaatctagggaacttaaagtgtctcaatgatcatctggaagcaaagaaacccttgagtaccccatctatggttaccgaggactggttggtgcagaaccaccaggatccctgtaaagttgaggaagtgtgtcgtgccaacgagccctgcacctcatttgccgagtgcgtctgtgacgagaactgtgagaaagaagctctgtataaatggctgttgaagaaggaagggaaagataagaatggcatgcccgtggaaccaaagccagaacctgagaagcataaagacagcctcaatatgtggctgtgtcctcggaaagaagtgattgagcagaccaaagctccaaaggcaatgacgcctagtcgcatcgccgattctttccaggttattaaaaattcacctttgtccgagtggctcatcaggccaccgtataaggagggaagtcctaaggaggtccccggcaccgaggatcgtgccggaaagcagaagtttaagtcccccatgaacactagttggtgctcattcaacacggctgactgggtcctccctggaaaaaagatgggcaatttatctcaactgtcgtccggggaggacaagtggctcctgcgaaaaaaggcccaggaagtcttgttgaactcacccctgcaggaggagcacaatttcccaccagatcactatggcttgcccgctgtctgcgatttattcgcttgcatgcagctgaaagtggacaaggagaagtggctgtacagaacacccctgcaaatgtag

SEQ ID NO: 197705 - DNA, 1953 bp, Artificial Sequence
  Description of Artificial Sequence: Synthetic coding sequence
atgggcgcccagctgaccaccttcgccctggccggcgccgtgcggcgtatgaatacttttcaggatcagagtggatctagttctaatcgggagcccttattgaggtgctcggacgcccgccgtgatctggaactcgcaataggtggtgtcttacgggccgaacagcagatcaaggacaacctcagggaagtgaaggcccagattcacagctgcatcagccggcatctcgagtgcttgaggagccgcgaagtgtggctttacgagcaggtggatctcatctaccagttgaaagaggaaacactgcagcagcaggcacagcagctatacagtctgctcgggcagttcaactgccttacacatcagctggagtgtacccagaataaagacctggcaaatcaggtgtccgtgtgtttggagaggcttggatcattaacgctgaagccagaagacagcacagttctgctgttcgaggcggacaccatcaccctgcgtcaaacaataacaactttcgggtccctgaaaaccattcaaatcccggaacatcttatggcccacgcatctagtgctaacatcggaccctttttggagaaacgcggttgtattagcatgccagaacagaaaagcgcttctggcatcgtagccgtccccttttccgaatggcttctgggctcgaagcctgcctctggatatcaggcaccctatatccccagcacggatccacaggactggctgacacaaaaacagacactggagaacagtcaaacatcctctcgagcctgcaactttttcaataacgttggcggcaacctgaagggactggagaactggcttctcaaaagtgagaaatcttcatatcagaagtgtaactctcactctaccacatcctcattcagcatagaaatggagaaggtgggcgaccaggagctgcccgaccaagatgagatggatttgagcgactggcttgtgactccacaagaatcccacaaactcaggaaacccgaaaacggaagccgggaaacatctgaaaaattcaagctgttgtttcagtcgtataacgtgaacgactggctggtaaagacagactcatgcactaactgtcagggaaaccagcccaagggggtcgaaatcgaaaacttagggaacctgaaatgcttaaacgaccatctagaagctaaaaaacctctgtcaacgcccagtatggtgactgaggattggctggtgcagaatcaccaggacccatgcaaggtggaggaagtctgtcgagctaatgaaccttgcacttccttcgctgagtgtgtgtgtgacgagaattgtgaaaaagaagcgctgtacaagtggctcctgaaaaaggaaggcaaggataaaaatggcatgccggtggaaccaaagcctgaaccagagaagcataaggactctctgaatatgtggctgtgtccaaggaaagaagttatcgaacaaacaaaagcaccaaaggcaatgacgccttcccggatagctgacagctttcaggtgatcaaaaacagtccgttgtctgaatggcttattagacctccatacaaggagggctccccgaaagaggttccaggaactgaggatcgcgccggcaaacaaaagttcaagtcgccaatgaacacgtcatggtgctcctttaacacagccgactgggtgctgcctggtaaaaagatggggaacctgtctcaactgagcagcggcgaagataagtggctcctgaggaaaaaggctcaggaagttcttcttaatagcccgctgcaggaagagcataactttcctccggatcactatggactgccagcggtatgcgacttgtttgcttgcatgcagctgaaagtcgataaagagaaatggttgtacaggacccccctgcaggcctactttaagatgaattttcaggatgtcaccgtggggaactttcagatcccctgtgggttttag

SEQ ID NO: 197706 - DNA, 6192 bp, Artificial Sequence
  Description of Artificial Sequence: Synthetic coding sequence
atggtgctggacgacctgcccaacctggaggacatctacaccagcctctgtagctccacaatggaagacagcgagatggatttcgactccggcttggaggacgacgatacaaagagtgattctattctggaggatagcacgattttcgttgcgttcaagggcaatatcgacgacaaagattttaaatggaaactggacgctattttgaaaaacgtgcctaatctgctgcacatggagtcgagcaaattaaaggtccaaaaggtggagccgtggaatagcgtcagagtgacgtttaatataccacgtgaggcagcagagcggctgcggattctggctcagtcgaataaccagcaattgagggaccttggcattctctcggtgcaaatcgagggagagggggccatcaatctggcactagctcagaaccgtagccaagacgttagaatgaacggacccatgggcgccggaaattctgtccggatggaagccggattcccgatggccagtggacctggcatcataagaatgaataacccagccactgtgatgatcccaccggggggaaacgtctcgagcagcatgatggcaccaggtccaaacccggagttgcaaccaagaacacctagacccgcatcgcagagtgatgcaatggatccactcttgtccggattgcatatccaacagcagtcccatccgagtggtagtctggctcctccgcaccatcctatgcaaccagtgtcggtgaaccggcagatgaaccccgctaatttcccacagctccagcaacagcagcagcagcaacagcagcagcagcaacagcagcagcagcaacaacagcagcagcagcaacagcaactgcaggcaagacctccacagcagcatcagcagcagcaaccacaggggattagaccccagtttaccgcccctactcaggttcctgtcccccctggctggaatcagctcccttccggtgcactgcagcctccccctgcacaggggagcctggggacgatgacagcaaaccaggggtggaaaaaggcaccgctgcccggccccatgcagcagcagctgcaggctagaccttccctcgctaccgtgcagaccccatcacaccctcctcccccctatcccttcggctcacaacaggcctcgcaggctcacaccaatttcccccagatgagtaatcctggacagtttactgcacctcagatgaagtctctccaggggggaccctcaagggtccctactccacttcaacagccccacctgacgaataagagtccagccagcagccctagcagcttccagcaggggagccccgcctcctcccctaccgttaaccagacgcagcagcagatgggcccgagacctccccagaataaccccctaccgcagggctttcagcagcccgtgagtagtcccggcaggaatcccatggttcagcagggtaacgtgcctccaaactttatggtgatgcaacagcaacctccgaatcaaggacctcagtcgctgcacccgggattgggcggaatgcccaagcgcctgccacccgggttctccgctggacaggcaaatccaaattttatgcaaggtcaggttccatctaccaccgccacaaccccgggaaattccggtgcaccccaactgcaagccaaccagaatgttcagcatgccgggggccagggagccgggcctccacagaatcagatgcaggttagccacgggccacccaacatgatgcaaccatctctcatgggcattcacgggaatatgaacaaccagcaggccgggacctccggggtgccacaggtaaatctgtcaaatatgcaaggacagcctcagcagggcccaccatcgcaactcatgggaatgcatcagcaaattgtaccaagccaaggacagatggtccaacaacaaggcaccctgaatcctcaaaatcctatgattctgtctagagcacaacttatgccccagggtcagatgatggtcaatccccctagccagaatttgggtccctcccctcaacgcatgactccaccgaaacagatgctgtctcagcagggaccgcagatgatggctccccacaaccaaatgatgggtcctcaggggcaggttctcctgcagcagaacccaatgatcgagcagatcatgacaaaccagatgcaaggaaacaagcagcagttcaacacgcagaatcaaagcaatgttatgcctggccctgcccagattatgagaggacctacgccaaatatgcagggtaatatggttcagttcaccggacagatgagcggtcagatgttgcctcagcagggacctgttaataattccccctctcaggtcatgggaatccaggggcaggttctgaggcctcctggaccttccccccatatggcgcagcaacacggtgaccccgcaactactgcaaataacgacgtctctctgagccaaatgatgccagatgtgagtatacagcaaacaaacatggttccaccccacgtccaggccatgcaaggcaacagcgcatccgggaatcacttttctggccacggaatgagtttcaatgccccattcagtggggcccctaacggaaaccagatgagctgtggccagaatcctggcttcccggtgaacaaagatgtgaccctcactagtcctctcctggtgaatctgctccagtccgacatctctgctggtcatttcggggtgaacaacaagcaaaacaataccaatgcaaataagccgaaaaagaaaaagccaccacgcaaaaagaagaattcacagcaagatcttaatacaccagatactcgtccagctggcctagaggaggccgatcagcctcccctccccggagagcagggtattaatctggacaatagcggccccaagctgcctgaattctcaaaccggcccccaggctatccttcacagcccgttgaacagagacctctccagcagatgcctcctcagctgatgcagcacgtagcgcctccaccacagcccccacaacagcagccccagccccagctgccacagcagcaacagccccctcccccttcacagccacagtcccagcagcagcaacagcagcaacagcagatgatgatgatgctgatgatgcagcaagaccctaaatccgtgcgtcttccggtttctcagaatgtccacccgcctagaggccccctgaaccccgattcccagcgcatgccaatgcaacagtcaggtagcgtgcctgtgatggtaagtttgcaggggccagcttctgtaccaccgagcccagacaagcagaggatgcctatgccggtgaacacccctctcggctctaactctcgtaaaatggtgtatcaggagtccccccagaacccatccagttcccctttggctgagatggccagtctccccgaggcatcaggctccgaggcgccttctgtgcccgggggacctaataacatgccttcccacgtcgttcttccacaaaaccagttgatgatgacaggtcctaagcctggccctagccccctttctgccacccagggggctacccctcagcaacctcctgtaaatagtttacccagctctcacgggcaccattttccaaacgtggccgcacccacacagacgtccagaccgaaaaccccgaatcgcgcgtcaccacggccttattacccacagacgccaaataataggcctcctagtactgagccttccgaaatatccctcagtcccgagcggctcaatgcgtccatcgccggcttattcccgccacagatcaacatccccttgcccccgcgtcctaacctcaatcgggggttcgatcagcagggcctgaatccgacaaccctgaaggctatcggccaggcacccagcaacttgaccatgaatccttctaattttgccacccctcaaactcacaaactggacagcgtagtggtaaactccgggaagcagtccaacagcggcgcaaccaaaagggcctccccaagtaacagtaggagaagtagccctgggtcctcacggaaaactactccatcccctggccgccagaatagcaaggctcccaagctgactctcgcctctcagacaaatgctgctttgctccagaatgtcgaactcccaagaaatgttctggtcagccctacccctctggcaaatccccctgtacccggaagcttcccaaacaattcaggtctgaacccacaaaacagcacagtaagtgtggccgccgtgggtggagtggtcgaggacaataaagaatccctgaacgtccctcaagattctgattgtcagaactcccagagccgtaaagagcaagttaacatcgaactgaaagctgtgcccgcacaggaggtgaaaatggtggtgcctgaagaccagtcaaaaaaggatggccaacccagtgaccctaataaattgcctagcgtcgaggagaacaagaatttagtttcgcctgccatgcgggaggcacccacatcgctgagccagcttctcgacaatagtggggcacctaatgtgacgatcaaacctcccggcctgacagacctggaagtaaccccccccgtcgtgtcaggagaggacttgaagaaagcaagcgttattcctacactccaggatctgtcctcgtctaaggagccatcgaattctctgaaccttccacattccaatgaactatgctcatcactagtacaccccgaattgtctgaagtgagcagtaatgtcgccccgtctatcccgccagttatgtcgcgcccagtgtccagctcctccataagcaccccgctgcctccaaaccagattactgtctttgtaacttccaatcctatcacaacttctgccaacacgtccgcagcgcttcctacccatctccaatctgctctgatgtccactgttgtcaccatgcccaatgccggatccaaggtgatggtttcagaggggcagtctgctgcccagtcaaacgcccgccctcaatttatcacaccggtgtttatcaatagttcctcaattatccaggttatgaagggcagccagccttccactattccagccgcacccctgacaaccaactccggcttaatgcccccctctgttgcagtggttgggcccctccacatcccccaaaatatcaaattcagtagtgctccagttccgcctaatgctttgagttctagccctgcccctaatattcagactggccgccccttggtgctgagttccagagcaacgcctgttcagctacccagccccccttgtaccagctcaccagtggtaccgtcccatccccctgtccagcaggtaaaggaactaaaccccgacgaggcatcccctcaggtgaatacatcagcagaccagaatacgctcccgtcctcccagagcaccacaatggtctcccccctgttaactaatagtcccggatcctccgggaatagacggtcacccgtgtccagttctaaggggaagggcaaggtcgataagattggacaaattcttctcactaaggcctgcaagaaagtgaccgggtccctggaaaagggtgaagagcagtacggagccgacggggagactgaggggcagggtttagataccactgcccctggcttaatgggaaccgaacaactaagcaccgaattggactcaaaaactccaaccccccctgccccaaccctcctgaagatgacctcgagcccagtgggcccgggcactgcctccgcaggacctagtctgccaggaggagcactgcctactagcgtgcgatcgattgtgactacattagttccttccgaactcatctccgccgtgccaactacgaagagcaaccatgggggaatcgcatctgaaagtcttgccggagggctagtggaagaaaaagtggggtctcatccggagttgctgccttccatcgccccctctcagaacctggtgagcaaggaaacatctactaccgccttgcaagcttccgtagccaggccagaattggaagtgaatgccgcaattgtaagcggccagtcatctgaaccaaaagagatcgtggaaaagagcaaaatccctggccgaaggaactctagaaccgaggagcctaccgttgcatccgaaagtgtggaaaacggtcacagaaagcggtccagtcgacccgcatccgcctcttcatccaccaaagatatcacttctgccgttcagtctaagcgccggaaaagcaagtag

SEQ ID NO: 197707 - DNA, 6192 bp, Artificial Sequence
  Description of Artificial Sequence: Synthetic coding sequence
atggtgctggacgacctgcccaacctggaggacatctacaccagcctttgttcatctactatggaggactctgaaatggactttgattcaggcctggaggacgacgacacaaagtctgattcaattctcgaagacagcaccatattcgtggcattcaaaggcaacattgacgataaagactttaaatggaaattggatgcaatcttaaaaaacgtacctaacctactgcatatggagtccagcaagctgaaggtccagaaggtggaaccgtggaactctgttagagtcacttttaacatccctcgagaagccgctgaaagactgagaattctggcccaatccaataaccaacaacttagagacctgggcatcctaagtgtgcaaattgaaggggagggggcaatcaacctcgcactcgcccagaacagatcccaggatgtccgaatgaatgggccaatgggcgcaggaaacagtgtgagaatggaagcagggtttccgatggccagcggaccgggcattattcggatgaataaccctgccaccgttatgatcccacctggaggtaacgtaagcagctcaatgatggcacccggacctaatcccgaattgcagccgcgcacccctaggcctgcttctcagtctgatgctatggacccgctcttatcagggttgcatatccaacagcagtcacatcccagtggctcactcgcccccccacaccatcccatgcagcccgtatcagttaatcgacaaatgaaccctgcaaattttccgcagctacagcaacagcagcagcaacagcagcagcagcagcaacagcaacagcagcagcaacaacagcaacagcaacagcagttgcaggctcgcccacctcagcagcatcagcagcagcagccccagggtattcggccacagtttactgcccctacccaggtgccagtacctcctggctggaatcaacttccctctggagctcttcagcctccgcccgctcaagggtctcttggcaccatgacggctaaccagggttggaagaaagcaccactacctgggccaatgcagcagcaactgcaggcccggccttccctggcaactgtacaaaccccaagccacccacccccaccctatccgtttgggagtcaacaggcttctcaggcacacaccaatttcccacagatgtcaaaccccgggcagttcacagctcctcagatgaaatccctgcaggggggaccctctagggtgcctaccccattgcagcaaccccaccttacaaacaaatcccccgctagttctccttcaagctttcagcagggctcccctgcaagctcccccactgtcaaccagactcagcagcagatggggcctaggccaccccagaacaatcctctgccacagggtttccagcagccagtgagcagccctgggaggaaccctatggttcagcagggtaacgtgcctcccaatttcatggttatgcaacaacagccgccaaatcaaggcccgcagtctctacacccaggattgggtggaatgcctaagagactacctcctggatttagcgcaggccaggcaaatcccaacttcatgcaaggccaggtgccaagcaccacagctaccactcctggaaactccggagcaccccagcttcaagctaaccagaacgttcagcatgcgggcggacaaggtgcaggacccccacagaatcagatgcaggtctcgcatggacctccaaatatgatgcagcccagtctgatgggaatccacggaaacatgaacaaccagcaagctggaacatcaggcgtgccacaggtcaatctctctaatatgcagggccagcctcaacagggaccaccgtctcagcttatgggcatgcaccagcagatcgttccatctcaagggcagatggttcagcagcagggcacactcaacccccagaacccaatgatcctgtcccgggcacagctcatgcctcaggggcagatgatggtgaatcctccgagtcaaaatctaggtccctcgcctcaacgtatgactccgccgaagcagatgttgtcccagcaagggccgcaaatgatggccccgcacaaccagatgatgggacctcaggggcaggtactgctgcagcagaatccaatgatagagcagataatgacgaatcagatgcagggaaataaacagcaattcaatacccagaatcaaagcaatgtgatgccggggcccgcccaaatcatgcgaggacccacccctaatatgcagggcaatatggtgcagttcactggccaaatgtcaggccagatgctgccgcagcagggccccgttaataattcaccttcccaggtcatgggcatccagggacaggtactacgcccaccaggtccctcacctcatatggcgcaacagcatggggaccctgctacgactgccaacaatgacgtgtctttgagccaaatgatgcctgacgtgagcatccagcaaaccaacatggtaccgccacacgtgcaagctatgcagggaaacagtgcctccggcaatcacttctcagggcatggcatgagctttaatgcaccatttagtggtgctcccaatgggaatcagatgtcatgtggtcagaaccccggcttccccgtcaataaggatgtgacactgactagtcctttgctcgtgaacctactccagtccgacatctccgcagggcatttcggtgtaaataataagcagaacaacacaaatgccaacaaaccaaagaagaagaaaccgccgcgcaaaaagaaaaattctcagcaggatctgaataccccagacaccagacctgccgggctggaagaggccgatcagcctcctttgcctggagaacaaggtatcaacttggacaattcaggcccaaaactacctgagttctcaaacagacctcccggctacccaagtcagccagtggagcagcggccccttcagcagatgcccccccaactcatgcaacatgtggcaccgcctcctcagccacctcagcagcagccccagcctcagctgccgcaacaacaacagccaccacccccaagtcagccacagtctcaacagcagcagcagcagcagcagcagatgatgatgatgttaatgatgcagcaggacccaaaaagtgtgaggttgccagtgtctcagaacgtccatccaccccgaggacctttgaatccggattcacagcggatgccgatgcaacagtctgggtcagttcctgtgatggtgtccctccaaggacccgccagcgtccccccatctcctgataagcagaggatgccgatgcccgtcaatacccccctgggtagcaacagtaggaaaatggtgtaccaggaatcaccgcagaacccctcctccagcccactggcagaaatggcttctcttccggaagcttcgggcagcgaggcacctagcgtgcccggcgggcctaataatatgccaagtcacgtagtgctgcctcagaaccagctgatgatgaccggaccaaaaccgggtcctagcccattatcagctacgcagggggcaacccctcagcagccccctgtgaatagccttccatcaagccacggtcatcattttccaaatgtggccgcgcccactcaaacgagtaggcccaagacacctaatcgagccagtcccagaccatactaccctcagacccctaacaacagaccaccctccaccgaaccttctgagatctccctgagccccgaaagactaaacgccagcatagccggactgttcccacctcaaattaacattccactgccccccagaccaaacttgaacagagggttcgatcaacaaggattgaatccgaccactctgaaggccataggacaggcaccgtccaacctgacaatgaaccccagtaactttgcaaccccacagacccataagctggactcggtggttgtcaattctggcaaacagtctaattctggcgctactaagcgggcctcaccgtccaattctcggagatctagccccggatcttctcggaagaccactccctcacctggccggcaaaattcaaaggcacctaaactgactttggccagtcagaccaacgctgcactgctccagaatgtggaacttcctaggaatgtgctcgtctctcccactcccctagctaacccacccgtaccagggtcattcccgaataacagcggactcaatcctcagaacagcacagtgtctgtcgcagccgtggggggggtcgtcgaagataacaaggaatcacttaatgtgcctcaggacagcgactgccagaacagtcagagccggaaagagcaggttaatattgaactgaaggccgtcccggcacaggaggtaaagatggtggtccctgaggatcagagcaaaaaagacggccagccctctgaccccaacaaattacccagcgtagaagaaaataaaaacctggtgagcccagccatgcgcgaagccccaacttctcttagtcaactattggacaactctggggctcccaatgtcacaatcaaacccccgggccttaccgacttggaagttaccccgccggtggtgagcggagaagatctaaaaaaagcctccgttatacctaccctgcaagatttgagtagctcaaaagaaccaagcaactccttaaatcttccacattcgaatgaactttgctctagtttagtccatcctgaactcagcgaagtgtcatctaacgtggccccatccattcccccagtcatgtccaggcctgtttcttcctcgtccataagcacccccctgccgccaaatcagatcacagtgtttgtgacctcaaaccctattactacaagtgcgaatactagcgctgccctaccaactcatctgcagtccgctctcatgagcaccgttgtgactatgcccaatgctggctcaaaagtgatggtgtccgagggccagagtgccgctcaatcaaacgcacggccacaattcatcacaccggtgtttatcaactccagctcaataattcaagtaatgaagggatcccagccttctactatccccgctgccccactgaccaccaactccgggcttatgccccctagcgtggccgttgtggggcccctgcacataccccagaacatcaaattctcgtccgcaccagtgcccccaaatgcactttcaagtagcccggccccaaatattcaaactggccgcccgcttgtcttatcctctagggccacgcccgtacagctcccaagtcctccttgtacttcatcccctgtcgttcctagtcacccccccgtacagcaagtgaaggaactgaatcctgacgaggcatcccctcaagttaacacaagcgctgatcaaaatactcttccttccagtcagagcactacgatggtgagccctctgcttaccaattcaccaggaagtagcggcaacaggaggtctcctgtcagcagttccaaaggaaagggaaaggtggataagatcggtcagattctgttgactaaggcctgcaagaaggtgactggcagcttggaaaaaggagaggagcagtacggcgcagatggggaaacagaaggccaaggcttggacaccaccgcccccggccttatgggtaccgagcagctgagtacagagttggacagcaagacacctactcctccagcgcctaccctcctgaagatgacctcttctcctgtgggccccgggacggcctcggctggcccttcactgcctggaggcgcactcccaacttccgttaggtctatcgtcacgaccttggtgccttcagagcttatctccgctgtccccacaaccaagtcaaatcatggaggaatcgcctccgagtccttggcaggtggcctggtagaagagaaggtgggcagccatcctgaactactgcccagtatcgctcctagccagaacctggtgtccaaggaaactagtacgacagcattacaggctagtgtcgcgaggcccgagttggaagtcaatgccgccatcgtcagcggacagagcagcgaacccaaagaaattgtggaaaaaagtaagattccagggagaagaaatagccgtaccgaagagcccacagtcgcatccgaaagcgttgagaacgggcataggaaaagatcctcacgacctgcctcagcaagctccagtacaaaagacatcaccagtgcagtgcaatcgaagagaagaaagagcaaatag

SEQ ID NO: 197708 - DNA, 1086 bp, Artificial Sequence
  Description of Artificial Sequence: Synthetic coding sequence
atggtgctggacgacctgcccaacctggaggacatctacaccagcttatgtagttctacaatggaggacagcgaaatggattttgatagtggtctggaggacgacgatacaaaatccgatagtatcttggaagactcaacaatttttgtggcctttaaagggaatatagatgataaggattttaagtggaagctcgatgcgattttgaaaaatgtgcctaacctcctgcacatggaatcgtcaaagcttaaggtgcagaaagttgaaccttggaatagcgttcgcgtgacatttaacatccctcgcgaagcagcagaaaggttaagaatcctggctcaatccaataaccaacagctgcgagatctggggatcctgtccgttcaaatcgaaggagaaggtgccatcaatctggcacttgcacagaatcgttcacaagacgtgaggatgaatggacctatgggagccggaaattctgttcgcatggaagcaggatttccaatggcttccggtcctgacgcaatggaccccctgttgtccggcctgcacatccaacagcaaagccacccctcggggtccctggctcccccccatcaccccatgcagccagtttccgtgaacagacaaatgaacccagcaaatttccctcagctccagcagcagcaacagcagcaacagcaacagcagcaacaacaacagcaacagcagcaacagcagcaacagcaacaacttcaggcccggcctccgcagcagcaccaacagcagcagccacaaggtattcggccccagttcaccgcccctacacaagtgcccgtgccacccggctggaatcagctcccaagcggagccctccagccccctccagctcagggcagcctcggcacaatgaccgcaaatcagggctggaaaaaagcacctctgcccgggccaatgcagcagcaacttcaggcgcgccctagcctggcaaccgttcagactccatctcaccctccgcccccttacccttttgggagtcagcaggcctcccaggcccacaccaatttcccacagatgagcaatccagggcagttcacggcgccccagatgtag

SEQ ID NO: 197709 - DNA, 549 bp, Artificial Sequence
  Description of Artificial Sequence: Synthetic coding sequence
atggccgaggagcaggtgaaccggagcgccggcctggcccccgactgtgaggccagcgcaactgccgagaccaccgtgagcagtgtggggacttgcgaggccgcaggaaagtctccagagcccaaggattacgactccacatgtgttttttgtcggatcgcagggaggcaagaccccggtaccgagttactgcattgtgagaacgaagatcttatatgcttcaaagacataaagcctgcggcaacgcaccactatctggtcgttcctaaaaagcatatcggtaactgccgcacgttgaggaaggaccaggtggagctagtggagaatatggtcaccgtcggcaaaacaatactcgagcgcaacaattttactgacttcactaacgttcggatgggtttccacatgccccccttctgctcaatctcacacctgcaccttcacgtcctggcgcctgtagaccagctgggatttctttccaagctggtctaccgggtaaatagttactggttcataacagctgaccacctaatcgagaagctccggacatag

SEQ ID NO: 197710 - DNA, 552 bp, Artificial Sequence
  Description of Artificial Sequence: Synthetic coding sequence
atgggcgccgcccacagcgtgtgggaggtggaccacctgtacaccttttttgtgcaatggtccccagacgtttacggtaaggacgcaaaggaacagggctttgtggttgtggagaaggaggagttgaatatgatagataattttttctctgagcccacaacaaaatcctgggagatcatcaccgtggaggaggctaagcgcaggaagagtacctgctcatattacgaagatgaggacgaggaagtgttacccgtgctgcgtccacatagtgcactgcttgaaaatatgcatattgagcagctcgcccggcggctgcccgctcgggtgcagggctacccatggcgcctggcctattctaccctggagcacggtacctcactgaagacactgtaccgaaagtctgcttcactggacagtcctgtgcttctggtcataaaggacatggataatcaaatcttcggtgcctacgcaacacatccattcaaattctctgaccattattacgggaccggcgagacgtttctttatactttcagcccacattttaagtag

SEQ ID NO: 197711 - DNA, 2829 bp, Artificial Sequence
  Description of Artificial Sequence: Synthetic coding sequence
atggacaccaaggaggagaagaaggagcggaagcagagctacttcgcacgactgaaaaagaaaaagcaagcaaagcagaacgctgagaccgccagcgctgtggccacgaggactcatactggtaaggaggataacaataccgtggttctagagcccgacaagtgcaacatcgccgtggaggaagagtatatgacagacgagaaaaagaagcggaagagtaaccagctgaaggagatcaggaggactgagttgaagagatactattccattgacgacaaccagaacaaaacacatgacaagaaggaaaagaagatggtcgtccagaagccacacggcaccatggaatatacggcaggtaatcaggatacactgaacagcattgcgctgaagtttaatataactcccaataaactggtggagttgaataaactgttcacacacactatagttcccggccaagtgctttttgtcccagacgccaacagcccctcttctactctgaggctctcttcctcctcccctggtgccaccgtctcccctagcagctcggacgcagagtatgataaactacccgatgctgatctggctcgtaaggccctgaagcctatcgaaagagtcctttcctccaccagcgaagaagatgagcctggggtggttaagtttctgaaaatgaattgcagatacttcacagacggaaagggagtggtgggaggggtaatgatagtgactcccaacaatattatgttcgaccctcacaaatctgatccgctggtgatagaaaatggatgcgaagagtacggactgatctgtcccatggaagaggtggttagtatagccctgtacaatgacatttctcatatgaagattaaagacgccctcccctccgacctaccacaggatctgtgtccactttaccgcccaggggaatgggaggatctggctagcgagaaggatattaaccccttctcgaagttcaaaagcatcaataaggagaaacgtcaacagaatggggaaaagatcatgacgtctgacagccgacccattgtaccactcgaaaagagtaccgggcacactccgactaagcctagcgggtcctccgtgagcgagaagttgaaaaaactagattctagccgagagaccagtcatgggagtcctacagtgactaagctctccaaagagccatctgatacgagtagcgcttttgagtccaccgctaaggagaacttcctaggagaagatgatgatttcgtggatttggaggaattaagttctcagacaggcggtgggatgcacaagaaggacactctcaaggaatgcctctcgctggacccagaggaacgcaaaaaggcggaatctcagatcaacaacagcgccgtggagatgcaggtgcagtcagccctagctttcctgggtacagagaatgacgttgagttaaaaggcgccttggacctggagacttgtgagaagcaggatatcatgcctgaggtggataagcagtcaggctccccagagtctagggtggaaaatacactcaatatccacgaagatttggataaggtcaagctgattgaatactacctcaccaagaataaggaagggccccaggtatccgagaacctgcagaagacagagctcagtgacggaaaatcaatcgaaccgggtgggatagacatcactctctcaagctctctgtctcaggctggagatccaatcacggagggtaacaaggaacctgacaagacttgggttaagaagggcgagcctctccccgtgaaactaaacagcagcactgaggccaatgtcatcaaagaagcacttgactcatcactcgagagtaccctcgataactcctgccaaggtgctcagatggataataagtccgaggtacagctctggctgctgaagcgcatccaagtccccattgaagatatcctgcctagcaaagaggaaaaaagcaaaaccccgccaatgttcctatgcatcaaggtgggaaagcccatgagaaaaagttttgctacccacacggctgccatggttcaacagtatgggaagcgccggaagcagcctgaatattggtttgccgtaccccgtgagagagtggaccatttgtacacgttcttcgtgcagtggtccccagatgtctacggcaaggatgccaaagaacaggggttcgtggtggttgagaaggaggagctgaatatgattgacaactttttctccgaacccaccaccaagtcatgggagataatcaccgtggaggaggccaagcggcgaaaatccacctgctcctactatgaggatgaggatgaagaggtgcttccagtccttcgacctcactctgcattattggaaaacatgcacatcgagcagctggcacggcggttgcctgctcgtgttcagggatatccatggaggctggcttactctacactggagcacggcacaagcctcaagaccttgtacagaaaaagtgcaagtctcgattcccccgtcttgttggtgattaaagatatggataaccagatttttggcgcatatgccactcacccattcaagtttagtgatcactactatggcactggcgaaacattcctgtatacgttctctccgcacttcaaagtgtttaagtggtctggggaaaactcgtactttataaatggtgacatttcctcgttggagttgggaggtggcggcggaagattcggcctttggctcgacgcggatctataccatggccgatccaatagttgcagcacctttaacaatgacatcctgagcaaaaaagaggactttatcgtacaggacctcgaagtttgggctttcgattag

SEQ ID NO: 197712 - DNA, 2829 bp, Artificial Sequence
  Description of Artificial Sequence: Synthetic coding sequence
atggacaccaaggaggagaagaaggagcggaagcagagctacttcgcccggctcaagaagaagaagcaggcgaagcagaacgcggagacagcatctgcggtggcgacccgcacacatactggcaaggaagacaacaacaccgtcgtcttggagcctgataaatgtaatatcgcagtagaggaagaatacatgaccgacgagaaaaagaagcgaaagtctaaccagctcaaggaaatcagacgaaccgaacttaagagatactacagtatagacgacaatcagaataaaactcatgacaaaaaggaaaaaaaaatggtcgtacagaaaccacacggcactatggagtacactgctggcaaccaggacaccctgaactccatcgcacttaaattcaacataacccctaacaaactggtggaactgaataagctttttactcacacaattgtacccgggcaagtcctgttcgttccagacgccaatagcccctcctccactctgcgcctgagcagctcatccccaggcgccacagtgtctcctagctctagtgacgcggagtatgacaaactcccagatgccgacctcgcccgaaaagcgctcaagcctatcgagcgggtactatcgagtacctcagaggaagacgagcctggtgtagtgaagttcctgaaaatgaactgtcgctacttcactgatgggaagggagtcgtaggcggagtgatgatagtcacccctaataacattatgttcgatccccacaagtcagacccactcgttatagaaaatggatgtgaagaatacggcctgatctgcccaatggaggaagttgtgtccattgctttgtacaacgacatttctcacatgaaaatcaaagacgcactgccgagcgacctccctcaggatctgtgtccactctacagacccggcgagtgggaggaccttgctagtgagaaggacatcaatcctttcagcaagtttaaatctatcaataaagagaagcgacagcagaatggagagaaaataatgactagcgactcgcggccaatcgtaccccttgaaaaaagcacaggacatacacctacaaagcctagtgggtcctcagtctcagaaaagttaaaaaaactggatagttcccgggagacttcccatgggtcacctactgtgactaagctgtccaaagagccctctgacacatctagcgcctttgagtccacggccaaggaaaattttctgggtgaggacgatgacttcgttgacttagaagagttgtcatcccaaacaggaggcgggatgcataagaaagacactttaaaggagtgtctgtctttggatcccgaagaacgaaagaaagcagagtcccagatcaataatagtgcagttgagatgcaggtccaatccgcccttgctttcctgggcaccgagaatgacgttgaacttaaaggcgcgctcgatttagaaacttgcgagaaacaggacatcatgccagaagtagacaagcaatcaggttcacctgagagtcgagtcgagaacaccctaaatatccatgaagacctcgacaaggtcaaattgattgagtactacctgacaaagaacaaagaaggcccgcaggtatcagagaatctccagaagaccgagctgtccgacggcaagagcatcgagcctggcggaatcgatatcactctgtcttcctccctaagccaagcgggagaccccatcaccgaagggaataaggagccagataaaacctgggtgaaaaagggggagcccctgccagttaaactgaactcttccaccgaagcgaatgtgattaaagaggcgctggattcatctctggaatccacccttgataattcctgtcaaggtgcccagatggataacaaatctgaggttcaattatggttactgaagcgcatccaggtaccgatcgaggacattctgccatctaaagaggaaaagagcaagacccccccaatgttcctttgtatcaaggtgggtaagccaatgagaaaaagcttcgccacgcacaccgcagcgatggtgcagcagtatggaaagaggagaaagcagccggagtactggttcgctgtcccaagagaaagagtggaccatctctataccttttttgtccagtggtctccggatgtgtatgggaaagacgccaaggaacagggattcgtggttgtcgagaaagaggagctgaacatgatcgacaactttttcagcgagccaactacgaagtcttgggagattattactgtggaagaggccaagcgacgtaaatccacttgcagctactacgaggacgaggatgaagaggtactacccgtgctcaggcctcatagtgcccttctcgaaaatatgcacatcgaacagttagctcggcgccttccagctcgtgtgcagggctatccctggcgcttggcttactccacgttggaacacgggacttctcttaagaccctgtacagaaaaagcgcctccctcgattcccccgtcctgctcgtgattaaggacatggacaaccagatcttcggcgcctatgcaacacacccttttaagttttcggatcattactacggcaccggtgaaacatttctgtacaccttttccccacacttcaaggtattcaagtggtcaggggagaactcgtactttataaacggggatataagctctctagaattggggggaggcggtggtcgctttgggttgtggcttgacgcagacctctatcatgggaggtctaatagttgctcgacttttaataacgatattctctccaagaaggaagatttcatcgtgcaggacctagaggtatgggccttcgactag

SEQ ID NO: 197713 - DNA, 1323 bp, Artificial Sequence
  Description of Artificial Sequence: Synthetic coding sequence
gacgccgacctggcccggaaggccctgaagcccatcgagcgggtgctctcatctacatccgaagaggatgagccaggcgtggttaaatttctcaagatgaactgcaggtactttactgacggcaagggagtggtcggcggagtgatgatcgtgacacctaacaacatcatgttcgatccacacaaatccgatcccctggtgatcgaaaatggctgcgaggagtatggattgatctgtcctatggaagaagtggtctccattgcgctttacaatgacatcagccacatgaagataaaggatgcactgccaagccctggggaatgggaggacctcgccagtgagaaagacattaatccgttctcaaagttcaagtctatcaacaaggagaagagacagcaaaacggcgagaagattatgacttccgattcccggcccattgtccccctagaaaaaagcacaggtcatacacccaccaagccttctggaagtagtgtttccgagaagttgaagaaattggactcatcccgcgagacgagtcatggctcccctactgtgaccaagctatccaaggagccatctgatacaagtagcgccttcgagagcactgccaaggaaaactttctgggcgaagacgacgattttgttgatctggaggagctatccagccagactggcggcgggatgcataaaaaagataccctaaaagagtgtttgtctctagaccctgaggagcggaaaaaggccgaatcacagatcaacaattccgccgtagagatgcaggtccaatccgcactggccttccttggcaccgaaaatgatgtagagctgaagggggctctggacctggaaacgtgcgagaagcaggacatcatgcccgaagtggacaaacagagcggcagccccgagtcacgcgtggaaaatactctgaatatccatgaggatctggataaggtgaaactaatcgagtactatctcacaaagaataaagaaggcccacaggtaagcgagaatctccaaaagactgaactcagtgacggaaaaagcatcgagcctgggggcattgacataacattgtcgtccagtttgtcccaggccggcgatcctatcacagaaggcaataaggagcccgacaagacatgggtcaagaagggtgaaccactaccggtgaaactaaattctagtacagaggctaatgtaattaaggaggccctagattctagcctggaaagtacactggataactcctgccagggcgcccaaatggacaacaaaagcgaggtacagctctggctactgaagcgtatccaagtgcctatagaatag

SEQ ID NO: 197714 - DNA, 576 bp, Artificial Sequence
  Description of Artificial Sequence: Synthetic coding sequence
atggacaccaaggaggagaagaaggagcggaagcagagctacttcgccagactgaagaagaagaaacaggcaaaacagaacgcggagacagcgagcgctgtggctacacggacgcacactggaaaggaagataataatacagttgtgcttgagccggataaatgcaacatcgccgtcgaagaggagtacatgactgacgagaagaagaagcgtaaaagcaaccaactgaaggagatcaggcgtaccgaattgaagcgatactacagcatcgatgacaaccagaacaagactcacgataagaaggagaagaaaatggtggtgcaaaaaccccacggtaccatggaatataccgccgggaaccaagatacacttaacagtatcgccttaaagtttaatatcacacctaacaaactggttgagttgaataagttatttacgcatacaatagtgcccggtcaggtgctctttgtccctgatgccaattcgcccagctccacactgagactctcaagctctagtcccggcgcaacagtctccccctcgagttcggacgccgagtacgacaagctgccgtag

SEQ ID NO: 197715 - DNA, 354 bp, Artificial Sequence
  Description of Artificial Sequence: Synthetic coding sequence
atggacaccaaggaggagaagaaggagcggaagcagagctacttcgcccgcctgaaaaagaaaaaacaagccaaacagaacgcggagaccgccagcgcagttgcaacacgaactcatactgggaaagaggacaataacaccgttgtcttggagcctgataagtgcaacatagctgtcgaggaggaatatatgaccgacgagaagaaaaagcgaaaatctaaccagctgaaggagatcaggaggactgagcttaaacgctattactcgatcgatgataaccagaacaagacccatgacaaaaaagagaagaagatggttgtccagaaaccacacggaactatggagtacacttag

SEQ ID NO: 197716 - DNA, 273 bp, Artificial Sequence
  Description of Artificial Sequence: Synthetic coding sequence
atggacaccaaggaggagaagaaggagcggaagcagagctacttcgcccggctcaagaaaaagaagcaggctaaacagaacgccgaaaccgcctccgctgtggctaccaggacccacacgggaaaggaagataataataccgtcgtactggagcctgataagtgcaacatcgccgttgaagaggagtacatgacagacgagaaaaagaagcgcaagtcgaatcaactgaaagaaatacgaagaacggaactcaaacgctattatagcatctag

SEQ ID NO: 197717 - DNA, 273 bp, Artificial Sequence
  Description of Artificial Sequence: Synthetic coding sequence
atggacaccaaggaggagaagaaggagcggaagcagagctacttcgccaggttgaaaaaaaaaaagcaggctaagcaaaacgcagagaccgcgtctgctgtagccaccagaacccacaccggtaaggaggacaataatactgttgtgctagaaccggacaagtgtaatatcgccgtcgaagaagaatatatgactgacgaaaaaaagaaacggaaatctaatcaactgaaagagattagacggaccgagttgaagaggtactatagtatctag

SEQ ID NO: 197718 - DNA, 552 bp, Artificial Sequence
  Description of Artificial Sequence: Synthetic coding sequence
atgggcgccgcccacagcgtgtgggaggtggaccacctgtacaccttcttcgtacagtggtcgccagatgtgtacggcaaggacgccaaagagcaagggtttgtggtggtggaaaaggaggaactgaacatgattgacaacttcttttccgaacccactacgaagtcgtgggaaattatcaccgtggaggaggcaaagaggcggaagtcgacttgctcttattatgaggatgaagacgaggaggtacttccggtactgagaccccacagtgccctgttggaaaacatgcacatcgaacagctggctcgccgtctgcccgcccgtgtgcaaggttacccctggcgcctcgcctatagcacactggagcacggtacctccctgaagacgctgtatcgaaaaagtgctagcctcgactctcctgtgctccttgtgatcaaggacatggataatcaaatcttcggcgcgtatgctactcatcccttcaaattttctgaccattactatggaaccggagagaccttcctatacaccttttccccccacttcaagtag

SEQ ID NO: 197719 - DNA, 714 bp, Artificial Sequence
  Description of Artificial Sequence: Synthetic coding sequence
tgagagaagacctgcagcagcctggagcgggagccccacttcagcttactgaccatgcgaggtcagcggctgcctctagatatccagatcttttactgcgcaaggccagatgaggaacctttcgtcaaaataattacagtggaggaggcaaagaggagaaagtcaacctgcagttactacgaggacgaagacgaagaggtgcttcctgtgttgcgcccccactccgccttgttggagaatatgcatatagaacaacttgcccggcgtctcccagccagggtccaaggttacccatggcggttggcatactctacactggagcacggcacgtccctcaagaccttatacaggaaaagcgccagcctcgattcacccgtccttctcgtgattaaggacatggataaccagatctttggggcatacgcaacacacccctttaaattctccgaccactattacggaacaggcgaaacttttctgtacactttcagcccacatttcaaggtgttcaaatggtccggagaaaacagctactttattaacggagacatctctagtctggagctagggggcggtggtggaaggtttgggctgtggctcgatgctgacttgtatcatggtcggagcaactcctgctctacgtttaacaatgatattctaagcaagaaggaggacttcatcgtccaggacctggaagtgtgggcatttgactag

SEQ ID NO: 197720 - DNA, 534 bp, Artificial Sequence
  Description of Artificial Sequence: Synthetic coding sequence
tgagagaagacctgcagcagcctggagcgggagccccacttcagcctattaactatgcggggccagagactccctctggacatccagatcttttactgcgcgagacccgatgaagagcccttcgtcaagatcataactgtggaggaggccaaacgacgaaagtccacatgcagttactatgaggacgaggatgaggaagtgttgcccgtactgcggccacacagtgctctgcttgagaatatgcacattgaacagttagcccgccgactgcccgctcgtgtacaggggtatccctggagactggcttattctacactggaacacgggacaagcctcaaaacactgtacagaaaaagtgccagccttgactcaccggtgttgttggttataaaggacatggacaatcaaatcttcggggcttacgccactcacccattcaaattcagcgatcactattacggcacaggcgagacctttttgtatactttttctcctcactttaagggcacgatctggtttatggcacgctgctag

SEQ ID NO: 197721 - DNA, 573 bp, Artificial Sequence
  Description of Artificial Sequence: Synthetic coding sequence
tgagagaagacctgcagcagcctggagcgggagccccacttcagcctcttgaccatgcgcgggcagcgactgcccctagatattcagatcttctattgcgcccgacctgacgaagagcccttcgtgaagatcattactgtggaagaagccaagcgcagaaaatccacctgcagttactatgaggatgaggacgaagaagttctgccagtcctgagaccccactctgcacttttggaaaatatgcatatcgagcagctggcacgccgtctgcccgcacgtgtgcagggctatccgtggcgcctcgcttattctacactagagcatggcacttcactgaagaccctgtatcgcaagtccgcttctctcgattctccggtgctgcttgtaataaaagatatggacaatcagatctttggagcatatgcaacccaccccttcaagttctcagatcattattatggaacaggagagacttttctttatacgttctccccccacttcaaatggtccggggaaaacagttactttattaacggggatattagttcattggagctgggcggcggcggttag

SEQ ID NO: 197722 - DNA, 273 bp, Artificial Sequence
  Description of Artificial Sequence: Synthetic coding sequence
atggacaccaaggaggagaagaaggagcggaagcagagctacttcgctagactgaagaaaaagaaacaagcaaagcaaaacgctgaaacagccagtgcagttgcaaccagaacgcataccgggaaagaggataataataccgttgttctggaaccggacaaatgtaatatagcggttgaggaagaatacatgactgacgagaagaagaagcggaaatcaaatcaactgaaggagattcgtagaacagagctcaagaggtactattctatttag

SEQ ID NO: 197723 - DNA, 7566 bp, Artificial Sequence
  Description of Artificial Sequence: Synthetic coding sequence
atgagcggcagcacccagcccgtggcccagacctggcgggccaccgaacctcgctatcctccacactccctgtcttatcccgttcaaatcgcaaggacccacacagatgttgggttgctcgagtatcagcaccacagtcgcgattacgcgtctcacctgtcacctggatcaatcatacaaccgcagcgccgaagaccgagcctcctgtccgagtttcagccaggaaacgagaggagccaggagttacatcttaggcctgaatctcacagctacctccccgaactcggcaaatctgagatggaattcatcgagagtaagaggccacgactggagttgctgcccgatcccttgctgcgcccaagtccgctcctggctacggggcagccagctggctccgaggatctcactaaagaccgtagcctcaccggtaagctggaacctgtaagccccccctctcccccccataccgaccccgagctcgaacttgtgccccctcgcctttcaaaggaagagctgatccaaaacatggacagggttgacagagagataacgatggtggaacaacagatcagcaagttgaagaaaaaacagcagcagctggaagaggaggccgcgaagcctcccgagccggagaagccagtctcgccgcccccaatagaatctaaacatcgttcactggttcagattatttatgacgagaacaggaagaaggccgaagccgcccatagaatcttggagggcttgggcccccaggttgaactgcccctttataaccagcctagtgatacccgacaatatcatgaaaacataaagatcaaccaggctatgcgcaagaaattgatcctctatttcaagagaagaaaccatgcaagaaaacagtgggagcagaagttctgccagcggtacgaccaactgatggaagcatgggaaaagaaggtggaaagaatcgagaacaatccacgtagaagggccaaagaatcgaaggtacgagagtactatgaaaagcagtttccagaaataagaaagcagagagagctccaggaacggatgcagtctcgggtgggccagcggggatccggcttatcaatgtcagccgctaggtccgagcacgaggtctcggaaatcatcgacgggctatccgaacaggagaacctggagaaacagatgcggcagcttgcagtcatacctcctatgctctacgacgctgatcagcagaggatcaaattcatcaacatgaatgggctcatggctgatccaatgaaggtctacaaggacaggcaggtgatgaatatgtggtcagagcaggaaaaagagacttttagagagaagttcatgcagcacccaaaaaacttcggtctgattgcaagcttcttggaacgcaagacagtggctgaatgtgttctctattattacctcaccaaaaaaaatgagaattataagtccctggtccgtagatcttaccgacggcggggcaagtcgcagcagcagcagcagcagcagcagcagcagcaacaacaacagcagcagcagccaatgccacgatcttcccaggaagaaaaagacgagaaggaaaaggaaaaagaggctgaaaaagaggaggagaagcctgaagttgagaatgacaaagaggatctgttgaaggagaagaccgatgataccagcggggaggataatgatgagaaggaagctgtggccagcaagggcaggaagaccgctaattctcaggggcggaggaagggcagaatcaccagatcgatggcaaatgaagcaaatagcgaggaagccataactccacagcaaagtgcagagctcgcatcaatggagctcaatgaatcttcaagatggacggaagaagaaatggaaacagcaaaaaaggggctgttagagcatgggcggaattggagcgcaatcgcccggatggttgggtccaagacagtctcgcaatgcaaaaacttctacttcaactacaaaaagcgccagaacctggatgagatcctgcagcagcacaagcttaagatggagaaagagcgcaacgcccgacgtaagaagaagaaggcccccgccgccgcgtctgaagaggcagcctttccaccagtggtggaggatgaagagatggaagccagtggagtgagtgggaatgaagaagagatggtggaggaggctgaagcgttacatgcgagcggcaatgaggtcccccggggtgagtgttcaggcccagctactgtgaataacagcagcgacaccgaaagcataccaagcccacacaccgaggccgctaaagacacaggtcagaatgggcccaagcctccagccacccttggggccgacgggcccccacctggccctccaacaccgccacccgaggatatccctgcccctactgaaccaaccccagcaagcgaggctaccggggccccaaccccccctcccgctcccccatcgccttctgcccccccgccggttgtccctaaggaagagaaggaagaggagaccgcagctgcgccgccagttgaagagggcgaagaacaaaagccacctgccgcagaggagctggcggtcgatactgggaaagcggaagagccggtgaagtccgagtgcacggaagaagccgaggaaggtccggcgaaaggcaaggatgccgaagcagccgaggccaccgctgaaggcgctcttaaggccgagaagaaagaggggggctctggaagggccacaactgcaaagagcagcggggcacctcaggattccgacagctcagccacctgttccgctgatgaagtggacgaagctgaaggcggcgacaagaataggttactgtcacctcggccctcgttgcttactccgacgggggacccaagggctaacgcctccccacagaaaccactggatcttaagcagcttaagcagcgtgccgccgccatcccccccatagttaccaaagtgcacgaaccacctcgagaagacgcagctccaacaaaacccgcacctcctgcacctccgcctccacagaatctgcagccggaatctgacgctcctcagcagccagggtcctccccaaggggtaagagtcggagccccgccccacctgcagataaagaggccgaaaagcctgtttttttcccagctttcgcagctgaggctcagaagctacctggcgaccccccttgctggacatctggcctcccatttccagtcccccccagggaggtcattaaggcttccccccacgcaccggatccaagtgcttttagttacgcacctcctgggcatcccttgcctctcggcctgcatgatacagcccggcccgtcttgccccgtccgcccaccatttcaaaccctcctcctttgatctcgtcagcgaagcacccttccgtcttggaacgccagatcggagccatctctcaaggcatgtccgtacagcttcacgtgccttatagcgagcacgcaaaggctccagttgggccagtgacgatgggactccccctacccatggacccaaagaaattggccccatttagcggcgtcaagcaggaacagctttctccgaggggccaagcaggtccacccgagtccttgggggtgcctactgcccaggaggcttcagtcctccggggcacggctttggggagcgtccctggcggaagtattaccaaagggataccatcaactagggtcccaagcgactcggccataacatatcgaggaagcatcacccatggcactcccgcagacgtgctgtacaagggaaccatcactcgcattattggtgaggactcacctagccgtctggaccgcggcagagaagattctctgcccaagggtcatgttatctacgaaggaaaaaaaggccacgtgctttcctacgaggggggcatgtctgtgacacagtgttccaaggaagacggacggagcagctctggaccccctcacgaaacggctgcgcctaaaagaacctacgacatgatggagggtagagtgggaagggcaatatcctcagcttccatcgagggcctgatgggccgcgcaattccccctgagaggcactccccgcatcatctgaaagagcagcaccatattcgtggtagcataacccagggcattccccggagctacgtggaggcccaggaagactacttgaggcgggaggcaaaactcttaaagagagaaggcacacccccacctcctcccccctccagggatctcaccgaagcgtacaaaacacaggcgctggggcccctgaaactgaagcctgcccatgaggggctggttgccacagtcaaagaagcaggacgctctatccatgagatcccaagagaggaactgagacatacacctgagctgccgttggcgccgcggccactcaaagaaggctccatcacccagggaacgcctttgaagtacgatacaggagcctccactactggttctaagaaacatgacgttaggagtctcatcggctcacccggaagaacctttccgcctgtgcaccccttggatgtgatggcagacgccagagctttagagcgggcttgctatgaggagtccctgaagtcaagaccaggcaccgctagctcttccggaggctccatcgcccggggtgcacccgtgatcgttcccgagctgggtaagccacggcagagtccactgacttacgaggatcacggtgccccttttgctgggcatctgccccgcgggagtcccgtgacgaccagggaaccaactcctagattacaggaaggatcgctctcatcttctaaggcttcacaggataggaaacttacatccacacccagagagatcgcgaagagcccgcattcgacagtgcccgagcatcatccacaccccatctctccttacgaacacttgttgcgcggagtgagcggcgtggacctctacagaagccacataccactggcatttgatcccacatcaattccgaggggcatccccttggacgctgctgctgcttattacctcccccgccatctggcaccaaatcctacgtatccacatctatacccaccctacctgatccgagggtacccagatacagctgccctcgagaacagacagactattattaatgattacataacttctcagcagatgcatcacaatgccgcaactgccatggcccagcgagccgatatgcttcgcggactgtctcccagggagagcagcctcgctctcaattatgcggctgggcccaggggaataatcgacctgagtcaagtccctcatctgcctgtcctggtgccacctacgcctggaacccctgcaactgccatggaccggcttgcctatttacccaccgcaccgcagcctttttctagtaggcacagcagcagtccactctccccaggcggtccgactcacctcacgaagccaacaactacgagtagttccgagcgggagagagaccgagaccgggagagggaccgagacagggaacgcgaaaaaagcattcttaccagcacaactacggtcgaacacgctcccatatggcgaccagggaccgaacaatcaagcggatcgtcagggggcggcggtgggtcatctagccggccagccagccatagtcacgcacatcagcactcccctatatcccctcgcacccaggacgcactgcagcagcgtccatcagtcttacataatacaggaatgaaaggaattatcactgccgtagagcctagtacaccaaccgtccttagaagcacaagcacatcctcccctgtcaggccagcagcaacttttccgccagcgacccactgtcctttaggtgggacgctggatggggtctatcctactttgatggaacctgtgttgctccccaaggaagcccctagagtcgctaggccagagcgccctcgcgccgacaccggtcatgccttcctcgccaagcctccagcccggtccggcttagaaccagcttcctctccgtctaaggggagcgagccccgtcccctggtcccacccgtcagcgggcacgcgaccatcgcgcgaactccagccaagaacttagcaccccatcacgcctcgcccgatccacccgccccacctgcctccgcctcggatccacatcgcgaaaagacccaatccaaaccttttagtattcaagaactggaattacgcagtctcggctaccatgggtcctcttacagtccagagggcgtggagccagtaagccccgtatcctctccaagcctcacgcacgacaaggggttacccaagcacctagaggagctcgataagtcgcaccttgagggagaactgaggccaaagcaacccggaccagttaagctgggcggagaagccgcccaccttccccacctgcgcccactaccggaaagtcagcctagcagcagtcccctcttgcagacagccccaggtgtcaaggggcatcagagggtggtgaccttggcgcagcatatcagcgaggttattacccaggactacactcggcaccatccacagcagctgagcgcacctctcccagctccgttatacagcttcccaggagccagttgtcccgtattggatctgaggcgtcccccatcagacttatatttaccacccccagaccacggcgctccagcaaggggcagtcctcactccgagggtggaaagcggtccccagagcctaacaaaacttcggtgttgggtggaggggaggacggtatagaaccagttagcccgccagagggcatgactgagcccggccactcccgcagcgctgtgtacccactattatacagggatggtgagcagacagaaccgagccggatggggtccaagtcccccggaaacacctctcaacccccggcttttttctctaagcttaccgagagcaactcggctatggtgaagtcaaaaaagcaagaaatcaacaagaagctgaacacccataatagaaacgaacctgaatacaatatttcccagccggggaccgagatcttcaatatgcccgccatcacggggactggacttatgacctacaggagccaggctgtccaggagcacgcctctacaaacatgggtctggaggccattattcgaaaagcactgatgggaaagtacgaccagtgggaggaaagcccacctttgagcgccaatgctttcaatcctctaaatgcctccgctagcctacccgcagctatgccaattacagccgccgatggtcggtctgatcatacactcacaagccccggtggcgggggcaaagctaaagtcagcgggagaccatccagccgcaaagccaagtcacccgctccggggctggcttcaggagaccgtccgcccagcgtctctagtgtgcactcagagggagactgtaatcgccggacccccctgacgaatagagtgtgggaggatcgcccttcaagcgcaggatcaaccccgttcccctacaatccactgatcatgcggttacaggcaggagtgatggcctctccccctccccccggtcttcctgcagggagtggccctttggcaggcccacaccatgcctgggacgaggaacccaaacccctcctttgtagccagtacgaaaccctgagcgatagtgaatag

SEQ ID NO: 197724 - DNA, 7380 bp, Artificial Sequence
  Description of Artificial Sequence: Synthetic coding sequence
atgagcggcagcacccagcccgtggcccagacctggcgggccaccgagccccggtatccgccacatagtctgagctaccccgtgcagattgccagaacacacaccgatgtgggcctgctcgagtatcagcaccatagtagagattatgcttcccacctttccccaggatctatcattcagccccagcgaaggaggccttctttgctttccgaatttcagcctggaaacgagcggtcccaggaactacatctgagacctgagagtcactcttacctaccagaactgggtaagtcagagatggaatttatcgaatccaaaagacccaggctcgaattacttcccgatcccttgctgcgacccagtccacttcttgcaacgggccagccggctggttcagaagacctaacaaaagacaggagccttacgggtaagttggaacctgttagccccccttctcctccgcataccgacccagaactcgagctggtgcccccaagactgtccaaggaggagcttattcaaaatatggaccgcgtagacagagaaattacgatggttgagcagcagatatctaagttaaaaaagaaacaacagcagctggaagaggaagccgctaagccccccgagcctgagaagcctgtatccccgccacccatcgaatccaagcaccgaagcctagtgcagattatttatgacgagaataggaagaaggccgaagctgcacaccggatcctcgaaggcctggggcctcaagtggaactccccctgtacaaccagcccagcgatacccgccagtaccacgagaatattaaaattaatcaggccatgagaaagaagttgattttatattttaagagaagaaatcatgcccgaaaacagtgggagcagaaattctgtcaacgttatgaccagctgatggaagcctgggagaagaaggtggagcgaattgagaataacccaaggcgccgagcaaaagagagtaaagttcgtgaatactatgagaagcagttcccggagatccgaaagcagcgagagttacaagagcgcatgcagtcccgggttgggcagcgtggttctggcctcagcatgtcagccgccagatcagagcatgaagtgtccgaaatcatagatggactgtccgaacaggagaatctggaaaagcaaatgcggcagttggccgtgataccacccatgctctatgacgcagaccagcagcgcatcaaatttataaatatgaacggactgatggcagatcccatgaaagtctacaaggacagacaggtcatgaacatgtggtcggagcaggaaaaggagacatttcgcgagaagtttatgcagcatccaaagaacttcggactcatcgcctcatttttggaaagaaaaaccgtggctgagtgtgtgctctactactacctgacaaagaagaatgagaattacaagtcactggtgcgccggtcctacagacgccggggaaaaagtcagcagcagcagcaacaacagcagcagcagcaacaacagcagcagcaacagccaatgcctcggtccagtcaggaggaaaaggacgaaaaagaaaaggagaaagaggccgagaaggaagaggaaaaaccagaggtggaaaatgataaagaagaccttctcaaagagaagaccgacgatactagcggagaagacaacgacgaaaaggaggccgtcgcgtctaaaggtcggaagacagctaactctcagggacgaaggaaaggccgaataacccggtctatggcaaatgaagctaacagcgaggaggccattaccccacagcagagcgccgagctcgcttctatggaattgaatgagtcctctagatggacagaggaggaaatggaaacagccaaaaaaggtctgctcgagcatggccgaaactggagtgctattgcaaggatggtgggcagtaaaactgtcagccagtgcaagaacttctactttaattataagaagagacagaatctcgacgaaatactgcagcagcacaagctgaagatggagaaagagagaaatgcaagaaggaaaaagaagaaggccccggccgccgcgtctgaggaggccgccttcccacccgttgtagaggatgaggagatggaggccagcggcgttagcgggaacgaggaggagatggtagaggaagctgaggccacggtcaacaatagctctgacacagaatccattcctagtccccatacggaggccgctaaagacacaggccagaatggcccaaagcccccagccaccctcggggccgacgggccaccccccgggccacccaccccgcccccagaagatattccagcccctacagagccaacccccgcttctgaggccaccggggccccaacacctccccctgccccaccatccccttcggctccaccgccagtggtgcctaaagaggaaaaggaagaggagaccgctgcagcccctccggtggaagagggtgaggagcagaagcctcctgcagccgaggaacttgccgtggacacaggtaaggcagaagagcctgtgaaatcagagtgcaccgaggaagctgaggagggccccgccaaaggcaaggatgcggaagctgccgaggctacggccgagggcgctctcaaggctgaaaagaaggaaggggggagtggaagagcgactaccgccaaaagttctggcgcaccacaggacagcgacagctccgcgacttgcagcgcagacgaggttgacgaggccgagggcggggataagaaccgtctgctttccccacggccaagtctcttgactcctactggcgatcctagggctaacgcgagcccccagaagccactggatttaaagcaactgaaacagcgcgccgctgccatcccacccatccaggttaccaaggtacacgagcccccaagggaggatgcggccccaaccaagcctgccccgcctgcccctcctccgccccagaatttgcaaccggaaagtgatgctccacagcagcctgggagctccccccgggggaagtcaaggagccccgcccccccagcggacaaagaagcagaaaagcccgtcttcttcccggccttcgccgctgaggctcagaagctgcctggtgaccccccctgctggacatcaggcttgcccttcccagtcccaccccgcgaagtcattaaggcgtctccacacgcgcccgaccctagcgctttcagttatgcacccccagggcaccctttgcctctgggcctgcacgacaccgctaggcccgtgctccctcgaccgcctaccataagcaatccccctccactcatctccagtgctaagcacccatctgttctggagaggcagataggggctatatcccagggaatgagcgtccaactgcacgtcccatactccgagcatgctaaagcacccgtcggccctgttacaatggggctgccgctgcctatggaccccaaaaagttggctccattcagcggcgtcaagcaagagcagcttagtccacgtggacaggccggcccacccgaatccctcggggtgcctactgctcaggaagcctccgtgctccggggcaccgctttaggcagtgtgcccggtggatcaataacaaagggtatcccctctactcgcgtgccatctgattctgcaattacttaccggggatccatcacgcatggcaccccagccgatgttttatacaagggcacaatcacccggatcattggagaggactctcctagtcgtctggatcgaggtcgcgaggactctctgccaaaggggcacgtgatctatgaagggaaaaagggccatgtgctatcctatgaggggggcatgagcgtgacccagtgcagcaaggaggacggaaggtcctcctccgggccaccccacgagaccgctgccccaaaacggacttacgacatgatggaaggaagggttggccgtgccatctctagcgccagtattgaggggctgatgggcagggcaattccacccgagcgacactctccacatcatcttaaagagcagcatcatattcggggaagcataacgcagggaatccctaggtcgtacgttgaggctcaggaagattacctcagacgcgaagcaaaattactcaaaagagagggaaccccgccaccaccccctcccagccgtgatttaacagaagcctacaagacccaggctctgggccctctcaaattgaaaccagcccacgaaggtcttgtcgccaccgtgaaggaggccggccgctcgattcatgagatcccaagagaagagttgagacatacaccagaacttcctcttgcacctcggcctttaaaagaaggttctatcactcaggggacccctctgaagtatgacaccggggccagcaccactggctcaaaaaaacacgacgtacgatccctcattggctccccagggagaacctttccgccggtccacccactggacgtgatggcagatgcccgcgctttggagcgtgcctgctacgaagaaagcctcaagtcccggccagggaccgctagttcttcaggagggagtatcgctagaggcgccccagtcattgttcctgaactgggaaagccccgccagagtcccctgacttacgaggaccacggtgcccctttcgctgggcaccttccaaggggcagtccagtgaccacacgggagccaaccccgcggctccaggagggatctttatccagcagcaaggccagccaggaccgtaagctgaccagcacaccgcgcgagattgctaaatccccgcactctacagtccccgagcaccaccctcatccaatctctccgtacgagcatctgttgagaggtgttagtggcgttgatctgtatagatcccacatccccttggcctttgaccccacaagcatccccaggggaatcccactggatgccgcagccgcctactatctccccaggcacctcgctcccaaccccacatacccacacttgtatcccccatatctgattcgtggctaccccgacaccgccgccttggagaatcggcaaacaatcataaacgactatatcacgtcccagcagatgcaccacaatgccgccacagccatggctcaacgcgcggacatgctaaggggactctccccacgagagtccagtctagccttgaactacgccgcaggcccacgcgggatcatagatctgagtcaagtgccgcacctgccggtactggttccacccacaccgggcacaccagcgactgctatggaccgattagcttatctgcccaccgcaccgcagccctttagttcccggcactcgagtagccctctgtcccctggaggccccacacacctgacaaagcccaccactacgagtagttcagaacgggaacgggatagagaccgggagagagatcgcgacagggaaagggagaagtcaatcttaacttcaaccacaacggtcgaacatgcgccaatctggaggcctggaactgaacagtcttccggttcctcgggtggtggaggcggatcaagttctcgccccgcatcacactcgcacgctcaccagcactctcctatcagcccccgcacccaggacgccttgcagcaacgacctagtgtgctgcacaacacggggatgaaaggaatcataactgccgtcgaaccctcaactcctaccgtgctaagaagcactagcacctcatcccctgtcagaccagccgctacctttcctcctgccacacattgcccgcttggggggaccttagatggcgtttatcccaccttaatggagccagtgctactccccaaagaggccccacgcgttgcccgccctgaacggccgagggctgataccggacatgctttcctggcaaaaccaccagcgcggtccggactggagcctgcttcctcccccagcaaaggcagtgagcctaggcctctcgtgcctccagtgtccggacatgctaccatcgctcggacacctgctaaaaatctggctccgcaccacgcctctcccgatccccccgcgccaccagcttcagccagtgatcctcatagagaaaaaacccagtccaagccattctctatccaagagctggaactgaggtcactggggtaccatggctccagttacagtccagaaggagtggagccagtctcacctgtctctagtccttccctgacccacgacaaaggactgccgaagcacttggaggagctggacaaatcacacctggaaggcgagttgcggccaaagcagccaggacctgtcaagctggggggcgaggcggcgcacctgcctcatctgcgtcctctgcctgagtcacagcccagtagttctccccttctacaaacagcgccaggcgtcaagggacatcagcgggtggtcacgctggcacagcatatctcagaagtcatcacgcaagactatacgcgccaccatccccagcagttaagtgccccactgccagcacccctctacagtttccctggcgcgtcgtgtcctgtcctagatcttagacggcccccttccgacctgtacctgcctcctccagatcacggcgcaccagcccgcggctctcctcattccgaaggaggcaagcgctctccagaacccaataaaaccagtgtcctgggggggggagaggacggtattgaaccagtgtcgcccccagaaggaatgacagaacccgggcatagtaggtccgcagtgtatcccctgttgtaccgggacggtgagcaaactgaacctagcaggatgggctctaaaagccccggaaacaccagccagcccccagccttcttctcaaaacttactgaatctaactccgccatggttaagtcaaaaaaacaggagatcaacaaaaaactcaatacgcacaatcggaacgagccagaatacaacatctctcagccaggcactgaaattttcaacatgccggctatcaccggaaccggcctcatgacttatcggtcacaagccgtccaggagcacgcgtcgaccaacatggggctggaagctatcatccgaaaagccctgatgggcggaggggggaaggctaaggtatctggccggccttcctccaggaaagccaagtctcccgctcccgggttagcgtcaggcgatcggcctccttcagtgagcagtgtgcatagcgaaggagactgcaaccggcggacgcccctgacaaatagagtgtgggaggacaggccctcctccgccgggagcaccccgttcccatataacccgctgatcatgaggctccaggcaggcgtgatggcctcacctccaccgcccggcctgcccgccgggtcagggcccctggcaggtcctcatcacgcctgggatgaagaacctaaaccactgctctgctcacagtatgaaacgctgtccgacagtgagtag

SEQ ID NO: 197725 - DNA, 6228 bp, Artificial Sequence
  Description of Artificial Sequence: Synthetic coding sequence
atgtggagcgagcaggagaaggagaccttccgggagaagttcatgcagcatcctaaaaacttcggcctaatagcgtcgttcctggagcggaaaaccgtcgcagagtgcgtgctgtattactacctaaccaaaaagaatgagaattacaaatcattggttagaagatcctatcgtcgtagaggcaagtcacagcagcagcaacaacagcagcaacaacagcagcagcagcagcagcaacagcccatgccaaggtcttctcaagaagagaaagatgagaaggagaaggagaaagaggcagaaaaggaagaggaaaagcccgaggtggagaacgacaaagaagatctgttgaaagaaaagacggacgatacatctggagaagacaatgatgaaaaagaagctgtcgcgtccaagggcaggaagaccgcgaactcccagggccgacgcaagggtaggatcaccaggagcatggctaacgaggctaatagcgaagaagcgattaccccccagcagagcgccgagctggctagtatggaactcaatgagtcctctcggtggactgaagaggagatggagacagcaaagaagggactgctggaacacggccgcaattggagtgccattgcacggatggtggggagcaagaccgtgtcccagtgtaagaacttttactttaactacaagaaacgccagaacctcgacgaaattctgcagcaacataagctcaaaatggaaaaagagcgaaacgctagacgtaagaaaaaaaaggcgcccgctgctgccagcgaggaggccgctttccctcctgtagttgaggacgaagaaatggaggcctctggcgtgtctggtaacgaagaagagatggttgaggaggccgaagctaccgtgaacaacagtagcgacaccgaaagcattccatcccctcacaccgaagccgcaaaggatacagggcagaacgggcctaaacctcctgctaccctcggtgctgatgggccacctcctggtccccctacccccccacctgaggatatcccagcacccacagaaccgaccccagcctccgaggctacaggggctcccactcccccccccgcacccccatctccgtcagctcctccccctgtcgtcccaaaggaggaaaaggaggaggaaacagcagccgctccaccagtggaagaaggggaagaacaaaagccaccagccgccgaagagcttgcggtggatactggtaaagctgaggagcctgtgaagtcagagtgcactgaagaggcggaagagggaccagcaaaaggtaaagacgctgaggccgctgaggcaacagctgaaggcgccctcaaggccgaaaagaaagagggaggaagcggaagggcaacaacggcaaagtcttctggtgccccccaggactccgactccagtgcgacctgttccgccgatgaggttgacgaggcagaaggcggtgacaagaaccgactgctgagcccacgcccatctctgctcacacccacgggagaccccagggccaacgcaagcccacaaaagcctttagaccttaaacagctcaaacagagggcggccgcaatcccccctatccaggtcactaaggtgcacgagcctccaagagaggacgctgcgccaactaagcctgccccacctgcccctccaccccctcaaaacttgcaacctgaatctgacgctccccagcagccaggatccagcccccgcggaaagtctcggtcccccgcccctcctgccgacaaagaagcagagaagccagtgttttttccagccttcgccgccgaagcgcaaaagctcccaggggaccctccatgttggacatcaggcttgccctttccagttccgccacgagaagtaatcaaggcttcacctcatgccccggaccccagcgctttttcctatgcgccccctgggcacccactgcccctgggcctccacgatactgcaagaccagtgcttccccgcccccctaccatcagtaaccctccacctctcatcagctccgcaaagcatccaagcgtgctggaaagacagataggggcaatatcccagggcatgagcgtgcaacttcatgtgccctatagtgagcatgccaaagcccccgtggggccagtgacaatggggttgcccctgcctatggaccctaaaaagctggcaccattttccggcgtgaagcaggaacaactgtcaccacggggacaggctggaccccccgagtctctcggggtgcccaccgcccaagaggctagcgtgctgcgcggtactgcactgggaagtgtgccaggaggatctatcaccaaaggcataccatctaccagggtgccatcggattccgccataacctaccgaggaagcatcacccacgggacacctgcagatgtgctatataaaggtacgataacccgaataattggcgaggacagtccttcacggctggatcggggaagggaggactctctgccaaaaggccatgttatatatgaagggaaaaagggtcatgtgctctcatacgaaggtgggatgtccgtcactcaatgttcgaaagaagacggacgtagtagcagcggaccccctcatgagaccgctgcccctaaacgtacttatgatatgatggaaggccgagtgggaagagccatcagctccgccagcatcgaggggttgatggggcgcgcaatccccccggagcgacatagtccacaccatttaaaggagcagcaccatataagaggctccatcacccaggggatccccagatcatatgtcgaggctcaggaagactaccttaggagggaggcaaagcttctcaagagagagggcactccgcctccgcctcccccttctcgggacctaacagaagcctataagactcaagctctgggccccctcaaactgaagccagcacatgagggcctagtcgccaccgtgaaagaggcagggaggtccatccatgaaatccctcgagaagagctgaggcatacgcccgagctcccactagcaccaagaccactgaaagagggaagcattacacagggaaccccattgaaatacgataccggcgctagtacaaccggatccaaaaagcatgatgtccgatcccttattggtagtcctggcagaacgtttccacccgtccatcccctcgacgtgatggctgatgcgcgagctcttgagagggcctgttatgaggagtctcttaagtcacggcctgggacggcctcctcctccggaggctctatcgctcgcggagctccagttatcgtgcctgagctagggaaaccacgtcagagtcccctgacatatgaagatcacggggctccatttgccgggcatctgccaagaggctcccccgtgactactagagaacccaccccccgcctacaagaggggagcctgtcctcttccaaagccagccaggacaggaagcttactagtactccccgggaaatcgcaaagtctccgcacagtacggttccggaacaccatcctcacccaatatctccatacgaacaccttcttagaggggtatcgggcgttgacctctacagatcacacatcccgttggcctttgacccaacttcaattcctcgtggaataccactggatgccgcagccgcctattacttacctcgccacctcgctccgaaccctacttaccctcacctatacccaccatatttaatcaggggctacccggatactgccgccctggagaaccgacagactattatcaacgattacattacgtcccagcaaatgcatcataatgctgctaccgccatggctcagagggccgatatgctccggggactctctccaagggaatcttctctggccctcaactacgccgcaggcccccgcggcattatagatctgtcacaggtcccacatctccctgtgctagttccccccacgcccggaaccccggctacggccatggacaggctcgcgtatctgcccacagcgccacagccgttcagcagcaggcacagctcgagtccactctcaccaggaggtccaacccacctgactaagcctacgactacctcttcttcagaaagggagcgcgaccgcgaccgggagagagaccgggaccgggagagagagaagtccatattgacatcaactactacagtggaacacgccccaatttggcggccgggcactgagcaaagtagcggatcgagcggcggcgggggagggtctagttccaggcctgcttcccacagccacgcccatcagcacagtccgatctcgccccgaacacaagacgccctgcagcaaagaccatccgtgctgcacaatactggaatgaagggcatcatcacagcggtggagccgtccactccaactgtactccgctctacatcaaccagctcccctgtacggccagcagcgacctttccccctgccacacactgtcctctaggcggcactctggatggtgtgtaccccacattgatggaaccagtcttgttacctaaggaagcccctagggtggcccgcccggagcgcccacgggctgacactggccacgccttcttagcaaagccccctgcacgatccggattggagccagctagttctcccagtaagggtagcgaacccaggcccctcgtgcctccagtttcaggccatgcgactattgcgagaactcctgcgaagaatctagcaccgcaccacgcttcaccagaccccccagcgccacctgcaagcgcctcagatccacatcgtgagaaaacacagagcaagcccttctctatccaagaactagaactgcgaagtcttggatatcatggatcctcatatagcccagagggggtggaaccggtcagcccagtctcgagtccttctctgactcatgacaagggtctgcccaaacatctggaggaactcgataagagccacctggaaggcgagctcaggcccaaacagcctggcccagtgaaactaggtggtgaggccgctcaccttcctcatttgagacctctgccagagagtcagccctctagtagccccctgctgcaaactgcccccggggtgaagggacatcagcgcgtcgtcacactcgcacagcacattagcgaagtaattactcaggactatactaggcaccatccgcaacagcttagtgcgccgcttcccgccccactgtattcgtttcccggagcctcttgccctgtcctggatttacggaggcccccctctgacttatatctgccaccacctgaccacggtgcacctgcgagaggttccccacattccgaaggcggaaaacgctctccggagcctaacaagacatcggtgctcggcgggggggaagatggtatcgaaccagtgagcccacccgagggaatgactgagccaggccactcaagaagcgctgtctatccgcttctttatagagacggggagcagaccgagcccagcaggatgggaagcaagagtccaggcaacaccagccagccgcccgctttcttctccaaactcactgaaagtaactctgcaatggtcaaaagcaagaaacaggagattaacaaaaaactgaacacacataataggaatgagccggagtacaatatttctcagcctggcacagaaatcttcaacatgcccgccatcactggaacaggtcttatgacatataggagtcaggcggtgcaggagcacgcctcgaccaatatgggtctcgaagccataatcagaaaagctcttatgggaaagtacgaccagtgggaggagagtccacctttgtctgccaatgcttttaacccattaaacgcatcagcctcccttcccgcggccatgcctatcacggctgccgatggacggagtgatcatactctgacctcgcctggcgggggtggaaaagctaaggtctctgggaggcccagttcaagaaaagctaaaagtcccgctcccgggctggcgtctggagatcggccaccctccgtgtctagtgtgcattccgaaggggattgcaatagacggacgcctctgaccaatagagtgtgggaggaccggcctagtagtgccggttctaccccctttccatataatcccttaataatgcgactacaagcaggcgtcatggccagccctcctccccccgggcttcctgccgggagcgggccgctggctgggccacatcacgcttgggacgaagagcccaagcctctgttgtgtagccagtatgagacactgtccgacagcgaatag

SEQ ID NO: 197726 - DNA, 7377 bp, Artificial Sequence
  Description of Artificial Sequence: Synthetic coding sequence
atgagcggcagcacccagcccgtggcccagacctggcgggccaccgagccgagatatccaccacattcactatcatacccagtgcagatcgcccgcacccacactgatgttgggctgttggagtaccagcaccatagccgggactacgcttcacacctatctcccggttcgattattcaacctcagcgaaggcgcccatctctcctgtccgagtttcaaccagggaatgagaggtcccaggagctgcacctgcgccccgaaagtcactcttatctgcctgagctaggtaaatccgaaatggaattcatagaaagcaagcggccgagactggagttactcccggatcctctgttgaggccgtcccctctcctggctacaggccagccagcaggatccgaggacttgacaaaagatagaagtctcacgggcaagctcgagcccgtgtccccaccctccccgccccataccgacccagaacttgagctggtgcccccaagactgtcgaaagaagagcttattcaaaacatggaccgcgtcgatcgtgaaataacgatggtggaacagcaaattagcaagttgaaaaagaaacaacagcagttggaggaagaggctgctaaaccccccgagccagaaaagccggtgagcccccctcctatcgaaagcaagcaccgaagtctggtccaaatcatatatgacgaaaaccgtaaaaaagcagaagctgctcatcgcatcctggaaggattggggcctcaggttgagctccccctgtataaccaaccttccgacacaaggcagtatcatgagaacatcaagatcaaccaggccatgcgcaaaaagctgatcctctatttcaagaggaggaatcacgcacgtaaacaatgggaacaaaaattctgtcagagatacgaccagctgatggaggcctgggagaaaaaggtggaacgaatcgaaaacaatccacgtcgacgagctaaggaatcgaaggttagagagtactatgaaaagcagtttcccgaaatccgcaaacagcgagagttgcaagagcggatgcagagagtcggccaaagggggtccggcttatctatgtcggcagcccggagcgagcatgaagtcagtgaaattatcgatggattgagtgaacaggagaatctggagaagcagatgaggcagcttgctgtgattccaccaatgctgtacgacgcagatcagcagcgaattaaatttattaatatgaatggactgatggctgaccccatgaaagtttataaggacaggcaagttatgaatatgtggagcgagcaggagaaggagaccttccgcgagaagtttatgcagcatcctaaaaattttggcttaatcgcctctttcctcgaaagaaaaaccgtggcagagtgtgtgttatactactatttaacgaagaagaacgaaaactataagtccctcgtgcgccgatcctatcgccgtaggggcaagagccagcagcaacagcagcaacaacagcagcaacagcaacagcagcaacaacagccaatgcccagaagctcccaagaagaaaaggacgagaaggaaaaggagaaagaagcagagaaggaggaggagaagcctgaagttgagaacgacaaggaagatctgctgaaagagaagaccgacgatacatcaggggaggataatgacgagaaggaagcggtggcctcaaaaggcagaaagacggccaactcgcaaggtcgacgcaagggtagaattactcgcagtatggcgaatgaggccaacagcgaggaagctatcaccccccaacaatccgcagagctggcatccatggagcttaatgaatcttcccgatggaccgaggaggaaatggagacagccaagaagggcctcctggagcatggccggaactggtccgccatagctcgcatggtgggaagcaaaactgtctcacagtgtaagaatttctattttaactataaaaaacgacagaatctcgacgagattctccagcagcataagctgaagatggagaaggagcggaacgccagacgcaagaagaagaaggcgccagccgctgcgtctgaggaggccgcttttccccccgtggtggaggacgaggaaatggaagccagcggagtgagcggaaacgaagaggagatggtggaagaagcagaggccactgtcaacaatagctctgacacagaatccattccctcccctcacactgaggccgcaaaggataccggccagaacgggccaaaaccacccgccacgcttggggccgacggccctcctcctgggccacccactccaccaccggaggacatccctgctcctacggaaccgacgcctgcctctgaagcaactggggcccctaccccgccaccggcccctccttcaccctcagcacccccccccgtggtgccgaaagaggagaaagaagaagaaaccgcagccgctccacctgtcgaagagggcgaagagcagaagccacctgctgcggaggagctggcagtggataccggtaaagcagaggaacctgtcaagtctgagtgtaccgaagaagccgaggaagggcccgcaaagggaaaagatgctgaagccgctgaggcaactgccgagggggccctgaaggccgagaaaaaggaggggggtagcggaagggctaccacggctaaatcctctggggcgccccaggacagcgactcctcagctacttgctccgctgatgaggtggatgaggccgaaggcggtgacaagaatcgactgctgagccctcggccttccctacttacccccaccggggatcctcgcgcaaatgcttctcctcagaaaccgttggaccttaagcagctgaaacagcgggccgcggccatcccaccaattcaggtcacaaaggttcacgaaccccccagggaggatgctgcgcctactaagcccgccccaccagcccccccaccgccacagaacttacagccagaaagtgacgcaccccaacagccggggagtagtcctaggggcaagtcccgcagccccgcacctcctgcagacaaggaggcagaaaaaccagtgttttttccggcatttgcagccgaggcacagaagctccccggggatcccccatgctggacttctggtttgcctttccctgtgccgccccgagaagtgattaaggcttctccacacgctccagatccgagcgcattcagctacgctcccccaggccaccccctgcccctgggactgcacgatactgcgcgccctgtgctccctcgacctccaactattagcaacccacctcctctgatctcctctgctaagcacccatccgtgctggagcgccagatcggtgcaatttcccagggaatgagtgtgcagctgcatgtgccttactctgaacacgccaaagcgccagtcggacccgtgactatggggcttccactgccgatggatcccaagaaactagccccattttccggagtcaaacaggagcagctttctcctagaggccaagcgggccctcctgagtctctaggcgtgcctactgcccaggaggcctccgttctgagagggactgccttgggatctgtcccgggtggatcaattaccaaaggaatcccgtccacaagagtgccctcggactctgcaatcacgtaccggggctcaattacccacgggacccccgcggacgtactgtataagggcaccattacaaggattattggggaggactctcctagtcgcctggacagggggagagaggatagcctgcctaagggacatgtaatctatgagggtaaaaaaggtcacgtcctgtcatacgagggcggcatgtcggtgacccagtgcagtaaagaagatgggcgaagtagttcagggccgcctcacgagacagcggcccctaagagaacatacgatatgatggaaggtagggtaggcagagccatttcctcagctagtattgaaggattgatgggacgcgcgataccacccgagagacatagcccccatcacttaaaagaacaacaccatattagagggagcattacccagggtattccacgatcctacgtggaggcccaagaagattacctcaggcgcgaggccaagttgctcaagagagaaggaactccccctccgcctcctccctcccgagatctaactgaggcatataaaacgcaggccttgggacccttgaagcttaaacccgcacacgagggtctggtggccactgtcaaagaagcaggccgcagcattcatgagatcccccgagaagaactaaggcacaccccagagttgcccctggcaccccgtcctctgaaggagggttcgattactcaagggaccccactgaagtatgacacaggcgcctccaccacaggatcaaagaagcacgatgtgcgatcccttatcggtagcccgggacggaccttccctccagtgcaccccctcgacgtcatggctgacgcgcgggcactggaacgagcctgttacgaggagtcactgaaatctaggccagggactgcaagtagctccgggggcagcattgccaggggcgcccccgtgatcgtgcccgaactggggaaaccacggcagtcccccctaacttatgaagatcacggggccccttttgctggccacctgccacggggcagcccagtgaccactcgggagcccactccccggctgcaggagggttcgctttcaagctcaaaagcttcacaggatcgaaaattgactagcacaccgagggagatcgccaaatccccccactcaactgtgcccgaacaccacccacatcctataagcccctacgagcaccttcttagaggtgtgtctggggtggacctatacagaagccacatcccacttgcattcgatccaacctctatccctaggggcatccccctagacgcggcagcagcgtactacttgcccaggcatctcgccccaaaccccacatatcctcacctgtaccccccatatttgatccgcggttaccccgacacagctgccctggagaatcggcaaacgataattaatgattacattaccagccaacagatgcaccataatgctgcaaccgccatggctcagagagctgacatgctgaggggtctttcaccacgggagtcctctttggcattaaactacgctgccggacccagagggatcatagacctgagtcaggtgccccatctgcccgtactcgtgccacctacccccggtacacctgccactgcaatggatcgtctggcttatctgcccactgcccctcagcctttctcgtcccgtcattctagttctcccctatcaccagggggacccacacatctgaccaagcccactacaacttcgtcctccgaaagggagcgggaccgggacagggaacgggacagggatcgagagcgggaaaaaagcatattgacttcaaccacgacagtggaacacgcacctatttggcggccaggaacggagcaatcatcaggcagctcaggtggcggtggcggttcatcatctagacccgccagtcatagccacgctcaccagcacagcccaatctctccaaggactcaagacgccctccaacagcggccatcggtgctgcacaacacagggatgaaggggattatcactgccgtcgaacctagtacccctacagtactgcgctcaacatctacgagctctccggttagacccgctgccacttttcctcccgctacgcactgtcccctgggcggaacactcgatggcgtctaccctacattaatggagccagtgctgctccctaaagaagccccccgcgtcgctcggcccgagcggccacgagcagatacagggcacgcatttctggctaagccccctgcgaggtccgggctggagcctgcctcaagcccctccaaaggttcagaacctagacctctcgttccaccagtctccggacacgccactatcgccagaactcccgccaagaacctggcaccccaccatgcgtcacctgatccccctgccccacccgcctctgcctccgacccccacagggaaaagacccagtctaagccattctccattcaggagttagagctgagaagcttaggataccatggatcctcctattcacctgaaggagtagaaccagtcagcccagtttcgtccccttcgctgacacacgacaaaggcctgccaaagcacctggaagaacttgacaagtcccacctagagggggaactgcggcctaagcaacccgggccagtgaagctgggcggggaagccgcccacctgccacatctgaggccactacccgaatcacagccttcttcaagcccccttcttcagactgctcccggcgtgaagggccaccagcgggtggttaccctcgcccagcatatcagtgaggtaataacacaggattacacccgacatcacccgcaacaactttcggcccctctgcccgctccactgtactcctttccgggcgcctcttgtcccgtgttggatctgaggcgacccccttctgacctgtatctgcctcctccggatcacggggccccggcccgagggagcccccattcagagggcggaaagcgctcacctgagcctaataaaaccagtgttttgggagggggtgaagacggaatcgaacccgtgagcccgcccgagggcatgactgagcccggacattctagatctgccgtgtatcctctgctatatcgtgacggtgaacagacggagccttcacgcatgggatccaagagtcccggaaacacgtctcagccaccagcctttttctctaaactgacagagtccaacagcgccatggtgaaaagcaaaaagcaggaaattaataaaaaattgaatactcataaccgaaatgagccagagtacaacatcagccagcctggaaccgaaatttttaacatgccagccatcaccgggactggattgatgacctacagatcccaggctgtgcaggagcatgccagcacgaatatgggcctcgaggctattatcagaaaggccctgatgggcggtggtggcaaagctaaggtatcagggcgtccttccagtagaaaggcaaaatctccagcaccaggactggcaagcggggacagacctccctctgtcagttcggttcactcagagggcgattgcaacagacgtacccccctcacgaatagagtgtgggaggacagacctagtagtgcaggaagtacaccattcccatataaccccctcattatgcgactccaggctggagttatggccagcccccccccgcccggcctccctgccggcagcggccccttggccggcccacatcacgcatgggacgaggaacctaagcccctgctctgctcccagtacgaaaccctgtccgactccgagtag

SEQ ID NO: 197727 - DNA, 7545 bp, Artificial Sequence
  Description of Artificial Sequence: Synthetic coding sequence
atgagcggcagcacccagcccgtggcccagacctggcgggccaccgaacccagatatccccctcacagcctgtcttaccccgtgcagatagccaggacacacactgacgtgggtttgttagagtatcaacatcacagtcgcgactatgcttcgcacctgtcacctggctccattatccagccacagagacggcgcccttccctgctttccgaattccagcccggtaatgagaggagccaagaactccacctgaggccagagagtcactcctacctgcccgagctaggcaagagtgaaatggaatttatcgagtcgaaacggccacggttggaactgctccccgatccactgctccgcccttcaccactccttgcgacgggtcaaccggccgggtccgaggatctcacaaaggacagatccttgactggcaagttggaacctgtgtcacccccatccccaccgcataccgaccctgaactggagctggttccaccgcggctctctaaggaagagcttatccagaatatggacagagtggatagggaaatcacaatggtggagcagcaaatcagcaaactgaaaaaaaaacagcagcagctagaagaggaagcagctaagccgcccgagccggagaagcctgtatcccctcctccgattgagtcaaaacaccgttctctcgtccagattatctacgatgaaaatcgtaaaaaagctgaagccgcacatcggatcctggagggcttgggcccccaggttgagctgccattatacaaccagccatcagatacaaggcagtaccacgagaatatcaagatcaatcaggccatgagaaagaagctaattctgtacttcaagcggcgaaatcacgcacggaagcagtgggagcagaagttctgtcagcggtatgaccagttgatggaggcttgggaaaagaaggttgagagaatcgagaacaatccaagacggcgcgcaaaggaaagtaaagtgcgcgaatattacgagaaacaatttccggagattagaaaacagcgcgaactccaggaaaggatgcagtctagagtcggtcagagaggatctggcttgtctatgagcgctgccaggagtgagcacgaggttagcgaaatcatcgacggactcagtgagcaggagaacctggaaaaacagatgaggcagcttgcggtgatccctcctatgttatacgatgcggaccagcagcgcattaaatttattaatatgaatgggctcatggctgatcctatgaaggtatacaaagacaggcaggtcatgaatatgtggagtgagcaggaaaaggaaacctttagagagaagtttatgcagcaccccaagaacttcggtctcatcgcttccttcctggaacgaaagactgtggccgaatgtgtgctatattactatctgacaaaaaagaatgagaattacaagagcctggtgcggcgtagttatagacgccgaggcaaatcacagcagcagcagcagcagcagcagcagcagcagcagcagcagcagcaacagcccatgccaagatcttcgcaagaggaaaaggatgaaaaggagaaggagaaagaggccgagaaggaggaagagaagcccgaggtggaaaacgacaaggaggatcttctgaaggaaaagaccgatgacaccagtggagaggataatgatgagaaggaggctgtcgccagtaaaggtcggaaaacagctaattcccagggtcgcagaaaagggcgtatcacccgtagcatggccaatgaggctaacagcgaggaagcaatcactccccagcagagtgctgagttggccagcatggagttaaacgagtcaagtcgctggacggaagaggagatggaaactgccaagaagggtctactcgaacatggcagaaactggtctgccattgctagaatggtcgggagcaaaacagtgtcacaatgcaaaaacttttactttaattacaaaaagcgacagaatcttgatgaaatcttgcagcagcacaaacttaagatggaaaaagagaggaacgccagacggaaaaaaaagaaagcacccgctgctgctagtgaggaagcagcctttcctccggtcgtcgaggacgaggagatggaggcttccggagtgagtggcaacgaagaagagatggttgaggaggctgaggccctccacgcaagcggaaacgaggtaccgaggggcgagtgctccggccccgcaacagttaacaattcctccgatactgagagcatcccatcaccacataccgaggccgcaaaagatactggccagaatggccctaagcccccagctaccttgggtgccgacggcccaccaccggggcccccaacccctcccccagaggacatacccgcaccaacagagccaactccagcctcggaagctacaggagctcccacacccccaccagcccccccctctccctccgcacccccgcctgtcgtgccgaaggaagaaaaggaggaagaaacagctgcggccccaccagtcgaagaaggcgaagagcaaaagccccctgccgcagaagagctagccgttgacaccgggaaggctgaggaacctgtgaaaagtgagtgcaccgaggaagcagaggagggccctgcaaagggcaaagatgcagaagccgcagaggctactgccgagggggcactgaaggctgagaagaaagagggagggtctggccgcgccactaccgctaagtcgtctggggctccgcaggacagtgatagctcagccacttgctcagcagacgaagtcgacgaggctgaagggggagacaaaaatagactgctttccccacgcccatccctgctcacccccacgggtgatcctcgagccaatgcctccccacaaaagcctttagatctgaaacaattgaagcagcgagctgcagccatcccgcctattcaagtgactaaggtccatgaacccccccgcgaggacgcagctcctaccaagccagccccccccgcccccccacctccacagaacctgcaacctgagtcagatgctcctcaacagcccggctcaagcccccgtggaaaatcccggagtccggctcccccagccgacaaagaagcgtttgctgcagaagcacagaaactgcccggggaccctccttgctggacttcaggcctgcccttcccagttccccctcgcgaggttattaaagccagcccacacgcccccgatcccagcgcgtttagctacgcccctcctgggcaccccctccctctcggactgcatgacacagctagaccggtgctgccaaggccaccaacaatttcaaatccccccccactgatcagctcagcaaagcacccgtccgttctggagaggcagattggtgcaatttcccagggcatgtctgtacagctacatgtgccctactccgagcatgccaaagctcctgtcggaccagttaccatgggtctgccactccctatggacccaaaaaaacttgctccattcagcggggtgaagcaggaacagctcagcccccgtggccaggcaggcccccctgaaagtctgggtgtcccaactgctcaagaggcttccgtgctgcgcggaacagctttgggctctgttcctggaggcagcatcactaagggaattccatccacacgcgtcccaagcgattccgctatcacataccgtggttcaatcactcacggtacaccagccgacgttctatataagggaacaattactcgcattatcggagaggattccccctccaggctcgacaggggtcgcgaagattctttgcctaaaggacatgtgatatatgagggtaagaaaggccacgtgctgagctacgaagggggcatgtcagtcacgcagtgtagcaaagaagatggccgaagttccagcggcccacctcatgagacagcagccccaaaacgcacgtacgatatgatggaggggagggtcggtcgggcaattagcagcgccagtatcgaggggctgatgggcagagcgatccccccagaacgccactctccccatcacctgaaagagcagcatcatatcaggggatctataactcagggaattccgcgctcttatgtggaggcacaagaggactacctcaggagagaggccaaactcctgaagcgggaaggaacaccgcccccaccacccccctctcgggatcttacggaggcttacaagactcaggctttgggccccctgaagctaaaaccagcgcacgaggggctggtggccacagtgaaggaggcgggtcggtctatacacgaaatccctcgcgaggagctgagacacacaccagaactgccattagctcctcgccctcttaaggaagggagcataacacagggcactccactgaaatacgacaccggggcctccaccactggctccaaaaaacacgacgtgcggagcctgatcggttctcctggcagaacatttccccccgttcacccgctcgacgtcatggcagacgcaagggccttggagagagcctgctatgaagaaagtctcaaatcgcgtcccgggacagcaagttcttcagggggatcaatcgccagaggggcgcccgtcatagtgccagagcttgggaagcctaggcagtccccgctcacatacgaagaccacggcgccccgttcgcgggccacctgccgagaggttcacccgtcaccacacgggaaccaacaccgaggctacaggaggggtccctatctagctccaaggcctcccaggatcggaaactcactagcaccccgcgagagattgctaaatcccctcattctacagtgccagaacatcatcctcaccccatctctccttatgaacacctactcagaggggtcagtggtgtggatctctaccggtcccacataccgttggctttcgatccgacctcaatccctagaggcattcctctggacgctgccgccgcatattacctccctcggcacctcgctccgaaccccacctatccacacctttatcctccctacctgatcagggggtatcccgacaccgccgctttggagaatcgtcaaacgatcataaacgactatattacttcccagcaaatgcaccacaatgccgcgaccgccatggcccagagggccgacatgctacgcgggttgtcgccaagagagtcgtccctagcactgaactacgctgctggacctagaggtatcattgacctctcacaggtgccgcatttgccggtgctcgtgcccccaaccccggggacccccgccaccgccatggaccgactcgcctatctccccaccgccccacagccattctcatctcgacatagctcgagtcccctgtccccaggtggcccaacacaccttaccaagcccacgaccacctcttcctccgaaagagaacgtgatagggaccgtgagcgggatcgagacagggagagagaaaaaagcatcttgaccagcaccacaactgtcgagcacgctccgatttggagaccgggtacagagcagtcctctggttcgagcggcggtggagggggtagtagtagtaggccagccagccactcccacgcacaccagcactcccctatcagccctaggactcaggacgccctgcagcaaaggccaagtgttctgcacaacacgggtatgaaaggtatcataaccgctgtggaaccatccactccaactgtgttgaggtccactagtacaagtagccccgtcaggcccgctgcaacctttcctcctgcaactcactgtccactcggcgggacactggatggggtgtatcccactctcatggaacccgtgctgcttcctaaagaggcgccaagagtggctcgtccggagaggcccagagctgatacggggcatgcgtttctcgctaagcctcccgctcgtagtggacttgaaccagcctccagcccttcaaaaggaagcgagcctcgtcctctggtaccaccagtgtcagggcatgctacgatcgctcgcacaccggccaaaaacttagctccacaccacgcttcacccgatccccctgccccgcctgcgtccgctagcgaccctcacagagagaaaactcagtccaagcctttcagcatacaggagctagaactcagaagtttaggatatcacgggagcagctactccccagagggggtggaacccgtgtccccagttagtagtccttccctgacccacgataaaggactgcccaaacacctggaagaactcgataagtcacacctcgagggggaactgaggcccaaacagccaggacccgtgaagctaggaggcgaagccgctcatctccctcacctgcgacccctgcctgaatcccagccctccagtagccccctgctgcaaacggccccaggggtgaagggacatcaaagagttgtaacactcgctcagcacattagtgaggtgattacacaggattacacaagacaccatcctcaacagttatctgcccctctccccgcccccttatactccttcccaggggcatcttgtccagtgctcgatctgcggcgcccccctagcgatctgtatctgcccccgcctgaccatggagctccagctaggggctccccccattccgaaggaggaaaacgttcgcctgagccaaataagacctcggttttaggcgggggcgaggacggcatcgagccagtgtcccctcccgaggggatgacggaacccggtcatagccggtcagctgtatatcctctgttgtatcgtgacggggagcagaccgaaccctctagaatgggtagtaagagcccagggaatacttcccagcctcctgctttcttttccaagctcaccgagagtaatagtgcaatggtgaagtctaaaaaacaagaaatcaacaaaaaactgaatacccacaacaggaatgagcccgagtataacatctcacagcctggaactgagatctttaacatgccagccattactggcaccggcttgatgacctatcgttcacaggccgtgcaggagcacgctagcaccaacatggggctggaagccataattagaaaagccctaatggggaaatatgatcagtgggaagagtcgcctcctctcagcgctaatgcatttaatcccttgaacgcctcggcctccttgcccgctgccatgcctatcaccgccgcagacggcagaagtgaccatacacttactagccctggaggcggaggcaaagccaaggtttccggacgaccttcttcccgcaaagcaaaaagtccagcccccggacttgcaagcggagatcggcccccatcagtgagtagtgtccattctgaaggcgactgtaatcggaggaccccgctgactaaccgcgtgtgggaagaccgccctagctcggcaggctctactccatttccctacaacccattaatcatgcgattgcaagccggcgtgatggcctcgccacctccccccggactccccgcggggtctggcccacttgccgggccacaccacgcatgggatgaagagcctaaaccccttctctgctcccagtacgagactctgagtgacagcgagtag

SEQ ID NO: 197728 - DNA, 7515 bp, Artificial Sequence
  Description of Artificial Sequence: Synthetic coding sequence
atgagcggcagcacccagcccgtggcccagacctggcgggccaccgagccgagatatcccccacacagtctctcataccccgtccagatagcgaggacccatactgatgtggggctccttgagtaccaacaccacagtcgcgactatgctagtcatttatccccagggagtattatacagcctcagaggagacgtcccagccttctgagcgagtttcaaccaggcaacgaacggagccaggaattgcatcttagaccggaatcccactcctacctccctgagcttggtaaaagtgagatggagtttattgagagcaagaggcccagacttgaacttttgccagatccactgttgcgtccatcccccttattggccaccggccagcccgccggcagtgaggatctgacaaaggatcggagcctgacaggaaagctcgagcccgtgagtcctccctccccgccccacactgacccggagctcgaactcgttcctcctcgcctttcgaaagaggagcttatccaaaacatggatcgcgtagacagggagattaccatggtggagcagcagatcagcaagctgaagaagaaacagcaacagctcgaagaggaagccgctaaaccccctgaacccgagaaaccagtcagcccccctcccattgagtccaagcaccggtccctggtgcagattatctacgatgaaaacagaaaaaaggcagaggcggcacataggatcctggagggcctgggaccccaggtggagctgccattatacaaccagccaagcgacacccgacaataccatgagaatatcaaaatcaatcaagcaatgcgaaaaaagctcatcctctatttcaaaaggcgcaatcatgcgcgcaaacagtgggagcagaagttttgccagagatacgaccagcttatggaggcgtgggagaagaaagtagagcgaatcgaaaacaaccccagacgtagggccaaagagagcaaggtccgggaatactacgagaagcagttccctgaaattcgtaagcagagagaactccaggaacggatgcagcgagtcggccagcggggatccgggttgagtatgagtgccgccaggtcggagcacgaagtttccgagatcattgatggtctgagtgaacaggagaatcttgagaaacagatgaggcaattagcggtgatcccacccatgctatatgacgcggaccagcagcgaataaaattcattaacatgaacgggctgatggctgatcccatgaaggtctataaggacagacaggtcatgaacatgtggagtgagcaagaaaaggagacattccgcgagaagttcatgcagcaccctaaaaatttcggactgatcgcatcctttctggaacgtaagacagtggcggaatgcgttctatattattatctaaccaaaaagaacgagaactacaagagcttagtaaggcgatcctatagaaggcgaggaaagagccagcagcaacagcagcaacagcagcagcagcagcagcaacagcagcagcagcccatgcctagatctagccaggaggagaaagacgagaaggagaaagagaaagaggccgagaaggaagaggagaagcctgaagtcgaaaatgataaagaggacctacttaaggagaaaacagatgacaccagcggggaagacaatgatgaaaaagaggctgttgcaagtaagggaaggaagaccgcaaactctcaggggaggagaaagggcaggattacccgatccatggctaatgaggcaaacagcgaggaagccattacacctcagcagtctgcagagctggcctccatggaactgaatgagtcaagtaggtggaccgaagaggaaatggagaccgccaaaaaggggcttctggagcacggcaggaattggagcgccatcgcacggatggttgggtcaaagacagtttcccaatgcaagaacttttattttaattacaaaaagcgccaaaaccttgacgagatcctgcaacagcacaagctcaagatggagaaagagcggaatgcacggcgcaaaaaaaagaaagcccctgccgccgcctcagaagaggcagcgttcccccccgtcgtggaagatgaggaaatggaggcatctggagtctcaggtaatgaagaggagatggtggaagaagctgaagctacggtgaacaactcctccgacactgaatcaatccccagccctcacaccgaggcagcaaaagacaccgggcaaaatgggccgaaaccgcccgcaacattgggcgccgacgggcctccccctggaccacctacaccgccacctgaggatattccagctcccactgagcccactcccgcatcagaggccacaggggctcccaccccaccccccgccccaccatccccatctgcccctcctcccgtggttcccaaagaggagaaagaagaggaaacagctgccgcacctccggtggaggaaggcgaagaacagaagcccccggccgccgaggagctagccgtggataccggcaaagccgaagagcccgttaagtcagagtgcacagaggaggcagaagaaggaccggccaaaggaaaggacgcggaggctgccgaagccacggccgaaggcgccttgaaagcagaaaagaaggaaggcgggtccggccgggcaactactgcaaagtccagtggtgccccgcaagactcagacagctcagctacatgctctgccgacgaagtggacgaggccgagggcggcgacaagaacaggcttctgagcccacggccttcgctgctgactcccaccggcgacccaagagccaatgcgagcccacagaagcccctggatttaaaacagttaaaacagagggccgctgctataccccccatacaggtgactaaagtgcatgaacctccccgcgaagacgctgctcctaccaaacccgctcccccagcaccccctccaccccagaatctgcagcctgagtccgatgctccccagcagcccgggtcaagcccaaggggcaagagccgatcccctgcaccacccgcagataaagaggccgagaaacccgtattctttcccgctttcgccgctgaagcacaaaagctgccaggcgatccaccctgctggaccagtggcctgccatttccagtgcccccacgtgaggtaatcaaagcatctccccacgctcccgacccatctgcattctcatacgcccctcctggacatccgctacctctcggcctgcacgatacagctcgaccagtattaccccggccccctacaatctctaacccccctcccctcattagctccgcaaagcatccatccgtgttggagcggcagatcggagcaatctcacagggtatgagcgtgcaattgcatgtcccttattcagagcacgctaaggcgccggttgggccggtcacaatgggacttcccctgccaatggatccaaagaaattagctcccttctcaggcgtcaaacaggagcagctgtccccacgcggccaagctgggcccccagagagcctgggcgtgcctaccgctcaagaagcgtcagtgctgagggggactgctcttggcagtgtgccggggggcagtatcaccaagggaattccatccactagagtgccttctgattccgctatcacctaccggggatcgatcacacacggaacaccagctgacgtgctctataaaggcactatcacccgcatcataggggaagacagtcccagccgactcgacaggggcagagaggactccctacccaaagggcatgtaatctatgagggcaaaaagggacatgtactgagttacgagggtggcatgagtgtgacccagtgctcaaaggaggacgggagatcaagctccgggcctccgcatgagaccgctgcccctaagcggacctacgacatgatggagggccgggtgggtcgagctatttcgagcgcgagcatagaaggactgatgggtcgcgcaatcccccccgaacggcacagtccccatcacctcaaagaacagcaccacatacggggctccattacccaaggaattccaagaagttacgttgaagctcaagaggactacttacgccgtgaggcgaaactgttgaagcgcgaaggaacccctccccctcccccacccagtagggacctgaccgaggcttataagacacaagccctgggaccactgaaactgaaacccgcccatgaaggacttgtcgcaactgttaaggaagctgggaggagcattcacgagatccccagagaagagctgcggcatacccccgaactacctcttgcccccagacctctgaaggagggcagcataacacaagggactcctctcaagtacgatacgggggcgtctacaaccggtagcaaaaagcatgacgtgcggtccttaatcggtagccctgggcgcacgttcccccccgtgcatcctttggacgttatggcagacgctagagcactggagagagcgtgctatgaggaatcgttgaagtcaaggcccggcactgcctcaagcagtggaggatcaattgctaggggagctcctgtgatcgtgccagagcttggcaagcccagacaatcacctttaacttacgaggatcacggcgcaccttttgccggtcatctgccccgaggctcaccagtgaccacgcgcgagccaactccgaggctccaagagggttctcttagctctagcaaggcctcacaggaccgcaagctaacatctacccctagggagatcgccaagtccccccactcgaccgttccggaacatcatccacacccaataagcccatatgagcatctgttacgcggcgtgtcgggggtcgatttatacagatcccacatcccccttgccttcgatcccacctccatccctcgggggattccactagacgctgccgcagcatattatcttcctagacatctggcaccaaaccctacatacccccatctctacccaccctatctaatccgggggtacccagacaccgctgctctggagaatcgccaaactattatcaacgactatattacctcccagcagatgcatcataacgccgctactgccatggcacaaagagctgacatgttgcgaggattgagccccagagagagctccctggccttgaactacgccgcgggccctcgcggcattatcgacctgtctcaggtgccacacctgccggtgctggtccctcctacgccaggaactcccgccacagctatggacaggctcgcttacctgcctaccgcgcctcagcccttttcgagccggcattctagtagtccccttagtcccggcggacccacacacctcaccaaacccacaactactagctcaagcgagcgtgaacgcgatcgggatagagagagggacagagatagggagcgcgagaaatcaattctgacatcaaccactaccgttgaacatgctcctatctggcgcccgggcaccgaacagtcatctggttctagcggggggggtgggggctccagctcccgaccggcttcccatagccatgcccatcaacacagccccatctccccccggacacaggatgccctgcaacagcgcccatctgtcctgcataacaccgggatgaagggcatcatcaccgccgttgaaccttccactcccaccgtcctgagatctacttcaacaagcagtcctgtaagaccagctgctactttccctcccgccacccattgtcctctgggagggaccctcgatggagtttatcctaccctaatggaacctgtgctgctccctaaggaggctcccagggtcgcaaggccagagcggccacgcgcagatactggccatgcctttttggcaaagcctcccgcgagatctgggttagaaccggcttccagtccttctaagggatccgaacctcgcccactagttccaccagtatctggccacgcaactattgctcggactccagctaaaaacctcgccccgcatcacgcttctcctgaccctcccgctccaccggccagcgcctcagatcctcaccgggagaagactcagtctaaaccattttccatccaggaacttgagctgcggtccctgggttatcatggaagctcctacagcccagagggggttgagcccgtctctcccgtgagctccccaagtctgacgcacgacaaggggctgccaaagcatctggaagagctggataagtcgcacctggagggggaattgcgacccaaacagcctggtcctgtgaaactagggggcgaagctgcacatttgccacatcttaggccgctccccgagtctcaaccatcctcttcccctctgctgcagaccgccccaggcgtgaagggacaccaaagagttgtgacactcgcgcagcatataagcgaagttattacccaggactataccagacaccacccacagcagctctcagctccattgcccgctccactgtactcctttcccggggctagttgccctgtcctagatctgagacgtcctcccagtgatctgtatttgcctcctccagaccatggggcacctgcgcgcggcagtccccactctgaaggagggaaaaggtctcccgaacccaataagacaagcgtgttgggagggggggaggacggcattgagcctgtctctccccccgaaggcatgacagagccaggacatagcaggagcgctgtgtacccccttttgtatcgtgacggtgagcaaactgagcccagtaggatgggaagcaaatcccccggcaatacttctcaaccccccgcatttttcagtaagctgaccgaaagtaatagcgccatggtgaaaagcaaaaagcaggagattaataagaagctaaatacccacaacaggaacgaacctgagtataatatctcacagcctggtactgagattttcaacatgcctgctataacaggtacgggactgatgacatatagatctcaagctgttcaggaacatgccagcactaacatgggcctcgaagccatcattagaaaggcacttatggggaaatacgaccagtgggaagagagccctcccctgtccgcaaatgctttcaaccccctaaatgccagcgccagcctacccgctgctatgccaattactgccgcagatggccggtccgaccatactctgaccagccctggagggggtggcaaggcaaaggttagcggtcggccatcttcaaggaaggcgaagtcccccgctcccggcctagcgtccggcgatcgacctccctcggtgtccagcgtacactccgagggcgattgcaaccggcggactcctctgactaacagagtttgggaggatcgtccatcttccgctggatcaacgcccttcccctacaatcctctaatcatgcgactgcaagctggtgtcatggcctcgcctcccccacccggtctgcccgctgggagcggtcctctggcaggcccgcatcatgcctgggatgaggagccgaaacctttgctgtgttcacagtacgagactcttagcgactccgagtag

SEQ ID NO: 197729 - DNA, 7542 bp, Artificial Sequence
  Description of Artificial Sequence: Synthetic coding sequence
atgagcggcagcacccagcccgtggcccagacctggcgggccaccgaaccccgatatcccccccatagcttgtcctacccagtgcagattgccaggacccataccgacgtaggactgctagagtatcagcatcactcccgcgactacgcctcccatttgtcaccaggttctatcatacagccacaaaggagacgccctagcctgctgtcggaatttcaacctggcaacgaaaggtcccaggagctacatttgaggcctgaaagccatagttacctccctgaactggggaagtctgaaatggaattcatcgagagcaaacgccccagacttgagctgcttcctgaccctctgctgcgaccttccccactcttagctactggtcagcccgcagggtctgaggacctaaccaaagaccgaagcttgacaggtaagctggaacccgtctcacctccaagtcccccccacacggatcctgagctggagctggtgccccccaggttatcaaaggaggagctcatacagaatatggacagagttgatcgggaaatcaccatggtagaacagcagatcagtaaacttaagaaaaaacagcagcagctggaggaagaagctgctaagcctccagagccagagaagcccgtgtcccctccccccatcgagagtaaacaccgcagcctggtccagatcatttacgatgaaaaccggaagaaggctgaggccgctcatcgcattttggagggattgggcccacaagtcgagctgcctctttataaccagccctctgacacccggcagtatcacgaaaacattaagataaatcaggcaatgagaaaaaaactgattctgtacttcaagcggcgcaaccacgctcgaaagcaatgggagcagaagttctgtcaaaggtacgatcagttgatggaggcgtgggaaaagaaggtggagcgcattgaaaacaacccaaggaggcgagccaaggagagtaaagtaagggagtattacgaaaagcaatttccagagatccgcaagcagagggaactccaggagagaatgcagagcagggtaggccagcggggaagcggactgtctatgagtgcagcccggtcagagcacgaggtttccgagattatcgatggactttcggagcaggagaatctggagaaacagatgagacagctggccgtgattcctcctatgttgtatgatgcagatcagcaaagaatcaaatttattaacatgaacggactaatggctgacccaatgaaggtgtataaagatcggcaagtaatgaacatgtggtcagagcaggaaaaggagacttttcgagaaaaattcatgcagcacccgaagaacttcggtctcatcgccagcttccttgagcgtaagacagtggccgagtgcgtgctctactactatttaactaagaagaacgagaactataagtccctggtgagacggtcttaccgcaggagaggcaaatcccagcagcagcagcagcaacaacagcagcaacagcagcagcagcagcagcaacccatgcctaggagctctcaggaagagaaggatgagaaggagaaagagaaggaggcagaaaaagaggaagaaaagcccgaagtcgagaacgacaaagaagacctcctgaaagaaaagaccgacgatacatccggtgaggataacgatgagaaggaagccgtggcttctaagggaagaaaaactgccaatagccaaggcaggcgcaaaggcaggattaccagaagtatggcaaatgaggctaactccgaagaggctatcacaccgcagcaatccgccgaactggcctctatggagctaaacgagtcaagcaggtggactgaggaggaaatggagactgccaagaaggggctcctggagcatgggcggaactggtctgctatagctaggatggtcggcagcaaaactgtgtcccagtgcaagaatttctattttaactataaaaaacgtcaaaatcttgacgaaatcttgcaacagcataaactgaagatggagaaagagagaaatgctcggagaaaaaaaaagaaagcccctgctgccgctagcgaggaagctgcttttccgccagttgttgaagacgaagagatggaagcgtcaggggtcagtgggaacgaagaggaaatggtagaggaggccgaagcgcttcacgccagtgggaatgaagtacccagaggcgaatgtagtgggcccgccaccgtcaataatagttctgacaccgagagtatcccttctcctcacactgaagccgcgaaggataccggccaaaatggtcccaagccccctgctacactgggggctgacggacccccaccaggcccccccacacctccacgtcgcactagtagacctacagagcccactcctgcctcggaggcaactggcgcccctacacccccccctgctcctccctctccttctgccccaccccccgttgttcctaaggaggagaaagaggaagagactgccgccgccccgcccgtcgaggaaggggaagaacagaagcctcccgctgctgaagaactcgccgtcgataccggaaaagctgaggagccagtgaaatccgagtgcacagaagaggctgaggaggggcccgcaaagggcaaagatgccgaagcagctgaggccactgcagagggtgccttgaaagcagaaaaaaaggaagggggctcaggacgcgcgaccactgctaagtctagcggtgcgccacaggactcggactcttctgctacgtgttcagccgacgaagtggatgaagccgagggaggggataagaatcgtctgctgagccctcgtccttccctgctgacgccgacaggcgatccgcgggctaatgcctccccacagaagccattggacctcaagcagctgaagcagcgggccgcagcgatcccacccatccaagtaacaaaggtacatgaaccgccgcgcgaggacgcagccccaactaaacccgctccgccagctcctcctccgccacagaacttgcaaccagagtctgacgcaccgcaacaaccaggtagttctccccggggaaagtcccggtctcctgcccctcccgcagacaaggaagcttttgcggccgaagcccagaagctccccggtgacccaccttgttggaccagcggcctgcccttccccgtccctcctagggaggtgataaaagcgagccctcatgcccctgatcccagcgctttcagctacgcgccaccagggcaccctctaccactgggactccacgatacagcccggccggtactgccccgaccccccacaatctcaaatccacctccgctcatctctagcgccaagcatccatccgtgttagagcgacaaattggcgcaatttcgcagggaatgtcagtgcagttgcacgtgccctactccgagcacgccaaagcgcctgtgggaccagtcaccatgggcctgcccctaccaatggatccgaagaaactggcccctttctccggggtgaaacaggagcaactatctcctagagggcaggccgggcctccagagtccttaggcgtacccaccgcgcaagaggcctctgttctgcgtggcacagccctggggagcgttcccgggggttccattaccaaaggaatcccatccactagggtcccttcagattccgcaataacttatcgtggatctatcacccacgggacacctgccgatgtcctgtataagggcactattacgcgaattatcggcgaagattctcctagccggctagatagaggaagagaggacagcctgccgaagggacacgtgatttacgagggaaagaaaggccatgtactgagctacgaagggggaatgtctgtaacacagtgttcaaaggaggacggaaggtctagctccgggccccctcatgagacagctgcccctaaacggacgtacgacatgatggaaggacgtgtgggacgggctatttctagcgcgtcaattgaaggattgatggggcgcgccatccctcccgagagacacagcccccaccatctaaaagaacagcaccacattagaggcagcattactcagggcatccccagatcctacgtggaggcacaagaggattacctacggcgtgaggcaaaactgcttaagagagaggggacgccaccacctcctcctccatctagggatctgacagaggcatataaaacgcaagcactcggaccgctgaagctgaagcctgcacatgagggtctggtagcgaccgttaaggaggcgggccgcagcatacacgaaatcccgcgggaagaactgcggcacactcccgaactgcctcttgctccccgccctctgaaggaaggaagcattacccaggggacacctctaaaatacgataccggcgcctccaccactggctccaaaaaacatgacgttcggagtttaattggcagtcctgggcggacttttccacccgtccatccccttgatgtgatggccgacgcccgggccctcgaaagagcttgctacgaggagtctctgaagtcccggcccggaaccgcaagctcctccggggggtccatagcgagaggagcacccgtcattgttcctgagctaggtaagcctcgtcagtcgcccctgacctacgaagatcatggtgccccctttgcaggacatctgcctcgggggagtccagtcaccactagggagccaacaccaagactgcaggaaggatctctttccagtagtaaggctagtcaggatcgcaagttgacctctacacccagagaaattgctaaatccccccattcaacggttcccgagcaccacccccatcccatctccccctacgagcacctcctgcggggcgtctctggggtcgatctatacagatctcatattcctctggctttcgatccaacgagtatcccccggggcattcctctagacgctgcagccgcctactacctacctcggcatttggctcctaaccccacctatccacatctctacccaccttacctgattcgaggttatcccgacacagcagctctggagaacaggcagacaataatcaacgactatatcacctctcagcagatgcaccacaatgcggcaacagctatggcgcagcgggccgatatgttgagagggctgtcaccacgggaatcatcactcgctttgaattacgctgctggtccacgggggatcatcgacctctcacaggtcccccacctccctgtccttgtcccccccaccccagggacgcctgcaactgctatggatcgcctggcctatctgccaactgctcctcagcccttttcctcaaggcactccagctctcctttatcgcccggaggccctacacatttgacaaagccaaccactactagttcctctgagcgggagagggatagagacagggaacgcgacagggatcgtgagcgggaaaagagcattctcacaagcaccactacagtggagcacgcccctatctggagacccgggaccgagcagtcctctggctctagcggaggcggcggcggaagctcctcgagaccggccagccacagccatgcccatcagcattcacccattagccctcgtacacaggatgctctccagcagcggcccagcgttctgcacaacacaggcatgaaggggatcatcactgccgtggagccgtcgacaccaacagttctgcggtccaccagcacttcttcccccgtccgacctgccgccacttttcccccggccactcattgtccccttggagggaccctcgacggggtgtatcccacgctgatggaaccagtcctgttgccaaaagaggccccgagagtggcccgccccgaaaggccccgcgccgacactggtcacgcattcttagcaaagccccccgctaggagtggtctggagccggcaagctccccttctaaagggagtgagccacgcccccttgtcccgcctgtttctggtcacgctacaattgcacgcaccccagctaaaaaccttgccccacatcacgcctctcccgacccacctgcccctcccgcaagtgcgtcagacccccaccgagaaaagacacagagtaaaccttttagtattcaggagcttgagctccggtcattgggttaccatggctcttcatactcccccgagggggtggagcccgtttcccctgtgtctagtccaagcctgactcacgacaaaggtctacctaaacaccttgaagagctggacaaatcccatcttgaaggggagctgcgccccaagcagccgggacccgtgaagctgggtggcgaggcagctcacctgccacacctcaggcccctacccgaaagccaaccgtcctctagtcctctgcttcagaccgcaccaggcgtgaagggccaccagagagtagtgacactcgctcagcacatctccgaagtgataacacaggactacacacgacaccatccacaacaactgtccgctcccctccccgcgcccctgtacagcttcccaggcgcatcctgcccagttctggacttgaggcggcctccttcagatttatacctcccacctcctgaccacggggctcccgctcgaggctccccccacagcgagggcggaaagcgctcccccgaacctaacaaaacatcggtcttagggggaggcgaggatggcattgaacccgtcagtccacccgagggaatgactgagcccggtcattcacggagcgcagtttatccacttctgtatagggacggcgaacaaactgagccatcgaggatgggctccaagtctcccggcaacactagtcaacccccggcttttttttctaaactgaccgaaagcaactccgccatggtgaagtccaagaaacaggagatcaacaaaaaactcaacacacataatcgcaatgagcctgagtataacatttcacagcccggaaccgaaattttcaatatgcccgcaattaccggcacgggtctgatgacttaccgttcacaggctgtgcaagagcacgcatccactaacatgggactggaagccatcattaggaaagctttaatgggtaagtatgaccagtgggaagagtccccccccctaagcgctaatgcgtttaacccactcaatgccagcgcctctctgcctgcggccatgcccatcaccgcagccgacggccgctcagaccacacactcaccagtccgggaggaggagggaaagccaaagtgtccgggaggccaagctctcgtaaagctaagtctccggcaccggggctagcctccggtgaccggccaccaagcgttagttccgtccatagtgaaggcgactgcaacaggcgcacacctttgacaaaccgagtctgggaggatcgaccaagttccgccggctctacccctttcccttacaacccactgatcatgcgtctgcaggccggcgtcatggcatcacctccccctccaggcctcccggcaggcagcggccccctcgcgggtccccaccacgcctgggacgaagagcctaaaccgctgctttgttcacagtatgagaccctgagcgacagtgagtag

SEQ ID NO: 197730 - DNA, 1821 bp, Artificial Sequence
  Description of Artificial Sequence: Synthetic coding sequence
ctgcagagcggcgccacccactgccccctgggcggcaccctggacggagtctatcccacactcatggaacccgtactactgccaaaggaagccccgagggtggccaggcctgagcgccctcgggccgacaccggccacgcttttctggccaaaccacccgcacgttccggccttgaacccgctagcagccctagcaaaggaagcgaacctcggccacttgtgccccctgtttctggacacgcgacgatagctaggactcctgccaagaatctggctcctcatcatgcatcacccgatccacctgccccaccggctagcgccagcgatccacaccgagagaagacacaatccaagcccttcagcattcaggagctggagcttcggagcctcggctaccacgggtcaagctactcccccgagggggtggaacccgtatcaccagtcagcagcccctcccttactcacgacaaagggctgccaaagcatctagaggagcttgacaaaagtcacctggagggtgagctcagacccaaacagccaggaccagttaagcttggcggggaggccgcgcacctcccacatttgcggcccctgcccgagtctcagccatcaagcagccctttgctgcagacagctccgggcgtgaaaggtcaccaacgggtggtaacacttgctcaacatattagcgaggttattacccaagattacactcggcatcatcctcagcaactgtccgcacctttacccgctcccctttactcttttcctggagccagttgtcccgtcctggacttgcgccgccccccgtccgacctgtaccttcctcctccggatcacggtgctcccgctcggggtagtccacactctgagggcggcaaaagatctcccgagcctaataaaacatctgttcttggcggtggggaagatgggatcgagcctgtgtcccctcctgaaggcatgactgaacctggccactccaggtcagctgtgtacccccttttgtaccgggacggagagcagacagaaccctctagaatggggtccaagtctccaggcaacaccagccagccacccgcctttttctcaaaattgaccgagagcaactcagccatggtgaaaagtaagaagcaggaaatcaataagaagctgaatacccataacagaaatgagcccgagtataacatcagccagcctggcaccgagattttcaatatgcctgccatcacggggacaggacttatgacgtacaggagccaggctgtccaagaacacgcgagtacgaatatgggtctcgaagcgatcatacgaaaggccctgatgggcaagtacgatcagtgggaggaaagtccccccctgtctgccaatgcctttaaccccttaaatgccagcgcatctctgcctgcagccatgcccatcacagccgctgacgggagatccgatcacacactgacttctcctggaggaggcgggaaggcaaaagtgtcaggaaggccctccagccgaaaggctaagtcaccggctccaggacttgcaagtggggaccgccctccatcagtgagctctgtacactccgagggcgactgtaataggaggactccattaacaaatcgggtatgggaggacaggcctagttcagctggcagcaccccgttcccttataatccccttatcatgaggctgcaagctggagtcatggcatccccaccaccccctggtctgcctgcaggatcaggacccctggccggaccccaccatgcatgggatgaagaaccaaaacccctgctgtgttctcagtatgagacactatcagacagcgagtag

SEQ ID NO: 197731 - DNA, 726 bp, Artificial Sequence
  Description of Artificial Sequence: Synthetic coding sequence
atgttctacagcggcctgctgaccgagggcggccggaaggagaccgacatgagagaggctgcatctctgcgccaacagagacgaatgaagcaagccgtacaattcatccacaaagactccgccgatctcttgccgctcgacggcctgaagaaactcgggagcagcaaggacatgcagccacataacatactccagcgcagactgatggagacgaatctgagtaagttacgctcgggaccccgagtgccttgggccagtaagactaacaagctcaaccaagctaagagtgaaggcttaaagaagtcggaggaggacgatatgattctggtgtcatgtcagtgcgccggcaaagacgtcaaagcgctggtcgacaccggatgcctgtataatctgatttctctggcctgtgttgaccgactgggactgaaggagcacgtaaagtctcacaaacatgagggtgaaaaattgtcactgccgcgacacctaaaagtggtggggcagatcgagcacctcgtgatcaccctgggcagcctcagactggactgtcctgccgcagtcgtggatgataacgaaaagaatctttcattagggttacaaacgctgcgatcacttaaatgcatcatcaatctcgacaaacatcgtctgatcatgggtaaaacagacaaagaagaaatcccttttgtcgagaccgtgtccctcaacgaggataacacttccgaagcatag

SEQ ID NO: 197732 - DNA, 774 bp, Artificial Sequence
  Description of Artificial Sequence: Synthetic coding sequence
atgagcaccagccagcccggcgcctgcccctgccagggcgccgccagcagaccagcaatcctctatgccctgttatcatcctccctcaaagctgtacccaggccgcggtctcgctgcctctgtcgccagcaccgaccagtccagctatgtgctccccacaggacctgccgcgaagccctggacgtgctcgccaagacagtcgcctttctacggaatcttcccagtttctggcaactgccccctcaagatcagcgcagactattgcaggggtgttgggggccactgttcttgctgggactagcccaggacgcagtgacctttgaggtggccgaggcccccgtgccatccatactgaaaaagatattgctcgaagagccatcgtcaagtggcggcagcggacagctgcccgaccgcccccagccttcactagcagctgtgcagtggttacaatgttgtttagagtccttttggagcttagaactctcaccaaaggagtacgcctgcctcaaggggacaattctgttcaatcccgatgtgcccggattgcaagctgccagccacatcggtcacttgcagcaggaggctcattgggttttatgtgaagtgctcgaaccctggtgtccagcggcccaggggagactcacaagagtgctattgaccgcctccacactgaaaagtatcccaaccagtctgctaggggatttgttttttaggcctattattggggacgtggacatcgccggcttattaggtgatatgcttctgctgcgctag

SEQ ID NO: 197733 - DNA, 1845 bp, Artificial Sequence
  Description of Artificial Sequence: Synthetic coding sequence
atgaccaccctggacagcaacaacaacaccggcggcgtgatcacctatatcggttcttctggctcctctccatcacggacatcgcccgagagcctttatagtgacaacagcaacggatcttttcagtcgctaactcagggttgccccacctactttccccctagccccaccggatccctgacgcaggatcccgccagatccttcggatccatcccgcccagtctgtcagacgatggatccccaagcagctcctcatcctcttcgagtagctctagcagcttttataatggctcccccccaggctccttgcaggtggctatggaggactcctccagggtgtccccatctaaatctacatcaaacattacgaagctaaacggcatggtcttgctttgcaaggtgtgtggtgatgttgctagcggcttccactacggagtgcacgcctgcgaaggatgtaaaggattctttaggcggtcaattcaacagaatattcaatacaagagatgcctcaaaaacgagaattgcagcattgtgcggattaacaggaaccgctgccagcagtgtagatttaagaaatgcctttctgttggcatgtctcgcgatgccgtgcgctttggcaggatcccaaaaagagagaagcagagaatgctggccgagatgcagagcgccatgaacctcgctaacaatcagctctcatcacagtgcccactggaaacctccccaacccagcaccccacacctggaccaatgggaccctcgcccccccccgcacctgtgccctctcccttagtggggtttagtcagtttcctcagcagctgacacctccaagaagcccgagtccagagcctactgtagaggatgtgatctctcaggtcgcacgagcccatcgggaaatttttacctacgctcacgataagctaggctcaagccccggtaattttaacgccaatcatgcctccggctcccctcctgctactaccccacaccggtgggaaaatcagggttgccctcccgcccccaatgacaataacacattggccgcccagcggcataatgaagctctaaatggcctgcgtcaagcaccaagttcataccctccaacgtggcctccgggtccggcccaccacagctgccatcaaagcaattcaaacggacataggttatgtccaacacacgtttacgctgcccccgaaggtaaagccccagcgaacagtccccgacaggggaacagtaaaaatgtcctgttagcttgccctatgaacatgtacccccacggaagatcagggcgtaccgttcaggaaatctgggaagatttcagcatgtcttttaccccagcagtcagggaggtcgtggaattcgctaagcatattccaggctttagagatctcagccagcacgaccaggttactctgctgaaagcgggtacattcgaggtcctgatggttcggttcgccagcttgttcaatgttaaggatcagacagtcatgttcctatccaggactacatattctctacaagaactgggagctatggggatgggtgacctgctaagcgcaatgtttgatttcagcgaaaaactgaattccttggccctaaccgaggaggagctcggcctgttcactgcggttgtgctggtgtctgccgatcgtagcgggatggaaaattcagcatctgtggagcagctccaggagaccttgctccgggctctgagggcactggtgctaaaaaataggccgctagagacctcccggtttacaaagttactcctgaaacttccagacctgcggacgcttaataatatgcacagcgagaaactgctgagcttcagggttgatgctcaatag

SEQ ID NO: 197734 - DNA, 1383 bp, Artificial Sequence
  Description of Artificial Sequence: Synthetic coding sequence
atgagcagccccaccaccagcagcctggacacccccctgcccggcaatggtccacctcaaccaggagcccccagcagttccccgacagtgaaagaagagggtccagaaccctggccaggtgggcccgatcccgatgtgcccggtaccgacgaggctagttcggcctgctccacagactgggtcatccctgaccccgaggaggaacctgaaaggaaaaggaagaaaggacctgctcccaaaatgttgggccacgaactgtgcagggtgtgtggagataaggcaagcggattccactacaatgtgctttcctgcgaaggatgtaaaggatttttccgacggtccgtggtgcgtggcggagcacgaagatatgcatgtcgcggcggtggaacctgccagatggacgcttttatgcgccggaagtgccaacaatgcagattgagaaagtgcaaggaggcaggcatgcgcgagcagtgcgtactgtctgaggaacagatccgcaagaaaaaaattagaaagcagcagcaagagtctcaatcacagtcgcagagtccggtggggccacagggaagcagctcttcagccagcgggcctggggcttcccccgggggtagcgaagcgggatcacaggggtccggggagggagagggggtgcagctaactgctgcacaggagctgatgatccagcagcttgtcgccgcccagctacagtgcaacaagaggagcttctccgatcagccaaaggtgaccccctggccattgggtgcagatccacagagccgcgacgctagacagcagagatttgcccatttcaccgagctggccataatctccgtgcaggagatcgtggacttcgccaagcaagtgcctggtttcttgcaattaggaagggaggaccagatcgctctcctgaaggctagcacaatcgagataatgttgctcgagaccgcacggcggtataatcatgagacggagtgcatcacttttctaaaggactttacatacagcaaagacgacttccaccgggctggactgcaggttgaattcataaatccaattttcgaatttagcagggctatgcggcgcctcggattagacgacgccgagtacgccctgctcatcgccatcaacatctttagtgctgatcgccctaatgtccaggagcccggaagggtagaggctctgcagcagccatacgttgaggccctgctcagttacactaggatcaagcgaccacaagatcaattaaggttcccaaggatgctgatgaaactagtcagtctgcgtaccctttcatccgtccacagcgagcaagtgtttgcgctgcggctgcaagataagaagcttcctccattgctgagcgagatttgggacgtacatgagtag

SEQ ID NO: 197735 - DNA, 1377 bp, Artificial Sequence
  Description of Artificial Sequence: Synthetic coding sequence
atgagcagccccaccaccagcagcctggacacccccctgcccggcaacggccccccacagccaggggcaccctccagctcacccacggtgaaggaggaggggcctgagccatggcccggaggcccagaccccgacgtgccaggaacagacgaggcgtcttctgcttgctctacggattgggtgatcccagatcctgaggaagaacctgaacggaagagaaagaagggtccggctcctaaaatgctgggccatgaactgtgcagggtgtgcggagacaaagcatccggttttcactacaatgtgctgagctgtgaaggttgtaaaggcttcttcaggcgctcggtcgtgcgcggaggtgctcggaggtacgcttgcagaggaggcggaacttgtcaaatggatgcatttatgagacgcaaatgccagcagtgccggctccggaaatgcaaagaggcagggatgcgcgagcagtgtgtgctgtcggaggagcagattcgaaagaaaaaaattcggaagcagcagcaggagtcgcagagccagtctcagagccccgttggacctcaggggtcttccagtagtgcctccggtccaggcgcatcgcccggcggctcggaggcaggctctcagggcagtggcgagggagagggagttcagcttacggctgcccaggagctcatgattcaacaactggtagccgcgcagcttcaatgtaacaagcgatcttttagcgaccagccgaaggtcaccccatggccattgggcgccgaccctcaatctcgggatgctaggcagcagcgctttgcccactttacagagctggcaattatctctgtacaggagattgtggattttgccaaacaggtgccaggcttcttacagcttggtcgagaagatcaaatcgcattgttgaaagcatcgactatcgaaattatgctcctggagaccgctcgtcgctataaccacgaaacagagtgtatcacatttctgaaagattttacttattcgaaagatgattttcacagagccggccttcaggtcgaatttatcaatccaattttcgaattttctcgcgctatgcgacgcctgggactcgacgatgctgaatatgccctgttgatcgccatcaacattttttcagccgatagaccaaatggtgcaggaccacggggtggtgtggctgctgccttgagaggaggcgctgccgttctgcatgctcaccaagaagccgctgatcagctcagatttcccaggatgttaatgaaattggtctctctcagaacactgtcctccgtgcactcagagcaggttttcgccttacgattacaggataagaagttacctcctctgctaagcgagatctgggatgtccatgagtag

SEQ ID NO: 197736 - DNA, 1092 bp, Artificial Sequence
  Description of Artificial Sequence: Synthetic coding sequence
atgagcagccccaccaccagcagcctggacacccccctgcccggcaacgggcctccacagccgggtgctcccagcagctcaccaaccgttaaagaggagggtccagaaccatggccaggtggcccggatccggatgtccctggaacggatgaggcctctagcgcctgcagcacagactggggcgttctttctgaggagcagattcggaaaaaaaagattcgaaagcagcagcaggaaagccagtctcagtcccaatccccagtaggacctcaagggtcatcatcctcagcatcgggccctggcgctagccctggcgggagcgaggccggcagccagggtagcggtgagggggagggggtgcaactcacagccgcacaagaattgatgattcaacagttggtcgccgcccaattgcagtgcaataaaaggagttttagtgatcaacctaaagtcacaccctggcctctcggcgccgatcctcagtcaagagacgcaagacagcagaggttcgcacatttcactgaactggctatcatttccgttcaggaaatcgtggattttgccaagcaggtcccaggctttctacagttgggtcgggaggaccaaattgccctgctgaaggctagcacaattgagatcatgttattagaaactgccaggaggtacaaccacgagacagaatgcattacgttcctgaaagattttacttactcaaaggatgattttcatagggccggtctgcaggtggagttcatcaatcctattttcgaatttagtcgtgcaatgagacgtctgggcctcgacgacgccgagtacgccctcctgatagcaatcaatattttcagtgccgaccgacctaatgtacaagagcctgggagggtggaagcgctgcagcagccctacgtggaggccctcttatcatacaccagaatcaagcgtcctcaggatcagttgcgattcccgagaatgcttatgaagctagtctcactccgaactctgtcaagcgtgcactccgaacaagtgttcgccttacggctccaggacaaaaagctgccaccactgcttagcgagatctgggatgtccatgagtag

SEQ ID NO: 197737 - DNA, 576 bp, Artificial Sequence
  Description of Artificial Sequence: Synthetic coding sequence
atgatccagcagctggtggccgcccagctgcagtgcaacaagcggtctttctccgatcaacctaaggtgacacttggccgcgaggatcaaatcgctctgctgaaggcttccacaatagaaattatgttactggaaactgcaagacgctacaatcacgagaccgaatgcattacgttcttgaaggacttcacctacagtaaagatgatttccatagagccggactccaggtcgagttcataaaccccatttttgagttttcccgggccatgagaagactcgggctggacgatgcggaatatgctctgctaatcgccatcaacatcttttccgctgatcgcccgaatgtgcaggagcctgggagagtcgaagcgctgcaacaaccctatgtggaggccctgctgtcgtatactaggattaagagaccccaggatcaactgcgatttcctagaatgctgatgaagctcgtgagtttgaggaccttgagctctgtccactcagagcaggttttcgcgctgcgtctgcaggacaaaaagctcccacccctgctctcagaaatctgggatgttcacgaatag

SEQ ID NO: 197738 - DNA, 1422 bp, Artificial Sequence
  Description of Artificial Sequence: Synthetic coding sequence
atgaccgtgacccggacccaccacttcaaggagggcagcctgcgggctcctgcgatcccactgcatagcgccgcagccgaattggcttctaaccatccccgggggccagaggccaatctggaggtgaggcctaaggaatcgtggaatcatgcagattttgtgcactgcgaggatacagagtctgtgcccggcaaaccttcggtcaatgcagatgaggaagtgggagggccgcagatttgtcgggtgtgcggtgacaaagctaccggataccacttcaatgttatgacctgtgaagggtgcaaaggcttttttagaagggcaatgaagcgcaacgctaggcttagatgcccgttcagaaagggggcatgtgagatcaccagaaagactaggaggcaatgtcaggcttgtagacttcggaaatgtctagaatctggaatgaagaaagagatgataatgtctgacgaggcagtcgaggagcggcgcgccctaatcaagcgaaaaaaatccgagcgaacaggaactcagcccctaggcgtgcagggattgacagaagagcagcggatgatgatacgagaactcatggacgcgcagatgaagacctttgacacaactttctctcacttcaagaactttcgactgccgggagttcttagctctgggtgtgaactgcccgagtcccttcaggctccttcgcgtgaggaggccgctaaatggtctcaggtcagaaaggatctgtgttctctgaaagtctctctgcagctcagaggagaggatggctccgtctggaactataaaccacccgcggactcaggaggcaaagaaatcttttctctgctgccacacatggcagatatgagcacgtacatgtttaaaggcatcatttcattcgccaaagtgattagctatttcagagacttacctattgaagatcagatcagtctgctgaaaggtgctgccttcgagctgtgccagctgaggttcaatactgtcttcaatgctgagactggaacttgggagtgtggaagactgagctattgcctagaggatactgccgggggcttccagcagctgcttttggagccaatgctcaagtttcactacatgctgaagaaattgcagcttcatgaagaagagtatgtcctgatgcaggccatctctctgttctctcccgatcggccaggcgtgctccagcatcgcgtggtcgaccagttgcaagagcagttcgctatcaccttaaaatcttacatcgagtgtaacaggccccagccagcccatagattcctgttcctgaaaataatggcaatgctcaccgagctcagaagtataaacgctcagcatacccaacgcttactcaggatacaggatatacaccccttcgctaccccactcatgcaagaactgtttggaatcacaggaagttag

SEQ ID NO: 197739 - DNA, 1305 bp, Artificial Sequence
  Description of Artificial Sequence: Synthetic coding sequence
ctggaggtgcggcccaaggagagctggaaccacgccgacttcgtgcactgcgaggacaccgagtccgtgcccggcaagccctccgtaaatgccgacgaagaagtggggggaccccaaatctgtagagtctgcggcgacaaggccaccggctatcatttcaatgtgatgacttgcgaaggatgcaaggggttcttccggcgggccatgaagagaaatgctcgactccgttgtcccttccggaagggtgcctgcgaaattactagaaagacacgccgccagtgtcaggcctgtcgactaagaaagtgcctcgagtccggtatgaaaaaggagatgattatgtccgatgaggccgttgaggagaggcgggctctgataaagaggaagaaatctgagcggacggggactcagccattaggcgtgcaaggcttaactgaggagcaacggatgatgatccgcgagctcatggacgctcagatgaagacctttgataccaccttcagccacttcaaaaattttcggctgcccggagtcctgtcctccggttgcgagctgcccgaatccctccaggccccatcccgggaggaggcagcaaagtggtctcaggtacgtaaggacctgtgtagtctaaaggtgtccctgcagcttcgaggggaggacgggtccgtgtggaactacaagccccctgctgattcaggcgggaaagagattttctccctactgcctcacatggctgacatgtccacttacatgtttaagggaattatctcctttgccaaggttatcagttactttcgggatctgcccatcgaggaccagatcagccttctcaaaggtgcggccttcgagctttgccagctgaggtttaacaccgtcttcaacgccgaaacaggaacctgggaatgtggaaggctgagttattgcctggaggacacagctggcggattccaacagcttctgctggagcctatgcttaaatttcattatatgcttaaaaaactgcaactgcatgaagaagagtacgtcttaatgcaagcgatttccctcttctccccagacagacccggcgtgttacagcacagggtggtggatcagctgcaggagcagttcgccatcacgctcaagagctacatagaatgtaatcgcccacagcctgctcatagatttctgtttctcaagataatggccatgcttaccgagctgcgctcaataaacgctcaacatacccagcggttgctgaggatccaggacattcacccgtttgccacccccctcatgcaggagctgttcgggattaccgggtcatag

SEQ ID NO: 197740 - DNA, 1194 bp, Artificial Sequence
  Description of Artificial Sequence: Synthetic coding sequence
ctggaggtgcggcccaaggagagctggaaccacgccgacttcgtgcattgtgaggatacagagtcggtccccggcaagcctagcgttaacgccgacgaggaagtcggaggcccgcagatctgtagagtctgtggagacaaagccaccggctaccacttcaatgttatgacttgcgaggggtgcaaaggcttcttcagaagagccatgaaacgcaatgccagactgcgctgcccttttcggaaaggcgcctgtgagattacacgtaagacgcggcggcagtgccaggcctgcagactcagaaaatgtctggagtcaggcatgaaaaaggagatgattatgtcagacgaggcagtcgaagagagacgggccttgattaagcggaaaaagtctgagagaacaggcacccaacctctaggtgtccaaggcctcacggaagaacaacgaatgatgattagggaattgatggatgcccagatgaaaacctttgatactacatttagccacttcaaaaacttcagggtctctctgcagcttcgcggtgaggacggttccgtgtggaattataagcctcccgctgatagcggaggcaaggagatcttttctctgctgcctcatatggcagatatgagcacttatatgttcaagggaataataagcttcgccaaggtcatctcctacttcagggaccttcctatcgaagatcagataagcctgttgaagggtgcagcttttgaactttgccagctgagatttaatactgtgtttaacgccgagacaggcacatgggagtgcggcagacttagctattgcttagaggatactgccggcgggttccagcagttgctcctcgagcccatgctgaaatttcactacatgctgaaaaaactgcagttgcacgaagaggagtacgttttgatgcaggccattagtttattcagtccggatagacccggggtgctgcagcaccgagtagtggaccaactgcaagagcaattcgccatcactctaaagagttatattgagtgcaaccggccccagccggcacatagattcttgtttctgaagattatggcaatgctgaccgagctgcggagcatcaatgcccagcatactcagcgtctgcttaggatccaggatatacatccatttgccactcccctgatgcaggagctattcgggataaccggttcctag

SEQ ID NO: 197741 - DNA, 1848 bp, Artificial Sequence
  Description of Artificial Sequence: Synthetic coding sequence
atgaccagccccagcccccggatccagatcatcagcaccgacagcgccgtcgcctccccgcagcgcattcagggaagcgaaccagcctctggacccttgtctgtgttcacttcccttaataaggaaaagatcgtgacagatcaacagaccggccagaagatacaaattgttacggccgtcgatgctagcgggtctccaaaacagcaatttattcttacctcgccggacggggccgggactggaaaggttattctggccagccctgaaacatcttctgcaaagcagctgatttttacgaccagtgacaatctggtcccaggaagaatccagattgtgaccgacagcgcttctgtggagcgactgctaggcaagactgatgtgcagaggccccaggtggtggagtactgcgtggtgtgcggggataaggcctcaggccgacattatggagctgtcagctgcgagggatgcaagggattttttaaacgatctgtccgtaagaacctgacctacagctgccggagcaaccaagactgcatcatcaacaagcatcaccgcaataggtgtcaattctgtagacttaagaagtgcctcgaaatgggcatgaaaatggagtctgtccagagtgagaggaaaccttttgacgtacaacgagagaagcccagtaactgtgcagcctcgacggagaagatttatattcggaaggaccttcgttcccccctcatcgctacccccactttcgtggcagacaaggacggagcacggcagactggtcttcttgatcccgggatgctggtaaatatccagcaaccgttgattcgggaggacggaaccgtgctgctggccactgattcgaaagctgagacatctcagggcgccctgggcactttggcgaacgtcgtgacctcgctggccaacctgtccgagtctctcaataacggcgataccagtgaaatccagccagaggatcaatcggcttccgaaatcacgagggcctttgacaccctggccaaggcccttaatactactgacagttccagttctccctccctggctgacgggatcgatacctcagggggcggatccattcacgtaattagccgcgaccagtcaactccaatcattgaagtagaaggaccactcctgtcagacactcatgtaacattcaagctgacaatgccaagccccatgccggagtatctgaacgttcactacatctgtgagagcgcttctcggctcctattcctttctatgcattgggctagaagcattcccgcattccaggccctgggacaggattgtaacacatcactggtccgcgcgtgttggaacgaattgttcacgcttggcctcgcacagtgcgcacaggtgatgtcactctcaaccatcttggccgcaattgtcaaccaccttcagaacagtattcaggaagataaactgagcggggaccggatcaagcaggtgatggagcacatttggaagctccaagaattttgcaacagcatggcgaagctggacatcgacgggtacgagtacgcatacctcaaggccattgtgctctttagcccagatcacccaggactgacaagtacatcacaaatcgagaaatttcaggaaaaggcgcagatggagttacaggattacgttcagaagacctattcagaggacacttatcgtctggcccggatcctggtacgactccccgccctacgtttaatgagttccaacataactgaggaactcttctttactggactgatcggtaacgtgtcaattgacagtattatcccatatatcctgaaaatggagacagccgaatacaatggtcagattactggcgcttcactgtag

SEQ ID NO: 197742 - DNA, 1791 bp, Artificial Sequence
  Description of Artificial Sequence: Synthetic coding sequence
atgaccagccccagcccccggatccagatcatcagcaccgacagcgcggtggcatctccccaacgcattcaaatcgtgactgaccaacagactggtcagaagattcagatcgttaccgcggtggacgcctcaggtagcccgaaacagcagtttattttgacttcaccggacggagcgggcacaggaaaggttatacttgcttctccggagactagttcagccaagcagctgatcttcactacatctgacaacctcgtgcccggccgtatccaaattgtaacggatagtgcgtctgtcgagagactgcttggtaagaccgacgtgcaacgcccccaggtagtcgaatactgcgtcgtttgcggcgataaagccagcgggcgccattatggcgccgtgtcatgtgagggctgtaaaggattctttaaacggagcgtgaggaagaacctgacctatagctgccgaagcaaccaggactgcatcatcaacaagcatcaccgtaatcgatgccagttttgtcggctcaagaaatgcctggaaatgggcatgaagatggaatcggttcagtcagaacgcaaaccttttgacgtgcagcgagaaaaaccttcaaactgtgccgcatctaccgaaaagatttacatccgaaaagacttgagatcaccgctgatagcgacccccaccttcgtggcggacaaggacggggccagacaaaccggacttctggaccccggaatgcttgtcaacatccagcagcccttgattagagaggatggtaccgtcttgcttgccacagactccaaggctgaaacaagccagggagccctcggaacattagccaacgtcgttacgtccctggcaaacctttccgaatccctgaacaacggtgatacttctgaaatccaacccgaggatcagtcagcttcggagataacccgcgccttcgatacgctagctaaggcactgaacactaccgattcatcctccagcccgtccctggccgatggcatcgatacgtcaggaggtggatcaatacacgtcatcagccgtgatcaaagtactcctattatcgaagtggagggaccactcctttctgatacccatgtgaccttcaagctgacaatgccatcgcctatgcccgaatatttaaatgtgcattacatttgcgagtccgcttcaagattgctctttctgtctatgcactgggctcgcagcatccccgcctttcaggcgcttggtcaggactgtaacacatctttagtccgggcttgctggaatgagctgttcactctgggactggcccaatgtgcacaggtgatgtcactctcaaccattctggccgctattgtcaaccacctccagaatagcatccaggaggacaagctgtctggcgatcggattaaacaggtgatggagcacatttggaaacttcaggaattctgtaacagcatggctaagctcgacatagacgggtatgaatacgcttacctgaaggcgatcgttctctttagtcccgaccacccaggcttgactagtacgtcgcaaatcgagaagttccaggaaaaggcccagatggaactccaggattacgtgcagaaaacttacagcgaggacacatacagactggcaaggattctcgtacgcctgcctgcactccgattgatgagttccaacatcacagaggagctcttcttcactggtctgattggaaatgtgtctatcgattctatcattccatacattctcaaaatggagacagctgagtacaatggccagattacaggggcctccctgtag

SEQ ID NO: 197743 - DNA, 1791 bp, Artificial Sequence
  Description of Artificial Sequence: Synthetic coding sequence
atgaccagccccagcccccggatccagatcatcagcaccgacagcgctgtggccagcccacaaagaatccagatcgtgactgaccaacagaccgggcaaaagatccagattgtcacagctgtcgacgcctcgggtagtcctaagcaacagttcattctgactagccctgacggcgcagggacagggaaggtgatactggcttccccggagacatcttcggccaagcagctgatcttcaccacctcggataatctcgtcccaggaagaatccagatcgttaccgattctgcaagcgtggagaggttgcttggaaaaactgacgtgcagagaccacaggtagttgagtattgtgtggtgtgcggtgacaaggcctccgggagacattatggggcggtctcctgtgaaggctgtaaggggttctttaaacgatctgtgcggaagaatctgacatatagctgtcggtctaaccaggactgcatcatcaacaaacaccacaggaacaggtgtcagttctgtagactcaaaaagtgtctggaaatgggaatgaaaatggagtcggtgcaatctgaaagaaagccattcgatgttcagagggagaaaccgagcaattgtgccgccagcaccgagaagatttatatacggaaagatctcaggtcccctctaattgcgacgcccacatttgttgccgataaggacggagcaaggcaaacaggactactggatcctggcatgttggtgaatatccaacagccattgatacgagaggacggaaccgttctgctggctacagacagcaaagccgaaacctcacagggcgcactagggacactggcaaatgtggtgacaagcctggccaatctaagtgagtcactgaataatggggacacctctgaaatccagccagaggatcagtctgcctccgagattactcgggccttcgacaccctagcaaaggcacttaatactactgactcatccagctcaccgtcactggctgatggcattgacacaagtggtggaggctctatccacgtgatcagtagggaccagtctaccccaattatcgaggttgagggacctctgctttcagatacacatgtgaccttcaaactcacaatgccctcccccatgcccgaatatctcaacgtacactatatctgcgagtccgcatcaagacttcttttcctgtcaatgcactgggcccgcagcatccctgcattccaggctcttggccaggactgcaatacaagtctggttcgcgcctgctggaatgagctgttcactctgggcctggcccagtgcgcgcaagtaatgtccctatctaccatcctggctgcgatcgttaaccatttgcagaattccatccaggaggacaagctgagcggcgaccgcatcaaacaagtaatggagcatatttggaaactgcaggagttctgcaatagcatggcaaagctggatattgacggttacgagtatgcctacctcaaagctattgtccttttttctcccgaccatcccggcctaacatcaactagtcagattgagaagtttcaggagaaggcacaaatggagctccaggactatgtacagaagacttattccgaggacacctacagactggcacgtattcttgtcaggttgcccgcacttaggttgatgagctctaatatcaccgaagagctgttttttaccgggctgattgggaacgtctcaatcgattccattattccctacatcctgaagatggagaccgcagagtacaatggccaaatcactggcgcatctctttag

SEQ ID NO: 197744 - DNA, 1791 bp, Artificial Sequence
  Description of Artificial Sequence: Synthetic coding sequence
atgaccagccccagcccccggatccagatcatcagcaccgacagcgcggttgcctctccgcagcgcatccagattgtcacagatcaacagacaggtcaaaagatccaaatcgtgacggcagttgacgcctcggggtccccgaaacagcagttcattctgacaagccctgacggtgccggcactggaaaagtgatcctcgcgtctcccgagaccagctctgccaagcagctcatcttcaccacctccgataacctggtgccaggacggatacagattgttaccgatagcgccagcgtggagcgacttctaggtaagaccgatgtgcagcgcccgcaggtggtggagtactgtgtggtatgcggtgataaggcatccggtaggcattacggcgccgtttcctgcgagggctgtaaggggtttttcaaaagaagtgtgcgaaagaatctcacctattcctgtagatctaaccaagattgcataatcaataagcaccatcgcaaccgatgtcagttctgtagacttaagaagtgcctggagatgggaatgaaaatggaatctgtccagagcgaacggaagccattcgatgtccagcgggaaaaacccagtaactgcgctgcaagcacagaaaagatttatattcggaaggatcttagaagccccctgatcgccactccgactttcgtggccgacaaggatggagcccggcaaacagggcttctggacccgggcatgctggtgaacatccagcagcccctgattcgcgaggacggtaccgtccttctcgccacagatagtaaagcagagacttcccagggcgctttaggtacacttgcaaacgtcgttacaagcctggccaacctttctgagtccttaaataatggcgacacgtctgagatccaacccgaggaccagtctgcctcagaaattacgagagccttcgacacacttgcaaaagctctcaacacaaccgattcttcgtcttctcccagccttgccgatggtattgatacttctgggggaggtagcatccatgttatcagcagggaccagtcaactcccatcattgaggttgagggcccactgcttagcgacactcacgttacatttaagttgaccatgcccagcccgatgccagaatacctcaatgtgcattatatttgtgaatccgcgtcccgactgctgttcctttctatgcactgggcgcggtcaatccctgcgtttcaggctttgggacaggactgcaacacttctttggtacgcgcctgctggaatgaactgtttacactgggactggcgcagtgtgcccaagtgatgtcgttatcaactatcctcgcagccatcgtgaaccatcttcagaacagcatccaggaggataaattgtccggagatcggatcaagcaggtcatggagcatatttggaagctgcaggagttctgtaattctatggctaagttggacatcgatggatatgaatacgcttacttaaaggctattgttctgtttagtccagaccatccaggactgacgtctacaagtcaaattgaaaagttccaagaaaaagcgcagatggagctccaggattatgtgcagaaaacttatagcgaggacacatatcgcctggcacgcattttggtgagactacctgctcttcggctaatgtcatccaacatcaccgaggaactgtttttcacagggctgattggaaatgtgtccatcgattcgatcataccatacattttgaagatggagacagctgagtataacgggcagattaccggcgcatccctctag

SEQ ID NO: 197745 - DNA, 111 bp, Artificial Sequence
  Description of Artificial Sequence: Synthetic coding sequence
atgaccagccccagcccccggatccagatcatcagcaccgacagcgcagtcgcctccccacagagaatccagggctcggagccggcctccgggcctctcagcgtgttttag

SEQ ID NO: 197746 - DNA, 618 bp, Artificial Sequence
  Description of Artificial Sequence: Synthetic coding sequence
atgaccagccccagcccccggatccagatcatcagcaccgacagcgccgttgcaagtccacagcgaattcagggcagcgagccagcatccggtccactgagtgtgtttacatctctgaacaaggagaagatagtgacggatcaacagactggccagaaaatccaaattgtgacggcggttgacgcctcagggtctcccaagcagcaatttattttgacttccccagatggggcaggtactgggaaggttatcctggcttccccggagaccagcagcgccaaacagctgattttcaccacatcggataacctggtgcctggaagaatccagatcgtgactgatagtgccagcgtggagcggttgctggggaagactgacgtccaacgacctcaagtggtagaatattgcgtagtgtgcggagataaggcctctgggcggcactacggcgctgtgtcctgcgaggggtgcaaaggcttcttcaagagatccgtgcgcaagaatttgacttatagttgtagaagcaaccaggattgcataatcaataaacatcatagaaatcgctgtcagttctgtcggcttaagaagtgcttggaaatgggcatgaaaatggaatgttag

SEQ ID NO: 197747 - DNA, 1269 bp, Artificial Sequence
  Description of Artificial Sequence: Synthetic coding sequence
atgttccgggccggcgccgagggcgccgagaaggagcccagccccagacccgagtgccgtgcggaccccggccccggtttggggttccctcttggttccggcctgccctggccgtcgctcctcgagtctcctggcgggaggattctggacataccatgcaaagtctgcggcgacagaagcagtggcaaacactacggcgtctatgcatgtgatggatgctcagggttcttcaaacgatccataagaaggaacaggacatacgtatgcaaaagtggtaaccaaggagggtgccctgtggacaagacccaccggaaccaatgtagggcctgccgcctgaagaagtgcctggaagttaatatgaacaaggacgcagtacagcatgagcgcggaccccggacttctacaatcagaaagcaggtggccctgtacttccgcgggcataaggaggagaatggggccgcagctcacttccctagcgccgcccttcctgcgccagcattctttaccgctgtgacacagcttgagcctcatgggctcgagctggccgccgtgtccactacaccagagcggcagacgctcgtgtcacttgctcaacccaccccaaagtatcctcacgaagtgaatggaactcctatgtacctgtatgaagtagctactgaatctgtctgtgaatcagcagccagactactgttcatgtctatcaagtgggcaaaaagcgttccagcattctcaaccctgagcctccaggatcagcttatgcttctcgaggacgcatggcgcgagctgtttgtacttggaattgcccagtgggccatcccggttgacgccaacacattgctcgccgttagcggaatgaatggcgacaataccgattcacagaaactgaataagattatttccgagatccaggccctgcaagaggtggttgcccgctttaggcagctcaggctggacgccactgagtttgcttgcctgaagtgcatcgtgacattcaaggctgtgcctacccattccggttccgaacttaggtcattccggaacgccgctgcaatagccgccctgcaggacgaagcacagttgaccctgaatagctacatccatacaaggtatcctacccagccatgtagattcggtaaacttctgctcttgcttccagctttgaggtcaatctccccctctaccatcgaggaggtgttttttaaaaaaaccatagggaatgtccccattacccgacttctgtccgacatgtataagtctagcgatatttag

SEQ ID NO: 197748 - DNA, 1158 bp, Artificial Sequence
  Description of Artificial Sequence: Synthetic coding sequence
atgagcaagcccgccggcagcaccagccggatcctggacatcccctgtaaggtatgcggagacagatccagtgggaagcactatggagtttatgcctgtgacggttgcagcggctttttcaaacgcagcattaggcgcaatcggacctacgtttgcaaatctggtaatcaaggcggatgtcctgttgacaagactcatcgcaaccagtgccgagcctgccggcttaagaagtgtcttgaagtgaacatgaataaagacgccgtacagcacgaacggggccccaggacctccactattagaaagcaggtagcactgtatttccggggccacaaggaggagaacggcgccgctgcacactttcctagtgcggcgctgcctgcccccgccttctttactgcagtgacccaactcgagccccacgggctggagctggccgccgtgtccaccacccccgaaagacagacattggtaagcctggcacagccaacacccaagtatccacatgaggttaatggaacaccaatgtatctctatgaggttgctactgagtctgtctgtgaaagtgcagcccgactactgttcatgtcaatcaaatgggccaaatccgtgcctgccttttcaactctttctctccaggaccagctgatgttgctggaggatgcttggagggagctcttcgtgctggggatagcacaatgggcaatccctgtggatgctaacacactgctggctgtctccggtatgaacggtgataacacggattcccagaagctgaacaaaatcatctccgagatacaggcactgcaagaagtggtggcacgatttcgtcaactgcgccttgacgccaccgaattcgcctgcctcaagtgcattgtcacttttaaggcagtgcccacacactccggatcagaactcagaagttttcgcaacgctgcagctattgccgcactccaagacgaggcacagctgaccttgaactcctatatccacacccggtatcctacccagccttgtagatttggcaaactgctgctcctcctacctgctcttagatccattagcccatcaacaatcgaggaggtgttctttaagaaaacaattggtaacgttcctatcactagattgctctccgatatgtacaagtcttccgacatctag

SEQ ID NO: 197749 - DNA, 141 bp, Artificial Sequence
  Description of Artificial Sequence: Synthetic coding sequence
atgaacaaggacgccgtgcagcacgagcggggcccccggaccagcactatccggaagcaggtcgctctgtatttcagaggccacaaggaggagaatggcgccgctgctcattttcccagcgcagccctacccgctccttag

SEQ ID NO: 197750 - DNA, 1272 bp, Artificial Sequence
  Description of Artificial Sequence: Synthetic coding sequence
atggccatggtggtgagcagctggcgggacccccaggacgacgtggcaggagggaatccaggaggaccaaatcccgcggcacaggctgctcggggtgggggcgggggggcgggggaacagcagcagcaagctggttccggtgccccgcataccccgcagacaccaggacagcccggagcccctgccactcccggtactgcaggtgataaaggccaggggccccccggaagtggccagagccaacaacatatagaatgtgtggtctgcggagacaaatcctcgggcaaacactacggtcaatttacatgtgaagggtgcaaatctttttttaagcgttcagtgcgtagaaatttgacctatacatgtcgcgccaatcgtaactgcccaatcgaccagcaccatcgcaatcagtgccaatactgccgcctgaagaagtgtctcaaggtcggcatgcgtcgcgaagccgtgcagcgcggacggatgcccccaacccagccgaatccagggcagtatgcacttacaaacggagatcctttaaacggtcattgttacctgtcgggatacatctctctgttgctgcgggccgagccttatcccacatcacggtatgggagccaatgcatgcagccaaacaacattatggggatcgaaaacatttgtgagctcgccgcccggcttctgttttccgccgtcgagtgggctcggaatataccatttttcccagacctgcaaataacagatcaggtatccctgttgcgcctcacttggtctgaactgtttgtcctcaatgctgcccaatgctcgatgccgctgcacgtcgccccactgttagcggctgcagggctgcatgcaagccctatgtctgcagatcgggtcgttgccttcatggatcatattagaatcttccaggagcaggtagagaagctgaaggccctgcacgttgacagcgcagaatactcttgtttaaaggcgattgtgctatttacaagcgacgcatgtggcctgagtgacgccgctcatatagagtcactgcaggaaaaatcccagtgtgccctggaggaatatgtcaggtcacagtatccaaatcaaccctctaggttcgggaagctcttgttgcgcctcccgagcctgcggacagtgtcgtctagcgtgatcgagcagctcttctttgttaggctagtcgggaagacgccaatagaaacacttatccgcgacatgttgctgtccggttcttcctttaactggccttacatgtctattcaatgcagttag

SEQ ID NO: 197751 - DNA, 1245 bp, Artificial Sequence
  Description of Artificial Sequence: Synthetic coding sequence
atggccatggtggtgagcacctggcgggacccccaggacgaggtgcccgggtcacaaggttcacaggccagccaggccccccccgtgcccggccctcctcctggcgcacctcacacccctcaaactcccggacagggaggcccagcttccacaccagcacagactgctgctggaggccagggcggccccggtggtcccgggagcgataagcagcaacaacagcaacacatagagtgtgtagtctgtggcgacaaatcctccggtaagcattacggccaatttacctgcgagggctgtaagtctttttttaaaaggagcgtgaggcggaatttgtcctatacttgccgggccaatcgtaactgccctatcgaccagcaccatcgtaatcagtgccaatattgtcgcttgaagaaatgtttgaaagttgggatgcgacgagaagccgtccagcgtggtcggatgcccccaactcagcccactcatggtcaatttgcgttgactaatggcgatccacttaattgtcattcctatctgagcggatacatatctctgctgcttcgcgctgagccatacccaacaagccgttttggatctcaatgtatgcaaccaaataatattatgggtattgaaaacatttgtgagctggctgccagaatgttattcagtgccgtggagtgggcgcgaaatataccattcttccctgacctccaaattacagatcaggtggctctgcttcgtctgacatggtccgaactgttcgtccttaatgccgcgcagtgttctatgcccctccacgtcgcccccctgctggcagctgccggcctgcatgcctcaccaatgagtgctgatcgagttgtggccttcatggaccatatcagaatttttcaagaacaggtggagaaactgaaagcgctgcatgtagattcagcagagtacagctgcctgaaggccattgtgttattcacgtcagacgcctgcgggctatcagacgtggctcacgtagagagcctgcaggagaagtcccagtgcgctctcgaagaatacgtgcgatcacaatatccgaatcagcctacccggtttggcaaacttttactccggttacccagcttaaggacagtttccagtagcgtgatcgagcaactcttcttcgtcaggctcgtgggtaagacacctatcgagaccctaatcagagatatgctcctctccggcagttccttcaactggccttatatggccatccagtag

SEQ ID NO: 197752 - DNA, 786 bp, Artificial Sequence
  Description of Artificial Sequence: Synthetic coding sequence
atgccccccacccagcccacccacggccagttcgccctgaccaacggtgacccgctcaactgtcattcctatctatcaggctatatttccctgcttcttcgggccgagccctaccctacgtcaagattcggctcccagtgcatgcagcccaataatattatgggtatagagaatatttgcgaactggctgcccggatgctgttctcagcggtggaatgggcgaggaatattccattcttccctgacctccaaatcactgatcaagtggcactcctgcggctcacgtggtcggagctgtttgttctgaatgccgcccagtgctccatgcccttgcacgtcgcccctcttttagccgccgcaggcctgcatgcaagccctatgtctgctgatagggtcgtggcctttatggatcacattcgtattttccaagaacaggttgagaagctgaaggccctgcacgttgattctgcagagtattcctgtctcaaagccattgtattgttcacatccgacgcctgcggactatcagacgtggcacatgtggaatctctgcaggaaaagtcccagtgtgccctggaggagtacgttcgaagccagtatcctaatcagcccacacggtttggcaagttactgctacgcctgccgagccttcgcacggtcagcagctctgtcatcgagcagctcttcttcgtaagactcgtgggtaaaacacccattgaaacactcattagggatatgttgctctccgggtcatcattcaactggccgtatatggctattcagtag

SEQ ID NO: 197753 - DNA, 846 bp, Artificial Sequence
  Description of Artificial Sequence: Synthetic coding sequence
atgcaggccgtgtgggacctggagcagggcaagtacggcttcgccgtgcagaggggacgcatgccacccacgcagccaactcatggacagtttgccctgactaacggcgatcctttgaactgtcattcgtacctgagcggctacatttctctgctattgcgcgccgaaccatatcctacttcacgtttcggaagccaatgtatgcagccaaataatatcatgggcattgagaacatatgcgagcttgccgctcgcatgctgttttcagccgtggaatgggctcggaacattcctttcttccctgatctccaaatcacagaccaagtcgctctcctccgcctgacttggagtgaattgttcgtcctcaacgccgctcaatgcagcatgcctctgcacgtcgccccactgctggctgccgccgggctccatgcctcgcccatgtctgcagaccgggttgtggcatttatggaccatatacgcattttccaggagcaagtggagaaactgaaggccttacatgtcgatagtgctgagtacagctgcctaaaagccattgtactgtttacaagcgatgcctgtggcctttcagatgtcgcgcacgtggaatcacttcaggagaaaagtcaatgtgcccttgaggagtacgtgcggagtcagtacccaaaccagccaaccaggtttgggaagttattgctaagacttcctagcctaaggactgtgtcctctagcgtcatcgaacaacttttcttcgtgcgcctggtcggtaagacccctatcgaaacgttgatccgcgatatgttactttctggcagttcctttaattggccatacatggccatacagtag

SEQ ID NO: 197754 - DNA, 786 bp, Artificial Sequence
  Description of Artificial Sequence: Synthetic coding sequence
atgccccccacccagcccacccacggccagttcgccctgaccaacggagatcccctaaactgccactcgtacctgtctgggtacatcagccttcttttgagggccgagccctaccccacctcaaggttcggaagtcagtgcatgcaacccaacaacatcatgggtatcgaaaacatttgcgagttggctgcacggatgctgtttagtgctgtggaatgggcacgtaatattccattttttcctgacctgcaaataacagatcaggtagccctgttgcggctcacctggagcgagttattcgtactcaatgcagcgcagtgtagcatgccgctgcacgttgcacctctgttggcagctgccggattacatgcctcccctatgagcgcagatcgggtagtggcgtttatggaccacattaggatattccaggaacaggtcgagaagctaaaggcactgcacgtcgattccgccgagtattcgtgcttgaaggctattgtgctttttacatcagacgcctgtggtctaagcgatgttgcacacgtggagtcactgcaggagaagagccagtgcgcactggaggaatacgtccgatctcagtatccaaaccagcctacccggttcggtaagttactcctccgccttcctagcctcaggaccgtcagtagtagcgttatcgagcaattgttttttgtgagactggtaggaaaaactcctatagaaactctcattcgcgatatgttgctgagcgggtcctcgttcaactggccttacatggcgatacagtag

SEQ ID NO: 197755 - DNA, 1215 bp, Artificial Sequence
  Description of Artificial Sequence: Synthetic coding sequence
atggccatggtgaccggcggctggggcggccccggcggcgacaccaatggagtggacaaggccggtgggtacccaagggcagcagaagacgattccgcaagtccacctggagccgcatccgatgctgagccaggcgatgaagagcgccccggactccaggtggattgcgtggtgtgcggcgataagtcctccggaaaacactacggcgtcttcacttgcgaaggctgcaaatcatttttcaaaagaagcatccggcggaaccttagctatacctgtagatcgaaccgcgactgccagattgatcagcatcaccgcaaccagtgccagtactgcagactcaagaaatgcttcagagtcgggatgcggaaggaggctgtacagcgcggacggattcctcattccctgcctggagctgttgcggcctccagcggttctccccccgggagcgccttggccgcagttgcgagtgggggcgacctcttcccaggtcaacctgtgagtgaactgatcgcccagctgcttcgggctgagccataccccgccgcagctggaagattcggggccgggggcggcgccgctggcgctgtgcttggcatcgacaatgtttgtgagttggccgccaggctgctgtttagcactgtggagtgggcccggcacgccccttttttcccggagctgcctgtggccgatcaggtggcattgcttcgcctatcctggagcgaactatttgtgctcaacgccgcccaggccgccctgcctttacacaccgccccgctactggcagccgctgggctccatgcagcgcctatggctgcggagcgcgccgtggccttcatggaccaagtccgcgctttccaggaacaggtggataagctgggtaggctgcaagtagattctgctgaatatggttgtctgaaggctattgcactgttcacacctgacgcctgcggcctttcagatccagcgcacgtggaatccttacaggagaaagcccaggtcgcgcttactgagtacgtgcgcgcacagtacccgtcacagccccagcgcttcggacgactattgctgcgactaccagctttgcgtgcagtgccggcatcgttgatttcacagttgtttttcatgcgcctggtggggaagactccaattgagacgctcatccgggacatgctgctctccggcagcacattcaactggccttacgggtcaggccagtag

SEQ ID NO: 197756 - DNA, 1134 bp, Artificial Sequence
  Description of Artificial Sequence: Synthetic coding sequence
atggccatggtgaccggcggctggggcggccccggcggcgacgccgaaccaggggacgaggaaaggcccgggttacaggtggactgcgtggtctgcggggacaagtcttctgggaaacattacggagtgttcacctgcgagggctgcaagtccttcttcaagcgtagcataaggcgcaatctgtcctatacctgccggagcaaccgcgactgtcaaatcgaccagcatcacagaaaccagtgccagtattgtagactaaagaaatgctttagggtaggcatgaggaaagaggcagtgcagcggggccgaatcccccatagtcttcccggtgccgtcgctgcctctagtggaagccccccaggatcagccctggccgccgtggcctcaggaggagatctgtttccaggtcagccagtttctgagctgattgcacaactcctcagggctgagccgtatcccgccgctgcaggacggttcggcgcaggcggtggagcggctggggcggtattgggcatcgataacgtctgtgagctggccgcccggctgctgttctccactgttgagtgggccagacacgcacctttctttcccgagttaccagttgctgaccaagtggctttgctccggctatcatggagcgagctatttgtcctgaacgccgctcaggcagccctgccactccacacagcaccgctgcttgctgctgccgggctccacgccgcgcccatggccgcagaacgcgcggtggcttttatggaccaggtgagagccttccaagaacaggtggacaagttggggcggctccaggtggatagcgcagaatatgggtgcttaaaagccatcgctctgtttaccccggatgcgtgcggcctgtccgatccagctcacgtggaaagcctgcaagaaaaggctcaggtcgcccttactgaatatgtacgcgctcagtaccctagccagccccagcgttttggcagactgctcctgaggttaccagctctgcgggctgtgcctgcctccctgatcagccagctgtttttcatgcgactcgtgggcaagacacccatcgagacactgatccgggacatgcttcttagcggtagtaccttcaactggccttacggctcaggacagtag

SEQ ID NO: 197757 - DNA, 2121 bp, Artificial Sequence
  Description of Artificial Sequence: Synthetic coding sequence
atggagaccaagggctaccacagcctgcccgagggcctggacatggaacgcaggtggggtcaggtgagccaggccgttgagagaagtagtcttggaccaacagagcgaaccgacgagaataattatatggaaattgtgaacgtttcttgtgtgtcaggggccatacccaataactcaactcagggctccagtaaagaaaagcaggagctcttgccatgcctgcagcaggataataatcggccagggatactaacctcagatatcaagacagagctggagagcaaggagctctcagccaccgtggctgaatctatggggttatacatggattctgttcgtgatgctgactacagctacgagcagcagaatcagcagggcagtatgagtcctgcaaaaatataccagaatgttgaacagctggtgaagttctacaaagggaatgggcaccggccttcaaccctgtcctgcgtgaatacgccgctccgaagcttcatgagcgacagtggcagtagcgtgaatggcggggtgatgagggctgtcgttaagtctccaattatgtgtcacgagaagtctcctagcgtctgcagccctctgaacatgacttcctccgtctgtagccctgctggcatcaattccgtgtccagcacaactgccagctttggctccttccccgtacacagtccgatcacccaaggcaccccgctgacctgttcgccaaatgtagagaaccgcggctcccgtagccactctccggcccacgccagtaatgtggggtcccccttgtcctcacccttgtcatcaatgaaatcatccatctcttcccccccatcccattgcagcgtgaagtctcctgtaagcagtcccaacaacgtcacgctccggagctcagtgagcagccccgcaaacatcaataattccaggtgcagcgtgtcctctcccagtaacacaaacaatcgaagtacactcagctctccggccgccagcacagtcggcagcatttgttctcctgtcaacaatgcattcagctacacggcaagtggaacgagcgccgggtcctcaaccctgcgggacgtggtccctagccctgatacacaggaaaaaggcgcgcaggaggtgccattcccaaagactgaagaggtggaaagtgcaatttctaatggtgtcactggtcagctgaatatcgtccagtacattaaaccggaaccagatggggccttctcatctagctgcctgggcggtaacagcaaaattaattctgatagctccttctccgtccccataaaacaggaatcaacaaagcactcgtgcagcggaaccagcttcaaagggaatcctaccgtgaatccattccccttcatggacggttcttatttcagttttatggatgacaaggactactattctctcagtgggattctcggtccccccgtgcctggattcgacgggaactgtgagggctccgggttccccgtaggtattaagcaggagccagacgacgggtcctattaccccgaagccagcatcccaagctctgctatcgtcggagtaaacagcgggggccagtccttccattataggattggggcccaggggacaatttcattgagcagaagcgccagagatcagtcctttcagcatctgtcgagctttcccccggtaaacacgctggtggagagctggaagtctcatggcgacctgtcctcccgcagatctgatggttatcccgtgctggagtacataccagagaatgtctcatcttccaccttgaggtcggtctcaaccgggtcaagccgaccgtccaagatttgtttggtgtgcggcgacgaagcaagcggctgtcactacggggtcgtaacctgcggatcctgcaaggtcttcttcaagcgggcggtggagggtcagcataattatctctgcgctgggaggaatgattgtatcattgataagatcagaagaaagaactgccctgcttgtcggctacagaagtgtctgcaggctgggatgaatctcggggagcgacgatgcatatccctaccttgtatgaactatgcacgcggctgtactaaaagtgccttcagctcattcgactgctcctcacctctgaaaaacacaccgtcttag

SEQ ID NO: 197758 - DNA, 2955 bp, Artificial Sequence
  Description of Artificial Sequence: Synthetic coding sequence
atggagaccaagggctaccacagcctgcccgagggcctggacatggagcgcaggtggggacaggtttcgcaggccgtcgaaagatccagtttagggcccaccgaacggactgatgagaacaattatatggaaatagtaaatgtgagttgcgtgtcaggggctatcccaaacaacagcacacagggcagctctaaggaaaagcaggagctcctgccctgcttgcagcaagataacaaccggccgggaattcttacctcagacatcaagaccgaactggaatctaaggagctgtcagcaaccgtggccgagagcatggggttatacatggatagtgtgcgcgacgctgattattcatacgagcaacagaaccagcagggtagcatgagtcccgccaaaatttatcaaaacgtcgagcagctggtcaaattttataaaggcaacggccaccgcccatcaacgctaagctgcgtaaacacaccccttagaagcttcatgtccgactccgggtcaagtgtaaacggaggcgttatgagagcggtagttaagagtcctattatgtgtcatgagaagtccccttccgtttgctctcccctcaatatgacctctagtgtgtgttcacccgccggcatcaattctgtgagctcaacaacggcatcttttggctctttccctgtccactcaccaatcacacagggaacccccctaacgtgctctcccaacgtagagaacagggggtcccgcagccactcccctgcgcacgcttccaatgtcgggtcccctctgagctctcctctgtctagcatgaagtctagcatctctagcccaccctcgcactgctctgtcaagtcaccagtgagctcccctaacaacgttacgttgcgatcatccgtgtcatcacctgccaatatcaacaactctcggtgctctgtaagcagccctagcaacactaacaaccggagtactctctcgtcgccggctgcatccacagtgggatctatctgttctccagttaacaacgcgttctcatacactgcaagcggcacatcagcagggagtagcacactgagagacgttgttccttctccggatacacaggaaaaaggagcccaggaagtcccattccctaaaaccgaagaagtggaaagcgccatctctaacggggtgaccggacagctgaatattgtccaatacataaagccagaaccagatggagccttctcaagctcctgtctcggcggcaacagtaagatcaactctgattcaagcttcagtgtgcccataaagcaggaaagcactaagcattcctgcagcggtacttccttcaaggggaacccgacggtgaaccccttccccttcatggatggctcttatttctcatttatggacgataaggattattacagcttgagtggcatcctgggcccacccgtccctggattcgatgggaactgcgaaggatctggttttccggttggaataaagcaggaaccagacgacggatcttattatcctgaggcttccattcccagctctgctatagtgggggtgaacagtggaggccagagctttcattacaggataggggcccaaggaactatctctctctccaggagtgcgagggatcagtccttccagcatctgtctagcttcccaccagttaatactctggtggaaagctggaaatcacatggcgatctgtctagtaggcgctccgatggttaccccgtgttggagtacattcctgagaatgtgagctcctcgaccctgcggagtgttagcactggatcatctcgccctagtaagatttgtcttgtttgtggggacgaggcttctgggtgccattacggggtggtaacgtgcggaagttgcaaggtgttttttaaacgcgcagtcgaaggccaacataattacctctgtgcaggcaggaacgactgtatcattgacaagatcaggcgtaagaattgccctgcttgtcgattgcaaaagtgccttcaagccggaatgaacctaggtgcccgcaaatccaaaaagctgggaaagctcaagggtattcacgaggagcagcctcaacagcagcaaccaccaccacctccccccccgccgcagtctcctgaggagggcactacttatatcgcgcccgctaaggagcccagcgtcaatactgcattagtgcctcaactcagcacaatctccagggccctaactccttccccagtgatggtgttagagaatatcgaacctgaaattgtttacgccggatatgatagcagcaagcccgacacagcagaaaacctgctgtccactctgaatcggttagctggcaagcagatgattcaggtggtaaagtgggccaaggtgcttccaggctttaagaacttgcccctcgaggaccagatcacacttatacagtacagctggatgtgcctgtcatccttcgcattaagctggcgctcctacaagcacacaaattcccagttcctgtactttgcccctgacctcgtttttaatgaagagaaaatgcaccagagtgccatgtacgaactgtgccagggcatgcaccagataagcctccagtttgtgaggctgcaactgacattcgaagaatacacgataatgaaggtgcttctgctcctcagtaccatccctaaagacgggttgaagtcccaggcagcatttgaggagatgcggaccaactacatcaaagagctccggaagatggtgacaaaatgtcctaataactctgggcagtcctggcagaggttctaccagcttactaagcttctggactctatgcacgacttggtgtcagatctgcttgagttctgcttttatacttttcgagagtctcacgctctcaaggtcgaatttcccgccatgctggtggagatcatctcggaccagctccccaaggtcgagtctgggaatgctaagccactctactttcatagaaagtag

SEQ ID NO: 197759 - DNA, 2967 bp, Artificial Sequence
  Description of Artificial Sequence: Synthetic coding sequence
atggagaccaagggctaccacagcctgcccgagggcctggacatggagcggagatggggacaagtgtcgcaggcggtggagaggtctagtcttggaccaactgaaagaacagatgagaacaattatatggagatcgtaaatgtgtcttgtgtttcgggcgcaatccctaataactcaacacagggttccagtaaagaaaaacaggaacttctgccatgtcttcagcaagacaataatcgcccgggaatcctgactagcgacatcaagaccgaactggagtctaaagaattatccgccacagtggcggagtccatgggcctctatatggactcagtgcgagacgccgactactcatatgagcaacagaaccagcaggggtcaatgtctccagcaaagatttaccaaaacgtagaacagctggtaaagttttacaagggcaatgggcatcggccaagcaccctcagctgcgtgaacactccacttcggagcttcatgagtgatagcggcagctcagtgaatggcggcgtgatgagagcggtggtgaaatcccccatcatgtgccatgaaaagagcccatctgtatgttctcctctgaacatgactagctccgtgtgctcaccagcagggattaatagcgtgagttctaccactgcttcattcggttcatttccggttcattctcctatcacccaggggacacctctgacctgctcccccaacgtcgagaaccgtggttcccgcagccattcccccgctcacgctagtaacgttggatctccgctgagcagtccactgtcttcaatgaagagctcgatctcgagcccccctagtcattgttccgtgaaatcaccagtctcatctcccaataatgtgaccctccgctccagcgtgagctcccctgccaatataaacaacagtcggtgcagcgtatcgtcaccctccaatacaaataaccgatctacgctgtcctccccggctgcatctaccgtcgggtccatttgtagcccggtgaataacgctttctcctatactgcttccgggacatcggctggaagttctaccctgcgcgatgtcgtacctagccccgatacacaggagaaaggcgcccaggaagttccttttcctaaaacagaggaggtcgaaagtgcaatctcgaatggcgttactgggcagctgaacatagtgcaatacataaaacctgagcccgatggcgccttctctagcagctgcctcggaggtaacagcaaaattaattcggattcctctttttctgtgccaatcaagcaggagtccacaaaacactcctgtagtggtacaagttttaaggggaatcccacagtgaatccctttcccttcatggatggaagttatttttcttttatggacgacaaagactattactctctgtcggggattcttggtccacccgtccctggctttgacggaaattgtgagggatcaggctttcctgtgggaatcaagcaggagcccgatgacggctcctactatcccgaggcttccattcccagctctgcgatcgttggagtgaacagtggaggccaaagcttccactatagaatcggggcccaaggtacgatctccctttcaagatccgctcgcgaccagagcttccagcacctaagttctttcccccccgtgaacacacttgtggaatcatggaagagccatggtgacctctcatctcgacggtcagacggctatcccgtgctcgagtatattcccgaaaacgtatcctccagtacgctgagatccgtatctacaggaagcagcaggccttcaaagatctgtctggtgtgtggcgacgaagcctcaggctgccactatggagtggttacctgcggaagctgcaaggtgttttttaagagagcggtagagggcaagtgctcttggcagcacaactatctgtgtgctggacgtaatgattgcattattgacaagatcaggagaaagaactgccctgcctgccggctccaaaagtgccttcaggccggaatgaacctgggagcacgcaagtccaagaaacttgggaagttaaaggggattcacgaagaacagccccagcagcagcagccccctccgccgcctccccctccacaaagccccgaggagggcacgacgtacatcgcaccggctaaggaaccttctgtgaatacggccttggtaccacagttgagcacgatctccagagctctgacgcccagccccgttatggtactggaaaatattgagcctgaaatcgtgtacgcaggttatgactcctctaaacctgatacagctgagaacctgctaagcaccctgaatagactggccgggaaacagatgatccaagtggtgaaatgggctaaggttctcccgggctttaaaaacctccctctggaagaccaaatcactctgatacagtattcttggatgtgcctctcttcgttcgcgctgtcatggaggagttataagcacacaaactctcagtttctctactttgcaccagatctcgtcttcaacgaggagaagatgcaccagtctgccatgtatgaactgtgccagggcatgcatcagatttccctgcagtttgtgcgactacagctgactttcgaggaatatacaattatgaaagttttgctactcctctccaccatcccgaaggacggcctgaaatctcaagccgcattcgaagagatgagaacgaactatataaaagagctgagaaagatggtcacgaagtgccctaacaattccggacagagctggcaacgcttctaccagctgacaaagctgctggatagcatgcatgatctggtcagcgacttactcgaattttgcttttacacctttagagaatctcacgccctcaaggttgaatttcccgccatgctggtggagattattagtgaccagctccctaaagtggagtccggaaatgccaaaccactttatttccatcggaagtag

SEQ ID NO: 197760 - DNA, 2955 bp, Artificial Sequence
  Description of Artificial Sequence: Synthetic coding sequence
atggagaccaagggctaccacagcctgcccgagggcctggacatggaacggaggtgggggcaagtgtcgcaggccgtggaacgtagctcccttggcccaacagagcgcacagacgagaacaactatatggaaatcgtaaatgtttcttgtgtgagcggggcgatccctaacaacagtacccaaggctctagtaaagaaaagcaggaattgttgccctgcttacagcaggataataaccgcccaggaattctgacatccgatatcaagactgaactggagtccaaggagcttagtgctacagttgcagagtctatgggcctctatatggacagcgtgagagatgctgactactcatatgaacagcaaaaccagcagggtagcatgtcccccgctaagatctatcagaatgtggagcagctcgtgaaattctacaagggtaatggacaccgccccagcacgttgtcctgtgtgaacacaccgctgcgcagttttatgtcggactcaggctcctcagtcaatgggggagttatgcgcgccgtggtgaaatcccctattatgtgccacgagaaatctccttctgtgtgttcacctctcaatatgacaagctctgtttgtagtcctgctgggatcaacagtgtgtccagcaccaccgcatcattcgggtccttccccgtgcacagccctattacccagggcacaccgctgacttgctctcccaatgtcgaaaatcgcggtagtagatctcactcacccgcacacgcatcgaatgtcggatctccactctctagtcccctgagctctatgaagtccagcatttcaagccccccaagccattgttccgttaagtcacccgtaagctccccaaataatgtaacacttaggagtagcgtctcctctccagccaacatcaacaattcgcgctgttcggtaagctcacccagcaataccaataaccgtagcactctgtcaagtcccgccgcttctacggtggggtccatttgctctcctgtgaacaatgctttttcttacacggcatctggcacctccgcgggaagtagcaccctgcgagatgttgtgccgtcaccggacactcaggagaaaggggcccaggaagtcccatttcctaaaacagaggaagttgaatccgctatctcaaatggagtgacagggcagctcaatatagtccagtacataaaacctgaacctgatggcgctttctcttcttcctgtctaggcggcaatagcaaaatcaactcagactctagcttttccgtaccaataaagcaggagtccactaagcattcttgtagcgggacctccttcaaaggtaacccaacagtcaacccattcccattcatggacggtagctacttttccttcatggacgataaggattattattccctctctggaattttaggtcccccagtccctggttttgacgggaattgtgaaggctctggatttccggtgggaattaaacaagaaccagatgacggttcttactatcccgaggctagcataccaagcagcgcaattgtaggtgtcaacagtggcgggcaaagcttccattaccggatcggcgcccagggcaccatctcactgtccagaagtgcacgggaccagtcctttcaacacctgtcatctttccctcccgtgaacacattggtggagtcatggaaatcacacggggacctgagcagccgcagatctgacggttatcccgtgttagagtatattcccgaaaatgtgagctcctcaaccctgcgcagtgtcagtaccggctcatcaagaccgagtaagatctgcctggtgtgcggcgacgaggcctctggatgccactatggcgtggtcacatgtggctcctgtaaggttttcttcaagcgagcagttgagggtcagcacaattacttatgtgctggccggaacgactgtatcattgataagattcggcggaaaaactgtcctgcatgccgcctgcagaagtgccttcaggcaggaatgaatcttggggcccgaaagagcaaaaagctcggcaaactaaaaggtatacatgaagaacagcctcagcagcagcagccccctcccccacctccaccgcctcagtcccccgaagaaggcaccacatacatcgctcccgccaaggaaccttctgtgaatacagctctggtgccgcagctgtcgactatcagcagggcattgactccaagccctgtgatggtattagagaatatagaacctgaaatcgtctacgcaggttatgactcctctaaaccagataccgccgagaacttattgtcaactctgaatcggctggcaggtaaacagatgatccaagtcgtgaagtgggccaaggtacttcccggattcaagaacctgcctctagaagaccaaatcacgcttatacagtacagttggatgtgtctgagtagcttcgctttatcgtggcggagctacaaacacaccaatagtcaattcctgtactttgctcccgacctggtgttcaatgaggaaaagatgcaccagtccgcaatgtatgagttgtgtcaggggatgcatcagatctccctccagttcgtgcgcctccagttaacttttgaggagtacacaatcatgaaggtgctcctcctgctaagcacaattcctaaggacggactcaagtcacaggctgcttttgaggaaatgagaacgaactatattaaggagctgcggaaaatggtcaccaaatgccctaacaattctggacaatcttggcaaagattctaccagctcactaagttactcgattctatgcacgaccttgtctcagatctactggaattttgcttctacacattccgggagtcacacgccctcaaggtggagtttcctgcaatgctggtggaaataatcagtgatcagctgcctaaagtcgaatctggtaacgcaaaacccctgtattttcatcgtaagtag

SEQ ID NO: 197761 - DNA, 2967 bp, Artificial Sequence
  Description of Artificial Sequence: Synthetic coding sequence
atggagaccaagggctaccacagcctgcccgagggcctggacatggagagacggtggggtcaggtaagccaggctgtcgaacggagctctctgggcccaacggagagaacggacgaaaacaactacatggaaattgtcaacgtctcctgtgtgagtggggccattcccaacaattccactcaaggctcttcgaaagagaagcaggagctgctaccctgcttacagcaggataacaataggccaggcatactgacatcagacattaaaaccgagctggagagcaaggaactgagcgcaactgttgccgagtctatgggcctctatatggacagcgtacgcgatgctgattattcctacgaacaacagaatcagcagggatctatgagccccgccaagatatatcaaaatgtggagcagctagttaagttctacaagggaaatgggcacagaccgagtacattgtcgtgcgtaaacacgccgctccggtcattcatgagcgactctggtagtagcgtcaacggcggtgtaatgcgcgcggtcgtgaagtctccaattatgtgtcacgagaagtctcctagtgtgtgcagcccactcaatatgacatccagtgtctgcagccctgccggcatcaattcggtgagctccaccacagccagttttggtagttttcccgttcatagccctattacccagggcacccctcttacttgctcccccaatgtggagaatcggggatcccgcagccactcaccagcccacgccagcaatgtaggaagccccctgtcatctcctctatcctctatgaagagttccatctcttctcctccctcacactgctcagtcaagtcacctgtctcatctcctaacaacgtcactcttcgtagctccgtctcaagtccagctaacatcaacaacagcaggtgctccgtgagcagtccatctaacacaaataaccgcagtactcttagttcccccgctgcctcgactgttgggtcaatctgttccccagtgaataatgccttttcctacaccgcctcgggaacctccgctgggtcctcaaccctgagggacgttgtgccttcgcctgatacacaagagaagggtgcacaggaggttccgtttcctaagaccgaagaagtcgaatctgccatatccaatggagttacagggcagttgaacatcgtgcagtacatcaaacctgaacctgacggcgccttttctagttcttgcctggggggaaactcaaagattaacagcgattctagcttcagtgtaccgatcaagcaggaaagcaccaagcacagctgctcaggcacttcatttaagggcaaccctacagtgaatccttttccttttatggatggtagttactttagctttatggatgacaaggattactattctctgtccggaatcctcgggcctcccgtgccgggattcgacgggaattgcgaggggtctggcttccccgtggggatcaagcaggagcctgatgatggaagttattatccagaggcaagcatccctagctcagcaattgtgggagtgaacagcgggggacagtcctttcattatcgaattggcgcgcagggcaccatatcactgtctagatccgctagggaccagtccttccaacacctgtcctcttttccccctgtcaataccctcgttgagtcctggaaatcacacggagacctttccagtaggcggtccgacggctatccagtgttagaatatatacctgagaatgtcagcagctctaccctcagaagcgtgtcaaccgggagctcaagaccttctaagatttgcttagtgtgcggggacgaagcatccggatgccactacggcgtggtgacatgtggaagttgcaaggtgttcttcaaacgagcagttgagggaaagtgtagctggcagcacaactatctttgcgccgggcgaaacgactgcatcattgacaaaatccggagaaagaactgccctgcgtgccggcttcagaaatgcctgcaggccggcatgaaccttggagcacgtaaatctaagaaacttggaaagctgaagggcattcacgaagaacagcctcagcagcaacagcctcctcccccccccccacctccacagtcacccgaagaaggtacaacatacattgccccagccaaggaaccttcggtaaacactgccctcgtgcctcagttgtcgactatttctagggccctcacccctagtccagtcatggtgttggaaaacattgaacccgaaatcgtttacgccgggtacgactcatctaagccagacaccgctgaaaatctcctcagcactctgaacagactagcagggaagcagatgatacaagtggtgaaatgggctaaagtactgcccggatttaaaaatctcccactcgaagaccaaataacgcttatacaatacagttggatgtgcctgagctccttcgctcttagctggcgcagttataaacacacaaattcacagtttctctacttcgccccggatttagtgtttaacgaggaaaagatgcaccagagcgcaatgtacgagctatgtcaagggatgcaccagataagcctgcagttcgtgagactacagctgacttttgaggagtacactatcatgaaggtgttgctactactctccacaatacctaaggacggcctgaagtctcaggcagccttcgaagagatgcgaacaaactacatcaaagagctcaggaagatggtcactaaatgccccaacaactctggacagagttggcagcggttttatcaattaacaaagctactggactcgatgcatgatctggtctcagacctgcttgagttctgtttttacacctttcgcgagagccatgctctgaaggtagaattccccgccatgctagtcgaaatcatttccgaccaacttccgaaagtcgagtcagggaatgctaaacccttgtatttccatcgcaaatag

SEQ ID NO: 197762 - DNA, 2604 bp, Artificial Sequence
  Description of Artificial Sequence: Synthetic coding sequence
atggagaccaagggctaccacagcctgcccgagggcctggacatggaacggcggtggggtcaggtgtcccaggcagtggaacggtctagcctcggccccacagaaagaactgacgagaacaactacatggagatcgttaacgtgtcttgcgtatctggggccatcccgaacaattccacacaggggtcatctaaggagaaacaagagctgctgccatgcctgcaacaggataacaaccgccccgggattcttaccagcgacattaaaacagagctggaatctaaggaactgtccgccaccgtggccgagtccatgggcctgtatatggattccgttcgagacgctgattactcctatgaacagcagaatcagcagggcagcatgtccccagccaaaatctaccaaaatgtagagcagctggtgaaattttataaaggtaatgggcatagaccctccacactgagctgcgtaaacacgcccctgcgatccttcatgagtgattccggttcttctgtgaacgggggggtgatgagggcggtggtcaagtcacccattatgtgtcatgagaagtccccctcagtgtgctcgccgctcaatatgacttccagtgtgtgttcaccagccggcataaattctgtttctagtacaacggcaagtttcggctcctttcccgtacattcaccaattacccagggcactccattgacgtgcagccctaacgtcgaaaatcgcggctctcgcagccatagccctgcccacgctagcaacgtggggtcaccactgtcctcacccttgtcttccatgaagtctagtatttccagcccccctagtcattgcagtgtgaagtctccagtcagcagtcctaacaacgtgactctgaggagcagcgtctcgagccctgcaaatatcaacaactctagatgctcggtatcaagtccttcaaacacaaataatcgctctacacttagtagcccagccgctagtaccgtggggagcatctgcagccctgtcaacaacgctttttcctataccgccagtggcacaagtgctggatcttctacgctacgagatgtcgtcccttcacctgacacccaggagaaaggtgcgcaagaggtcccctttcccaaaactgaagaggtggagtccgccatctctaacggtgtgacaggccagctgaacatcgtccaatatattaaacctgagccagacggggcatttagttcatcctgcttgggaggtaattccaaaattaactccgattcgagcttctcagtgccgatcaaacaggagtccacgaaacactcatgttctggaacctcatttaaaggcaatccaaccgtgaacccatttccattcatggacggctcatacttcagtttcatggacgataaagactattactccctgtctgggattctaggtcctcctgtcccagggttcgatggcaattgtgaaggatctgggttccccgtgggcatcaaacaggagcctgacgatggctcttactaccctgaagcgagcattcccagttcagcaattgtgggagtgaactctggcggccaatcctttcactaccgaatcggtgcacaggggaccatatcgctctcccgctccgcgagggatcaaagcttccagcacctctccagctttccacccgtgaataccctcgtcgaaagttggaagtcccacggagatttgtcctcccgccggtccgacggataccctgtgctagagtacattcccgaaaatgtgtcctctagcacactgagatccgtcagtacaggaagtagccgaccatccaaaatctgtctcgtgtgcggtgacgaggccagcggctgccactatggagtggtgacctgcggatcttgtaaggtattctttaaacgagccgttgagggacagcataactacctgtgcgcgggccggaacgattgcattatcgacaaaattcgtcgcaagaactgtccagcctgccggctccagaagtgtcttcaggctggtatgaacctcggcggttttaagaacctgccactggaggaccaaattacactgatccagtactcctggatgtgcttgagcagctttgcactgtcctggagaagctacaaacatacaaactcccaatttctgtactttgccccggacctggtgttcaacgaagaaaagatgcatcaaagcgctatgtatgaactgtgtcagggtatgcaccagatctcacttcaatttgtgcgactgcagttgacctttgaagagtataccattatgaaggtgctgctactgctgtccacaattcctaaggatggactgaagtcacaggcagcctttgaagaaatgaggacgaattatatcaaggaactacgcaaaatggttacaaaatgtcccaacaattctgggcagagctggcagaggttttaccagctaactaagctcctggacagcatgcatgatctcgtgtcggatctcctggagttctgtttctacacttttcgtgagagccatgcactgaaggtcgagttcccagctatgctggtcgagattattagcgaccagctcccaaaggtagaatcgggcaacgcaaagcccctctattttcatcggaaatag

SEQ ID NO: 197763 - DNA, 1920 bp, Artificial Sequence
  Description of Artificial Sequence: Synthetic coding sequence
atggagaccaagggctaccacagcctgcccgagggcctggacatggagcgtcgatggggacaggtgagccaggctgtggagagatccagtctggggcccactgaacgaacagatgaaaacaattatatggagatagttaatgtgtcttgcgtctctggagctattccaaacaacagtacccagggcagttccaaagagaaacaggagctcctcccgtgcctgcagcaggacaataaccgccccggtatcctgacctctgatatcaaaaccgagctggaaagcaaagaactgtctgccacagtcgctgagtctatggggctttacatggatagcgttcgggacgcggattacagctatgagcagcagaatcagcagggcagtatgtcgccagcaaagatataccaaaatgttgagcagcttgtgaagttttacaaaggcaatggccacaggccctcaaccctgtcttgcgtcaatacaccgctgcgttcgttcatgagcgactcaggtagttcagtgaatgggggagtgatgagggcggttgtgaagtcccccatcatgtgccatgaaaagagcccctctgtgtgttcccctctgaacatgacaagctccgtctgctctcccgctgggatcaattccgtgtcttctactaccgcttccttcggaagctttccagtgcactcaccaattacgcaagggactccgctgacctgttccccaaatgtggagaatagagggtcccgctcacattcacctgcccacgcctcaaatgtcggatctcctctgtcttcccctttgtctagtatgaagagttcaatttcaagcccaccaagccactgctctgttaaaagccctgttagcagccctaacaatgtgacgctcagaagttctgtgagtagccctgcaaacataaacaattctcgatgctcggtttcgagtccatcaaacaccaataatcgctccaccctgtcatctccagcggccagtacggtcggctctatctgtagtccagtgaacaatgcgttctcctataccgccagcggcacctccgctggttcctccactctcagggatgttgtgccctccccggatacgcaggagaagggcgctcaggaggtcccatttccgaagaccgaggaggtggaatccgccatctccaacggggtgacagggcagctgaatatcgttcagtatattaaaccagaacctgatggcgcgtttagctccagctgccttggaggaaattcgaaaatcaatagcgactctagcttctcagtgcccattaagcaagaatctacgaagcatagctgctccggaacgagcttcaaggggaaccccaccgtaaacccttttccttttatggacggatcttacttctccttcatggacgacaaggactattattccctcagcgggattctcggacccccggtgcctggatttgatgggaactgcgagggttccggctttcctgtgggcataaagcaagagccagatgacgggagctattaccccgaggcctccatcccctcatcagccattgtgggggtgaattctgggggccaatcctttcactacagaatcggcgcccagggtacaattagcctatcaagatcagcccgggaccagagcttccagcatctgagtagcttcccgcctgtgaataccttggtagagagctggaagtcccacggcgacctctcatcgcggcggagcgacggatacccagtcctggagtatattccagaaaatgtgagctcgagtactctgaggtcagtatctactgggtcctcccggcccagcaagaagaacatataccggtttctgctgtgtaacaaccgcaccagaggggttgggcagcagttgcccctcagcccgcgatcctcaaccgtcttctgcattaccggtattcatacgcgctag

SEQ ID NO: 197764 - DNA, 1797 bp, Artificial Sequence
  Description of Artificial Sequence: Synthetic coding sequence
atgccctgcatccaggcccagtacggcacccccgcccccagccccggcccccgggatcacttggcttcagatccgctcactccggaattcatcaagcctacaatggacctggcgagccccgaagctgctccagccgccccgacagctctaccgagcttttctacttttatggacggttatacaggggaattcgatacattcttataccaattgcccggaactgtccagccttgttctagtgcctcttcttcagcctcctccacttctagcagctcagcaacttcccctgccagcgcctcttttaaattcgaagacttccaggtgtacggctgttaccctgggccactttccggaccagtcgacgaggccctgtctagctctggatctgattattacgggtccccatgctcagcaccaagtcctagtactccttctttccagcctccccagttgtcaccatgggacggctccttcggccatttttctcccagccagacctatgagggactccgggcatggacagagcagcttcccaaagcttccgggcccccgcaacctcctgcttttttttcatttagtccaccaacaggacccagcccatccctggcacagagccctctgaagttgtttccttcgcaggctacacatcagctcggcgagggagaatcttatagcatgcctaccgcttttcctggcttggcacccacaagccctcacctcgaaggaagcggcatcttagacactccagtgactagtacgaaggccaggtcaggagctcctggcggatccgaaggacgttgcgcagtatgcggagataacgccagctgccaacactatggagtgcgaacctgtgagggatgcaagggtttcttcaagagaaccgtccagaagaacgccaaatatatctgtctcgcaaacaaggattgccccgttgacaaaaggcggcgaaataggtgccagttctgccggtttcagaaatgtttggccgtggggatggtgaaagaagtggtccggaccgacagtctgaaaggtcggagggggaggcttcccagcaaaccaaaacagccccccgacgcctctcccgccaaccttttgaccagcctggtacgcgctcacttggattctggaccttctactgctaaactcgattactcaaagttccaggagcttgttctgccccattttgggaaagaagacgccggcgatgtgcaacaattctacgatctgctgagtggtagcctggaggttatcaggaagtgggcagagaagatcccgggctttgcagagctgagcccagccgatcaggatctgctacttgagtctgcttttctagaactgtttatcctccgactggcctatcggtcgaagcctggagagggcaaactaatcttttgctccggcctggtgctacacagattgcagtgcgctaggggtttcggtgattggatcgacagcatcctggcatttagccggtcattgcattccctcctggtggacgtgccagcgttcgcctgtttgtccgctcttgttctgatcactgataggcatggcctgcaggaaccgcgaagggtggaggaactgcagaatagaatcgcaagctgcctgaaagagcacgttgcagccgttgcgggcgagcctcaacccgcctcatgtctgagtcgcctcctgggaaagctgccggagctgaggaccctgtgtacacagggtttacaaagaattttttatctgaaactcgaagacctcgtaccacctccaccgattatcgacaagattttcatggacacactgccattctag

SEQ ID NO: 197765 - DNA, 1836 bp, Artificial Sequence
  Description of Artificial Sequence: Synthetic coding sequence
atgtggctggccaaggcctgctggagcatccagagcgagatgccctgcattcaggctcagtatggaactcccgctccttccccgggccctagggatcacctagcatccgatccgctcacccccgagtttattaaaccgaccatggatctggcaagtccagaggcagcacccgccgccccaaccgcactgccatcttttagcaccttcatggatggatatacaggtgaattcgatacatttctgtatcagctgcctggcactgtgcagccctgttccagcgcctccagttccgcctctagtacgagttcatcctccgccacgtccccagccagcgcttccttcaaattcgaagatttccaagtctacgggtgttatccaggacccttgagcggccctgtggatgaggccctctcatcatccggcagcgactattacggttctccttgtagtgcaccatccccctccaccccttccttccagccaccacagctgagtccctgggatgggagctttggccactttagcccttcgcagacatatgaggggctccgtgcgtggactgagcagctgcctaaggccagtgggcctccccagccccccgccttcttttcgttcagcccacccaccggtccctctccatcattggcgcagtccccgttgaagctattcccaagccaggctacccatcagttgggagagggcgagagttattctatgcctacagcttttcctggccttgcccctacttcccctcaccttgaagggagtggaattctggacacgcctgtgacttccactaaagctcgctctggagcacctggcggatccgaaggtcgctgtgctgtgtgtggggataatgcatcctgccaacattacggtgtacggacctgcgaaggatgtaagggctttttcaagaggactgtccagaaaaacgcgaaatacatttgcttggctaacaaagactgtcccgtcgacaagcggaggcggaaccgttgccagttttgtagattccagaagtgtctagccgttggcatggttaaggaggttgtccgcacagatagcctgaaagggcgaagggggaggctccctagcaaacctaagcagccgcccgacgcgtcaccggccaatctcttgacatcgctcgtgagggcacatctcgactcagggccttcaaccgctaagctggattattccaaatttcaggaactggtgctgccacactttggtaaagaagacgccggagatgttcagcagttttacgacttgctgtctggcagcctagaagtgataaggaagtgggccgagaagattccaggtttcgcagagctgtcccctgccgaccaggacctcctcctggagtctgcatttcttgaactgttcatcctccggctcgcttatcgatccaaacctggtgagggtaagttgatcttctgcagcggactggtgctgcatcgcttgcagtgtgccaggggatttggggattggattgacagcatcttggccttctcgcgctctcttcattccctgctggtagatgtaccagccttcgcatgcctgagtgccctggtactgattacagaccggcacggtctgcaagagccaagaagagtggaggaactccaaaacaggatagcctcttgcctcaaagagcacgtcgctgctgttgctggggaaccccaaccagcaagttgtttaagtcggctgctcggaaaattgccagaactgagaacactttgcacccaagggctccagcgaatattctacctcaagctcgaggacctggtcccgcctcccccgattattgataaaatctttatggatacactgccattttag

SEQ ID NO: 197766 - DNA, 1797 bp, Artificial Sequence
  Description of Artificial Sequence: Synthetic coding sequence
atgccctgcatccaggcccagtacggcacccccgcccccagccccggtccacgggaccatcttgcttcagatcctttgacgccggaattcatcaagcctacaatggacttggccagtccagaggcggcaccggcagcacctaccgctcttccaagtttttccacctttatggatggatacactggcgagtttgacacgttcctataccagctaccaggcactgttcagccatgtagctctgccagttcgtctgcctcctctacaagctcctcaagcgccacttctcccgcatctgctagctttaagtttgaagacttccaggtttatggctgctatcccgggcccctatcaggccccgtcgacgaggcacttagtagctcagggtctgattactatggttctccatgctcagctcctagccctagcactccctcttttcaaccaccgcagttgtcaccttgggacgggtcatttggccatttctcacccagtcaaacctacgagggacttcgcgcttggaccgagcagctgcccaaggcaagcggccctccacagccccctgccttttttagcttttctcctcctactggcccgagtccttccctcgctcaatcgccccttaaactgtttccctcccaggctacccaccagctcggcgagggggagagctattccatgccaaccgcttttccagggctggctccaacctcccctcatctcgagggctccgggattttagatacacccgtgacaagtaccaaagctcggagcggtgctcccggagggagtgagggacgatgtgccgtctgtggcgacaacgcttcttgtcagcattacggagtccggacatgcgagggatgtaaagggttttttaagcggacagtccagaaaaacgccaagtatatttgcttagccaataaggattgtccagttgacaagcggcggcggaaccgatgccagttttgtcgattccagaagtgcctggcagtagggatggtgaaggaggttgtcagaaccgatagcctgaaaggtagaagaggcagactcccgtcgaaaccaaaacagccccctgacgcttcaccagctaacctccttacgtcattggtgcgtgctcatctggattcagggccatccactgctaagctggattactctaagttccaggaattagtgctgccccatttcggcaaggaagacgctggagacgtgcagcaattctacgacctcctgtccggaagcctggaggtgattcggaagtgggccgaaaaaattccaggcttcgccgaactgtcccccgcagaccaagatttgctgctggagagcgcttttcttgagttattcatactgcgactggcttaccgatccaagcccggagaaggaaagcttattttctgcagtggcttggtgttgcacaggctgcagtgcgcgcggggattcggcgattggatagatagcatcctagcatttagtcgcagcctccactccttgctggtggacgttcccgccttcgcatgtctttccgccctcgttctaataactgaccgccacgggcttcaagaaccacgccgcgtcgaggagctgcaaaatcgtattgcttcctgcctgaaggagcacgttgctgcagtcgccggggaaccacaaccggcctcatgcctgagtaggctgctcgggaagctgcccgaattgaggaccctgtgtacacagggcctgcagaggatattttacctcaaacttgaggatcttgttcccccaccacctattatcgacaagatatttatggacaccctaccgttttag

SEQ ID NO: 197767 - DNA, 1797 bp, Artificial Sequence
  Description of Artificial Sequence: Synthetic coding sequence
atgccctgcatccaggcccagtacggcacccccgcccccagccccgggcctcgggatcacctagcctcagatcccctgacacctgagtttattaagcccactatggacctagctagtcccgaggccgcacctgcggctcccacagcactgcctagcttttcaactttcatggatgggtataccggtgagttcgatacatttctttaccagctgcccggtacagttcagccctgctctagcgcctcatcttctgcctctagtacctcctccagctcggccacaagcccagctagcgcatctttcaagttcgaagactttcaggtttatgggtgttatccaggaccattgtccggacccgttgatgaggccctatcatctagcgggtctgactattacggaagcccctgtagtgccccctcaccaagtacaccctcatttcagcctcctcaactttctccctgggatggatctttcggccacttctcaccctcccagacatacgaaggactccgggcttggacagaacagctgcctaaggccagcggtcccccacaacctcccgcattttttagcttttcgcctcctacaggacctagcccatcgctggcacagagcccactaaaattatttccgtcacaggccactcaccagctgggcgagggcgagtcctacagtatgcccacagcctttcccggattggcccccacatctccccacctagaggggtcaggtattctggatactccagtcacgtcaaccaaagcccggtcaggcgcgccaggcggatcagaaggcagatgcgctgtgtgcggggataacgcatcctgccagcattacggggtaaggacctgtgagggatgtaaggggtttttcaaaagaaccgttcaaaagaatgcgaaatacatatgtctggccaacaaagactgccctgtggataaaagacggaggaatagatgccagttttgccgattccagaagtgtctcgctgttgggatggtgaaagaagtggtgcgcaccgattctctgaagggtaggcgaggacgcctcccatccaagccaaaacagccacctgatgcatctcccgctaacctgttgacaagtctcgtccgagcgcacctggacagcggtccttcgacagccaaactcgactactccaaattccaagagctcgtgttaccacactttggcaaggaggacgccggtgacgtccagcagttctatgatttgctcagtgggtcattagaggtaatcagaaaatgggctgagaaaatcccaggatttgctgaactatcccctgcggaccaggaccttctgctggagagtgcgttcttagagcttttcatactcaggcttgcttatcggagtaaacctggggaaggaaaacttattttctgctcgggcctggtgctgcacaggcttcaatgcgccagaggcttcggcgattggatagactccatattagccttctccagatccttgcactctttgttagtcgacgtacctgcgtttgcttgcctgtctgcattagtactgatcaccgacagacacggtctgcaggagccaagacgggtcgaagagctgcagaaccggattgcatcatgccttaaggagcacgttgcagccgttgcaggagagccacaaccagcttcatgtctatcacgattgttgggcaaactacccgaactcagaactctctgcactcaggggttgcaacgaatcttctacctgaagctggaagatctggtcccccctccgccaatcatcgacaaaatctttatggatacacttccattctag

SEQ ID NO: 197768 - DNA, 1959 bp, Artificial Sequence
  Description of Artificial Sequence: Synthetic coding sequence
atgaccagcgcccagtacaagatcaagatcctgatcgagggcctgcaccacggacagaggccggggccggccccccctagacagcccggctctttttgttgggccctcaaagccgacggaattatgtggctcgcaaaggcttgctggtcaatacaatccgaaatgccatgtattcaggcccaatacggcactccagccccatcacccggtccccgtgatcacctggcgtctgatccccttacccccgaattcataaagcccacaatggatctggcttctcctgaagccgcccccgcagccccaaccgctttacccagcttctccacctttatggatggctatacgggcgaattcgatacatttctttatcagctacctggtaccgtgcagccctgtagctcggcctcttcttcagctagttccacctcatcctcctctgccacctcgccagccagtgcctcctttaaatttgaagatttccaggtttacggttgttaccccggtcccctgtccggcccggtggatgaagcgctgagtagcagcggtagtgattactacggttccccttgctcagcgcccagcccctcgaccccttcttttcagccaccccaacttagcccatgggacggcagtttcgggcacttttccccctcgcaaacttatgagggcctccgcgcctggacagagcagctcccaaaagcaagtggcccaccccagccaccagccttttttagtttctccccgcccaccggccctagtccttctcttgctcagtccccactgaagctcttcccctctcaagctacgcatcagttaggagaaggcgagagttattctatgccgacggcctttccaggcctggcccctacttcccctcatctcgaggggtccggcattctggatactccagtgacatcaacaaaggcaagaagcggggcccctggggggtcagaggggcggtgtgccgtctgtggagacaacgccagctgccaacactatggcgtgaggacgtgcgaagggtgtaagggattctttaagcgcacagttcagaaaaacgcaaaatatatttgcctcgccaacaaagactgcccagtcgataaaaggcgccgtaaccgctgtcagttttgtagatttcaaaagtgtctggccgtggggatggtgaaagaagttgttaggacagatagcctcaaggggaggcgagggcggctgccgtccaaaccaaagcagccccctgacgcaagtcccgccaatctgctgaccagcctcgttcgagctcacctcgactcgggcccgtctaccgcaaaattggattatagtaaattccaggaactggtattgcctcacttcggcaaggaggacgccggggacgttcaacaattctacgacttgctgtcgggatccctcgaggtgattagaaagtgggcagagaaaatcccaggctttgctgagctgagccccgcggaccaggatctccttctggagtccgcgtttttagagctcttcattttgagattagcttataggagcaagcctggtgagggaaagctaatcttctgctcaggactcgtgctccatcggctccaatgtgcacgtgggttcggcgattggatagatagcattctggcgttctccagaagcctacattcactactcgtggacgttccggcttttgcttgcctctccgccctggtgctgatcacagaccgtcacgggctgcaagagccccggcgagtcgaagagctccagaataggatagcctcttgtctgaaagagcatgtggctgcagtagctggcgaaccacaacctgcctcgtgccttagccgtttgttgggcaaactgcctgaattgaggaccttatgcacccaaggactccagcgcatattctacctgaagctcgaagatctggtaccaccgcctccaatcattgataaaatatttatggacactcttccattttag

SEQ ID NO: 197769 - DNA, 978 bp, Artificial Sequence
  Description of Artificial Sequence: Synthetic coding sequence
atgccctgcatccaggcccagtacggcacccccgcccccagccccggcccccgggatcatcttgcatcagatccgctgacaccagagtttatcaaaccaactatggacctcgcttcaccagaagcagcccctgccgccccgaccgcccttcccagttttagtaccttcatggatggatacacgggggaatttgacacttttctctaccagttgcccggcacagttcaaccgtgttcatctgcaagcagttcagcctctagcacttccagttccagcgctaccagtcctgcctcggcttccttcaaatttgaagactttcaggtctatggatgctaccctggaccactgagtgggccagtcgacgaagcgctcagctcctctggcagcgactactacggaagcccctgcagcgcaccctcacccagtactcccagtttccagcctcctcaactgtcaccgtgggacgggagctttggacatttcagcccctcccaaacctatgagggattaagagcctggactgagcaactccccaaggcaagcggaccacctcagccacccgcatttttctctttcagtccacccacagggccctccccatctcttgctcagagccccctcaaactcttcccctcgcaagcaactcaccagctcggcgagggcgaatcttactcgatgcctactgcattccctgggctggccccaaccagcccccacctcgaaggttctgggattctcgacaccccagttacatctactaaggcaaggtcgggcgcgcccggagggagtgagggccggtgcgcagtatgtggagacaatgcatcctgtcaacactatggtgttcgcacgtgtgaaggctgcaagggcttcttcaaggtgcctagatccccgagatggggtctgctgctggagatggaacggggttggccccacccaatcggcacatgtggcttgccactggggtccccaccgtcatag

SEQ ID NO: 197770 - DNA, 1836 bp, Artificial Sequence
  Description of Artificial Sequence: Synthetic coding sequence
atgtggctggccaaggcctgctggagcatccagagcgagatgccctgcattcaagctcagtatggtacgcccgcaccttctcctggacccagggaccacctggcttccgatccactgactcctgagttcattaagcccaccatggatctcgcctctcccgaggctgcacctgcagcgcctacggcacttccctctttctcaacctttatggatggctacaccggagaatttgatacttttttataccagctgcctggaacagtccaaccttgttcatccgcatccagctccgctagctctacgagcagctcttccgccactagcccggccagcgctagtttcaaatttgaggactttcaagtctacgggtgctatcccggccccctgtctggacccgtcgatgaggctctatctagcagcggatcagactattatggtagcccctgctccgctccctccccatctaccccctcttttcagccccctcagctgtcgccatgggacggcagctttggtcacttcagcccttctcagacttatgaagggcttcgagcttggaccgagcaacttccgaaggcctctggcccacctcagcctccagccttttttagtttctcacctccaaccgggccctctccgtcgttagctcagtccccgctgaagctgttccccagccaagccacccaccagctgggtgagggtgagagctatagcatgcccactgcctttcccggcctcgctccgacaagcccgcacttggaaggttctggcattcttgatacccctgtcacctccaccaaggctcggtccggagcccccggcgggtctgaaggaagatgcgccgtctgcggtgataacgcctcatgccagcattatggagttaggacatgcgaaggttgtaaagggttctttaaaaggactgtgcaaaagaatgcgaagtatatctgcttggctaataaggactgtcccgtcgacaagcgtagaaggaatagatgtcagttctgcaggtttcaaaaatgccttgctgtgggaatggttaaggaggtggtgcggacagacagcctgaagggccgtcggggccggctgccaagcaaaccaaaacagcctcccgatgcctccccagccaacttgttgacatccctggtgcgggcacacctggactcggggccaagcactgcaaaattagactattccaaatttcaagagctggttctgccgcattttggaaaggaagatgcaggagatgtccaacagttttacgatttgcttagcggatcccttgaggtgatccgtaagtgggcggagaaaattcctggcttcgctgagttaagtccggccgaccaagatttactcctcgagagtgctttcctggaactgtttattctgaggctcgcctaccgatcaaaaccaggcgaaggcaagttaatcttttgttctggcctagttttgcatcgactgcagtgcgccagggggttcggtgactggatcgacagcatactggcatttagtaggtctttacattctcttctggtcgacgttcctgccttcgcctgtttgagcgccctggtcctgatcaccgatcgccatgggcttcaggagcctcgccgtgtagaagagcttcagaatcggattgccagctgtctgaaagagcacgtcgccgcagtcgcaggcgaaccacagcccgctagctgtttgagtaggttgctgggcaagctgccggagcttaggacgctatgcacccagggcttacaacgaatcttttatctcaagctggaggacctggtcccacctccgccgatcatagacaaaatcttcatggataccctgcccttttag

SEQ ID NO: 197771 - DNA, 1797 bp, Artificial Sequence
  Description of Artificial Sequence: Synthetic coding sequence
atgccctgcgtgcaggcccagtacggcagcagcccccagggcgcctcccctgcctcacagagctactcttaccacagcagcggagagtactccagcgattttttgaccccagaatttgtgaaattcagcatggatttgacgaataccgagataactgccacgactagcctgccatcctttagtacatttatggataactattctaccggctatgatgttaagcctccttgcctgtaccaaatgccgctgtcgggtcagcagtcttccatcaaagtggaagatatacagatgcacaattatcagcagcacagccacctgccaccccaatctgaggagatgatgcctcatagcggctctgtgtactacaaaccctccagcccaccgactcccacgacgcccgggtttcaagtgcaacacagtccaatgtgggatgaccccggaagcctgcacaacttccatcagaactacgtcgctaccacacacatgatcgagcagcggaagacacctgttagtcggctgagcctctttagttttaaacaaagtccccccggcacccccgtgtccagttgtcagatgcggttcgatgggcccctccacgttcccatgaatccagaaccagctggtagtcaccatgtggtggatggccagactttcgcagttcccaaccctattcgtaagcccgcctcgatgggcttccctggactccagatcgggcacgcttcacagctcctcgatacccaggttccttcgccaccgagtcgcgggtctccctcaaacgagggactgtgtgccgtttgcggcgataatgcggcttgtcagcactacggagtgcgaacatgtgaagggtgcaaggggtttttcaaaagaacagtgcagaagaacgctaagtacgtgtgtcttgccaacaagaactgtcctgtggataaacgtaggcggaataggtgtcagtactgccgattccagaagtgtctggctgtcggaatggttaaagaagtggtgaggactgatagcctcaagggacgccgaggcaggttgccttctaaacccaagtcccctcaggagccttcccccccttctccacctgttagcctcattagtgccctggttcgagcccacgtggatagcaatccagctatgacatcattggattactcacggttccaggctaacccagactaccagatgagcggggacgatacgcagcatatccagcaattctatgacctgctgaccggtagcatggagatcattagagggtgggccgagaagattcctggttttgctgaccttcccaaagcagatcaggatctgctttttgagtccgctttcctggaattgttcgtgttgcggttggcatatcgaagcaaccccgtggaaggtaagctgatattctgcaatggtgtggtgctgcacaggctgcaatgcgttcggggatttggcgagtggatcgatagtatcgtggagttcagtagcaaccttcagaatatgaatatcgacatttcagccttctcgtgtattgcagctctcgccatggttacggaaagacatgggctcaaagaaccaaagagagtagaagaactgcagaataagattgttaattgtctaaaagaccatgtcacttttaacaacggcggactgaaccgtccaaattacttaagcaagctcctgggcaagctgccggaactaagaaccctatgcacccaggggctccaaaggatcttttatcttaagcttgaggacctggtcccaccccccgcaataatcgacaagctctttctcgacactcttcccttctag

SEQ ID NO: 197772 - DNA, 1797 bp, Artificial Sequence
  Description of Artificial Sequence: Synthetic coding sequence
atgccctgcgtgcaggcccagtacggcagcagcccccagggcgccagtccagcgtctcagtcctacagctaccattcttccggcgagtacagttctgacttcttaacacccgaattcgtcaagtttagcatggaccttactaatacagagataactgcaactacctcgcttccatccttctccacgttcatggataattactcaactggatatgacgtgaagcccccctgcctatatcagatgcccttgtccggacaacagagttcgataaaggtggaggacattcaaatgcataactaccagcagcactcccacttgcctcctcagagtgaagagatgatgcctcattcaggatccgtgtattataagccatcttctccaccaacgccaacgactcctgggtttcaggtccagcacagcccaatgtgggatgatccaggttcactgcacaactttcaccaaaactatgtggcgacaacacatatgatcgagcagcgcaagacccctgttagtcgactgtcgcttttctcctttaaacagtccccacccggaaccccggtatcatcctgccagatgcgttttgacggcccactgcacgtgccaatgaacccggagcccgccgggtcacaccatgtggtggacggccaaaccttcgctgtgcctaacccaatcagaaagcccgcttccatggggttccccgggctccaaataggccacgctagtcaactgctggatacacaggtgccatcgcctccctctcgggggtcaccgtcaaatgaaggattatgcgccgtgtgcggcgacaacgccgcttgccaacactatggggtcaggacctgcgaagggtgcaaggggtttttcaagaggaccgtacagaagaacgctaaatacgtgtgtctggctaataaaaattgtcctgtggataaaaggcggcggaataggtgccagtactgtagatttcaaaaatgcctggctgtgggcatggtgaaggaggtggtcaggacagatagcctgaagggacggcgtggacgcttaccctccaaacctaagtctccccaggagccatcccccccatctcctcctgtttccctgatatccgcgctggtgcgcgcacacgtggactctaatcccgccatgacctccctggactacagtcggtttcaggcgaatccagactatcagatgagcggcgatgacacccagcatattcagcagttttatgatcttctaaccggatctatggagataattcgagggtgggctgagaagattcccggatttgccgatttgccaaaggccgaccaagatttgctgtttgagtcagcctttcttgaacttttcgtcctccggcttgcctaccggtccaatccagttgaaggcaaactcatcttctgcaatggggtcgttctgcaccgccttcagtgtgtccggggcttcggcgaatggatcgactcgatcgttgaatttagcagcaatctccagaacatgaacattgatatttctgccttctcgtgcatcgcggccttggctatggtgactgaacgccacgggctaaaggaacccaagcgggttgaagaactacagaacaagatcgtcaactgcctgaaggatcatgtgactttcaacaatggtggactaaaccgtccaaactacctgtccaaattgctcggcaaattacctgagctccgtacattgtgtacacagggcttgcagcgaatcttctacctaaagctggaagatctagtgcctcctccggcaatcatcgacaagctcttcctggatactttgccattctag

SEQ ID NO: 197773 - DNA, 1179 bp, Artificial Sequence
  Description of Artificial Sequence: Synthetic coding sequence
atggacaactacagcaccggctacgacgtgaagcccccctgcctgtaccagatgcctctcagtggtcagcagtcaagtatcaaagtggaagacatccagatgcacaactaccagcaacacagccatctgccaccacagtcagaagagatgatgccccactctggaagcgtctactataaaccatcctcaccacccacacccactacacccggattccaggttcagcatagcccaatgtgggatgatccggggagcttacataactttcaccaaaactatgtagctactacccacatgatagaacagaggaagacgcctgtgtcccgtctttcattgttctcatttaaacagtccccgcctggcacacctgtgagctcctgccagatgcggttcgacggccctctgcacgtcccaatgaatccagagcctgctggttctcaccacgtcgtagatgggcagacttttgcagttcctaatccaatcaggaagcctgcttcaatgggattccctggtttgcagattggacatgccagccaactgttggatacacaggtgcctagtcccccctcgaggggcagcccctccaacgaaggactgtgcgcagtctgcggggacaacgccgcctgccaacattacggcgttaggacctgtgaagggtgcaaaggcttcttcaaacggacagtccaaaagaacgcgaagtatgtttgtctcgcgaataagaattgcccagtggacaaaagacgacgcaaccggtgccagtactgccgcttccaaaagtgccttgcagtcggtatggtcaaggaagtggtccgcactgatagtctcaaagggaggcggggcaggcttccctcaaaaccaaaatcaccccaggagcccagtcctccttctccacctgtgagtttgatctccgcactcgtgcgggcccacgtggattctaatcctgctatgacatctttggactactctcggttccaggccaaccccgactaccaaatgtccggtgacgacactcagcacatacaacagttttatgacttacttactgggtcaatggaaattattcgcggctgggctgagaagatacccggattcgccgaccttccaaaggcagatcaggacctgctgttcgagtctgcctttttagaattatttgtgttgagactcgcctacagaatatag

SEQ ID NO: 197774 - DNA, 1179 bp, Artificial Sequence
  Description of Artificial Sequence: Synthetic coding sequence
atggacaactacagcaccggctacgacgtgaagcccccctgcctgtaccaaatgccgttgagcgggcagcagagctcgattaaagtcgaggacattcagatgcataattaccaacagcactctcacttacctccacagtccgaggaaatgatgcctcattccggaagcgtgtactacaaaccaagctccccaccaaccccgacaactccgggtttccaggtgcagcatagccctatgtgggatgaccctgggtccctgcacaattttcatcaaaactacgttgcgacgacccacatgattgaacagcgtaagacacctgtctcccggctgagtctcttcagtttcaagcagtcgccgcctgggactcccgtcagctcctgtcagatgagattcgatggcccactgcacgtcccaatgaacccagaacctgctggtagtcaccacgtggtggacggtcagactttcgcagtcccaaaccctatcagaaagccggcttccatgggcttcccaggcctgcagatcggacatgcaagtcagctactggacacacaggttccaagcccacccagccgaggatcgccgtccaatgaaggcttatgcgcggtctgcggagataacgctgcctgccagcattacggcgttcgaacgtgcgaaggctgcaaaggattcttcaagcggactgttcagaagaatgccaaatatgtctgcctcgcaaataaaaactgtcctgtggacaagagacgaaggaatagatgtcagtattgtaggttccaaaaatgcttagccgtcggaatggtgaaggaggttgtgaggaccgattctttaaaaggcagaaggggtcgactcccttctaagcctaagtcaccacaggagccgtctccacctagtccgccggtgtccttgatcagcgctcttgttagggctcacgtagatagcaatccagcaatgaccagcctggactacagcaggtttcaggccaacccggattaccagatgtccggagacgatacacagcacattcaacagttttatgacctcctgactggatcaatggaaatcattcggggttgggccgagaagatccctggctttgctgacctgccaaaagccgaccaggacttgctgtttgagtcagcctttctggagcttttcgtgctgcgcctggcttaccgcatttag

SEQ ID NO: 197775 - DNA, 777 bp, Artificial Sequence
  Description of Artificial Sequence: Synthetic coding sequence
atgccctgcgtgcaggcccagtacggcagcagcccccagggcgccagcccagcaagccagtcttactcttatcacagctccggggagtacagttccgattttctgactcctgagtttgtaaagttttccatggacctgaccaataccgaaatcactgccactacttcactgccttctttttccacgttcatggacaattactctacagggtatgacgttaagcctccgtgtctatatcagatgccattatccggacagcagagcagcatcaaagtcgaggatatccaaatgcataactatcagcagcacagtcacctcccccctcaaagcgaggagatgatgccacacagtggatctgtttattataagccttcgtcgccgccgactccaaccacgcctgggtttcaagtgcaacactctcctatgtgggatgatccgggctctttacataattttcatcagaactatgtggccacgacacatatgatcgaacaaaggaaaactcctgtgtccaggttgagcctcttcagcttcaagcagagcccccctgggacgccagtatcctcctgccaaatgagattcgatggccctctgcatgtcccgatgaacccggaacctgccgggagtcaccacgtagtcgacggccaaactttcgccgtgcccaacccgatccggaagccagccagtatgggtttccctggcttgcaaatcggtcacgcatcgcaacttctggatacgcaagttccatcccctcctagtaggggcagccctagctag

SEQ ID NO: 197776 - DNA, 1608 bp, Artificial Sequence
  Description of Artificial Sequence: Synthetic coding sequence
atggacaactacagcaccggctacgacgtgaagcccccctgcctgtaccagatgccgctgagcggacaacagtcctccattaaggtagaagacatccaaatgcacaactatcagcagcactcgcacctgccaccccagtccgaagaaatgatgccacactcggggagcgtatattacaagccttcctcaccacctacccctaccacccccggatttcaagtccagcactctccaatgtgggatgatcccgggtctctgcataattttcaccagaattacgtagctaccacacatatgatcgaacagcgcaaaactcctgtatcacggctttcactctttagtttcaagcaatcccccccaggaacgccagtgagcagctgtcagatgaggttcgatggacccctgcacgttccaatgaatcccgagcccgcaggttcacaccacgttgttgatggccagactttcgcagtaccgaatccaatacggaagcctgcaagcatggggtttcccggcctgcagatcggacatgcgagtcaacttctggatacccaggtgccaagccccccctctaggggcagcccatccaatgagggtctgtgtgccgtttgtggagataatgccgcctgccaacactatggagtaagaacatgcgaaggctgcaaagggttctttaaacggactgtacaaaagaacgccaaatacgtgtgcctggcaaacaaaaattgtcctgttgacaagcgtagacgaaatcgatgtcagtactgcagatttcaaaagtgcctagcggtcggaatggtgaaagaagtcgtgagaacggattctctgaaggggcggagaggccgcctgccttccaagccaaagtctcctcaggaaccctccccccccagcccccctgtgtcactgatcagcgcactcgttcgggcgcatgtggattccaatcctgccatgaccagtttggattactctcgcttccaggctaaccctgactaccagatgagcggcgacgatactcagcacatccaacaattttatgatctgttgactggttcgatggaaatcatccgcggctgggcagaaaaaatccctggattcgcagacctcccgaaggcagaccaggacttactgtttgaatccgccttcctagaactctttgtcctgagactcgcctacaggtccaatccagtagaaggcaaactaatcttttgcaatggagtcgtgcttcaccgcttgcagtgcgtccgcggctttggcgaatggattgacagtattgtggagttctcctccaacttgcagaacatgaacatcgacatctccgcattcagctgtatagctgctctagccatggtaacagagcgtcacgggctgaaggagccaaagagagtggaggagttacagaacaagatcgtaaattgtctgaaggaccacgtcacctttaacaacggtggccttaatcggcctaactacctatcgaagctgctggggaagttacccgaacttcggaccctctgtacacagggcctccagcgcattttctatttgaagcttgaggatctagtgcctccccccgccatcattgataagctcttcctggacacattacctttctag

SEQ ID NO: 197777 - DNA, 1830 bp, Artificial Sequence
  Description of Artificial Sequence: Synthetic coding sequence
atgaacgaggaccggcggggcgagctgctgaccatgccctgcgtgcaagctcagtatggctcatccccccagggagcttcgccggcatctcaatcttactcttatcattccagtggtgagtactcctccgactttctgaccccagagtttgtcaagttctccatggacctgactaatacagagatcacagcaaccacatccctgcccagttttagcacttttatggataactattctactgggtacgacgtgaagcctccatgtttgtaccagatgccactgagcgggcagcagtcaagtatcaaagtggaggacatccagatgcacaactaccagcagcacagccacctgcctccccaatctgaagagatgatgccccactcgggttcagtttactacaagcctagcagcccaccaactccgactacccctgggttccaggtgcagcactctccaatgtgggatgacccaggctccctccacaatttccaccagaactacgtggcaacaacccacatgattgaacaacgcaagacaccagtgtcccggttatccctattctctttcaagcagagccctcccgggacaccggtgagctcttgtcagatgcgattcgatggtccgctccacgttcccatgaacccggagccagcaggatcacaccatgtagtggacggccaaacgttcgccgtgcctaatcccatccgcaagccagcctccatggggtttcctgggttgcaaattggacatgcaagccagctgttagatacacaggtgccttcgcccccctcaaggggcagccccagcaatgagggcttatgcgccgtgtgcggcgacaacgctgcttgccagcattacggggtacgcacgtgcgagggctgtaaggggtttttcaagcggaccgtccagaaaaacgcaaagtatgtgtgcctggcaaacaagaattgtccagtagacaagcgtcgccgaaacagatgtcagtactgtagatttcaaaaatgcctcgcggtggggatggtaaaggaggtggtcaggacagattcgttgaagggacgacgtgggcggttgcctagtaagcccaaatctccccaagagccaagcccccctagcccacctgtgagtctcatatctgcactggtgcgtgcccacgtggattcaaatcccgccatgacctctctcgattatagtcggtttcaggcgaaccctgattatcagatgtccggtgatgacacgcagcacatccagcaattctacgatttacttaccggctccatggaaatcatccgaggatgggccgagaagatccccggatttgccgacctcccaaaagcagaccaggatctcttatttgagtctgcattcctggagctgtttgtgttgaggctggcttaccgcagtaatcctgtcgagggaaagctcattttttgtaacggcgttgtgctccacaggcttcaatgtgtgcgcggatttggtgaatggattgacagcatcgttgagttttccagcaaccttcagaacatgaacatcgacatttctgccttttcttgcattgcagcgctggcgatggtgacggagcggcacggcctgaaggaaccaaagcgcgtggaagaactgcagaacaagattgtaaattgcttgaaggatcacgttacatttaacaatggcggactgaaccgccctaactacctttcaaagttgttgggcaagcttcccgaactccgtacactatgtacgcagggcctccagaggatcttttatctcaagctagaggacctggtgcctcctcccgctataatcgacaagttgttccttgacactctgccattctag

SEQ ID NO: 197778 - DNA, 738 bp, Artificial Sequence
  Description of Artificial Sequence: Synthetic coding sequence
gtggaggaggagggcgacgtgagcaaccggggcgtggagctgctgcagcttgaacccgacgaagatcaggtgcgagccaggatcctaggctgcctgcaggagcccactaaatccagacccgaccagcccgcggcattcgggctgttatgtcgtatggccgaccagaccttcatcagcatcgtggattgggctagaaggtgcatggttttcaaggaactagaagttgctgaccaaatgaccttactccagaactgctggtccgagctgttggtcttcgatcacatttaccgacaagtgcagcacggtaaagaaggctcaatcctcttagttacaggtcaagaagtggagctgacaacggttgcaacacaggccgggtcactcctgcattctcttgtcctgcgtgcccaggagttggtgctccagttgctcgcgcttcagctagaccgacaagagtttgtctgtctgaaatttattatacttttctctctcgacctgaaattcctgaacaaccatattctcgtaaaggacgcacaagaaaaagcgaatgcagctcttttggattatacactgtgccattacccccattgcggcgacaaatttcaacagttactattgtgtctggtcgaagtgcgagcactgtccatgcaggccaaagagtacctttaccacaaacacttggggaatgagatgcctcggaataacctgctgatcgaaatgctgcaagccaagcagacctag

SEQ ID NO: 197779 - DNA, 1386 bp, Artificial Sequence
  Description of Artificial Sequence: Synthetic coding sequence
atggactacagctacgacgaggacctggacgagctgtgccccgtgtgcggagataaagtgagcgggtatcactacggactactgacctgtgaatcgtgcaaaggcttcttcaagagaaccgtccagaataacaagcactacacctgcactgagtctcagtcctgcaagatcgataaaactcagaggaaaagatgccctttttgtagattccagaagtgtttaacggtgggaatgaggttggaagcagtcagagctgaccggatgaggggtggaaggaacaaatttggcccgatgtacaagcgcgaccgtgctttaaaacagcaaaagaaagctcagatccgggccaatggatttaaattggaaacaggtcccccaatgggcgtgccccccccccccccccccgctcctgattacgtcctcccaccctcactgcatggtcctgagccaaaggggctcgcagctggaccccctgccggaccactcggagattttggcgcccccgcgctacccatggccgtgccaggtgctcacggtcctctggcgggctatctctatcctgctttcccgggccgcgccataaagagcgaataccccgagccttatgccagccccccacagccaggcttgccctacggttatcctgaaccattttcaggaggccccaatgtgcccgagttgattcttcaattgctccagctcgaacctgacgaagatcaggtgcgcgcacgcatactcggctgtttgcaggagcccacaaagagccgccccgatcaaccggctgcgttcggcttgctgtgccgcatggccgatcagactttcatcagcatcgtggactgggccagaagatgcatggtgttcaaggaattggaagtggctgaccagatgacccttctgcagaactgctggagtgaactgttggtattcgaccatatttaccgacaggtgcagcatggcaaggagggatccatacttctggtgacaggccaggaggtagagctaacaacagtggcaacgcaggctgggagtttgttacactccctggtgcttcgagcccaagagctagttctgcagctcctcgctctccagctggacaggcaggaatttgtatgcctaaagttcatcattctgttcagtctggatttaaagtttctgaacaaccacatcctggtgaaagacgcccaggaaaaggccaacgccgccctgttggattacaccctgtgtcactatccccattgtggagataagtttcaacaacttcttctgtgtctcgttgaggtgcgggctttgtccatgcaggccaaagagtacctctaccataaacatctcggcaacgaaatgccaagaaacaacctgctgatagaaatgctacaagccaaacagacctag

SEQ ID NO: 197780 - DNA, 537 bp, Artificial Sequence
  Description of Artificial Sequence: Synthetic coding sequence
atggactacagctacgacgaggacctggacgagctgtgccccgtgtgcggtgataaagtgtctggataccattatgggctgctgacttgtgaaagttgcaagggctttttcaagagaaccgtccagaacaataagcactatacttgcaccgagtcccagagctgtaaaatcgataaaacccagaggaaacgttgtcccttctgccgcttccagaaatgcctcaccgtcggcatgagattggaggcagtgagagccgaccggatgcgtgggggcagaaacaaattcgggcccatgtacaaacgagatagagctctaaaacagcagaagaaggcccagatacgtgctaacgggtttaagttagagacaggccccccgatgggggtgcctccacctccacctcccgcacccgactatgtgctgccaccctctctgcacgggccggaaccaaaaggtctcgcagctgggccccctgccgggcccttaggggacttcggcgcgcctgcactacctatggccgtgcccggggctcatggttag

SEQ ID NO: 197781 - DNA, 972 bp, Artificial Sequence
  Description of Artificial Sequence: Synthetic coding sequence
gacctggaggagctgtgccccgtgtgcggcgacaaggtgagcggctatcattacggactgttgacctgtgagtcctgcaaaggtttttttaagcggaccgtccagaataacaaacgctacacgtgcatcgagaaccagaactgccagatcgataaaacacaaaggaaaagatgtccgtattgtcggttccagaagtgcctgtccgtggggatgaaactggaggccgtgcgcgccgataggatgcggggtggacgcaacaagtttggtcccatgtacaagcgtgacagagctctgaagcaacagaaaaaagccctgatccgagctaacggcctgaagttggaagccatgtcccaggttattcaggcaatgccctctgatctcacaatatcctctgcgattcagaacattcacagtgccagcaaaggactcccacttaatcatgccgcccttccccccactgattacgacaggagtcccttcgtcacatcacctatctctatgaccatgcccccccacgggtcacttcagggttatcagacttatggacatttcccaagccgggccataaagtccgagtatcccgacccttatacgagctcccccgagagcataatgggttacagttatatggattcctaccagacctcttcccccgcttcaattccgcacctcattctcgagcttctgaagtgcgaacccgatgaaccgcaggttcaggccaagatcatggcctacctgcaacaggagcaggccaatagatcaaagcatgagaagctatcaactttcgggctgatgtgcaaaatggccgatcagacactgttttccatcgtggagtgggcccggtcaagcatttttttccgagagctaaaagggctgacactgtctcccagcctggagtgttcgggctcatggcttatggccacatccacttcttgcattcaggtcatccggctcccccagccgcccgagtag

SEQ ID NO: 197782 - DNA, 1488 bp, Artificial Sequence
  Description of Artificial Sequence: Synthetic coding sequence
atgagcagcaacagcgacaccggcgacctgcaggagagcctgaagcatggcctgacccccatagtcagccagttcaagatggtaaactatagctacgatgaagacctggaggagctctgtcctgtctgcggggataaggtcagtggatatcactatggactgcttacgtgtgagtcttgcaagggattcttcaagcggacagttcaaaacaacaaacggtatacctgcatcgagaatcaaaactgccaaatagataagacacagcggaagagatgtccttactgcaggtttcagaaatgtctctccgtggggatgaaactcgaagctgtacgcgctgacagaatgcgagggggaaggaacaagtttggtccaatgtataaaagagacagagctctgaagcagcaaaaaaaagcactgattcgcgccaatggcctgaagcttgaagccatgtctcaggtgattcaagctatgcctagcgatttaacaatctcgagcgctatccagaatattcattcagcgtccaagggcctccctctgaaccacgccgcactccctcctacggattacgataggtccccgttcgtcacttctcccatctcaatgacaatgcctccgcacggctccttgcagggctatcagacctacggacacttccctagtagggccattaagtctgagtaccccgacccctatacttccagcccggagtcgattatgggatacagctacatggactcttaccagacaagttcacctgccagtattccccatctcatattagaacttctaaaatgtgaaccggacgagcctcaagttcaggctaaaattatggcatatctgcagcaggaacaagcgaacaggtcaaagcacgagaagctcagtacctttgggcttatgtgcaagatggctgatcaaactcttttctccatcgtggagtgggccagatcaagcatttttttcagggaattgaaggtggatgatcagatgaaactcctgcagaattgctggagcgagctactgatcttggatcatatttatcgccaagtcgtgcatggaaaagagggcagtatatttttggtcacaggacaacaggtcgactacagcataatagccagtcaggctggcgctacactcaataatttgatgagtcacgcccaagagctggttgccaaactgcgctctctccagttcgaccagagagaatttgtgtgcttaaagtttctggtgctctttagtctggatgtcaaaaatctcgagaattttcagctcgtcgaaggcgtccaagaacaggtgaacgcggcccttctcgattacaccatgtgcaactatccccagcagaccgagaagttcggacagctcctgctccgcctccctgaaatccgtgctatttccatgcaggccgaggaatacctgtattacaagcacctgaatggtgacgtgccctacaacaatctactgattgaaatgctgcacgctaagagagcctag

SEQ ID NO: 197783 - DNA, 1134 bp, Artificial Sequence
  Description of Artificial Sequence: Synthetic coding sequence
tgagacctggaggagctgtgccccgtgtgcggcgacaaggtgagcggctaccactacgggctgctcacatgcgagtcgtgtaaagggttttttaagaggactgtgcagaacaacaaacggtatacatgcatcgagaatcaaaattgccaaattgacaagactcagaggaagcggtgcccttactgccggttccagaagtgcctctctgtcggcatgaagctggaggctgtgcgcgccgataggatgagagggggcagaaataagttcggtcccatgtataaaagggatagagctctaaaacaacaaaagaaggcgctgatcagggctaacggtcttaagctggaagctatgtcacaggtgatccaagcgatgccttccgacttaacgattagttccgctatccagaatatccactcagctagcaaaggcctgcccctgaaccacgccgcgctgccacctacagactatgaccgatcacctttcgtcacctcccccatttctatgaccatgccaccccacggatccctgcaagggtatcagacatacggtcatttcccatctcgtgctatcaaatctgaataccccgatccatatacttcctcccccgaaagcattatgggctactcatatatggattcctaccagaccagcagccctgcctccattccccacttgattttggagctgctcaagtgtgagccggacgaaccacaagtgcaagccaagatcatggcatatctgcagcaagagcaggctaatcgctcaaagcatgagaagctgtccaccttcggtctgatgtgcaagatggccgatcagactttgttctctatcgtcgagtgggcccgttcatctatcttctttcgagaactgaagggcctgaccctctccccttcgctcgagtgcagcggcactattctggctcatggcaatctccaccttctacattcgagtgactctccagccagtgcttcaagggtggctgggatcaccggggtgcaccataatactcacttaatttttgtctttttagtcgagatgggattctgccacgtgggccaggcagggctgaaaaccccagatctcagagttatctgcctgccacgcccaccaaaagtgctggggctttgggcttag

SEQ ID NO: 197784 - DNA, 1626 bp, Artificial Sequence
  Description of Artificial Sequence: Synthetic coding sequence
atgagcagcaacagcgacaccggcgacctgcaggagagcctgaagcacggccttactcctatcggtgcaggcctccctgatcggcacggatctcccatccccgctagaggcagattagttatgcttccgaaggtagagaccgaagctctagggttagctcggtcacacggagagcaagggcagatgcccgagaacatgcaggtgtcccaatttaagatggttaactacagttacgacgaggatttggaggagctgtgtcccgtgtgcggggacaaagtctctggataccactacggcctgttgacatgcgagtcctgtaaggggttttttaagcgtaccgtccagaataataagcgatatacgtgcatcgaaaatcagaattgtcaaatcgacaaaacccaacgcaagagatgtccttattgtagatttcagaaatgcctgtctgtgggaatgaagttggaggcagttagagcagatcgtatgcggggtgggaggaataaatttggacccatgtacaaaagagacagggcactgaagcagcaaaaaaaagcattgatacgagctaatggactcaagctggaagccatgtcgcaggtgatccaggccatgccctccgatctgacgatctcaagtgcaatccagaatatccattctgcatcaaaagggctacctctaaaccatgcggccctcccccctacagactatgataggtcaccgtttgtgacttccccgatctccatgacgatgccaccacacgggtctttgcaaggctaccagacttacggtcacttcccctcgcgcgcgattaagagtgagtacccagacccgtacacgagcagtccagagtcaattatggggtacagttacatggacagctaccagaccagctcgcccgccagtataccccatttaatcctcgaattgctcaagtgcgagcctgatgaaccacaggttcaggcgaaaattatggcctatctgcaacaagagcaagcgaatagaagcaagcacgagaagctgtccacctttggcttaatgtgtaagatggctgatcaaactctgttcagcattgtggaatgggccagatcatcaattttttttcgtgaactcaaggtggatgaccagatgaagttgctgcaaaactgctggtctgagctattgatcctggatcacatctacagacaagtagtacacggcaaggaaggatcgatattcctggtgacaggacagcaggtagactacagcataatcgccagccaagccggagccacactgaacaatctaatgagccacgctcaggaactcgtggctaaactgcggtctctccaattcgatcagagggaattcgtgtgtctgaagttcttggtgttgttttcccttgatgtcaaaaatctggaaaatttccagctggtggagggtgtgcaggagcaggtgaacgccgctctgttggactacactatgtgcaactaccctcagcagaccgagaaattcggccagctcctgctacgcttgccagagattcgtgctatatcaatgcaggctgaagagtacctgtattacaagcacctgaatggggacgtcccttataataacctacttatcgagatgttgcacgccaagcgggcctag

SEQ ID NO: 197785 - DNA, 216 bp, Artificial Sequence
  Description of Artificial Sequence: Synthetic coding sequence
tgaagcctgaagcacggcctgacccccatcgaccggggcaactgcaggtccgggtgcttcagttttgccgctacactgaggcaacggagcctgttaactagctgcgcaggcctccccgatagacatggtagccccatcccagccaggggaaggctggtaatgctgcctaaagtcgagaccgaagctttagggttggctcgctcacatggcgaatag

SEQ ID NO: 197786 - DNA, 66 bp, Artificial Sequence
  Description of Artificial Sequence: Synthetic coding sequence
atgagcagcaacagcgacaccggcgacctgcaggagagcctgaagcacggtctgacacctatctag

SEQ ID NO: 197787 - DNA, 249 bp, Artificial Sequence
  Description of Artificial Sequence: Synthetic coding sequence
atgagcagcaacagcgacaccggcgacctgcaggagagcctgaagcacggtcttactcccattgataggggaaattgccggagcggatgcttttcatttgctgccactctccgccagaggtcattactaactagctgcgccggcctcccagacagacatggctccccaattcctgcaagggggagactggtgatgctacctaaggtggaaactgaggcgttggggctcgcacgaagccatggcgagtag

SEQ ID NO: 197788 - DNA, 1410 bp, Artificial Sequence
  Description of Artificial Sequence: Synthetic coding sequence
atggtgaactacagctacgacgaggacctggaggagctgtgccccgtgtgcggagacaaggtgtctggctatcattatggtctgcttacctgcgagtcttgtaagggtttttttaagcggacagttcagaacaacaaacggtatacctgcattgagaaccagaattgtcagatcgataagacccagaggaagcgctgtccttattgtagattccagaaatgcctcagtgttggcatgaagctggaggccgttcgcgctgataggatgaggggaggccgcaataaatttgggccaatgtacaaaagagatagagccctcaagcaacagaaaaaggctctaatccgggcgaacggcctaaaactagaagccatgagccaagtgattcaagctatgcccagtgacttgacaatcagtagcgcgatccagaacatccattcagcctcaaaaggactgcccctgaatcacgctgctcttccaccaacagattatgacagaagtccttttgtgacctcacccataagtatgacaatgcccccccatgggagcttacagggttaccaaacttacggccacttcccctcacgtgcaatcaaaagtgaataccctgacccttacacgagcagtcccgagtcaataatgggttacagctacatggattcctaccagaccagctctccagcctcgatcccacaccttatcctcgaactgctgaaatgcgaaccagacgaaccacaggttcaggctaaaatcatggcataccttcagcaagaacaggctaatcggtcaaagcatgagaagctctctacctttggactgatgtgtaaaatggccgaccagacgttgttctccatagtggagtgggcgcgatccagcatcttcttcagggagctgaaggttgatgaccagatgaaactgcttcaaaactgttggagcgaactcctgatcctggatcatatatatcgccaggtggtgcatgggaaggagggctctattttcttggtgaccggtcagcaagtagattatagcatcattgctagccaggcaggggccactctgaataatctcatgagccacgcacaggaactcgtagctaaactgcgtagcttacagtttgaccagcgggagtttgtgtgtctcaagttcttggtgctgttctcccttgacgtgaagaatctggagaatttccagctcgttgagggagtccaggagcaggtaaatgctgccctgctggactatactatgtgtaactacccccaacaaacggaaaaattcggccagctcctcctgcggctgccagagatccgagctatctctatgcaggccgaggagtacctttattataaacatctaaatggcgatgtcccatataacaacctcctgatagaaatgctccacgccaagagagcttag

SEQ ID NO: 197789 - DNA, 681 bp, Artificial Sequence
  Description of Artificial Sequence: Synthetic coding sequence
atgctgctgcggctggtgagcaacagctggccccaggtgatcctgcctccacgcccacctaaagtgctggggttacaggctcctagacgagctagaaaaagagccgagggcacagcttcgagcaacgtttttagcatgttcgatcagagtcagatacaagaatttaaggaatctctcgccttgtctcctaggctcgaacggaacggtatgatcagtgcccattgcaatctatgtttgacaggatctagtaactctcccgcgtccgcttctcaggcattcaccattatggatcagaatcgcgatgggttcatcgataaggaggatttgagggacacgttcgccgctctgggcaggatcaatgtgaagaatgaggagctcgaggccatggtaaaagaggccccgggtccgatcaatttcaccgtgtttttaactatgttcggtgagaaactgaagggcaccgacccagaggagacaatacttcatgcttttaaagtctttgacaccgagggtaagggcttcgtgaaagctgatgtgatcaaagagaaacttatgacccaggccgatcggttcagtgaggaggaagtgaagcagatgtttgccgccttcccccctgacgtctgcggcaatctggactacagaaacttgtgttacgtcataacccacggtgaggaaaaggactag

SEQ ID NO: 197790 - DNA, 1569 bp, Artificial Sequence
  Description of Artificial Sequence: Synthetic coding sequence
atggaggagcacggcgtgacccagaccgagcacatggccaccatcgaagcccacgcggttgctcaacaggtccagcaagttcatgtggctacctataccgaacatagtatgttaagtgcagatgaagattctccctccagccccgaggacacatcttacgacgatagcgacatcttaaattcgaccgcagctgatgaggttaccgctcacctggctgccgccggtcccgttgggatggccgctgccgcggcggtagccacaggaaaaaagagaaagcgtcctcacgtgttcgagagtaatccttcgatcagaaagaggcagcaaacgaggctgctgcggaagctcagggctacactggacgaatatacaactagagtggggcagcaggcaattgtgctgtgcatttccccttctaagcccaatcccgtgttcaaagtattcggcgcagctcccttggaaaatgttgtcagaaaatataagtccatgattctcgaggacttggagtccgccttagcagagcatgccccggctcctcaggaagttaacagcgagctccccccactgactatcgacggaatacccgtgagcgttgacaaaatgactcaggctcagctgagggcctttattcccgaaatgttgaaatattctacaggtcggggaaagccgggctggggcaaagagtcatgcaaacccatttggtggccagaggatatcccctgggcaaatgttagaagcgatgtgagaacggaagaacaaaagcagagggtcagctggacccaggcactgcggactatcgtcaagaattgctacaagcagcatggtcgcgaagacttgctgtatgctttcgaggatcagcaaacccaaacgcaagctacagcaacacatagcattgcacaccttgttccgagtcagacagttgtgcagacattctctaatccagacgggacggtctccttgatccaggtcgggacgggggcgacagtcgctacgctcgctgatgcctccgagttgccgactaccgtgactgttgctcaggtgaactactctgcagtggcagatggagaagtcgagcagaattgggcgactctgcaaggaggcgaaatgactattcaaacaacccaagcgagcgaagccacccaggcagtggcatccctcgccgaagctgcagtggcagcaagccaggagatgcagcagggcgccactgtaaccatggcactcaactccgaggccgcagcacatgcagtagctaccttggccgaggcgactttacaaggtggaggtcagattgtacttagtggcgagacagctgccgctgtaggggccctaactggagtgcaggacgctaacggacttttcatggctgatagagctggccggaagtggatacttactgacaaggctaccggtttggtgcagattcctgtttcaatgtaccagactgtggttacaagtctagcacagggtaatgggccagtgcaggtggcaatggccccggtgactacaaggatcagtgactctgcggtgaccatggacggtcaagccgtggaggtagtaacattggaacagtag

SEQ ID NO: 197791 - DNA, 1314 bp, Artificial Sequence
  Description of Artificial Sequence: Synthetic coding sequence
atggaggagcacggcgtgacccagaccgagcacatggccaccatcgaagcccatgccgtggcccagcaggtccagcaggttcatgtggcaacatacaccgaacactctatgctcagtgctgacgaggacagccctagcagtcccgaggatacaagttatgacgatagcgatatcctgaatagtacagccgccgacgaagtgactgcccatctcgcagctgccgggcctgtggggatggccgcagctgccgctgtggctaccggcaagaagcgtaaacgacctcatgtgtttgagtccaatccttcaattcgtaaaaggcagcagacccgcttgctgaggaaactgcgcgctacattggacgagtatacaactcgcgtcgggcagcaggccattgttctgtgtatcagtccttccaaaccaaatccggtctttaaagtattcggggccgcgcctttggaaaatgtggtgcgtaagtataagagcatgattctcgaagatttagagtcagcccttgctgaacacgctcctgctccccaggaggtgaattccgagctgccaccactgaccatcgacggcatccccgtgtcagtggacaaaatgacacaggctcagctgcgtgccttcattcctgaaatgttaaaatatagtaccggccgcgggaagcctggttggggtaaggagtcttgcaagccaatctggtggcccgaggacataccatgggcaaatgttcgcagtgatgtccgcactgaggaacaaaaacagcgggtagggactggtgctacagtggccactttagccgatgcttctgagcttcctactaccgtgactgtggcccaggtaaactattccgccgttgctgacggcgaagtagagcagaactgggccactctccagggcggggagatgacaatacagacaacccaagcatccgaggccactcaggcggtcgcctccctcgcggaggcagccgtggctgcttcacaggaaatgcagcagggcgcaacagtcactatggcactgaactctgaagccgccgcccacgctgtggctacccttgctgaggccacgctgcaaggcggcggtcaaatcgtgttgagcggcgagactgctgccgccgtgggggccctgacaggtgtgcaggatgctaatgggctcgtgcagatcccggtgtctatgtatcagaccgtggtgacatcacttgcccaggggaacggtcccgtgcaggtcgccatggcgcccgttactacacggatctcagactccgctgttactatggacggccaggctgttgaggtggttaccctcgaacagtag

SEQ ID NO: 197792 - DNA, 1512 bp, Artificial Sequence
  Description of Artificial Sequence: Synthetic coding sequence
atggaggagcacggcgtgacccagaccgagcacatggccaccatcgaggcccatgctgtggcgcaacaggtgcagcaggtgcatgtggccacatataccgaacattcgatgctgtccgccgacgaggactctcccagctcacccgaggacacatcctatgatgactcagacattcttaattctacggccgcagatgaagtgacagctcatctggccgctgcaggtccagtgggaatggccgcagctgcagcagttgctacaggcaagaaacgtaagagaccccacgtgttcgagagtaacccatctataaggaaacgtcagcagacccgattgcttagaaagctccgcgccacactcgacgagtacactaccagagtcggccagcaggcgatagtcctgtgtatctcgcctagcaagcccaacccagtgtttaaggtgttcggagcggcccctctggagaacgtggtcaggaaatacaagagcatgattttggaagatctcgagtccgctctcgccgagcacgccccagctccacaagaggtgaacagcgagctgccccccctgactatcgatggtattccagtttctgtggataagatgactcaagcacagctcagggccttcattcctgagatgcttaaatactctacaggcaggggtaaacccggctggggcaaagaaagttgcaagccaatttggtggcccgaggacattccctgggccaatgtgaggtctgacgtccgcaccgaggagcagaagcaacgggtatcctggacacaagccctgaggaccatcgtgaagaattgctacaagcagcacggccgagaggatcttctttatgctttcgaagatcagcagacacagacccaggcaactgcaacacatagtatagcacacttggtcccgtcccagacggttgtgcagacctttagcaacccggacggaacagtctccctcattcaggtgggcaccggcgccactgtcgctacattagccgatgcttcggaactccccacgaccgtcactgtggcccaggtcaactactccgctgtggccgatggtgaagtggaacagaattgggcgaccttacaggggggggagatgaccattcagacaacccaagcttctgaagcgactcaagctgtggcttccctagcggaagccgccgtcgcggcatcacaggagatgcagcaaggtgcaacagtgacgatggccctgaacagtgaggctgcagcacacgcagttgcaaccctggctgaggctaccctgcagggcggaggacagattgtgttgagtggggagactgcagcagccgtgggggctcttaccggtgtgcaagatgctaacggactggtacagatacctgtaagcatgtaccagactgtggtcacaagcctggcacaaggtaatggtcctgtccaggtggctatggcacccgttacaactagaatcagtgacagcgcagtgacaatggatggccaggcagtcgaagtcgttactctcgaacagtag

SEQ ID NO: 197793 - DNA, 1569 bp, Artificial Sequence
  Description of Artificial Sequence: Synthetic coding sequence
atggaggagcacggcgtgacccagaccgagcacatggccaccatcgaagcgcatgccgtagcgcagcaggtgcagcaggtgcacgtagcaacttatacggagcatagcatgttatcagcagatgaggacagccctagctccccagaagacacttcatacgacgattccgacattcttaatagcacagctgccgatgaggttacagcccacctcgcggctgccggaccggtcgggatggctgccgcagccgccgtggctaccggaaaaaagcgcaagcgcccacacgtgttcgaatccaatccttcaatccgcaagcgacaacagactcgactcctgcgcaaactgagagcaacccttgatgagtacaccacgcgtgtcggccaacaggctattgtgctctgcatctcacccagtaagcccaacccagttttcaaagtgttcggggccgcacccttggagaacgtggtgaggaagtataaaagcatgatattagaggatctcgaatctgccctcgcggagcatgcccccgcacctcaggaagtgaactctgaactgcctccactcaccattgacggcatcccggtgagtgtggacaaaatgacacaggcgcagctgagggcattcattccagagatgttaaaatactctaccgggcgaggaaagccggggtgggggaaggagagctgcaaacctatctggtggcccgaggatatcccatgggccaatgtacggtccgacgtgcgcacagaagagcaaaaacagagagtgtcatggacgcaggctctccgtacgattgtgaagaactgctataaacagcacggtcgggaggatctgttgtacgcattcgaggaccagcaaactcagacacaggccaccgcaactcatagcatcgcacacctcgtgccaagccaaaccgtcgtgcagacattctccaaccccgacggcaccgtgtccctcatccaggtgggcaccggggccaccgtggccaccttggctgatgcttccgaactccccacgacagttacggtggcccaagtcaattacagcgccgtggccgacggagaagtggagcaaaattgggctacgctccaagggggcgagatgacaatacagaccacacaggccagtgaggctactcaggccgtggcctccctagccgaagcggcggtcgccgcttctcaggagatgcagcagggggcaacagtgaccatggcattgaacagcgaagctgccgcacacgctgttgcgacactggcagaggccactctgcagggggggggccagatagtgctgtcaggtgaaaccgcagccgctgtgggagcactgacaggggtgcaggacgccaatggcctgtttatggcagaccgagcaggcaggaagtggatacttactgataaggccactggcctggttcagattcctgttagtatgtaccagaccgtagtgaccagtctggctcagggcaatgggccagtgcaggtggctatggcgcctgtgaccactagaattagtgacagcgctgtcactatggacggccaggccgttgaggtggttaccctagagcagtag

SEQ ID NO: 197794 - DNA, 1512 bp, Artificial Sequence
  Description of Artificial Sequence: Synthetic coding sequence
atggaggagcacggcgtgacccagaccgagcacatggccaccatcgaggcccacgcagtcgcacagcaggtccagcaggtgcacgtcgctacctacactgaacactctatgctttctgccgatgaggacagtcccagctcaccagaggacacaagctatgatgattccgatatcctgaactcaactgcagccgatgaggtaaccgcacacctcgccgctgcaggcccagtgggaatggcagcagccgccgccgtggccaccgggaagaaaagaaagagaccccatgtcttcgagtctaacccaagtattaggaagcggcagcaaacccggctgctacggaagttgcgtgcaaccctggacgaatacaccactcgcgtggggcagcaggcaatcgtactctgcatttccccgagtaaaccgaatccagtgttcaaggtgttcggtgctgcacccttggagaatgttgtgcgaaagtataaaagcatgatcttagaggatttggagtcagccctagctgaacatgctccagctccacaagaagtgaactctgagctgccccccctcactattgacggcattcctgtgagtgtggacaagatgacacaggctcaattacgagcatttatccctgaaatgttaaagtatagcacggggcgcggaaagcccggttggggtaaagaatcatgtaagccgatctggtggcccgaagacataccttgggcaaatgttcgctccgacgttaggactgaggagcagaagcaaagggtgtcttggactcaagcattaaggaccattgtaaaaaattgttataaacagcacggtcgagaagatctgttatacgcatttgaagaccaacagactcagacgcaggcaaccgccacacactccatcgctcacttggtgccgtcccagactgtagtgcagaccttctccaaccctgacggaaccgtctccctcattcaggttggcacgggcgccactgtggccactctggccgacgcctctgagcttccaaccacagtcaccgtggcacaagtaaactactccgctgtggccgacggggaagtggaacaaaattgggctacacttcaaggcggcgagatgacgatccaaaccacccaggccagtgaggccacacaggccgttgctagtctggcagaggcggcagttgcagcgagccaagagatgcagcaaggcgccaccgtcacaatggcactgaattccgaagctgctgcacatgccgtagctaccctagccgaggccactttgcaggggggcggccaaatcgtgcttagcggagagacagccgccgcagtgggagcactgacaggagtccaggacgccaatggactggtccagatacctgtgagcatgtaccaaacggtggtcacatcccttgctcaggggaacggccccgtacaggtggcaatggctcccgtaactactcgcatcagcgattcagccgtgacaatggacggacaggccgtcgaggtggttactctggagcagtag

SEQ ID NO: 197795 - DNA, 633 bp, Artificial Sequence
  Description of Artificial Sequence: Synthetic coding sequence
atggaggagcacggcgtgacccagaccgagcacatggccaccatcgaggcccatgctgtagcgcagcaggtgcagcaggtccacgtcgctacttacactgagcactccatgctgagtgccgatgaggatagcccgtcgtctcccgaggacacgtcctatgatgactcagacatccttaactctaccgccgccgatgaggtgactgcccatttagctgcagccggccccgtggggatggccgcagctgccgccgttgccacgggcaaaaagcgtaagaggcctcatgtattcgagtctaatcctagcattagaaaaaggcaacagacgaggcttctgcgaaagctgcgcgctacgctagacgaatacacaactagagtgggacagcaggccatcgtgctctgcataagcccaagtaaaccaaatccagtgttcaaagtattcggcgctgcccctcttgaaaacgtcgtgcgcaagtataagtcaatgatcctggaggacctggagtcagccctggctgagcatgctcctgctccacaggaggtgaattcagagttacctcctttaactatcgatgggatccccgtgagcgtagacaagatgactcaggctcagctcagagcctttataccatag

SEQ ID NO: 197796 - DNA, 1029 bp, Artificial Sequence
  Description of Artificial Sequence: Synthetic coding sequence
atgatcctggaggacctggagagcgccctggccgagcacgcccccgcccctcaggaggtgaactctgagctgcctccactgactatcgatggcattcctgtcagtgtggacaagatgacccaagcacaacttcgcgcttttataccagagatgctgaaatactcgacaggccgaggtaagcccgggtggggtaaggagtcttgtaagcctatttggtggccagaggatataccttgggccaacgtgaggagcgacgtcagaacagaggagcagaagcaacgcgtttcatggacacaggcactcaggactattgttaagaattgttataaacagcacggaagagaagacctgctgtatgcctttgaggatcagcagacgcaaacacaggccacagcaacccactccatagcccacttggtccctagccaaacggtggtgcaaaccttctccaatccagacggtacagtgagtctgatccaggttgggaccggtgcaactgtagccaccctcgcggacgctagcgagttacccaccaccgtgaccgtggcacaggtcaactattccgccgtggcagacggagaagtggaacagaactgggctactttgcaaggcggtgagatgacaatccagaccactcaggcctctgaagcaacgcaggctgtcgcctcactggccgaggccgccgtggccgcgagccaggagatgcagcaaggtgcaactgtcaccatggccctcaactccgaagccgctgctcacgccgtggccacgctggctgaagcaacactgcagggcggcggtcaaatagtcctttcaggggagaccgccgctgccgtgggggcactgaccggagttcaagatgccaacgggctggttcaaatccctgtctctatgtatcagacggtcgtcacgtcgctggctcagggcaatgggcccgtccaggtggccatggcacctgtgactacgcgcatttctgatagtgcagtaaccatggacgggcaggcggttgaggtagtgaccctagaacagtag

SEQ ID NO: 197797 - DNA, 1860 bp, Artificial Sequence
  Description of Artificial Sequence: Synthetic coding sequence
atggccgacgagggcaagagctacagcgagcacgacgacgagcgggtcaactttcctcagcgaaaaaagaaaggccggggaccatttcgctggaaatatggggagggaaaccggcgctctggtagaggtggcagtgggattcgctccagccgactcgaggaggacgacggcgacgtggcaatgagcgacgctcaggatgggcctcgggtaagatataacccatacacaacacggcctaacagaaggggagacacctggcacgatcgggatcgaatccatgtgacagtcagacgggatagagctccgccggaaagaggcggggcgggtaccagccaggatggaacgagtaagaattggtttaaaattacaattccatatggccgcaagtatgacaaagcatggctgctgtcaatgattcagagtaagtgtagcgtgccttttacacccatagagtttcactacgaaaatacccgcgcccagtttttcgtggaagacgcatctacagcgtcagctctaaaagcagtgaattacaaaatcctggatagagagaatcggcgcatatccatcattattaacagctctgctccccctcatactattctgaacgagttgaagcctgaacaggtcgagcagcttaagctcataatgtctaagcgctatgatggaagccagcaagccctcgatttaaagggactccgaagtgacccagaccttgtggctcagaatatcgatgttgttctgaatcgccgatcttgcatggccgctacccttcgcatcattgaagaaaatattccggaattactgagtctgaatctctcaaacaaccgtctgtatcgtttggacgatatgagtagcatcgttcaaaaggcccctaacctcaagatacttaacctgtcgggaaatgaactaaaatccgaacgcgaattggataagatcaaaggtctgaagcttgaagaactttggttggatggcaattccctgtgcgacacgttccgcgatcagtccacgtacatctccgccatacgcgaacggttcccgaaacttctgaggctagatggccatgagctgccacctcccatagcttttgacgtggaagccccaacaacgctgccgccctgcaaagggagttactttggaaccgaaaacttgaagtctctggtgctccacttccttcagcagtactatgcaatctatgactctggagatcgccagggactcttagatgcataccatgacggagcttgctgctctctgtctatcccattcataccccagaatcctgcacgcagcagtctcgcagagtattttaaggattccaggaatgtgaagaagctgaaagaccccaccctccggttccggctattaaagcatacacgccttaacgttgttgccttcctcaatgaactccccaaaacccaacacgacgtgaactcatttgtcgtggacatctctgcccagacatcgacgctgttgtgcttttccgtgaacggggtgttcaaggaagtagatggtaaaagccgtgactcactgcgggcatttactagaacctttatcgctgttcccgcctcgaactcaggtctgtgcatcgttaatgacgaattatttgtccgcaatgcttcctctgaggaaatccagcgtgcttttgcgatgccggccccaaccccctccagttcacccgtcccgaccctttcccctgaacagcaggagatgctgcaggctttttccacacagtcgggaatgaacctagagtggtctcagaaatgtcttcaggataacaactgggactatactcgaagtgcccaagcatttacacatctgaaggcaaaaggagagattccagaggtcgcattcatgaaatag

SEQ ID NO: 197798 - DNA, 1071 bp, Artificial Sequence
  Description of Artificial Sequence: Synthetic coding sequence
atggccgacgagggcaagagctacagcgagcacgacgacgagcgggtcaactttccacaacgcaaaaaaaagggacggggtccattccggtggaagtacggcgaaggaaatcggcgttcagggagagggggctctggcatcaggtcgagcagactggaagaggacgacggtgatgttgccatgagcgatgcacaggatggaccccgtgtgcgatacaatccttacacgacgcgccctaacagacggggtgacacttggcatgatagagacaggatccatgtgactgtgagacgcgacagagcaccccctgagagaggtggcgctggaacctctcaggacgggacatctaagaattggtttaaaataactatcccgtacggccgtaagtatgacaaagcctggctcctgtcaatgatccagagcaaatgctccgtgcctttcactccaatcgagttccattacgagaacactagagcacagttctttgtggaggatgcctctacagccagcgccctcaaggccgtcaactataaaatccttgatcgagaaaatcgtcgtattagtatcattattaattcttccgctcctccacacacgatcctgaacgaactgaaaccggagcaagtcgaacagctgaaactgattatgagtaaaaggtatgatggcagccaacaagccctggacctgaagggtctgcggtccgaccctgatctggtagcccagaatattgatgtcgtgctgaaccgtaggagctgcatggcagccactctccgaatcattgaagagaacatccccgagctgttgagccttaacttgtctaataatcgcctgtatcgcctggatgatatgtcctctatcgtgcaaaaagcccccaacttgaaaatcctcaatttatcgggcaatgaactcaaatccgaaagagagctggataagattaaaggcctcaaactggaagaactctggctggacgggaacagcttgtgcgacactttcagagatcagagcacatatatccggagcgtcgtggcttgcgtttcacctccaggtgacctccaccccctgggaggttag

SEQ ID NO: 197799 - DNA, 1071 bp, Artificial Sequence
  Description of Artificial Sequence: Synthetic coding sequence
atggccgacgagggcaagagctacagcgagcacgacgacgagcgggtgaattttccacagcggaaaaagaagggaaggggcccatttcggtggaaatacggggagggcaacagacggtcgggacggggcgggtcgggtatccgcagcagcagactagaggaggacgatggcgacgtggcgatgagcgatgctcaggacggaccccgagttcgttacaatccttatactactaggcctaatcggcggggtgatacttggcatgaccgggatcgcatccacgttaccgtgcgcagggacagggctcctcccgaaagaggcggcgcaggtacttcacaggatgggacatctaagaactggttcaaaattacaataccgtatggtcgaaaatatgataaagcttggctgctgagcatgattcagtctaaatgcagcgtgcccttcacgccaatcgagttccactatgagaacaccagagcccaattttttgtggaagatgcaagtacagcctccgctctgaaagcagtgaactataagattttggaccgtgaaaataggagaatcagtatcatcattaactccagcgctcccccacatacgattctcaatgagttgaaaccagaacaggtggagcaactcaagctgataatgtctaaaagatacgatggcagccagcaagccctcgacttaaagggcctgagatctgacccagatctggtagctcagaatattgacgttgttctgaaccggagatcctgcatggccgcgaccttgaggatcatagaggagaacatccccgagctgttgtccctcaatttgtctaataaccgcctgtacaggcttgatgacatgtcatcaatcgtgcagaaggccccaaatctcaagatcctgaacctttctgggaacgagcttaagagtgaacgggagttggacaagatcaaaggtctcaaactggaggaactgtggctagatgggaacagcctgtgtgacactttccgggaccagtccacgtacatccgctcggtggtggcctgcgtttccccgcctggcgatcttcatccgctcggggggtag

SEQ ID NO: 197800 - DNA, 1860 bp, Artificial Sequence
  Description of Artificial Sequence: Synthetic coding sequence
atggccgacgagggcaagagctacagcgagcacgacgacgagcgggtaaactttccccagcggaagaagaagggacgcggtccattccgatggaaatatggggaggggaacaggaggtcaggtcgcggtggatcaggaattagatctagccgtctcgaggaagatgatggcgacgtggcaatgagcgatgcccaagacggcccgagggtgcgctataacccatacaccactcgcccaaatcgcaggggcgacacatggcatgaccgggataggattcatgttaccgtgcgccgggatagggcaccgcctgagcggggtggggctggaacctcccaggacggaacaagcaagaactggttcaaaatcaccattccttacggtagaaagtatgataaggcttggctcctcagtatgatccaatccaagtgcagcgtgcctttcactcctatcgaatttcattatgaaaacaccagagcccagttcttcgtggaggacgcgtcaactgccagcgcattaaaagcggtgaactacaaaattctggaccgtgaaaacagacgtatatccataattattaactcaagtgccccaccccataccatcttaaacgagcttaagccggagcaggtggaacagctgaagctaatcatgtctaaacgctacgatggaagccagcaggccctcgacctgaagggactgcgtagcgaccccgacctagtggcccagaatattgatgtcgtgctgaaccgcagaagttgcatggcggcaaccttacgtatcatagaagagaacatccccgagctactaagcttaaacctgagcaataaccggctgtaccgtctcgatgacatgtctagtattgtacaaaaggcgcctaatctaaagatactgaatttgtccggtaatgagttaaagagcgaaagagagctcgataagatcaagggcctgaagctcgaagaactctggctggacggaaattccttgtgcgacacttttagagatcagagcacgtacatttctgccattagagaaagattccccaagctgctgcggctcgacggacatgaactgcctcctcctatcgcctttgatgttgaggcacccacaaccttgccaccatgcaagggcagttactttggtactgagaacttgaagagcttggttttgcattttctgcaacagtattatgccatatacgacagtggcgataggcaagggcttttagacgcttaccacgacggggcatgttgctctttatccatccctttcatacctcagaatccagctaggtccagcctggccgagtacttcaaggactcgcggaacgtgaaaaagctgaaggaccctacgctccggttccgtttattaaagcatactagactgaacgtggtcgcatttctgaacgagttgcccaaaactcaacacgatgtgaacagcttcgtggtggacattagcgcacaaacctccactctgctgtgcttcagcgtaaacggtgttttcaaagaagtggacggcaaatctagagacagtctgcgcgcgtttactagaaccttcatcgctgtgcccgcgtccaatagtggcctgtgtatcgtgaacgacgagctcttcgttaggaatgcgagctctgaggagatacaacgggctttcgccatgcccgcccccaccccttcttcaagtcccgtaccgactctgtcgccagagcagcaggagatgctgcaagcctttagcacccagagcgggatgaacctagagtggtctcagaaatgtctccaggataacaattgggactataccagaagtgcacaagctttcacacacctcaaggccaagggggaaattcctgaagtcgccttcatgaaatag

SEQ ID NO: 197801 - DNA, 1881 bp, Artificial Sequence
  Description of Artificial Sequence: Synthetic coding sequence
atgtgcagcaccctgaagaagtgcggcacctaccggaccgaggtggctgaatgccacgaccacgggtcaacatttcaaggcaggaagaagggcgggagcagcttcagagacaacttcgacaagcgatcctgtcattacgagcacgggggttatgagagacccccctcccactgccaagagaacgacggttcagtggaaatgcgtgacgtccataaggatcagcagctgagacacacaccttactctatcagatgtgaaagaagaatgaaatggcactcagaggacgaaatccgaataaccacatggcgtaatcgcaaacctcccgaaagaaagatgagccagaatactcaggatgggtacaccagaaactggtttaaagtcacaatcccctacggtatcaagtatgataaggcttggttgatgaactccattcagagtcactgcagtgatagattcacccccgtggacttccattacgtgaggaatagagcttgtttctttgtgcaggacgctagcgcggcttctgccctgaaggacgtttcctacaagatatacgacgacgaaaaccagaaaatttgcatctttgtgaatcattccacagcgccgtattcagtgaagaataaactgaaaccgggacaaatggaaatgctgaagctgactatgaataagcgttacaatgtgtcacagcaggccctcgatttgcagaacctgagatttgacccagacttaatgggcagggatatagacatcattttgaacaggagaaactgcatggccgccacattgaagattattgaaagaaattttcccgaactgctgtctcttaacctctgcaataacaagctatatcagctggatggattaagtgacatcacggagaaggctcctaaggtgaaaactctcaacctatccaagaacaagctggagagcgcttgggagctgggcaaagtgaagggcttaaagctggaagaactgtggttggaaggcaaccctctgtgttctactttctccgatcagagcgcctacgtgagcgctattagagactgtttcccgaagctcttgagactggatgggagggagctgagcgcccctgtcatcgtggatattgatagctcggagaccatgaaaccatgtaaagaaaatttcacaggcagcgaaaccctgaaacatctggtattacagtttctgcagcagtactacagcatatatgattcaggcgatcgacaggggctgctcggcgcttatcatgatgaggcgtgcttcagtctggccatcccatttgaccccaaggactccgcccccagctctctctgtaaatacttcgaagactcacggaacatgaaaacactaaaggacccctacctgaaaggagagctcctgcgtcgtactaaacgggacatagtcgattcgctcagcgccctgcccaaaacacagcacgatctttcgtctatcctcgtcgacgtttggtgccagaccgagcggatgctgtgcttttctgtgaatggagtgtttaaggaggtcgaaggtcagagtcaaggcagcgttctagcctttaccaggaccttcatcgcaacaccaggatccagttcctccctctgcattgtcaacgatgagctctttgtgcgagatgctagcccccaggagacgcaatctgcattttccattcccgtgtcaactctctcaagtagttccgagcctagcctgagccaagaacaacaggaaatggtccaggccttctctgcccagtccgggatgaagctggagtggagccaaaaatgcctgcaggacaacgaatggaattataccagagctgggcaggcgtttaccatgctgcagacagaaggtaagattcctgccgaagcatttaaacaaatctcctag

SEQ ID NO: 197802 - DNA, 1881 bp, Artificial Sequence
  Description of Artificial Sequence: Synthetic coding sequence
atgtgcagcaccctgaagaagtgcggcacctaccggaccgaggtggccgagtgccatgaccacgggtcgacgttccaagggagaaagaagggaggttcgtccttcagggacaacttcgacaaacgatcttgtcattatgaacatggagggtatgagcggcccccatcccattgtcaggagaatgacggctctgtggaaatgcgagacgtgcataaagaccagcagttgcgacataccccctattccattcgttgtgagcgcaggatgaagtggcattctgaagacgaaatccgtataacaacttggagaaacagaaaacccccagagcgaaagatgagccaaaatacacaggacggttacacaaggaattggttcaaagtcaccatcccgtatggtatcaagtacgataaagcctggctgatgaactctatccagtctcattgcagcgatcgttttactccagtcgacttccactacgttcgaaatcgcgcgtgcttttttgtacaggacgcctccgcggcatctgccttaaaggacgtctcctacaagatctacgatgacgaaaatcagaagatctgtatttttgtgaaccactccaccgctccttatagtgtcaagaataagcttaaacccggtcaaatggagatgttgaagctcacgatgaataagcgctacaatgtgagccagcaggcactggacctgcagaacctgaggtttgaccctgacctcatggggcgggacatcgacataattctaaaccgaaggaattgtatggccgcgaccctgaagattatcgagagaaacttccccgagctactaagtctgaacctctgtaataataagctttaccaattggatggcctaagcgacataaccgagaaggcacccaaagtcaagactctgaacttatccaaaaacaaactggagtctgcctgggagctgggcaaggttaaaggattaaaactggaggagttatggctggaggggaatccactgtgcagcacatttagcgaccaaagtgcatatgtttcggcaattcgcgactgctttcccaagctcctacggctggatggtcgtgagctcagcgcccccgttatcgtggatatcgacagtagtgagacgatgaaaccgtgtaaggaaaatttcacgggctctgaaacattgaagcacttagtgctacagttcctgcagcagtactacagcatctacgattctggggatcgacaggggctccttggcgcttatcacgacgaggcatgttttagcctcgcaattccctttgaccctaaagacagcgcgccatcaagtctgtgtaagtacttcgaggatagtcgcaacatgaaaacgcttaaagacccttacctgaagggagagttgctccgtaggaccaagcgcgatattgtggatagcctttccgctttaccaaagacccagcacgatttatcttccatcctggtcgatgtgtggtgccagactgaacggatgctatgcttttcagtgaacggtgtcttcaaggaagtagaggggcagtcccaggggagcgtgcttgcgtttacccggacatttatcgccacaccgggctcctcatcatccttatgtatagtcaacgatgagctcttcgtgagggatgctagcccacaggagactcagtctgcattcagtatccctgtgtccacattgtcaagttcatctgaaccatctctgagccaggaacagcaggaaatggtgcaagctttctcagcacagagcggaatgaaactggagtggtcacagaaatgtctccaggataatgagtggaattacacaagggctggccaggcatttacaatgttacagactgaaggcaagattcccgccgaggctttcaagcaaatcagctag

SEQ ID NO: 197803 - DNA, 1881 bp, Artificial Sequence
  Description of Artificial Sequence: Synthetic coding sequence
atgtgcagcaccctgaagaagtgcggcacctaccggaccgaggtggccgagtgccacgaccatgggtctacgtttcaagggcggaaaaaaggaggatccagtttccgtgataatttcgacaagcgctcatgtcactacgagcacggaggctatgaaaggcccccatcgcattgccaggagaatgacgggtcagtcgaaatgagagacgtccacaaagatcagcaactccgacacacaccctattctattaggtgtgagcggagaatgaagtggcacagcgaagatgaaatccgtatcaccacctggcgtaacagaaagccaccggagcgaaagatgtcccagaacacacaggacggctatactaggaattggttcaaagtcacaatcccctatggtatcaagtacgataaggcctggctgatgaactcaatccaaagccactgctctgatcgctttactcccgtcgattttcattacgtccgcaaccgggcctgcttctttgttcaggatgctagcgctgccagtgctctgaaggacgtgtcttacaagatctacgatgatgagaaccaaaaaatttgcattttcgtcaatcacagcacagccccttattctgtgaagaacaagctcaaaccaggccaaatggaaatgctaaaattaacaatgaacaagcgctacaacgtgagtcagcaagccctggacctgcagaacctgcggtttgacccagatctgatgggtcgcgacattgatatcattctcaatcgaaggaattgcatggcagctacactgaagatcatcgaacgcaacttccctgagctgctgagcttgaacctctgtaataataagctgtatcagctggacggcttgtcggatataaccgaaaaggctcccaaggtcaaaaccctcaacctgagcaagaacaaactggagtccgcctgggaactgggtaaagtgaaggggcttaaactggaggaactgtggctggagggcaaccctctctgctcaacatttagtgaccagtcagcttacgtgagcgcgatcagagactgctttcccaaactgctgcgcctcgatggccgtgaactgtccgctccagtgatcgtcgacattgatagctccgaaacgatgaaaccgtgtaaagagaattttactggcagtgaaacactgaagcatctcgtgttgcagttcttacaacaatattattctatttacgattcaggcgatcgtcaaggcctccttggagcttatcacgacgaggcttgcttctccctagctatcccattcgatcccaaagatagtgcccctagcagtctgtgtaaatacttcgaagatagtcgcaacatgaaaacactgaaagacccctatctgaagggcgaactgttgcgacggactaaaagagatatcgtggactccctgagtgccctccccaagacccagcatgatctcagcagcatactcgtggacgtttggtgtcagactgagcggatgttgtgtttctctgtaaacggagttttcaaggaagtagagggacagtctcaaggctcggttctcgcatttacccgcaccttcatcgccacacccggatcttcttccagcctgtgcatagtcaatgatgagctcttcgtgcgcgatgcctccccccaagagacacagagcgctttcagcatcccagtgtctactctctcttctagttccgagccatctctgtcccaggaacagcaggagatggtgcaggctttctccgcccagagtggaatgaagcttgagtggtcccagaaatgtttgcaagataacgagtggaattatactcgcgcaggccaggctttcactatgctccagacagagggcaagatcccagccgaagcgtttaagcaaatttcctag

SEQ ID NO: 197804 - DNA, 1230 bp, Artificial Sequence
  Description of Artificial Sequence: Synthetic coding sequence
atgaagtggcacagcgaggacgagatccggatcaccacctggcggaacaggaagcccccagagagaaagatgtcacagaatacgcaggacggctacactcgcaattggtttaaagtcactataccttacgggataaagtatgataaagcatggctcatgaactctatccagtctcactgttccgataggttcacacccgtcgacttccactatgtgcgaaacagagcatgtttcttcgtgcaggacgcatcagcagcctcagccctaaaggatgtctcttacaaaatctacgatgatgagaaccagaagatttgcatttttgtgaaccatagcaccgcaccttactcagttaagaacaaattgaagcccggacagatggagatgctgaaattgaccatgaataaacgttacaacgtgagccagcaggctctcgatctgcaaaacttgaggtttgatccggaccttatggggagggatattgatattatcttgaacagacgcaactgcatggcagccacattgaagataattgagaggaattttcctgaactcctgtcgcttaacctctgtaacaataaactctaccaactggacggactctcagacattaccgagaaggctccaaaggttaagaccttaaatctcagcaagaataaactcgaatctgcttgggagctaggcaaggtgaagggtctcaaactagaagaactttggctggaggggaatcccctatgctcaacattttccgaccagagcgcatatgtgtctgctatcagagattgtttccctaagttactgagactggatggccgcgagttatcagcccctgtcatcgtggacatagactcctccgagaccatgaaaccatgtaaagaaaacttcacaggatctgagaccttgaagcacctagttcttcaatttttacagcaatactactctatctacgactcaggagatcgccagggattgttgggagcctaccatgacgaagcctgcttttcactcgccattccttttgaccccaaagattctgccccaagttctctatgcaagtacttcgaggattccagaaacatgaagaccctgaaagatccctacctcaaaggtgagttgttacgacgcaccaaacgtgacatcgtggatagcttatccgcgctgccgaagacgcagcacgacctcagcagtatattggtggacgtgtggtgccagactgtgccgagcgggcagtag

SEQ ID NO: 197805 - DNA, 1881 bp, Artificial Sequence
  Description of Artificial Sequence: Synthetic coding sequence
atgtgcagcaccctgaagaagtgcggcacctaccggaccgaggtggctgagtgtcatgatcacggttctacttttcaaggtcgcaagaagggggggagttcttttcgggataattttgacaagcggtcttgccattacgagcacggaggatacgagcgcccacctagccattgtcaggaaaacgatggcagcgtggagatgcgagacgtacataaggatcagcagctccgacatacaccatattctatccgatgcgagaggagaatgaaatggcatagcgaggatgagatcaggattactacatggcgcaataggaaaccaccagagcgcaaaatgagtcagaacacgcaagacgggtatacccgcaattggtttaaggtgacaataccttatggtatcaagtatgataaagcatggctgatgaactccatacagtcccattgttccgacaggtttaccccagttgacttccactatgttcggaacagggcgtgtttttttgtacaggatgcatctgccgccagcgccttgaaggatgtgtcctataaaatctatgatgatgagaaccagaaaatttgcatcttcgtaaatcacagcaccgccccgtattctgtgaagaacaaactcaagcccgggcaaatggagatgctgaaattaaccatgaacaaaagatataacgtgagccagcaagctttggatctccagaatctccgctttgaccccgacctgatgggccgggacatcgatattattctgaaccgcagaaattgtatggcagccacactgaagataattgagaggaatttcccagagctgctatctctgaacctgtgcaacaataaactctatcagctggatggcttatcagatatcactgaaaaggcccctaaagtgaagaccctgaatctgtctaagaataagctggagtcagcatgggagctgggcaaagtgaagggtctcaaacttgaagagctatggctggagggcaaccccctgtgcagtaccttttccgaccaaagcgcctatgtaagcgcaattcgagactgctttcccaagctgttacgtctggatggtcgcgagctgtcagccccagtaatcgtcgacatagatagttctgaaacaatgaaaccttgcaaagaaaactttacaggctccgaaacgctcaaacacctcgtactccagtttttgcagcaatactatagcatatacgacagtggagatagacagggtcttttaggagcttatcatgacgaagcctgtttcagtttggccatcccattcgaccctaaagacagtgccccctctagcctgtgtaaatacttcgaggactcccggaacatgaagactttaaaggatccttacctgaagggggagttgctgaggcgtacaaagcgcgacattgtggattctcttagcgcactgcctaagacacagcacgacctttcctctattctggtcgacgtgtggtgccaaaccgagcggatgctctgcttctctgtgaacggggtgtttaaggaggttgagggacagtcccaggggtctgtactagcattcaccagaacatttatcgccacccccggctcatcttcttccctatgtatcgtgaacgacgaactgttcgttcgggacgcttctccccaggagactcaaagtgcttttagcattcctgtatctactttgagttcttcctccgagcctagtctctctcaggagcagcaagaaatggttcaggctttctctgcccaatccggcatgaaactggaatggtcccaaaaatgtctgcaggataatgaatggaattacacacgcgctggacaggctttcacaatgttacaaaccgaaggcaagatcccggcagaagccttcaaacagatatcttag

SEQ ID NO: 197806 - DNA, 1596 bp, Artificial Sequence
  Description of Artificial Sequence: Synthetic coding sequence
atgagcctgcccagcggccacaccaccggccacaccgaccaggtggtgcaaaggagagcccgttgctgggacatctatcagagaaggttcagctctcggtctgaaccagtgaaccctggaatgcactccagttctcaccaacagcaggacggagatgctgctatgcatggagcccacatggacagccctgttcggtacaccccatacaccatttccccctacaatcgcaaaggatctttcaggaaacaggatcagacacacgtgaacatggagagggaacagaagccaccagagcgtcggatggaaggtaacatgccggatggaacccttggctcctggtttaaaatcactgttccattcggcatcaaatacaatgaaaagtggctgttgaatctgatccagaacgaatgctccgtgcctttcgtgcctgtcgagtttcattacgagaacatgcatgccagcttcttcgtcgagaatgcttctatcgcttatgcgctgaagaatgtgtccgggaaaatatgggacgaagacaacgaaaagatcagcatttttgttaaccccgccggcattccacattttgtgcatcgcgagctaaagtcagagaaggtggagcagattaaattagccatgaatcagcaatgtgacgtcagccaggaggcactggacattcagcggttgcccttttacccagacatggtgaatcgcgataccaaaatggcctctaatccgcgcaagtgcatggccgcttccttagatgtccacgaagagaacatacccaccgtgatgagcgcaggggagatggataaatggaaggggatcgagcccggcgagaagtgtgccgacagaagccccgtgtgtaccacgttctcggacacatcctccaacattaacagcattctggaacttttccccaaactgctgtgcctggacggccagcagtcacctagagccaccttgtgtggaacagaggcccacaagaggttgccaacatgcaaagggtcatttttcgggagtgaaatgctgaagaatcttgtcctgcagtttcttcagcagtattatctgatatatgacagtggcgatagacaaggacttctgtccgcttatcacgatgaagcctgcttcagcctctcaattccttttaaccctgaggacagtgccccttctagcttctgtaaattttttaaggactccagaaatatcaagattctcaaagatccttatctccgtggcgaactattgaaacatacaaaacttgacatcgtggactccctgtcagctctgcctaaaacacagcatgacctctcttccttcttagttgatatgtggtatcagaccgaatggatgctgtgtttttccgtgaatggtgtcttcaaggaagtggagggtcaatcccagggctcggttctagcatttaccagaaccttcatagcaactcccgggagtagtagcagcctctgcattgtgaatgataagctgttcgtcagagatacttcccaccagggtacgcaaagtgctctctttaccctggtgcctaccgcgtttagctcatcagtgccagcgtttagccaggagcagcaaaagatgctgccatcgtag

SEQ ID NO: 197807 - DNA, 702 bp, Artificial Sequence
  Description of Artificial Sequence: Synthetic coding sequence
atggagcgggagcagaagccccccgagcggcggatggagggcaacatgccagacggcaccttgggatcatggttcaaaatcacagttccatttgggataaagtataacgaaaaatggctgctgaatctcattcaaaacgaatgctccgtgcccttcgtacccgtggagtttcactacgagaacatgcacgccagcttctttgtggaaaacgcctcaatcgcctacgcactcaaaaacgtatccggtaaaatttgggacgaagacaatgagaagatttctatatttgtgaatcccgctggaatcccacactttgtacacagggagctgaaatcagaaaaggtagagcagattaaacttgccatgaaccagcagtgtgacgtgtcccaggaggccttggacattcagagactcccgttctatcccgacatggtgaatcgtgacacaaagatggctagcaacccgcgcaagtgcatggccgctagccttgacgtgcacgaggaaaatatcccgacagtgatgtcagcaggcgagatggacaagtggaaggggatcgagcctggtgaaaagtgtgccgatcgctccccagtctgcaccacattctcggataccagctctaatattaaatctgtggttccctccgttaccacctgggatcccgacctgtgcttgattgctcccttttgccggcggagacagcactag

SEQ ID NO: 197808 - DNA, 612 bp, Artificial Sequence
  Description of Artificial Sequence: Synthetic coding sequence
atggccagcagccaccccgagcagctgtacgtggtgctgaagcccaccaggggctaccagccagtcagatactatctgatctacgacagtggtgatagacagggcctgcttagcgcttaccacgatgaggcttgcttcagtctttccattcccttcaatcccgaagacagcgccccatccagtttctgcaagttcttcaaggattctcgcaatattaagatactcaaagatccctaccttcgaggcgagctgcttaagcataccaaactagatatcgtcgactctttgtctgctctgcccaaaactcagcatgacctgtcctcttttcttgtcgacatgtggtaccagacggaatggatgctgtgctttagcgttaatggcgtgtttaaagaagtcgaaggccagtcccagggatccgtgctcgcttttacccgcacattcatcgcaacccccgggtcaagctcctcattgtgcattgtgaacgataaactattcgtaagggacacctcacaccagggcactcagagtgccctgtttaccctcgtgcctaccgctttctcatccagcgtgcctgcattctcccaggaacaacaaaagatgctaccaagctag

SEQ ID NO: 197809 - DNA, 1086 bp, Artificial Sequence
  Description of Artificial Sequence: Synthetic coding sequence
tgaaacgagaagtggctgctgaacctgatccagaacgagtgcagcgtcccatttgtgccagtggaatttcactacgagaatatgcatgctagcttctttgttgaaaatgcatctatcgcttatgcccttaaaaacgtgtctggcaaaatttgggatgaagacaatgagaagatttctatcttcgtgaatccggccgggataccccacttcgtgcaccgcgagctcaagtccgaaaaagtggaacagatcaagctagccatgaatcagcaatgtgacgtgagccaggaagcgctcgatatccagcgcctgcctttctacccagacatggtgaatcgcgacaccaagatggcttcaaatcctcggaaatgcatggctgcaagccttgatgtccatgaagagaacattcctacagtgatgagtgcgggtgaaatggataagtggaaagggatcgaacctggcgaaaagtgcgccgatcggtctcccgtttgtactaccttttccgatacttctagcaatataaattctattctagaactctttcccaagctgctgtgcttggacgggcaacaatccccccgagccacattgtgcggaacggaggctcacaaacggctgccaacgtgcaaagggtcgttctttggatcagaaatgctgaaaaatcttgtcctccagtttttacagcaatattacctcatctatgattctggtgatagacagggtctactgtcagcctaccatgacgaggcgtgcttttccttgtcaattccatttaaccctgaggattcagctccgagcagcttttgcaagtttttcaaagatagtcgtaacatcaaaatcctcaaagatccctacttgcgcggtgagttgttgaagcacactaaacttgacatcgtcgatagcctgtccgcactcccaaagacccagcatgatttatcttctttcctggtggacatgtggtaccagactgaatggatgttgtgctttagcgtgaatggtgtattcaaggaagtatctgggttctgttccagactgcacccggacttacactgttatccctggcagcagttccagtctgtgcatcgctag

SEQ ID NO: 197810 - DNA, 1194 bp, Artificial Sequence
  Description of Artificial Sequence: Synthetic coding sequence
atgcggcggaacacccaggacgagaacatgcggaagtggttcaaggtaacaatcccgtatggcattaagtacgacaaagcatggctcatgaactccatacagtccaattgctccgtccctttcacccccgtcgacttccactacatccggaatcgcgcctgcttctttgtccaggtggcgagtgcagcttcagcactgaaggacgtgtcatacaagatctacgacgacgagaaccaaaagatctgtatctttgtcagtcatttcactgccccttattctgtaaagaacaagttgaaaccaggccagatggagatgcttaaattaaccatgaacaaaaggtataatgtgagccagcaagcattagatctccagaaccttaggttcgaccctgacctgatggggcgagacattgacataatcctgaaccgccggaactgcatggccgctaccctgaagatcactgaacgaaatttcccagaattgctgtccctgaacctttgcaacaacaagctgtaccagcttgatggtttgagcgatataacagagaaagcccccaaggtcaaaacgctgaatctctcaaagaacaagctcgagagcgcatgggagctcggaaaggtgaaagggctgaaactcgaggaactgtggctggaaggcaatcccttgtgtagtacattctcagaccaatcggcgtacgtgagcgccatccgggattgctttccaaagcttctaagactggatgggcgtgagcttagcgcccctgtgatagtggacattgacagcagcgaaacgatgaagccgtgtaaagagaatttcaccggcagcgagaccctcaaacatctcgttctccagttcctccagcagagtaacctctgcaaatactttaaagatagccgcaatattaaaatcctcaaggatccctatctgcagcgaaagctcctcaagcatactaagtgccccagaaatgtggattccctgtccgcattaccagagacacagcatgactttacatcaatccttgtggatatgtggtaccagacagtgaatacatgtttcctaccccgcgccggaccagagagccaaagatggtggtgcttgctatcactgaaatggaaagatggacttagagtgctcattttgccttcctgtggaccttcctccctgcccctcgcagcaatacccgtttgtgcctcctag

SEQ ID NO: 197811 - DNA, 1194 bp, Artificial Sequence
  Description of Artificial Sequence: Synthetic coding sequence
atgcggcggaacacccaggacgagaacatgcggaagtggttcaaggtcaccatcccatatggcattaagtacgacaaggcctggctcatgaactcaattcaatctaactgtagcgttccattcactcccgtggactttcactacatccgaaaccgggcttgttttttcgttcaagtcgcctccgctgcttccgcactgaaggatgtaagttataagatctatgatgatgaaaaccaaaaaatttgtatctttgttagccattttaccgctccatattctgtaaagaataagcttaagcctggccagatggaaatgttaaagctgactatgaataagcggtacaatgtctcccagcaagcactcgatttgcagaacctgaggtttgacccagaccttatggggagggatatagacatcattttaaataggcggaactgcatggctgctactctgaaaatcactgaacgtaacttcccagagctattgagtctcaacctgtgcaacaataagctgtatcagttggatggcctgagtgacattacggagaaagcgccaaaggtgaaaacactgaatctctccaaaaataagcttgaaagtgcctgggagcttggaaaggttaaaggccttaagctggaggagctgtggctggagggcaaccccctctgtagcacttttagtgaccaaagtgcttacgtgtcagccattagagactgctttcccaagctgctcaggctggacggtcgcgagctttccgcaccagtgattgtggatatcgactcttcggagacaatgaagccgtgtaaggaaaacttcacggggtcggagacgctcaaacatcttgtccttcagtttctccagcagagtaatctgtgcaagtatttcaaagactcgcgtaacataaaaattctcaaagatccttacttacagaggaagctgttaaagcacactaaatgtcctcgtaatgtagactcattgtctgctctgcccgaaactcagcatgactttacaagcatcctagtggacatgtggtatcagacggtaaacacttgtttcctgccgagggccgggccagagagccagaggtggtggtgtcttttgtccctgaagtggaaggacggcctccgagtgctgatcctcccctcctgtggcccctcgtctttaccactggcagccattcctgtttgcgcttcttag

SEQ ID NO: 197812 - DNA, 1098 bp, Artificial Sequence
  Description of Artificial Sequence: Synthetic coding sequence
atgcggcggaacacccaggacgagaacatgcggaagtggttcaaggttaccattccttacgggattaaatacgacaaggcttggctcatgaactctatccagagcaattgcagtgtcccatttacacccgtagacttccactacattagaaatagggcctgcttctttgtccaagtcgcctccgccgcctctgcgctgaaagatgtgtcctacaagatctacgacgacgagaatcagaaaatttgcatctttgtcagtcactttactgcaccgtactctgtgaagaacaagctgaagccaggccagatggagatgctcaagctgactatgaacaagcggtacaatgtgtcccagcaagctttggacctccagaacctgcgcttcgaccccgaccttatgggacgagacatcgatatcatattgaaccgccgaaactgcatggctgccactcttaagatcactgaacgtaacttccccgaactgctcagtctcaatctgtgtaacaataaactttatcagcttgacgggctgtcggatattacagagaaggcaccaaaggtgaaaaccttgaatctcagcaaaaataagctggaaagcgcctgggagctgggcaaagtaaaaggactcaaactggaggaactttggctggaaggaaatcctctgtgttctacattctccgaccagagtgcctacgtctctgctatccgggattgttttcctaaactgctgcgactggatggtagggaactcagtgctcccgtcattgtggacatcgatagcagtgaaaccatgaagccgtgcaaagagaatttcaccggatcagagacattgaaacaccttgtgctccagttcttacagcagtccaacctgtgtaaatattttaaggacagccgcaacattaaaattctgaaggacccttacctgcagcggaagttgctgaagcacaccaagtgtcccagaaacgtggattccctgtcagccctgccagagacacaacacgacttcactagtattctggtagacatgtggtatcagacagttaacacttgtttcttacctcgggccggtcctgaatcccagtctctccgacccctctag

SEQ ID NO: 197813 - DNA, 1098 bp, Artificial Sequence
  Description of Artificial Sequence: Synthetic coding sequence
atgcggcggaacacccaggacgagaacatgcggaagtggttcaaggtgaccattccctatggcattaaatacgataaggcatggcttatgaacagtattcaaagtaattgttcagttcctttcacaccagtggattttcactacattcgcaacagagcctgcttttttgtccaggtggcctctgctgctagcgcactgaaggatgtcagttacaagatctacgacgatgaaaaccagaaaatctgcattttcgtgtcccacttcacagccccatattccgtgaagaacaagctaaagcctggccagatggagatgctcaaactcactatgaacaagcgatataatgtgagccagcaggcccttgatcttcaaaatctgcgattcgacccagaccttatgggtagagacattgatatcattctcaacaggcgtaactgcatggcagcgaccctcaaaatcaccgagagaaattttccagagttgctctctttgaatctatgcaacaataagctgtaccagcttgacggacttagcgacattacggagaaagccccaaaagtcaaaaccctgaatctgagcaaaaataagttggagtccgcatgggaactcgggaaagtgaaaggactgaaattagaggaactgtggctggaggggaaccccttgtgcagtacgttctcggatcaatcggcatatgtctcagccattagggattgctttccaaagctccttcggctggacggccgggaactgtctgcacccgttattgttgacatcgacagttcagaaaccatgaaaccttgcaaggagaactttactgggtctgagacactgaaacatctcgtcctgcaattcctgcagcagtccaatctctgcaagtactttaaggactcccggaatattaagatcttgaaagacccttacctccagcggaagttgttaaaacatacaaaatgtccacgtaacgtcgactctttgtctgcactccctgagacacaacatgattttacatcaatcttggtggacatgtggtatcagaccgttaacacctgctttctgcctagggcagggcccgaaagccagagcctgagacctctgtag

SEQ ID NO: 197814 - DNA, 1044 bp, Artificial Sequence
  Description of Artificial Sequence: Synthetic coding sequence
atggagcagtacaccgccaacagcaacagcagcaccgagcagatcgtagtgcaggccggtcagattcagcagcaacagcaagggggagtaaccgcggttcagttgcaaaccgaggctcaggtggcttccgcctcagggcagcaggtgcaaaccctccaggtagttcaggggcagccattaatggtccaggtctctggtggacagctgataacatccacagggcagcccataatggttcaggccgttcccggcgggcagggtcagaccatcatgcaggtgcccgtgagcggaactcaggggctgcagcaaattcagctggtgccgcctggtcagatacagattcagggaggccaggccgtgcaggtgcaagggcagcagggtcagacacagcagataataatacagcagccacaaacggcagtaacggccggacagacacagactcagcagcagatcgctgtacaaggccagcaggtcgcccagaccgctgaagggcaaacaatcgtttaccaacctgttaatgccgatggcacaatactacagcaagtgacggttccagtctccggaatgatcaccattcccgcagcttctctggccggcgctcaaatagtgcaaactggcgccaacaccaacacgacaagtagcgggcaggggacagtgacggtgacacttcctgtggcaggcaatgtcgtgaatagcggaggaatggttatgatggtgcccggagctggctccgttcccgccatccagaggataccactgcccggcgccgagatgctggaggaggaacccttgtatgtgaatgccaaacagtaccataggatcctgaagcggcgacaggctcgggccaaactggaagcagaaggcaagatacccaaagagcgccggaaatacctccacgagtcacggcacaggcatgctatggctcggaaaaggggcgagggggggagatttttttcccccaaagagaaggacagtccgcacatgcaagatccaaatcaagcagatgaggaagccatgacccagattatacgagtgtcttag

SEQ ID NO: 197815 - DNA, 957 bp, Artificial Sequence
  Description of Artificial Sequence: Synthetic coding sequence
atggagcagtacaccgccaacagcaacagcagcaccgagcagatcgtcgtgcaggcagggcagatccagcagcaggttcaagggcagcccctgatggtacaggtctccggaggtcagctgattacatcgacgggccaacctatcatggtccaggctgttccaggcggtcagggacaaaccatcatgcaggtgcctgtatccgggacccaggggcttcagcaaatacagctggtacccccaggtcagattcagatccaaggcggccaagccgtccaggtccaggggcaacaggggcagacacagcagattattatccaacagccccaaaccgccgtgacagctgggcaaacacagacccagcaacagattgccgtccagggacagcaggtggctcaaaccgctgaaggacaaactatcgtctatcagcccgttaatgccgacgggactattctccagcaagtgacagttcctgtgtccgggatgattaccattcctgccgcgtcgctcgccggcgctcagattgtgcagacgggggccaatactaacactacttcctctgggcagggcactgttaccgtcacactgccagtggccggaaacgtcgtgaattctgggggcatggtcatgatggtcccaggcgcaggcagcgtgcccgctatccaacgcatccctcttcccggagccgaaatgctggaggaggagcccctttacgtcaacgcaaaacagtaccataggatcctcaagagacgccaagctcgggccaaactcgaagcggaaggcaaaattccaaaggagcgccgcaaatatctgcacgagagtaggcacaggcacgctatggctaggaaacgcggagaaggggggagattcttctcaccaaaggaaaaggatagcccccacatgcaggatcctaatcaagccgatgaggaggctatgactcaaattatcagagtgagctag

SEQ ID NO: 197816 - DNA, 624 bp, Artificial Sequence
  Description of Artificial Sequence: Synthetic coding sequence
atgaccatggacggcgacagcagcaccaccgacgccagccagctgggcattagcgcggactatatcggaggctcgcactatgtcattcagcctcacgatgatactgaagatagcatgaacgaccatgaagataccaacggctcaaaagaatccttccgcgagcaagacatttatcttcctatcgctaatgttgcgaggattatgaaaaatgccataccacagacaggaaaaatagccaaggatgcaaaagagtgcgtccaggagtgcgtctccgagtttatcagtttcatcacctctgaagcttccgagcggtgtcaccaggaaaagcgaaagacaattaacggggaggacatcctcttcgcaatgagcacactgggctttgattcttatgtggagcctctgaaattgtatctgcaaaagttcagagaagccatgaagggggaaaagggcatcgggggcgccgtcacagccacagacgggctgtccgaggaactcactgaagaggctttcaccaatcaattgcctgccgggctgatcactactgatggccagcagcagaacgtcatggtctacactaccagctatcaacagatctcgggcgttcagcagatacagttctcctag

SEQ ID NO: 197817 - DNA, 624 bp, Artificial Sequence
  Description of Artificial Sequence: Synthetic coding sequence
atgaccatggacggcgacagcagcaccaccgacgccagccagctgggaatttcggctgactacataggcggtagccactatgtgattcagcctcacgacgacaccgaggactcaatgaacgaccacgaagacacaaatggatccaaagaatcatttcgagaacaggacatctacttgccgatcgcgaatgtagcccgtattatgaagaatgccataccgcagactggtaagatcgctaaggacgcaaaagagtgtgttcaggaatgtgtatccgaatttataagctttattacgtctgaggcttccgagcgctgtcaccaggaaaaaaggaaaaccattaacggagaggacatcctcttcgcaatgtctactttagggtttgatagctatgtagagcctcttaaactatatttacagaagtttagagaagccatgaagggagagaagggcattggcggtgctgtgaccgctactgacggtctgtcggaggagctcacggaggaggcctttactaaccaattgcctgctggactcatcacaactgacggtcagcagcaaaacgtgatggtgtatacgacttcttaccagcagataagcggagttcagcagatccagttcagctag

SEQ ID NO: 197818 - DNA, 1377 bp, Artificial Sequence
  Description of Artificial Sequence: Synthetic coding sequence
atgagcaccgagggcggcttcggcggcaccagcagcagcgacgcccagcagtctcttcagagcttctggcctcgggtgatggaagaaatcagaaacttaactgtaaaggactttagggtccaggaactgcccctggctaggattaaaaaaattatgaagctggacgaggatgtgaaaatgatatccgccgaggcgcccgtgctttttgcaaaagctgcccagatattcattaccgagctgacacttagagcgtggattcacaccgaggacaacaagcgacgaaccctgcagagaaacgacattgctatggctattacaaaattcgatcaatttgactttctcatcgacatcgttccccgagacgagctgaaaccccctaagagacaggaagaggtccgtcagtccgtcacccccgccgagcctgtgcagtattattttacattagcccagcagccgacggcagtgcaagtccagggccaacagcaaggccaacagaccacttcctccaccaccactatccagccagggcagataatcatcgcgcagccacagcagggacaaacaactcctgtgaccatgcaggtgggggagggacagcaggtgcagatcgtccaggcacagcctcaaggccaggcacagcaggcacaatctggcacagggcagactatgcaggttatgcagcaaatcatcacaaacacgggcgagatccagcaaatccccgtccagctcaacgccgggcaactccagtacattagattggctcagcccgtgagcgggacacaggtggtacagggccagatacaaaccctcgcgacgaacgcacagcagggtcaacgcaatgcttcccagggaaaacctcgtcgctgcctcaaggaaacgctgcaaatcacacagactgaagtgcagcagggacaacagcagttcagccaattcaccgatgggcagcgaaatagcgtgcagcaggcccgagtgagtgagctcacaggtgaagccgaacccagggaagtcaaagctacagggaacagtaccccatgtaccagcagtctgccaaccacccatcccccatcacatagggctggggcttcctgtgtgtgttgctcccagccacagcagagttcaacctccccacccccatcagacgccctacagtgggtggtggtagaagtttctgggactccaaatcagctcgagactcacagggagctgcacgcccctctgcctggtatgaccagtctgtctccactccaccccagtcagcaactctaccaaattcagcaggtcacgatgcctgctgggcaggatctggcccagccaatgttcattcagagcgcgaaccagccttcagacggacaggcccctcaggttacaggggactag

SEQ ID NO: 197819 - DNA, 1008 bp, Artificial Sequence
  Description of Artificial Sequence: Synthetic coding sequence
atgagcaccgagggcggcttcggcggcaccagcagcagcgacgcccagcaatcactacagtcattttggccccgggtgatggaggagattaggaaccttactgtgaaagacttccgggttcaggaacttccgctggccaggatcaagaaaataatgaaattggatgaggacgtaaagatgatctctgcggaagcccctgtgctgtttgccaaggctgcacagatcttcataacggagctcactctgcgcgcctggatccacaccgaggataataagcggcgaaccctgcaaaggaacgacatagctatggcaataaccaaatttgatcagttcgatttcttgatcgatatcgtgcctcgggacgagcttaagccgccaaagcggcaagaggaagtaaggcaatccgtgacgcctgcagagcctgtgcaatattactttaccctggctcagcagcccacagcagtacaggtacagggccagcagcagggccagcagaccacatccagcaccacgaccattcaaccaggccagataattatcgcccaacctcagcaaggtcagactacccctgtaaccatgcaagtcggagagggccaacaagtgcagatagtccaggcacagccacaggggcaggcgcaacaggcacaatcaggtactgggcagacaatgcaggtcatgcaacagattatcaccaacaccggcgaaatacagcagatccccgtgcagctaaacgccggccagctccagtatatccgactcgctcagcccgtgagtggcacccaggtcgtgcagggtcagatccaaaccctggccactaatgctcagcagatcacccaaactgaggttcaacagggtcagcaacaattctctcagttcacggacgggcaacaactgtatcagattcagcaggtcactatgccagccggccaagacctcgctcagcctatgtttatacagtccgccaaccagccttccgatgggcaagcaccgcaggtgaccggtgattag

SEQ ID NO: 197820 - DNA, 1320 bp, Artificial Sequence
  Description of Artificial Sequence: Synthetic coding sequence
atgagcaccgagggcggcttcggcggcaccagcagcagcgacgcccagcagagcctccagagtttctggccccgggtcatggaggaaatcaggaaccttactgtgaaggactttcgggttcaggaactacccctcgccaggatcaagaagataatgaaactggatgaggatgtgaagatgatctcagccgaggcccccgtcctgttcgcaaaagccgcccagatcttcatcaccgagttgaccctgagagcctggatccataccgaagacaataagagacgcacactccagcgcaatgacatcgccatggctattactaaatttgaccaatttgatttcctgatcgacatcgtaccgcgtgacgaactgaagccccctaaacggcaggaggaggtccggcaatcggtcaccccagccgaacccgtgcagtactatttcacgctggctcaacagcccaccgctgtccaggttcaggggcagcaacagggacagcagaccacgtcttccacaacaaccatccaaccaggtcagattatcattgcccaaccccagcagggccaaactacaccggtgacaatgcaggtgggcgagggacagcaagtgcaaatcgtgcaggcccaaccacagggccaagcccagcaggcacagtcaggcaccggccaaacaatgcaagtgatgcagcaaataattaccaatactggggaaattcagcaaattcctgtccaacttaatgccggccagttgcagtacattcgcttggctcaacccgtatccggtacacaggtggtgcagggccagatacagacattggccacaaatgcacaacagatcacccagacggaggtgcaacaaggccagcagcagtttagccagtttaccgacggacagcgcaactctgtccaacaagcacgagtctctgaattgaccggggaagctgaaccacgggaagtcaaagctaccggaaacagcactccttgcacatcctcccttcccactacacaccccccctcccaccgagctggggcttcttgtgtgtgctgcagccaaccccagcagtcctccacctcaccgccacccagcgatgcgttgcagtgggttgtggtggaagtatctggcaccccaaaccagttagagacacacagagagctccacgcacccctaccgggcatgacgagcttgtcgccgctgcacccttctcagcagctttaccagatccagcaggtgacgatgcccgccgggcaggacctggcccaacctatgttcatacagagcgcaaatcagccctccgatgggcaagctccgcaagtgactggagactag

SEQ ID NO: 197821 - DNA, 906 bp, Artificial Sequence
  Description of Artificial Sequence: Synthetic coding sequence
atgagcaccgagggcggcttcggcggcaccagcagcagcgacgcccagcaatcactccagtcattctggcctcgggtgatggaagagattcgaaatttgactgtcaaggatttccgggtgcaggagctgccactcgcccggattaaaaagataatgaagttggatgaggatgtgaaaatgatatctgccgaagctcccgtgctgtttgccaaagccgcccaaatttttatcaccgagctcacattgagggcatggatccacactgaagataataaacggcggaccctccaacgaaacgacattgcgatggctatcacaaaattcgatcagtttgacttcctgattgatatcgtgccacgggacgaattaaaaccgccaaagcggcaggaggaagtgagacagagtgtgacccctgcagagcctgttcagtactacttcactctggcacagcagccgactgccgtacaggttcagggtcagcaacagggccaacagactaccagttcgacaactactatccagcctggccagatcatcattgcccaacctcagcagggacagacaatgcaggtgatgcagcagattattaccaatacgggtgagattcagcaaatcccagtacaactgaacgccggacaactgcagtacatacgccttgcgcaaccagtgtccggcacccaggttgtgcagggtcagattcagaccttggcaacaaacgcacagcagattacccaaactgaagtacaacagggccagcagcaattttcccagtttaccgacggccagcagttgtaccagattcaacaggtgacaatgcccgctgggcaagatttggcccagcccatgttcatacagagcgccaaccagcctagtgatggtcaggcgccccaggtgacaggtgattag

SEQ ID NO: 197822 - DNA, 1008 bp, Artificial Sequence
  Description of Artificial Sequence: Synthetic coding sequence
atgagcaccgagggcggcttcggcggcaccagcagcagcgacgcccaacagtctttacagagtttctggccacgcgtgatggaggagataaggaacctaacagttaaagatttcagggtacaggagttgccacttgcgaggatcaagaagattatgaagctcgatgaggatgtcaagatgattagcgcagaggccccggtcctgtttgccaaagcagcccagatcttcatcaccgaactgacccttagagcctggatccatactgaagacaataagcgcagaactcttcaaagaaatgatatcgcaatggcaattactaagttcgaccagttcgattttttgattgacattgttcctcgagacgagctgaaaccacctaaaaggcaggaggaggtgaggcagagcgtcaccccggccgagcccgtccagtactattttaccctggcccagcagcctactgctgttcaggtgcagggccagcagcagggccaacagacgacgtcatccactacaaccatccagccgggtcagatcattattgcccagccacagcagggtcagacgactcctgtgaccatgcaggtcggggagggccagcaggtgcagattgtgcaggctcagccacaaggccaggcacaacaggcacaatccgggaccggtcaaacaatgcaggttatgcaacagatcatcaccaacaccggcgaaatccagcagatccccgttcaactcaacgccggacaacttcaatacatacgtctcgctcagcccgtcagcggcacgcaggtggtgcagggacagatccagaccctcgcaaccaacgcacagcaaattacccagactgaagtgcagcaggggcagcagcaatttagccagttcacggatggccaacaactgtatcagatccagcaggtcaccatgcctgccggacaagatttggctcagcccatgttcatacagagcgctaatcagccctccgacggacaggctccccaagtcacaggagactag

SEQ ID NO: 197823 - DNA, 702 bp, Artificial Sequence
  Description of Artificial Sequence: Synthetic coding sequence
atggccatcaccaagttcgaccagttcgacttcctgatcgacatcgtacctcgagatgagctgaagcctccaaagcgccaggaagaagtgcgacagagcgtgacccctgcagaaccagtgcagtactactttactcttgctcaacaacctacagccgtgcaggttcaaggacaacagcagggacagcagactacaagctctaccaccacaatccaaccagggcagatcataattgctcagccccaacaggggcagactacaccagtcaccatgcaagtgggggaaggccagcaagtccaaattgtccaggcccagccacagggacaggctcagcaggcgcagtccggtactggccagacaatgcaagttatgcagcagatcataaccaacacaggcgaaattcaacagattcctgtgcaactaaatgccgggcagctgcagtatataaggttagcccaaccggtttcgggcacacaagtagtacagggacagatccagaccttggcaactaatgcgcagcagataacccagactgaggtccagcagggacaacagcagttttcgcagttcacagacggacagcagctgtaccagatccagcaggtcactatgagggcccggacctccccatccccatgtagtagcagccagccaacgagcccgcctacgggaccacccggtgaccgccggctgagggcgtag

SEQ ID NO: 197824 - DNA, 606 bp, Artificial Sequence
  Description of Artificial Sequence: Synthetic coding sequence
atggccatcaccaagttcgaccagttcgacttcctgatcgacatcgtcccgagagatgaacttaagcctcctaaacggcaggaggaggtgagacagagcgttacgcctgctgagcccgtgcaatactacttcactctggcgcagcagcccactgctgtacaggttcagggtcagcagcagggtcagcaaacaacctctagcacaacaacaatacagcccggtcaaataatcattgctcagccccagcagggacaaacgaccccagttactatgcaggtgggcgaaggccagcaggttcagatcgtccaggctcaaccccaggggcaggcccagcaggcccagtcagggaccggccagaccatgcaagtgatgcagcagataataactaataccggagaaatacagcagatacctgtgcagctgaacgccggacagctccagtatatcaggctggctcagcccgtgtcaggaacccaggtcgtgcagggtcagatccagacccaggcaatggaaacattcttcgccttcaaacgccagatttatagcctctggcgggtcgggggatttatcgccactctattttccccaagggatcccggaaactag

SEQ ID NO: 197825 - DNA, 942 bp, Artificial Sequence
  Description of Artificial Sequence: Synthetic coding sequence
atgagcaccgagggcggcttcggcggcaccagcagcagcgacgcccaacagtccctgcagtcattctggcctagagtaatggaggaaattcggaacctcactgtgaaggattttcgcgttcaggaactcccacttgctcggataaagaaaatcatgaagttggacgaggatgtgaaaatgatcagtgcagaggccccagtgctctttgccaaagccgctcaaatctttattaccgagctgacccttcgggcctggatacacacagaggacaataagaggcgaacactccaaagaaacgacattgctatggcgatcaccaagttcgaccagttcgactttttgattgacattgtacccagagacgagctgaagccccctaaacgtcaggaggaggtgcgacaatctgtgacgccagccgagccagtacagtactatttcactctggcgcagcagcctaccgccgttcaggtacagggacagcaacagggccagcagactactagttcaaccacgaccatccagccagggcagatcattatcgcccagccacagcaagggcagacgaccccggttacaatgcaggtgggagaaggtcagcaggtgcagatcgttcaggctcagccgcaaggacaggcccagcaggctcagtctggcacgggacagaccatgcaggtgatgcaacagatcatcacaaataccggcgaaatccagcagatccctgagacaggcctagctgtcagtctgcgactgatgaaatgcagcggcctgatctccgcacattgctcctttcggttacccggctctagcgattcacccgcttcagccagccgagtagccggaatcatcggagccgcagagtgccggccggcggctgtttacccactgagtccagcctgtatccgccactcttcatgcgcaggcacagacccggacacctgctag

SEQ ID NO: 197826 - DNA, 543 bp, Artificial Sequence
  Description of Artificial Sequence: Synthetic coding sequence
atgagcaccgagggcggcttcggcggcaccagcagcagcgacgcccagcagagcttacaaagcttctggcccagggtgatggaggagataaggaatctcactgttaaggattttcgagtgcaagagttgcccttagctcggatcaagaaaattatgaagctggacgaggacgtcaaaatgatcagcgcagaggctccagtgttattcgcgaaagccgcccaaatctttatcacggaacttaccctcagggcctggatccatactgaagacaacaaacgccggaccctccaggaggaggttaggcagtctgttactccagcagagcctgtgcaatactatttcactcttgcccaacaaccaacagcagtacaggttcagggacaacagcagggtcagcagaccacctccagcacaacgacaattcagccgggacagataattatcgcacagccgcagcaggggcagacaacacccgttaccatgcaggtcggcgagggtcaacaggtacagattgtccaggcccagccccaggggcaagcatag

SEQ ID NO: 197827 - DNA, 1065 bp, Artificial Sequence
  Description of Artificial Sequence: Synthetic coding sequence
atgagcaccgagggcggcttcggcggcaccagcagcagcgacgcccagcagagcctgcagtcgttttggccccgggtgatggaggagatccggaaccttacagtaaaggactttcgggtgcaagaactccccctggccaggatcaagaagattatgaagttagacgaagatgttaagatgatcagtgctgaggcacctgtgctcttcgctaaagctgcacaaatctttattaccgaattgacactgagagcttggatccatactgaagacaacaagcgaaggaccctccaacgaaacgatatcgctatggcgataaccaaatttgaccagttcgactttctgatcgacatagttcctcgagacgaactgaagcctcccaagcgccaggaggaggtccggcagtccgtaactcctgcagagccagtgcaatattacttcactcttgcacagcagcctacagcagtacaggttcagggacagcagcagggtcaacagaccacctcctcaaccaccaccatccagcctggccaaattatcattgcccaaccacagcaggggcagacaacccccgtcaccatgcaggtgggcgaggggcagcaggtgcagatcgtccaggctcaacctcagggacaggcccagcaggcacaaagtgggacgggacagactatgcaggtgatgcagcagatcataactaatactggggaaattcagcagatccccgtccagctgaatgctggacagctccaatacattagattagcacagcccgtttcgggcacccaggtggttcaggggcagatccaaacactggccactaatgctcagcagggacaacgcaatgcctctcagggcaagccccggaggtgtctcaaagagacactccagatcacccaaaccgaggtgcagcagggccagcagcaatttagtcagttcactgatggccagcagctgtaccagattcagcaagtgaccatgcctgccggccaggacctggcccagccgatgttcatccagtccgcaaatcaaccttctgacgggcaagccccccaggtcaccggagactag

SEQ ID NO: 197828 - DNA, 894 bp, Artificial Sequence
  Description of Artificial Sequence: Synthetic coding sequence
atgagcaccgagggcggcttcggcggcaccagcagcagcgacgcccagcagtctctccaatcattctggcctagggttatggaggagatccgcaatctcactgtgaaggacttccgggtgcaggaactgcctctcgcaaggatcaagaaaatcatgaaactggatgaggacgtgaaacgtaatgatatcgcgatggctattaccaagtttgaccaattcgatttcctcattgacatagtgccacgtgacgaactgaaaccgccaaagcgtcaggaggaagtgagacaaagtgttacaccggccgaaccagtccagtactatttcaccctggcacagcagccaacggccgtgcaggtacaaggccagcagcaggggcagcagactactagtagcacgacaactatacagcccggacaaatcatcattgcccagccacagcagggacagacgaccccggttacaatgcaggtaggggaagggcagcaagtgcagatcgtccaagctcagccccagggacaggcacaacaagcccagtccggcacaggtcagaccatgcaagtcatgcagcaaatcatcacgaataccggcgaaattcaacagatccccgttcaattgaacgccggccagctgcagtacatcaggctggctcagcccgtttcgggaacccaggtggtacagggtcagatccagacgctcgctactaacgcccagcagataacacagaccgaggtgcagcagggccaacagcagtttagccagtttacagatgggcagcagctttaccagattcaacaggtaaccatgccagcgggccaggacctagcccaaccgatgttcattcagtcggcgaatcagcctagcgacgggcaggctccccaggtaactggcgattag

SEQ ID NO: 197829 - DNA, 1008 bp, Artificial Sequence
  Description of Artificial Sequence: Synthetic coding sequence
atgagcaccgagggcggcttcggcggcaccagcagcagcgacgcccagcagagtcttcagtccttctggcctagagtaatggaagagatccgtaacctcacagtcaaagattttagggttcaagaactgcccctggcaagaatcaagaagatcatgaagctagacgaggatgtcaaaatgatcagtgcagaagctccagtgctgtttgcaaaagccgctcagatctttattaccgaactcacactgcgtgcctggattcatactgaagacaacaagcggcggacacttcagaggaatgacatagcaatggccatcactaagttcgatcagttcgatttcctgatcgacatcgtgcccagggacgaactgaagccccctaaacgccaagaagaggtccggcaaagtgtgacgccagccgaacccgtccagtattactttactttggcccagcagccgaccgccgtccaggtacagggtcagcagcaaggtcaacagaccacatcaagcaccaccaccatccagcccggccagatcatcatcgcccagccccagcaggggcaaaccactcctgtgactatgcaggtaggagaagggcaacaggttcaaatagtacaggcccaaccacagggccaggcccagcaggctcaaagcgggacaggccagacgatgcaggtgatgcagcagatcattaccaatacaggagagatacaacagatccctgtgcagctgaacgctggacagctccagtacatcaggcttgcgcagcctgttagtggaacccaggtcgttcaggggcagattcagactttagctaccaacgctcaacagataacacagactgaggtccagcagggccagcagcaattttcacaattcactgatggccagcagttgtaccagatacagcaggtaacaatgccagcagggcaggaccttgcacagccaatgttcatacagtccgcgaatcagccctctgacggacaggctccccaggtaactggagactag

SEQ ID NO: 197830 - DNA, 1008 bp, Artificial Sequence
  Description of Artificial Sequence: Synthetic coding sequence
atgagcaccgagggcggcttcggcggcaccagcagcagcgacgcccagcagtcactgcagtcgttctggcctagagtgatggaggaaattcgaaacctgacagtgaaagactttagagttcaggaattgcccctggccaggatcaagaaaattatgaagctggatgaggacgtaaagatgatctccgccgaggcgcctgttctttttgccaaagctgcgcagatattcataactgaactcacgctgcgggcttggatccatacagaggacaacaaaaggaggacgttacagagaaacgatattgcaatggccatcactaaattcgatcaattcgatttcttaatcgatattgttccccgggatgagttgaagcctcccaagaggcaagaagaggtgcggcagtctgttacacccgctgagcccgtgcagtattatttcaccttggcacaacagcctactgcagtgcaagtgcagggccaacagcagggccagcaaaccacgtcttcaaccacgaccattcaacccggccagatcattatcgcgcagccacagcagggccaaacaacgccagtgactatgcaagttggagagggccagcaagtgcagatcgttcaggcccagccccaggggcaagcccagcaagctcagagtgggacagggcagaccatgcaggtcatgcagcaaattatcaccaacacaggagagatccagcagattccagtccagttaaacgccggccagctccagtacattcgcctagcccagcctgtaagtggtacccaagtcgttcaggggcagattcaaaccctcgctactaacgctcagcagattacccaaacagaagtgcagcaggggcagcaacagttctcacagtttaccgatggccagcaattgtatcagattcagcaggtgaccatgcctgctggtcaggacttggctcagcctatgtttatacagtcagcaaatcagccgagcgacggccaggctccccaggtcaccggggactag

SEQ ID NO: 197831 - DNA, 390 bp, Artificial Sequence
  Description of Artificial Sequence: Synthetic coding sequence
atgagcaccgagggcggcttcggcggcaccagcagcagcgacgcccaacagagcctccaatctttctggcctcgcgtgatggaggaaatacgaaacttgacagtgaaagacttccgcgtgcaggaactcccactggcccgaattaaaaagattatgaagcttgacgaggatgtgaagatgatttcagccgaggctcctgtgctgttcgccaaagcagcacagatttttatcaccgaactaacccttcgagcctggatacataccgaagacaacaagcgaaggaccctccagcgaaacgatatagcgatggctatcactaaatttgatcagtttgactttctgatcgatatcgttcctagggacgaactgaagccacctaagaggcagtag

SEQ ID NO: 197832 - DNA, 1005 bp, Artificial Sequence
  Description of Artificial Sequence: Synthetic coding sequence
atgagcaccgagggcggcttcggcggcaccagcagcagcgacgcccaacagtcgctacaatcattctggccaagagttatggaggagatccggaacctcacagtgaaggacttccgagtgcaagaactgccactcgcccgcatcaagaaaattatgaagttagatgaggacgtaaaaatgatcagcgccgaggcacctgtgctgtttgccaaagcggcccagattttcattacagaactcacactccgggcttggatccataccgaggacaataaacgaagaactcttcagagaaacgatatcgctatggctatcacaaaattcgaccagttcgacttcttaatcgacattgtccctcgtgatgagcttaagccccctaagcgtcaggaggaggtgcgtcagtccgtgacacccgcagagcccgttcagtattattttactctggctcaacagcccaccgcagttcaggttcagggccagcagcagggacagcagacgaccagcagcacgaccaccatccaaccaggtcagatcatcatcgctcaaccacagcaaggccagacaactcctgttacaatgcaagtcggcgagggacagcaggtacagatcgtgcaggcacagcctcagggccaagcacagcaggcccagtccggaacaggacagacgatgcaggtgatgcaacagattatcacaaataccggagagatacagcaaattcccgtgcaattgaatgccggccagctccagtatatcagacttgcccaaccagtcagtggcacccaagtggttcaaggccaaattcaaactctggccaccaacgcacagcagatcacccaaacagaggtgcagcagggccagcagcagttctctcagttcacagacggacaactgtatcagatacaacaggtaacaatgcctgcgggccaagacctggcccagcctatgtttattcagtcagcgaaccagccttccgacgggcaggcaccccaagttaccggcgactag

SEQ ID NO: 197833 - DNA, 426 bp, Artificial Sequence
  Description of Artificial Sequence: Synthetic coding sequence
atgagcaccgagggcggcttcggcggcaccagcagcagcgacgcccagcagtcactgcagagcttctggccacgagttatggaagaaattcgcaatctgacagtcaaagactttcgggtgcaagagctgcctctggcccggattaaaaagatcatgaagttggatgaggatgttaaaatgatatcagccgaagcaccggttctgtttgctaaagccgcacaaatattcattacagagctgaccctgagagcctggatacacacagaagataacaagagacggaccctgcagcggaatgacattgccatggccatcactaagttcgaccagttcgattttctaattgacatcgtccccagggatgaactgaaacctccaaagagacaggaggtgagacagtcagtcacccccgcagagcccgtgtag

SEQ ID NO: 197834 - DNA, 288 bp, Artificial Sequence
  Description of Artificial Sequence: Synthetic coding sequence
atgagcaccgagggcggcttcggcggcaccagcagcagcgacgcccaacaaagccttcagtctttctggccgcgcgtgatggaagaaattaggaacctgactgtaatgataagtgccgaagctccagtattgtttgctaaagccgcacagatcttcattacggaactgacgttgagagcgtggattcacacagaagataacaaacgccgcacactccagcggaacgatatagctatggccatcactaagtttgaccagttcgattttctgatagatattgtcccttag

SEQ ID NO: 197835 - DNA, 183 bp, Artificial Sequence
  Description of Artificial Sequence: Synthetic coding sequence
atgagcaccgagggcggcttcggcggcaccagcagcagcgacgcccagcagagtttgcagagtttctggcccagggtcatggaggagatcagaaacctgacagtcaaggattttcgcgtgcaagagttgccactcgcgagaatcaaaaaaatcatgaagcttgacgaagatgttaagatgtag

SEQ ID NO: 197836 - DNA, 159 bp, Artificial Sequence
  Description of Artificial Sequence: Synthetic coding sequence
atgagcaccgagggcggcttcggcggcaccagcagcagcgacgcccaacaatctcttcaatcgttttggccacgggtgatggaagaaatcagaaacctaacagttaaggacttccgggtacaggagttacctcttgcacgcatcaagaagattatgtag

SEQ ID NO: 197837 - DNA, 555 bp, Artificial Sequence
  Description of Artificial Sequence: Synthetic coding sequence
atggcccggagcctggtgcacgacaccgtgttctactgcctgagcgtgtaccaggtcaaaattagccccaccccccagctcggggccgcctcctctgccgagggacacgtggggcagggagccccaggtctgatgggcaatatgaaccctgaggggggtgtgaaccacgagaatgggatgaatcgtgatgggggaatgataccagaaggaggcggagggaaccaggagcctagacagcagccgcagcccccgccagaggaaccagcgcaggccgccatggaggggccccagccagaaaatatgcaaccgcggacacggaggaccaaatttaccctactgcaggtggaggagctcgaaagcgtgtttcgccatactcagtatccagacgtgccaaccaggcgagagctggccgaaaacctgggcgtcacagaggacaaagtgcgagtctggtttaaaaataaacgtgcccggtgtcggagacatcagcgcgaattgatgctagccaacgagctccgagccgacccagatgattgtgtctacattgtggtcgactag

SEQ ID NO: 197838 - DNA, 345 bp, Artificial Sequence
  Description of Artificial Sequence: Synthetic coding sequence
atggacaagcggcggcgggccctgacccggctgtacctggacaaggctactttgatttggaacggtaatgccgtgagtgggctggatgctcttaacaattttttcgacacactgccgagtagtgaattccaggtgaacatgttggactgtcagccagtccacgaacaggctacgcagagccagaccaccgtgcttgttgtcacttccggtaccgtgaaatttgatggaaacaagcagcacttcttcaatcagaattttctgttgactgcgcaaagcacacccaacaacaccgtctggaaaattgccagcgattgttttcgcttccaggactggagtagctcttag

SEQ ID NO: 197839 - DNA, 429 bp, Artificial Sequence
  Description of Artificial Sequence: Synthetic coding sequence
atggccaccagcctggacttcaagacctacgtggaccaggcctgccgagctgcagaagaatttgtgaatatttactatgaaaccatggacaagcggcggagagctctgacccggttatacctggataaagcaacattaatatggaacgggaatgccgtgtccggattggatgcacttaataatttcttcgacactctgccatcgtcggaattccaagtgaatatgctcgactgccaaccagtgcatgagcaagccacccagagccagacgacagtgctggtcgttacatcagggacggtgaaatttgacggcaataaacagcatttttttaaccagaactttctgctgaccgcacagagcacccccaacaatacagtgtggaagattgcttcggattgcttccgctttcaggactggagttcgagctag

SEQ ID NO: 197840 - DNA, 345 bp, Artificial Sequence
  Description of Artificial Sequence: Synthetic coding sequence
atggacaagcggcggcgggccctgacccggctgtacctggacaaggcaaccctcatctggaacggcaacgccgtctcgggcttggatgcactaaataacttcttcgacacccttcctagctcagagttccaagtgaacatgctggactgtcagccggtgcacgaacaggccactcagagccagaccactgtcctggtggtgacaagcggtactgtgaaatttgatggtaataagcaacacttcttcaaccagaacttcctactcacggcccagagcaccccaaacaatacagtgtggaaaattgcgtcggattgtttcagattccaggactggagctcaagctag

SEQ ID NO: 197841 - DNA, 882 bp, Artificial Sequence
  Description of Artificial Sequence: Synthetic coding sequence
atgaccggcctgtacgagctggtgtggcgggtgctgcacgccctgctgtgtctgcacaggacccttacgtcctggctcagagtacggttcgggacctggaactggatctggagaagatgttgtcgagcagcgtcggcggcagtcctggctccgctcggctttactctgcgcaagccccctgccgtggggcggaatagaaggcaccatcgccacccccgaggaggctcctgtctcgccgccgcccaccatcgcatgagatggcgtgctgatggcagatccttggagaaactgccagttcacatgggccttgtaattacggaggtggaacaggaaccgtcttttagtgacattgctagcttggtagtctggtgcatggcagtgggcatatcatatatttcagtgtatgatcatcagggaatattcaaaaggaacaacagcaggctgatggacgagattctgaagcagcagcaagaactcctcggactggactgttctaagtactcccccgagtttgccaactcgaatgacaaagacgatcaggtcctgaattgtcatcttgcagtgaaagtcctctccccggaggatggcaaagctgatatcgtgagggctgcccaagacttctgccaactcgtggcccagaaacaaaaacgcccaactgacctggatgtagacactcttgcaagtttgcttagcagtaatgggtgccctgatcctgacttggtgctcaaattcggccccgttgactctaccctcggtttcctgccatggcacattagattgacggaaatcgtgtccttgccctcgcacctaaacatcagttacgaggacttctttagtgcgctaagacagtacgccgcctgtgagcagcggctaggaaagtag

SEQ ID NO: 197842 - DNA, 2571 bp, Artificial Sequence
  Description of Artificial Sequence: Synthetic coding sequence
atgaagccccggcccgccggcttcgtggacaacaagctgaagcagagggttatccagtatttgacctccaacaagtgtggcaagtacgtagatatcggcgtactcgcgtccgacttacagcgcgtctatagtattgactacgggaggaggaaacggaatgcatttaggatacaggtggaaaaggtcttcagtataatcagttcagaaaaagaactgaagaatctgactgagctcgaggatgagcatcttgcaaaacgggcccgccagggcgaggaggataacgagtacaccgaatcttactcagatgatgatagcagcatggaagattatcctgacccccagtctgccaaccacatgaacagttcactcctcagtttataccggaaggggaacccagactccgtatctaatacccctgagatggagcagagggagaccacctcgtccacgcctcgaatctccagtaagacaggcagcatccctcttaaaacgccggcgaaggacagcgagggcgggtggttcatcgataaaactccctcggtcaaaaaggacagcttcttcctggacttgtcttgtgagaagagtaatcccaaaaaaccaatcacggagatccaagactcaaaggactcatcactgctggagagcgatatgaagagaaaaggcaagctaaaaaacaaaggatccaagagaaagaaggaggacctgcaagaagttgacggcgagatcgaagcagtcctgcagaagaaagccaaagctcgcggtctggaattccagatctcaaatgtgaaatttgaggacgttggtgggaatgacatgaccctcaaggaggtatgcaagatgttgatacacatgaggcacccggaagtgtatcaccatctgggcgtggttcccccgagaggtgttttattgcacggtcctccaggatgcgggaaaacgctgctggcacatgctattgcaggagagctagacttacctatcttgaaagtggcggccccagaaatcgtgtctggcgtttcaggggagtcggaacaaaagctgcgggaactcttcgaacaggccgtctctaatgccccctgcatcatatttattgacgaaattgatgccatcaccccgaaaagggaagtagcaagtaaagatatggagcggagaatcgtcgcacagctccttacctgcatggatgaccttaataatgtagcggccaccgcccgggttctggtcatcggcgctacgaataggccggacagtctggatcccgccctgaggagagctggccgctttgatcgagaaatttgtctcggaatccctgatgaagccagccgcgaacgaatacttcagaccctgtgccgtaaactgcgcctgccacaagcgttcgacttctgtcacctggcccacctgacccctggattcgtcggggccgacctgatggccctgtgccgagaggcagcaatgtgcgcagtgaacagagttctgatgaaactgcaggagcagcagaagaagaatcccgagatggaagacctgcccagcaaaggagtgcaggaagagcgtttgggtacagagccaacttcagagacacaggacgagttgcagcgcttattaggtctgctcagagatcaagatcccttatccgaagaacagatgcagggtctttgcattgagctgaacgacttcatcgtggctctctctagcgttcagcccagtgcaaagcgcgaagggttcgtaaccgtacctaatgtaacctgggccgacattggggccctggaggacatacgtgaggagctgaccatggcaatcctggcccccgtcagaaaccccgaccaattcaaagctttggggctcgtgacgccggctggagtgttgcttgccgggcccccaggctgtggtaagactttattggctaaggccgtagccaatgaatctggcttgaacttcataagtgtgaaaggccctgagctgctgaacatgtatgtgggcgagagcgagcgggccgtgagacaagtctttcagcgggctaaaaattcggcaccctgcgtaatctttttcgacgaggtggatgcgctgtgccctcgccgtagtgaccgggagacgggcgctagcgttagagtggtaaaccagttactcactgaaatggacggccttgaggctcggcagcaggtgtttatcatggctgccaccaaccgcccggatattattgatccagcaatacttcgccccggcaggctcgataaaacactcttcgtcggactgccccctcctgccgacagactagctattctcaagactatcaccaagaatggtactaaaccacccttggatgcagatgtcaacctggaggccatagcgggcgaccttcggtgcgactgttacactggagccgacctttctgctctggtccgggaggcctctatctgtgccttacgccaagaaatggctagacagaaatccggaaacgagaagggagagctgaaggtgagccacaagcattttgaagaggcatttaaaaaggtgagatcatctatcagcaagaaagaccaaatcatgtatgaaaggctgcaggagagtctctctcgatag

SEQ ID NO: 197843 - DNA, 2004 bp, Artificial Sequence
  Description of Artificial Sequence: Synthetic coding sequence
atgaagcggaagggcaagctgaagaacaagggcagcaagcggaagaaagaagacttgcaggaagtggacggtgagatagaggccgtcttgcaaaaaaaagctaaggcccggggcctagagttccaaatctctaatgtcaagttcgaggacgtagggggaaacgatatgaccctgaaggaggtctgtaagatgttgatccatatgagacacccggaggtttatcaccacctgggtgtagtgccccccagaggggtgctgctacatggcccccccgggtgtgggaagaccctgctggctcacgccatagcaggtgctgaatgcagtggcatgatcacggctcactgcagctttgattttagcgggtcaaatgaccctcctgcctctgcctcacaggaactggatctgccaattctaaaggtcgccgcccccgagattgtgtccggagtatcaggcgagtctgaacaaaaactccgggagttgttcgagcaggccgtgagcaacgcgccctgcatcatatttattgacgaaatagatgcaattacccctaaacgagaagtggcctccaaggatatggagaggaggatcgtggcacaactgttgacatgcatggatgacctgaataatgtagccgccaccgcacgcgtgttggtaattggtgctacgaataggcccgactctctcgatcctgcacttcggcgcgctggccgcttcgaccgggagatctgtcttgggatccccgatgaagccagtcgggagcgcatcttgcaaaccctttgtcgtaagctaagactgccccaggccttcgacttctgccatttagcgcatctgacccccggcttcgtgggagccgacctgatggctctatgtcgggaagcagccatgtgcgcagtaaatagggtccttatgaaactgcaggaacagcaaaagaagaatcccgagatggaagacctaccatccaaaggcgttcaggaggaacgactcggcaccgagccaacatccgaaacccaggacgagctgcagagactgctgggcttactgcgcgaccaggatccactctctgaagagcagatgcagggactgtgtattgaactgaacgactttatcgtggccctaagctccgtccagcccagcgcaaaacgcgagggttttgtcacagtacctaacgtgacctgggccgatattggcgccctggaagatatcagggaggaacttactatggccatcctggcccctgtgaggaatcccgaccagttcaaggcccttggattggtgacccccgccggcgtcctgctggcaggcccacctgggtgcgggaagaccctcctcgcaaaggcagtagcaaatgagtctgggctgaactttatcagcgttaaaggcccagagctgttgaacatgtatgtcggtgagagtgagagggcggtcaggcaggtgtttcagagagcaaagaactctgctccctgtgtgatattcttcgacgaagtggacgccctttgtcctcgaagatcggaccgggaaaccggcgcgtctgtacgcgtggttaatcagctgctcaccgaaatggacgggttagaggcacgacaacaagtgtttatcatggccgccacgaatcgcccggatataatcgatcccgccatcctccgaccgggtcgccttgataaaaccctgtttgtcggcctccctccccccgcagatagactggcaatcttaaagacgatcaccaaaaatgggacaaagccaccgttagatgccgacgtgaatctcgaagctatcgctggcgacctgaggtgtgactgttatactggcgccgacctcagcgccctcgtgcgagaggcttccatttgtgccctgaggcaggaaatggcccgccagaagtccgggaacgaaaaaggagaactcaaggttagccacaagcacttcgaagaggctttcaaaaaggtaaggagcagcattagcaagaaggaccaaattatgtacgaacggctacaggagtctctgtcccggtag

SEQ ID NO: 197844 - DNA, 1770 bp, Artificial Sequence
  Description of Artificial Sequence: Synthetic coding sequence
atggaggactaccccgacccccagagcgccaaccacatgaacagctccctcttgtcactgtacaggaagggcaatcccgacagtgtctctaacacacccgagatggagcagcgagagacaacatcctccacaccccgcatcagttccaagacaggatccatccccctgaagacaccagccaaagactcagagggaggctggttcattgacaaaacgccctccgtcaagaaggattcctttttcttggacctctcatgcgagaaaagtaatccaaaaaaacccatcacagagatccaagatagtaaggattctagcctgctggagtccgacatgaagaggaagggcaagttgaaaaacaaaggcagcaagcgaaagaaagaagatctccaagaggttgatggggaaatcgaagccgttctgcaaaagaaagcaaaagccagaggactggagtttcagatatccaacgttaaattcgaagatgtgggggggaatgacatgacgctgaaggaggtctgcaaaatgctgatccatatgcgtcatccagaggtttatcatcatctcggggtggtaccaccccggggcgtgttgcttcatgggccacccgggtgtgggaaaacccttttagcccacgccatcgctggagagctggacttgcctattcttaaagtggccgctcctgagattgttagtggcgtatctggagagtcagaacaaaagttgcgagaactctttgaacaggctgtttcaaatgccccctgcattatcttcatcgatgagatcgatgccattactccaaaacgcgaagtcgcctctaaagatatggaacggaggatcgtcgcccagctgctcacatgcatggatgatctcaataacgtggccgctactgctagggtcctggttattggggctaccaatcgacccgatagtctggacccggctctgcggcgcgcaggacggtttgatagagagatctgcctaggaatcccagatgaggctagccgcgaaagaatcttgcaaactttgtgccggaaactgaggctgcctcaggcgtttgacttttgccacctggctcacctgaccccgggctttgttggcgcggatttgatggctttatgtcgagaagctgcaatgtgcgctgtcaacagggtgctgatgaaactacaggagcagcagaagaagaatccggaaatggaagacttgcctagcaaaggcgtccaggaggagcggttaggaaccgaacctacttccgagacccaggacgagttacagagactgctggggctcttacgtgaccaggaccccctcagcgaagagcagatgcagggtctttgtatagagttaaacgactttattgtcgcactgagtagtgttcagccatctgccaaacgcgaggggttcgtaacggtccccaatgtgacctgggccgatattggggctctggaggatatccgcgaagaactcaccatggctattttggcaccagtgcgtaaccctgaccaattcaaggcactgggcctggttacccctgctggagtacttctcgctggccccccaggctgtgggaaaaccttgctggcaaaggcggtcgcaaacgaatctgggcttaactttatcagcgtcaaagggcccgagcttcttaacatgtacgtgggagagtcagaacgtgctgttaggcaggtcttccagcgggctaaaaacagtgctccatgtgttattttctttgatgaggtagacgcactctgccctcgtcggagcgatcgtgaaatatag

SEQ ID NO: 197845 - DNA, 2253 bp, Artificial Sequence
  Description of Artificial Sequence: Synthetic coding sequence
atggaggactaccccgacccccagagcgccaaccacatgaacagctcactgctgtctctttatcgaaaaggcaaccccgattctgtgtcaaatacccctgagatggagcagcgagagactacctcttccacacccaggatttcctccaagactgggagtatcccattgaaaaccccagcaaaagactctgagggaggctggttcattgataaaactcctagcgtcaaaaaagacagcttctttctggacttgagctgcgagaagagtaatcccaagaaacccataacggagatccaagattccaaggattctagccttttggaaagtgacatgaaacggaaaggaaaactgaaaaacaaggggtctaagcgaaagaaagaagacttgcaggaggtggacggtgaaattgaggccgtccttcagaagaaagccaaagctcgtggacttgagttccagatctctaacgtgaagttcgaagatgttggagggaatgatatgaccctaaaggaagtgtgcaagatgctgatacatatgcggcatcctgaagtctaccaccatctcggagtcgtgccaccacgcggagttttattgcacggaccgccaggctgcgggaaaactttactggcccatgctatcgccggtgaacttgacttacccattcttaaggtcgctgcgcccgagatcgtgagtggagtctccggggaaagtgagcaaaagctgagggagctgttcgagcaggcggtctccaatgccccatgcatcatctttattgatgagatcgatgctatcacccctaagagagaagttgcctctaaggacatggagagacgaattgtcgcacagttactaacgtgcatggacgatctgaataacgtcgctgccactgctcgagtgctggttattggagccaccaatagacccgattctctggatccagctctgcgaagggccggcagattcgatagggaaatctgcctcggcatccccgacgaggctagccgggaaagaatactgcagaccctgtgtcggaagctcaggctgccccaggcatttgacttctgtcatctagcccatctgacgcccggctttgtcggagcagacttaatggcactctgtcgggaagctgcaatgtgtgccgtgaacagggttctgatgaagctccaggagcagcagaaaaagaatcccgagatggaagatctgccgagtaagggggtgcaagaagaacggctgggtacggaaccaacatcggaaactcaagacgagctccagcgacttttgggcttgctgagggaccaggatcccctctcagaagagcagatgcagggactctgtatcgagttgaacgacttcattgtcgctctgtcctcagttcagccttctgctaagcgggaaggcttcgtgactgtgcccaatgtcacttgggctgacattggagccctcgaagacatcagggaggaacttaccatggccattctggcgcctgttcgtaacccggatcagtttaaggccctcggcctcgtcacccccgctggtgtgttgctggcgggaccgcccggatgcggcaaaacactgcttgcaaaggccgtcgcaaacgagagcggcctgaactttattagtgtgaagggtcctgagctgctgaacatgtatgtgggcgagagcgaacgtgctgtcaggcaggtctttcagagggctaaaaactccgccccgtgcgtgatcttcttcgatgaggtcgacgcactctgccctcgccggtctgacagagagactggggcttctgtccgggtcgtcaatcagttgctgaccgaaatggacggcctggaagctcgacagcaagtttttattatggcggccactaacagacccgacatcatcgaccccgccattctgcgcccaggccggttggacaagactctctttgtggggctgccccctccagctgacagattagccatcctgaagacgatcacgaaaaacggcaccaagcctcccttagatgccgatgtcaacctcgaggctatagcgggagatctcagatgcgattgctacaccggcgctgacctttctgcattagtgagggaggcctcgatctgcgccctgcgccaggaaatggcccggcagaaatccggtaatgaaaagggcgagctgaaggtatctcataagcactttgaggaggcttttaagaaggtgcgtagctccatatcaaagaaagaccagattatgtacgaaaggttacaagaatctctttctcgatag

SEQ ID NO: 197846 - DNA, 2298 bp, Artificial Sequence
  Description of Artificial Sequence: Synthetic coding sequence
atgaagccccggcccgccggcttcgtggacaacaagctgaagcagcgggtgattcagtacctcacgagtaataaatgcggcaaatatgtcgatatcggcgtgctggcctccgatttacagagggtgtactctatcgattatggtcggagaaagaggaacgctttccgcatccaggtggagaaagtgttcagcattataagcagtgagaaggagctaaagaaccttactgagcttgaggacgagcatctggcaaagcgagcccggcagggcgaggaagataatgagtacacagaatcatacagcgatgacgacagctcaatggaagactatcccgatcctcaagacagcaaagactcaagcctcttagagtctgatatgaaaagaaaggggaagctgaagaataagggatccaaacggaaaaaagaagacttgcaagaagtggatggagagatagaagccgttctccaaaaaaaggcgaaagcaagaggcttggaattccagatctctaatgtgaaattcgaggacgttggaggcaacgacatgaccctcaaagaagtgtgtaaaatgctaatccacatgcgccacccggaagtgtatcaccatctgggagtcgtgccacctcggggagtactgctgcatggtccacccggctgcgggaaaactctgttggctcatgcgatagccggtgagctggatctgcccattctgaaggtggcagctccggaaatcgtgagcggcgtatctggcgaatcggaacagaagctccgggagttgtttgaacaggctgtgagcaacgcaccatgcattattttcatcgacgaaatagacgctataacccctaaacgagaagtcgcatccaaagacatggagaggagaatcgttgcccagctgctcacctgcatggatgacctgaataatgtggcagcaaccgcccgtgtcctggttattggggcaaccaatcggcccgacagcctggatcccgccctgagacgcgctggcagattcgatagggaaatttgtctgggtatacccgacgaggctagcagggaaaggattcttcaaactctatgcagaaagttacggctgccgcaagcttttgacttttgtcacttggctcacctgactcctggcttcgtgggcgcagacctgatggccctgtgcagagaggctgcgatgtgtgcggtgaaccgagtcttgatgaagttacaagaacagcaaaaaaaaaatcccgagatggaggatctgccctcaaagggcgttcaggaggagcgccttgggaccgagccaacttctgagacacaagacgagctgcaacgactccttggactgctaagggaccaggatccgctctcagaggaacaaatgcagggtctttgtattgagctgaacgactttatcgtagctctttcatcagtgcagccttccgcaaagcgagagggtttcgtcactgtgcctaatgtgacctgggccgacattggcgccctagaggatatccgcgaggagctgactatggctatcttggcccccgtgaggaaccctgaccagttcaaggccctggggctggttaccccagctggcgtcctgctggccggcccaccgggatgtggcaagacccttcttgctaaagcggtggccaatgagtctggccttaatttcatcagcgtaaaaggtcccgagctgttgaatatgtacgtcggcgagtcagagagggctgttcggcaggtgtttcagcgcgccaagaacagcgctccttgtgtgatcttcttcgacgaggttgacgccctttgtccacgacgctcagaccgcgaaaccggagcaagcgtccgggtagtaaatcagctgctgactgagatggacggacttgaagccagacaacaggtattcatcatggcagcaacaaaccgcccagatatcatcgaccctgcgatcctgcgtccaggtcgattggacaagaccctgtttgtggggcttcctccccccgcagacagattggccattctgaaaaccatcacaaaaaacggaactaagccccctctggacgcagatgtcaacctggaagctattgccggagacttgcgttgcgactgttacaccggcgcagacctgtccgctttggtgcgagaggcttccatctgcgcactgcgacaggaaatggcgaggcagaaatcagggaatgagaagggtgaattgaaggtatcacacaagcattttgaggaagctttcaaaaaagtacggagctctatcagcaagaaggatcaaattatgtacgaacgtctacaggagtcgctcagccggtag

SEQ ID NO: 197847 - DNA, 1386 bp, Artificial Sequence
  Description of Artificial Sequence: Synthetic coding sequence
atgccccccagcggcccccggggcaccctgctgctgctgcccctgctgctcctcctcctgctgcgggccgtcctcgccgtaccactggagcggggtgcaccaaataaggaagagactccagcaactgagtcccctgacacaggtttatattatcacagatacttgcaagaggttattgatgtcttagaaactgacggccatttccgagagaagttgcaggctgcgaacgccgaggatataaaaagtggcaaactgtcaagggagctcgattttgtttctcatcatgttagaacaaagctggatgaactcaagagacaggaagtgtccagactccgtatgttgctcaaggcgaaaatggatgcagagcaagatcccaacgttcaagtggaccatctgaatcttcttaagcagttcgagcatctggaccctcaaaaccagcacacctttgaagctagagatttggagctcctaatccagactgcgacacgtgatttggcccagtacgacgccgcccatcatgaggaatttaagcgttacgaaatgctcaaggagcatgaaaggaggcgctacctcgagagcctaggcgaggagcagcggaaagaagcggaaagaaagttagaggagcagcagcggagacatcgtgagcatcccaaagtcaatgtgcctggcagccaggctcagctgaaggaggtttgggaagaactggatggacttgatcccaataggtttaaccccaagacattttttattctgcacgatattaattccgacggtgttctggatgaacaggagctagaggccctattcacaaaagagctggaaaaggtgtacgaccccaaaaatgaagaagacgatatgcgcgaaatggaggaggaacggctgaggatgagagagcatgtgatgaaaaatgtagacacaaatcaggataggctggtgaccctggaggaattcctagcctctacccagcggaaggagttcggggatacaggagaaggatgggaaacggtggagatgcatccagcgtacacagaggaagagctgcgcaggttcgaagaggagctcgccgctcgcgaggcggagctaaacgctaaagcccagcgactgtcacaagagaccgaagcacttggccgatcacaaggtagactggaggcccaaaagcgggaactccaacaggcagttctccacatggagcagcgtaaacaacaacagcagcaacaacaaggacacaaagcacccgccgctcatcctgagggacagcttaagtttcatccggacacggacgatgtccctgtgcccgcgcctgccggggatcagaaggaagtcgatacgagcgagaaaaagcttctggagcgtcttccggaggtcgaggttcctcagcatctctag

SEQ ID NO: 197848 - DNA, 1386 bp, Artificial Sequence
  Description of Artificial Sequence: Synthetic coding sequence
atgccccccagcggcccccggggcaccctgctgctgctgcccctgctgctgttgctgctgctgagggcagtgttagccgttcccctagagaggggggcccctaacaaggaagaaaccccagctacggagtcacccgatacgggtttgtactaccatagatacctacaggaggtcattgatgtgctggagactgatggccactttagagagaagctacaggccgcaaacgcagaggatatcaagtctggaaaattgtccagagagctggatttcgtgtcccaccatgtgagaacgaagctcgacgaattaaaacggcaagaagtaagtaggctgagaatgctgcttaaggcaaagatggatgctgagcaggacccaaacgttcaagtggaccatctgaacttacttaaacagttcgagcacttagatcctcaaaatcagcacaccttcgaagctagagacctggaattgcttatacagacagcaactcgcgatctggcccaatacgatgctgcccatcatgaggagtttaagaggtacgaaatgctgaaagaacacgagagaagacgttaccttgagtccctgggtgaagagcagcgaaaagaggccgagcgcaagttggaagagcaacagaggcgtcatcgtgaacatccgaaggtgaacgtgcccggatcacaggcacagctcaaggaggtctgggaggagctcgatggcctggaccctaatcggtttaacccaaagacattctttatcttgcacgatattaactccgacggggtgctggatgaacaggaactcgaggccttatttaccaaggaactcgagaaagtgtacgaccctaaaaacgaggaagacgatatgagggaaatggaggaagaaagactgagaatgcgcgaacatgtaatgaaaaacgtggataccaaccaggatcggctggtaaccctggaagagttccttgcaagtactcagagaaaggaatttggcgatactggcgagggctgggaaacggtggaaatgcatcctgcatataccgaagaggagcttcggagatttgaggaggaattagctgctagagaagcagaacttaatgccaaagcccagagactctcacaggaaaccgaggcccttggtaggagccaaggccgtttggaagcgcaaaaaagggaactgcaacaagctgttctgcatatggagcagagaaagcaacagcagcagcaacaacaggggcataaagcccctgcagcccatcccgaaggtcagcttaaattccatcccgacaccgatgatgttcccgtgccggctccagctggggatcagaaggaggtggacacctccgaaaaaaaactgctggagcgcctgcccgaggtagaagttccgcaacatctgtag

SEQ ID NO: 197849 - DNA, 1386 bp, Artificial Sequence
  Description of Artificial Sequence: Synthetic coding sequence
atgccccccagcggcccccggggcaccctgctgctgctgcccctgttgctcctgctgcttctgcgcgctgtactggccgtccccctggagcgtggcgccccaaacaaggaggagacaccagccactgagagtcccgacactggtttgtactatcatagatacctgcaagaagtgatcgatgttctggagacggacggccattttagagaaaaactccaggccgctaatgccgaagatatcaaaagcggcaagctgtccagagaactggatttcgtctcacatcacgtgaggacgaagctggacgagctgaaacgacaggaagtttctcggctgcgcatgcttttgaaagcaaaaatggatgccgagcaagatcctaacgttcaggtggatcacctgaatctgttaaagcagttcgagcacctagatccccagaaccagcataccttcgaagcacgggacctcgagttgctgattcagaccgcaacgagggatttagcccagtacgacgcggcccatcatgaagagttcaaacgctatgagatgttgaaggaacacgaacgcaggagatacctcgagagcctaggtgaggagcaaagaaaggaggccgagaggaaactggaggagcaacagcgtcgacaccgagaacaccccaaggtcaatgtcccgggctcccaggcccaactcaaagaagtatgggaggagcttgacggcttagaccccaaccggtttaaccccaaaaccttctttattctgcacgacattaattccgacggagttctggatgagcaggaactggaagctctgttcaccaaggagttggagaaagtctacgaccccaagaatgaagaagacgatatgagggaaatggaggaagaaagactgcggatgcgcgaacacgtcatgaagaatgtagatactaaccaagatagactggtcactctggaggaattcctggctagtacgcaaaggaaggaatttggggacaccggcgagggatgggaaaccgtcgagatgcaccctgcttacacagaagaagaactgaggaggttcgaagaggaattggccgcccgcgaggctgaattgaacgcaaaagcccagcggctctcacaggaaaccgaggctctcgggcggagtcaggggaggctagaggcgcagaagagagagctgcagcaggcagttctgcacatggaacagaggaaacaacagcagcagcagcaacaaggccataaggctcccgcagcccacccagagggccagctcaagtttcaccctgacacggacgatgtgccagttcccgctcccgctggggatcagaaagaggtagatacgtctgaaaagaagcttctggaaagactgcccgaagtggaggtgcctcaacacctgtag

SEQ ID NO: 197850 - DNA, 375 bp, Artificial Sequence
  Description of Artificial Sequence: Synthetic coding sequence
atgccccccagcggcccccggggcaccctgctgctgctgcccctgctacttctgctgctgctaagagcagtgctcgcggtacctctggaaaggggagcccctaacaaggaagaaacacctgctaccgagagtcccgataccggactgtactaccatcggtatttgcaagaagtgatcgacgtgctggaaactgacggccactttagagagaaactgcaagctgcgaatgccgaggacatcaagagcggtaaactgagtagggagctggacttcgtgagtcaccatgtccggacgaaacttgatgagctgaagcgtcaggaggtttcccgcctgcggatgctgcttaaggctaaaatggacgctgagcaagattag

SEQ ID NO: 197851 - DNA, 336 bp, Artificial Sequence
  Description of Artificial Sequence: Synthetic coding sequence
atgccccccagcggcccccggggcaccctgctgctgctgcccctgctcctcctgctgctgcttcgtgccgtgctggctgttccgctggaaaggggcgcaccaaacaaagaggaaactcccgctacagagtccccggataccgggctatactaccaccgctatctgcaagaagtcatagatgtgctggagactgatggacatttccgagagaagctccaagccgccaatgccgaagacatcaagtcaggcaaactgagcagagaattggattttgtgtcccaccacgttcgcaccaagctggatgagctgaagcgacaggaagtgagccgtctgtag

SEQ ID NO: 197852 - DNA, 1263 bp, Artificial Sequence
  Description of Artificial Sequence: Synthetic coding sequence
atgcggtggcggaccatcctgctgcagtactgcttcctgctgatcacctgcttactcaccgctctggaggccgttcctatagacatagacaaaacaaaagttcagaacatccaccccgtagagtctgcgaaaatcgagccccccgatacaggtttgtattatgacgaatacctgaagcaggtcatcgacgtcctagagacagacaagcatttccgagagaagctgcaaaaggccgacatcgaggaaatcaaatcggggcgtctgagtaaagaactcgatctcgtgtctcatcatgtcagaaccaagttagatgaactcaaaaggcaggaagtgggtcgtctgaggatgttgatcaaagcaaaacttgacagtctacaagacatcggaatggaccaccaagccctgctgaaacaatttgatcatctcaaccatcttaaccctgataagttcgagtctaccgacctcgatatgctgattaaggctgcaacctccgacttggaacactacgataagacccgccatgaggagttcaaaaaatacgagatgatgaaggaacatgagagaagggaatatctcaaaaccctcaacgaagagaaaaggaaagaggaagaatctaaattcgaggagatgaagaagaaacatgaaaatcaccccaaagtgaatcacccgggctcaaaggatcaactgaaggaagtgtgggaggaaacagatggacttgatccaaatgactttgatcctaaaacctttttcaaacttcacgacgtgaacagcgatggctttctggatgaacaggaactcgaggccctgttcactaaggaactagagaaagtgtatgaccctaagaacgaggaagacgacatggtagagatggaagaggagagattgcggatgagagagcatgtgatgtcagaagtggatacaaataaggacagattagtgacgctggaagagttcctgaaggcaaccgaaaaaaaggagttcttagagccagattcctgggagaccctcgaccagcaacagttttttaccgaggaagaactaaaggagtacgagaacatcattgccctgcaagagaatgagttgaaaaaaaaagccgatgagctgcaaaaacagaaagaagagctccagagacaacatgaccagcttgaagctcagaagctggagtaccatcaggtgattcaacagatggaacagaaaaagttgcagcagggcatcccaccatctggacccgccggcgaactgaagtttgaaccaagagtgtag

SEQ ID NO: 197853 - DNA, 1173 bp, Artificial Sequence
  Description of Artificial Sequence: Synthetic coding sequence
atgcggtggcggaccatcctgctgcagtactgcttcctgctgatcacctgcctgctgactgccttggaggctgtaccaatcgacatcgataagacaaaggtgcagaatatccatccagtggaatctgccaaaatcgagccacctgacaccggcctctactacgatgagtacctgaagcaggtgatagacgtcttggagaccgataagcatttcagagaaaagttacagaaagcagacatagaagagattaaaagcggtcgcctgagtaaggagctggatctggtgagccatcacgtgcggacgaaactggatgagctaaagagacaggaggttgggagacttcgcatgttgatcaaagcaaagctggattcattacaagacatcgggatggaccaccaggccttattaaagcagtttgaccatctgaaccacctgaatcccgacaaattcgagtcaaccgatctagacatgcttataaaagcggcgactagtgacctcgagcattacgacaagactcggcacgaggagtttaagaaatatgagatgatgaaagagcatgagaggagggagtacctcaagactctaaatgaagagaagagaaaagaagaggagtccaagttcgaggagatgaagaagaaacatgagaaccaccctaaagtgaatcatccagggagcaaagaccagctgaaggaggtttgggaagagaccgacggccttgaccctaatgatttcgatccgaaaacattcttcaagctccacgacgtgaatagcgatggatttctggatgagcaggagctggaggctctgtttactaaagagctcgagaaggtgtatgatcctaagaacgaggaggatgacatggtggagatggaggaggagcgtttgagaatgagagaacacgtgatgagcgagacccttgaccagcagcagttctttacggaggaggaactcaaggagtacgaaaacatcatcgctctccaggagaacgaactgaaaaagaaagctgatgagctgcagaagcagaaagaggaactccagaggcagcacgaccaacttgaggcgcagaagcttgagtaccatcaggttatccaacaaatggagcagaaaaagctgcagcagggaattccgccttcgggccccgccggcgagctaaagttcgagccccatatttag

SEQ ID NO: 197854 - DNA, 210 bp, Artificial Sequence
  Description of Artificial Sequence: Synthetic coding sequence
atgcggtggcggaccatcctgctgcagtactgcttcctgctgatcacctgccttcttacagccttggaagctgtgcctattgatatcgataaaaccaaggttcagaacattcaccccgttgagagtgctaagatagagccaccagatacagggctgtactacgacgagtacctgaagcaggtgatcgatgtgctagagaccgacaaatag

SEQ ID NO: 197855 - DNA, 105 bp, Artificial Sequence
  Description of Artificial Sequence: Synthetic coding sequence
atgcggtggcggaccatcctgctgcagtactgcttcctgctgatcacctgtttacttacagctttggaagctgtgcccatagacatagataagaccaaagtgtag

SEQ ID NO: 197856 - DNA, 1263 bp, Artificial Sequence
  Description of Artificial Sequence: Synthetic coding sequence
atgcggtggcggaccatcctgctgcagtactgcttcctgctgatcacctgcctcctaactgctctagaagcagtgccaatcgacatcgataagaccaaagtgcagaatatacatccggtcgagtctgccaaaattgaacctcccgacacaggattgtactacgatgagtacttgaagcaggtgatcgacgtgttggagactgacaagcattttagagaaaaactccaaaaagcagatatcgaagagatcaagagtgggaggctgtcgaaggagctggacctcgttagccaccatgtgcgcacaaaactggatgaacttaagagacaagaggttggccgcttgcgaatgctaataaaagcaaaactagactcgctccaggatattgggatggatcaccaggccctgttgaaacagtttgaccatctgaaccatcttaatcccgacaaatttgagtccacagaccttgatatgcttatcaaagcagcaacgagcgacctggagcattacgataagactagacacgaggagttcaaaaaatatgaaatgatgaaggagcatgaaaggagagagtatcttaaaactctgaacgaggaaaaaagaaaggaagaagagtccaagttcgaggaaatgaagaagaaacacgaaaaccacccaaaagtgaaccacccaggaagcaaagatcagctgaaggaggtttgggaagagacagacgggctggaccctaacgacttcgatccaaagacattctttaaattacatgatgtcaactctgacggattcctggacgagcaagagctcgaggcattattcacaaaggaactggagaaagtctacgaccccaagaacgaagaagatgacatggtagaaatggaagaggaaagattacggatgagggagcatgtgatgtcagaggtggatacaaataaggaccgccttgtcacgttggaggaattcctcaaggccaccgaaaaaaaagagtttctggaacccgactcttgggagaccctcgatcagcagcaattttttaccgaagaagagttaaaggagtatgaaaacatcatagcgctgcaggaaaatgagctgaaaaagaaagctgatgagctgcaaaagcagaaggaggaactccaaagacagcacgatcagttagaggcgcaaaaactggaatatcatcaagtaattcagcagatggaacaaaagaagttgcagcaaggaatcccgccaagcggccccgcaggggagctgaagttcgaaccgcatatttag

SEQ ID NO: 197857 - DNA, 588 bp, Artificial Sequence
  Description of Artificial Sequence: Synthetic coding sequence
atgcggtggcggaccatcctgctgcagtactgcttcctgctgatcacctgcctgctgaccgccttagaagctgtgcccatagatatcgacaagactaaagtgcagaacattcaccccgtggagtctgctaaaatcgagcccccagatactggactctactacgacgagtacctgaaacaagtgatcgatgtgctggagacggataagcatttccgcgaaaaactgcagaaggctgacattgaggagattaaatccgggcggctctccaaggaactcgatctcgttagtcaccatgtccgcacaaagttggatgaactgaaaaggcaggaggtggggcgacttaggatgttaattaaagccaagctcgactcattgcaggacatcgggatggatcaccaggccctactgaagcaattcgatcacctgaatcatttgaaccccgacaaatttgagtctaccgatttggacatgctcattaaggccgcaactagcgacctggaacattatgacaaaacccgtcatgaggagtttaaaaagtacgaaatgatgaaagagcacgagcggcgcgagtatctgaaaacattgtag

SEQ ID NO: 197858 - DNA, 597 bp, Artificial Sequence
  Description of Artificial Sequence: Synthetic coding sequence
atgcggtggcggaccatcctgctgcagtactgcttcctgctgatcacatgtttactgactgctttggaagccgtacccattgacattgacaagacaaaggtacagaatatccatcctgtggaaagcgcgaagatcgaacctcctgatacagggctgtactacgatgaatatttaaagcaggtgatagacgttctggagaccgataagcatttccgggaaaaactgcaaaaagcggatatcgaggagataaaatctggccgcctgagcaaagagcttgaccttgtttcgcaccatgtcaggaccaagttggatgagctaaaaaggcaggaagtcggacggctcagaatgctgattaaggcgaagctcgatagcttgcaagacatcggcatggaccaccaggctcttttaaagcaatttgaccacctgaatcacctgaaccctgacaagttcgaaagtacagacctggacatgctcattaaggccgcgacaagtgacctggaacattacgacaaaaccaggcatgaagagttcaaaaagtatgagatgatgaaggaacacgagcgtcgcgagtacctcaagactctcaatgaagagtag

SEQ ID NO: 197859 - DNA, 105 bp, Artificial Sequence
  Description of Artificial Sequence: Synthetic coding sequence
atgcggtggcggaccatcctgctgcagtactgcttcctgctgatcacatgtctattgactgcccttgaggccgtccctattgacatcgataagaccaaggtgtag

SEQ ID NO: 197860 - DNA, 120 bp, Artificial Sequence
  Description of Artificial Sequence: Synthetic coding sequence
atgcggtggcggaccatcctgctgcagtactgcttcctgctgatcacttgtctcctgactgccctcgaagccgtgcctattgatattgacaagacaaaagtgcagaatatccacccctag

SEQ ID NO: 197861 - DNA, 210 bp, Artificial Sequence
  Description of Artificial Sequence: Synthetic coding sequence
atgcggtggcggaccatcctgctgcagtactgcttcctgctgatcacatgtctgctcacagctctcgaagctgtccccattgatatcgacaaaacgaaggtccagaatatccacccagtggagtccgccaaaattgagccgcccgatactggcctgtattacgacgaatatctcaagcaggtgatcgatgtgctggagacagacaaatag

SEQ ID NO: 197862 - DNA, 273 bp, Artificial Sequence
  Description of Artificial Sequence: Synthetic coding sequence
atgcggtggcggaccatcctgctgcagtactgcttcctgctgatcacctgcctgctcaccgcactggaggccgtgcctattgatattgacaaaaccaaggtgcagaacatccatcctgtggagtctgctaaaatagaaccgccagataccggcctgtactatgacgagtacttaaagcaggtcatagacgtgttggagaccgacaagcattttcgcgaaaaactgcagaaagcagatattgaagaaatcaagagcggtagactgagcaagtag

SEQ ID NO: 197863 - DNA, 1323 bp, Artificial Sequence
  Description of Artificial Sequence: Synthetic coding sequence
atgatcatccccagcctggaggagctggacagcctgaagtacagcgatcttcagaatctggcgaagtctctgggactgcgagccaatctgagagccaccaagctgctgaaagcactgaaaggctacatcaagcacgaggcgcggaaggggaacgagaatcaggatgagagccagacttcagcatctagttgtgatgagacagagatccagatcagtaaccaggaagaggctgaaagacagcccttagggcatgtgaccaagactcgacgtcggtgtaagaccgtgcgcgtggaccccgactcgcaacagaatcactccgagatcaagatttctaatccaaccgagttccagaaccatgagaaacaagaaagtcaggacctccgcgcaaccgcaaaggtgccctctcccccagatgaacatcaggaggccgaaaacgcggtgagttctgggaatcgtgacagcaaggtgcccagcgagggaaagaaaagcctgtatacagacgagtcgtctaaaccgggtaagaacaagaggactgctatcactacaccgaactttaagaagctccatgaagctcactttaaagagatggaatccatcgatcaatatatagagcgaaagaaaaaacatttcgaagaacataattccatgaacgagctcaaacagcctatcaacaaaggtggcgtgcggacgcccgtgccgccgcggggcagactgtccgttgccagcacgccaatctcccagcgtaggtctcaggggcggagttgcggccctgcctcacagtctaccctgggtctaaaagggtcgcttaagaggtccgcaatatctgcagcaaagacgggggtgaggtttagtgcagccactaaagacaacgagcacaaaaggtctctcaccaaaactccagctaggaagtctgcacacgtaaccgtgtctggtggcactccaaagggggaggcagttctgggaacccataagctaaagacaatcactggtaactcggccgccgtaataactcccttcaaattgaccactgaggctacccaaacacccgtttctaacaaaaagccagtatttgatctgaaagcctctctgagcagaccccttaattacgagcctcacaagggtaaacttaagccgtgggggcagtctaaagagaataattatttaaaccagcacgtcaataggatcaacttttacaagaagacttacaaacagccccaccttcagacgaaggaagagcagcggaaaaaacgggaacaggagagaaaagaaaaaaaagcaaaggtgcttggaatgcgccgtgggttgattctagccgaagattag

SEQ ID NO: 197864 - DNA, 1209 bp, Artificial Sequence
  Description of Artificial Sequence: Synthetic coding sequence
atgatcatccccagcctggaggagctggacagcctgaagtacagcgacttgcagaatctcgcaaaatccttgggcctccgcgcaaacctgcgcgctaccaagctacttaaagccctgaagggatatataaaacatgaggcccgaaagggcaatgagaaccaggatgaatctcagacatcagcctcttcatgtgatgaaaccgagatccagatctctaatcaagaagaagccgaaagacagcccctgggacacgttactaagacccgccggaggtgcaagaccgtgagagtggacccggactctcagcagaaccactctgagataaaaatcagcaacccgacagagttccagaaccatgagaaacaagagtcccaggacttaagggccacagcgaaagtgccctctcccccggacgaacatcaagaggccgagaatgcagttagttctggaaaccgggatagcaaggtgcctagtgaaggaaagaaatcactgtacaccgatgagagctctaagcctggaaagaacaagcgcacagcgatcactactcccaattttaagaagctgcacgaggcacacttcaaggagatggagagtatcgatcagtatatcgagcgcaagaaaaagcacttcgaggagcacaattctatgaacgaactgaaacaacagccaattaacaaagggggcgtgcgtacccccgtcccaccacgggggcgcttaagtgtcgccagtaccccaatctcccagagacgaagccaaggccgtagctgtgggcccgcctctcagtcaaccttggggctgaaaggatccctgaagaggtcggccatcagcgctgcaaagacgggcgtgaggtttagtgcagccaccaaagacaacgagcacaaacgctcactgacaaagacgcccgctaggaaatctgcccacgtgacggttagtggaggcacgccaaaaggcgaggccgtccttggcacgcacaaattgaaaacaataactggtaatagcgccgctggcaagttgaaaccttggggacagtctaaggaaaataactatctcaatcagcacgtgaaccgcatcaatttctacaaaaagacctataagcagcctcaccttcagaccaaagaagaacagcggaagaagcgcgagcaggaacgaaaagaaaagaaagcaaaggttctgggaatgaggaggggcttgattttagctgaggactag

SEQ ID NO: 197865 - DNA, 1326 bp, Artificial Sequence
  Description of Artificial Sequence: Synthetic coding sequence
atgatcatccccagcctggaggagctggacagcctgaagtacagcgacctacagaatctcgccaaaagcctcgggctccgcgccaacttgagagcgactaaactactaaaggcactgaagggttatatcaagcacgaggctcgcaaggggaacgagaatcaggacgaaagccagactagtgcaagctcttgcgatgaaaccgagattcagatatcaaatcaggaggaggccgaacggcagcctctggggcacgtgaccaagacacgccggcgctgcaagacggtgcgcgtcgacccagattctcagcagaaccacagcgaaatcaagattagcaatcctactgagttccagaaccatgaaaaacaggaatcacaagatttgcgcgccaccgcaaaggtgcccagtccacctgacgagcatcaggaggcagaaaatgctgtgtcctctgggaatcgcgatagcaaagtgccatccgaaggaaagaagagcctgtataccgatgagtcctcaaagcccggtaaaaacaagcgaaccgccatcaccactccaaactttaagaagctgcatgaggctcactttaaagagatggagagcatagaccagtacatcgagcgcaagaagaaacattttgaagaacataattctatgaatgaactcaagcagcagcccatcaataagggtggcgtccgtacccccgtgcccccaagaggtcgcctttcagttgcatctacacccattagtcaacgaagatcacaaggccgctcgtgcggacctgcctcccagtccaccctgggtctgaaaggcagtttgaagagatccgctattagcgccgccaaaacgggggtgagattttcggcagccaccaaagacaacgagcacaaacggtccctcacaaagacacccgctcggaaatccgcccacgtcaccgtatcgggcgggacccccaaaggagaggcggtgttaggtacccacaaattaaaaaccatcaccggtaactctgctgccgtgattactccattcaagctgaccacggaagccacgcagactcccgtctccaacaaaaaacctgtcttcgatctcaaggcctcactgtccaggcctctcaattatgaacctcataagggaaagctgaaaccgtggggccagtcaaaagagaacaattacctgaatcaacacgtgaacaggattaatttttacaaaaaaacgtacaagcagccccacttacagacaaaggaggaacaacggaagaagcgagagcaagaacgcaaagaaaagaaagcaaaagtactgggaatgaggagaggcttaattcttgcagaggattag

SEQ ID NO: 197866 - DNA, 1323 bp, Artificial Sequence
  Description of Artificial Sequence: Synthetic coding sequence
atgatcatccccagcctggaggagctggacagcctgaagtacagcgatctccagaatctggctaaatccctcggtttaagagctaacctgagagcaactaaactgttaaaagccctcaagggctatatcaagcacgaggctcgcaaggggaatgaaaaccaggatgagtctcagacttccgcaagctcctgcgatgagacagagatccaaatctcaaatcaggaggaagcggagcggcagccccttggacatgtgacaaaaactaggaggaggtgcaagaccgtccgtgtggacccggattcccagaatcactccgagatcaagatctcaaaccctaccgagtttcagaatcatgaaaaacaggaaagtcaggaccttagagcgaccgctaaggttccttcccccccagacgaacaccaggaggctgagaacgccgtgagcagcgggaatcgggacagcaaggttcccagtgaagggaagaaatctctgtacacggatgaatcatctaagcctggtaaaaataagaggacagctattacgaccccgaactttaaaaagctgcatgaagcacatttcaaggaaatggagtcaatcgaccagtatattgagagaaagaaaaagcatttcgaagagcataattctatgaatgagcttaaacagcaacccattaacaagggaggggtgagaaccccagtcccaccgcgggggcgcctgtccgtggcttctacacccatctctcagcgaagatcccaggggaggtcctgtggtcctgcatctcagagtacactcggactgaagggtagcttgaaacgatctgctatttctgcagccaagactggggttaggttttcagcagcgacaaaagacaatgagcacaagagaagcctgactaagacaccggcccggaagtcagcccacgttacggtaagcggcggcacacccaagggagaggccgtgctgggtacacacaagctgaagaccataacaggcaattccgcggcggtcataaccccatttaagcttacaacagaagcaacccagactcccgtgtctaacaaaaagcccgtcttcgatctgaaggcaagtctctcccgcccactgaactatgaaccccacaaggggaagttaaagccctgggggcagagcaaggaaaacaactacctgaatcagcacgttaacaggattaacttctataagaagacttataaacagccccaccttcagactaaagaagaacagcgaaagaagcgcgaacaggagcggaaggagaagaaagcaaaggtcctcgggatgcgccgtgggctgattctggcagaagattag

SEQ ID NO: 197867 - DNA, 1320 bp, Artificial Sequence
  Description of Artificial Sequence: Synthetic coding sequence
atgatcatccccagcctggaggagctggacagcctgaagtacagcgacctgcagaacctcgcaaagagtctgggtttgcgggccaatcttcgggcaactaaactcctgaaggccttgaagggctacataaaacacgaagctcgcaagggcaacgaaaatcaggatgagagccagacctctgcttcctcatgtgatgaaacggagatccagatatcaaaccaggaggaagccgaaaggcagcctctgggccacgtgactaaaacgagaaggcggtgcaagaccgtaagagtcgatccagattcccagaaccatagcgaaattaagatctccaatcctacagagtttcaaaatcatgagaagcaagaaagtcaagatctgcgcgccacagccaaagtcccaagtccacccgacgagcaccaggaggcagaaaacgcagtgtctagcggcaatcgcgactcgaaagtcccctcagaaggcaagaagtcactttatactgacgagagtagcaaaccaggaaaaaacaaacgaacggcaattacaaccccaaactttaaaaaactccacgaggcacattttaaagagatggagagtatcgatcagtatattgagcggaaaaagaaacatttcgaggagcacaacagcatgaacgaactgaagcagcctattaacaaaggcggagtaagaactccagtgcctcccaggggacgtctctcagtcgcctccaccccaatcagccaaagaaggtcacagggccgctcctgtggtccagcctcacagagtactctgggactgaagggtagtttaaagaggtccgctattagcgctgctaagacaggcgtgaggtttagcgctgctacaaaggacaacgagcataagcgctccctcaccaagacacccgctaggaagagtgctcatgtgactgtatccggcgggactcctaaaggggaagcggtgttaggcacacacaagctcaaaacgattaccgggaattcggcagcagtgatcaccccttttaagcttaccaccgaagccacacaaaccccggtgtcaaataagaagcctgtgtttgacctcaaggcttcattgtccaggcctctgaactatgagcctcacaagggaaagttgaagccatggggacagtcaaaagaaaataactatttaaaccaacatgtgaaccgcatcaatttctataaaaaaacgtacaagcaaccacatcttcagaccaaagaggaacaacggaagaaacgggagcaggaacgcaaagagaagaaagcaaaggtgctgggcatgagaaggggcctgatattagctgaggattag

SEQ ID NO: 197868 - DNA, 1281 bp, Artificial Sequence
  Description of Artificial Sequence: Synthetic coding sequence
atgatcatccccagcctggaggagctggacagcctgaagtacagcgatttgcaaaatttggcgaaatctcttggcctgcgagcgaacttgcgggcaacgaagcttctcaaagcactgaagggatacatcaagcatgaggcccggaaaggaaatgaaaaccaagacgaaagccagacatctgcatccagctgcgacgagactgaaatacagatcagcaatcaggaggaagccgagcgacagccactagggcacgttacaaagacgaggcgccggtgcaagacagtgcgcgttgatccagacagtcagaatcacgaaaaacaagaaagtcaggatctgagagccaccgccaaggtcccttccccacccgatgagcaccaggaagccgagaatgcagtcagctccggtaacagggactcaaaagttccctcagagggcaaaaaatccctttatacagatgaatctagtaaacccggcaagaataagagaactgcaataacaacacccaacttcaaaaagctccacgaagcacatttcaaggagatggaaagtatcgatcagtacattgagcggaaaaagaaacattttgaagaacataactcaatgaatgaattaaagcagcagcccatcaataagggaggagtacgcactcctgttccacctagagggcgactgtctgtggccagcactccaatcagccagagacgttcccaggggagatcttgcggccctgcgagccaaagtacgcttggcctgaaaggatccctgaaaaggtcagccatttccgcagccaagaccggggtaagattttccgcagcaactaaggataatgaacataaacgaagtctcactaagactcccgccaggaagtccgctcatgtaactgtatccggggggacgcctaagggggaagctgtgctcggtacccataagctgaagaccattactggtaatagcgcagccgtaattactccctttaaactgaccaccgaagcaacgcagacacctgtgagcaataagaaacccgtctttgatcttaaagcctctctcagtagacccttgaattatgaaccacataagggaaagctcaagccctggggccaatctaaagaaaataattatctgaaccagcacgtgaataggattaatttttataagaaaacctacaaacaaccacaccttcaaacaaaggaagagcaacggaaaaagagggagcaagagcgaaaggagaaaaaggctaaggtactgggtatgcgtcgagggttaatactggcagaagattag

SEQ ID NO: 197869 - DNA, 2250 bp, Artificial Sequence
  Description of Artificial Sequence: Synthetic coding sequence
atggccgccgccggcagccggaagcggcggctggccgagctgaccgtggatgagtttcttgcctcgggcttcgactcggagtcggaatccgagtcagaaaatagcccgcaagctgaaacaagagaagccagagaagctgccaggtccccagataaacctggcggcagtccgtctgcaagcaggaggaagggccgggctagtgagcacaaggatcagctttcacgattgaaagatcgggatccagaattttacaagttcctccaggagaacgatcagtctttgctgaatttttctgatagcgactctagcgaggaagaagaggggccttttcactctttgccggatgtgctcgaagaggcgagcgaggaagaggacggagccgaggagggggaggatggtgaccgcgtcccacgggggctcaagggcaagaaaaattcggtccccgttaccgtcgccatggtggaaaggtggaaacaagctgcaaaacaaaggctgacacctaagctatttcacgaagttgtgcaagccttccgggctgcagtggccacaactcgtggggaccaagagtctgcagaggcaaacaagtttcaagtcactgacagtgctgcatttaacgcactcgtaaccttctgcatccgtgatctgattggatgcctccagaaactgttgttcggaaaggttgccaaggattctagccggatgctgcagccttcaagttctccgctgtggggtaaactgagagtggatattaaagcctacctgggatctgctatacagctggtgtcgtgtctttccgagactactgtgttggccgccgttctgcgccacatcagtgtgctggtgccttgttttctgacatttcccaagcaatgtaggatgctgctgaagaggatggttattgtgtggtccactggtgaggaatccctgcgagtcctcgctttcctggttctgtcccgcgtctgtaggcataagaaggacaccttcctcggccccgtactgaagcaaatgtacattacctacgttagaaactgcaagtttacatcccccggcgccctgcccttcattagctttatgcaatggaccctgactgaactccttgcgttagagcctggagtagcgtaccagcacgcttttctctacatccgtcaacttgccatccatttgcgaaatgccatgactactcggaagaaggagacgtatcagagtgtttataattggcagtacgtccattgcctcttcttgtggtgccgagtgctgtcaaccgcgggcccctccgaagcgctccaaccgcttgtctacccattggctcaggttatcattggctgcatcaagcttatacctacagcccgattttatcccttaagaatgcattgtatccgagccctgactttattgagtggtagtagcggcgcatttattccagtgctgcccttcatcttagagatgtttcagcaggtcgactttaacagaaaacccggaaggatgagttccaagcctattaacttttcagttatcctgaaactctctaacgtgaacctgcaggagaaggcgtatagggacggactggtcgagcagttatacgaccttacccttgaataccttcacagtcaggctcactgtatcgggttccccgaattggtgctaccggttgtcctccagctgaagtccttcttgcgagaatgtaaggtggctaactactgccgccaggtgcagcagttgttgggcaaagttcaggaaaattcggcttacatttgttcacgtaggcagcgtgtcagcttcggtgtaagtgaacagcaggcagtcgaagcttgggagaaactgacccgggaggaaggaactccactgacattgtattacagtcattggcgcaagctgagagacagagagatccagttggaaatctctggcaaagagcgcctggaggatctgaacttccccgaaatcaaacgacggaagatggccgacaggaaggatgaggacaggaagcaatttaaggatctgtttgatctgaacagcagcgaagaagacgacaccgaaggcttctcagagagaggcattttaagacccctcagcacaagacatggggtcgaagacgatgaggaagatgaggaagaaggggaagaggattcatcaaattcagaagacggtgatcctgatgcagaggcaggcctggctccaggcgaattgcagcaactcgcacaaggtccggaggacgagctcgaggaccttcagttgagcgaagatgactag

SEQ ID NO: 197870 - DNA, 2403 bp, Artificial Sequence
  Description of Artificial Sequence: Synthetic coding sequence
atgaagttccggcggaacaagaagcagatccccagcttccggaagctgatcaagacctcaaaagtgaagctggagaataagttaaagaataagcagtttaaacagcaatcaacgctcaaaaagtacaggaaagagcagcggaagttaagacaagcggtcaaggatgctgttagtaaaaagccaatcccattggagaatcctaaagagaagcggcccggcaaaaggatagagcgcgaagaagaggaggaagaggaggctcttccactggatatgatggatgaagatgatctgcagttgatgaaggatctgggccagagggtgagctttctgactcgcgacctgtcatcatccgagccagtacacgctaaaaagcgcaaacatgagcggattatcgacaagtacgaaaagattccacgcactttgcagacagcgcctgaaaaggaactcatccacttgctgcccattaaggataagtccggaattattcctcaaacgagggagaaaccagtaactgattctaataaagacgaagaggatcaggaagaggaacgggaacttgaggaggagataattgaggatccaatccaggagctcaccattgaggagcacttaatcgaacggaagaagaagcttcaagagaaaaaaatgcatatagccgcactggcatctgccatcctaagcgaccctgagaacaacataaaaaagctcaaagagttgcgctcaatgctgatggaacaggatcctgatgtcgccgtcaccgtgagaaagctggtgatcgtttccttaatggagctctttaaagatatcaccccctcttacaaaatcagacccctgactgaggcggagaaatcaacaaagacgcggaaagaaactcagaaactcagggagtttgaggaaggcctggtgagccagtacaaattttacctggagaacctcgagcaaatggtgaaggattggaaacaaaggaagctcaagaaaagcaacgtggtgtccctgaaagcttacaaaggactcgctgaagttgcggtgaagagcctatgcgagctgctcgtcgccctgccgcattttaacttccacaataatattatcgtcctgattgtgccactcatgaatgacatgtctaagcttataagcgaaatgtgctgcgaagcagtcaaaaaattgttcaagcaggataaactgggacaggcttcactgggagtgatcaaagtgatcagcgggtttgttaaggggagaaattacgaagtgcgaccagagatgcttaaaacctttctgtgcctgcgcattaaagaagttgaggtgaagaaggatactgaagacattaacaagcctaagaagtttatgacctttaaagagaaaagaaagtccctttcccggatgcagcggaagtggaagaaagcagaagaaaaactggagcgagagttgagggaagctgaagcgtccgaaagtaccgaaaagaagctcaagctccatacagagacgcttaatatcgtgtttgtgacatatttccgcatactgaagaaggcacagcggagcccccttctgccagccgtgctggaagggctcgcaaaattcgcccatttaatcaacgtggagttctttgatgatttgctggtagtgctgcatacactgattgaatctggggatttaagctatcaggagagccttcattgtgtgcaaaccgcctttcatatcctgtcgggtcagggggatgtgttgaatatcgatcctttgaagttttatacccacctctataagacactgttcaaactccacgccggagctacaaacgaaggcgtggaaattgtgctacaatgtctggatgtaatgcttaccaagcgacggaaacaggtcagtcagcagcgcgcactcgctttcataaagcgcctgtgtactctggcgctgcacgttctgccgaacagctcaattgggatcctggcgacaaccaggattcttatgcataccttcccgaagacagatcttctgctggacagcgagtcccaaggttccggagtgttcctgcctgaactcgatgaacccgagtactgcaatgcacagaacaccgcactgtgggaactccacgccctccggaggcactaccatcctattgtgcagcggttcgcagcccacctgattgcgggtgctccatcagaaggctccggcgcattgaaaccagaactcagcaggagaagtgcgacagaactgttcgaagcttacagtatggctgaaatgacctttaaccctccggttgagtccagcaatccaaagatcaaggggaagtttcttcaaggggactctttcttgaacgaggatctgaaccagctaataaagcggtattcttcggaagtggccaccgaatcacctcttgacttcacaaaatatctgaaaactagcctgcactag

SEQ ID NO: 197871 - DNA, 2403 bp, Artificial Sequence
  Description of Artificial Sequence: Synthetic coding sequence
atgaaggcccggcggaacaagaagcagatccccagcttccggaagctgatcaagacctctaaggttaaactagaaaataagctgaagaataaacagttcaagcagcaatcgaccctaaaaaagtacagaaaagagcagcgcaagttgaggcaagcagtgaaggatgccgtcagcaaaaagcccatccctctcgaaaaccctaaagagaaaaggcccggtaaaaggatcgaacgggaggaggaggaggaggaggaggctctgcctctggatatgatggatgaggacgacctacagctgatgaaagatttaggtcagcgcgtatcattcttaacgagagacctaagttcctcagagccggtgcacgccaagaagcgcaaacatgaacgcatcatcgacaagtacgagaagatcccccgaacactgcaaacggccccagagaaggagctaattcacttgctgcccatcaaggacaagtcgggaattatacctcagactagagaaaaacctgtgaccgattctaacaaggacgaggaggatcaagaagaagaaagagaactcgaggaggaaatcattgaagaccccatccaagagctaaccatcgaggagcacttaattgaacggaaaaaaaagctgcaggaaaagaagatgcacatcgcagctctggctagcgccatcctctcagaccctgagaacaatattaaaaagctgaaggagctgcggagcatgctcatggaacaggatcctgatgtcgccgttaccgtgcgaaaactggtcatcgtttcactgatggagcttttcaaggatattacacccagctataagatcagaccccttacggaagccgagaaatcaactaagacccggaaagagactcagaagctacgggagtttgaagaaggactggtttcacagtataaattctatctggaaaatctggagcagatggttaaggattggaaacagcgcaaattgaagaagtcaaatgtggtgagcctgaaggcttacaaaggcctggcggaggttgccgtgaagagtttgtgcgaattgctcgttgcactgccccacttcaacttccataataacattatagtgctcatagtgccattgatgaatgacatgagcaagctgatctccgaaatgtgttgcgaagccgtgaaaaaacttttcaagcaagacaaactgggccaggccagcctgggagtgattaaggtgatcagtgggttcgtcaagggacgcaattacgaagttcggcctgagatgctgaaaacctttctatgcctcaggataaaggaggtggaggtgaagaaggataccgaggatatcaacaagcccaagaaattcatgacctttaaggaaaagcggaaatcactttctcggatgcagcgcaaatggaaaaaagccgaggagaagctcgaacgcgaactgcgcgaagcggaagctagtgagtcaactgagaagaaacttaaactgcacacggagacgctgaatatagtgttcgtaacttatttcaggattctgaaaaaagcccagcggtccccactgttacccgccgttttggaagggttggctaaattcgctcacctgatcaatgtggaatttttcgatgatctgctagtggtgttgcatactttaattgagtccggcgatctgtcttatcaggaatccctgcattgtgttcagaccgcattccatatccttagtggccagggtgacgtcctaaatatcgaccctctgaaattctatacccacctgtacaagaccctgttcaagcttcatgccggggccacaaacgagggagtggagattgtccttcaatgcctcgacgtcatgctcaccaagcgacggaaacaggtctctcagcagcgggccctagcctttatcaagagattgtgcacccttgcgctgcacgtgctccccaactcctcgattggtattctggcaaccacgagaatccttatgcatacatttcccaagacggatctactgctagattcagagtcccaggggtccggcgtgttcttgcccgaactggatgagccagaatactgtaacgcacagaatacagctctttgggagttacatgccttgcgtagacactaccatcctattgtccaacgctttgcagcacatctcatcgcgggagcaccctctgagggatctggggctttaaagcccgaattgagccggaggagcgctactgaactcttcgaggcctacagtatggcagagatgacattcaaccctccagtggaaagctcgaaccccaagataaagggcaaattcttgcagggagatagttttctgaacgaagatcttaaccaacttattaaaaggtactcaagcgaagttgccactgagtcacccttggacttcactaaatatttgaaaacgtctctccactag

SEQ ID NO: 197872 - DNA, 1506 bp, Artificial Sequence
  Description of Artificial Sequence: Synthetic coding sequence
atggagctgttcaaggacatcacccccagctacaagatccggcccttgaccgaagccgaaaaaagcactaagacaaggaaggagactcagaaattgcgcgagttcgaggagggacttgttagccagtacaaattctacttggaaaacctcgagcagatggtcaaggactggaagcagcggaagctcaaaaaaagcaatgtggtgtccctcaaagcatacaaaggactggctgaggtcgccgtgaaaagcctgtgtgaactcctggttgccctccctcacttcaacttccacaataatattatagtgctgattgtgccattgatgaatgacatgagtaagttaatttctgagatgtgctgcgaggccgtgaaaaagctcttcaagcaggataagctcgggcaggctagtttgggggtgatcaaggtgatcagcggattcgtcaaagggcggaattatgaggtcaggccagaaatgttgaagacattcctttgcctcaggatcaaagaagtcgaggtcaagaaggacactgaggatattaacaagccaaaaaaattcatgacctttaaagagaagcgcaagtctttgtctcggatgcaaagaaagtggaaaaaggcagaagaaaagttggagcgggagctgagagaggcagaagctagtgaaagcacagaaaaaaagctgaaacttcacaccgagaccttgaacatcgtgttcgttacctatttccgcatcctgaaaaaagctcagagaagtcccctgttaccagctgttttagagggcttggccaagtttgcccacctgataaatgtcgagtttttcgacgacctcctcgtcgtcctgcacaccctgatcgaatccggcgatctttcctatcaggagtccttacactgtgtgcagacggcgtttcatattctatccggtcagggtgacgttttgaacatagacccccttaagttctacacccacctttataagacactctttaaactgcacgctggggctaccaatgagggcgttgagatcgttctacagtgtctggacgtgatgcttacgaaaagacgtaagcaggtaagccagcagcgggctttggctttcatcaagcgcctttgtaccctggcccttcatgtcctgcctaactctagtatcggcattttggcaaccactaggattctgatgcacactttcccgaagacagatttactgttagattccgagtcccaggggagcggggtgttcctccccgagctagacgagccggaatactgcaatgcccagaacacagccctctgggaattgcatgctctgcgcagacactatcatccaattgtgcaacgctttgccgcgcacttaattgcaggagcccccagcgaggggtctggcgcactcaaacccgaattgagtcgccgatcagcaactgagctgttcgaggcttactccatggctgagatgacattcaatcccccagtcgagagttccaaccccaaaataaaggtcacaacaaagggttag

SEQ ID NO: 197873 - DNA, 1551 bp, Artificial Sequence
  Description of Artificial Sequence: Synthetic coding sequence
atggagcgggagcccggcgccgccggcgtgcggcgggccctgggccgccgcctggaagcagtcctggcgtcgcgttccgaagccaacgctgtctttgatattctggctgtgttacaatctgaggaccaggaagagatccaggaagccgtacggacctgttcacgacttttcggagccctcctcgagagaggagagttattcgtaggccagttaccctctgaggaaatggtgatgaccggcagccagggcgccacacgcaagtataaggtgtggatgcgtcatagataccatagctgttgcaacagactgggggagttattgggacatccaagtttccaggtcaaagaattggccttgtcagccctgctgaaatttgtgcagctggagggcgcccacccattagaaaagtccaagtgggagggcaactatttattcccccgggaactgtttaagctggtcgtgggcggtttgttatcacccgaggaagaccagtctcttctgctgtctcagttcagagagtacctggactacgatgacacccgctaccacaccatgcaggccgcagtagatgccgtggccagggtcaccggccagcaccccgaggtacctccagcgttctggaataacgcatttacactattatcagccgtttcactccctcgtcgggaacccactgtctccagtttttatgtcaagagagccgagctctgggatacatggaaagtggcacacctgaaggagcatcgcagggtctttcaggccatgtggctgtcctttttaaagcacaaactccctctgtcgctgtataaaaaagtgctcctaatagttcatgacgcaatcttgccacagctcgcccaacctaccctgatgatagactttctgacccgggcttgtgaccttgggggagcgctctctctgctggctctgaatgggctgttcattctgatacacaaacacaacctggagtatcctgatttttataggaagctatacggcctgttggatccaagtgtgtttcacgtgaaatatagggccaggttctttcacttggctgacttatttctttcatcctctcacctcccggcttatctggtagctgcttttgccaaacggctggcacgcctggccctcacggccccacccgaggcgctgctgatggtgctgccattcatttgtaatttactgaggaggcacccagcctgtagggtcctggtgcatcgcccgcatggtcccgagcttgacgccgacccttacgaccctggcgaggaggacccagcccagtctcgggcccttgagagttccttgtgggaactgcaggctctccagaggcattaccatccagaagtgtcaaaggctgcttctgtgattaaccaggccttatcgatgccagaggttagcatcgctcctctgttagaattgactgcttacgaaatttttgagcgggacctgaaaaagaagggccccgagccggtgccactggagttcataccggcccagggcctccttggccgccccggagagctttgtgctcagcatttcaccctgtcatag

SEQ ID NO: 197874 - DNA, 252 bp, Artificial Sequence
  Description of Artificial Sequence: Synthetic coding sequence
tgacccgaggagctgaccttcgccagcgcccaggccgaggcccgggaggaggaacggcgagtaagagaaacagtaagacgggataaaacgctgctgaaggagaagcgcaagaggcgagaggaactctttatcgagcagaagaagcgcaagttgttacccgacaccattttggagaaattgaccacagcctctcagactaatattaaaaagtcccccggaaaggtgaaagaagggatgacaatcttgatatag

SEQ ID NO: 197875 - DNA, 774 bp, Artificial Sequence
  Description of Artificial Sequence: Synthetic coding sequence
atggtgcagctgcggccccgggccagccgggcccccgccagcgccgaggctatggttgacgaagggcagctggccagcgaagaagaagaagccgagcacggtctgctattaggccagccaagttccggagccgctgccgagcctctggaggaggacgaagaaggcgatgacgaatttgatgacgaagccccagaagagttaacgtttgcttccgcccaggcagaggcccgggaggaagaacggcgcgtcagagagaccgtgaggagagataagacgctcctgaaggaaaaaaggaagaggcgcgaggagctcttcattgaacagaagaaacgtaagctactccccgacaccattctggaaaagctgactactgcatctcagacaaacattaaaaaaagcccagggaaagtcaaagaagttaatctccaaaaaaagaatgaggattgcgagaaagggaacgactctaaaaaagtcaaggtgcaaaaggtgcagagcgtgtcgcagaataagagttacctggcagttcgactgaaggatcaggatttacgggattccaggcaacaagctgcgcaagctttcatacacaacagtctctatgggccaggcaccaaccgcacaaccgtcaataagttcctgagcctcgccaacaagaggcttcccgtgaagcgcgccgccgtgcaattcctcaataatgcctggggcatccaaaagaaacaaaacgccaagagattcaagcgacggtggatggttaggaaaatgaagaccaagaagtag

SEQ ID NO: 197876 - DNA, 3300 bp, Artificial Sequence
  Description of Artificial Sequence: Synthetic coding sequence
atgagcgtgctgaacaagaccaagtggaagggcggcaccctgcagatccagctggcaaaagagagctttttgcaccgccttgcacaagaacgagaagccgcaaaagccaagaaagaggagagcacaactgggaacgccaacctcttggagaaaacaggtggcgtcgattttcacatgaaagccgtacccgggacggaagtgcctggacataaaaactgggtcgtcagcaagtttggccgagtcctacccgtactacaccttaagaaccaacacaagcgcaaaataatcaaatacgacccttcaaagtattgtcataatctgaaaaaaatcggggaagactttagtaatacaatccccatctcatccctaacctgggaacttgagggaggcaacgatcccatgtccaaaaaacgccgcggagagttctccgacttccatggtccgccaaaaaagatcatcaaggtgcaaaaagacgagtcgtcaaccggctcattagcaatgagtactagaccaagaagggtcatcgagcgcccccctctgacgcaacagcaggcagcccagaagagaacttgcgattcaataaccccatctaaaagtagtcccgtgcctgtgtcagacactcagaagctaaagaacttgcctttcaagacatcgggccttgagactgctaagaagaggaattcaatcagcgacgacgataccgatagtgaagacgagctgcgaatgatgatcgcaaaagaggaaaatttgcagcgaactacccagccctctatcaatgaaagtgaaagtgacccgtttgaggtggtgcgggacgacttcaagtcaggggtccataagctccactctttaattgggcttgggatcaagaacagagtgtcctgccacgattcggacgacgacatcatgaggaatgatcgagagtacgactcgggagatacagatgagatcatcgctatgaaaaagaacgtagccaaggtcaaaaacagcaccgagttctcccaaatggagaagagtactaagaaaacctctttcaagaacagagagaattgtgagctgtcagaccactgcatcaagctccagaagagaaaatccaacgttgaatcagcgctctcccacggccttaagtctctgaaccgcaaatcaccgtctcactcctcttcgagtgaggacgccgatagtgccagcgaactggctgattcagaggggggcgaggagtacaatgctatgatgaaaaactgtctgagagtcaacctgactctggctgatctagaacagttagccggctccgacctgaaagtcccgaacgaggatacaaaatcagacggtcccgaaacgactacccaatgtaaatttgatcgcgggagtaagagccccaagacccctaccggattgcggcgagggcgacagtgcattcgccccgccgagatagtagcttccttattagagggggaggagaacacatgcggaaaacaaaaaccaaaggagaacaatctgaagcctaagttccaggccttcaaaggcgtggggtgtctttacgaaaaggaaagcatgaaaaaatccttaaaggactcagtggcgtcaaataataaggaccagaactccatgaaacacgaagaccctagtattatctctatggaagacggtagcccttacgtgaacggttctctcggggaagtcactccctgtcagcacgctaaaaaagctaacggccccaattatatccagccccagaagcgccagacaactttcgaaagtcaagaccgtaaagctgtgtctccaagcagtagcgaaaagcgctctaagaatcctatcagtaggccattagaagggaagaagtcactctcactgtccgccaagactcataatatcgggtttgacaaggactcctgtcacagcacgacaaagaccgaagcttcccaggaggagcgctcggattcgagtggactcacatccctgaagaaatctccaaaggtttcctccaaggatacccgagagataaagactgatttctccctctctatctcgaacagttccgacgtgtcggctaaagataagcacgccgaagacaatgaaaagcgactggctgccctggaagccagacaaaaggctaaggaagtgcagaagaaactggtgcacaacgccctggcgaatctggatggccatcccgaagacaaacctacccatattattttcgggtctgattccgaatgcgagaccgaagaaaccagtacccaggagcagagccaccctggcgaggagtgggtgaaagagtcaatgggtaaaacgtctggtaagctctttgacagctcagacgatgacgaatccgattccgaagatgattctaatagattcaaaattaaacctcagttcgaggggagggccggtcaaaaactgatggacctccagagtcatttcggaacagatgacaggtttaggatggacagccgattcctcgagacagacagtgaagaagaacaggaggaagtgaatgaaaagaagaccgccgaggaagaggaacttgcggaggaaaaaaagaaagcactcaacgtggtgcagtccgtgctccaaatcaacctgagtaactcgaccaatcgcgggtcagtagcggctaaaaaattcaaggacatcatccactacgacccgaccaagcaggaccacgctacctatgaacgcaaaagagatgataaacccaaagaaagcaaagctaagagaaagaagaagcgggaggaggctgagaaactcccagaggtcagcaaggagatgtactataatattgctatggacttgaaggagatttttcagacaacaaaatatacgagcgaaaaggaggaagggaccccctggaacgaggattgcggcaaggaaaagccggaagagatacaggatcccgccgcactgacaagtgacgcagagcaacctagtggcttcaccttcagctttttcgactcagacaccaaagacattaaggaggagacatatcgggtcgagactgtcaaacccggcaagattgtgtggcaggaggacccacgtttgcaggacagctctagcgaggaggaggacgttacggaggagactgaccacaggaatagctctccaggggaggcttccttgcttgaaaaggaaaccactcggttcttcttcttttccaaaaacgatgaacggctgcagggcagtgacctcttctggcggggcgttggttccaacatgagccgaaattcttgggaggcccgcacgaccaatttgcgcatggattgtagaaagaagcacaaagacgctaaaagaaagatgaagcccaaatag

SEQ ID NO: 197877 - DNA, 3396 bp, Artificial Sequence
  Description of Artificial Sequence: Synthetic coding sequence
atgaaggtgaaccgggagaccaagcggctgtacgtgggcggcctgagtcaggatatcagcgaggcggatctgcagaaccagttttcaaggttcggggaggtctctgatgtcgaaattatcacacggaaagacgatcaaggtaatcctcagaaagtgttcgcctacatcaacatatctgtagcagaggcagatctgaagaagtgcatgagtgtgctgaacaaaacaaaatggaaaggggggactctacagatccaactggctaaggaatcatttctgcatcggctggcccaggagcgcgaagccgccaaggctaagaaagaggagagtacaacgggaaacgcgaacttgttggagaagaccggcggggtggatttccacatgaaagcagtccccggcaccgaggtgcccggccataaaaattgggtcgtctcgaaatttggccgagtccttcccgtgctccatctgaagaatcagcataagcatctgcgaaacattatcaagtatgatcctagcaaatattgtcataatctaaagaaaatcggggaagacttttccaacaccatccccatctcgagcctaacttgggaactcgaaggcggaaatgacccaatgtccaagaagcgccgcggggagttctccgactttcacggcccacctaagaagatcattaaagtgcagaaagatgagagctccactgggtcacttgctatgtccaccaggcctcgccgcgtgattgagcgcccccctctcacccagcaacaggctgctcagaaaagaacttgcgactccattacgccgtcgaagagctcccctgtccccgtgtccgacacccagaaattgaagaatctgcccttcaagaccagcggtctggagaccgcaaagaagagaaattccatctctgatgatgacactgacagtgaagatgagctgaggatgatgatcgcgaaggaggagaacctgcaacggacaacccagccaagcattaacgagtctgaatcagatccgtttgaagtggttagagatgacttcaaatccggtgttcacaagcttcattccttgattggtctcgggatcaaaaatcgcgtctcatgtcatgatagcgacgatgatataatgcgaaacgatcgcgagtacgacagtggcgataccgacgaaatcattgccatgaaaaaaaatgtggcaaaggtgaagaacagcaccgaattttcccagatggaaaagagcactaaaaaaaccagcttcaaaaaccgggagaactgcgaactgtccgatcactgcattaagctccagaaaaggaaatctaatgtggaatctgccctctcacacggtttaaagtccttaaatcgcaaatcaccttcccactcttcgtcttccgaggacgccgattccgcaagcgaactggccgactccgagggtggcgaagaatacaacgctatgatgaagaattgccttcgggtaaacctgaccctcgccgatctggagcaactcgctggatccgatcttaaggtgccaaatgaggacactaagtccgacggccccgaaactactacccagtgtaaattcgaccgagggagcaagtcacctaaaacaccgacgggcctccgccgcggcagacagtgcatcagaccagctgaaatcgtcgcttctctactcgagggtgaggagaacacgtgtggcaaacagaagccgaaagagaataatctgaaacccaagtttcaggcctttaaaggagtgggatgcttgtacgagaaagaatctatgaagaagtcacttaaggatagtgtagctagcaacaacaaggatcagaactctatgaagcacgaggacccttctatcatctccatggaagatggctctccatatgtcaatggatccctaggagaggtgaccccctgtcagcatgctaaaaaggccaacggacccaactacatccagccacagaagaggcagaccactttcgagagccaagatagaaaggctgtttctccttcttcgtcagaaaaacgctccaaaaatcctatctcacgtccactcgaggggaaaaaatctctcagtctctcagcgaaaacccataacatcgggttcgataaggacagctgccacagtacaactaaaactgaggcttctcaagaagaacgaagtgactcaagcgggctgacctccctgaaaaagtcccctaaggtaagctctaaagacacacgggaaattaagacagatttttctcttagcataagcaatagcagtgatgtgagcgccaaagacaagcacgccgaggacaatgaaaaacggttggccgccttggaagcccgccagaaggctaaggaggtacaaaagaagttagtgcataacgcgttagcaaatctcgaatctatgggcaagaccagcggcaagctgtttgatagttctgacgacgacgagtctgactccgaagatgacagcaatagatttaagataaaaccccaattcgaaggaagggcgggccagaagcttatggaccttcaaagtcactttggcaccgatgaccggtttcggatggatagtcgttttctcgagacagactccgaggaggaacaggaagaagtaaacgaaaagaaaacagccgaagaggaggaattggccgaggagaagaagaaagctctgaacgtcgtccagtctgtgctccaaattaatctctccaatagcaccaatagaggtagtgtggccgctaaaaaattcaaggacatcatccactatgatcctactaaacaggaccacgctacctatgagcgcaaacgggatgacaaacctaaagagtctaaagctaaacgaaagaagaagagagaggaggccgagaaactcccagaggtaagcaaggagatgtactataacatcgcaatggatttgaaagagatcttccagacaacaaaatacacctcagagaaagaggagggaaccccatggaacgaggactgcggtaaagagaagcccgaagagatacaggatcccgctgccctgaccagtgacgctgaacagccatccggttttacattcagtttctttgactcagatacaaaagacataaaggaggaaacttatagggtggagacagtcaagccaggtaagattgtttggcaggaggatccccgcttgcaggactcaagctcagaggaggaagacgtcactgaagaaacagaccacaggaattcaagtccaggggaggcttctctgcttgaaaaggagacaacaaggtttttctttttttccaagaatgacgaacggctgcaaggatccgacctattttggcgcggggtgggcagcaacatgagcaggaactcttgggaagccaggacaacgaatctgaggatggactgccgcaaaaaacacaaggacgcaaagcgcaaaatgaaacctaaatag

SEQ ID NO: 197878 - DNA, 777 bp, Artificial Sequence
  Description of Artificial Sequence: Synthetic coding sequence
atgaaggtgaaccgggagaccaagcggctgtacgtgggcggcctgagccaggacatctccgaagcagacctgcagaatcagttttctcgcttcggggaagttagcgatgtcgaaattatcacaaggaaggatgaccaggggaacccacaaaaggtcttcgcatacataaatatctccgtcgcagaggccgaccttaaaaaatgtatgagcgtgctgaataagaccaagtggaagggagggactctccagattcagctggccaaagagtcttttctccaccgattggcccaggagagggaagctgccaaagccaaaaaggaagaatctacaacaggcaatgctaacttgctggaaaagacaggtggcgtggatttccatatgaaggccgtgccaggaaccgaagtccctggccacaagaactgggtggtaagcaagttcgggcgggtcctccccgtgctccacctcaagaaccagcataagaggaagatcataaagtatgaccccagcaagtactgtcacaacttaaaaaagataggggaggacttctccaacaccatccctattagttctttgacatgggagctggaaggcgggaacgaccccatgtcgaaaaaacggcgcggcgaattttcagacttccatgggccaccaaaaaaaataatcaaagtgcagaaagacgagagcagcactggaagcctggcaatgtcgacgaggccaagacgggttattgaaagaccccccctgacccaacagcaagctgctcaaaagcgtacttag

SEQ ID NO: 197879 - DNA, 2913 bp, Artificial Sequence
  Description of Artificial Sequence: Synthetic coding sequence
atgaaggtgaaccgggagaccaagcggctgtacgtgggcggcctgtctcaggatatctctgaggccgacctacagaatcagtttagtagattcggggaagtgtctgacgtcgaaattattacacggaaggacgatcaaggaaatccccagaaagtattcgcttatattaacatctcagtggcagaggcggatttgaaaaaatgcatgagtgtgttgaataagacgaagtggaaggggggaacactgcagattcagctcgctaaggaatcctttctgcaccgcctagcacaggagagagaagctgcgaaggccaaaaaggaagagtcaacaaccggaaacgccaatttactggaaaagaccgggggagttgacttccacatgaaggcggtacctgggaccgaagtccccggccacaagaactgggtcgtgagtaaattcggccgggtgctccctgtgctccacctcaagaaccagcacaaacggaaaatcattaagtacgacccctccaaatactgccataacttgaagaaaattggcgaagattttagcaacactatcccaattagcagcctaacatgggaactcgaaggaggcaatgaccccatgtctaaaaaaaggagaggtgagttttcagattttcacgggccaccaaagaaaattatcaaggttcagaaagatgagtcctctacaggctccctcgccatgtctactaggccaaggagagttatcgagcgtccaccactgacgcaacaacaagccgcccagaagcgaacctgcgacagcatcaccccgtcaaagtcttcaccggtgccagtgtcggacacccagaagctaaaaaatttgcctttcaaaacatcagggcttgagacagctaagaaacgcaactccatctctgatgatgatactgactctgaagacgagttgcggatgatgatcgcgaaagaagaaaacctacaacggactacccagccctccatcaatgaatctgaatccgatccatttgaggttgtgcgcgatgacttcaagagcggagttcataaactccattccctgatcggcttaggaatcaaaaacagggtctcttgccatgactctgatgacgatataatgcggaatgatcgcgaatacgattctggtgacactgatgagataatcgctatgaagaagaacgtggcaaaggtaaagaacagcacggagtttagccagatggaaaaatcgaccaaaaagaccagcttcaaaaatagggaaaactgcgaattgtccgaccattgcattaagcttcaaaagcgcaagtctaacgtggagagtgccttgtctcatggactaaaatcactcaaccgcaaatctccatcccattcttctagttccgaagatgccgacagtgcctcagaattggccgacagtgaaggtggcgaagagtacaacgccatgatgaaaaactgcctcagagtcaatctcacactggccgatttagagcagttggcaggctcagacctgaaggtcccgaatgaagacacaaagtctgacggacctgaaacgacaacacaatgtaaatttgatagggggagcaagtctcccaagacccccaccggactacgccgcggacgccaatgcattcgccccgcggaaatcgtcgcctcattactggaaggcgaagaaaatacttgtggcaaacagaagcccaaggaaaataatttgaaacccaagtttcaggcttttaagggcgtaggatgcttgtacgaaaaggagtctatgaagaaatcactaaaagatagcgtggccagcaacaacaaagaccaaaactccatgaagcatgaggaccccagcattatctcgatggaggacggttctccatatgtgaatggtagcctgggcgaggtgaccccttgccagcacgcgaagaaagcgaatgggcctaactatatccagccccagaaaagacagactacctttgagagccaggatagaaaggcagtgtcccccagctcctccgagaagagaagtaaaaatcctatctctcggccgctagaaggcaaaaaaagcctctcattgtccgccaagacacataatatcgggtttgacaaggatagctgccactcgacgaccaaaacagaggcttcccaggaggagcggtccgactcatctggcctcactagccttaagaaatccccgaaggtgtctagtaaagacacccgtgaaatcaaaaccgatttcagtttatctatcagtaattcaagcgacgtgtctgccaaggataagcatgctgaggacaatgagaagcggctggctgctttggaagcacgtcagaaggccaaggaagtccagaagaagcttgttcataatgcactggcaaatttggatggacacccagaagataaaccgactcacatcatcttcggaagtgattcagaatgtgaaactgaagagacatccacccaggagcagtcacatccgggcgaagaatgggtgaaagaatccatgggaaagacctccggcaagttgttcgactcttcagacgatgacgagtctgattcggaggacgactcaaaccggtttaagatcaagccccagttcgaaggccgggctggccagaaactgatggatttacagtctcatttcgggaccgacgatagattccgaatggattcccgatttctagagactgactctgaggaggaacaagaggaggtcaacgagaagaaaactgctgaagaggaagagttagctgaagagaagaagaaggctttgaatgtggtccagagtgtgctgcagatcaacctaagtaatagcaccaacaggggcagcgtggctgcaaagaaattcaaagatataatccactacgaccccaccaagcaggatcacgccacttacgagcggaagagggacgacaagcccaaggagagtaaggcctag

SEQ ID NO: 197880 - DNA, 1242 bp, Artificial Sequence
  Description of Artificial Sequence: Synthetic coding sequence
atgaaggtgaaccgggagaccaagcggctgtacgtgggcggcctgtcacaagacatttctgaggccgatctacagaaccagtttagcagattcggtgaagtgtcagatgtggaaataatcacccgaaaggatgatcaggggaatccgcaaaaagtgttcgcttatatcaacatatctgtagccgaagctgacctgaagaaatgtatgtctgtgttaaacaagactaaatggaaaggcgggacccttcaaattcagcttgccaaagaatcattcctgcaccgcctggcacaagagagagaagccgcaaaagctaagaaggaagagagcacgaccggcaacgccaatctgctcgagaaaacaggaggggttgacttccacatgaaagccgtgccagggactgaagtaccaggccacaaaaattgggttgtaagcaaatttgggcgggtgttgcccgtgctgcacctgaagaaccagcacaagaggaagattatcaagtacgaccctagtaagtactgtcacaacctcaagaaaatcggcgaggacttctctaacacaattcctataagctccctcacttgggaattagaggggggcaacgaccccatgagcaaaaagcgaaggggggagttctcagacttccatgggcctcccaagaaaatcatcaaagtgcagaaagacgagagctctactgggtctcttgccatgagcacccgccctcgccgggttattgagaggccaccacttacccagcagcaagccgcgcagaagaggacatgtgattctatcacacccagcaaatcgagccccgttcccgtcagcgatactcagaagctgaaaaacctaccctttaagactagtgggctcgagactgccaagaagcggaatagcattagcgacgacgacaccgactcagaagatgaattgcgcatgatgattgctaaagaagaaaatcttcaacgcacgacgcagccatccattaatgaatctgagtctgatccattcgaggtggtccgggacgacttcaagtccggcgtacacaaactgcacagcctcattggacttggaatcaagaatagggtttcgtgtcatgattcagacgacgatatcatgaggaacgaccgagaatacgacagcggcgacacagacgagatcatagccatgaaaaagaacgttgccaaggtaaaaaacagtactgaatttagccagatggaaaagagcaccaaaaagacatcgtttaagtag

SEQ ID NO: 197881 - DNA, 3504 bp, Artificial Sequence
  Description of Artificial Sequence: Synthetic coding sequence
atgaaggtgaaccgggagaccaagcggctgtacgtgggcggcctgtctcaggacatctcagaagccgaccttcagaatcaatttagccgctttggcgaagtttccgatgtagaaatcatcaccagaaaggatgaccagggaaacccccagaaggtcttcgcgtatatcaatatcagtgtcgccgaagcagatctgaaaaaatgcatgtccgtgttaaacaaaactaagtggaaggggggtaccttgcagatccagctggccaaagagagcttcctgcaccgcctggcccaggagcgtgaagcagcaaaagccaagaaagaggaaagtacaactggcaacgcaaatctactagagaagactggcggggtggacttccacatgaaagcagttcccggcacggaggttcctgggcataaaaattgggtggtatctaagtttggccgagtgttgcctgtgttgcacctcaagaaccagcataaacgaaaaattatcaagtacgacccgtcaaagtactgtcataacctgaaaaagatcggggaggacttttcgaacacaataccaatctcatctctgacatgggaactggaaggcggaaatgacccgatgagtaagaagagacgtggggagttctctgattttcacggccctccaaagaagattattaaggtgcagaaggacgaatcctcaacagggtctctagccatgtctacacggcctcggagggttatcgagaggcccccactgacccaacagcaagctgctcagaagagaacttgcgacagcatcaccccctccaagtcttcaccggttcccgtctctgatacacagaagctgaaaaatctgccattcaaaacttctgggctggaaaccgccaaaaaaaggaatagtatctccgacgacgataccgactccgaagatgagctgagaatgatgatcgctaaggaggaaaacctccagcgtaccacccagccatccatcaacgaaagcgaatccgatcctttcgaagtggtacgcgatgatttcaagtctggtgtccataaactccactctctcataggactggggatcaaaaaccgcgtgagctgccacgattctgatgatgatatcatgcgcaacgacagggagtatgattctggcgacaccgatgaaatcattgccatgaaaaagaatgtagctaaagtgaagaacagcacagagttcagccaaatggaaaaatcaactaagaagacttccttcaagaatagggagaactgcgagttaagtgatcattgcatcaagctacagaagcgaaagtcaaatgtagaaagtgcgctcagccacggattaaagtctctaaaccggaaaagcccctcccatagctcaagctctgaagacgcagactcagcatccgagctggccgactcagaggggggcgaggaatataacgctatgatgaaaaattgcttgcgggtgaacctcacactggctgatttggagcagctggccgggtccgatctgaaagtgccaaacgaagatactaagagcgacggccctgagacaaccactcaatgtaagttcgaccgggggagcaaatctccaaagactccgaccgggctgaggcgcggacgacagtgtatccgtcctgctgaaattgtcgcctcgctcttagaaggtgaagaaaacacctgtggaaagcagaagcccaaggaaaataatctgaagcccaagtttcaggcatttaagggagtcggctgcctctacgagaaggagagcatgaagaaatctctgaaagacagtgtggcttcaaacaacaaagatcaaaatagcatgaaacatgaggacccgtctattatttctatggaggacgggtctccttatgtcaacggctccctaggtgaagttactccatgccaacatgccaagaaagccaacggccccaattacatccagcctcagaaaagacagaccactttcgaatctcaggaccggaaggctgtatccccttcctcgtccgagaaacggtctaagaatccgatttctaggccactcgaagggaagaagtcactgtccctctctgcaaagactcacaacatcgggttcgataaagatagctgccactccactactaagacagaggcttctcaggaggagcgcagtgactcttccggcttaacatccttgaagaagtcgccaaaagtgagtagcaaagacacccgagagattaagaccgatttctccctgtcaatctctaattccagtgatgtcagcgccaaggacaagcacgccgaggataacgaaaagaggttggctgctctcgaggcgcgccagaaagcaaaagaggtccaaaagaaactggtgcacaatgcgctggccaacctggatggtcaccccgaggacaaacctacgcacattatcttcgggtccgattctgagtgcgagacggaggagacaagtacacaggagcagtctcacccaggggaagagtgggtgaaagaaagtatgggtaaaactagtggcaaactgtttgatagcagtgacgatgatgaaagcgattctgaagacgattcaaataggttcaagattaaaccgcagtttgagggtagggctggccagaaactgatggacttgcagagtcatttcgggacagatgaccggtttcgcatggactcacggttccttgagaccgattccgaggaggaacaggaggaagtcaacgagaagaagaccgcggaggaggaggagctggcagaggagaagaaaaaggccctcaatgtggtgcaatctgtcctgcagatcaatctgtccaattccaccaaccggggatctgtggctgccaagaagtttaaagatatcatccattacgacccaaccaagcaggaccacgcaacctacgaacggaagcgcgacgacaaacccaaagagagcaaagcaaagagaaaaaaaaagagagaggaggcggaaaaactccccgaagtcagtaaagagatgtattacaacattgcaatggatcttaaggagatcttccaaaccaccaagtatacatcggagaaagaagaggggaccccctggaatgaggattgcggcaaagaaaaacccgaagagattcaggaccccgctgctttgacatccgacgcagagcagcccagtggatttaccttcagtttctttgatagcgacaccaaggacattaaggaagagacttaccgagttgaaacggtcaagccaggcaagattgtctggcaagaagatccgcgcctgcaggactcctctagtgaagaggaggacgttacagaagagacagaccatcggaattcaagtccaggagaggccagtctgctggagaaggagacaacaagattcttctttttctccaaaaatgacgagcggcttcaggggtctgacctcttttggcggggggtggggtcgaacatgtcaagaaattcctgggaagcaagaacaacaaacctgcgaatggactgtcggaaaaagcacaaagatgcgaagagaaagatgaagccgaagtag

SEQ ID NO: 197882 - DNA, 438 bp, Artificial Sequence
  Description of Artificial Sequence: Synthetic coding sequence
atgaaggtgaaccgggagaccaagcggctgtacgtgggcggcctgagccaggacatatccgaggcagacctgcagaatcagttttccagattcggggaagtttccgatgtcgagatcatcacccgcaaggatgaccaggggaatccgcagaaagtgttcgcatatattaacatcagcgtggccgaggctgatctaaagaagtgtatgtctgtgctcaataaaacaaaatggaagggtggtacgctgcaaattcagttggccaaggagtcttttttgcaccgattagctcaggaaagggaagcggccaaggctaaaaaagaggagtcgacgacagggaacgccaatctgctggagaagacgggcggcgtagacttccatatgaaggccgtgccaggtacggaggtgccagggcataagaattgggtagtttctaagtag

SEQ ID NO: 197883 - DNA, 3504 bp, Artificial Sequence
  Description of Artificial Sequence: Synthetic coding sequence
atgaaggtgaaccgggagaccaagcggctgtacgtgggcggcctgtctcaggacatttctgaggccgacctccagaaccagttcagccgtttcggcgaggttagcgacgtagagatcatcacaagaaaagacgaccaagggaacccacagaaggtattcgcatatattaatatcagtgtggcagaagccgatctgaagaagtgtatgagcgtgcttaacaagaccaaatggaaggggggcaccctacagatccagctggcgaaggaaagcttcctccaccggctggcacaagagagagaagcggcaaaagctaagaaggaggagtccacaacaggcaatgctaacttattagagaagactggaggcgtggattttcacatgaaagccgtgccaggcaccgaagtaccaggccacaagaactgggtggtatcgaagttcgggagggtcctgcctgttctgcaccttaagaatcagcacaaaagaaaaataatcaagtatgatccatccaagtactgtcacaatctgaaaaagataggcgaggacttctccaataccatccctatcagcagcctaacatgggaactggaggggggaaatgaccctatgagcaagaaacggaggggagagttttcggatttccacggaccacccaaaaagatcattaaagttcagaaggacgagagttcaactggctctttagccatgagtacccgacccagacgggtcatcgagcgcccaccactaacccaacagcaggcagcccagaaacggacctgcgattctattaccccgtcaaagagctctccggtacctgtgtccgacactcagaagctgaaaaacttacccttcaagacaagcggactggagacggcaaagaaacgcaactcgatcagcgatgacgatactgattccgaagacgaactgcggatgatgatcgcaaaggaagaaaacttgcaaaggacgacccagccaagtatcaacgagtccgagtcagacccctttgaggtcgttagagatgatttcaagtctggggtgcataaactgcacagcctcatcggtcttggcatcaagaatagagtcagctgtcacgactcggatgacgatattatgaggaatgatcgagaatacgactcgggcgatacggatgaaatcattgccatgaaaaagaatgtggcaaaggttaagaacagcaccgagttcagccaaatggaaaaatcaacgaagaaaacatccttcaaaaatcgcgagaattgtgaattatccgaccactgcattaaactccagaagcgaaaatctaatgttgaatccgctttgagtcatggcctcaaaagtctgaatagaaagagcccctcgcatagttcctcatcagaggatgcagactccgcttcagaactggccgattccgaaggtggtgaggagtacaatgcaatgatgaagaattgtttaagagtaaatctgacactggctgacctggagcaacttgcggggtctgatctgaaagtccctaatgaggacactaaatccgatggtcccgagactaccactcaatgcaagttcgaccggggctctaaatcgcctaaaactcccaccggcttgagaaggggccgacagtgtatcagaccagctgagatcgttgcctccctgttagagggtgaggaaaacacgtgtggcaaacagaaaccgaaggagaataacctcaaacctaaatttcaggccttcaaaggagtgggatgcctatacgaaaaggaaagtatgaagaaatctctgaaggacagcgtggcaagtaataataaagatcagaactctatgaaacacgaggaccccagtatcatttcaatggaggatgggtctccttacgtgaatggatccttaggggaagtgactccctgtcagcacgccaagaaggcaaacgggcccaattatatacagcctcagaagcgacagaccacgtttgagtcccaggataggaaagcggtgtctccttcttcttcagaaaagagatctaaaaaccctatctctaggccgctggaggggaagaagtctctctcccttagcgccaaaacccataatattggtttcgataaggactcatgccattcaaccaccaaaaccgaggctagccaggaagagcggtccgactctagcgggctgacttctttgaagaagtcaccaaaggtgtctagtaaagacacaagggaaatcaagaccgattttagcctctctatctccaattccagcgacgtgtctgctaaggataaacatgcagaagacaacgaaaagaggttagctgctctcgaggcccggcagaaagctaaggaagtccagaaaaagctggtgcacaacgcgctggccaacctggacggtcatcctgaggacaaaccaactcatatcatctttgggtctgactctgagtgcgaaactgaggagacttccacccaggaacagagtcatccaggcgaagaatgggtgaaggagtccatgggtaagacaagcgggaagttgtttgactcttccgacgacgatgaatcagattcagaggacgattctaaccgtttcaagatcaaacctcagtttgagggccgggctggtcaaaaattgatggatctgcaatcacacttcggtactgatgacaggtttcgtatggactcaaggttcctcgaaacggatagcgaagaggaacaggaagaggtgaatgagaagaaaaccgccgaggaggaggaacttgccgaggagaaaaaaaaggcgcttaacgtggtacagtctgtcctacagatcaacctttcaaattctacaaaccgaggatcagtggcagctaagaaattcaaggacattatccactatgatcccacaaagcaggatcacgccacttatgagcggaagcgcgatgataagccaaaggaatcgaaggctaagcggaaaaagaagcgcgaagaagcagagaaactgccagaagtgagcaaagaaatgtactataacatcgccatggacctcaaggagatttttcagactactaagtacacatctgaaaaggaggaaggtaccccttggaatgaggactgcggcaaagagaaacccgaagagattcaggatccagctgctctaacgtcggacgctgagcaacctagcggatttacattttctttcttcgactcggacactaaagacatcaaggaggaaacttacagagtggagacagtcaaacctgggaagatagtgtggcaagaggaccctagattacaggactccagttctgaagaagaagacgtgacagaagaaaccgatcacaggaattctagccccggggaagcctccctgctagagaaagaaacaacccgcttctttttcttcagtaaaaatgatgaaaggctccagggaagtgatctcttctggaggggcgtgggcagcaatatgtcccgcaattcttgggaggctagaacaactaatctgcggatggactgccgtaaaaagcacaaggatgcaaagcggaaaatgaaacccaagtag

SEQ ID NO: 197884 - DNA, 261 bp, Artificial Sequence
  Description of Artificial Sequence: Synthetic coding sequence
atgaaggtgaaccgggagaccaagcggctgtacgtgggcggcctgagccaggacattagtgaggcagacttgcagaaccaattctcaaggttcggagaggtgtccgacgtagagatcattactcggaaggacgaccagggcaacccgcagaaggtttttgcatatatcaatattagcgtggcagaggctgatctaaaaaagagcatttttcatgtcattcagcgggattcaagtgacgaagagaacagttctattgtgtag

SEQ ID NO: 197885 - DNA, 3441 bp, Artificial Sequence
  Description of Artificial Sequence: Synthetic coding sequence
atgggccccgcccccgccggcgagcagctgcggggcgccaccggcgaaccagaggtgatggaacccgccctggagggtactggcaaagagggcaaaaaggcatcctcaagaaaacgaaccctggccgaacccccagccaagggtctccttcagccagttaaactgtcgcgggccgaactgtacaaagagcccacaaacgaggagctgaacagactgagagagacagaaatcctttttcactcatcccttctcagactgcaggtggaagagttacttaaggaagtacgtctgtccgaaaaaaagaaagataggatcgacgctttcctgagggaggtgaatcagagggttgttcgggtacccagtgtgcccgaaacagagctcacagaccaggcttggttacccgctggtgtgcgtgtgcctcttcaccaggtgccatacgccgtgaaggggtgctttcgattcttacctcccgcgcaagtaactgttgtgggatcttatctgctagggacttgtattaggcccgacattaatgtagacgtagcactgactatgccccgcgagattttgcaggacaaggatggattgaatcaacggtatttcaggaagagggctttgtatctggcccacctcgcgcatcacctggctcaggatcctctttttggctctgtttgtttctcctacacgaacggttgccatttgaagccttccctgttactcagaccacgcggaaaggatgagcgcctggttacagtgcggcttcacccttgccctccacccgatttctttcggccttgtcggctcctccctacgaagaataatgtccgcagtgcctggtatcggggccagtctcctgcgggcgatgggtcccccgagcctcctacacctcggtacaacacctgggttctccaggatacagtcctcgagagccacctccagctgttatctactatcttgtcttcggctcagggcttgaaagatggggtggctttgctgaaggtctggctacgtcaacgcgaactggataaagggcaaggtggtttcaccgggttcctcgtctctatgttagtagtgtttctggtctccaccagaaagatacatacgactatgtccggttatcaggttttgaggagcgtcttacagtttcttgccacgactgacttgaccgtgaacggcataagtctttgcttgagctccgatcccagcctgccggctctggcggattttcaccaggcattctcggtagtctttctagactcttctggtcatctgaatttatgcgccgacgttaccgccagcacatatcaccaggtgcagcacgaggctcgcctgagtatgatgctattagacagtagggctgacgatggctttcatctacttctgatgaccccgaagcctatgattagggctttcgaccacgtgcttcatctgcgacctttaagccgtctgcaggccgcttgccatcgcctaaagctttggcccgagctgcaggacaatggtggcgactatgtgagcgcggcgcttggccctcttaccacccttctggaacagggactaggcgctaggctgaaccttctggcccacagtagacctcctgttccggaatgggacatcagtcaggatccccccaagcacaaggatagcggtacattaactttggggcttctcctgaggcctgagggtcttacttccgtgctggaactaggcccagaggcggaccagccagaagctgccaagttccggcagttttggggaagtcggtccgagctgagacgctttcaggacggagccatcagggaagccgttgtctgggaagccgccagcatgagccagaaacgtttaattccccaccaagtagttacgcatctgctggccttgcacgccgatatccccgagacctgcgtgcactacgtgggcggacccctcgatgccctgatccaggggctgaaagagacctcctcaactggcgaagaagcattagtggcagctgttagatgctatgacgatttgtcccgtctcctctggggcttagaaggcctgccccttaccgtcagcgcagtccagggagcacatcccgtgttgaggtacaccgaagttttccctccgacccctgtgcggccagcattcagcttctatgagactctgcgagaacggagctccctcctacctcggttggataagccttgtccggcatacgtagaaccaatgactgtggtctgtcaccttgagggcagcggacagtggcctcaggacgcagaagcggttcagcgtgtgcgagccgcctttcagctgcgattggccgagctcctgacacaacagcatggcctgcaatgcagagctactgccacccataccgacgtcctgaaagatggcttcgttttccggatccgtgttgcctaccagcgggagcctcagattttgaaagaggtgcagagtcccgaggggatgatcagcctgagggacacggccgcatcccttaggctggagcgggataccagacaactaccgctgttaaccagtgccctgcatggactccagcagcagcatccagcattctctggcgttgcccgcctggccaagcggtgggttcgggctcagctgctcggcgagggattcgccgatgagagcctcgatttggtcgcagccgccctttttttgcaccctgagccttttacccctccttctagtccccaagttggcttcctaaggttcctgttcctggtgtctacgttcgattggaaaaacaatccactcttcgtgaatctgaacaacgagctaactgtagaagagcaggtggaaattagaagtgggttcctcgccgctcgggcccagctgccggtcatggttatcgtcacaccccaggaccggaagaacagcgtttggacccaggacggacctagcgcgcagatactccagcagctcgtagtgctcgcagcagaggcattgcctatgctcgaaaagcagctaatggatccacgtgggcctggagatatcagaacagtattcagaccgcccctggatatttacgacgtgctgatcagattgagccctcggcatatcccacgacatagacaggccgtcgatagtcccgccgcttcattctgcagaggtttattgagccagccagggcctagttcccttatgccagttttgggatatgaccccccacaactgtacctgacacagctgagggaggctttcggggacctggccttgtttttttatgaccagcacggcggggaagtgatcggagtattgtggaagccgacaagctttcagcctcagccatttaaggcttcctccaccaaaggacgaatggtaatgtctcgcggcggcgagttggttatggtgcctaatgtcgaagcaatcttggaagattttgctgttctcggcgaaggactggtacagaccgtggaggcccgaagcgagaggtggactgtgtag

SEQ ID NO: 197886 - DNA, 3024 bp, Artificial Sequence
  Description of Artificial Sequence: Synthetic coding sequence
atgggccccgcccccgccggcgagcagctgcggggcgccaccggcgagcccgaagtaatggaacctgcccttgaaggtacaggaaaggaaggtaagaaagcctcaagccgcaagcgcaccttagccgagccgcctgctaagggacttttgcagcccgtgaaactgtcccgagcagagttatataaggaacccacaaatgaagaactcaataggctgagggagaccgagattttgtttcacagctcgctgctcagactgcaggtggaggagctactgaaggaagtgcgactgagcgagaagaagaaggatcgaatcgacgcatttcttagagaggtgaaccaaagggtggtgcgagttccctctgtgcctgaaaccgaactgactgatcaggcatggctgccagctggcgtgagagtgcccctgcaccaggtaccatacgcagttaagggctgcttccgattcttgccgcccgcccaggtgaccgtggtgggatcctatctattagggacctgcatccggccagatataaacgttgatgtggccctgactatgccgcgggagattctccaggataaggatgggctcaatcagcgttatttcagaaagcgggcactctacctggcacacttagcacatcacctggcgcaagacccacttttcggctccgtttgctttagttacaccaatggctgtcacttgaagccaagcctcttgctgcgaccgcggggcaaggatgagagactcgtgaccgtgcgactgcatccatgcccgcccccggacttctttcgcccgtgccgactgttgcctacgaagaacaacgtgcggtcggcctggtaccgagggcagagcccagccggcgatggatcccccgagccccccaccccccgctacaacacctgggtgcttcaagacactgttctggagagccacctgcagctgttgtccactatcctgagctccgcacaaggcctgaaggacggcgttgcccttctgaaagtatggctgaggcagagggagctggataaggggcagggcggttttacgggtttccttgtgagcatgctggttgtgttccttgtaagcactaggaagatccacaccacgatgagcgggtatcaggttctgcgcagcgtgttgcagttcctggccacgaccgacttgaccgtaaatggcatctccctatgtctcagttcggatccatcacttcctgcgctggcagacttccaccaagccttttctgttgtgtttttagattcctcaggccacctgaatctgtgtgccgatgtgaccgcctccacataccatcaggtccagcacgaggcccgactgtctatgatgctgctcgactcccgcgccgacgacgggtttcacctgctcctcatgacacctaagcccatgatcagagcatttgaccatgtgcttcacctccggccgttgtctcgcttgcaggctgcctgccatcgtttgaagctctggcccgaactccaggataatggtggcgactacgtgtcggctgccttgggtcccctcaccaccctgctggagcagggactcggagctcgcctgaacctcctagcacattcccgccctcctgtcccagagtgggatatctcacaggatccacctaaacataaggatagtggcaccttgacactcggcctgctcctgagaccagaaggcctaacgagtgtccttgagctgggacccgaagccgatcagcccgaagctgccaagtttcgacagttctggggcagccgcagtgagctgcggaggttccaagacggtgccataagggaagccgtagtctgggaagctgctagcatgtcacaaaaacgcctgataccacatcaggtggtcacccacttgcttgccttacacgccgacattcccgagacgtgtgttcattacgtgggcgggccgctcgatgccctgatccaaggtctgaaagagactagtagcacaggagaggaagccctcgtggccgctgtgcgctgttacgatgacctctctcgcctcctctggggtctagaaggactgccgctgaccgtctccgccgttcagggagctcatccggttctcagatacacagaagttttcccccccactcccgttagacccgccttcagcttctatgagacgctcagagagaggtccagtcttctgccacgcctcgacaaaccgtgtccagcctacgtagagcccatgacagttgtatgccacctggaggggagtggtcagtggccccaggatgctgaggccgtgcagcgggtgcgagcagctttccaactgcgcttagccgagctgctaacccagcagcacggcctccaatgtcgggcaacagccacgcacaccgacgtgctgaaggatggtttcgtgtttagaattcgagttgcctatcagagggagcctcaaatcttaaaggaggttcagagccctgaagggatgatcagcctgcgagacacggccgcgtccttacggctggaaagagataccaggcagctgccgcttctgacctccgccctgcacggtctgcaacagcagcatccggctttctctggcgtggccagactagcgaaaagatgggtcagagcgcagcttctgggggaaggtttcgctgacgaatcgctggatctggttgctgctgcacttttcctccaccccgaaccgtttactcctccttccagcccccaagtgggatttctcagattcctgtttctggttagtactttcgactggaaaaataaccccctcttcgtgaacctgaataatgagctgacagtggaggagcaagtggagattagatccgggtttctggctgcaagggcccagctgccagtcatggtgatcgtgactcctcaagatagaaagaactccgtgtggacccaagatggtccaagcgcacagattctgcaacaactggtagtcctcgcagcggaggctctgcctatgctagagaaacagctcatggatccccgcggtcccggagacatccggtgggacccagccaaaatgtggcccttctag

SEQ ID NO: 197887 - DNA, 2100 bp, Artificial Sequence
  Description of Artificial Sequence: Synthetic coding sequence
atgggccccgcccccgccggcgagcagctgcggggcgccaccggcgaaccggaagtgatggagcctgctctggagggaacaggaaaagaggggaagaaagcatcgagccgcaaaagaaccttggccgaaccacccgctaagggactgctgcagcccgtgaagctctctcgggcggaactttataaagagcctaccaatgaggaactgaaccgcctgagggagacggaaatactttttcactcgtcccttctgagactgcaggtggaagaactgctgaaagaggttcggttgagcgagaagaagaaggatcgaatagatgccttcctgcgggaggtgaatcagagagtcgtgcgcgtgcccagtgttcctgagactgagttgactgaccaagcttggcttcctgctggcgtgcgtgtgcctctccaccaggtgccctatgctgttaaggggtgctttaggttcctccctcctgcccaagtaacggtcgtcggaagctatttattgggcacctgtatccgacccgacattaacgtagacgttgccttgactatgcctcgcgagatcctccaggacaaggatggattgaaccagcgctatttccggaagagggctctgtatctagcgcacctggctcaccacttggcccaggatcctctgtttggatctgtgtgttttagctacacgaacggctgtcacctgaagccgagtctgctgctgaggccgaggggcaaggacgagcgccttgttaccgtaagattacatccttgccctccccccgacttttttagaccgtgcagattgctgcccactaaaaacaatgttaggtctgcatggtaccgtgggcagagtcccgccggagacggcagcccagaaccgcctactccccgttataacacctgggtgctgcaggacacagttctggagtcgcatctgcagctgttgtctacgatcctgagctccgcccagggtctcaaagacggtgtagctcttctcaaagtgtggctgaggcagagggagttggataaaggccaaggggggttcaccggcttcttggttagcatgttggtggtctttctggtgagcacccgcaaaatccacacaaccatgtccgggtaccaggtgctccgcagtgtccttcaattcttggccaccacggaccttaccgtgaatgggatctcattatgcttaagctcagacccaagtttgccggcactcgccgattttcatcaggcgttcagcgtggtgtttcttgactcgagcgggcacttgaatctatgtgcagatgtaaccgcaagcacctatcaccaagttcagcacgaggcaaggctttcgatgatgcttcttgactcccgagcggacgacgggttccaccttctgcttatgacacctaaacctatgatacgcgcttttgatcacgtgcttcatctgaggcccctgtctaggttgcaagcggcttgccacagactcaaactgtggccagagctccaggacaacggcggcgactatgtgtctgcggccttgggccccttgactacactattggagcagggcttgggtgcacgcctaaatttacttgcccactcacgcccaccggtgccagaatgggatatctcgcaggatccacccaaacacaaggattctgggaccttaaccctcggcctgctgctgaggcccgaagggttgacatcagttttagagctcggtcccgaggcagaccagccagaggccgccaagttccgacagttttggggctcacgcagcgagctgaggcgttttcaggatggagccatcagggaagcggtggtctgggaggccgcttccatgagccagaagagactgataccccaccaagtagttacccaccttctggctttacacgccgatatccccgagacttgcgtacactatgtgggaggaccactcgacgctttaatccagggtttaaaggaggcctcttccaccaagggccggatggttatgagtcggggcggtgaactcgtgatggtccctaacgtagaggctatcctcgaggactttgcagtgctaggggagggtttggtgcagaccgtggaagccaggtccgagcggtggactgtgtag

SEQ ID NO: 197888 - DNA, 603 bp, Artificial Sequence
  Description of Artificial Sequence: Synthetic coding sequence
atggtgatcgtgaccccccaggaccggaagaacagcgtgtggacccaagacggcccatcagcccagatcctgcagcagctggtcgtccttgctgccgaggccctgccaatgctcgagaagcagctgatggacccgcgaggccctggcgacatcagaacagtcttccggccaccactggatatatacgacgtgctgatacgattgtcacccaggcatatcccccgacatagacaggcagtagactcccctgcggcttctttttgcagggggctgttatcacagcccggaccatcaagcctgatgcccgtgcttgggtatgatccaccacaactgtacctgacccagctgcgtgaggccttcggggacctggctctgttcttctacgatcagcatggaggggaggttatcggagttctgtggaaaccgacgagtttccagcctcaaccattcaaggcaagtagcaccaagggccgcatggtcatgtcgagagggggcgagctggtgatggtgcctaatgtagaagcgatcttagaagactttgctgtattgggcgaaggcctggtacaaaccgtcgaagcccggtccgaacgatggaccgtatag

SEQ ID NO: 197889 - DNA, 3072 bp, Artificial Sequence
  Description of Artificial Sequence: Synthetic coding sequence
atgggccccgcccccgccggcgagcagctgcggggcgccaccggcgaaccagaggtgatggagcctgccttggagggtacaggaaaggagggtaagaaagctagctcccgcaagcgcactctcgcggagccacctgccaagggccttctccagcccgtgaagctgtcccgggcagagctttataaagagcccactaacgaggagctgaatcgattgagagagactgaaatactgtttcattcctctctgcttcgactccaggttgaagagctgctgaaagaggttaggctatctgaaaagaaaaaggataggattgacgcctttttgcgggaggttaatcagcgggtcgtccgagtgcccagcgtgccagagacagaactgacagatcaggcctggctccccgctggggtccgagtccccctacaccaggtgccgtatgccgttaaaggttgctttcgattcctgccacctgcccaggtgacagtagtagggtcttacctcttgggcacatgcattcgcccagatatcaacgtggacgtggccctaaccatgccccgcgagatcctgcaggataaagacggcctcaaccagcgatacttccgaaagagagccctctatctggcccatttggcacatcatttggctcaggaccccctattcggatctgtttgtttcagctacacaaatggatgccacttgaaacccagcctactcctgcggccaagggggaaggatgaaaggctggtcaccgtgaggctccacccttgtcccccaccagatttcttccgcccttgccggctgttgcccactaaaaataacgtcagatctgcttggtatagggggcagtcccccgccggggatggttcaccggaacctcctacgccacggtataacacctgggtgctgcaggacacagtgctggaatcccacctccagttattgtccaccattctatcttcagcccaggggttgaaggatggcgtggcactgcttaaggtatggctacgccagcgggaattggataagggtcagggtggttttactgggtttctggtaagcatgttggtggtgtttctagtctctactaggaagattcatacaacgatgtcaggttaccaggtactgcgaagcgttctccaattcctagcaacaaccgacctgacagtcaacggcatcagtctgtgcctcagctcagatccaagcttgcctgcattggccgacttccatcaagcattttccgtggtatttttagactcctctgggcacctgaacctttgcgccgacgtaacagcttcaacgtatcaccaagtgcagcatgaagcgagacttagcatgatgctgctagactcacgagcagatgatggattccaccttctccttatgaccccaaagccaatgatccgggctttcgaccacgtgctccacttacgtccactgtccaggctgcaagcagcctgtcacaggctgaaactctggcccgaattgcaggataacggtggtgattacgtgtcagcagccctgggtcccttgaccaccttgctcgagcagggcctcggtgctcgcctgaaccttttggcccactcccgacccccggtgcccgaatgggacatcagtcaggatccacctaagcataaagacagtggcaccctgactctgggtctgctactgagaccggaaggactcacctctgtgctagaacttgggccggaggctgaccaacccgaggccgcaaaatttcgtcagttttggggatcacggagcgagttacgtcgctttcaggacggggcaatccgcgaggctgtagtatgggaagccgcctccatgtcacagaaaaggctcattccacaccaagtggtcactcatctattagcccttcacgccgatatcccagagacctgtgtgcactatgtcggagggccactggacgctctgatccagggcctcaaggagacgagttctactggcgaagaggccttagttgcggctgttagatgctatgatgatttgtctcgcttgctgtggggattagaggggctacccctcactgtaagcgccgtccaaggcgctcacccagttctgcggtacacagaagtgtttcccccaaccccggtaaggccagccttttcgttttatgaaacattgagggaacgctctagccttctgccccgcctcgacaaaccatgccctgcatacgtggagcccatgactgtagtctgccatctggaaggatctggtcaatggcctcaggatgcggaggctgtccagagggtccgtgcagcgttccagcttagactcgccgaactcttgacgcaacagcatggcctacagtgccgtgcaactgccacccacactgatgtgctcaaggacggcttcgtatttcggattagggtggcataccagagggagccgcagatcctgaaggaggttcagagcccagaaggcatgataagtcttcgagataccgccgcaagcctccggctggagagggataccagacagctgcctctgctcacgagtgccctgcacgggctgcaacagcagcacccagcattctccggtgtagcaagactggcgaaacgatgggtgagagctcagctgctaggcgaaggctttgcggacgagtcgctcgatctcgtcgcggccgcccttttcctccacccagagccatttacacccccaagtagcccccaagtaggattcctgcgatttctgttcctagttagcaccttcgattggaagaacaacccattgttcgttaacctaaataacgaacttacagtcgaggagcaggtggagattcggagcggcttcctggcggcaagagcacaactgcccgttatggtcatcgtcactccacaggaccgtaaaaatagcgtgtggacacaggatggcccttccgcccagattcttcagcagctggttgttctagcagccgaggcgttgccaatgctcgaaaagcagctaatggatccccgggggccaggagatattaggatgggaccctcagaaaatgttgctttactctctcatataactgataccgaacagtggaaaggggccatctgtgtatag

SEQ ID NO: 197890 - DNA, 3285 bp, Artificial Sequence
  Description of Artificial Sequence: Synthetic coding sequence
atgggccccgcccccgccggcgagcagctgcggggcgccaccggcgaacccgaggtcatggaacccgctctcgaaggaaccggcaaggagggcaagaaagctagctcacgtaaaagaaccctggctgagcccccagccaaagggctactgcagccagtgaaactatcacgggccgagctctacaaagaacccacaaatgaggagcttaatcggcttagggaaaccgaaatcttattccacagctccctactgcgtctccaggtggaagaattgctgaaagaggtgagactgagcgagaagaagaaggacaggatagacgcattcctcagggaggtcaatcaacgtgtagtcagggtcccctccgtaccggagactgaggagattttacaggataaagatggattgaatcagagatactttagaaaaagggctctgtacctcgcacacctggcgcatcacctggcccaggaccccctgtttggatctgtgtgtttctcgtacaccaatggctgtcacctgaaaccatccttactgctccgacctagaggcaaggacgagcgcctggttactgtccggctgcacccctgtccgccccctgatttcttccgcccttgtcggctacttccgacgaagaacaatgtgagaagtgcttggtatcggggccaatccccagcaggggatggatccccagagccccctaccccacggtacaacacatgggtcctgcaagataccgtcctagaaagccatctccaacttttaagcactatcctgagttctgcgcagggacttaaagacggcgttgccctgctgaaggtgtggctgagacaaagagaactggacaaagggcagggcggtttcaccggatttttggttagcatgttagtggtgtttctggtctcgaccaggaagatccacacaacaatgagcgggtaccaggtgcttcgtagtgtcctgcagtttctcgcaaccacagacttgaccgtgaatggcattagcctgtgcctgagcagtgacccctcactccccgctcttgccgatttccatcaggcgttcagcgtcgttttcttagattcgagcggccacctgaacctctgcgctgacgtgacagccagtacatatcatcagggatggtcccttctgtggctgcaggtccagcacgaggctcgcttgtccatgatgctgttagacagcagagcagacgatggattccacttgttattaatgactcccaaaccaatgattcgagcctttgatcatgtactgcaccttaggcccttgagtaggttgcaagcggcctgccatcgattgaaactttggccagagctgcaggataatgggggcgattatgtatccgctgccctcggccctctaacgacacttctggagcaagggctgggtgccaggctgaatctgctcgctcactcacgaccgcctgtgccagagtgggatatttctcaggatcctcctaagcacaaagactccggcacactcacactcggcctgctgctccgcccagagggactgactagcgtgttagaactgggacctgaggccgatcaaccagaggcagctaagtttaggcaattctggggctcccgctctgagctccggcgctttcaggatggcgctattagggaggcagttgtgtgggaagcagccagtatgtcacaaaagaggctaatcccccaccaagtcgtcacacacctcctcgctctgcacgcggacatccctgagacctgtgtgcactacgtcgggggccctctggacgccttgatccagggtctgaaggaaacgtccagcacaggagaggaagcgctggttgctgcagtgaggtgctacgacgacctgagccgactcctttggggcctagagggcctcccattgaccgtaagtgccgtccaaggcgcccatccagtgttacgctataccgaagtctttcctcctacaccagtcagacctgccttcagtttctatgagactctgagagagaggtctagcctactccccaggttggataagccatgcccagcttacgtggagcctatgaccgtcgtctgccaccttgagggttcaggccagtggcctcaggatgccgaggctgtgcagagagtgcgcgccgccttccaattgcgcctcgccgagctgcttacacagcaacacggactgcagtgtagggccaccgctacacacactgacgtgctgaaagatgggttcgtgtttagaatccgagtggcctatcagagggagccccagattctgaaggaagtacaatcgcctgaagggatgattagtctcagagatactgccgccagtcttcgtctggaacgtgatactagacagcttccactactcacaagcgcgttacacggattacagcagcagcaccccgcctttagtggggtggcacgtctggctaaacgttgggtaagagcccagctcttaggtgaaggcttcgctgatgaaagcctggacttggtggctgctgccctgttcctgcacccagaacctttcactcctccttcttcaccgcaggtgggttttctgaggtttttgttcctggtatccaccttcgattggaaaaataatccgctcttcgttaaccttaataacgagttaacggtcgaggaacaagtcgagatcagatcgggctttctagccgcccgagcccagctcccagtgatggttattgtgactccccaggataggaaaaacagcgtgtggacccaggacggcccctctgcccagatcctgcagcagctcgtggtcctagcagccgaggctctaccaatgctggagaagcagttgatggatccacggggtcctggagacatcagaacagttttcagaccaccactcgatatctatgatgtcttgattagactgagccctcgccatattccaagacatcggcaggccgttgacagtccggccgcttccttctgccggggcttgctgagtcaacctggcccttcgtccctcatgcccgtcctgggctatgacccgcctcaactgtacctgactcagttacgggaagccttcggagaccttgccctttttttctatgaccagcatgggggtgaagttataggcgtcctctggaaaccaacgtcctttcaaccccagcccttcaaggcttcttccaccaagggcaggatggtcatgagccgaggtggagagctggtcatggtgcctaacgtggaggcaattttagaggattttgctgtcctgggggaaggtttggtgcaaactgtggaggcccgatcggaacggtggaccgtgtag

SEQ ID NO: 197891 - DNA, 2109 bp, Artificial Sequence
  Description of Artificial Sequence: Synthetic coding sequence
atgatgctgctggacagccgggccgacgacggcttccacctgctgctgatgacacccaagcccatgatccgggccttcgatcacgtcctccatctgcgacccctctccagactgcaggctgcatgccaccgcctgaagttgtggccggagctgcaggacaacgggggggactacgtgagtgccgctctgggcccccttaccactctgttggagcaagggttaggcgctcggctgaaccttctcgctcattccaggccacccgtgcccgagtgggatatatcccaagaccctccgaaacataaagatagcggaaccttaaccctcgggctcctgttgcggcccgaggggctgacctcggtcctcgagctgggacctgaggccgaccaacctgaggccgcaaagtttagacagttctggggtagtcggagcgaactcagaaggtttcaggacggagccatccgcgaggctgtggtgtgggaggctgctagcatgtctcagaaaagactaatcccacaccaggtcgtgacacacctattggcactccatgccgacatcccggagacatgcgtgcactacgtgggtggtcccttggacgcactgatccagggcctaaaggaaacctcctccacgggtgaagaggcattggtggcagccgttagatgctatgatgatttgagcagactcctgtggggcttagaaggcctgccacttacggtgtctgctgttcagggggcacaccctgtgttgagatacaccgaggtattcccccccacccctgtccggccggcgttctccttttatgagaccctgcgggaacggtcatccttgctgcccagactggacaagccctgtcccgcgtatgtagagcccatgactgtcgtctgtcacttggaggggagcggacagtggccccaggacgccgaggccgtgcagcgggtgagagccgccttccagctgcggctcgccgagctcctgacccagcaacatggcctgcagtgtagagcgactgctacgcatacggacgtgctgaaggacggcttcgtgttcagaattcgagtggcatatcagcgggagcctcagatccttaaggaggtgcaatccccagagggcatgatatccctgcgcgacactgccgcgagcctccggctggaacgggacacccggcaacttcccctgctgacatctgctctgcacggactacaacaacagcaccctgccttctcaggggtggcccgcctggccaagaggtgggttcgggcacaattgttgggtgaaggcttcgccgacgagagccttgatctagtagccgccgcgctctttctccaccctgagccttttacccccccatccagcccacaagtgggctttctgagattcctgtttctcgtgtctacttttgactggaaaaacaacccattgtttgttaatctgaataatgaactgacggttgaagagcaagtagaaatccgttctggatttctggcggcgagggcccagctgcccgtgatggtaattgtaacacctcaggacaggaaaaactcagtctggacccaagatggcccctccgcacaaattctgcagcagttagtggtcctggcagccgaagcactcccaatgctcgagaaacagttgatggacccgcgggggcccggagatattaggaccgtgtttcgtccacccctcgatatctacgatgtcctcattaggctctcccctcgtcacattcccaggcatcgccaggccgtggactccccggctgcatcattctgcagaggactgctctcccagccaggaccgtcttctttgatgccagtgctaggatatgatccgccgcagctgtacttgacacagcttcgagaagctttcggcgacctggcactgttcttttatgaccagcacggcggggaagtcataggtgtgctctggaagcccaccagtttccaaccgcagccattcaaagcctccagcactaaaggcaggatggttatgtctcggggcggcgaattggtgatggtgcccaacgtcgaggcgatactcgaggactttgccgttttgggcgaaggcctggtgcaaaccgtcgaagcccgctctgaaaggtggacggtgtag

SEQ ID NO: 197892 - DNA, 645 bp, Artificial Sequence
  Description of Artificial Sequence: Synthetic coding sequence
atgaacctgagcagcgccagcagcaccgaggagaaggccgtgaccaccgttctttggggatgcgaattgtcccaagagcgaagaacttggacttttagaccacagttggaggggaagcagagttgtagactcctgctgcatactatttgcctgggcgaaaaagctaaagaagaaatgcaccgggtggaaattctgccgcctgccaaccaggaggataaaaagatgcaacccgtaacgattgctagtctgcaggcgagtgtcctgcccatggtgtccatggtcggtgttcagctgtctccacctgtgacatttcagctacgggccgggagcggacctgttttcctaagtggtcaggaacgatatgaggcatcagacctcacttgggaagaagaggaagaagaggaaggagaagaagaggaagaagaggaagaggatgatgaggacgaagatgctgacattagccttgaagagcaatctccagtaaagcaggttaagagactcgttcctcagaagcaggcatctgtggctaagaagaagaaactcgagaaggaggaggaggaaatccgcgcatcagtgcgggacaaaagccccgtcaaaaaggcaaaagcaaccgcacgagctaaaaaacctggctttaagaagtag

SEQ ID NO: 197893 - DNA, 411 bp, Artificial Sequence
  Description of Artificial Sequence: Synthetic coding sequence
atgaacctgagcagcgccagcagcaccgaggagaaggccgtgaccaccgtcttgtggggatgcgagctatcgcaggagagacggacatggacctttcggccacagctcgagggcaaacagagctgtcggctgctgctccatactatctgcctcggagagaaggccaaggaagagatgcatagagtggagattctcccacctgcaaatcaggaagacaaaaagatgcagccagtgacgatcgcgagcctgcaggcttcggtgcttccaatggtttctatggttggagttcagctttcaccacccgtgacgttccagctgagggctggatctggacccgtcttcctttccggtcaggaacgatatgaaaagaaggcaggcaagaggagacgaggtaataagagccagagatag

SEQ ID NO: 197894 - DNA, 645 bp, Artificial Sequence
  Description of Artificial Sequence: Synthetic coding sequence
atgaacctgagcagcgccagcagcaccgaggagaaggccgtgaccaccgtcctgtgggggtgtgagctcagtcaagagaggaggacgtggaccttccggcctcaactggaagggaaacagtcatgcagactgctgcttcacacaatctgcctgggtgaaaaagctaaagaggagatgcaccgtgtcgagattctccccccggcaaatcaggaggacaaaaagatgcagcctgtgacaatagcttcgttgcaggcctctgttctgcctatggtgagcatggtcggtgtccagttgtccccaccagtgacgttccagctgcgcgccgggtccggccccgtttttctgtcaggtcaggagaggtacgaggcttcagacctaacttgggaggaagaagaggaggaagagggagaggaggaggaggaggaggaggaagacgacgaagatgaggacgcagatatatccctggaggaacaaagcccagttaaacaggtcaaaaggcttgtcccgcaaaaacaggcttcagtcgcaaaaaagaaaaagcttgaaaaggaggaagaagaaatcagagccagtgttcgggataagagtccagttaaaaaggctaaggccacggctcgtgcaaagaagcctgggttcaaaaaatag

SEQ ID NO: 197895 - DNA, 645 bp, Artificial Sequence
  Description of Artificial Sequence: Synthetic coding sequence
atgaacctgagcagcgccagcagcaccgaggagaaggccgtgaccaccgtgctgtggggttgcgagttgtcccaggagcgccgaacttggactttcaggccccagctcgagggaaagcagtcttgcagactcctgttacacacaatctgtctaggcgaaaaagcaaaggaggagatgcatcgtgtggagatccttccccccgccaaccaggaagataaaaagatgcagcccgtgacaatcgcgagcctgcaggccagtgtcctaccaatggtgagcatggtgggtgtgcagctatctcctcctgtcacatttcagttacgcgccggatcaggcccggtgtttctgtcaggacaggaacgttacgaagcgtccgaccttacctgggaggaagaggaggaggaggaaggcgaagaggaagaagaagaggaagaggacgatgaggatgaggacgccgatatcagcctggaagagcaatctcctgtgaaacaggtgaaaaggcttgtcccacagaagcaggccagtgtcgcaaaaaaaaagaagctcgagaaggaagaggaggaaatacgagcttctgtgcgggataaaagcccggtgaagaaggccaaggctaccgcacgcgccaaaaaacccggctttaagaaatag

SEQ ID NO: 197896 - DNA, 645 bp, Artificial Sequence
  Description of Artificial Sequence: Synthetic coding sequence
atgaacctgagcagcgccagcagcaccgaggagaaggccgtgaccaccgtgctatggggctgtgagctgtcacaggagcggcgcacatggacatttagaccacagctggaagggaagcaatcttgccggttgctgctgcatacgatatgcctgggcgagaaagcaaaagaggaaatgcaccgggttgaaattcttcctccagccaaccaagaggacaagaaaatgcagcccgtgaccatcgcttccctccaggcatctgtcctgcccatggtctcgatggtgggtgtgcaattgagtccccctgtgacctttcagctccgcgccggctcaggcccagtgttcctctccgggcaggagcggtacgaagcctctgatctaacttgggaggaagaagaggaggaggagggggaggaggaggaggaagaggaggaagatgacgaggacgaggatgccgacatatccttagaggagcagtctcctgttaaacaggttaaaagattagtgccccaaaaacaagccagtgtggctaagaagaaaaaactcgagaaagaggaagaagagatccgggcatctgtccgagacaagagcccagtaaaaaaagccaaagccactgcccgcgcaaagaagcctggcttcaagaagtag

SEQ ID NO: 197897 - DNA, 537 bp, Artificial Sequence
  Description of Artificial Sequence: Synthetic coding sequence
atggccgccggcaccgccgccgccctggccttcctgagccaggagtcacgaactcgggccggtggtgtgggtggcctgcgtgttcctgctcccgtgactatggactcctttttctttgggtgtgagctgagtggtcacacccgaagctttacatttaaagtggaggaggaagatgacgcggagcatgtcttggcgctgaccatgttatgtctgaccgaaggggcaaaagatgagtgcaacgtcgtcgaggtggtggccagaaaccacgaccaccaggagatagcagtgcccgtcgctaacctgaaactgtcatgccaaccaatgttgtctctggacgacttccaactccagccacctgttacttttcggctgaagtctgggtctggaccagttagaataaccggccgccatcaaatcgtaacaatgtctaatgacgtcagcgaggaggagagtgaagaggaagaagaagattctgacgaggaggaagtcgagctgtgcccaattttacccgcaaagaagcaagggggtcgcccctag

SEQ ID NO: 197898 - DNA, 501 bp, Artificial Sequence
  Description of Artificial Sequence: Synthetic coding sequence
atgaagtacaccagctacatcctggccttccagctgtgcatcgtgctggggtcactcgggtgctactgccaggacccgtacgttaaagaagccgagaatcttaaaaagtactttaatgcaggccatagtgacgtagccgataacggtacactcttcctgggaatcttgaagaattggaaagaggagagtgacaggaagattatgcaatctcaaatagtgtccttttacttcaaattgttcaagaacttcaaggacgatcaaagcatacagaaatcagtagagaccataaaagaggacatgaatgttaaattctttaactccaataagaagaaacgggacgacttcgagaagctcacgaattacagtgtcacggacctgaatgttcagcgaaaagctatccatgaacttatccaagtgatggctgagctatctcccgctgccaagactggcaaaaggaaaaggagccagatgctgttccggggcagacgagctagtcagtag

SEQ ID NO: 197899 - DNA, 2061 bp, Artificial Sequence
  Description of Artificial Sequence: Synthetic coding sequence
atgagcatgttcagcgacttcctgcagagcttcctgaagcacagcagttccactgtgttcgatctggtggaagagtatgaaaacatctgtggttcccaggttaatatcctaagtaagattgtttcccgagccacacctgggttacagaagtttagcaagactgccagcatgctctggttgttgcagcaagagatggttacatggaggttgctagcaagcctctaccgggatcgcattcagagtgctctggaagaagaatctgtatttgctgtaacagcggtcaacgcctctgagaagacagtagtggaagccctcttccagagggacagcctggtgagacagtcccagctggtggtggattggctggagtcgatagccaaggacgaaataggagagttcagcgacaacatcgagttctatgctaagtctgtgtactgggaaaatacgctccacacccttaaacaaaggcagctgacaagctacgtgggctccgttagacccctggtcacagagctggacccagatgcacccatccggcagaagatgccactggatgaccttgacagggaggacgaggtaaggctgctaaagtatttgtttactctcattcgcgccgggatgactgaagaggcccagcgcctctgtaagcgctgcggacaggcctggagagctgccaccctggagggatggaaactctaccatgatcccaacgtcaacggcggtaccgagcttgagcccgtggaaggcaacccataccggcgcatctggaagatctcgtgctggaggatggcagaagatgagctctttaaccggtacgaacgcgcgatttatgctgccctgtccggaaacctcaagcaactgctccctgtgtgtgacacatgggaggacactgtctgggcctatttcagggtgatggtcgatagtcttgtagaacaagagatccagaccagcgttgcaacattggatgagaccgaggaactccctagggagtatcttggggccaactggacactagaaaaagtgttcgaggagctccaggccactgacaagaaaagggtcctcgaagagaaccaagaacactaccacatcgtgcagaagttcttgatcttaggcgacattgacgggctgatggatgagttttcgaagtggctctcaaagtccaggaataaccttccaggccatttgttaaggtttatgacgcatctgattctgttcttccgcaccctcggcctgcagacaaaggaggaggtttcaatagaagtgttgaagacttatatccaggaagaccgcttaaaaatcgacgtgatcgattggctggtatttgatcctgcacagagggcagaagctttgaagcagggaaatgccattatgcgcaaattcctggccagcaaaaagcacgaggcggccaaagaagtgttcgtcaagatcccacaggattccattgccgagatttacaaccagtgtgaggagcagggcatggaatcacccttacccgccgaagacgacaacgccatccgtgaacatctatgcataagagcgtacttggaggcgcatgaaacattcaatgaatggtttaagcacatgaatagtgtgccccagaagccagcccttattccgcagcccacgtttacagagaaagtggcacacgagcacaaggagaagaagtacgaaatggattttgggatctggaagggccatctggacgcactaactgccgacgtgaaagaaaagatgtacaacgtccttcttttcgttgacggcggttggatggttgatgtcagagaggacgctaaagaggaccacgaaagaactcaccagatggtgctactgcggaaattatgtcttcctatgttgtgtttcctgttacatacaatcctgcatagcactgggcagtaccaggaatgcctgcaactcgctgatatggtctcgtcagagaggcacaagctgtatttggtgttctcaaaagaagaactgaggaagcttctgcagaaactgcgtgagtctagcctgatgctgcttgatcagggacttgacccactcgggtacgagatccaactgtag

SEQ ID NO: 197900 - DNA, 2691 bp, Artificial Sequence
  Description of Artificial Sequence: Synthetic coding sequence
atgaagatcctggtgatcctgcaccaggagacccggctgagcctggaactgctcgcccattttgacagtttggtgctgagcaccaacttgctgttcattgtaacccccacgtcgcgatcactgctgcggcagcctgatatatcctgtatattgggtaccggaggaaaaagcccgcgcctgacacaaagctccggctttttcgggaacctgtctatggttaccaacttggacgacagcaactgggcggccgctttcagctcacagagaagcggcttgtttactaatacagagccccactccattacggaggatgtcacaatttctgcggtcatgttgagggaagacgatccaggggaggcggcctccatgtcgatgtttagcgattttctgcagtcttttctcaagcacagcagcagcacagtgtttgatctggtggaggaatacgagaacatttgcggatcacaagtcaacattcttagcaaaatagtgagccgggccaccccaggactgcagaaattctccaaaaccgcgagcatgctctggctcctgcagcaagagatggttacgtggagactgttggccagcctctatcgggataggatccagagcgccttggaggaagagtctgttttcgccgttacggccgtgaacgcgtcggagaagactgtcgtggaagccctttttcaacgagacagtctggtgcggcaaagtcagctcgtggtggactggctggagagcatcgcaaaggacgagatcggagagttcagtgacaatatcgagttctacgccaagagcgtgtattgggaaaatactctgcacacacttaagcagagacagcttacttcgtacgtcggctcagtgagaccactcgtgacagaattggacccggatgccccgatccgccagaagatgcctctcgatgacctggatagggaagacgaagtgaggctgttgaaatatctcttcacgctgatcagggcaggtatgaccgaggaggcccaaagactctgtaaacgatgcggtcaggcatggcgagccgcgaccttggagggctggaagctctaccacgatccaaacgtaaacggaggtaccgagctcgagccagtcgagggcaatccctaccggcggatttggaagatttcatgttggcgcatggccgaagatgaactatttaatcgatacgagagggccatttacgcagccctgtcaggtaacctgaagcagcttttgccagtctgcgacacttgggaagacacagtgtgggcgtactttcgcgtcatggtggatagcttggtggagcaagagattcagacaagcgtcgccaccctggatgagacagaggagctgccacgggaataccttggcgccaattggaccctcgagaaggtgttcgaggagttgcaagcaacagataaaaagcgcgtactcgaagagaaccaggaacattatcatatcgtccagaaatttctaatactaggagacatcgatggtctgatggatgaattttcaaagtggttgagtaaatcccggaataatctccctggccacctcctgcgctttatgacccatctcatcctgttctttcggaccctgggtctccagactaaagaggaagtgagtattgaggtgctgaagacctacatacaactgctgataagagagaaacacaccaacctcatagcattttatacttgtcatctgcctcaggacctagcggtagctcagtacgccctgttcttggagtctgttacggagttcgagcagcgccatcactgtctggagcttgctaaggaggccgatctcgatgttgcgactattactaaaaccgtcgtggaaaacatccgtaagaaagataatggtgagttctctcaccatgaccttgccccagccctggataccggcactactgaggaggatcggctgaaaatcgatgttatagactggcttgtcttcgatcccgcgcagcgtgctgaggctttaaagcaggggaatgctatcatgaggaagtttcttgcttctaagaaacatgaggccgcaaaagaagtgttcgtaaaaatcccacaggacagcatcgctgagatctacaaccagtgtgaggagcagggaatggagagtccactcccagcagaagacgacaatgccattagggagcatctgtgcatccgggcctatttagaggctcacgagaccttcaacgaatggtttaaacacatgaactccgtccctcagaagccagccctgatcccccagccaacgttcaccgaaaaagtggcacacgaacacaaggaaaaaaaatatgaaatggatttcggtatatggaaagggcacctcgatgctctaactgctgacgtcaaggagaagatgtataatgtcttactgttcgtcgacggcgggtggatggtggacgtcagagaggatgctaaagaggatcacgaacgaacccaccagatggtgctactgaggaaactttgcttaccaatgctgtgttttcttttgcataccatcttgcacagtacagggcagtatcaggagtgcctacagctggcggacatggtgtcatcagagaggcataaactatatcttgtcttttcaaaggaagagttgaggaaattgcttcagaaactcagagagagtagtctcatgctgttagatcagggcttggatcctctggggtacgaaatacagctctag

SEQ ID NO: 197901 - DNA, 3471 bp, Artificial Sequence
  Description of Artificial Sequence: Synthetic coding sequence
atgttccccgccgcccccagcccccggacccccggcaccggcagccggcggggccccttagcaggattagggcctggctcaaccccgagaacagcctcacgcaaggggctccccctcggtagcgctgtaagtagtcccgttcttttctcccccgtgggaaggagaagctctctgtcttctcgtggaaccccgacccggatgtttccacatcactctattaccgagagtgtgaattatgacgtgaagaccttcggctcaagcttgccggtgaaggtgatggaggctcttactcttgctgaagtcgatgatcagctgaccatcaacatagatgagggaggatgggcttgtttggtgtgtaaggaaaaactcatcatctggaagatcgctctgtcacctatcaccaaactctcagtctgcaaggagctgcaactcccgccctcagatttccattggtctgccgatctggtggctctgagttactcctcccccagcggggaggcacattcaacccaggccgtggcggttatggtcgcgactagagaggggagtattaggtactggccatctctcgcaggcgaggacacatacactgaagcattcgtggacagtggcggggataaaacttacagcttcctgacagccgttcaaggaggctcttttattttaagctctagtggatcccagctgattcgacttattcctgaaagctccgggaagatccaccagcacattcttccccagggacagggcatgctgagtggtatcggtaggaaagtatcatcgctgttcggaatcctgtctccgagtagtgacctgacccttagtagcgtcctgtgggaccgagagaggtcttcattctattcacttacatcgagcaatatctctaagtgggaactggacgacagcagcgaaaagcatgcttactcctgggatatcaatcgtgccctaaaggaaaacattaccgacgcgatctggggcagcgaaagcaactacgaagcgatcaaagaaggagtgaacatacgctatttagacctcaagcagaattgcgatggactcgtaatcctagctgctgcgtggcacagtgctgacaacccatgcttaatttactattcactgattactatcgaggataacgggtgtcagatgtccgacgccgtaacggttgaagtgactcagtacaaccctccatttcagagcgaggatttgatcctttgtcagttgacggtgcctaatttttcgaaccaaactgcctatctgtataacgagagcgccgtttacgtgtgctctactggaactggcaagttttcactgccacaggaaaagattgtatttaacgctcagggcgatagtgtgctgggcgccggtgcttgcggcggcgtccccataattttctccagaaatagcgggctggtttccatcacatcacgcgaaaatgtctcaattcttgcagaagacctggaaggttcactcgcctcttccgttgcgggacctaacagcgaaagtatgatttttgaaaccaccactaaaaacgaaacaattgcccaagaagacaagataaagctgctaaaggctgctttcctgcagtattgtcgtaaggatctgggccatgcccagatggtcgtggacgaactttttagctctcattccgacctggacagcgatagtgaactcgatcgagccgtgactcagattagcgtggatctgatggacgactacccggcctctgaccctaggtgggcggagtctgtgcccgaggaggctcctgggttctcgaacaccagcctgatcatcctgcatcagttagaagacaagatgaaggctcatagctttttgatggactttatccaccaagttgggctctttgggagacttggtagcttccccgtgcggggaacacccatggcaacaaggctgctgttgtgcgaacatgctgagaagctttctgctgccatcgtcctgaaaaaccatcattcgagattgtccgatctcgtgaacactgctatcttaattgctcttaataaaagggaatacgagatcccttccaatttaactcctgccgacgtattctttagggaagtgagtcaggtcgataccatctgcgagtgtttactggaacatgaagaacaagtcctaagagatgcccctatggattcaatagagtgggccgaggtggtgatcaacgtcaacaacatactcaaagacatgctacaggccgcctcacactatagacagaatagaaacagcctctatagaagagaggagagcctcgaaaaagaacccgaatacgttccatggacagcaacgtcaggaccaggggggatccgcacagtaattattcgccagcatgaaattgtgctcaaggtcgcctaccctcaggccgactccaatcttagaaacattgtcacagaacagttagtggcattaatcgactgcttcctcgacggctatgtgtcacagctgaagtcggttgataagagcagcaaccgggagaggtatgataacctcgagatggaatatctgcaaaaacgctctgacctgctgtctcctttgctctcgctgggtcagtatttgtgggccgcatctctcgccgaaaagtactgtgacttcgacatcctggtacagatgtgtgaacagaccgataatcagagcaggttgcagcggtacatgacacagtttgcagaccagaacttttcagatttcctttttcgctggtatcttgaaaagggcaagagagggaaacttctttcacagcctatctcacagcatggtcaactggccaactttctgcaagctcatgagcatctcagctggctgcacgaaattaatagccaagagctcgagaaggcccatgcaactctgctggggttagccaacatggagacgcgctactttgccaaaaagaagactttgctgggtctgtcaaagctggccgctcttgctagcgatttttccgaggatatgctgcaggaaaaaatcgaggagatggccgagcaagagaggtttctactccaccaggaaactctgcctgaacaactgctggctgagaaacagttaaatctttcagccatgccagtgctaacggcaccccaactcattggactatatatctgtgaggagaatcggagggcaaacgaatatgatttcaagaaggctttggatctgctagaatacattgacgaggaagaggacatcaatattaacgatctgaagttagaaatcttgtgcaaagcgcttcaaagagacaactggtcgagctccgacggaaaagacgacccaatcgaggtctccaaagattcaatttttgtcaaaatactgcagaagctccttaaggacggaatccaactttccgagtacttgccagaggtgaaggatctccttcaagccgatcagctcgggagcctgaagagcaacccctatttcgagttcgtcctgaaggcaaattacgaatattacgttcagggtcagatctag

SEQ ID NO: 197902 - DNA, 675 bp, Artificial Sequence
  Description of Artificial Sequence: Synthetic coding sequence
atgttccccgccgcccccagcccccggacccccggcaccggcagccggcgtggtcccctcgctggcctgggacctggctccacgccccggactgcctcacgtaaaggtctgccattaggatccgccgtatcgtcaccggtgctcttctcacccgtgggaagacggtcatcgctctcatctagggggactcctactcgtatgttcccccaccacagcattaccgagtcagtcaactacgacgtgaaaacatttggatccagtctgcccgtgaaggtgatggaagcactgaccctggccgaggtagatgatcagttaactatcaacattgacgaaggaggctgggcatgtctcgtgtgtaaggaaaagttgatcatctggaaaattgcccttagcccgatcaccaaactgagcgtgtgtaaagaactgcagctgcccccctcggatttccactggtcagcggacttagtggctctgtcgtatagctccccttccggcgaagcacatagtactcaggcagtggccgttatggtcgccaccagagaggggtccatccgatactggccaagcttagcaggggaggatacttatactgaggcatttgtcgacagtggaggggacaaaacttattctttcctcaccgcggtgcaggtgcataaggaaacaaagtctggctag

SEQ ID NO: 197903 - DNA, 3207 bp, Artificial Sequence
  Description of Artificial Sequence: Synthetic coding sequence
atgttccccgccgcccccagcccccggacccccggcaccggcagccgacgcgggcccctagcaggacttggtcccggctccacccctagaactgcctctaggaagggcctcccacttgggtccgccgtcagttccccagtgctgttttctcccgtgggtcgccgcagctcgctctcctcaaggggcaccccaacacggatgttcccacaccattctattacggaatctgtaaattatgacgtgaagacctttggtagcagtctgcccgttaaggtgatggaggctctgaccctcgccgaagttgacgaccagcttacaatcaatatagacgaaggtggttgggcttgcctagtatgcaaggaaaagttaattatttggaaaatcgccctctcccccatcactaaactgtccgtgtgtaaggaattgcagctgccgccttctgacttccattggagcgccgacttggtggcactcagctattcctctccatccggggaggcacattcaacgcaggcagtggccgttatggtggcaactcgggaaggctccatccgctattggccatctctggctggcgaagacacctacacggaggcttttgtggattcaggtggggacaagacctattcttttcttacagccgtgcagggcgggtcatttattctcagctcttccggaagccagctgataagactgatcccggaaagctctggcaagatccatcagcacatcctgccgcagggacagggaatgctgagcgggatcggtcgaaaagtgtctagtttattcgggatcctgtctccctccagtgacctgaccctgagctctgttctctgggatcgtgagcgcagctctttctatagcctaacctcctcaaacatctccaaatgggaacttgacgatagctccgaaaagcatgcatactcttgggatatcaatagggctctaaaggagaacataactgatgccatatgggggtctgagagcaattatgaggcaataaaggagggagtgaatatcagatacttggacctgaagcagaactgcgacgggttggtgatcttggccgccgcttggcactctgcagacaatccctgtctgatctattactccctcatcaccatcgaggataacggctgtcaaatgtcagatgcggttaccgtcgaggtgactcagtataatcccccattccagagcgaagatctgattctctgccaactgaccgtgcccaattttagcaaccagaccgcctacctatataatgaaagcgccgtgtatgtgtgctctacagggacaggtaagttctccttacctcaggaaaaaatagtgttcaacgcacagggtgatagtgtcctgggcgccggagcctgtggaggcgtgcctatcattttcagccgcaacagcgggcttgtgagtataacgagtagggagaatgtatccatcctggctgaagatttggaaggatcactagcttcatccgtcgccgggccaaattcagaatctatgatattcgagacaacaacgaaaaatgagacaatcgcccaagaggataaaatcaaacttttgaaagccgcattcttgcagtattgtaggaaagacctgggccacgctcagatggtcgtggatgagctgttctcctcacatagtgacctggattcggactctgagttagaccgcgctgttacacagatctccgtggaccttatggatgactaccccgcatctgacccacggtgggctgagagcgtgcccgaggaggcaccagggtttagcaacaccagcctgattattctacatcagcttgaggataaaatgaaagcacatagcttcctgatggactttatccatcaagtgggcctgttcggccgcctggggagctttccagttcgcggcacaccaatggcaacgcgcctactgctgtgtgaacacgccgagaagctgtccgctgcaatcgtcctaaaaaaccaccactcacggctttcggaccttgtaaataccgccattttgattgctttgaacaaacgcgaatacgaaattccttcaaatcttactcctgcggatgtgttctttagagaggtctctcaggttgatactatctgtgaatgtctgctggagcacgaggaacaggtccttcgggacgcccctatggactccatagagtgggcagaagtggttatcaacgtgaacaacatacttaaagatatgcttcaggctgcctctcactataggcagaaccgcaatagtttatacagacgcgaagaatcactggaaaaagaacctgagtatgtcccctggaccgctacctctggtccaggtggaatccggacagtgatcatcaggcaacacgaaattgtgttgaaggtagcttatccccaggccgacagcaatctccgaaatatcgtgaccgaacagctcgtggctcttatagactgtttcctagatggctatgtctctcagctcaaatcagtggacaagtcctccaaccgagaacgctacgataacttggaaaagggaaagcgcgggaaactgctttcgcagcccatttcccagcatggtcaactcgcgaactttctccaggcccatgagcacctgtcatggctccatgagatcaactctcaggaactggagaaggctcatgctacccttctgggactagctaatatggagacacgctactttgccaaaaagaagaccctccttgggctttcaaagttggccgccctggcctccgacttctccgaggacatgttacaggagaagatcgaagagatggccgagcaagagagattcctgttgcatcaggagaccctccctgaacagctgctggctgaaaaacagcttaacctgagcgccatgccagtgctgacagccccacagctgattggtctgtacatttgtgaggaaaacaggcgtgccaacgaatacgattttaagaaagctctcgatctccttgaatatattgatgaggaggaggatatcaacattaacgatctgaaactggaaatcctgtgcaaggcccttcagcgcgacaactggtcttcgagtgatggaaaggatgacccgatcgaggttagcaaagactctatcttcgtaaaaatactgcaaaagctgcttaaagacggtattcagttgtctgagtaccttccagaagtgaaggatctgctgcaagccgatcagctgggctccatcaacgtaaacttctgctag

SEQ ID NO: 197904 - DNA, 3258 bp, Artificial Sequence
  Description of Artificial Sequence: Synthetic coding sequence
atgttccccgccgcccccagcccccggacccccggcaccggcagcaggcgcgggccgctcgccgggctaggtccaggatctaccccaaggactgcatcaaggaaagggctaccccttggaagcgcggtgtcatcccccgtgctcttttcacctgtaggccggagaagtagcttgtctagcagaggaacacctacccggatgttcccacaccacagcataaccgagtcagtgaattacgatgtcaaaacttttggttcttccttgccggtgaaggtcatggaggcgctaactttagcagaagttgatgaccagttgaccatcaatatcgatgaaggcgggtgggcctgtctggtttgtaaagagaaattgataatctggaagattgctctgtctcctatcacaaaactcagcgtgtgtaaggaactgcagctcccacccagcgatttccactggtctgcagatctcgtagccttgtcatattctagcccgtcaggtgaggctcactccacccaggctgtagccgtgatggtcgccacccgggaaggctctattcgatactggccatccctggctggggaggatacttacactgaagcctttgtcgattctgggggcgacaagacttacagctttttgaccgcggtgcaaggtggatcctttatcctgagcagttccggctcgcagctgataagattgattccagaatcttccgggaaaattcaccagcacatcctgccgcagggacaggggatgctctccgggatcggcaggaaggtgtcttcactgttcgggatcctgagcccatccagcgatcttaccctgtcttctgttctttgggatagggaacggagctccttctacagtcttacatcctcaaatatttccaagtgggaactcgacgacagcagtgagaaacacgcatactcgtgggatatcaacagggcactaaaggagaacatcactgatgctatatggggatcggaatctaattacgaggctattaaggaaggtgtgaacatccggtacttggacctcaagcaaaactgtgacggcttggtcatccttgccgccgcctggcacagcgctgacaacccctgcctgatctactatagtctgatcacaatcgaagataacggctgtcagatgagtgacgccgttactgtcgaagttacacagtacaaccctccattccagtctgaggatctgattctctgtcagcttaccgtaccgaactttagcaatcagacagcctacctgtataatgaaagcgcggtctacgtctgcagtaccgggaccggcaaattctccctcccacaagaaaagatcgtttttaacgcccagggagactcagtgttaggcgcaggtgcctgcgggggggtgcccataatcttctcccgaaattcgggactcgtgtcaatcacaagtcgggaaaatgtgagtatcctggctgaagacttagaaggatcgctcgcatctagtgtagccgggcccaactctgagtctatgattttcgagactacgaccaaaaatgagaccattgcacaggaagacaagatcaaactgctcaaggctgctttcctgcaatactgccgcaaagacctgggccatgcccagatggtggttgatgaattattttcctcgcatagcgacctggatagcgactccgagcttgatcgcgccgtgacccaaattagtgtagacctgatggacgactatccagcctctgatccccggtgggcagaatctgtacccgaagaggcccctggcttcagtaatacatctctgatcattctccaccagcttgaggacaagatgaaggcccactcttttctcatggattttatccatcaagtcggattatttggcagactgggatccttcccagtgagagggacccctatggcgacgcggctcctgctgtgcgagcacgccgagaaactatccgcagccatagtgctgaagaatcatcattctcgcctaagcgacctagtgaacactgccattctgattgcattgaataaacgagagtatgagatccctagtaacctgactccagccgatgtttttttccgcgaagttagtcaggttgacacaatctgcgaatgcttactggagcatgaggaacaggtcctgcgggacgcccctatggattcaatcgagtgggccgaggtagttattaacgtcaacaatatcctgaaagatatgttgcaggcagcctcacactacaggcagaacagaaactccctgtacaggcgggaggagtctttagagaaggaaccggagtacgtgccctggaccgcaacaagcggtcccggcgggatccggacagttatcattcgtcaacatgagatcgtgcttaaggtggcatatccacaggccgatagcaatctacgcaatattgtgaccgagcaactggtggctctaattgactgcttcctggatggatacgtaagccagctcaaaagcgtcgataagagttcgaaccgcgagcggtacgacaacctcgagaagggaaagcgcgggaaactcttgtcccagcccatctcccagcacggtcagttggccaactttttacaggcccatgagcacttgtcatggttacatgagataaactcacaggaattggaaaaggcccacgcaactcttttgggcttggctaatatggagacacgatattttgcgaagaagaagacgctcctcggcctctcgaagttagccgcactggccagcgatttctctgaagatatgctgcaggagaagattgaggaaatggctgaacaggagaggtttctcctgcaccaggagactctacctgaacagttattagccgagaagcagctcaacctgtctgccatgccagttctgaccgcaccgcagcttattggcctttacatttgtgaggaaaatagacgggcgaatgaatatgatttcaaaaaggcattggacctccttgaatacatcgatgaggaggaggatatcaatatcaacgatctgaaactggaaattctgtgcaaagccctacagagggacaattggagcagcagcgatggaaaggacgacccaattgaggtaagcaaggactccatatttgtcaagatccttcagaagctcttgaaagatgggatccaactctccgaataccttccagaggtaaaggacctcctccaggctgatcagctcggatcattaaagagtaacccatatttcgagttcgttcttaaagcaaattatgaatactatgttcagggccagatctag

SEQ ID NO: 197905 - DNA, 3423 bp, Artificial Sequence
  Description of Artificial Sequence: Synthetic coding sequence
atgggccccctggccggcctgggccccggcagcaccccccggaccgcctctcggaagggcctccctttgggatctgctgtgtcgagccccgtcttattcagcccagtgggcaggagatccagcctcagctctagaggtacccccactagaatgtttcctcaccactccatcactgagagcgtgaattatgatgtaaaaacgtttgggtcaagcctgccagtgaaagtgatggaggcccttactttagctgaggtcgacgaccagctcactataaatatcgacgaaggcggctgggcatgtctcgtttgcaaggaaaaactgatcatctggaaaatagcacttagcccaatcaccaagctttctgtgtgcaaagaactgcagctccctccttctgactttcactggtcagctgatctggtggcactcagttatagttcccctagtggcgaagcccatagtactcaggcagttgcggttatggtcgccactcgtgagggatccattagatattggcccagcctggccggagaagacacatacacagaagccttcgtcgacagcgggggggacaagacttactcttttcttactgccgtccaggggggctcttttatcttgtcttcctctgggagccagctgatccgcctgatccctgagagctctggtaagatccaccagcacatcctgcctcagggacagggcatgctgtctggaatcgggcgcaaggtgtcttccctgttcggcattttgtcaccttcctcagatcttactctgagcagcgtgttgtgggaccgtgagcgcagttcattctattcattgactagctcaaacatcagtaaatgggaactagacgactcatccgagaagcatgcctactcctgggacataaatcgagcgttgaaagaaaatataacggacgccatttggggttcggagtcgaattacgaggccatcaaagagggggtgaacattagatacctggacctcaagcaaaattgtgacggattagtcatcctcgcagccgcctggcattcagccgacaacccctgcctgatctactattctttaataactatcgaggacaacggctgtcagatgtccgacgccgtcacggttgaagtaacacagtataaccctccctttcagagcgaagacctgattctctgccagctcaccgtgcctaacttcagtaaccaaaccgcctatttatacaacgagtccgcagtctacgtgtgtagcaccggaaccggcaaattctcactgcctcaggaaaaaatagtcttcaacgcacagggagactcggttcttggcgccggagcctgcggcggtgtgcctattatcttctctcgaaattctggtctggtctctattaccagcagagaaaatgtcagcatattggccgaggatttggaagggagcctggcttcatccgtggccggtccaaatagcgagtccatgatctttgagacaacaactaaaaatgagaccatcgcccaagaagacaaaatcaagctgcttaaagcagcattcctccagtactgccgaaaggacttgggtcacgcccagatggtggtggacgaactgttctcctcacacagcgatctggatagcgacagcgaattggatcgggctgtcacacagatttctgtcgatctcatggacgactacccagcgagtgatcctaggtgggcagagtccgtgccagaggaagcccctgggttctctaacacctccctgataattctgcaccagctggaagataagatgaaagctcactcgttcctgatggactttatccatcaagtaggcttatttggaagactgggttccttccccgtccgtgggactcccatggctaccaggctgctgctttgcgagcatgccgagaagctgagcgcggccatcgtactgaagaaccatcatagcagattaagcgacctggtgaacacggcaatcctgatcgcccttaacaagcgtgaatatgaaatcccttctaacctcactcctgcggacgtgtttttcagagaggtgtcacaggtggatacgatctgcgagtgcttgttagagcacgaagaacaagtcctcagggacgcccccatggattccattgagtgggccgaagtggtgataaacgtaaataacatcctcaaggacatgctgcaggctgcctcccattacaggcaaaatcgtaacagtctttaccgtagggaagagtcgctcgaaaaagagcctgaatacgtgccttggacagctacatccgggccgggcgggatccgcactgtcatcatccgacagcatgagattgtcctgaaggtcgcttaccctcaagccgacagcaacctgcgcaatatcgtaaccgaacaactggttgctctcattgattgtttcctcgacggctatgtcagtcagctgaagtccgttgacaaatcctctaatagggagagatatgataatctagagatggaatatctgcagaaacgttctgacctactgtccccacttctgagcctgggccaatatctgtgggctgctagcctggctgagaagtactgcgattttgatattcttgttcaaatgtgcgagcagacggacaatcaatccagactccagcggtatatgacacagttcgcagatcagaatttctcggatttcctgtttagatggtacctggagaaaggcaagcgcgggaaacttctgtcacagcccatctctcagcacgggcaactggccaacttcctccaagcccacgaacacctcagctggctacacgagatcaacagccaggaattggagaaggcccatgctacccttctgggactggccaacatggagacccggtactttgctaagaagaaaacgctgctcggcctgagcaagttagcggctcttgcgtccgatttctccgaggatatgctccaggagaagatcgaagagatggccgagcaggaacggtttctcctgcatcaggagactctccctgaacagttactagcggagaaacagcttaaccttagcgcaatgcccgtgcttacggccccccagctgattggcctgtatatctgtgaagagaaccgaagagctaacgagtacgattttaagaaggcactcgatcttctagagtacattgacgaagaggaagatatcaacattaatgacttgaagctcgaaattctctgtaaagctctgcaaagggacaattggagctcttccgacggcaaggatgaccctatcgaggtgagcaaggactcaatcttcgtaaagatccttcagaaactgctaaaggacggaatccagctgagtgaatacttgcctgaagtgaaggacctgctccaggcagaccaattagggtcacttaagagtaatccctacttcgagttcgtccttaaggctaactacgaatattacgtgcagggccagatttag

SEQ ID NO: 197906 - DNA, 4428 bp, Artificial Sequence
  Description of Artificial Sequence: Synthetic coding sequence
atggccagcggcgccggcggcgtgggcggcggcggcggcggcaagatcaggactcgtcggtgccatcagggcccaatcaagccataccaacaaggacggcagcagcaccagggcattctcagcagagtcaccgagtccgtgaaaaacattgtgccgggctggcttcagcgctactttaacaaaaacgaagatgtgtgtagctgcagcacagatacttccgaggtccctcgctggccagaaaataaagaagatcatctcgtttacgccgatgaggagtcttctaatattacagacggtagaattaccccagaacctgcagtatctaacactgaagaaccttctaccactagtacagctagtaactatccggatgtactaaccagaccctccctacatcgttcacacctaaatttctccatgcttgaaagtcctgctctacactgtcagccaagcacctcaagtgcttttccaattggctctagtggcttctcccttgttaaggaaatcaaagatagtacctctcagcacgatgacgacaacatctcaacgacaagcggctttagttcacgggccagcgataaggatattacagtgagcaaaaatacttccttgccaccactatggtctcctgaggccgagcgcagtcattctttgtctcagcacacggccacttcttctaagaaaccagcttttaatctgtctgcatttgggaccctctcaccatccttgggcaactccagcatccttaaaacatcccaacttggggattctcccttctacccgggcaaaactacatatggcggggccgcagcggccgtgagacaatcaaaactgaggaacaccccataccaggcacccgtgcgccggcaaatgaaggctaagcagttgtcagcacagtcatatggggtcacatcaagcaccgcccgcaggattcttcagagcctggagaagatgtcatcaccgctcgccgacgctaaacgcatccctagcatcgttagcagccctctcaatagccctctcgaccgatcaggtatcgatattacagatttccaggcgaagagagagaaggttgatagccagtaccccccagtacaacgtctgatgacacccaaacccgtgtctatcgccaccaataggagtgtgtacttcaagccaagcctgacgccttccggcgagtttcgcaagaccaatcagcggattgacaataagtgtagcactggctacgaaaagaacatgacacctggccaaaatcgggaacagagggaaagcggtttcagttaccccaatttttctctcccagctgccaatggcctcagcagtggcgtgggaggcggaggtggaaaaatgcgtcgggagaggaccaggttcgtagcatcaaagcctctggaggaggaggaaatggaggtcccagtactgcccaagataagcttgccgatcacatcctctagcttgcccacatttaatttttcgagcccggaaatcacaacatcatccccgtccccaatcaactctagccaggccctgacgaataaagtacagatgacctcgccatccagcaccggatctccaatgttcaaattttcctcacccatcgtgaaatccaccgaagccaatgttctgccccccagcagtatcggatttaccttttctgtcccagtagccaaaactgcagagctgtctggctcaagctctacgctcgaacccatcatcagttcgtctgcgcaccacgtgaccaccgtgaacagcaccaattgcaagaaaacacctccagaggactgtgagggtccctttaggcccgccgagatactgaaagaggggagcgttttggacatacttaagagccccgggttcgccagtcccaaaatcgatagcgttgccgcccagcctacagcgacaagccctgttgtgtataccagacccgcgatctcctcctttagctcttctgggattggatttggtgaatctctgaaggccggttctagctggcagtgcgacacttgcctgcttcaaaacaaggtgaccgataacaagtgcatcgcctgccaggccgccaaactgtctccccgcgataccgccaagcagactggcattgagactcctaacaagagcggcaagacgactttgtccgcttcaggcacaggatttggcgataagttcaaaccagttataggcacatgggactgcgatacctgtcttgttcagaacaagcccgaagccatcaaatgtgtggcctgtgagacaccaaaacccggtacctgtgtaaaacgcgctcttacactcaccgtggtcagtgaaagcgccgagacaatgacagcttcatcttcctcttgtaccgtgactaccggtactctaggctttggggacaagttcaaaaggccaatcggttcctgggagtgtagcgtctgttgcgtctcgaataacgccgaggataataagtgcgtgagctgtatgtctgaaaagcctggttcttctgtgcccgccagctctagcagcaccgtcccagtgtcattgcccagcggtggctctctaggcctggaaaagttcaagaagcctgagggaagttgggattgtgaactgtgcctggtccagaataaggccgacagcacaaaatgcctggcttgcgaatccgccaaacctggcacaaagtccggattcaaggggtttgacacatcgtcatcttcctccaactccgcagcaagctccagctttaaatttggcgtcagctcatcaagcagcggcccctctcagaccttaacctccacaggtaatttcaaattcggcgaccagggcggattcaagatcggggtgtcctctgactccggctcgatcaacccaatgagtgaaggctttaagttcagtaagccaatcggcgactttaagttcggggtgagcagcgaatctaaacccgaggaggtgaaaaaggattctaagaacgacaactttaagtttgggctgtcttctggattatctaatcctgtttcgctgacccctttccagtttggagtttccaacctgggccaggaggaaaagaaagaggaactgcctaaatcgtcctccgcaggattttccttcggaaccggggttataaacagtaccccagcgccggccaacacaatcgtaacatctgagaataagtcgagcttcaacctgggcaccatcgagacaaagagcgccagcgttgccccattcacatgcaagacgagcgaagctaaaaaagaggagatgccagcaaccaaaggggggttcagctttgggaacgtagaacccgcaagcctaccgtcagcctcggtgttcgtgctggggcgaaccgaagagaagcagcaggagcccgtcacctctacctccttagtcttcgggaagaaagccgataatgaggaacccaagtgtcagcctgtgttttcatttggcaactctgaacagactaaagatgagaattcatccaagagtactttttcttttagtatgaccaagccgtcggaaaaagaatcggagcagcctgccaaagctacttttgcatttggcgcgcagacgagtacgacagcggatcagggagcagctaagcccgtctttagctttctgaacaatagcagcagttcgagcagcacacccgcaacctcagctggggggggcatcttcggaagtagtacttcctcttccaatccaccagtggcaactttcgtgtttggacagtcctctaatcctgtatcgtcatccgccttcggaaacacagccgagagctcaacgtcgcaaagtctgctgttctcacaggacagtaaactcgccacaacttcttccaccggcactgccgtaacacccttcgtatttgggccgggggcctccagcaataacacaaccacttccggatttgggttcggtgcaaccaccacaagctcgagcgcaggctcatcatttgtttttggaacggggccaagcgcgccctctgcgtcccccgcatttggcgcaaatcagacacccacatttggccaatcgcaaggtgcctctcagccgaacccacccgggttcgggtctatttcgtctagtactgctctgttcccaaccgggtcacagccagctccgcctacctttggtacagtgtcttcaagctctcaacctcctgtgtttggccagcagccatcacagtcagcattcggatccggtactactcctaatagtagctccgcattccagttcggcagctctactactaactttaatttcacaaataactccccaagtggtgtgtttacctttggggccaattcttctacgcccgccgctagcgcgcagccatccggttcaggcggctttccctttaatcagtcccccgccgcttttacagtcgggtctaacggcaagaacgttttttcctcttcaggaacatccttcagtggcagaaagattaaaactgctgtgaggcgaaggaaatag

SEQ ID NO: 197907 - DNA, 4368 bp, Artificial Sequence
  Description of Artificial Sequence: Synthetic coding sequence
ggcctgcggctgtgcctgagccggcccctgacccggcccggcgccggatccggaggcggctcagctatggccagtggcgccgggggagtgggaggggggggcggaggcaagattcgcaccagaagatgccaccagggtcccatcaaaccctaccaacaaggccggcagcagcaccagggaatattatcccgggttactgaatccgttaagaacattgtgccaggttggctacaacggtattttaacaagaatgaagatgtgtgtagttgcagtacagatacaagcgaggtacccagatggcctgagaataaagaagatcaccttgtgtacgccgacgaagaatcctccaatatcactgacggccgcatcactccggagccagcagtgagcaacacggaggagccaagtacaacttctacggcctccaactacccggacgttcttacccggccctccctgcaccgctctcacctcaatttctcaatgctggaatcgccagcactacactgtcagccaagcacatccagtgcattcccaataggcagttctggttttagcctcgtgaaggagattaaggacagcaccagccagcatgacgacgataatatatctactacctctgggtttagttcacgcgccagcgataaagacatcaccgtgagtaaaaatactagccttccgcctctgtggtctcccgaggccgaacgctctcattcgctctcacaacacacagcgacttcttccaaaaagcccgcattcaacctgtctgcatttgggaccctgagcccttcactgggaaatagcagcattttgaaaacctcacagctgggagactcccccttttatcctggtaaaacgacttacggcggcgccgccgcagctgtccgccaaagcaaattgcggaacacaccatatcaggctcccgtcaggagacagatgaaggccaagcagctgtcagctcagtcttacggtgtcacaagcagtactgcccgcagaatcctgcagagcttagagaagatgtcttccccactcgccgatgccaaacgcatcccgagcattgtgtcctccccgctcaactctcccctggatcggtctggtattgatatcacagattttcaggcaaagcgtgaaaaagtcgacagccagtaccctccagtgcaacgcttgatgacacctaagccagtgtcaattgccacaaaccggtcagtctattttaagccatctctgaccccgagcggcgaatttcggaaaactaatcagcgcatcgacaacaagtgctcaaccgggtatgagaagaatatgactcccgggcagaatcgcgaacagagggagtctggcttctcatatcctaacttcagcctgcccgctgctaatgggctctcatcgggagttggtgggggcggcggaaagatgcgcagggaaagaacaaggtttgtggcaagcaaaccccttgaagaagaggaaatggaagtaccagtgctgccgaaaatctcactgcccatcaccagcagctccctgccgacgttcaacttcagctctccggaaatcaccactagctctccatcccctatcaactccagtcaggcactgactaacaaggtccagatgacctccccatcatcgactggaagccctatgtttaagttcagtagcccaatcgttaaatcaaccgaggccaacgtactacccccctcctctatcggatttaccttctccgtccccgtggccaaaaccgcagagctttctggttcttcatccacactcgagcccattatctcaagttccgggtttgcaagtcccaagatcgatagtgtggctgcacaacctacagccactagcccagtggtgtatacccgcccggccatctcgtctttcagcagctccgggattgggtttggagaatcattgaaagctggatcaagttggcagtgtgatacttgcttgctgcagaataaagtgaccgacaacaagtgtatcgcttgccaggccgcaaaactgagccccagggacacagccaaacaaacagggatagagacccctaacaaatccggtaagacaactttgtctgcctccgggacgggatttggtgataagtttaaacccgtcataggtacgtgggattgtgatacctgcttggtgcaaaataaaccagaggccattaaatgtgtcgcctgtgagacccctaagccaggcacgtgtgtgaaaagggcgctgaccctaacagtggtttccgaaagcgctgagaccatgaccgcctctagtagtagttgcaccgttacaactggcacattgggattcggggataaatttaaaagaccaattggcagctgggagtgctctgtatgctgtgtgtctaacaatgccgaggacaataaatgcgtcagttgtatgagtgaaaagcccggctctagcgtacccgcatcctctagctctacggttcccgtctcgctccccagtggagggagtctgggtctcgaaaagttcaagaagcctgaaggatcatgggattgcgagctctgtctcgtccagaataaagctgattctacaaaatgtctggcctgcgagtctgccaaacctgggactaaatccggctttaagggattcgacacgtcgtcatcttcctcaaatagcgctgcttctagctcttttaagttcggggtcagtagtagttcaagcggtccaagtcaaacactcacttcaaccggaaacttcaagttcggagatcagggtggattcaagattggggtgtcaagtgacagtggttccataaatcctatgtcagaaggattcaaattcagcaaaccaatcggcgactttaaatttggcgtcagcagcgaaagcaaacctgaggaggtgaagaaggactctaagaacgacaatttcaaattcggcctgtcatctgggcttagcaacccagtctcgcttacgcccttccaattcggagtttcaaatttgggccaggaggagaagaaagaagagttgccaaaaagctcctctgccggcttttcatttggaacaggtgtgatcaattctactccagcaccagcaaatacaatcgttacctccgaaaacaagtcttcttttaatttggggaccattgagacaaagagcgccagtgtagccccttttacgtgtaagacttctgaagccaaaaaggaggaaatgccagcaacaaaaggcggcttttctttcggcaacgtggagccggcttcactgccctcagcctcggtatttgtcctaggtaggacagaagagaagcaacaggaaccagttacatcgacaagcctggtattcgggaaaaaagccgataacgaggagcccaagtgtcaacccgtgttcagctttggaaacagtgagcagaccaaggacgagaactcctccaaatccactttctcattttccatgaccaaaccaagcgagaaggagtctgagcagcccgccaaggccacttttgcgtttggcgcacagacctccactaccgcagatcagggagcggcaaaacctgtattttcctttctcaataactcatccagcagttcaagcacacctgccacaagtgctggcggaggcatttttggatcatctacgagctctagcaatccacccgtggccacattcgtgtttggacagagttccaatccggtctccagcagtgccttcggtaacacagccgagagcagcacctctcagtcactcctattctcccaggattctaaactcgctacaacctcgtctactggcacggccgttacccctttcgtttttggtcccggcgctagcagtaataacactacaaccagtggctttggcttcggtgcaaccacaacctcgtcaagcgccggctcatcttttgtcttcggcaccgggccatccgccccttcggcctccccagccttcggagcaaaccaaactcctactttcggacagtcccaaggagcttctcagcctaacccccccggctttgggtctatctcttctagtaccgcgctatttccaacaggaagccaacccgccccacctacattcggcacagtgagctccagctcccaaccgcccgtgttcggccagcagccctcccagtcagcatttggcagtggaacaacacctaactcatcctctgcatttcagtttggaagcagtacgacaaactttaatttcaccaacaattcacccagcggcgtgttcaccttcggagccaactcatcaactcctgccgcgtctgcccaaccctctggaagtggcgggtttccatttaaccagagtcccgccgcctttactgtggggagtaacgggaagaacgtctttagctctagcgggacctccttcagtggtagaaaaattaaaactgcagtccgacgccggaaatag

SEQ ID NO: 197908 - DNA, 4521 bp, Artificial Sequence
  Description of Artificial Sequence: Synthetic coding sequence
atggccagcggcgccggcggcgtgggcggcggcggcggcggcaagatcaggacgcggcgctgtcaccaaggccctatcaaaccataccagcagggcaggcagcagcatcaggggattctctcaagagtaaccgaatcggtgaagaatattgtgcccggctggttacagcggtactttaataaaaatgaagatgtttgcagctgttccactgatacctctgaggtacctcgctggccggaaaacaaagaagaccacctggtgtatgcggatgaggagtcctcaaatatcaccgatggaaggatcaccccagaacccgcagtgtctaacacagaagagccttctactactagcaccgcgagcaattaccctgacgtcctcacgcgccccagcctgcataggagtcaccttaatttctctatgctggagtcaccagctctgcactgccagccaagcaccagctcagccttccctatagggtcatcagggttctctctggttaaagaaataaaggattctacaagccagcacgatgacgataatattagcaccactagcgggtttagtagtcgcgcttccgacaaagatatcacagtgagcaaaaacacatcactacctccactgtggtcccccgaggccgagcgtagccactcactctcacagcatacagcaacgtcgtcaaaaaaacctgcgtttaacctgtctgcatttgggacgctgagcccgtccctcgggaattcctccattctgaagacttcccaactgggggatagccccttctacccagggaaaaccacatacggcggagcagctgccgccgtaaggcagtctaaactccggaacacaccctaccaggctcctgtgcggcggcaaatgaaggcaaaacagctcagcgcacaaagctacggcgtgactagctccactgctcggcgcatcttacaaagcctggaaaaaatgagctctccactggctgatgccaaaagaattccaagcattgtctccagccccctcaactccccccttgacaggtccgggatcgatatcaccgatttccaggctaaacgcgaaaaggtcgatagccagtacccccccgtccagcggctgatgaccccaaagcctgtcagcatagcgacaaaccggtccgtgtactttaagccaagcttgacgcctagcggcgagttcaggaagactaaccagcggatcgacaataaatgcagcaccggctacgagaagaacatgaccccgggccagaaccgagagcagcgtgaatccggattttcttacccaaacttctccctgccggctgcaaacggactatcgtctggcgtgggcgggggcggaggaaagatgagaagggagaggactaggtttgtggcgtcaaaacctctggaggaagaacgccagggcctgacggtcttacctaaactcatcagtagctcatgtgcacaagccattatcccctcttggccactaaaggtgctgcgcttgcaagaaatggaagtaccggtcctcccgaagatctcactccctatcacatctagctctctgccgaccttcaacttctccagccctgaaatcactacttcttcacctagccccattaattctagtcaggcactaactaataaagtacaaatgaccagccctagcagcaccggttcaccaatgttcaagttcagctctcctatcgtgaagtcgacagaagccaatgtacttccccctagtagtatcgggttcactttctctgttccagtcgctaagaccgcggagctgtccgggagcagctccaccctcgagccaattatttcttcaagtgcacaccacgtgaccaccgtcaactcgaccaactgcaagaagacaccacctgaagactgcgaaggcccatttcgtccagcggaaatcctgaaagaggggagcgttttggacatcttgaagagtcccggcttcgcctcccccaagattgattctgtggcagcccaaccaaccgctacctcccccgtagtttatactcggccagcaataagctctttcagctcctcaggcatcggatttggcgaatccctgaaagctggatccagttggcaatgtgatacttgtctgctgcagaataaagtgacggacaataagtgcatagcgtgccaggcagctaagctctcaccacgggacactgccaagcagactggtattgagacgcccaataagtccgggaaaaccaccctctccgcttcgggtaccggttttggggataaatttaagcccgtgatcgggacatgggactgtgacacatgtctagtccagaacaaaccagaagctattaaatgcgtggcctgtgaaacgcccaagcccggcacatgcgtgaaaagagcactgacactgactgtagttagcgaatccgccgaaaccatgactgccagctcaagctcttgtactgtgactaccggcactcttggttttggagacaaatttaagagacctatcggcagctgggagtgcagcgtgtgttgcgtttcgaataatgccgaagacaataagtgcgttagttgcatgagcgaaaagcctggaagctccgtacctgcctcttcttctagcactgtgccggtgagtttgcccagtggaggtagcctcggactggaaaaatttaagaagcctgagggaagctgggactgcgagctctgcctggtccagaataaggctgactccaccaagtgcttagcttgtgaatctgccaaaccaggaaccaagagtgggtttaaaggtttcgatacatcatcaagctcttccaacagcgccgcttcctcctcgtttaaatttggcgttagcagttcttcaagcggaccctctcagaccctcaccagcacgggaaactttaaattcggggatcagggagggtttaagattggagtgtcctcagactcaggctcaattaacccgatgtccgaaggctttaagttctccaaaccaatcggagactttaaattcggcgtgagctctgaaagcaaaccagaggaggtgaagaaagattctaagaacgacaactttaaatttggtctcagctctggcctgtcaaatccggtgtctctaactcccttccaatttggcgtaagtaacctgggtcaagaagaaaagaaagaggagttgccaaagtctagtagcgctggcttctcgtttggtaccggagtaatcaattccacccccgcccccgccaacaccatcgtgacatccgaaaacaagagcagcttcaacttggggaccattgagacaaagtcagcctcggtggccccttttacctgtaaaacatcagaagcaaaaaaagaagaaatgccggccactaagggaggatttagcttcggtaatgtggaacccgcttctcttccatccgcttccgtctttgtgctgggccgaacagaagagaaacagcaggagccggtgaccagtaccagccttgtgtttgggaagaaagcggacaatgaggagccaaaatgccagcccgtgttcagttttggcaatagtgaacaaacgaaagatgagaattccagcaagtcaaccttctcctttagcatgaccaaacctagcgaaaaagagtcagaacagccggccaaagccacatttgccttcggggcccagacctccacgaccgcagaccagggtgcagccaaacctgtcttctccttcctgaataatagttcttcctcttctagtacccctgccacatcagccggaggcggcatcttcgggagttcaacgtcctcctctaatccccctgtagccactttcgtcttcggtcagtctagcaaccctgtgtccagctcagcctttggaaacaccgcagagagctccacttcacaaagtcttctgttttcccaagactctaaattagccacaacttctagtactggaactgccgtgaccccctttgtcttcggtcctggcgctagttccaacaacacaacgacctccggctttggattcggagccaccacgactagcagtagtgctggctcctcattcgtcttcgggaccgggcccagcgccccctccgcctcccccgcttttggggccaaccagacacccacctttggtcagtcacagggcgccagccagccgaaccctccaggattcggctcaatttcatcctctaccgcgctgtttcctacgggtagtcagccagctccgcccacattcggcaccgtctcaagctctagccaaccccccgtattcggacagcaaccttctcagtctgctttcggaagcggtacaactcccaacagctcaagcgcctttcagttcgggagctcgaccacgaatttcaatttcactaataactccccatctggcgtctttaccttcggcgcaaacagcagtaccccggctgcatctgcccagcctagcgggtcaggcggctttcctttcaaccaaagccctgccgcttttaccgtgggctctaatggcaagaatgtgttctcaagctctggaacaagttttagcggcagaaagataaaaactgcggttagacggcggaaatag

SEQ ID NO: 197909 - DNA, 3555 bp, Artificial Sequence
  Description of Artificial Sequence: Synthetic coding sequence
atgatgcagctgctgcagctgctgctgggcctgctgggccccggcggctacctgttcctgctgggcgactgtcaagaggtgacaactcttacagtgaaataccaagtgtcagaggaagttcccagcggtacggtaatcggcaagctcagtcaagagctgggccgggaggagcgtcgccgtcaggcgggcgctgccttccaggtcctgcagctgcctcaagcgctgccaatccaggtggattcagaggagggtctgctctccaccggacgccgcctcgatcgcgaacagttgtgccgtcagtgggatccttgcctggtgtcctttgatgtgctggcgacaggggacctggccctcattcacgtggagattcaggtcttggatatcaacgaccatcagccgcgcttccctaagggtgagcaagagcttgagatcagtgagagcgcatcactgagaactcgcattcccctcgaccgcgccttagatcccgatactggtccgaacactttgcacacctacacactgagcccttcggagcacttcgccctggatgtcatcgtgggaccggacgagacaaagcacgcggaacttatagttgtgaaagagcttgatcgcgagatccactccttctttgatttagtcctcacagcttatgataacggaaaccccccaaaaagcggtacgtcattagtgaaggtcaatgtgcttgatagtaatgataattcccccgctttcgccgagtcttctttagctctggagatccaggaggacgccgccccaggtacactactcataaagcttacagcgaccgaccctgaccaaggtccaaatggggaggtggagtttttcttatccaagcatatgcccccagaagttctcgacacctttagtatcgacgccaagacgggccaggtcatcctccgccgcccacttgattatgaaaagaatccggcctacgaagtcgatgttcaagcccgggaccttggaccaaatcccatcccagcgcactgcaaagtcctcattaaggtgcttgatgttaacgataatatcccctccatccatgtgacgtgggcttctcagccaagtctggtctcggaagctctgccaaaagatagctttatcgccctggtcatggccgacgatctggacagtggccataatggcctggtacactgctggctgtcacaggagcttggccacttccgcctgaagcggactaatggcaatacctatatgttactgacaaatgccacccttgacagagagcagtggccaaagtacacattaactctgctggcgcaggaccagggactccagcctttaagtgcaaagaagcagctgagtattcagataagcgacatcaatgacaatgcccctgtgttcgagaaatcgagatatgaggttagcactcgcgagaataatttaccttctctacacctcattaccattaaagctcacgacgctgatctcggtatcaatgggaaagtctcctaccgcatacaagatagtcccgtggcacaccttgtggcgattgactccaatacaggagaagtgactgcacagcggtccctaaattatgaggaaatggccggatttgagttccaggttattgcggaggattctggccagcccatgctggcctccagtgtcagcgtatgggtctccctcctggacgctaacgacaatgccccggaagtggtgcagccagtcttgtccgacgggaaggcatccctgtccgtcctcgtcaatgcctcaactggccatttattggttccaattgagacccccaatgggctaggtcccgcgggaactgacacaccaccattagccacacattcttcaagaccctttctgcttactaccatcgtcgccagggatgctgactctggcgcaaatggcgagccgctgtactccatccgttccgggaatgaggcacaccttttcattttgaatccccacaccggacaactttttgtgaacgtaaccaacgcctcgagcctgataggcagtgagtgggaactggaaatagtcgttgaggatcagggcagccctcccttgcagaccagggcactgctgagggttatgtttgttacatctgtagatcacttacgggactcggccaggaaacccggcgcgttaagtatgagtatgctgaccgttatctgcctcgcagtgctcctcggaatattcggactgatactcgcccttttcatgtcaatatgtaggacagagaagaaagataacagggcttacaactgtcgcgaagctgagtccacctaccggcagcagccaaagaggccacaaaagcacattcagaaggccgatatccatctcgtccccgtactgcgggggcaggccggcgagccatgcgaggtcggccagtctcacaaggacgtggataaggaggccatgatggaggccggatgggacccctgtctccaggcccctttccacctgacacccacactgtacaggacactgcggaaccagggtaaccagggagcccctgccgaatcaagggaggtgcttcaagacacggtgaacctcctgtttaaccaccccaggcagagaaatgcctcccgcgagaacctgaacctgccagagccgcaaccagcaaccggccaacccagatcaaggcctctgaaagtggctggtagcccaactgggcgcctggctggagaccaaggaagcgaggaagccccccagcgcccaccggcatcatctgctacccttagacgacaaagacatctcaacggcaaagtctctccggagaaagagtctgggcccaggcaaattctgcgatccttggtacggttgtccgtcgccgcgttcgcagagagaaatcccgtcgaggaactgaccgtggactctcctccagtgcagcagatttctcaacttctgagcttactccatcagggccagttccagccaaaacctaaccataggggcaataaatacctggctaagcctggcggcagtagaagcgcgattcccgataccgacgggccttccgccagggcagggggtcagaccgacccagagcaggaggagggcccattagaccctgaggaggatcttagtgtgaagcaactgctggaggaggagctctcctccctgctagaccccagcaccggcttagcgctggatagattgagtgcccctgatccagcttggatggcacggttgagccttcctctcaccactaactaccgggacaatgtcataagtccagacgctgctgctacggaggaaccccggacttttcaaacctttggtaaggccgaagcgccagaattgtccccgacaggcactagattagctagcacctttgttagcgaaatgtcaagcctcttggaaatgctgctggagcagcgttctagcatgccagttgaggccgcttccgaggccttgcgccggctgtcagtgtgcggtcgcacattaagcctggacctggctacatctgccgcaagcgggatgaaagtacagggggatccaggaggcaaaaccggaactgaaggaaaatctcgtggaagcagcagcagcagccggtgcttgtag

SEQ ID NO: 197910 - DNA, 3999 bp, Artificial Sequence
  Description of Artificial Sequence: Synthetic coding sequence
atgagcgacatggactaccccctgcagggccccggcctgctgagcgtgccaaatctgcccgagatctcctcaattcgccgtgtgcccctccccccggagttagtcgagcagtttggacatatgcaatgcaattgtatgatgggtgtgtttccgcctatctcaagggcatggctgacaatcgactctgatatctttatgtggaactacgaagacggcggcgacctagcttattttgacggccttagcgaaaccatactggctgtcggcctggttaagccgaaggccggcatctttcaacctcacgtccgacatttactcgtcttggccacccctgtggatatcgtcatcctaggcttgtcctacgccaatctacaaacagggtccggagtgttgaacgatagcctcagcggcggtatgcagctgctgcctgatcccttgtattccctgccaactgacaatacatacctcttgaccattacatctacagataacggccgcattttcctagcaggcaaagatggatgcttgtacgaggtcgcatatcaagcggaagcgggctggttttcacagcgttgtcggaagataaaccactcgaagagtagcctgtcttttcttgtgccgtccctgctgcagttcaccttctcagaggacgaccccatcctccagattgccatcgacaatagccggaatatcctttacacaagaagtgaaaaaggggtgatacaggtctacgacctcggacaagatgggcaagggatgagccgggttgcctcagtgagtcagaacgccatagtgagtgccgcgggcaacatcgccagaactatagaccgcagcgtctttaaacccatcgtccaaatagccgtcatcgaaaattcagagtctttggactgtcaactgcttgccgtgacccatgccggtgtgcggttatatttcagtacctgtccttttcggcaaccgctggccaggccaaacaccctgactctggttcatgtgcgtttaccacccggtttctctgcatcatccaccgtggagaagccttcaaaggttcaccgagccctgtacagtaaaggcatcctcctgatggctgctagcgagaacgaggacaatgacatattatggtgtgtcaaccacgatactttccccttccagaaaccaatgatggagactcagatgacagctggtgttgacgggcactcgtgggctttgagcgcaattgatgagttgaaggtagataaaattatcacacctctgaataaggatcatattcccatcacagactcccctgtggtagtacaacagcatatgctgcccccgaagaagttcgtgctactcagtgcccaaggttctctcatgtttcacaagctgaggccagtggaccagcttcgtcatcttcttgtgtctaacgttggtggggatggagaggagatcgaaaggttcttcaagctgcaccaggaggaccaggcttgtgctacttgcctgattctcgcatgctccacggccgcctgcgatcgggaagtgagcgcgtgggccactcgtgcatttttccgatatgggggcgaagcacagatgcggtttcctaccactttaccccctcctagtaacgtggggccgattcttgggagcccagtgtattcatcttctcctgtgccgagtggtagcccctaccctaatccaagcttcttaggcactcctagccacggaatccagccacccgccatgtcgactccggtttgcgccctcgggaatcccgctactcaggctaccaatatgtcttgcgtgacagggcctgaaatcgtatattccggaaaacataacgggatctgtatctatttttcacgcatcatgggtaacatctgggatgcatcattggttgttgaacggatatttaagtctggcaatcgcgaaattactgctatcgagagttctgtaccatgccaacttctggaatctgtgctgcaggaactgaagggtctgcaggaatttcttgacagaaattcgcagtttgccggcggccccctcggaaatcccaatactacagccaaggtccagcagagactcatcggctttatgagacctgagaacggaaatccccagcaaatgcagcaggaattgcagagaaagttccatgaggcccagctgagcgagaaaatcagcttacaggctatccaacagctggtgaggaagagttatcaggcactcgcattgtggaaacttctctgtgaacaccagttcaccataattgtcgcagagttgcaaaaggagctgcaggaacagctcaagattacgacgttcaaggatctggtgatccgtgataaggagcttactggggcactgattgcaagcctgattaactgctatatccgcgacaacgccgccgtggacgggatatcactgcatttacaggatatctgtcccctgctctatagcaccgatgacgctatttgttcaaaagccaatgagcttctacagagatccagacaggttcagaacaagacagaaaaagaaagaatgctacgagaaagcctgaaggagtaccagaagatttctaatcaggtcgacctcagcaacgtgtgtgcacaataccgtcaggtcagattctacgagggcgtggtggaactgagtctgactgcagcagagaaaaaagaccctcaggggctgggcctgcacttctataagcacggcgaacccgaggaagacatcgtaggactccaggctttccaggaacgcctgaattcctataaatgtataacagataccctccaagagctggtaaaccagtccaaagccgcgccgcagtctcccagcgtgccgaagaagcccggaccccctgtgctgagttctgatcccaacatgctgagtaatgaggaggctggccaccactttgagcagatgctgaaactctcacagagatctaaagatgagctatttagtattgcattgtataactggctcatacaggtggacctcgccgataagttattgcaggtggccagtccttttctcgagccccatttagtgcggatggccaaagtagatcaaaacagagtgcgctacatggacttgttgtggagatattacgaaaaaaacaggagtttttccaatgctgcccgcgtcctgtctaggctagctgatatgcatagtacagagatatccttgcagcagaggcttgagtatatcgctcgcgctatcctgagtgctaagtcctcgaccgccatttcttcaattgctgcagatggcgaattcctccacgaattggaggagaaaatggaggtagcacgtatccagcttcagattcaggaaactctgcaacgccaatacagtcaccactcaagcgtccaggacgctgtcagtcagcttgactccgagttgatggacattaccaagctgtatggcgaattcgcagatccctttaagcttgctgagtgtaaactcgcgattatacactgcgccggttactctgatccgatactcgtgcagaccctgtggcaggatattatagaaaaggaattgtcagattcggtgacactttcaagcagcgataggatgcatgcccttagcctaaaaattgtcctcctaggaaaaatttacgccggaacccctcgcttctttccacttgactttattgtccagttccttgagcagcaggtctgcacattgaactgggatgtgggtttcgtcatacagaccatgaacgagattggggtgccattaccaaggcttctcgaagtgtacgaccagctgttcaaatcgcgggaccccttctggaatcgcatgaagaaaccattgcacctgctagattgtatccacgtccttctgatccgctacgtagagaacccatctcaggtccttaattgcgagcgccgcagatttacaaatctttgtctggacgccgtctgtggctacctggtggaactacagtcaatgtctagcagcgtggcagtacaggccatcacgggaaatttcaaatccctgcaggcgaagctcgagagactgcattag

SEQ ID NO: 197911 - DNA, 4062 bp, Artificial Sequence
  Description of Artificial Sequence: Synthetic coding sequence
atgtaccccgacctgagcgagctgctgatggtgagcgcccccaacaatcccaccgtgtcgggcatgagcgatatggattaccccctccagggaccaggcctcctttctgtgcccaacctcccagagattagtagcatcagaagagttccactgccgccagaactcgtcgaacagttcggccatatgcaatgtaactgcatgatgggagtgtttccccctatcagtagggcctggttaacgatcgactccgacatcttcatgtggaattatgaggacggcggtgacctcgcctacttcgacggtcttagtgagaccatcctcgccgtgggactggtaaaaccaaaagcaggaatttttcagccacacgtgagacatctactcgttctggctacccccgtggatatagtaatcctaggcctgagttatgcaaacctgcaaactggaagtggtgtgctgaatgactccctctcgggcggtatgcagctactgccagacccactttactccttgccaaccgacaatacttatctcttaacaattacgtctaccgacaacggccggatatttctggcggggaaggatggatgcctctacgaggtcgcctaccaggctgaagcaggttggttttctcaacgttgcagaaagataaaccattcaaagagttctctgtccttcctggtgccttctctcctgcagtttacattctcagaggatgaccccattcttcagattgccattgacaactcccgcaacatcctttatacacgctcagaaaagggggtgatacaggtgtacgatctgggacaggatgggcaagggatgtcgcgggtggcctctgtaagtcagaatgccatcgtatcagccgctggcaatatagcccggacaatcgacagatccgtgttcaaaccaatcgttcagattgccgtgatcgagaatagcgagagtcttgactgccagttgctggccgtgacccatgcgggcgtacgcctctatttctcaacatgtccctttcgacaacctctggcgagacccaatacgctgacactcgtgcacgtcaggctgccccctggctttagcgcatcatccactgtggagaagcctagcaaggtacacagggctctgtactccaaggggatcttgctcatggcagcctcagagaacgaagacaatgatattctgtggtgcgtgaaccacgataccttcccctttcagaaacccatgatggagacacagatgacagccggtgtggacggacacagttgggccctgtccgctatcgacgaactgaaagtggacaagattattacccccctgaacaaggaccatattcctattaccgatagtccagtggtagtgcagcagcacatgctgcctcccaagaaattcgtactgctctcagcccaaggatccctcatgttccacaaattgcggcccgtggatcagctcagacacctgctcgtttcgaatgttggcggggacggagaagaaatcgagcggttttttaaattgcaccaggaggatcaggcctgtgccacctgcctcatcttagcctgctcaaccgctgcctgcgatcgcgaagtatctgcatgggccactagagcatttttccgctacggcggagaggcccagatgagatttccaacaacgctgcctcctccttctaatgtgggacccattctgggctcccctgtgtactcaagcagccctgtcccttccggttcaccgtatcctaatccatcgttcttgggcaccccctcacatggtatccagccaccagccatgtccacccctgtttgcgcattaggaaatcccgccacacaagcaaccaatatgtcatgcgtgaccggtcccgaaattgtgtactctggaaagcataacggaatctgtatctacttctctagaatcatgggaaatatttgggacgcaagcctggttgtggagcgcatttttaagtccgggaacagagagatcactgccatcgagtcaagtgtcccctgtcagctgctcgagagcgtattacaagagctaaaggggctccaggagttcctggatcgcaactcgcagtttgcgggggggcctttgggcaacccgaacacaacagcgaaagtgcaacagagactgatcggattcatgcgacctgagaatggtaatccacagcagatgcagcaggagctccagagaaagttccacgaagcgcagctctcagagaaaattagtctccaagccatccagcagcttgtgcgcaaaagctatcaggctcttgctctatggaagctcctgtgtgagcaccaattcaccatcatcgtggcagagctgcagaaggagctgcaggagcagctgaagatcactaccttcaaagatcttgttatccgagacaaggaattgactggcgccctcattgcctccctgataaactgttacatcagagataacgcggctgttgatggtatttcccttcacttacaggatatctgccctctactgtattctactgatgacgcaatctgttctaaagcgaatgagctactgcaaagaagtcgccaagtgcagaacaagactgaaaaagaacggatgctaagagagtctttgaaggaatatcagaaaattagtaatcaggtcgatctgtcgaacgtgtgtgcccagtacaggcaggtgcgtttctatgaaggggtagtggaattgagcttaacagcagccgagaagaaagacccccagggactgggtctccacttttataagcacggagagcctgaggaagatattgtaggactgcaagcttttcaggaaaggctgaactcatacaaatgtatcacagacactctccaggaactggtgaaccaaagcaaggccgccccccaatcgccctctgtgcccaaaaagccaggacctcccgtgctgtcctccgaccctaatatgctatccaatgaggaggcaggccaccacttcgagcagatgttaaaactgtctcagaggagcaaagacgagctgttctcgatcgcgctctataactggctgattcaggtggacctggcagacaaactgcttcaggttgcaagtccatttctggagccgcatcttgttcggatggcaaaggtggaccagaaccgtgttcgctatatggatcttttatggcgatattacgaaaaaaatagatcgttttccaatgctgcaagggtactcagcagactggctgatatgcactccaccgagatctccctgcaacagcggttggagtatattgctcgggccattctttccgcaaagtccagcacagccattagtagcatcgcggctgacggcgaattcttgcacgagctggaggagaagatggaggtcgctagaatacaactccaaatccaagagactctgcaaaggcagtactcccatcactcctccgtgcaggacgccgtcagccagctggatagtgagcttatggacataaccaagctgtacggcgaattcgccgaccctttcaagctcgccgagtgtaaactggctattatacattgcgcaggctattcagaccccattttggttcaaactctctggcaggatatcattgagaaggagctgtcagacagcgtcactctctcatcctccgatagaatgcacgcactatctcttaagatcgtgctgctagggaagatctacgcagggacgcctaggttctttcctctggattttatagttcagttcttggagcaacaggtgtgtacgctgaattgggacgtgggattcgttattcagactatgaatgaaattggcgttccactcccacgacttctggaagtgtatgatcaacttttcaaatctcgggacccattttggaaccgcatgaagaaacctctccacttgctggattgtatccacgttctgctcataagatacgttgagaatccatcccaggtgttgaactgtgagaggagacggttcacaaatctgtgcctggatgccgtctgcggttatttggttgagctgcaaagcatgagttcctctgtggccgtccaggctatcaccggcaacttcaagagcttacaggcaaagctcgaacgtcttcactag

SEQ ID NO: 197912 - DNA, 3984 bp, Artificial Sequence
  Description of Artificial Sequence: Synthetic coding sequence
atgcccagcagcctgctgggcgccgccatgcccgccagcaccagcgctgcggcactccaggaagctctggagaatgcagggcgcctcatcgatagacaactgcaggaggatcgaatgtatcccgacctaagcgaactgttaatggtcagcgctcctaacaacccaacggtgagcggaatgtccgacatggattaccctctacagggtcctggtttattgtcagtgcccaacctgccagagattagttctatcagaagagtaccacttccgccggagcttgtggaacaattcggacatatgcagtgtaactgcatgatgggggtctttcccccaatatcaagggcttggttaacaatagattcagacatctttatgtggaactacgaagatggcggggatttggcctacttcgatgggctttcagagactatcctggccgtgggtttggtcaagcctaaggccgggatctttcagccccatgttaggcacctgctagttctggcaactcccgtcgacattgttattctgggattgtcttatgctaatctccagactgggtcgggggtgttgaacgactcgctgtctgggggtatgcagttgctgccggacccgctgtacagcctccccaccgacaacacttacctgttgacaatcacatccactgacaacggccggattttcttagcaggtaaggacgggtgtctgtatgaggttgcttaccaggcagaggcagggtggttctcccagcggtgccgcaaaatcaatcattctaaatctagtctgtcatttcttgtcccctcgctgctgcaatttacattctccgaggacgacccaattttgcaaattgcgatagataactctcgaaatatcctgtataccagatctgagaagggcgttattcaggtctatgatttgggccaggacggccagggaatgagtcgggtggctagtgttagccagaatgctatcgtctccgcagccgggaatattgccaggaccatagaccggtctgtctttaagcctatcgtacaaatcgccgtcattgagaatagcgagtctcttgattgtcagctgctggccgtgacccatgccggggtcagactctattttagtacatgccccttcagacagcccctcgctcgacccaatactctgactctggtacatgtgcgtctgccacctgggttcagtgcaagcagcaccgtagagaagccaagtaaggtgcacagggctctctacagtaagggaattctgctgatggctgccagcgaaaacgaggacaacgacattctgtggtgcgtgaatcatgacacatttccattccagaagcccatgatggagacgcagatgacggccggggtggatggccactcctgggccctctctgccatcgacgagctaaaagtggacaagattattactcctctgaataaggatcacatacctataacagacagccccgtggttgtgcagcaacacatgcttcctcctaaaaagttcgtccttctgtctgcccagggcagcctgatgttccacaagttgagacccgttgaccagcttaggcatctcctggtctcaaatgttggcggcgatggagaggagatcgagcgatttttcaaacttcatcaagaggaccaagcctgtgcaacctgtctgattttggcttgctctactgctgcatgtgatcgcgaggtgtcagcctgggcaaccagggccttttttagatacggaggggaggcacagatgcgctttccgacaacactgccccctccaagcaatgttggccccatcctaggttcgcctgtatatagttcttccccagtgcctagcggatcaccatatcctaacccctcatttttaggcacgccttcccacgggatccagccacccgcgatgagtacccctgtatgcgctttaggtaatcctgcaacccaggccactaatatgagctgcgtaaccggacctgaaatcgtgtactctggcaagcataatggaatatgcatctacttcagcagaattatgggcaatatctgggacgccagcctggtcgtagagcgcatcttcaaatctgggaatagggaaattactgccatagagagctcagtgccttgccagttgctcgagtctgtgctgcaggagttgaaagggctccaggagttcctcgaccgaaatagccagttcgcaggcggcccgctcgggaatcccaacacaaccgctaaggttcagcaacgcctaatcggcttcatgcggcctgagaacggtaatccacagcagatgcagcaggaactccaaagaaaattccacgaagcccaactctctgaaaagatttccctgcaggccattcagcagctggtccgtaaatcttatcaggccttagcactgtggaagctgctttgcgaacatcaatttactatcatcgtcgccgagcttcagaaggccaacgaactgcttcagcgaagtaggcaagtgcagaataaaacggaaaaggagcggatgcttagagaatcgctgaaagaatatcagaagatcagcaaccaggtagatctgagcaacgtttgtgcccagtaccgccaggtgcgtttctacgaaggggtcgtggagctgtccctgaccgctgccgagaagaaggacccacaggggctgggcctccatttctacaaacatggggagcctgaggaggacatagtggggcttcaggcgtttcaggagcggctaaattcctacaagtgtatcacagacacactgcaagaactagtaaatcagagcaaagcagcaccccagtcacccagtgtccccaaaaaacctgggccccccgttctgtcatccgatccaaacatgctctccaacgaggaagccgggcaccatttcgaacaaatgctgaaactgtcccagaggagcaaggacgagttgttcagcatagccctctacaattggctcatccaggtggatctcgccgataaattactgcaggtggcctcaccatttttggagccacatctcgttagaatggccaaggtggaccaaaaccgggtcagatacatggatcttctctggcgttattacgaaaaaaataggtcctttagcaatgcagccagagtgctcagccgcctggcagacatgcactcaacggagatttctctgcagcagagactggagtacatcgcaagggctatcttatctgctaaatcttccaccgccatatctagtattgccgccgatggggagttcctccatgaactggaagaaaagatggaggttgctaggattcagctgcagatccaagagaccttgcaacggcaatactcccaccattcttcagtacaggatgcagtttcacagctggactctgaattgatggacatcactaaactttatggggagtttgccgacccgttcaagctcgctgagtgtaagttagccatcattcattgtgccggctactctgaccctatcctggtccaaactctatggcaagacataatcgagaaagagctgtcagacagtgtaaccctgtccagcagtgatcgaatgcatgccctttccctgaaaatcgtgctgctggggaagatatacgcgggtaccccccgattctttcctttagactttattgttcagttcctggaacagcaagtctgcactcttaattgggatgttgggttcgttatccagactatgaacgagatcggagtccccctgccccgcctgctggaagtgtacgatcagttgttcaaatcacgcgacccattttggaatagaatgaaaaagcccctgcacctgctggattgtatacatgtccttctcatcaggtatgtagagaatccatcacaggtccttaactgtgagaggaggcgatttacaaacctgtgccttgatgccgtttgcggctacctggtggagctccaatcgatgtcttcatctgttgcagtccaagctattaccggcaatttcaagtcgttgcaggcgaagctcgaacggctacactag

SEQ ID NO: 197913 - DNA, 4311 bp, Artificial Sequence
  Description of Artificial Sequence: Synthetic coding sequence
atgctgcacctgagcgccgccccccccgcccccccccccgaggtgaccgccacagcacgaccttgtttgtgttctgtggggcgccgcggcgacggtgggaaaatggctgccgctggcgcgctggaaaggtcttttgtggaactgagcggtgccgaaagggaacgcccgcggcatttccgcgagtttaccgtgtgttccattggaaccgcaaatgctgttgcaggcgccgtcaaatattcggagtctgccggcggcttttactacgtcgaatcgggcaagctgttcagcgtgactaggaatcgatttattcactggaaaacaagcggggataccctggagttgatggaggagtcactcgatataaatctgctgaataatgccatacgattgaagttccaaaactgctcagtgctgcccgggggcgtttatgtatctgaaacgcagaatcgagtgatcatcctgatgttgacaaaccagacggttcacaggctcctcctcccccatccctccaggatgtatcggagcgagctggttgtagacagccagatgcagtcaattttcactgacatcggaaaggtggactttacagacccgtgcaattatcagttaattccagccgtccctgggatctctcccaactctactgcttcgacagcctggctgagtagcgatggagaggcgcttttcgcgctaccatgtgctagcggcggtatcttcgtcctcaagctgcctccatatgacattcctggaatggtgtccgtcgtcgagctgaagcagtcctcagtgatgcaacgcttgctcacgggatggatgcccactgccattcggggagaccaatccccctccgaccgcccgctcagcttagccgttcactgcgtcgagcacgacgcattcatcttcgctctctgccaggaccataaactgcgcatgtggtcttacaaagaacagatgtgccttatggtggccgatatgctggagtatgtgccagtgaagaaggatttgaggctgactgcgggtacaggtcacaagctccggctggcctattcacccaccatgggcctgtacttgggcatctatatgcatgctccaaaaagaggccaattctgcatttttcaattggtgagcacagagtcgaacagatactcccttgatcatatatcttctctctttacttctcaggagaccctgatcgacttcgcattgaccagtaccgacatttgggctctgtggcacgatgctgaaaatcaaactgtagtgaagtacatcaatttcgagcacaatgtggctggccagtggaacccggtcttcatgcagccactcccagaggaggagattgtgatccgggatgaccaggatccacgggagatgtatttgcagagcctctttacccccggacagttcaccaatgaggccctatgcaaagcacttcaaattttctgccgaggaaccgaacgtaatctggacctttcatggtcggaactgaagaaagaggtcacgctagccgtggagaacgagcttcaaggatcggtgacagagtacgagttctctcaagaggagttcagaaatctccagcaagagttttggtgcaaattctacgcatgctgcctgcagtatcaggaggcccttagtcacccgctggcactccacttgaatccccacacgaacatggtgtgcctgcttaaaaaaggctacttgagcttccttataccttcctctctggttgatcacctgtacttgttaccctacgagaatctcctaaccgaagacgagactaccattagcgatgacgtagatatcgctagagacgtaatctgcctgatcaagtgtttgaggctaatagaggaaagtgtaacagtcgatatgtccgtcatcatggaaatgagttgttacaatttgcaaagccctgagaaagctgcagagcaaatcctggaagatatgatcacaattgatgtggagaacgttatggaagacatttgcagcaaactccaggagattaggaatccaatccacgcaatcggattgttaattcgcgagatggattatgagaccgaggtcgaaatggagaagggctttaaccccgctcagccgctgaatatccgtatgaatttgacacaactctacggatctaatacagccgggtatatagtttgcaggggcgtgcataaaatcgcaagtactagattcttgatttgccgtgacctccttatcctgcaacagctgctgatgagactgggtgatgcagtcatctggggtacaggccagcttttccaagctcagcaggatctcctccaccgcaccgcgcccctgctcctgtcttattacctgatcaagtggggttcagagtgcctggccaccgatgttccattggacactctggaatcgaatctgcaacatctcagcgttctcgagttaacagattcaggtgccctcatggctaatcggttcgtgagcagtccacaaacaattgtggaactgtttttccaagaggtggcacgtaagcacatcatctcacatctcttttcacaacctaaggccccactctcccagacaggccttaattggcccgagatgattaccgcaattacctcttatctactgcaacttctatggccctctaatcccgggtgcttgttcctcgagtgtttgatgggaaattgccagtacgttcaactccaggactatatccagttgctccacccatggtgtcaagtgaatgttggttcctgtagattcatgctgggccgatgctatctggtaaccggggaggggcaaaaagcactggaatgtttttgccaggcggccagtgaagtggggaaagaggagttcctggatcgtttgatcagatccgaggatggcgagatcgtaagcacgcctagactccagtattacgataaggtactaagactgctcgacgtcattggtctccctgagctcgtgatccagctagctacctccgcaatcacagaagctggggatgattggaaaagtcaggcaacgctgcggacctgcatattcaaacaccacttagacctcggacataactcacaagcttacgaggcccttacacaaattccggatagcagtcgtcagctggattgtttgaggcaacttgtggttgtgctatgtgagcgttctcagctgcaggacctggttgagtttccttatgtgaacctgcataacgaggtcgtcggcattatcgagagtcgggctagagccgtcgatcttatgacacataactactacgaactcctctatgcatttcatatctacaggcacaactacagaaaggcgggtacagttatgttcgaatacggaatgagactgggaagggaggtgaggaccctccgcggactcgagaaacaaggaaactgttatctggccgctctgaattgccttcgccttatcaggcctgagtacgcctggattgtgcagccggtgtcaggagcagtctacgatcgaccaggtgcttctcctaaacgcaatcatgacggagagtgcaccgcagcaccgactaaccggcagatcgaaattctggagctcgaggacctcgagaaagaatgttccttggcccgcatacgcctgactttagcccaacacgacccaagtgcagtcgctgtcgcagggtcctccagtgccgaggagatggtgacactgttggttcaggcaggcttgttcgacactgccatatccctgtgtcagacattcaaactgcccctgacacctgtttttgaaggactcgcatttaaatgcatcaagctgcagttcggaggcgaggccgctcaggctgaggcctgggcttggcttgcagcaaatcaacttagctctgtgatcactactaaagagtctagcgctaccgatgaagcctggaggctgttgagtacatacttggagcgttacaaagttcagaataatctgtaccatcactgcgtcattaataagctgctctcccatggcgtgcctctgcccaactggcttatcaacagctataagaaggttgacgccgctgaactgctgcgtctgtatctcaactatgacttattggaagaggccgtggacttggtcagtgagtacgtggatgctgttctaggaaagggccatcagtacttcgggatcgaatttcccctatccgctactgctcccatggtgtggttgccctattccagtattgatcagctcctgcaggcactgggcgagaattcagcaaactctcacaacattgcgctttcacagaagatcctggacaagctggaggactatcaacagaaagtggacaaggctacgcgagacctgctatatcgacggactctgtag

SEQ ID NO: 197914 - DNA, 1452 bp, Artificial Sequence
  Description of Artificial Sequence: Synthetic coding sequence
atggtgagcgtggtggagctgaagcagagcagcgtgatgcagcggctactcacagggtggatgccaaccgccatccgcggagaccagtcgccttctgacagacccctatccctagctgtgcattgtgtggaacacgacgcctttattttcgctctgtgccaagatcataagctaagaatgtggagctacaaggagcagatgtgtttgatggtggcagacatgctggaatacgtccccgtgaagaaggacctgcggctgactgccggaaccggccataaacttaggcttgcttattcacccacaatgggcctgtacctggggatttacatgcacgctccaaagcgggggcaacgtcgcggttttgctatgcttcctggactcaaacttttgagctcgtccagcccacctacaagcgctagtcagtgcgcaggaataaccagcgtaaaccacagcacacagcccgagttctttttctgtatttttcagctcgtaagtacggaatctaatcgatattcactcgaccatataagcagcctctttacctctcaagagactttaatagactttgcactgacaagcacagacatctgggcgctgtggcacgacgctgagaaccagactgtggtcaagtatatcaacttcgaacacaacgtcgctgggcagtggaatccggtcttcatgcaaccactgcctgaggaagagattgtgatcagagatgatcaggacccccgggaaatgtacctccaaagcctattcacacccggccagtttactaatgaggcgctttgcaaggctttgcagattttctgtagaggcaccgagcgaaacctggacctgagttggagcgaactgaaaaaagaggtcaccctggccgtcgaaaatgaacttcagggtagtgttacagagtacgagttctcacaagaggagttccggaatctacagcaagaattctggtgtaagttctatgcatgctgtctacagtaccaggaggcactgtcacatccactcgcgttacatctgaatcctcatacgaacatggtctgtctgctgaaaaaaggatatctatccttcctgatcccaagctcactcgtggatcacctttatctcctgccatatgaaaatctgcttacagaggacgaaacaacgattagtgatgatgtagatatagccagggacgtgatatgtctgatcaagtgcctgcggttgattgaggagagcgtcaccgtagacatgtccgtcataatggagatgtcttgttataatttgcaaagccctgagaaggccgccgagcaaatactggaggacatgatcaccatagatgtagagaatgttatggaagacatatgctctaagctgcaggagattcgaaatcctattcatgccatcgggctacttatacgtgagatggactatgaaacagaggttgagatggaaaagggattcaacccatag

SEQ ID NO: 197915 - DNA, 675 bp, Artificial Sequence
  Description of Artificial Sequence: Synthetic coding sequence
atgctgcacctgagcgccgccccccccgcccccccccccgaggtgaccgcaacagcaagaccctgtctgtgctccgtgggccgcaggggcgacggcgggaaaatggccgccgccggggctctcgaaagaagttttgtggagctgtctggagccgagcgggagcgcccaagacacttcagggagttcaccgtctgctccatcgggaccgccaacgcagttgccggcgcggtgaagtactcagaaagtgcaggcggtttttactatgtggaaagtgggaaactgttttcggtgacccggaaccggttcattcattggaagacctcgggtgacacattggaactgatggaagagtctctcgacatcaatctgctgaacaatgccattcggctcaagttccagaattgctcggtgcttcccggcggtgtgtacgttagcgaaacacaaaatcgagtcataatattaatgttgactaaccagaccgttcatcgactgctcttgcctcatccaagcaggatgtacagaagcgtgtcttggctctctgccatcagcttcattagccagatcactctcggcgtgaccaatgtagtgttagagaggtgcttgcttgaactcaaagaaatatggattctggtcattccccaccaggcatatttcgattcgtacagattaaaatag

SEQ ID NO: 197916 - DNA, 6039 bp, Artificial Sequence
  Description of Artificial Sequence: Synthetic coding sequence
atggccacccccctggccgtgaacagcgccgccagcctgtggggcccttacaaggacatctggcataaggtcggcaatgcactctggaggcggcagcctgaggccgtccaccttctggacaaaattctcaagaagcacaagcccgatttcatttcgttgtttaaaaatcctccgaagaatgtgcagcaacacgaaaaggtccaaaaggcttccacagagggggtggcaatacagggccagcaaggaactagactgctccccgagcaactaattaaagaagctttcatactttctgacttgttcgatattggcgagctggccgccgtagaattgctgcttgctggtgagcaccaacagccccactttcctggtttgactagaggccttgtcgcggtcctgctgtattgggatgggaagaggtgtattgccaactccttaaaggccttgatacaatccagacgtgggaagacctggacactggagctatctccagagctggcatctatgacaactcggttcacagatgagctgatggaacaggggctgacctacaaggtgctaacgctggtttcccagattgacgtgaacaacgagttcgagaaattacagcgcgaacgcggcttaggatctgagaagcacagaaaagaagtttctgaccttatcaaagaatgccgtcagagtctggcggaaagtctctttgcctgggcctgccagtccccactgggcaaggaggacacgttgcttcttataggacatcttgagcgagtcacggttgaagctaacggctctctggatgctgtgaacttggccttacttatggccctcttgtattgcttcgatatctcttttatcgaacagagcacagaagagcgagacgatatgatccaccagctgccactccttactgagaagcaatatatcgcgaccattcattctcggcttcaggactctcagctgtggaagctccccggacttcaggccactgtgcggctcgcatgggccctcgcactaagaggcattagccagctgccagatgtcactgccctcgctgaattcaccgaagccgatgaggccatggctgagctcgctattgccgacaacgtgtttcttttcctcatggagtccgtggtggtatccgagtacttttaccaggaagagttctatataaggcgcgtgcacaatctgattacagacttcttggcactgatgcctatgaaagtcaagcagctgcgcaaccgggcagatgaggacgctcggatgattcatatgtccatgcagatgggtaacgaaccccccatcagtttgagaagagacctcgagcatcttatgctgctgataggtgaactgtacaaaaaaaacccatttcacctcgagcttgctctggaatactggtgtcccacagaacctctgcagaccccgacaattatgggatcatatttgggtgttgcccaccagcgccctccccaaagacaagtggtacttagtaaattcgttcgacagatgggagatcttctaccccccacaatttacattccatacctcaagatgctgcagggactcgccaatggtccacagtgcgcccactattgcttctctctgttgaaagtgaacggctcctcccatgtggaaaatatccagggcgcgggcgggtcacccgtgtcctgggagcatttcttccacagtctcatgctttatcacgagcatctgcggaaggacctaccaagtgcagacagtgtccagtatagacatcttcctagtagaggcatcacacaaaaagaacaggacgggttgattgcctttctacaactgacaagcacgattatcacctggagcgagaatgcccgccttgccctgtgcgagcacccccagtggacccccgtggtcgtcatattgggactgttacaatgttccattccaccggtgttaaaagccgaactgctgaaaacactcgctgcctttggaaaatcccctgagattgcggcctccctttggcagagtctagagtacactcagattttgcagacagtgaggattccatcccagagacaggcaattggaatcgaagtcgagttgaacgagatagaatcgcggtgtgaggagtatccattgactcgggccttctgtcaattaatcagcactctcgtggaatctagttttcccagtaacctgggagctggcctgcgaccacccgggttcgatccttacttgcagtttcttcgcgactccgtgttcctgcgcttccggaccagggcctaccgccgggccgcggagaaatgggaggtggccgaggtggtgctcgaagttttctataaactgcttcgcgattatgagccccagctcgaagactttgtggaccaattcgtggaactacagggagaagaaattatagcgtacaaacctcccggcttttctctgatgtatcacctcctaaacgagagccctatgttggaactggcactgtctcttctggaagagggcgtgaaacagctggatacctacgctccttttccaggtaagaagcacttagagaaagccgtacagcactgtctggctctgctgaacctgacactgcaaaaggaaaatctatttatggacctcctgagagagtcacaactggccctcatcgtttgcccgctcgaacaacttctccaaggcattaacccccgcacaaaaaaggctgataatgtagttaatatagccaggtacctgtaccatggcaacactaaccccgaactggcatttgaatcagcgaaaatcctgtgttgtatctcatgtaatagtaacatacagatcaagctggtcggggatttcactcatgatcaatccatatcacagaaactgatggcaggcttcgtagaatgcttagattgtgaagacgctgaggagttcgtaaggctggaggagggatcagagctggagaagaagctcgtagcaataagacacgaaacccgcatccacatcctgaacctgcttatcaccagcttggaatgcaaccctcctaatctggccctgtatctcctgggctttgagctgaagaagcctgtgtcgactaccaacctccaggacccgggcgtgctgggctgcccccgaacctgtctgcatgccatcctcaatatcttggagaaggggaccgagggccgcacaggccccgtggcggtgcgagaaagtcctcaacttgctgagctgtgttatcaggtaatctatcaactctgcgcttgcagcgatacgagtgggcccactatgagatacctgcggacatcgcaggattttctgttctcccagttgcagtacctgccctttagcaataaggagtatgaaatatcgatgctgaatcagatgtcatggctcatgaaaacagcctccatcgaacttagagtgactagcctgaaccgacagcggtcccacacgcagaggctcctgcacctgcttctcgatgacatgcccgtcaagccctactccgacggcgagggcggcatagaagatgagaaccggtccgtgagtggattcctgcactttgatacagctaccaaagtgcgcagaaaaattctgaatattctggacagcatcgacttcagccaggaaatacccgagcccctccagcttgactttttcgaccgggcccaaatcgagcaggtgatcgcgaactgtgaacataagaatcttcgtggtcaaacagtgtgcaatgtgaaactactgcaccgggtcctcgtcgcggaggttaatgccctgcagggcatggcagccattggtcagcggcccttgcttatggaagaaatctcaaccgtgttacagtatgtggtgggacgcaacaagctgctgcagtgccttcacgccaaacgccacgccctggaaagttggagacaactggtagagattatcctgaccgcctgtcctcaggatctcatccaagcagaggacaggcagctgatcattagggacattctgcaggacgtgcacgataaaatcctcgacgacgaagctgcgcaggagcttatgcctgtggtggccggggcagtcttcaccctgactgctcatttgagccaagccgtgctgaccgagcagaaggaaactagcgtcctgggacccgcggaagcccattatgcgtttatgttggactcttgcttcacctctccgccgcccgaggagaatcctttagtggggtttgccagcataggcgattcatctctgtacattattttaaaaaagctgcttgactttatcctcaagacaggcggcggatttcagagagtgcgaactcacctctacggtagtcttctgtactatctccagattgcacaacgtccagatgagcctgacaccttggaagctgccaaaaaaaccatgtgggaacggctgacggcccccgaggatgtgttcagcaagctccaacgggagaacatagcaatcatcgaatcttacggcgccgcattaatggaggtggtgtgtagggacgcttgcgacggacatgaaattggacgcatgctcgcccttgccctgcttgatagaatagtttcagttgacaagcagcaacagtggctgctctatctatccaacagcggctatctgaaggtgctagtcgatagcctcgtggaagacgatcggaccctgcagtcccttttgacaccacaacctcccttgctgaaggccttgtacacttatgagtccaagatggcatttctaacccgggtggccaaaattcagcagggagccctagagctcctgcgatctggggtcatcgtccgactggcccagtgtcaggtgtatgacatgcggccggagacggacccccagtcaatgtttgggatgagggatcctccgatgtttattccaaccccagtggacagataccgccagatcttactgcctgccttacagctctgccaagtgatcctgacctcctctatggcccaacacctgcaggccgcaggacaagtgctgcaattcttaatctcccattctgacacaatccaggccatcctgaggtgtcaggacgtgtctgctgggagcttgcaagagctggctctgctcaccgggattatctcaaaggcagccctcccaggaattctgtctgagctagacgtggatgtgaacgaagggagcctcatggagctccaaggccacatcgggagattccagcgtcagtgcctgggcctcctgtccagatttggaggttcagatcgcctgaggcagtttaagttccaggacgataatgtagaaggagataaggtctcaaagaaggatgagatagagctcgccatgcagcagatttgcgctaatgtgatggagtattgccaaagcctgatgctgcagtctagcccaacgtttcagcacgctgtgtgcctgtttacccccagcttgagtgagacagtaaacagggacggccctagacaagatactcaggcacctgtggtgccttactggagattgccaggtctgggaataatcatctacctattgaagcagtccgccaacgattttttctcttattacgactcccatcggcagtctgtcagcaaactgcagaatgtggagcagttgccccctgacgaaatcaaggagctgtgccagtcggttatgcccgccggagtggataagatctcgaccgctcagaaatatgtgctcgctaggaggaggctggtgaaagtgataaataatcgggcaaagctcctgtctctgtgctccttcattattgaaacgtgcctgttcattctatggcggcatttagaatattatctcttgcactgcatgccgactgactctcaggattccctctttgcctcccgcactttgtttaaatcccggcggctgcaggatagcttcgcaagcgaaacaaatctagattttcgtagtggtctcgccattgtcagtcaacatgacctggatcagctccaggctgacgccattaacgcattcggtgaatccctccagaagaagttactggacattgagggactgtactccaaggtccgttcccgctacagctttattcaagcgctcgtgcgccggataagaggattactccggataagccgtaattag

SEQ ID NO: 197917 - DNA, 750 bp, Artificial Sequence
  Description of Artificial Sequence: Synthetic coding sequence
atgagcctgcggaactacagcgagcgggaggtgagcgacctgatcaaggagtgtagacagagtctcgccgaatcactgtttgcgtgggcctgtcaatctcccctcggcaaagaagatacgctgttgctgatcggtcatctggagagagttaccgttgaagccaatgggtcattagacgcagtcaacctggctctccttatggcgctgctgtattgcttcgacattagtttcatcgaacagtccactgaagagcgcgacgatatgatccatcagctgccactgctgacggaaaagcagtatatcgccactattcactcgcggctgcaggatagccagctctggaaattgcctgggctccaggcaacggtccggttagcctgggccttggcgttgcggggtattagtcagttgccggacgtgaccgcgctggctgagttcacggaagcagacgaggccatggctgagctggctattgcagataacgtttttctgtttctcatggagagcgtagttgtcagcgagtacttctaccaggaggagttctacatacgacgcgtccacaatttgatcacggacttcctcgcacttatgcctatgaaggtaaagcagctgcgcaaccgagccgacgaggatgcgaggatgattcatatgtcaatgcagatgggaaatgagccacctatctcactgcgccgggaccttgagcatcttatgcttttagtttcgaaattactggtgctgagactcaattag

SEQ ID NO: 197918 - DNA, 5664 bp, Artificial Sequence
  Description of Artificial Sequence: Synthetic coding sequence
atggccgcccggggccggggcctgctgctgctgaccctgagcgtgctgctggccgccggtccatcagctgctgccgcaaaactaaatatcccgaaggtcttgctgccttttacaagagccacgcgggttaatttcacattggaagcctctgaaggatgctacagatggctgagtaccaggcccgaagttgcatccattgagccccttggcctcgacgagcagcaatgcagccagaaggccgtggttcaagcccgcctcactcagcctgcccggctgacttccattatctttgccgaagatattacaaccggccaggtgttgagatgcgacgccatcgtcgatctgatacatgatatccaaatcgtatcgacaacgcgggaattatatttggaagattctccactcgagctcaaaattcaggcacttgacagtgaaggcaacaccttttctacactggccggcctggtgtttgagtggacaatagtcaaggacagcgaggccgatagattctctgacagtcataatgccctgaggatcttaaccttcttggagtcaacatatatccctccatcctatatttctgagatggaaaaagccgccaagcagggagacacaattctggtcagcggaatgaaaacaggcagttctaaattgaaggcccgaattcaggaagccgtgtacaaaaacgttaggccagccgaagttcgattgctgatcttagaaaatatactgttgaaccccgcatatgacgtgtatctcatggtcgggaccagtatccactataaagtccagaaaatccgccaaggcaaaatcaccgaactgtcaatgccttccgaccagtacgagctgcagctgcagaacagcatccccggccctgagggagacccagccaggcctgtggctgtccttgcccaggacactagtatggtgacagcactgcaactgggccagagctcacttgtactggggcacagaagcatcagaatgcagggcgccagtcgattacccaacagcactatatacgtggtggagccagggtatttagggtttactgttcacccaggtgaccgctgggtgctagaaacaggtcgactatacgagataaccatagaggttttcgataagttttccaataaggtatatgtttccgacaatatccgaatcgaaactgtcctgcctgccgaattcttcgaagtgttatctagtagccaaaacggttcttatcacagaattcgcgccttgaagaggggccaaacggctatcgatgccgcactgacctcggttgtagatcaagatggaggagtgcatatcttgcaggtgcctgtctggaaccagcaggaggtggaaatccacatccccattaccctttaccccagtatcctgaccttcccatggcaacctaagactggcgcctatcagtatactataagagcccacggcggatctgggaactttagctggtcttctagttcacatctcgttgcaacagttaccgtgaagggcgtgatgaccaccggctccgacattggattctcggtgatacaagcacacgatgtgcaaaaccctctacactttggggagatgaaagtctatgtgatcgaaccccattcgatggaatttgcaccatgtcaagtggaagctcgtgtggggcaagcactggaactcccgttaagaatatccgggttaatgcccggtggggcaagcgaagtcgtcactctgtccgattgtagccattttgatcttgctgtggaggtcgagaatcagggcgtcttccagcctctcccaggtaggctgccgcctggatcggagcactgttctggtattcgagtcaaggccgaggctcaaggctcgaccacattgctggtgtcctacagacacggtcacgtacacttaagtgctaaaattaccatcgctgcttacctccctctcaaggctgttgatccgagcagcgtggcacttgtgactctcggttcttccaaggaaatgctttttgagggtggacctcggccttggatactggagcctagcaaatttttccaaaatgtcacagccgaagacacagactccattggtctggctctcttcgcaccccattctagcagaaattatcagcaacactggatcctcgtgacctgtcaggccctcggagagcaagtaatcgccttgtcagtgggcaacaagcctagtctgacaaatccgtttccagcagttgaacctgccgtagttaagtttgtgtgcgccccaccaagtcgcctgactctggcacctgtgtatacttcaccccagctcgatatgtcttgcccgctgctacagcagaataaacaagtggttccagtgagcagccaccgcaatcctagattggacctcgccgcgtacgatcaagagggacgccgattcgataacttctcctctctttctatccagtgggagtcaaccaggccagtgttggccagtattgagcctgagttacctatgcagctggtatctcaggacgatgagtccggtcagaagaagctgcatggcctgcaggctattctcgttcatgaggcttcgggcacgacggccataaccgcgacagcaaccggctatcaagaatcccatttatcgtccgccaggacaaagcagcctcacgacccactggtgcccctgtcagcttccatcgagctcatcctggttgaggatgttcgcgtctcacccgaggaggtcacgatctataaccacccagggatccaggcagagctgagaattagagaagggtctggatatttctttctgaacacttctacagccgatgttgtgaaagtcgcctaccaggaagcacggggggtagcaatggtgcatccactcctccccggcagcagtaccattatgatccacgatttatgtctggtattcccagcgcctgccaaggcggtggtttacgtctcagatatccaggaattatatatacgcgtggtggacaaggtggaaatcggcaagaccgtgaaggcctatgtgagagtcctggatctccataagaagccctttctcgctaagtacttcccattcatggatcttaagctccgagccgccagtccgattatcacattggtcgccctggacgaggcactggacaactataccatcacctttctcatcaggggagtcgctattggtcagaccagcttgacagcctcggtgactaacaaggcaggccagcggattaactctgccccccagcagatagaggtcttcccgccattcagactgatgccacgcaaggtcaccctgctgatcggcgcaacgatgcaagtgacgtccgagggagggccacagccacaaagcaatatcctgtttagtatctctaatgagagtgtggcccttgtgagtgcagcaggtttagtgcaggggctagccatcgggaacgggacagtcagcgggttggtgcaggccgtagacgctgagaccggcaaggtggtgatcatctcacaggacctggtgcaggtcgaggtgctgctcttgagagcagtcaggattcgcgctccaatcatgcgaatgcggaccggtacgcagatgcccatttatgttaccggtataactaatcaccagaacccattcagtttcggtaacgccgtgccaggcttaacttttcactggtctgttacgaaaagagatgtcttggaccttcgggggaggcaccacgaggcgagcatacgactcccttctcaatacaatttcgcgatgaacgtgctcgggcgagtcaaaggtagaacagggctgagagtagtggtgaaagctgtcgatcctacaagtggtcagctctacggcctggcccgcgaactgtccgatgaaattcaggtgcaagttttcgaaaaattgcagctattaaatcccgagatcgaggcggagcagatcttgatgtctccgaattcttacatcaagcttcagactaacagagacggagctgctagtcttagttatagagtattggacggcccagaaaaggtgccagtggtccatgtcgacgagaaaggctttctggcatccggctccatgatcggtaccagcacaatcgaggtgattgcacaggagccctttggggcgaaccagacaatcatcgtcgccgtgaaagtttctcctgtaagctatttgagggtgtccatgagtccggtgcttcacactcagaataaagaggcactggtggccgtgccattaggcatgaccgtcactttcactgtccattttcacgataatagcggggacgtatttcatgcccattctagtgtgctgaatttcgccacaaaccgagatgactttgtgcagattggtaaggggcccaccaataatacttgtgtggtacgaaccgtcagtgtgggcctcaccttgttgagggtatgggatgccgaacatcccggactatctgatttcatgccgctgcccgtcctgcaagctatttcccctgaactatcaggcgctatggtggtaggggatgtgctctgtctcgcaaccgtcctgacaagcctggagggcctctccggaacctggtcctcttccgcaaattcgattttacacattgaccctaagacaggcgtggcggtggccagagctgtgggttcggtcactgtgtactatgaagtcgcgggccacctaaggacatacaaggaagtcgtcgttagtgtaccccagcggattatggctcgccaccttcaccctatccagaccagctttcaggaagctaccgcatccaaagtgatcgtggccgtgggtgacagatcctccaacctgcggggagagtgcacacctacgcagcgtgaggtcatccaggcactgcaccctgaaacacttataagctgtcagtcccaatttaagcccgcagtctttgactttccctcccaagatgtgttcacggtggagcctcagttcgacacagctttgggccagtacttttgtagtattaccatgcacagactgactgataaacaacgaaaacacctgtcaatgaagaagaccgcactggtcgtttcggccagtttatcaagcagccattttagtaccgaacaggttggggccgaagtaccgttcagccccgggctcttcgcagaccaggccgagatactgctgtccaaccattatacctcgagcgagatcagggtatttggcgcccccgaagtgctggaaaatctcgaagtcaagagcggatctcccgccgtgctggctttcgctaaggagaagtcctttgggtggccctcattcatcacatacacagtcggcgtactagatccagccgcagggtcacagggccccctgtctacaacattaactttctcgtcgcccgttactaatcaggcgatcgctatacccgttactgtagcattcgtggtggaccggcggggacctgggccttatggcgcatctctgttccagcactttctggatagctaccaggtcatgttcttcacactgtttgccctgctggcaggcacggcggttatgatcattgcttaccatacagtgtgtacacctcgtgacctagccgtgccagccgctctgacaccaagagccagtccaggtcatagtccacactactttgctgcttctagccccacctctcctaatgccctgccccccgctaggaaagcctcccctccttccggtctctggtctcctgcctacgcaagccactag

SEQ ID NO: 197919 - DNA, 6273 bp, Artificial Sequence
  Description of Artificial Sequence: Synthetic coding sequence
atgggcgacgagatggacgccatgatccccgagcgggagatgaaggacttccagtttcgggccctcaagaaagtgcgcatttttgactccccggaggagttgccaaaggagcgatcatccctgctggccgtgtccaacaagtatgggctggtgttcgctggcggggcttccgggctgcagattttccctaccaagaatcttcttatacagaacaagccaggagatgatcccaacaagatcgtcgataaagtccaaggccttttggttcccatgaaattccctatccaccacctagccttatcctgtgacaacctaactctgagcgcatgcatgatgagcagcgagtatgggagcatcatcgctttcttcgatgtccggactttttcaaacgaggcaaaacagcagaagagacccttcgcttatcacaagttgcttaaagacgcaggtggtatggttatagacatgaaatggaaccctacagtgcctagcatggtggctgtttgccttgccgatggcagtatagccgtgctacaagtgaccgaaactgttaaggtgtgcgctacactgccaagcaccgtggcagtgacaagtgtgtgctggtcacctaagggaaaacagctcgctgttggcaagcagaacggcactgtggtgcagtacctcccaaccttacaggaaaagaaagtgattccgtgcccccctttctatgaatctgaccaccccgtgcgcgtgctggatgtcctctggataggtacctacgtattcgcaatcgtgtacgcagcagctgacggcacactagagacatctcccgatgtggtgatggccctccttcccaagaaggaggagaagcaccccgagatcttcgtaaatttcatggagccgtgttacgggtcatgcacagagcgacagcatcactactacttgagttatattgaagaatgggacctagtgttagccgcgagcgctgccagtacggaggtgtccatcctcgccaggcagtccgaccaaatcaactgggaaagctggttgcttgaagacagttcccgagccgaactgcccgtcactgataaaagtgacgatagcctgccaatgggagtggtcgtagattacacaaaccaagtggagattacaatctccgacgagaagaccctgccccccgcaccagtcctgatgctcttaagcactgatggagtgctatgtccattctacatgattaaccagaaccccggggtgaagagcttgatcaagacgccagaacggctcagccttgagggtgaaagacagcctaagtcaccaggatccacaccaacaacacctacctccagccaagccccccagaaactggatgcctcagctgcagcagctccggcatccctgcctccctcatcccccgctgcgcccatcgcgactttcagtcttctgcctgcagggggggcccccactgtgttttcatttggatccagctcactaaagtcaagtgctacagtgacaggcgagcccccttcctacagttccggctcagactcctcaaaggccgctcctgggccaggccccagcacgttttccttcgtccccccatctaaagccagtctggctcccaccccggctgcctcccccgtggccccgagcgccgcaagctttagctttgggtcaagtggcttcaaacctaccctggagtctaccccagtgcctagtgtttccgcccctaacatagccatgaagccaagtttccctccctccacctcagccgtcaaagttaatttgagcgagaagttcaccgccgctgctacatcaacccccgtgagcagctcccagtctgccccacctatgagcccattctcatcagcaagcaagccagctgcctctgggcctttgagccatcctacccccctgtctgcacctcccagcagtgtgccactaaagtcatccgtcctccccagcccaagcgggcggagcgcccagggtagcagttccccagttcccagcatggttcagaagtctcctcggatcactccaccggccgcgaaacccggctcaccccaggcaaagtcccttcaacccgctgtggccgaaaagcagggacatcagtggaaggacagcgaccctgtgatggctggaatcggcgaggagatagcgcactttcagaaggagttagaagagctaaaggcacgcacctctaaagcttgcttccaggtcggtacgagcgaagaaatgaaaatgctgcgcaccgaatccgacgacctgcataccttcctgttggagatcaaggagaccacagaatccctgcacggcgacatctccagcctgaaaacaaccctcctggaaggtttcgcaggggtggaggaagcccgagaacagaatgagagaaaccgggatagcggctatctgcacctcctgtataagcgccccctggatccgaaatcggaggctcagcttcaggagataaggagactgcaccagtacgtcaagtttgccgtgcaggatgtcaacgacgtgctggatctagaatgggatcaacatctggaacagaagaaaaagcagaggcacctgctcgttccggaacgcgaaacacttttcaatactcttgctaacaatcgggagattatcaatcagcagagaaaacgtctcaaccacctagtagactccctgcagcagctgagattgtataagcagacttccttatggtcactgagttctgctgtccctagccagtcgagtatccacagcttcgattctgatcttgagtcattgtgtaacgcccttttaaaaacgaccatagaatctcatacaaaaagcttgccgaaagtcccagccaagctttctccaatgaaacaggctcaactaaggaatttcctggctaaacggaaaacccctccggtcaggtcaactgcaccggcatcactgtcacgctccgcattcttatcccagcggtattacgaggatttagacgaggtgtcctctacgagttccgtgtcgcagtcccttgaaagcgaggatgctagaacctcttgcaaagatgatgaggccgtggtccaagcccctcgccatgcgcccgttgttaggacaccctctatccagcccagcctgctccctcacgccgcgcctttcgcaaaatcacacctggtccatggttcaagtcccggcgttatgggcacatcagtcgctacctcagcttctaaaattattccccagggtgctgactctacaatgctggcaacaaagaccgttaagcacggagcccccagcccctcacacccaattagtgcgcctcaggcagcagcagcggccgcactccggaggcagatggccagtcaggccccagcggttaatactctgactgagtccactttgaaaaatgtgccgcaggtggttaacgtgcaggaacttaaaaacaatcctgcaaccccgagcaccgcaatgggctcaagcgtgccgtacagtaccgccaaaactccgcatccggtgctcacccccgtggctgctaaccaggccaagcagggctcccttatcaatagcctaaaacctagcgggcctacccccgcatcgggacagctctccagcggtgataaagcgagtgggactgcgaagattgagaccgcagtcacctcgactccctcagcatccggccagtttagcaagccatttagtttctccccttctggcacaggctttaatttcggcattatcacgcccacccctagttccaacttcacggctgctcagggtgcaaccccctccactaaggagagctctcagccagacgccttttcctctggcgggggatccaaaccctcatatgaggctattccagaatcctctcctccctccggtattacttctgcttctaacaccacccccggcgaacctgccgcaagcagctcgaggcccgttgcaccttctggcacggctctttcgacaaccagcagcaagctcgagacccccccatctaaactcggcgaactgctcttcccaagctcattagcaggtgaaacactgggtagcttcagcggcctccgggtcggacaggcggatgacagcaccaaaccaacgaataaggccagttccacttcgctaaccagcacacagccaacaaagacatcaggggttccgagcggctttaatttcaccgccccacctgtgttaggaaaacacaccgagcccccggtaacatctagcgccacaacaacaagtgtcgccccccctgccgcaacttctacttccagcacagcggtttttggatcgctgcccgttacaagcgctgggtccagcggagttatcagtttcggcggtacaagtctgagtgcaggcaagacctcattttctttcgggtctcagcaaactaattctacagttcctccctctgcaccgccaccaacgacggcagccacgcccttacccacatcctttcccaccctgtccttcggcagcttactctcaagcgccaccaccccaagtctgccaatgtccgctgggagatctaccgaagaagctacttctagtgctttgcccgaaaaacctggagatagcgaagtgtcagctagtgctgcttccctgctggaagagcaacaatccgcacagctgccgcaggcaccacctcagacgtcagactcggtgaagaaggaaccagtgctagcacaaccagctgtttcaaattcaggcactgcggcatcatctacaagtctcgtggcactcagcgccgaggcaacccctgccactaccggagttcctgatgcacgcaccgaggctgtgcccccggcctcaagtttctctgtgcctggacagacagccgtgactgccgccgcaatctcatccgccggcccagtggctgtcgagacatcaagcaccccgatagccagcagtactactagcattgttgctcctggaccgtcagccgaggccgccgcctttgggaccgtgacatctgggtccagtgtgtttgcacaaccacctgcagcgtccagctccagcgcatttaaccaactcaccaacaacacagcaacagccccgtctgccacaccagtcttcggtcaggtagccgcttcaactgccccctctctgtttggtcagcagaccggatcaacagctagcaccgccgcagcaaccccccaagtttcctcatccggtttttcctcacctgccttcggcaccacggctcctggcgttttcggacagacaacttttggtcaggctagtgtgttcggacagagcgcttcttcagccgcgtcagtgttttcattctcccagcccgggttttcaagcgtgcctgccttcggccaacccgctagctccacacccacaagcacctcgggcagcgtgttcggagccgcgagtagtacttccagctcctcttcatttagctttggtcaatccagcccaaatactggggggggtctgttcggtcaaagtaacgctccagctttcgggcagagtcctggcttcggacagggagggtccgtctttggggggacttctgccgcaactaccacagcagccactagcggcttcagtttttgtcaggcatcggggttcgggtcatcaaatacgggatcagtatttggccaggcagcctccaccggcggcatcgtgttcgggcagcagtcaagttcttcctctggcagcgttttcggaagcggaaacactggccgtgggggcggctttttcagcggtctggggggcaaaccgtctcaggacgccgctaataagaaccccttctcttcggcaagtgggggatttggcagcaccgcaacatccaacacctcgaacttattcggtaattctggtgctaagacattcggggggttcgcctcatcctcatttggcgaacagaagcccacagggaccttttcttccggagggggttcagtggcttctcagggattcggcttcagctcacccaataaaactggagggtttggcgcggcgccagtttttggaagtccccccactttcgggggtagcccaggttttggcggcgtgcccgcctttggatctgcaccagcctttacctctccactgggttccacagggggcaaagtctttggcgaggggaccgccgcagccagtgcagggggttttggttttggcagctcaagcaacacaacctctttcgggacgttagcttcacagaacgcccctacattcggcagcctatctcagcagacatccgggtttggcacccagtcctctgggttctctggtttcgggagtggcacggggggcttctcgttcggcagtaataacagcagcgtccagggctttgggggatggcgaagctag

SEQ ID NO: 197920 - DNA, 6243 bp, Artificial Sequence
  Description of Artificial Sequence: Synthetic coding sequence
atgggcgacgagatggacgccatgatccccgagcgggagatgaaggactttcagtttcgcgctctcaaaaaggtgcggatcttcgactccccagaagaactccctaaagaacgcagcagcttgcttgccgtgtcgaataagtacggcctggtatttgccggcggagcttctggcctacagatctttccgacaaaaaatctgttaatacagaacaagccaggggatgaccctaacaaaattgtcgataaggtacaggggctacttgtcccaatgaagttccccattcaccatctggccttgagctgcgacaacctgaccctcagcgcatgtatgatgtcttctgaatatggaagcatcattgcttttttcgacgtgcgcactttttccaacgaggccaaacagcagaaacgaccatttgcttatcacaaacttctgaaggatgctggcggcatggtgatcgatatgaagtggaacccaactgtcccttccatggtcgcagtctgcttggcagacgggagcatagctgttctccaagtgacagaaactgtcaaggtgtgcgcaacgctcccaagtactgtggctgttacctctgtctgttggtcccccaaaggtaaacagctggcagtggggaagcaaaatggaaccgtagttcaatatctccccacacttcaggagaaaaaagtcattccttgccctccattctacgagagtgaccaccctgtccgtgtcctggacgtgctgtggataggcacgtatgtttttgccattgtgtatgccgctgcggatggaaccctggaaacttcacccgatgtagtcatggcccttctcccgaagaaggaggagaaacaccctgagatatttgtgaacttcatggagccctgctatggctcctgcaccgagagacagcaccattactatttgtcttacatcgaggaatgggacctggtgctggccgcatcagcggcatcaactgaagtgagcatcttagcaagacagtccgatcagataaactgggagtcttggctgctggaagacagttctagagctgaattacctgtcactgacaagtctgacgactccctgccaatgggcgtggttgttgactacacaaaccaggtggaaatcaccatttccgacgagaagaccttgccgccagcacccgtgctgatgctactttcaacagatggcgtgctgtgccccttctatatgatcaaccagaacccgggtgtaaaatctcttatcaagacgcctgagaggctctctctggagggtgaacgacaaccaaaatcacctggatctaccccaacaactcccacaagcagccaagctccccaaaagcttgacgcatctgcagccgccgcgcccgcatcactgcccccgtcgtccccagctgcgcctatcgcaaccttttccttactccctgccggcggtgccccaacagtattctcgtttggaagtagctctctcaagagttcagctaccgtaactggggagccacccagctattcaagtggaagcgattcatccaaggcagccccaggccccggccctagcactttctctttcgtgcccccaagcaaagcgtcccttgcaccaaccccggctgcctctcctgtggcccctagcgccgctagtttttcattcggctctagtgggttcaaacctactctggagtcaacgcccgttccctccgtgtctgcgccgaatattgcgatgaagccttcattccccccttctactagcgctgtgaaggtgaacttatcagagaatagtagccagtctgctccccccatgagtccattcagcagtgcatcaaaacctgctgcctccggtcctctgtcacaccccacacctctttccgccccaccctcttccgtgccactgaaatcatcggttctgccatccccatcagctggcagaagcgcacaaggctctagctcccccgtcccttccatggttcagaagtccccgcggattacccccccagctgcaaaacccgggagccctcaggcaaaatccctgcagcctgccgtggcagaaaagcaaggacaccaatggaaagactcagacccggtgatggccggtattggtgaggagatagctcactttcagaaagagctggaggaacttaaagcaaggacctcgaaagcgtgttttcaggttggcacctccgaagaaatgaaaatgcttcgtacggagtccgacgatcttcacacgtttcttctcgagataaaggaaactactgagtcgctccacggcgatattagttcgctcaagacaacccttcttgaagggtttgctggagtggaggaagcccgcgagcagaatgagagaaatagagatagtgggtacctacacctgctgtacaaaaggcccctggatcccaaaagtgaggcacaattgcaggagatacggagactgcaccagtacgtcaaatttgcagtgcaggatgtgaacgatgtattagatttggagtgggaccaacacctcgagcagaagaaaaaacagagacaccttctcgtgcctgagagggagaccttgtttaacacattagccaacaatcgggagattatcaaccagcaaaggaagcgactgaatcacctggtagattccctccagcagctgcgcctctataaacaaacgtcactctggtccctgtcatctgctgtgccttctcagtctagcatccattcatttgactctgatctcgagagcctctgcaacgccttgcttaagactaccattgaaagccacaccaaatcgctccctaaagtacccgctaagctcagtccgatgaaacaagcccaactgcgcaacttcctcgcgaaacggaagacgccacctgtgagaagcactgccccggcatccttatcacgtagcgcatttttaagccagagatattatgaagacctggacgaagtttcttctaccagctctgtgtctcaatcgctggaaagcgaagatgcgagaactagttgtaaagacgacgaagcagttgtgcaagccccgcgacatgctccggtcgttcgaacccctagcattcagccctctctgctaccccacgccgcacctttcgctaagtctcatttagtccacggatcatcaccgggcgttatggggaccagtgtggcaactagtgcctctaagatcatcccacagggcgccgactctacaatgctggcaaccaagacagtcaaacacggagccccctctcccagtcacccaattagtgcacctcaggccgccgccgccgccgccttgagaaggcagatggcaagtcaggctcctgccgtgaacactttgacagaatcaacactgaagaatgttcctcaagtcgtcaatgtgcaagaattaaagaataatcccgcaactcccagcaccgctatgggaagctccgtcccttactctacagctaaaaccccacatcccgtgctgacacccgtagcagccaatcaggccaaacagggcagcctcattaactcattgaaaccgtctggcccgacaccagcctctgggcaattgagctctggagacaaggcaagtggaaccgccaaaatcgagaccgcagtaacatccaccccctccgcctcagggcagttctccaagccattctcattttcccccagcggcacaggatttaactttggaattataactcccactccaagctctaattttaccgcagcccaaggagccaccccctcgacaaaagaaagttcgcaacccgatgcttttagttccggagggggtagtaaaccctcttatgaggccatcccagagtcatcccctccatcaggcattacaagtgcctccaacactactccaggagaacccgcggcctctagtagccgacccgtggccccctcaggcaccgccctaagcaccaccagctcgaagctggaaacgccgccgtcaaagctgggtgaactcctgttcccatcatcgctggcaggagagaccctgggcagtttctccggcctgcgggttggccaggctgacgatagcactaagcctacgaacaaggcaagctctacttcactgacaagcactcagccaacaaagacgtccggcgtgccttcaggtttcaacttcaccgctcctcccgtcctcggcaaacacactgagcccccagtcacatcctccgctacaacaacctcagtagcaccccctgctgcaactagcacatcttctaccgccgtgttcggctcactacctgtgaccagcgccgggtcttctggagtgatttccttcgggggcacgtctctgagtgctggtaagacctccttttcctttgggagccagcagacgaattcaacagtcccaccttcagctccacctcccacaacggcggccaccccacttccaacttcctttccaacattgtcatttgggtctttgctgtcttcagccacgacgccatccctgccaatgtccgcaggcaggtctaccgaagaagccacctcgtctgccttgccggaaaagcccggcgactccgaagttagtgcgtccgccgccagcctgctggaagagcagcagagtgcccaactaccccaggcacccccacagacaagcgatagcgtgaaaaaggagccggtacttgcacagccagccgtcagcaacagtggcactgccgcgtcatccaccagtctagtagctctctctgccgaagcgacccctgcgaccacaggcgtacccgacgctcgcaccgaagccgtgccccctgcgtctagcttcagcgttccagggcagacagctgtgacagctgctgccattagcagcgccggtcccgtcgctgtagagacctcctccaccccgatagccagctctacaacaagtatcgtggcccccggccccagtgcagaagcagccgctttcgggaccgtgacctcagggtctagtgtgtttgcccagccacccgctgccagttcctcaagcgcgtttaaccagttgacaaacaatacagccacagccccaagcgcaactcctgtgttcggccaggtcgctgcctcaaccgccccctcgctctttggccaacaaacaggctctaccgctagcacggcagccgctacaccccaggtgtccagtagtggcttcagtagtcccgcatttggcacaactgctcctggagtatttggtcaaacgacattcggtcaagcaagcgtattcgggcagtctgcgagctcggccgccagtgtattttctttctcacagcccggtttttccagcgtcccggcattcggccagccagcttccagcactccaacctccactagcggtagtgttttcggcgctgccagttctactagctcgagtagctcctttagcttcgggcaatctagtcccaatactggtggcggactgttcggccaatccaatgctcctgcttttggtcaatcgcccggtttcggccaggggggtagcgtcttcgggggaacctccgcggccaccaccacagcggcaaccagtggcttcagcttctgccaggcttcagggtttgggtcaagcaacaccgggtctgtgttcgggcaggctgcatccaccggcgggatcgtcttcgggcagcagagtagcagcagcagtggtagcgtgttcggcagcggtaacacaggacgcggcgggggctttttttctggcctaggaggaaaaccaagccaagatgctgctaataagaatccattctccagtgcttccggggggtttgggagcaccgccacatcaaacacctctaacctgttcggcaattccggtgctaaaacctttggcggtttcgcctcatccagcttcggcgaacagaaaccaaccggcactttttcatccggcggtggctctgtggcttcccaggggttcggatttagttcgcctaacaaaactgggggattcggtgcagctcccgtgtttgggagccccccaacctttgggggaagccccggctttggaggtgtacccgctttcgggtccgctcccgcttttacaagccccttgggtagcactggtggcaaggtctttggcgagggtaccgcggctgcaagtgcagggggatttggctttggttcaagttctaacactaccagtttcgggaccctggcttctcaaaatgctcccacctttgggtcgttatctcagcagacatcgggctttggaactcagtccagcggattcagtggtttcggctcagggacaggcggctttagctttggctctaataattcctccgtccaaggttttggcggttggcgatcttag

SEQ ID NO: 197921 - DNA, 4560 bp, Artificial Sequence
  Description of Artificial Sequence: Synthetic coding sequence
atgaagcccagcttcccccccagcaccagcgccgtgaaggtgaacctttctgagaagttcaccgcagctgctacttcgacaccagttagctcctctcagtccgcccctcctatgagtccattcagttctgcatctaagccggccgcctctggaccactttcccatcctacccccttatcggcgcccccctcctctgttccactcaagagtagcgtgctcccatctccatccggcaggtctgcacagggatcgtcaagtccggttccctccatggtccaaaaaagtccccgtatcacccctcccgcagcgaaacctgggtcccctcaggcaaaaagcttacagcccgccgtcgcagaaaaacagggtcaccagtggaaggactccgacccggttatggccgggatcggtgaagaaatcgcacactttcaaaaggagctggaggaattgaaggctaggacatcaaaagcttgcttccaagttggcacctcagaagaaatgaaaatgctgagaacagagagtgatgatctccataccttcctcctggagatcaaggaaaccaccgagtcccttcacggtgacatttcttctctgaagactactctgctggaaggcttcgcaggggtggaggaggcgcgggagcagaatgagcgcaatagagactctgggtacctgcatctactttataaacgaccactggatcctaaatcagaagcccagttgcaggagattcggcggctccatcaatacgtcaagttcgctgttcaggatgtcaacgacgttctcgacttagaatgggaccagcatttagagcagaagaagaaacaacgacacctgctcgttcccgagcgagagaccctgttcaacacacttgcaaataatcgggaaattatcaaccagcagcgcaaaaggctcaatcacctcgttgactcactccagcagctcagactctacaagcagacctccctgtggtccttgagttccgctgttccttcccagagctcaatccactcattcgacagcgatttggaatctctgtgtaatgctctgctcaaaacaacaattgagtcacacaccaaatctttacctaaggtgcccgccaagctttcgcctatgaaacaggcccaattgaggaactttctggccaaaagaaaaacacctccggtgcggtctaccgccccagctagtctgagccgaagtgctttcctctctcaacggtactatgaggatctcgatgaggtgagttctactagtagtgtctcccagagtctcgagagcgaggatgcccgtacctcctgcaaggacgacgaagctgtggtgcaagcaccccgccatgcaccagtcgttcgcacaccctctattcaaccctcccttctaccccacgcagcgcctttcgcaaaatcccatcttgtccacggctcctcacccggcgttatgggcacatcggtggccacaagtgcttctaagatcattccacagggagcagactccacaatgcttgcaaccaaaacagttaaacacggggctcccagcccatcccatcctatctccgccccccaggctgctgccgccgccgccttacgaagacagatggcaagccaggcaccggccgtgaataccctcactgagagcactctcaagaacgttccccaggtggttaatgtccaggagctcaagaataaccctgctactcccagtaccgcgatgggctcaagcgtaccatacagcaccgccaaaaccccccaccccgttctcacccctgtcgccgcaaatcaggctaaacagggttcactgataaattctctaaaacccagcggtccgacccctgcttcaggacagctatcaagtggagacaaagctagcggaacagccaagattgaaactgcagtaacaagcactccatcggcctcagggcaattttcaaagcctttcagtttttccccctccggcactggcttcaacttcgggattattactcccacaccaagctctaatttcactgccgcacaaggcgcaaccccttctaccaaggagtcatcccaacccgatgcgttcagcagcggcgggggctccaagccctcctacgaagcaatcccagaatcctctcctccttcagggattactagtgcctctaatacaactcctggagagcctgccgcctcttctagcagaccagtggctccttcaggtacagcactaagcaccaccagctctaaactggaaaccccccctagtaagttgggagagcttctgtttccgtcgtctcttgccggcgagaccctgggatcttttagcggtctcagggtgggtcaagccgacgactctaccaagccaaccaacaaagcctctagtacgagcctgacttctactcagccaaccaagacgtccggagtaccgagtgggtttaatttcacggctccccctgtgctggggaagcatacagaacctcctgtgacctctagtgcaaccacaacatctgtagcccctcccgctgctacaagcacctcttccactgcagtcttcgggagcctgcctgtgacgtctgcaggatcgtccggggtcatcagcttcggcggtacctcactgagcgctggtaagactagcttcagttttggatcacagcagaccaactccactgtgccacccagcgcaccgccccctaccaccgccgcaaccccgcttcctacaagttttcctacactgagctttggtagcctgctcagttccgcaactaccccctcactgccgatgtctgctggaaggagtaccgaagaggctacctcttccgccttgcccgagaagcctggcgattctgaggtgtctgccagcgctgcgagccttctggaggaacagcagtcagcccagctgccacaagctccgccacaaacatccgactccgttaagaaggagcctgtgctggctcagcctgctgtctctaacagtgggactgccgctagtagcacctcccttgtggcgctcagtgcagaggctaccccagccacgacaggagtccctgatgcgaggacagaggccgttccccccgcgagttctttctctgtgcccggccaaactgctgtaaccgccgctgctatatcaagcgctgggccggttgctgtggaaacctcctcaacaccaattgcttcgtcaactacaagcattgttgctccaggcccatcagccgaggccgccgcctttggaacagtcacaagcggatcttcagtgttcgcacaacctccagccgctagtagctcatctgcgtttaatcagcttacaaataataccgcgacagcacccagtgctaccccagtttttgggcaggtggcggccagcacggcaccttcacttttcggccagcagacgggttccactgcctccactgccgcggcgacaccacaagtgtctagcagcgggtttagctcacctgcctttggcaccacagcccccggcgtgtttggccaaacaacttttgggcaggcttccgttttcgggcagagcgcatcatctgccgcctcggtttttagcttctcccaacctggcttctcttccgtgccagcgttcggtcagcctgcctcatcgaccccgacaagtacttccgggagtgtgttcggcgccgccagctccacctctagcagttcctccttctcctttggccaatcatcaccaaataccggagggggcctatttggccagagcaatgctccagcctttggacaaagtccaggttttgggcagggcggaagtgtttttggtggcactagcgcagccacaaccacggccgcaacatcagggttttccttttgccaagcttctggcttcgggagtagcaatactggaagtgtttttgggcaggcagcgtccaccggagggatcgtgttcggccagcagtctagctcatctagtggatctgtgtttggctcaggaaacacagggcgtggcggcgggttttttagcggactcgggggcaaaccctcacaggacgccgctaataagaatcctttttcttccgctagcggcggatttgggtccactgcaacctccaatacgtcaaatctgttcggcaattcaggcgcaaagacctttggcggatttgccagctcgtcctttggcgaacagaagcctactggcactttcagctccggcggtgggtctgtggcttcacagggtttcggcttctcatcaccaaacaagaccggcggcttcggcgctgctccagtgtttggtagtccaccaacgtttggtgggtcaccgggattcggcggggtccctgcgttcggaagcgccccagcttttactagtccactcgggagcactggagggaaggtgtttggggagggaaccgcggccgcttctgctggaggtttcgggtttggctcttcatccaataccaccagcttcggtaccctcgctagccagaacgctcctaccttcgggagcttatcccagcagaccagcggctttggtacccagagctcaggcttttccgggtttggcagcggtacaggagggttctcattcgggtcaaataacagcagcgtgcaaggatttggcggttggcgcagctag

SEQ ID NO: 197922 - DNA, 6276 bp, Artificial Sequence
  Description of Artificial Sequence: Synthetic coding sequence
atgggcgacgagatggacgccatgatccccgagcgggagatgaaggacttccaattccgtgccctgaaaaaggtgagaattttcgacagtcctgaggaactgccaaaggaaaggtccagtttacttgcagtgtccaataagtacggactggtgttcgccggaggggcttcggggttgcagatattccccaccaaaaacctcctgatccagaataaacccggtgatgacccaaacaagattgttgataaggtgcaggggttgttggtgccaatgaaatttccaattcaccacctggctttgtcatgtgataacctcaccctgagcgcctgcatgatgtccagcgaatacggatccatcatcgccttcttcgacgtgcggacattttcgaatgaggctaaacaacagaaacgtccctttgcataccataaattgcttaaagacgctggaggcatggttatagatatgaagtggaacccaacggttccttcaatggtggcagtctgtctggccgacggatccattgctgtgctccaggtgaccgagaccgtcaaagtgtgtgccaccctcccgtcaacagttgctgtgactagcgtgtgctggtcgcctaaagggaagcagctggcagtgggcaaacaaaacgggacagtcgttcaatacctgcctacccttcaggagaaaaaggttattccgtgcccaccattctacgagtcagaccaccccgtaagagttttggatgtgttgtggatcggtacctacgtgttcgcgattgtatacgctgccgctgatggaacgctggaaaccagtcccgacgtggtgatggctctgctcccaaaaaaagaagagaaacatcccgaaatctttgtaaacttcatggaaccgtgctacggaagctgtacagagcgccaacatcattattatttgtcatatatcgaagaatgggatctggttcttgccgcatccgccgcatcaaccgaagtgtcaattttggcccggcagtctgatcagatcaattgggagtcttggctgctggaggatagttctcgggccgagctcccagtgactgataaatctgacgattcactgcccatgggggtggtggtggattacactaaccaggtggaaatcacaatctctgacgagaaaacattaccacccgctcctgtattgatgctgttgtcaacagatggtgttctgtgccccttttatatgataaatcagaaccccggcgtgaaaagtcttattaagactccagaaaggctgtcactggagggcgagcggcagcccaaaagcccaggcagcacccccacaaccccaacaagctcacaggcccctcaaaaactagatgccagcgcagccgccgctcccgctagcctgcccccgagctcacccgccgcaccgattgcgacatttagtcttctgccagccggcggcgccccaaccgtgttcagcttcggctcctcttcattgaagtccagtgctactgttactggcgaaccgccaagctactcttcagggagcgattcctctaaggcggcacctggcccaggacccagcacgtttagctttgtgcccccttcgaaggcttctctggcgcctactcccgccgcttctcctgtggctccttccgccgccagtttcagcttcggatccagcgggtttaaaccgacactcgagtcgacaccagtgccatcagtttccgccccaaacattgccatgaagccgtcattcccccccagcacttccgctgtaaaagtcaacttgagtgagaagtttacggccgccgcgacctctacaccggtctcttcgtctcagagcgctcctccaatgtcacccttcagttcagctagcaaacccgctgcttctgggcccctgagccatccgacgccactgagcgcacctccctcctcggtgcctctaaagtcatctgtgctgcccagcccatccgcgggtaggtcagcccaaggctcatcatccccagttccatccatggtgcagaaatctccacgcatcacacccccggctgcaaagcccggttctcctcaggcaaagtccctccagcctgccgtggccgaaaaacagggacaccagtggaaggactctgaccccgtcatggccggtatcggcgaggagatcgctcacttccaaaaagagctggaggaattgaaagcaagaacctctaaggcgtgcttccaggtcggaacgtccgaggaaatgaagatgctacggaccgaatccgatgatcttcacacattcttgttggagatcaaggagacaaccgaaagcctccacggagacatcagctccctgaaaacgaccttactggaggggttcgcaggagtcgaagaggctcgcgaacaaaacgagcgaaaccgggactcaggttatttgcaccttttatacaaacgtcccctggatcccaaatccgaggcacaactgcaggaaattcgacgcctgcaccaatacgtcaagtttgcagtgcaggatgtgaatgatgtgctggacttagagtgggaccagcatctggagcagaaaaaaaaacagcggcacctgctcgtaccagagcgcgagactctgttcaacacactggccaacaatcgagagattataaatcaacagaggaagcgcctaaaccatttggtggattccctgcagcagctgcggctttataagcagacctccttatggagcttatcctccgctgtgccctcccaatcttccatccatagcttcgattccgacctggaaagcctttgtaacgctctgctcaagactaccatcgagtcacacaccaaatccttgcctaaggtgcccgctaaactgagccctatgaagcaggctcagttgcggaattttctagctaaaaggaagaccccaccagtaagatcaacggccccagctagcctctccagaagcgcgttcttgtcacagcggtactacgaagacctagacgaggtttcctcgacctcttctgtttctcagtccctggaatccgaggacgctcgcacatcttgcaaggatgacgaggcagttgtgcaagctccccggcacgcaccagtggtccgaaccccctctatccagccgtcattgcttcctcacgcggcaccgtttgccaaaagccatctggtgcatggctcaagtcctggggtcatgggcaccagcgtggcaacgtcagcctccaaaatcatccctcagggagccgattctaccatgttggccaccaaaaccgttaaacacggtgcccctagcccatcgcatcccatctctgctccacaggccgcagccgctgccgcccttaggcggcagatggcttcacaggcaccagccgtgaacacactgacagagtcaacactgaaaaacgtcccacaagtagtgaatgtccaggagctgaagaataatcccgcaaccccctccacagcaatgggctcatccgtgccatactccacagccaagaccccacatccggttcttactccggtcgccgcaaatcaggccaaacaagggtccctgatcaactcgctgaagccctctggccccactcctgcgtccgggcagctatcatcaggtgataaagcatccggcacagccaagatcgagactgctgttacaagtacaccatcagcatcgggtcagttctctaaacccttttctttctctcccagtgggaccgggttcaatttcgggataattaccccaactccctcttcaaacttcactgcggcccaaggcgcgacgcccagcacaaaggagtcctcacagcccgacgcatttagtagcggaggcggatccaagccctcgtacgaggcaattcccgaaagtagccctccttctggcataacttccgcaagtaataccactcccggagaacccgccgcatcttctagtaggcccgttgcccctagcggtacagccctgtctaccacctcttctaagctagagactcctcctagcaaactcggagagctgctattcccctccagtctcgcgggcgagactctggggtctttttcaggcttgagggtggggcaggccgacgattccaccaagcccaccaataaagccagtagcaccagcctgaccagtacacagccaacgaaaaccagcggagtaccatcaggcttcaattttaccgcacctccagtgctgggaaagcataccgagcctcccgtcacgtcatctgccaccaccacgtcggttgccccccccgctgctactagtacatcaagtacagcagtattcgggtccctacctgtgacatctgctgggtcttcaggagtgatctcattcggtggaactagtctatcggctggcaaaacgtccttcagctttggctcccagcaaactaactctactgtgcctccatcagcccctccccctactactgctgcgacaccactgcctacgtcattccccactctgagctttggtagccttctgagctctgcgaccacaccatcactgcccatgtcggctggccggagcaccgaggaggcaacgagcagtgcactgcccgaaaagcctggcgactctgaagtttctgcaagtgccgcttcccttctcgaggaacagcaatctgctcagctgcctcaggcccccccacagacttctgactcagttaaaaaggagcctgtactggcccagcccgcagtgagtaatagcgggactgccgcgtcctccacgtcacttgttgctcttagcgcagaagcgactcccgccacaacgggcgtcccagacgccaggaccgaggcggtgcccccagcaagctccttctctgtgccgggccagactgccgtaacagctgcggcaatctcatcagctggtccagtggcagtcgagaccagcagcacacctatcgccagtagcacaacctcaatcgtggccccgggaccctccgccgaagcggccgcctttggcactgtgacaagcggcagctccgtgtttgcacagccccctgcagctagctcatcaagtgcatttaaccagctcaccaataacaccgcaaccgccccctcagctacacccgtgttcggtcaagtggcagccagcactgctcccagtctgttcggacaacagacaggcagtactgcctcaaccgccgcagcaacaccccaagtcagttccagtgggtttagcagtccagccttcggtacgactgcaccgggggtctttggacaaactaccttcggacaggctagcgtgttcggacagtcggctagcagcgcagcgagtgtttttagtttcagccagccaggcttttcctccgtacccgcctttggacagcccgcaagctccacacctaccagcacttcaggctcagttttcggggcagcctcaagcacaagctcatccagttctttctcattcggacaatcttcgcccaacaccggcgggggccttttcggacagagtaatgcgccagcgtttggccaatctccagggtttggccagggaggaagtgtgttcggaggaacctctgcagccaccactactgctgccacatccggtttttcattctgtcaagcgagcgggtttggaagcagtaataccgggagcgtgtttgggcaggcagcctctaccggaggcattgtgttcggccagcagtcatcgagtagcagtggtagcgtgttcggctccggcaatactggaagaggtggcggctttttttcgggactcgggggtaaaccgagccaggacgctgccaataagaacccctttagttccgcttccggcggctttggaagcacagccacgtcaaacacatctaatttgtttggaaactccggcgccaagacatttgggggtttcgcctcttcttcctttggcgagcagaagcctacaggaactttctcaagcggaggcggaagtgtcgccagtcagggatttggtttcagcagtccaaacaaaacaggcgggttcggtgccgctcccgtattcggatcaccaccaactttcggcgggtcccccggtttcgggggcgtgcccgcatttgggagtgctccagcatttacatcaccattggggtccactggcggaaaggtgtttggggaggggaccgccgcagccagcgctggtggtttcgggttcggttcaagcagtaatacaacatcctttggtaccctggccagccagaacgccccaacgtttgggagcctctcccagcaaactagtggtttcggaacccagtcatcgggctttagcggcttcggatcgggtacaggagggttttcttttggatccaataatagttcagtgcagggtttcggcggttggcggtcctag

SEQ ID NO: 197923 - DNA, 237 bp, Artificial Sequence
  Description of Artificial Sequence: Synthetic coding sequence
ggcgagggcaccgccgccgccagcgccggcggcttcggcttcggctcttcttcaaatacaaccagttttggaactctggccagccagaacgcccccacattcggttcccttagccagcagacaagcggcttcgggacacagtcctcaggtttctctggatttggttctggcacaggtggctttagttttggctctaacaattccagcgtccaaggttttggcggttggcgctcgtag

SEQ ID NO: 197924 - DNA, 5055 bp, Artificial Sequence
  Description of Artificial Sequence: Synthetic coding sequence
ggcgccgagggccggaagttcgccgtggagcggcccggcttccggggacagggtcgcggcaggcaacgctggttgctaaggcacactacccctacctcctcacaggcacctcaaaagttggacgcctccgcagccgccgctccagccagtttgcctccctcttcgccagcagcaccgattgcgacattcagcctattacctgccggtggagcccccaccgtcttctctttcgggtcctcctctttgaaaagcagcgccacagtgacaggggaacccccctcctatagctctgggagcgatagctctaaagccgcgcccggacctgggcctagtacattctcctttgttcccccgtctaaggcctcattagccccgacgccagcagcttctccagttgctccatctgccgcatcattctcttttggctctagcggatttaagccaaccctagaatccactccagttccctctgtcagcgctccaaatatcgctatgaagcccagcttccccccatccacctccgcagttaaggtgaatctgagcgaaaaatttacagctgctgctacctccacaccagtcagctcttcacagagtgcgccccctatgagccccttctccagtgcgtcgaagcctgcagccagcggaccgctttctcaccctacacccctgtctgctcccccttcctccgttcctttgaagagttctgttctgccctcaccctcagccggtcgctctgctcagggttctagttcgcccgtgccaagcatggtgcagaaatcccccagaatcacccccccagccgccaaacctggcagtcctcaggcgaagagcttacagcccgctgtcgccgagaaacagggccaccagtggaaagatagtgatcctgttatggctggcatcggcgaggaaatcgcgcatttccagaaggagctggaggaattgaaagcccggacaagcaaggcttgttttcaagtcggcacttcggaagaaatgaaaatgcttcgtactgagagcgatgacctgcatacattcttgcttgagattaaggagactaccgaaagcttgcatggagatattagctctctgaagactacgctactagaaggatttgccggtgtcgaggaggcacgggaacagaatgaaaggaaccgggactctggctatctccatctgttgtataaaaggcctcttgatcctaagagtgaagctcagctgcaggagatacggcgactccatcaatacgtcaagtttgccgtacaggatgtgaacgacgttcttgacctagagtgggaccaacacctcgagcagaaaaagaaacagcgccacttgttggtgcctgagcgagaaacattgtttaacactctggccaacaatagggagataattaatcagcaacgcaaacgactcaaccacctggtggacagcttgcagcagctgcgactttacaagcaaacctcactttggtcgctttcttccgcggttccctctcagtcatcaatccacagttttgatagtgacctggagagcctgtgtaacgctttgctcaaaactaccattgagtcacacaccaagagcctgcccaaagtgcccgctaaactgagccctatgaaacaggcccaattgcggaacttcctggcgaagagaaagactcctccagtccggagtacagcacccgcatcactcagtcgttccgcattcctaagccaacgctactacgaggacctcgatgaggtgagtagtacgagcagtgtgagccagtcactcgagtctgaagacgcaaggacatcttgcaaggatgacgaggcagtggtacaggcccctaggcatgcaccagtggtccgcacccccagtatccaacccagcctactacctcacgccgcaccatttgctaagtctcatctcgtccatggttcttcccctggcgtaatgggcacctctgtggccactagcgcctcgaaaattataccgcagggggcagacagtactatgctggcaacaaaaactgtcaagcacggggctccctctccatcccaccctatctccgcaccacaggctgccgcagcagcagccctccgcaggcagatggcttcccaggcccctgccgtgaacaccctaacagagtctacactcaagaacgtgccgcaagtcgtaaacgtccaggagcttaagaacaaccctgcaactcctagtactgccatgggtagtagtgtcccttactcaactgctaagaccccgcatccagtgttaacaccggtcgctgccaaccaggccaagcagggctctttaatcaattcactcaagccttctggtccaacacccgcttctggacagctgtcatccggcgacaaggcctcgggaacagctaaaatagaaacggctgtgacaagtactccgtcggcctcaggacaattttctaagccattctctttcagcccaagcgggacggggttcaatttcggcatcatcacccccactcctagcagcaatttcacagccgctcagggagccactccttctacaaaggagagctcacagcctgatgccttttcaagcggtggcggctctaaaccaagttatgaggctattcctgagagttcgccaccatcggggataacctccgcgtccaacaccactccaggggagcccgcggcttccagctcccgaccagtcgccccaagcgggacagctttaagtacaactagttccaaactggaaacaccgccctcaaaattgggagagctgctcttcccgtcatctctggccggggaaaccctgggttcgttctccggtttacgagtggggcaggcagacgacagcactaagcccaccaataaggcgagtagtacatcactgacttccactcagcccacaaagacctctggggtgccaagtggatttaattttacagctcctcccgtgcttggcaaacataccgagcctccagttacttcttcagctacaacgacatccgtcgcccctccggcagcaacctcaacttcaagcactgctgtttttgggtcccttcccgtgacttccgccggttcaagtggcgtaatatcctttggagggacctcactgagcgctgggaagacttccttttctttcggatcccagcagacaaactctacggttcccccgagcgctccgcctcctaccaccgctgccactccactcccaaccagcttcccaaccttgagttttggtagcctgctcagtagcgccaccactccttccctgcctatgtctgcaggacggtccacagaagaggccacttcctccgccctccccgaaaagccaggggattccgaggtttctgccagtgctgctagcctgctcgaggaacagcagtcggcacagttaccccaagcccctccccagacttccgacagcgttaaaaaagagccagtgttagcgcagccggctgtgtctaattctggcaccgcggctagttccacatccctggttgcactctccgccgaggccacccccgctacaacaggtgtcccggacgccaggactgaggcagtgcctcctgcttcctcatttagcgtacctggacagaccgccgtgactgctgcagccatttctagcgccgggcccgtggccgtggagacaagttctacgcccatcgcatcatctaccacaagcatcgttgctcccgggccctcggccgaggccgcggccttcggcactgtgacttcaggctccagtgtctttgcccagcctccagctgctagctcttccagcgctttcaaccagctgacaaacaataccgccacggcccccagtgccacccctgtttttggccaggtggctgcctccacagctccatctctcttcggtcagcaaaccggatcaactgcctccactgccgctgctactccccaggtcagtagttcgggcttctccagccccgcttttggcactacagccccgggtgtgttcggccaaaccaccttcggacaggcctcagtcttcgggcagagtgcctcctctgcagcgtccgtctttagtttcagccagccgggattctccagcgtgcccgctttcggacagcccgccagctcaacccctacgtcaacgtccgggagcgtcttcggggcggcgagttccactagctctagcagtagcttttcctttggccagtcaagcccaaacaccggaggcggactgttcggtcagtctaacgcccccgccttcgggcaatctcccggcttcggacagggggggtcggtattcggcggtacctctgcggctactactacagctgctacaagcggtttcagcttctgccaggcttcaggatttggaagcagcaacacaggaagcgtgttcggccaagccgctagcaccggtgggatcgtgtttggtcagcagagctcttccagctctgggtccgtttttggcagcggcaataccggacgagggggcggattcttctctggattaggcgggaagcctagccaggacgccgctaataaaaatcctttttcttcggctagcggggggtttggtagcaccgccacctcgaacacttccaacctgtttggcaactcaggtgccaagacgttcggcggatttgcctcatcctcctttggcgagcaaaagcccacaggcacatttagtagtggaggcggatctgtggctagtcagggctttgggttcagctcccccaataaaacaggcggattcggcgctgcaccagtgtttggatccccacccacattcggagggagccccggctttggaggggtccccgcatttgggagcgctcctgcattcacctcgccacttggctctaccgggggaaaggtattcggagaaggtacagctgccgcctccgcaggcggcttcgggttcgggtcgtccagtaataccacgagcttcggtacactggcaagtcagaacgcccctacattcggtagcttaagtcagcagacatcaggatttgggacacaatcgagcggtttttctggatttggaagcggcacgggaggcttcagtttcggttccaataacagcagtgtgcagggctttggcggatggcgctcttag

SEQ ID NO: 197925 - DNA, 6282 bp, Artificial Sequence
  Description of Artificial Sequence: Synthetic coding sequence
atgggcgacgagatggacgccatgatccccgagcgggagatgaaggatttccagttccgcgctctgaagaaggttcgtatttttgatagtcccgaagaactgcccaaagaacgctcttctttactggcagtgtccaataagtatggcctggtatttgcaggtggcgcctcgggcctgcaaatatttcccactaagaacctgttgatccagaacaagcccggggacgaccctaacaaaatcgtggataaggtacagggactactggtgcctatgaagtttcccattcaccacctcgcgctgtcttgcgataatctgacgctctccgcctgcatgatgtcctccgaatacggttctatcattgcattctttgacgtacgtacattttcaaatgaagctaagcagcagaagaggccgttcgcttaccacaagctgttgaaggatgccggcgggatggtgatcgacatgaagtggaatcctaccgtgccatccatggtagctgtttgtctggctgacggatcaatcgccgtgttgcaggtgactgagactgtcaaggtttgtgcgactctgccgtctacggtggccgtaacatctgtgtgttggtctcctaagggcaaacagttggccgttgggaagcaaaacggaaccgtggtccagtatctgccaaccttacaggaaaaaaaagttatcccttgtccacccttttatgaaagcgatcaccccgtccgtgtcctggatgtgctgtggattggcacctacgtgttcgccatcgtgtatgctgctgctgacggcaccctggagacaagcccagatgtcgttatggcccttctcccaaagaaagaggagaagcaccctgagatctttgttaacttcatggagccctgctatgggtcatgcactgaacgccagcaccattattacctcagctacatcgaggaatgggatctcgtgctggccgcctctgcagcttctacggaggtctccattcttgcgaggcaaagtgatcagattaactgggagagctggctcctggaggacagctcccgggctgaactgccggtgacagataagtcagatgattctctgccaatgggtgtcgtggttgattacacaaatcaagtggaaattaccattagtgatgaaaaaactctgccccctgcaccagtgttaatgctactgtcaactgatggtgtactgtgtcctttctacatgataaatcagaaccctggcgtaaaaagtctgatcaagacgcccgagaggttgagtctcgagggcgagcgtcagcctaagtcccccggatccactcctactacccctacaagtagccaagccccacagaaattggacgctagtgctgctgccgcccctgcctcgttacctccaagttctcctgctgcgccgattgccactttcagtctgctgcccgcgggtggggcccctacggtattcagttttggttcatcatctctcaaatcatcagccaccgtaacaggagaacccccgtcctattcttctggcagcgactctagcaaagctgcccccggccccggtccgagtacctttagcttcgttcccccaagcaaagcatccctggccccaactcccgccgcttcaccagtggcccccagcgcagcctctttttcgtttggtagttctgggtttaagcctactctggagtccacccccgtcccctctgtgagcgcccctaacatcgccatgaagccatctttcccccctagcacctcagcagttaaggtaaatttatcagagaattcttctcagtccgctccacctatgagcccatttagcagtgcttcaaagccggcggcaagcggcccattgagccatcctacacccctgagtgcccccccatcctcggttccactgaagagtagcgtgctcccaagcccaagtggcaggagtgctcaaggctctagttctccagttccaagcatggtccagaagtcccctaggataacacctcccgctgcgaagcctgggtcacctcaagcaaagtcacttcagccggctgtggcagagaagcaaggccatcagtggaaagactctgaccctgtgatggccggtattggagaagaaattgctcatttccagaaggagctcgaggaattgaaggcacgcaccagcaaggcctgttttcaggtggggacgtctgaagaaatgaagatgctcagaacagagagcgacgatctccacacatttctgctggagatcaaagagactacagagtctctgcacggggacatctcgagtctgaaaacaacactactcgagggatttgcaggggttgaagaggcccgggaacagaatgagcgcaacagagactccggttacctgcacctgctgtacaagagaccgcttgatcctaaatccgaggcacagttgcaagagattcgtaggttgcaccagtatgtgaaatttgccgtccaggacgtgaacgacgtgttagatcttgaatgggaccagcacttagagcagaagaaaaaacagcgtcatctcctggtgcccgagagagaaacgctcttcaacacactggctaataatagagaaatcatcaaccagcaacggaagaggctgaatcacctagtagattcactgcagcagctgcgcctgtataagcaaacctctctttggtcgctgagttccgctgtgccgagccaatcctcaattcattctttcgattccgatctcgagagtctgtgtaatgcccttctgaaaacaacaatcgagtcacataccaagtctttgccaaaggtccccgcgaaactgtctcccatgaagcaagctcagcttcgcaattttctcgccaaaagaaaaactcctcccgttaggtccactgctccggcctctctttcccggagcgccttcctctctcagagatattacgaagacctggacgaggtgtcttctaccagcagcgtgagccagtcactggagtctgaagatgccaggacttcttgtaaagatgatgaagctgtggtgcaggcccctagacacgcacccgtcgtgcgcacgcctagtattcaaccaagtctgttgcctcatgccgctccttttgccaaatcccaccttgtgcacgggagctctccaggggtcatggggacttcagtcgccaccagtgccagcaaaataattccccagggcgccgatagtacaatgctggctaccaagaccgtgaaacacggtgctccttcaccctcacacccaattagcgcccctcaggccgctgctgccgctgctctgagaagacagatggcatctcaggcacccgccgtaaacacacttaccgagtcgacccttaagaatgtgccccaggtggtcaacgtgcaggagctcaagaataacccagccacgccgagcacagctaaaacaccgcaccccgtgttaacacccgtggcagccaaccaagcaaagcaaggtagcctgatcaattccctcaaaccaagtgggcccacaccagctagtgggcagctcagctccggcgataaggcatcaggaacggcaaagattgagacagccgtaaccagcaccccaagcgctagtggccaattttcaaaacctttctccttcagcccctccgggaccggatttaacttcgggatcatcactcccacacctagcagcaacttcacagccgcccagggggctactcccagtacgaaagaaagctcacagcccgatgcttttagttcagggggtgggtccaagccaagctatgaggctattcccgagtcctcccccccgtctggtatcactagcgctagcaatacaacgcccggggagcctgcagcttcctcatcacgcccagtggccccctccggcacagccctctcaactacttccagcaaattggagactccacccagtaagcttggagagctcctgtttccgagcagtcttgccggcgaaacattgggctcattcagcggactccgcgtgggtcaggcagatgactccactaaacctactaacaaagcgtcaagtacatcactcactagtactcagccaacgaagacctccggagtccctagtgggtttaattttaccgctccgcccgtgctggggaaacacacagagccgcccgtgacatccagcgctacaactaccagcgtagctcctcccgctgccacgagcacctccagtacagccgtgtttggaagtttacccgttacgagcgctgggagctcaggcgttatcagcttcggaggaacatcacttagcgctggaaaaacttcattcagctttggaagccaacagacgaactcgacggttcctccctctgctcctccgccaactacagccgcaacccccttgccgacatcgttccctacactgtcttttggcagtctcttgtcaagtgctaccacaccttcactacctatgtctgccggcagatcaactgaagaagccacttcaagcgcactccctgaaaagcctggggatagcgaggtcagtgccagtgctgcgagtcttctggaggagcaacagtcggcacaactcccccaggctcccccccagaccagtgactctgtgaagaaagaacccgttttggctcagcctgctgtgtctaacagcggaaccgctgcgtcaagcacgtccctggtggcgctgagcgccgaagctacccccgcaacaacgggcgtacccgacgcccgtactgaggccgtcccacccgcctcttcctttagcgtccctgggcagactgcagtaaccgctgctgcaattagctctgccggcccagtggccgtcgagacatcttctacccctatcgccagttccaccacctcgattgtcgctccgggccccagcgcagaggccgcagcctttggcaccgtgacatctggtagctccgtcttcgcacagccacctgccgcctcaagctctagtgccttcaaccagctgaccaataacacagctacagctccatctgcgacacccgtgtttggccaggttgccgctagtactgccccctccctgtttggccagcagactgggagtaccgcatctacagcagcagcaaccccccaggttagttcatcagggttctctagtcccgcatttggaacaactgcccccggggtgtttgggcaaaccaccttcggccaggctagcgttttcggacagtcggcttctagtgcagctagtgtgttctcattttcacagcctggcttctcatcagtgccagcttttggacagccagcgagctctacccccacatccaccagcggctccgttttcggcgctgcctctagcacatcttcttcatccagctttagtttcggccaatcctccccgaataccgggggcgggctgttcgggcagtctaacgcccctgcttttgggcaatcccctggctttgggcagggtggatccgtgttcgggggaacttctgctgccactacgacagccgccacttccggcttctctttttgtcaggctagcggcttcggctcatctaacaccggcagcgtgttcggccaggccgcaagcacgggtggaatcgtgtttggccagcagagcagctcttccagcggaagcgtgtttgggtctggaaacactggtcgaggcggaggtttctttagcgggctggggggtaaaccatcacaggacgctgctaacaaaaaccccttcagttctgcatccggaggatttggaagcaccgctacctcaaataccagcaatctctttggtaactcgggtgccaagacttttggaggattcgccagttccagtttcggggagcaaaagccgacggggacgttttcttctggaggcggaagtgtggcaagccagggctttggattttcaagccctaacaaaacaggcggttttggtgccgcaccggtgttcggctctccgcccacattcggaggctcgccagggttcggcggtgttccggcctttgggtccgcgcccgccttcacatcgccccttggctccaccggggggaaggttttcggtgaaggaacagcggccgcctctgcaggggggtttgggagcttagctatgagtctgagtccgactctgaaaggccggctgctgctaatgcgcccaaaagctggcggaggaagagagcaggccgcacccggaaggaagtctaatgaatcccgttctctgggacatttatgtatggaacgcgcccttacaagtcccttaaaggtgtgggaacaacagcagcatcatatcttgcgccacgcacgcgaaagcgaatgcccacatttcaggatcacggtccctacagacttttggttttgggacccggagtag

SEQ ID NO: 197926 - DNA, 1308 bp, Artificial Sequence
  Description of Artificial Sequence: Synthetic coding sequence
atgaagagcagcctgctgctgcggggcgtgcacttctgcttccacctacctggggcaaccccttctaccaaagagtctagccagcccgacgcattttcatcgggcggcggttctaagccctcatatgaggcaattcccgaaagctctcctccctccgggataacctccgccagcaataccactccgggcgagcctgccgcaagttcctctaggcccgttgccccaagcggcaccgcgctgtccaccacaagcagcaaactggagaccccgccctcgaagctcggtgaactgttgttccccagcagcctcgcaggggagactctgggttcttttagcggtttaagagttggtcaagccgatgactctacgaagcctacaaataaagcctcctccacctctttgacctccacgcaacccacaaagacttctggcgtgccaagtggctttaactttactgccccccctgtgctgggaaagcacacagagccacccgtcactagtagtgccactacaacctccgtcgccccacctgctgccacctccacatcttctactgcagttttcggatctttgcccgtgacctcggcaggatctagtggggttattagtttcggtgggacaagtctgagcgccgggaagactagcttcagtttcggatcacagcagaccaattcgacagtgcctcccagcgctccacctccaactaccgccgcaacccccttgccaacttcgtttccgactctgtcttttgggagtctcctgagctcagctacaaccccttcattacctatgagtgccggacgctcgaccgaggaggccacttcctccgctctcccggaaaagccaggtgattccgaagtatctgctagtgcggcctccttgttggaagaacagcaatccgcgcagctaccccaggccccgccccagacctctgatagtgtgaaaaaggagccggtgctcgcccagccagctgtgtcaaatagtggcaccgctgcctcatcaacttcactggtggcacttagtgctgaagctacacccgctaccaccggtgtgccggacgcaagaacagaggccgtccctcccgcctcgtctttttccgtgcctggccaaactgcggtgactgccgctgctatctcctcagctggacccgtggccgtggagactagcagcacacctattgcaagctcaaccacatctatcgtagctccagggcccagtgccgaagctgcagcttttggcaccgtcacatccggcagctcggtatttgcccaaccacccgccgcctccagctcatccgcgttcaactag

SEQ ID NO: 197927 - DNA, 981 bp, Artificial Sequence
  Description of Artificial Sequence: Synthetic coding sequence
atggccgccttcgccgtggagccccagggccccgccctgggcagcgaaccgatgatgctggggtcaccgacctcgccaaaacctggtgtcaatgcccaatttcttcccggattcctgatgggcgatctgcctgcccccgtaaccccccagccgaggagcatttctggaccatccgtgggggttatggaaatgaggtccccactgctggcggggggatcgccacctcagcccgtagtgcctgctcataaagacaaaagtggtgcgccgcccgtaaggagcatttacgacgacataagcagtccaggcctcggctcaacccccctcacctcgcgccggcagcctaacatttcggtcatgcagagccctctcgttggagtgacatcaacgccgggtacagggcagagcatgttcagtcccgcctctatcggacagccccgcaaaactaccctgtcccctgcgcagttggaccctttttatacccagggagactcactcacctccgaagatcatttagatgattcatgggtcaccgtttttggatttcctcaagcttccgctagctacatcctgctacagtttgcccaatacggaaatatattgaaacacgtgatgtcaaatacggggaattggatgcatatccggtaccagtcgaagctacaggcccggaaagccctctccaaagatgggcgcattttcggggagtccatcatgattggggtcaagccctgtatcgataaatcggtgatggagagctccgacaggtgcgccctttcctcgccatcccttgcctttactccccctatcaaaactctgggcaccccaacccaacccggctcgacgcccagaatttcaacaatgagacctttggctaccgcttacaaggcttctactagcgattaccaggttatttccgaccgtcagacccccaagaaagacgagtctttggtgtccaaggcaatggagtatatgtttgggtggtag

SEQ ID NO: 197928 - DNA, 930 bp, Artificial Sequence
  Description of Artificial Sequence: Synthetic coding sequence
atgatgctgggcagccccaccagccccaagcccggcgtgaacgcccagttcctgcccggctttttgatgggcgatctacctgctccagtaaccccacaaccgaggtcaataagcggacctagcgtgggagtcatggaaatgcgttctcctctcctcgccggagggagtccacctcagcccgtcgtgcccgctcacaaagacaagagcggagcacctccagtgcggtctatatacgatgatattagttcccccggattaggaagtacaccactgacctcaaggagacaaccgaatatctctgtgatgcagtctccactcgtcggtgtgactagcacccccggaacaggacagagcatgttttcccccgccagtatcggacaaccccgcaagaccacactcagcccagcccagcttgaccctttttacactcagggtgatagtttaacgagtgaggatcacctggatgacagttgggttactgtgttcggtttcccccaggcatccgcatcctatatcctcctacaatttgcccagtacgggaatattttgaagcacgtgatgtccaacactggaaattggatgcatatcagataccagagcaaactgcaggctcgcaaagccttgtccaaagacggacgtattttcggagagtctattatgatcggcgtgaagccctgtatcgacaagagcgtgatggagtcaagcgacagatgcgcactctcttccccctccttggcattcacccccccaattaagacgctgggaacccccacccagccaggaagcacccccagaatatcgactatgagaccactcgccacggcgtataaggccagcacctcagattatcaagtaatttccgaccggcaaacccctaaaaaggatgagagtttggtctcaaaggccatggagtatatgtttgggtggtag

SEQ ID NO: 197929 - DNA, 576 bp, Artificial Sequence
  Description of Artificial Sequence: Synthetic coding sequence
atgttcagccccgccagcatcggccagccccggaagaccaccctgtcgcccgctcagctcgatcctttttatacgcaaggggactctcttacgtccgaagatcaccttgacgattcttgggtcacagtttttggtttcccccaagcatcagcatcttatattttgcttcaatttgctcagtacggtaacatcttgaagcatgtgatgtccaataccggcaactggatgcacataaggtaccagtcaaaattgcaggcaagaaaagccctgtccaaggatggcagaatattcggcgagagcattatgatcggggtcaaaccctgcattgataaaagcgtcatggaatcgtcggaccgctgtgcactaagcagcccaagtctggcatttacaccacccataaaaactctagggaccccaacccaacctggatcaaccccccgaatatctaccatgcgtcccctcgccacggcctataaggcaagtacctctgactaccaggtgatctcggataggcagacccccaaaaaggatgagagtctcgtgtccaaagcaatggagtatatgtttggctggtag

SEQ ID NO: 197930 - DNA, 981 bp, Artificial Sequence
  Description of Artificial Sequence: Synthetic coding sequence
atgaagcaggacgccagccggaacgccgcctacaccgtggactgcgaagattacgtacatgtagtcgagtttaacccttttgagaacggcgatagcggcaatcttatagcttatggaggaaataattacgtggtgatcgggacctgcacgttccaagaagaagaggctgacgtagaagggatccagtacaaaactctgcggacttttcatcatggcgtgcgcgtggacggcatcgcctggtcaccggaaacacggctggacagcttgccccccgtgattaagttctgcacaagcgctgccgacatgaaaattaggctcttcaccagcgacctgcaagacaagaatgaatacaaggtgttggaaggtcacactgactttataaatggtcttgttttcgatccaaaggagggccaggaaatcgctagcgtttctgacgatcacacttgccggatctggaacctggagggcgtgcagacagcccacttcgttttgcattccccaggcatgagtgtttgctggcacccagaagagacattcaagttgatggtcgcagaaaagaacgggactatccgcttctatgacttgctagcccagcaggcgatcctctcccttgagtcagagcaggtaccgctgatgtctgcccactggtgtttgaagaataccttcaaagtgggggcagttgctggtaatgactggctgatctgggatataacccggagcagttacccgcagaacaagaggccagttcacatggatcgagcctgcttgttccgttggtcgaccatcagcgaaaatctgttcgcgacaactgggtaccctgggaaaatggcctctcagttccagatccatcatcttgggcacccgcagcccattcttatggggtctgtggctgtggggagcggcctttcctggcataggactctgccactgtgcgtgatcggaggtgatcataaactccttttctgggttactgaagtgtag

SEQ ID NO: 197931 - DNA, 156 bp, Artificial Sequence
  Description of Artificial Sequence: Synthetic coding sequence
atgaagcaggacgccagccggaacgccgcctacaccgtggactgcgaggattatgtgcatgtggtcgagttcaaccctttcgagaatggggatagcggaaatctaatcgcgtatgggggcaataactatgttgtgatcggcacatgtactttctag

SEQ ID NO: 197932 - DNA, 981 bp, Artificial Sequence
  Description of Artificial Sequence: Synthetic coding sequence
atgaagcaggacgccagccggaacgccgcctacaccgtggactgcgaggattatgtgcatgttgtggagtttaatccatttgagaacggagactctggtaatctgatcgcatatgggggtaataattatgttgtgattgggacctgcacattccaggaggaggaagcagatgttgaggggatccagtataagactctgcggacattccatcatggtgttcgggtggatggcatcgcctggtctcctgagaccaggctggacagcctcccaccggtgatcaagttctgcaccagcgccgcggacatgaaaattcgattgtttactagtgatctccaggataagaatgagtataaggtcctggagggacatactgactttattaatggactggtgttcgatccgaaggaaggccaagaaattgcctccgtgtcagacgaccacacgtgtcggatctggaatttagagggggtgcagacagcgcacttcgtcctccacagtcctggcatgtccgtctgttggcacccagaggagacatttaaattgatggtggcagagaaaaacgggaccataagattctacgacctactcgctcagcaagcaattctgtccctggagagtgagcaggtgccactgatgagcgcgcactggtgcctgaagaacacctttaaggtgggcgcggtggccggaaatgactggttgatctgggacatcacacggtctagctaccctcagaacaagaggccagtccatatggatcgggcttgtttgtttcgttggtccaccataagcgaaaacctcttcgctacaactggttacccaggcaagatggcctctcagttccaaattcaccatctcggtcacccccagcctatcctgatgggcagcgttgcagtcggcagcgggttgtcctggcacaggaccctgccactttgcgtcatcggtggagatcataaacttctgttttgggtgactgaggtgtag

SEQ ID NO: 197933 - DNA, 1143 bp, Artificial Sequence
  Description of Artificial Sequence: Synthetic coding sequence
atggaggagatctacgccaagttcgtgagccagaagatcagcaagacccgatggagaccacttcctcccgggtccctccaaaccgccgagacattcgccacaggcagttgggataacgaggagaactacatttccctttggagtatcggagattttggcaatctggactccgatgggggctttgaaggcgatcaccagctgctctgcgacattcgccaccatggtgatgtcatggacctgcaatttttcgaccaagaacgcatcgtcgccgcgagctcaactggatgcgtgacggtgtttctgcaccatcctaacaatcagaccctgtcagttaatcagcaatggactacggcacattatcataccggacccggtagcccatcttacagttccgccccatgcacaggcgtggtctgtaacaacccagaaattgttaccgtgggcgaggacggcaggatcaacctgtttagggcagaccataaggaggccgttaggaccattgataatgctgatagttcaacgttgcacgccgtgacgttccttcggacgccagaaatcctgaccgtcaacagtattggccagctgaaaatctgggattttcgacaacagggcaatgaaccctcccaaattctcagcctgaccggggaccgcgtacctctgcactgtgtggaccgtcaccctaaccagcaacacgtggttgcaaccggcgggcaggatgggatgttatccatctgggacgtccgtcaagggactatgccagtgagcctcctgaaagcccacgaggcggagatgtgggaagtacattttcatccatccaatcccgagcacctattcacctgttccgaggacggcagcctctggcattgggatgcatccaccgatgttcctgagaaatctagcttgtttcaccagggggggcgttcctccacctttctgtcacattccatcagcaatcaggccaatgtgcaccagtctgtgatttcttcatggctgtccacagacccagctaaggaccgcattgaaatcacctcgctgctgcccagccggagtttgtctgtgaacactctggacgtgctggggccctgcctagtgtgcggtactgacgccgaggcaatatacgttactcgacacctcttttcctag

SEQ ID NO: 197934 - DNA, 747 bp, Artificial Sequence
  Description of Artificial Sequence: Synthetic coding sequence
atgggcggccccctgagcctgggcaccgactgcgcccacaccggctatagacgggagttgaccctgtgtagccacaggctgagaccaaaagttccatctaatcaggggtctgcagggaggggtggggcagagcgacgggtcctctgcttgctcttcgccgtacccgccgccgcagctttcggtatggaggaaatctacgctaaatttgtgtcgcaaaaaatctctaagaccagatggagacctctccctcctggttctctacagacagccgagacttttgcaactgggtcttgggataacgaagaaaactatatcagcttgtggtcaatcggagacttcggaaacctggacagcgacggggggtttgagggagaccaccaactgctctgcgacatcaggcatcacggcgatgtcatggatctgcaatttttcgaccaggagagaattgtcgccgctagctcaacgggttgtgttacagtttttttgcaccatcccaacaaccagactctctcagtaaaccagcagtggaccacagctcattaccataccggccctggatcccctagctatagtagcgccccatgcactggcgtagtctgcaataaccctgagattgtgacggtaggtgaagatgggaggattaatctctttagagccgatcataaggaggccgtgagaacgatagggctggtgaccgagtgccattctactgtactgatcgatatccccactaactctatgttgtag

SEQ ID NO: 197935 - DNA, 1143 bp, Artificial Sequence
  Description of Artificial Sequence: Synthetic coding sequence
atggaggagatctacgccaagttcgtgagccagaagatcagcaagacaagatggagacccttgccacccggcagtcttcaaaccgccgaaacgttcgcaaccggaagctgggataacgaggagaactacattagcctgtggagcatcggcgactttggcaacctggacagcgacggagggttcgagggagaccaccagttgctctgtgacattcgccatcacggcgacgtgatggacctgcagttcttcgaccaagaaagaattgtagccgccagctctacagggtgtgtcacggtgtttttacaccaccccaataaccagaccttgagcgtgaaccagcagtggaccactgctcactatcacacgggacccggctcgccctcttactcctccgccccttgtacaggggtggtctgcaacaaccccgaaatcgtcacagtcggtgaagatggacgcattaatctatttagggcagaccacaaggaggccgttagaaccatcgacaacgccgactctagcactttgcatgctgtgaccttccttcgtacgcctgagatactgaccgtgaatagcattgggcaactcaagatatgggactttcggcagcagggaaatgaaccatcccagattctgtccctcaccggtgatcgggtcccactgcactgtgtggataggcaccctaatcagcaacacgtggtggcaacggggggccaggacggtatgctatctatatgggatgtcagacagggtactatgccagtgtccctgctaaaggcccacgaagccgagatgtgggaagtgcatttccacccaagtaaccccgaacacctgtttacttgttcagaggacggttcattatggcattgggatgcctccacagatgtgccagaaaagagtagcctgtttcatcagggcggcaggtcctccacattcctgagtcattccatctccaaccaggcaaatgtgcatcagagtgtgatctcaagttggctgagtacagatccagctaaagatcgcattgagattacaagcctgctgcccagcagatcgctgagtgttaacacactcgacgtgctgggcccctgcctggtctgtggtacagatgctgaagctatctacgtcacccgacatctgttttcatag

SEQ ID NO: 197936 - DNA, 1407 bp, Artificial Sequence
  Description of Artificial Sequence: Synthetic coding sequence
atggccaagcggaacgccgagaaggagctgaccgaccggaactgggatcaggaagatgaggccgaggaggtcggaacattcagcatggcgtcagaggaagtcttgaaaaatcgggccatcaagaaagcgaagcgcagaaacgtaggcttcgaaagcgacactggaggggctttcaaagggtttaaggggcttgtggtacccagtggaggcggacgtttttcagggttcggctctggtgccgggggtaagcccctcgagggcctatccaacgggaacaacatcacttcagccccacctttcgccagcgccaaggctgctgctgacccgaaggtggcgtttggctccctagccgctaatgggccaactaccctggtggacaaggtgagtaacccaaagacaaatggagattcacagcagccgtcttcttcgggtcttgcatcatcaaaagcatgcgtgggaaatgcgtatcataaacagctcgcggctctcaactgctccgtgcgagattggattgttaaacatgtaaacacaaaccctttgtgcgatctgacccccatattcaaggactacgagaagtatctagccaatattgaacaacaacatggtaactcagggcggaactcagagagcgagtctaataaagtggccgccgagacacagtcccccagcctattcgggagtactaagctgcagcaagagagtaccttcctcttccatggcaataagacagaggatacacccgacaagaaaatggaggtcgcatccgaaaagaagaccgacccatcgagccttggagctaccagcgcttcttttaactttgggaaaaaagtagatagcagcgtgcttggcagtctcagctcagttcctctgaccggcttctccttctcacccgggaacagttcactgttcggaaaggacacaacccagtctaagcccgtgtcaagcccattccctactaagccattggagggccaggccgagggtgactccggagaatgcaaaggcggcgatgaggaggagaacgatgagccacccaaggtggttgtgaccgaggtgaaagaagaggacgcattctatagtaagaagtgcaagctcttttataaaaaagacaatgaatttaaagagaaagggatcggcactctgcatcttaagccaacagccaatcagaagacccaattactcgtgagagccgacacaaatcttggaaacatcctgttgaacgtccttatccccccaaacatgccctgtacgcggacagggaagaacaatgtgctgatagtatgtgtccccaaccccccgattgacgaaaagaatgccacgatgcctgttactatgttaatcagggtgaaaacatcggaggacgccgacgagttgcacaagatacttctggagaaaaaagacgcttag

SEQ ID NO: 197937 - DNA, 1323 bp, Artificial Sequence
  Description of Artificial Sequence: Synthetic coding sequence
atggccagcgaggaggtgctgaagaaccgggccatcaagaaggccaagcgccgtaatgtgggctttgagagcgataccgggggtgccttcaagggttttaagggactcgtggtaccctctggtggcggcaggttttctggttttgggagtggcgctgggggtaagccactggagggcctgtcaaacggaaacaatataacctcagccccacccttcgcaagcgccaaggctgcagcggatcccaaagttgcgttcgggtcactggctgccaatgggccgacgacgctcgtagacaaagtgtcgaatccaaaaactaatggggatagtcagcagccaagcagctcaggcttggccagctcaaaagcttgcgttggcaacgcttaccacaaacagctagcagctctgaattgttccgttcgagactggattgtgaaacacgttaacactaaccccttgtgcgacttgaccccaatttttaaggattacgagaagtatctcgctaatatcgagcaacagcacgggaatagtggcagaaacagcgagagtgagtctaacaaggtggctgcggagactcagagccctagcttatttggatccacaaagctccagcaggaatccactttcctcttccatggtaataagactgaagatacccctgataaaaagatggaagtggcttcagagaaaaaaacagaccccagctctctgggcgccactagcgcaagtttcaattttggaaaaaaggtggatagtagcgtgctggggagcttgtcttccgtgcctcttactggctttagcttctctcccggtaactcttctttgttcggaaaggataccacgcagtccaaacctgtgtcttccccgtttccgactaagcccctcgaagggcaggcggaaggcgacagtggtgaatgcaaaggaggagatgaagaagagaatgacgaacctccaaaggtggttgtgactgaggtaaaggaggaggacgccttctattccaagaagtgtaagctcttctataagaaagataacgaattcaaagagaagggtattggcaccctgcacctgaaaccaacggcaaaccaaaaaacccagttacttgtgcgagccgacacaaatcttggaaacatactgttgaatgtcttgataccccctaatatgccgtgcacacgcaccggtaagaacaacgttctgatcgtgtgtgtgcccaacccgccaattgacgagaaaaacgctaccatgccggtgaccatgttaatcagagttaaaacaagcgaggacgccgacgagctgcataagattttacttgaaaaaaaggacgcctag

SEQ ID NO: 197938 - DNA, 1323 bp, Artificial Sequence
  Description of Artificial Sequence: Synthetic coding sequence
atggccagcgaggaggtgctgaagaaccgggccatcaagaaggccaagagacgtaacgtggggttcgagagcgacaccggcggcgcattcaaaggatttaagggccttgttgtgcccagtggaggcgggcgcttttccggctttggaagcggtgccgggggcaagcctttagagggactgtctaatgggaacaatataacctctgctccaccattcgcgagcgctaaggccgcagctgaccccaaggtggcctttgggagtctggcggctaatggtcccaccacattggtcgacaaggtatctaacccaaagacgaatggggacagccagcagcctagctctagtggcttggcatcaagcaaggcatgtgtgggtaacgcctaccacaagcaattggcagccttaaactgcagtgtgcgagattggatcgtgaagcatgtgaacaccaaccccctgtgcgatctgacccctatctttaaagattatgagaagtacctggctaacattgaacagcagcatggaaactctggccgtaactcagaatccgagagcaataaggttgcagccgaaactcagtccccatctctgttcggcagcacaaaattacaacaggaatcaacattccttttccatggtaacaagaccgaagacacgcctgataagaagatggaggtggcaagcgaaaagaagaccgacccctctagccttggcgccacatcagcaagctttaactttggcaagaaggtggactcctctgtgctaggctcactctcctctgttccattgactggattctccttctccccaggcaattcatccctcttcggcaaagacaccacacaaagtaaacctgtttcttccccattccctaccaaacccctggagggccaagccgagggtgactccggggagtgcaaaggcggagatgaggaggagaatgatgagcccccaaaggtggtggtcacagaagtgaaggaggaagacgctttttactctaaaaaatgtaagctcttttacaaaaaggataatgaattcaaggagaaaggcattggcaccctgcatctgaagcctaccgccaaccagaagacccagcttcttgttcgggctgacaccaaccttggcaacatcctgctgaacgtcttgattccacctaatatgccttgcaccaggacaggaaagaataatgtactgattgtatgcgtgcccaacccacccattgacgagaaaaacgccaccatgcctgtcactatgctcatccgagttaagacaagtgaggacgctgatgagttgcataaaatccttcttgagaagaaggacgcatag

SEQ ID NO: 197939 - DNA, 27 bp, Artificial Sequence
  Description of Artificial Sequence: Synthetic coding sequence
atggccagcgaggaggtgctgaagtag

SEQ ID NO: 197940 - DNA, 537 bp, Artificial Sequence
  Description of Artificial Sequence: Synthetic coding sequence
atggccaagcggaacgccgagaaggagctgaccgaccggaactgggaccaggaggacgaggcggaagaagttggtacttttagcatggcttccgaggaggtcctcaagaatcgggccattaaaaaggcaaagcgtcggaatgtaggcttcgaatcagacactggcggagctttcaaaggttttaaagggctggtcgtccccagcgggggaggaagattcagtgggtttggttctggcgcaggcggtaagccgttggaagggctgtccaacggtaacaacatcactagcgcaccgccgttcgcatccgccaaagccgccgccgaccctaaggtcgcgttcggcggcgatgaggaggagaatgatgagccacctaaagtggtggtcactgaagtgaaggaggaggacgctttctattcgaagaaatgtaaactgttctataagaaggacaacgagttcaaggagaagggaatcggcacccttcatctcaagccaactgctaatcaaaaaacccagctgctggtgagagccgacacatag

SEQ ID NO: 197941 - DNA, 138 bp, Artificial Sequence
  Description of Artificial Sequence: Synthetic coding sequence
atggccaagcggaacgccgagaaggagctgaccgaccggaactgggatcaggaggatgaggccgaggaagtagggactttttcgatggcatccgaggaggtattaaagaacagagccatcaaaaaggcaaagagatag

SEQ ID NO: 197942 - DNA, 657 bp, Artificial Sequence
  Description of Artificial Sequence: Synthetic coding sequence
atggaggtggccagcgagaagaagaccgaccccagcagcctgggcgcaacgtcagcatcatttaattttgggaagaaggtggattctagtgtgctggggagcctgtcgagtgtgccactgaccggcttctccttttccccaggaaattcttccctgttcggcaaagatactacccagagcaaaccagtgtcgtccccattcccaacaaaacccttagagggccaggccgaaggggatagcggagagtgcaaggggggcgacgaggaggaaaacgatgaaccccccaaggtcgttgtgaccgaggtgaaggaggaggacgccttttatagtaagaagtgtaagttattctataagaaagataatgaattcaaggaaaaagggatcggcaccctacacttaaaacctaccgccaaccaaaaaacacaattactggtcagggccgacaccaatctgggcaacatcctgttgaacgtcctgatccctccaaatatgccttgcacacggactggaaagaacaatgttttgatcgtatgtgttcctaatccccctatcgacgagaagaatgccactatgcctgttactatgctgatccgagtgaaaaccagcgaggatgcagatgagcttcataagatcctccttgagaaaaaggatgcatag

SEQ ID NO: 197943 - DNA, 231 bp, Artificial Sequence
  Description of Artificial Sequence: Synthetic coding sequence
atggccaagcggaacgccgagaaggagctgaccgaccggaactgggaccaggaggacgaggccgaggaagtgggcaccttctcaatggcttctgaagaagtgttgaagaatcgggccatcaaaaaggccaagagacggaacgtgggctttgaagttctcctgctgcagatggctctgcctccctggctgattaagtttcaaattcccaagctaatgggtacagtgtcatag

SEQ ID NO: 197944 - DNA, 15 bp, Artificial Sequence
  Description of Artificial Sequence: Synthetic coding sequence
atggccaagcggtag

SEQ ID NO: 197945 - DNA, 33 bp, Artificial Sequence
  Description of Artificial Sequence: Synthetic coding sequence
atggccaagcggaacgccgagaaggagctgtag

SEQ ID NO: 197946 - DNA, 1524 bp, Artificial Sequence
  Description of Artificial Sequence: Synthetic coding sequence
atggccttcaacttcggcgcccccagcggcaccagcggcaccgccgctgcgactgcagctcctgcaggcgggttcgggggcttcggcacgactagcacaacagccggttcagccttcagcttcagtgcacccacaaatactggcacaacaggtctgttcggaggtacccagaacaaggggtttgggtttggtactggattcggcacaaccacaggtacctcaacggggcttgggacaggactggggacaggacttggatttggaggatttaacacccagcagcagcagcaaacaacgctgggcgggctattttcccagccaacgcaggcacccacgcagtccaatcaattaattaatactgcgagtgccctgtctgcccccactctgcttggcgacgaaagggatgctatcctggcaaagtggaatcagctgcaggctttctggggaactggcaagggctatttcaacaacaacattccaccagtggaattcacccaagagaatcctttctgccggtttaaggctgtgggctattcttgtatgccttccaacaaagacgaggatggactggtcgtcctggtgtttaataagaaagaaacagaaatcagatcacaacagcagcagttagtggagtcactgcataaagtcctgggtgggaatcagacgcttactgtgaatgtcgagggaaccaaaacactgcccgatgaccaaaccgaggtcgttatctacgtcgtggaacgaagccccaatggcaccagtagacgggtccccgcaactaccctgtacgcgcattttgaacaagcaaacataaagacacagctgcagcaattgggggtgacactatctatgacccgaacggagctatcccctgcacagattaagcaactacttcagaacccacccgccggagttgatcccatcatctgggagcaggctaaagtggacaatcccgactctgagaaactaatacccgtccctatggtggggtttaaggagctactgcgcagactcaaagttcaagatcaaatgaccaagcaacaccagacgagattagatataatcagtgaagacatttccgagctccagaagaatcagactacctctgtggcgaaaattgcccagtataagaggaagctgatggacttatcccatagaactctgcaagttctgattaagcaggagattcagcggaagtccgggtatgcgattcaggccgatgaagagcaactgcgcgtacagctcgatactatacagggtgaactcaatgccccgactcaattcaagggccggctgaacgaacttatgtcgcagatcagaatgcagaaccactttggcgcggtcaggagtgaagagcgttactatatagatgcagacttgctccgggagatcaagcagcacctcaagcagcagcaagagggtctcagtcacctgatctcaatcattaaagatgatctagaagatatcaagctggtcgagcacggcctaaatgaaactattcacatcaggggtggcgtgttcagttag

SEQ ID NO: 197947 - DNA, 876 bp, Artificial Sequence
  Description of Artificial Sequence: Synthetic coding sequence
atgcccagcaacaaggacgaggacggcctggtggtgctggtgttcaataaaaaagaaacggagattcggagtcagcagcagcaactggtggagagtctccacaaggtccttggcggaaatcagacgctgacagtgaatgttgaaggtacaaaaactctccctgacgatcagactgaggtcgttatatacgtcgtggaacgttcacctaacggtacaagccgccgggtgccagccaccactttatacgcccatttcgagcaggccaacatcaagactcaattgcagcagctcggcgtgaccctgagcatgacgcgaacggaactgtcacctgcacagataaagcagctcctgcagaacccacctgcaggcgtggatccaatcatttgggaacaggccaaggtagacaatcctgattccgaaaaattaattccagtccccatggtgggattcaaggaattgcttaggcggctgaaggtgcaagatcagatgactaaacagcatcagacgaggctcgatgttttgattaaacaagagattcagcgcaaatctggctatgcaattcaggccgatgaagagcagttgagggtacaacttgatactatccagggcgagctgaacgccccaacacaatttaaggggcgtttaaacgaactcatgagccagattcgcatgcaaaaccattttggggcggtgcggagtgaagagaggtattacatagatgccgacctgctgagggagattaaacagcacttaaaacagcagcaggaggggctctctcatcttatttcaattatcaaggatgaccttgaggatataaagctggtggaacacgggttgaatgagactatccacatcagaggcggggtgttctcatag

SEQ ID NO: 197948 - DNA, 984 bp, Artificial Sequence
  Description of Artificial Sequence: Synthetic coding sequence
atgcccagcaacaaggacgaggacggcctggtggtgctggtgttcaacaaaaaggaaactgagataaggagtcaacagcagcagctggttgagagcctccacaaagtgctgggtggaaaccagacactcacagtcaatgtggaggggacgaaaacactgccggacgaccaaacggaggtggtcatttatgtggtcgagaggtcccccaatggaacttcgaggagggtacctgcaacaaccctctacgcgcattttgagcaggcaaatattaagacccagctccagcagctgggagttactttgtccatgacccgcaccgagctgagccccgcacagatcaaacagctactccagaatccccccgcgggtgtggatccaattatctgggaacaggccaaagttgataacccagattcagagaagctcatacctgtgccaatggtgggatttaaggaattactcaggcgtctcaaggtacaagaccagatgactaagcaacaccagacgcggctcgacattatctcagaggacatttcagagctgcagaaaaaccagacaaccagtgtggcaaagatcgcccagtacaagaggaagctgatggacctcagccaccggactttgcaagtccttattaagcaagagattcagcgcaagtccggttacgccatacaagcagacgaggaacagcttcgtgtccagctggacacgattcaaggtgagctgaatgccccgactcagttcaaaggaaggctaaacgaattgatgtctcaaattcgaatgcagaaccacttcggggcggttagatccgaagagaggtattacatcgacgctgatctgctacgtgagattaaacagcacctgaagcagcagcaagaggggctgagccatctgatttccatcatcaaggacgacctagaggacatcaagctggtggagcacggactcaatgagacaatccacattagagggggagttttctcgtag

SEQ ID NO: 197949 - DNA, 1380 bp, Artificial Sequence
  Description of Artificial Sequence: Synthetic coding sequence
atggccttcaacttcggcgcccccagcggcaccagcggcaccgccgctgccactgctgcccctgcgggcggctttgggggcttcggcactacatccaccaccgctggaagtgcctttagtttttcagccccaaccaacaccggcaccacagctctagggggcctgtttagccagcctacccaagctccaacccagagtaatcaacttattaacactgcttccgctctcagtgctccgacactcctgggagatgaacgggatgccattttggctaaatggaatcagctgcaagccttctggggaaccgggaagggttacttcaataacaacatccctcctgtcgaatttacccaagagaatcccttctgtaggtttaaagccgttggatactcttgcatgccctccaataaagacgaggatggactggttgtgctagtgtttaataagaaagagactgaaattaggtctcaacagcagcagctagtagaatccctgcacaaagtgctgggtggcaaccagactctgactgttaacgtggaggggaccaaaacactgccagacgaccagacagaggtggtcatttatgtggttgaacggagtcctaacggaacttcccgcagggtgcctgcaacgacactgtatgcgcattttgaacaagcaaacattaaaactcaactccagcaactgggtgtgactctgtctatgacccgaacggaactatctccagctcagatcaagcaactgctgcagaatcctcccgctggtgtcgatcctataatctgggagcaggccaaggttgataacccggattcagagaaattgattcctgtacctatggtggggtttaaagagctgctcagaaggctgaaggtccaggatcagatgaccaagcagcatcaaacacgcctggatataatctccgaggatattagcgagctgcaaaagaaccaaacaaccagcgttgccaagatcgcacaatacaaaagaaaactgatggacctgtcgcatcggacactgcaggtcctgatcaagcaggagattcagagaaagtctggctatgccatccaggcggacgaggagcagctaagagtccaactggatacgatccagggagagcttaatgctcctactcaatttaagggacgtctgaacgagctcatgtctcagatccggatgcagaaccactttggcgcggtgagatccgaggaacgctattatatcgacgcagacctgctgagagagatcaaacagcacctcaaacagcagcaggaaggcttatctcatctgatttcaatcatcaaagatgacctagaggatattaagctggtggagcacggtctgaatgaaacaattcatatcagaggaggcgtgtttagctag

SEQ ID NO: 197950 - DNA, 582 bp, Artificial Sequence
  Description of Artificial Sequence: Synthetic coding sequence
atgagcggcttcaacttcggcggcaccggcgcccccaccggcggctttaccttcgggactgctaaaacagccacaacaacacccgctaccggcttcagcttcagtacttccggaaccggcggtttcaattttggggcaccattccagccagctacaagcacaccatctaccggcctgttttctctggccactcagacaccagcaacccaaactacggggtttacctttggcacagcaaccctggctagtgggggaaccggtttcagcctcgggatcggagccagcaagctgaacctctccaacacagctgctacccccgccatggccaatccctccggattcggcctcggtagctctaacctgaccaatgcaataagcagcacggtcacctccagccaagggaccgctcccaccggattcgtcttcggacctagcaccacatctgtggcgcctgctaccacttccggtggctttagcttcacaggcggcagtaccgcacagccaagtggctttaacattggcagcgcaggaaactcagcgcagcccacggcgccggccacactcccctttacccccgcctag

SEQ ID NO: 197951 - DNA, 1569 bp, Artificial Sequence
  Description of Artificial Sequence: Synthetic coding sequence
atgagcggcttcaacttcggcggcaccggcgcccccaccggcggcttcacattcggcaccgccaagaccgctaccactacgcctgccactggctttagcttctccacaagcggcacagggggatttaattttggcgcacccttccagccggcgacatcaacaccctccaccgggttgttctcccttgctacgcaaactcccgctacgcagacaaccggcttcacctttggcaccgcaactctagcctccggggggaccgggttttcactgggaatcggtgcgagcaagcttaatctctctaatacagcggccacaccagccatggccaacccgtctggctttggccttggctcatccaatctgaccaacgccattagcagtacagtcaccagctcccaggggaccgctcctacggggtttgtgtttggcccatctactacctcggttgccccggccaccacatcagggggcttctcattcactggcggatcaacagcccagccgagcggtttcaacattgggtccgccggcaattctgctcagcccaccgcgccagccacactgccatttacacccgccacccccgctgcgacaacagctggcgctactcagccagcagcaccaacacccacggcaaccataacctcaaccggcccgtctctgtttgcctcgatcgccaccgcgcctacatccagcgcaacaaccggtctctcactgtgtacgcctgtgaccactgcgggcgcacccacagcaggtacccagggttttagcctgaaggcccctggtgcagcaagcggcacaagcacaacaaccagtacagccgcaacggcgaccgccactacaaccagttcaagttctactaccggctttgcacttaaccttaaacctcttgcaccagcgggaatcccatctaacactgcggcagctgttactgcacctccaggtcccggagccgctgcgggcgccgcagcgtcctcagctatgacatacgctcagcttgagtcactgattaataagtggagcctggaacttgaagatcaggagcggcacttcttacagcaggccacccaggtgaatgcctgggatcgcacattgatagagaacggggagaagattacatcactgcaccgcgaagtggagaaggtgaagctcgaccagaaacggttggaccaggagcttgattttattcttagtcagcaaaaggagctcgaggatctcctctcaccactggaggagctcgtgaaagaacagtccggaacaatctatttgcagcacgcagacgaggaacgggaaaaaacgtacaagctggctgagaatatagacgcccagctgaaacgcatggctcaagacctgaaggacatcatcgagcacctgaacacctcgggggcgcccgcagacacctccgaccccttgcagcagatttgcaagatccttaacgcccacatggatagcttacagtggatagatcagaactccgcattactccagcgcaaggtcgaagaggtaacaaaggtgtgtgaagggcgacggaaggagcaggagagatcattccgaatcacctttgattag

SEQ ID NO: 197952 - DNA, 1569 bp, Artificial Sequence
  Description of Artificial Sequence: Synthetic coding sequence
atgagcggcttcaacttcggcggcaccggcgcccccaccggcggcttcaccttcgggaccgctaaaactgcaactactacaccagctacaggtttcagctttagcacgtccggcactggcggattcaacttcggcgcaccgttccagcccgccacctccactcccagtactggtttgttttccttggccactcagacacccgcgactcagacaaccggctttaccttcggaaccgccacactcgctagcggcgggacaggcttcagtctcggaatcggcgccagcaaactcaatttgagcaacacagctgctacacctgccatggcgaacccatctggatttggcctgggcagcagcaatctcaccaatgctatatccagcacagtgacatcaagccagggcactgctccgactggattcgtctttggacccagcacaacatcagtggcaccagccaccacaagtggtggtttctctttcaccggtgggagcaccgcccagccaagcggatttaacattggctcggcaggtaattccgcccagcccacggcaccagcgactctcccattcaccccggcaacccccgcagcgaccactgctggagcaactcagcctgccgccccaactcccactgcaaccattacgtctactgggccctcactgttcgcatccatcgccaccgccccaacaagttctgcaacgacagggttgtccttatgcacacccgttacaactgccggcgccccaacggccgggacacaggggttttcactgaaagcgccaggagcagccagcggtacctcaacaactactagcacagcagcgactgcaaccgcgaccacaaccagcagctcgtcaactaccggctttgctctcaacctcaagccactagcgccagcaggtatcccatccaataccgcagccgcagtgactgctccccccggaccaggtgccgctgcaggggctgcagccagcagtgccatgacttatgcccagctggagtctctcatcaacaagtggtccctggagttggaagaccaggagcggcactttctgcagcaggcaacccaggtgaacgcttgggatcgaacgctcattgagaatggtgaaaagataacctccctccacagagaggttgagaaggttaaattagatcagaagaggttagatcaagaactcgattttatactgagccagcagaaggagctggaagatctgctgtctcctttggaggagctggtgaaagaacagagcggcacaatctacctgcagcatgcagatgaggagagagaaaagacttataaattggcagagaacatcgacgcacaactgaagcgtatggcacaggacctgaaagacatcatagaacacctcaacacctcaggtgcccccgcagatactagtgaccctctgcaacagatctgcaaaattctcaacgctcacatggacagtctacagtggatcgaccaaaatagtgccctactacagcggaaggtggaagaagtcactaaagtttgcgaggggaggagaaaagaacaggaacgttcatttcgaatcacattcgattag

SEQ ID NO: 197953 - DNA, 1569 bp, Artificial Sequence
  Description of Artificial Sequence: Synthetic coding sequence
atgagcggcttcaacttcggcggcaccggcgcccccaccggcggctttacctttggcacggctaaaacagcaacaacgacaccagcgaccgggttttcattctccaccagtggaacaggcggcttcaatttcggagccccctttcagcccgcgacatcaactcctagcaccgggttattttcattggcaacccagacccccgcaacacagactaccggtttcacctttggcaccgccacattggcctccgggggtactggcttctcattagggataggcgcctcaaagttaaatcttagtaacaccgccgccacgcccgccatggcaaacccatcaggatttggactgggttccagtaatctgactaacgcgatcagctcaaccgtcacaagctcccaggggacagctccgacaggttttgtcttcggtccgtcaacaaccagcgtggctccagccactaccagtggtgggttttcttttaccgggggcagtactgctcagcccagcggcttcaatataggctcagcaggaaatagtgcccagccaacagctccagctaccctcccctttaccccggccaccccggcagctaccacagcaggcgccactcaacctgccgcccccacccccacagccacgattacatcaactggacctagcctgtttgcgagtattgctactgcgcccaccagcagtgcaactactggcctgtcactgtgtaccccagttacaacagctggagctcctacggctggtacacagggcttttccttaaaagcacccggcgccgcttccgggacatccacgactacaagtacagccgctaccgcaactgccaccaccacatctagttctagtacaacaggttttgctcttaacctcaaacctttagcccctgccggtatcccatcaaatactgcagctgccgtgaccgcccctccggggcccggagccgcggcaggtgccgccgcaagtagcgctatgacatacgcccaactggaaagtctcatcaacaagtggagtctcgagctggaagatcaggagcgacattttctccagcaggccacacaggtaaacgcatgggaccggacactgattgaaaacggcgaaaagatcacctcattgcacagagaggtggaaaaagtaaaattggatcagaagagacttgaccaggaactcgactttatcttatcgcagcagaaggaactggaggatttactgagcccattggaggaactagtaaaggaacagagtggtacaatttatctccagcacgccgacgaggagagagagaagacttataaattagcggagaatattgacgcacagttaaagagaatggctcaggacctaaaagacattattgaacaccttaacacctcaggtgctccagccgatacctccgacccccttcagcaaatttgtaagattctgaacgcacatatggactccttgcagtggatcgaccagaattcagcactgctccagaggaaggttgaggaggtgactaaagtgtgtgaggggcgccggaaagaacaggaaaggtcattccgaatcacattcgattag

SEQ ID NO: 197954 - DNA, 1971 bp, Artificial Sequence
  Description of Artificial Sequence: Synthetic coding sequence
atggaggagctggacggcgagcccaccgtgaccctgatccccggcgttaacagtaaaaaaaaccaaatgtacttcgattggggcccgggcgagatgctggtctgtgagacctcctttaacaaaaaggaaaagtcagagatggtacctagctgtccattcatttacatcataagaaaggacgtggacgtttacagccagatcctgaggaagttattcaatgaatcacatggaatttttctcggccttcagaggattgacgaggaactgactggcaagtcacggaagagccagttggttcgggtgagtaagaactatcggtcagtgattcgcgcatgtatggaagaaatgcatcaagttgctatcgcggctaaagatcctgctaatgggcggcagttctccagccaagtgtcgattctaagcgccatggagctcatatggaatctgtgcgaaatcctgttcattgaggtggctcctgcaggtcccctccttcttcacctgctggattgggtgagattgcatgtttgcgaagtcgactccctgtcagcagacgttctcgggtcagagaacccaagtaagcacgacagcttctggaacctggtgaccatcctcgtgctgcagggtcgtctcgacgaagctagacaaatgctgagtaaggaggccgacgccagccccgcatccgcaggaatctgtcgcatcatgggggatcttatgaggacaatgcccatcctctcaccgggcaatacacagactctcacggagctggaactgaaatggcagcactggcacgaagaatgtgaacgctacctacaggacagtacattcgcgaccagtcctcacctggagtccctgctgaagatcatgctaggcgatgaagcagctctgttggagcagaaagaattactgagcaactggtaccatttcctggtgacaaggttgctctattctaatcctacagtcaagcctattgatctccactattacgcgcagagtagcttggacctgttcttggggggagagtcttccccagagcccctcgataacatcctgctggcagcctttgaattcgacatccaccaggtcattaaggaatgcagcatcgccctttcgaactggtggttcgtcgcccacttaactgacctgttagaccactgcaagctgctgcagagtcacaatctttacttcgggagtaacatgcgggagttcctgcttctggaatatgcatcaggcttattcgctcatccaagcctgtggcagctaggcgttgactacttcgactattgtcccgaattgggccgagtgtccctggaattgcatatcgagagaattcccctcaacacggaacaaaaagccttgaaggttctaagaatatgcgagcagaggcaaatgaccgaacaggtgcgttctatctgcaagattctggccatgaaggccgttcggaataataggctcggctcagctttaagctggtcaatccgagcaaaggatgccgctttcgccactctcgtctcagaccgttttctgagagattactgtgagagaggctgctttagtgacttggatctcatcgataaccttggccccgcaatgatgctgtcagaccgcctcacctttttaggcaagtacagggagtttcacagaatgtatggggaaaagcgtttcgcagacgcggcatcacttttgctcagtctcatgacctctcgtatcgcccctcggtcgttttggatgacgctgcttaccgatgccctgccattgctggagcagaagcaggtcatctttagcgcagaacaaacttacgaacttatgcgctgtttagaagacttgacttcccgacgcccggttcatggcgagagcgatactgaacagctccaggacgatgacattgagactacaaaggtggaaatgctccggctgtcccttgcacgcaatctggctcgtgccatcatcagagagggttctctggagggcagttag

SEQ ID NO: 197955 - DNA, 1389 bp, Artificial Sequence
  Description of Artificial Sequence: Synthetic coding sequence
atggccgccagcagcgccgcccggagccccttctgccagcagtggtcttcaagcgggacatgtgtccgctttttcctgcttaagtggcctcaggtgactatcctggtgctccaggggagactcgacgaagcgcgacaaatgttatccaaggaagcagatgccagtcccgcttccgcagggatctgtcgcatcatgggagacttgatgagaaccatgcctatcctgtctccagggaacacacagacactgactgaactggagctgaaatggcagcattggcatgaagaatgtgagcggtatctgcaggatagtacctttgcgacatctccacatttagagtcactcttgaagattatgctgggggatgaagccgccttgctggagcaaaaagagctgttgtccaactggtaccattttctcgttacacgcctgctgtacagcaatccaacggttaaacctattgacttacactactatgcccagagcagtctggacctgttcctaggcggggaatccagcccagaaccattggataacattctgctggcagctttcgagttcgacattcaccaagtgatcaaagaatgcagtattgctttgagtaactggtggtttgttgcccacttaaccgacttgctcgaccactgtaaactgttacagtcccacaatctctatttcgggagcaacatgcgcgaatttctgctgctggaatacgcatctggcctttttgcgcacccatctctgtggcagcttggagtcgattattttgattactgcccagaactcggccgggtgagcttagagctgcacattgaacgaatccctctgaacaccgaacagaaggccctcaaagtcttacgcatttgtgaacagcgccagatgactgaacaggtgagatccatatgtaagattctggccatgaaagccgtcagaaataacagactgggatccgccctttcctggagtatcagagcaaaagacgctgccttcgcgactctggtgtccgaccgcttcctgagagactattgcgagcgcggctgcttctctgacctggatttaatcgacaaccttggccccgccatgatgctctcagatcgcctgacgtttttaggcaagtatagggaattccacaggatgtatggcgagaagcggtttgccgacgccgcttctctgctgctgtccctgatgacatctcggattgcccctcgatcattctggatgactctacttactgacgccctgcctcttcttgaacagaaacaggtcaaggtggctgcagctgtcgtcttctttgcctgccagagtttgcttgaattgtcatgtatagctgtggcggacgtgagagtttctagcttcgtggtgctgcccgtcagggtgtatagcccatag

SEQ ID NO: 197956 - DNA, 975 bp, Artificial Sequence
  Description of Artificial Sequence: Synthetic coding sequence
atggtgcccagctgccccttcatctacatcatccggaaggacgtggacgtctactctcagatcttaagaaaactctttaacgaatcccacgggatattcctgggactgcagcgcatagacgaagaattgactgggaaaagtcggaagtcccagctcgtgcgtgtgtcaaagaactaccggtccgtgattcgcgcctgcatggaggagatgcaccaagtggctattgccgcaaaggatcctgcaaacggacgacagttctccagccaggtgtccatactgtccgccatggagctcatctggaacctgtgtgaaatcctgttcatcgaggtcgcacctgccggaccccttctcttacaccttctggattgggtgcgtctgcacgtctgtgaagtggatagcctgagtgctgacgtgttaggatccgaaaatcctagtaaacacgactccttttggaatttggtgacgatacttgttcttcagggccgccttgatgaagccagacaaatgctgtccaaggaggccgacgcaagtccagcctctgcaggcatatgccggattatgggggatctgatgagaaccatgcccattctatcccccggcaatacgcaaaccctgactgaactcgagctcaagtggcagcattggcacgaggaatgcgaaagatacctacaggactctacctttgccactagcccccatcttgagagtctgctgaagattatgctgggagatgaagccgccctcctggagcagaaagagctgctgagcaactggtatcatttcttggtcaccaggctgctatattccaaccccacagtaaagccaatcgacctgcactattacgcacagtcctcccttgacctctttttgggtggagaaagttcaccagaacccctcgacaacatcctactggctgcctttgagttcgacatccatcaggtgatcaaagagtgccgcgatgtgcaccttaagtag

SEQ ID NO: 197957 - DNA, 780 bp, Artificial Sequence
  Description of Artificial Sequence: Synthetic coding sequence
atgcgggagttcctgctgctggagtacgccagcggcctgttcgcccacccatctttgtggcagctgggcgttgattactttgattattgcccggaactgggccgggtttcactggaacttcacatcgaacgcatccctctgaacaccgaacagaaagctcttaaagtcctgagaatatgtgaacagcgccagatgaccgaacaagttcgcagtatttgcaaaattctggcgatgaaggccgttaggaacaaccgtttgggaagcgctctgtcctggtctattcgcgcaaaagacgccgcatttgcaactctggtgtcagaccggttcttacgagattactgtgaacggggctgtttcagcgacctggacctgatcgacaacttagggccagctatgatgctcagcgacagactcacattcttgggaaaatatcgagagttccacaggatgtacggcgaaaagcgctttgctgatgcagcatccctcttgttgtccctcatgacatcaaggatcgcccctcgctcattctggatgactctactcacggacgccctccctctgctcgaacagaagcaggtaattttctctgccgagcaaacgtacgaactcatgcgatgcctcgaggacctgaccagccgccgccctgtgcacggagagtctgacaccgagcagctgcaggacgacgacattgagaccactaaagttgagatgctgaggctatcactggctaggaaccttgctagggccattatcagagagggatctctggagggatcctag

SEQ ID NO: 197958 - DNA, 1833 bp, Artificial Sequence
  Description of Artificial Sequence: Synthetic coding sequence
atggtgcccagctgccccttcatctacatcatccggaaggacgtggacgtgtacagccaaattctgcggaaactgtttaacgagtcacatggtatattcctaggcctgcagcggatcgacgaggaactgaccggtaagtccaggaagtcacagttagtgcgggtgtccaaaaactatcggtctgtgatccgggcgtgcatggaagagatgcatcaagtggccatcgccgcgaaggatcctgcgaacgggagacaatttagtagccaagtgtccattctgtccgcaatggagctgatctggaatctttgtgagattctctttatcgaagttgcgcccgctggacctttgctcctccatctcctggattgggttcggttacatgtctgcgaagtggactcactgagtgctgatgtgctggggtctgaaaacccctctaagcacgacagtttctggaatctggtgacaattctggtcctccagggcagactagatgaggcacgacaaatgctgagtaaagaggctgatgctagccctgcaagtgctggcatatgtagaatcatgggcgaccttatgcggactatgccgatcctgagccccggcaacacgcagactctgaccgagctggagctgaagtggcagcactggcatgaggaatgtgagaggtatcttcaggactcaacgttcgccacaagcccgcatttggaatcattgctgaaaatcatgctcggcgacgaggccgccctcctggagcaaaaggaactcctgtccaactggtatcacttcttggtcacccgccttttgtactctaaccccacagtaaaacctatcgatctgcattactacgcccagtcctctctggacttgttccttggaggagaaagttctccagaacccctggacaacatactgctggccgcatttgagttcgacatccaccaggtcataaaggagtgcagcattgctctgtcaaactggtggttcgtcgctcacctgactgatctgctcgaccactgcaagctactgcagtcccacaacctatatttcggcagtaacatgagggagttccttctgcttgagtatgctagcggcctcttcgcacacccttccctatggcagttgggcgtggattactttgattattgtcctgaattagggagagtcagcctggagctgcacattgagcggatacccttgaacactgaacagaaggcgctcaaggtgttgcgcatttgcgaacagcgccagatgacagaacaggttagaagtatctgtaaaatcctggccatgaaagccgtccgaaataacaggttgggttcagctttgtcatggtctatacgcgctaaagacgcagccttcgccacgcttgtgtccgatcgctttttgcgagactattgtgagcgaggttgttttagtgacctggaccttattgataatctaggtcccgctatgatgctcagcgaccggctaacatttctcggcaagtaccgagagtttcatagaatgtatggcgagaagaggttcgccgacgccgcttctcttctgttaagccttatgaccagtagaatcgccccccgctccttttggatgacacttctcacggacgctctaccattgctggagcagaaacaggtaattttttctgcagagcagacatacgagcttatgaggtgtttggaggatctcacttctcgcaggcctgtacatggagagtccgacaccgaacagctccaggacgatgacatcgagacaaccaaggtggaaatgctgagactcagcttggcgagaaaccttgcaagagccataatcagagaggggagtttagagggctcctag

SEQ ID NO: 197959 - DNA, 846 bp, Artificial Sequence
  Description of Artificial Sequence: Synthetic coding sequence
atgaagctggccgccatgatcaagaagatgtgccccagcgacagcgagctgtccatccctgctaagaactgctaccggatggtgatcctggggtctagtaaggtgggaaagaccgcaattgtatcaagattcctcaccggacgctttgaagatgcttatacccctaccatagaggactttcatagaaagttttatagtatacgaggagaagtctatcaattggacatcctcgacacatcaggtaatcacccattccccgcgatgcgacgattgagtatactcactggggacgtctttattctggtctttagcctcgacaacagggattcattcgaggaggtccaacgcctgcggcaacagatccttgacacaaagtcgtgcctgaaaaacaaaaccaaagagaatgtggacgtgcccctggttatctgcggtaacaaaggcgatcgcgatttctaccgggaagtggatcaaagggaaatagagcagctcgtcggggatgacccccaaagatgcgcctacttcgagattagcgcgaaaaagaattcctcgctcgaccagatgtttagggcacttttcgcaatggcaaagttgccttcggaaatgtctcctgaccttcaccgcaaagttagcgtacagtattgcgacgtgctgcacaagaaggcactgcggaacaagaagcttctacgggccggaagtgggggtggtggtggtgatcccggcgacgcattcgggatcgttgcccccttcgcccggcgtcccagcgtacactcagatctaatgtatatcagagaaaaagcatctgcagggtcccaggcaaaggataaagaacgctgtgtgatcagctag

SEQ ID NO: 197960 - DNA, 1881 bp, Artificial Sequence
  Description of Artificial Sequence: Synthetic coding sequence
atggtgctggagctgcccaagcggtggggcaagaacagcgagttcgagggcggcaagagcacagtcaattgcagcacaacgcctgtggcggaacgcttttttacatcttccacctctttgactttaaaacatgctgcctggtatccatccgagatactggatccacatgttgtgctcctcacaagcgataatgtgatacggatttactctctccgcgagccgcagacacctaccaatgtgatcatcttatcagaagctgaagaagagtctcttgtgctcaataaggggcgagcatatacggctagtctgggtgagactgccgtcgcatttgattttggccccctggccgccgtgccaaagaccctttttggacagaatgggaaagacgaagtggtggcctacccactctacatactctatgaaaacggcgaaacattcctaacctatatttccctgctccactcacccggaaacatcggaaagttgctgggtcctttgccaatgcaccccgctgcagaggacaattacggatatgacgcctgcgctgttctgtgcctgccctgtgtgccaaatattctagtcatcgccaccgagtccggcatgttgtatcattgtgtcgttctggaaggcgaggaagaggacgaccacacttcggagaagtcctgggattcccgcatagatttgattccctccctgtacgtgtttgaatgtgtggagctggagctggcgcttaagctagctagcggcgaagacgatccatttgattccgacttcagttgccctgttaaactgcatcgggaccctaaatgcccttcacgatatcattgcacccacgaggccggcgtgcactcagtaggcctgacgtggatacataaactgcataaattcctggggagtgacgaggaagataaagacagcctccaagaattgagcaccgaacagaagtgttttgtggaacatatcctgtgtaccaaacccctgccttgccgtcaacccgcacctataaggggattttggatcgttcccgatatccttggacccacgatgatttgtatcacttctacatatgaatgtctgatttggccactcctgtcaacagtgcaccccgctagccccccactgttgtgcacgagggaagacgtcgaagtggccgagtcgcctctaagggtcttggctgagactcccgactcatttgaaaaacacatccggtcaattctgcagaggtccgtggctaacccagcatttctgaattgctttactcagctgcggaagatcaaggtggaaacactatttctcagagcaagtgagaaagacattgcccctcccccggaagaatgccttcagctgcttagcagagccacacaagtgttccgcgaacaatacatactgaaacaagacctggctaaagaagagatacagagacgagtgaagctactgtgcgatcagaagaagaagcagctggaggatctgtcttattgcagagaggagcgcaagagcctcagagagatggccgaacgactggctgacaagtacgaagaagctaaggaaaaacaagaagacattatgaataggatgaagaagctgcttcattcttttcatagcgagctgccagtgctttccgattccgaacgggatatgaaaaaggagctccagctgattcccgatcagcttcgacatctgggaaatgccataaagcaggtcacaatgaaaaaagattaccagcagcagaagatggagaaggttttgtccctccccaagccgacgatcatcctctccgcttaccaaaggaaatgtattcagagcatactgaaggaggagggggagcacattagagagatggttaaacagataaatgatataaggaaccatgtgaacttctag

SEQ ID NO: 197961 - DNA, 2226 bp, Artificial Sequence
  Description of Artificial Sequence: Synthetic coding sequence
atggccgccgccgagggccccgtgggcgacggcgagctgtggcagacttggctgcccaatcacgtggtgttcctgaggcttcgcgagggcttaaaaaaccagtcgccgaccgaggctgagaaacctgcatcctctagtttaccatcatccccccccccccagttgctcacccgaaacgtggtattcggactgggaggagagttattcctgtgggatggcgaagactcatccttccttgtggtgcgtctccggggtccctcagggggcggcgaagagcccgcgctaagccaataccagcggctgctttgcattaatccacccttgtttgaaatctaccaggtcctgctctcgccaacgcaacaccatgtggctctcataggcatcaagggactcatggtgttagagctacctaagcggtggggtaagaatagtgagttcgagggaggcaaatcaacagtgaactgctccactactcctgtcgcagaacgctttttcacgtccagtacctctctcacccttaaacatgccgcatggtacccctcagagatactggatccacacgttgtacttcttacctctgacaatgtgatcagaatctacagcctgcgggagccccagactcccaccaatgtgattattctttccgaagccgaggaagaatcactagtgcttaacaaggggcgggcttacacagccagtctaggagagactgcggtcgcattcgattttggtccactggcggccgtgcccaagacattgttcggtcaaaatgggaaggatgaagtggttgcctatcccctgtatatcctgtacgagaatggcgagacttttctcacctacatatctttgcttcactcacctggcaacatcggtaaactgcttgggccactgccaatgcatcccgccgccgaggacaactacggatacgatgcgtgcgccgtcctctgtcttccatgcgtgccaaatatcctggtgatcgccactgaatcggggatgctataccactgtgtggttttggaaggcgaggaagaagatgaccacacttccgagaaaagttgggactctcgcattgacttaatacctagtttgtatgtcttcgagtgtgttgaattagaacttgccctgaaactggcttccggggaggatgatcctttcgattctgacttcagctgtcctgtgaagctccatcgggaccctaagtgcccttcacgatatcactgtacgcacgaagctggcgtgcactcagtaggattgacatggatccataagctccataaattcctcggatctgacgaggaggacaaggatagcttgcaggaattgtctacagaacaaaaatgttttgtagagcatatactgtgcacaaaaccactgccttgccgccagccagcacccatcagaggcttttggatcgtgcccgatatccttggccccaccatgatctgtatcaccagtacctacgaatgcctgatttggcccctgttgtcgactgtgcaccctgcatctcccccactgttatgcaccagggaggacgtggaagtggctgaatcacccctgcgggtcttagcagagactcctgattctttcgaaaaacacattagatctatactccaacggtccgtcgcaaatccggcttttctgaaagctagcgaaaaggacatcgcaccccctcctgaagagtgcctgcaacttttgagtcgggccacccaggttttccgcgaacaatatatcctaaagcaggatctggcgaaggaagaaatacagcgtcgcgtaaagttgctgtgtgatcagaagaagaagcagttggaagatctgagctattgccgcgaagagagaaagagtttgcgcgaaatggctgagaggctcgctgataaatatgaagaagctaaggaaaagcaagaagacataatgaatcggatgaaaaaacttttgcacagtttccacagtgagcttcccgtgctttcagactccgagcgcgacatgaagaaagaactgcaacttatccccgatcagctgcggcacttgggaaacgcaattaaacaggtcactatgaagaaagactatcagcaacaaaagatggaaaaagtgctctccctgcccaaaccaactatcattctgtctgcctaccagaggaagtgcatccagtcaattctcaaggaagagggagagcatatacgcgagatggtgaagcagattaacgacatccggaatcatgtgaacttttag

SEQ ID NO: 197962 - DNA, 2460 bp, Artificial Sequence
  Description of Artificial Sequence: Synthetic coding sequence
atggacaccgagggcttcggcgagctgctgcagcaggccgagcagctcgcggctgagacagaaggaattagtgagctcccacacgttgaaagaaacctgcaggaaattcagcaggctggagagaggttgaggtcccgcactttgactagaacatcccaggaaactgcggatgtgaaggcttccgtgcttctcggtagccgcggcctggacatcagtcatatatcccagcggctcgaatcactctcggcagcaacaaccttcgaacccctagaacctgtgaaagacacagatatccaggggtttctgaaaaatgagaaggataatgctctgttatccgctattgaggagtctaggaagcggacattcgggatggccgaggagtatcacagagaaagcatgttggtcgaatgggagcaggtgaagcagcggatactacacacactgcttgcaagcggcgaggacgctttagattttactcaggaatcagaaccaagctacattagcgacgtggggcctcctgggcgtagctctcttgacaacatagaaatggcctacgctcggcaaatttatatctataatgaaaagattgtgaatgggcatttgcagcctaacctggtggatctttgcgccagtgtggccgagctcgacgataagagcatttcagacatgtggacaatggtcaagcagatgacggatgttctgctgacaccggctactgacgctctgaaaaatagatccagtgtcgaagtgagaatggagttcgtacgccaagcacttgcttacttggagcagtcctataagaattataccctcgtcaccgtttttggtaacctgcatcaggcccaactcggcggcgtgcctggaacctaccaactagtgcgatccttcctgaatataaagctccctgctcccctcccaggtttgcaggatggcgaagtagagggccatcccgtctgggctctgatctactattgtatgaggtgtggagaccttctcgcagccagtcaggttgtaaatcgagcccagcatcagctgggagagttcaagacgtggttccaggaatatatgaactctaaggatcgtagactcagccctgccactgaaaataagctccgcctacattacaggcgggctctgcggaacaatactgatccatataagcgggccgtttactgcatcattggccgatgcgacgtgaccgacaatcagagcgaagttgcagacaagaccgaagactatctgtggctcaaacttaatcaggtctgctttgatgacgacggtacaagctccccacaggacaggttgacactgagccagttccagaaacagttgttggaggattacggtgaaagtcatttcaccgtcaaccagcaaccattcctgtacttccaggtcctatttctgactgcccagttcgaggccgcggtggcctttctgttcaggatggaacgcttaaggtgccatgccgttcatgttgccttagtattgttcgaattgaagctgctgttgaaatcctcgggccagtccgcccagctgttgtcccatgaacctggggatcccccttgcctgagaaggctgaatttcgtaaggctgctcatgctgtatacccgcaaattcgagtctacggacccccgtgaagctctgcagtatttctattttcttagagacgaaaaggattctcagggcgaaaacatgttcctgcgatgcgtgtcggaactggtgatcgagagtagagagtttgatatgatcctggggaagctggagaacgacggcagtcggaagcctggcgtgatcgataagtttacctccgataccaagccaattattaacaaggtggcctcagttgcggagaacaagggactttttgaggaggccgcaaaactgtacgatctagctaaaaatgccgataaagtgctggaactgatgaataaactgctttcccctgtggtcccacagatcagcgccccgcagagcaacaaggaaaggttgaagaacatggccctttctatcgctgaaaggtatcgcgctcaggggatctccgcaaacaaatttgtagacagcacattttatttgctgcttgatttaatcacattctttgatgaataccatagtggacacatcgaccgggcgttcgacatcatagaaagacttaagctagtgcctcttaatcaggaatccgttgaggagcgcgtggccgcttttaggaacttctcagatgaaattcgtcataatctcagcgaggtcctgctagccaccatgaacattctctttactcagttcaaaaggttgaaaggcaccagcccaagcagtagttcaagaccacagagggtaattgaagatcgagacagccagttacgcagccaagcccgcactctgataacttttgcgggaatgattccctaccggacgtcaggtgatacgaatgccaggctggtccagatggaggtactgatgaactag

SEQ ID NO: 197963 - DNA, 2091 bp, Artificial Sequence
  Description of Artificial Sequence: Synthetic coding sequence
atggccgaggagtaccaccgggagagcatgctggtggagtgggagcaagtcaaacaaaggattcttcacaccctcttggcttccggtgaagacgcactggactttactcaggaaagcgaaccttcttacatttccgacgtgggtcctcctgggcggagctccctggataatatagaaatggcctacgcccgtcagatatacatatataatgagaagattgttaatgggcacttgcagcctaacttggtcgatctctgtgctagtgtggccgagctggatgacaagtccatttcggatatgtggaccatggtgaagcagatgactgacgttctactgacacccgcaaccgatgccctgaagaaccgctcgtccgtggaagtgcgaatggagttcgttagacaggcacttgcctacctcgagcagagttacaaaaactacaccctcgttacggtcttcgggaaccttcaccaggcccagcttggcggcgttcctggaacatatcaactggtccggagttttctgaacatcaagctacctgcccccctgcccgggctccaagatggcgaggtggaggggcatccagtgtgggctctcatctattactgcatgagatgtggggacctgctggccgcttctcaagtggtcaaccgtgcgcagcatcagcttggggagttcaagacatggttccaggaatatatgaacagcaaggaccgccggctttccccagcaactgaaaacaagctcagactccattatagaagggccctacgcaacaataccgacccttataagagagctgtgtattgtatcattggaaggtgcgatgtgactgacaaccaatcagaagttgccgacaaaaccgaagattacctctggctgaagctgaatcaggtgtgtttcgacgacgacggaaccagcagcccccaagacagactgaccctctcccagttccaaaaacagctgctggaggattatggggagtcccactttacagttaatcagcagcccttcctatattttcaagttctgttcctcactgcccaattcgaagcggcagtggcattcctcttccggatggagagacttcgttgtcacgccgtccacgtagccttagttttatttgaactgaagcttcttctgaaatcatctgggcaaagcgctcaactgctcagccacgagcccggggaccctccatgcttgaggcgactgaattttgtaagactgctgatgctttataccaggaagttcgaatcgactgatccacgggaagcactccagtatttctattttcttagggatgagaaagacagccagggggaaaatatgtttctgcgttgtgtaagtgagcttgttatcgagtctcgggaattcgatatgatactcggcaagttggaaaacgacggttcccggaagccaggcgtgatcgacaagtttaccagcgacacaaaaccgatcatcaataaggtcgcatcggttgcagaaaacaaaggacttttcgaagaggctgctaagctttacgaccttgccaagaatgctgacaaagtgctagagttgatgaacaagctgttgtccccggtcgtgccccagatctccgccccacagtctaacaaggaaagattgaaaaatatggcactgtcaatagccgaacgctatagagcccaggggatctccgcgaataagtttgttgatagcacattctatttattgctcgatctgattacctttttcgatgagtatcattcaggacacatcgaccgcgcttttgatatcatcgagagactcaaacttgtcccgctgaatcaagagtctgtcgaggagcgcgtcgccgctttccgaaatttttccgatgagattagacacaatttgagcgaagtgctgctggctacaatgaatatcctgtttacacagttcaagcgcctaaaagggacctccccaagctctagcagccgcccccagcgagtgatcgaggatcgggacagtcaacttcgaagccaggcgcgaacattaattactttcgcgggaatgatcccttataggacaagcggagatactaacgcgagactagtacagatggaagtgcttatgaactag

SEQ ID NO: 197964 - DNA, 2091 bp, Artificial Sequence
  Description of Artificial Sequence: Synthetic coding sequence
atggccgaggagtaccaccgggagagcatgctggtggagtgggagcaggtcaagcaacgtattctgcacactctgctggccagcggcgaggatgcactggactttacacaggaatcagagcccagctatatcagcgatgtggggccccctggaagaagttcccttgacaatattgaaatggcttatgcaagacaaatctacatatataatgaaaagattgtgaacggacatcttcagcctaatctcgtggatttgtgtgcctctgtcgcggaactcgatgacaagagtatctcagacatgtggaccatggttaaacagatgactgacgttctgctaacgcccgcaaccgatgcactgaagaacagatctagtgtggaagtccgcatggaattcgtgaggcaggccctggcttatctcgagcaaagctacaaaaattatacccttgtgaccgtgttcgggaacttgcatcaggcccagctggggggggtgccgggaacgtaccagctcgtccggtcctttctgaatattaagctgcctgctccactacctggtctgcaagatggcgaagtcgagggtcatccagtttgggcactgatctattactgcatgagatgcggcgacctgttggcggcttcacaggtcgtcaatcgcgctcagcaccaattgggcgaattcaaaacctggttccaggaatacatgaatagcaaggacaggcggctgtctccagcaaccgagaacaagctacgccttcactatagaagggctctgcggaataatacagatccttacaagcgggccgtgtattgtatcattgggagatgtgatgtcaccgataaccaatccgaggtggcagataagacagaagattacttatggttaaagttaaaccaagtctgcttcgatgacgatggcacaagcagccctcaggaccggctgactttgtcacagtttcagaagcaactgctggaggattatggcgagagccacttcacagtgaatcagcagccatttttgtatttccaggttctgtttctgaccgcacagttcgaagccgccgtggcatttctgttccggatggaaagactgaggtgtcatgcggtgcatgtggcccttgttttgttcgaactaaagctcctcttgaaatcaagcgggcaatccgcccagctcttatcgcatgagccaggcgacccaccctgcttgcggcgactgaatttcgtgaggcttctgatgctctacacgcgcaagttcgagtcaacagaccccagggaggccctccagtatttctacttcctcagagacgaaaaagactcccagggcgaaaacatgtttctgcgctgcgtaagcgagctggtgatcgagtcacgggaatttgacatgattctgggaaaactggagaatgatgggtctagaaagccaggcgtcatagacaaatttacctcagacaccaagcctatcatcaataaagtcgccagcgttgctgagaacaaaggactgtttgaggaggcggcgaaactctatgatttagccaagaacgctgataaggtgttagagctgatgaacaagctcctgtccccagtcgtccctcagatcagtgcaccgcaaagtaataaagagaggctaaagaacatggccttgtctatagctgaacgctaccgtgctcagggaatctcagccaataaatttgtggacagcacgttctacctgctgctcgacctcatcacattcttcgatgagtaccacagtgggcatatcgatagggcgttcgacatcatcgaaaggttgaagcttgtgccattgaatcaggagagcgtagaagagcgcgtggccgctttccgaaatttcagtgacgagattagacacaacttgtcggaagtgctcctggccaccatgaacatcctcttcacccaatttaaacggctgaaaggcacatctccttcctctagttctcgaccgcagagagtaattgaagacagagatagtcagttaaggtctcaggcacgcactctgattacattcgccggcatgatcccctatagaactagcggagacacaaacgctcgcctggtccagatggaagttctcatgaactag

SEQ ID NO: 197965 - DNA, 5403 bp, Artificial Sequence
  Description of Artificial Sequence: Synthetic coding sequence
atgttcaacaagagcttcggcacccccttcggcggcggcaccggcggttttgggacgacttccaccttcggccagaacacagggttcggaactacttccgggggcgcgttcgggacctcagcatttggatcatctaacaatactggcgggctatttggtaattcgcagacaaagcccgggggtctattcggcacgtccagcttttcacagccagcaacatcaacgtccactgggttcggattcggtacttctactggaacagctaatactctgtttggaactgctagcaccggtactagtctcttttcatcccagaacaatgctttcgcacagaacaagccaacgggatttggcaatttcggaacttctacatccagtggtggccttttcgggactactaatactacatctaacccatttgggtccacttccgggtcgctgtttgggccctcctcttttactgctgctccaacaggaactaccatcaagttcaatcccccaacagggactgatactatggtcaaagctggggtttcgacgaatatatcaacaaagcatcaatgtataacagccatgaaggagtacgagagcaaatccctagaagagctgagattagaggactaccaagccaatcggaaaggtccacaaaaccaagtgggcgcaggaacaacaacggggctctttggctcatcacccgcaacatcttcagctacaggactcttcagctccagcacaactaactcaggctttgcctacggacagaacaaaactgctttcggcacatcgaccacagggttcgggaccaacccgggggggctatttgggcaacagaaccaacaaaccacctcactgttcagcaaacccttcggccaagctaccacaacccaaaatacaggcttctcttttgggaataccagcaccatcggccagcccagcaccaacacgatgggtttattcggagttacccaggcctcccagccgggcggattgttcgggaccgctactaacactagtacaggcaccgcctttggtaccgggaccggactttttggccagactaacaccggtttcggcgccgtgggatctacactgttcggcaataacaagctgaccacgtttggaagttccaccaccagcgcacctagcttcgggactacctctggtggactttttgggtttggcacgaacacttctggaaacagcatttttggaagtaagcccgcaccaggaaccctgggcacagggcttggggccggctttggcacggccctgggagccggccaggccagtctgtttggtaataatcagcctaagatcggggggcccctcggcaccggtgcctttggagctccagggtttaacaccacaacagctaccctgggttttggtgccccccaagcacctgtggccctgacggatccaaatgcttctgctgcccaacaggctgttctacagcagcacattaacagcctcacatatagccccttcggggatagcccactcttccgaaacccaatgagcgaccccaaaaagaaggaggagcgtctaaaacccactaaccctgcggcacaaaaagcactgaccacacccacacattacaagcttacaccacggcccgccactagggtcagaccgaaggcactgcagactacaggaactgccaagagccacctctttgacggcctcgacgatgacgagccttctctggctaatggagcatttatgcccaaaaaaagcatcaaaaaattggtactcaagaatctcaacaatagcaacctgttcagcccagtgaatcgagactctgagaacctggcctcaccatccgagtatcccgagaatggcgaacggttctctttcctcagcaagcctgtggatgaaaaccaccaacaggatggagatgaagacagtctggtcagccacttctatactaatcctattgccaaacctatcccacagactcccgaatcggctggtaacaaacactccaattctaattccgtggatgacaccattgtggccttaaatatgagagcagccctgcgaaacggtctcgaagggtcctcagaggaaacctccttccacgatgaatctctgcaggatgaccgcgaggaaattgaaaacaatagctaccacatgcaccccgcgggaattatactgaccaaagtcggatattacactattccttccatggacgatcttgcgaaaatcaccaatgagaaaggtgagtgtattgtcagcgattttaccatcgggcggaagggttacggctccatttactttgagggcgatgtgaacttaacaaatctgaaccttgatgacattgtgcacattaggaggaaggaagtggtagtgtatctagacgacaatcagaaaccaccagtcggggaagggcttaatcgtaaggccgaggtgacactagacggtgtctggcctactgacaagacgtccagatgtctcataaagagcccggacagactggccgatatcaactatgaaggccgcctggaggccgtgtccagaaaacagggggctcagtttaaagaatacaggccggagacaggttcttgggttttcaaagtgtctcacttttcaaagtatggacttcaagactctgacgaagaggaagaagagcatccctcaaagacatctaccaaaaagctgaaaacagccccgctcccaccagctagtcaaacaactcccctacaaatggccctgaacgggaaacccgcaccccccccccagtcccaatcacccgaggtggagcagctgggaagggtggttgaactcgactctgacatggtggatatcacgcaggaacctgtcctcgacactatgttagaagagtccatgccagaggaccaggagcctgtaagcgcttctacacatatagctagtagcctgggaattaacccacacgtgctgcagatcatgaaggcctcgctactgaccgatgaggaggatgtggatatggctctggatcaacgcttttcacggctgccatccaaagctgacacctcacaagagatctgttctcctaggctgcctatcagcgcctcccattcttcgaagactcgctccctggtgggtggccttctgcagtctaaattcacctcaggggcatttctgtcaccatccgtgtctgttcaggaatgccgcaccccccgtgcagcaagcctgatgaacattccaagtacctcttcatggtccgttccacctcctctaacctcggtgttcaccatgccttcaccagcacccgaggtacccttgaagaccgttgggacgagacgccagttaggattggtcccgagagaaaaatcagtcacctacggaaaggggaaactcttaatggatatggctctcttcatggggcgaagtttcagagttggatggggccctaactggactctcgcgaatagcggggagcaattaaatggttctcacgagctggagaaccaccagatagcagactcaatggaatttgggtttttacctaatccggtcgcagtgaagccactgaccgagagtccattcaaggtgcatctggagaagttgagtctcagacaacgcaaaccagacgaagatatgaaactgtatcaaacaccattagaacttaagttgaaacactcaacagtccacgtcgatgagctctgcccccttatcgtgcccaacctgggagtcgcggtcatccatgactatgcagattgggtgaaggaggcatccggcgacttaccagaggcccagattgttaagcactggagcctcacctggactctgtgtgaggctttgtggggccatctcaaggagcttgactcccagctgaatgagccacgagagtatatccaaattttggaaaggcgccgagccttcagcagatggttgtcctgcaccgccaccccacagattgaagaggaggtgtcgcttacacagaagaattcccctgtagaggccgtgtttagctacctgacaggtaaaagaatttctgaggcctgcagtttagcccaacagagcggtgaccaccggttagctttgctgttaagccagtttgttgggtcccagtcagtgcgggagctcctgaccatgcagttggtggattggcaccagctgcaggcagactcattcatacaggatgagcgcctgcggatatttgccctgctcgcaggcaagcctgtttggcaactgagtgagaagaaacagatcaacgtgtgctcccagctggattggaagcgcagccttgccatccacctctggtacctccttccacccaccgcatccatttcccgggcactttcgatgtacgaggaagcttttcagaataccagcgactcagataggtatgcctgctcgcctctgccctcgtatctggaaggctctgggtgcgtgatcgcagaggagcagaatagtcagacgcctcttagggatgtgtgctttcacctcctcaagttgtactctgacaggcattacgacttgaatcagttactagagccccgttccatcactgccgatcctcttgactacagactgtcatggcacctatgggaagttctgagagcattgaattatactcacctttcagcccaatgtgagggcgtgctgcaagccagctatgcaggccagctggaatctgaaggcctgtgggagtgggccatctttgtattgttacatatcgataacagcggcatcagagagaaagccgtgcgcgagttattgaccagacattgccagctcttagagacacctgagtcttgggccaaagaaaccttcctgacccagaagctgagagtgcccgccaaatggattcatgaggctaaggcagttcgggcccatatggagagcgataaacacctggaggccctctgcctgttcaaagccgaacactggaaccgttgccacaaactgattattcggcatctggcgtccgacgctattatcaatgaaaactacgattacctgaagggctttctggaggatctggcgcccccggagagaagctctcttatccaagactgggagacttcaggtctggtttacttagactacatccgtgtcattgaaatgctgcgacacatccaacaggtggactgctctggaaatgatctggagcagctccatatcaaagtaacgtctctttgctcaagaattgagcaaatccagtgctacagcgctaaagaccggctggcccagtcggatatggcaaagagagtcgcgaatctgctcagagtcgtcttaagccttcaccatcctcccgaccggacctcagactctactccagacccacagcgagtcccactgcgactcctagctccgcatattggtagacttcccatgcctgaggactatgccatggacgagctcagaagcctgacccagtcctacttgcgggagctggcggtgggatcactgtag

SEQ ID NO: 197966 - DNA, 5181 bp, Artificial Sequence
  Description of Artificial Sequence: Synthetic coding sequence
atgttcaacaagagcttcggcacccccttcggcggcggcaccggcggttttggcaccactagtacttttggtcagaatacggggttcggaacgacctccggcggagcctttggcacttccgcattcggatcatctaacaataccgggggattgtttggcaactctcaaaccaagccaggcggtttgttcggtacctctagcttctctcagccagcaaccagcacatccaccggattcggattcgggaccagtactgggaccgccaatactttgttcggaacagcgagcactggcacatctctattctcaagccaaaacaatgccttcgcccagaacaagcccaccggctttggcaatttcgggacttccacatcaagcggggggctcttcggtacaaccaacactacatccaaccctttcggctccacctctggctcactgttcgggccaagttcgtttacagcggcccctactggtaccactatcaagtttaatcccccaacggggactgacaccatggtgaaagctggggtttctacgaacatctcaactaagcaccagtgtattaccgccatgaaggagtacgagagtaagtcgctggaggaactgcgccttgaagactatcaggcaaaccggaagggaccgcaaaatcaggtgggtgcagggactacaaccggcctattcggttcctcaccagccacatcttcggccaccggcctgttctcgagcagtaccaccaacagtggattcgcgtacggtcagaacaagacagcattcggcacgagcaccacagggttcggtaccaatccgggcggactgttcgggcagcagaaccagcagaccacctcactatttagcaaaccatttggacaggccactactacacagaacacgggattcagctttggcaacacatccaccattggccaaccttccacaaacaccatggggctgtttggcgtaacacaggcttcgcagcctggtggtcttttcgggaccgccacaaacactagtactggcacagcttttgggaccggaaccggtttgttcggtcagaccaacacagggtttggcgccgtgggctcgacactgtttggcaacaacaagctgaccaccttcgggtcctccacgacatctgctccgtctttcgggaccacatccggcggtctcttcggttttggtacgaatacgagtggtaacagcatttttggcagcaagccagctccaggtaccttagggaccgggctgggtgctgggttcggcaccgccctgggtgctggacaggcgagcctgtttgggaataaccagcccaagattggtggccccctcgggaccggtgctttcggagctccagggttcaacactacgactgcgaccttagggtttggtgccccccaggctccggtcgccctgacagacccaaacgccagcgcagcccagcaggccgtgctgcagcagcacattaacagcctcacatatagccctttcggcgattcgcccctgttcaggaatcccatgtcagatcccaagaagaaagaggagaggctgaagcctaccaaccctgctgctcagaaagccctgaccacacctacacactataagttgacacctcgaccagctacccgggtgcgaccaaaggcccttcagactaccggtaccgctaagagccacctgttcgatggcctagacgatgatgaaccatcactagccaacggtgccttcatgccaaagaaatctattaaaaaactagtgctgaaaaatttgaacaatagcaatctgtttagtcccgtgaatagagacagtgaaaatctggcctcaccctctgagtacccagagaatggggaacgatttagcttcctgagcaaacccgtggacgagaaccatcaacaggacggagatgaagactcactggtgtcccacttttataccaacccgatcgccaagcctattccccagactcccgagtcagccgggaataagcatagcaactctaacagtgtggacgacacaatcgtggcactcaacatgcgcgccgctctgcgcaacgggctggaggggtcctctgaagaaaccagcttccatgacgagagcctgcaggatgatcgggaggagattgagaacaatagttatcatatgcacccagccggcataatcctgacaaaagtcggctattacaccataccgtccatggacgatctcgctaagatcactaatgagaaaggtgaatgcattgtatcagactttacaataggtcgcaaaggctatggatcgatttatttcgaaggcgatgtgaatcttaccaatctgaatctggacgatatcgtccacattaggcggaaggaggtcgtcgtttacctggatgacaatcagaagccacccgtaggtgagggcctgaaccgcaaggcagaggtgaccctagatggtgtgtggcctacagataaaacaagtcgttgccttatcaagtcacccgaccggctggctgatattaactatgagggcagactggaggcagtgtcccgcaagcagggcgcccagttcaaggaatatcggcctgagacaggatcctgggtgttcaaagtgagccacttcagtaagtacggattacaggactctgacgaagaggaggaagagcacccatccaagacaagcacaaagaagcttaagacggcaccgctgccacctgcgtcacagacgactccgctgcagatggctctgaatggtaagcccgctccaccaccacagagccaaagccctgaagttgaacagctgggtcgcgtcgtggagctcgatagtgacatggtcgacatcacccaagagcctgtcctcgataccatgctggaggagtcaatgcctgaagatcaagagcccgtttccgcatcaacgcacatcgccagcagtttggggataaatccccacgtcctccaaattatgaaagcctctctcctgaccgacgaggaagacgttgacatggccctggaccaaagattctcccgcttaccttcaaaggcggacacatcccaggaaatttgctcccctagattgccaatctccgcatcccacagctcgaagacgcgcagtttggtcggcggactactgcagtccaaattcacctccggcgctttcctctcacccagtgtcagcgtgcaggagtgtcgcactccacgagctgcctccctgatgaatatacctagcacatcctcttggtcagttccacccccgctgaccagcgtgttcactatgccctcacccgcacccgaagtgccattaaagacggtaggcactagacggcaactgggtctcgtgccgcgagaaaagtcagtcacttatggaaaagggaagttactaatggacatggcactctttatgggacgctccttcagggttggttggggccctaactggaccctggcaaattccggagagcaacttaacggttctcacgagctggagaaccatcaaatcgccgacagtatggagttcggattcctgccaaatcccgtggctgtaaagcccttgacagaaagccctttcaaagtgcacttagagaagctgtccctgcgccagcgaaagccagatgaagatatgaaattataccagacccctctggagttaaagttgaagcactcaacggttcatgtcgacgagttgtgtcctctgattgtgcctaatctgggggtcgcggtaattcacgattacgcggattgggtgaaggaagcatccggcgacttacccgaagctcagattgtgaaacactggtcactgacttggacactgtgcgaggccctgtggggacacttaaaggaactggattcacagttgaatgagcctcgcgagtacatccagatcctagagcggaggagagcgttcagccgctggctatcatgtactgccacgcctcagatagaagaagaggtctccctgactcagaaaaattcacccgtggaggctgttttctcataccttaccggcaagcggatcagcgaggcatgttctctcgcacaacaaagcggtgatcaccgactcgccttgcttctgagccagttcgtcggttcacagagtgttcgggagcttctgactatgcagctggttgattggcaccaactgcaggcagacagtttcatacaagacgaacgcctgagaatttttgctcttctggcagggaaacccgtgtggcagttgagtgagaaaaagcaaatcaacgtgtgttcacaactagactggaaaagaagtctggcaatacacctgtggtatctgctgccacccaccgccagtattagccgggcactcagtatgtacgaagaggcttttcagaacacctccgactctgaccgctatgcgtgttctcctctgccctcttacttggagggttcaggttgcgtcatcgctgaggaacagaacagtcagactcccttgagggacgtgtgttttcacctgttgaaattatattccgactctatccgagaaaaagccgtgcgggagttgcttacaagacattgccagttactcgagactcctgagagctgggctaaagaaacctttctgacgcagaagctgagagtgcctgctaaatggatccacgaggccaaagccgtgcgagcccatatggaaagcgacaagcatctggaagctttatgcctgttcaaggccgagcactggaacagatgtcacaagctgatcattagacacttggcaagcgacgccatcataaacgagaactacgattatttgaaaggcttcttggaggacctcgcaccacccgagaggagctctctaatccaggactgggaaacatctggacttgtgtacctggattacatcagagtgatcgagatgcttcggcatatacagcaggttgattgctcggggaacgatctcgaacagttacatattaaggtcacgagtctctgcagccgtatcgaacaaattcagtgttattccgcgaaagataggctcgcccagtcagatatggctaaacgggtggctaacctgctgagggtcgtcctgagtctgcaccaccccccagacagaacaagcgattcaacccccgaccctcagcgggtgcccttgagactgttagccccccacattggccggctccctatgcccgaggactatgccatggatgaactacggagcttgacccagtcttacctgagggagttggccgtgggctcgttgtag

SEQ ID NO: 197967 - DNA, 4917 bp, Artificial Sequence
  Description of Artificial Sequence: Synthetic coding sequence
atgttcaacaagagcttcggcacccccttcggcggcggcaccggcggattcgggaccacctccaccttcgggcaaaatacgggtttcggaacaacatctggcggcgctttcggtacctcagccttcggcagctctaataatactggcggattgtttggcaactcccagacaaagcctggaggccttttcgggacttcttctttcagccagccagcaacaagtaccagtaccgggttcggctttgggactagcaccggcacagcaaacacactgtttggaaccgccagtactggaacaagcctttttagtagccagaataacgcatttgcccaaaacaagccaacaggctttggcaactttggcacctccacatcatccggtggcctctttggcactaccaatacaactagcaatcctttcggctcaacctccggcagtctgttcggaccttcctccttcacagccgccccaaccggaactaccatcaaattcaatccccctactggaaccgataccatggtgaaagccggggtgagcacaaacatctcaactaagcatcagtgtataactgcaatgaaagagtacgaaagcaagtccttggaggaactacgtttagaggactaccaggcaaatagaaaggggccccaaaatcaggtcggggctggcactacaacaggactgtttgggtcttcccctgcgacaagttcagctactggcctgttcagcagcagcacgacgaactccggattcgcctacgggcagaacaagacagcgtttggaacaagtactaccggctttggcacgaatccgggcggcttatttggccagcaaaatcagcagaccacctcgctcttctcaaagccattcgggcaggctacaactactcaaaatacgggatttagttttggcaataccagtactatcggccagccaagcactaacaccatggggctgtttggtgtgactcaggcgtcacagccaggaggcttgtttggaaccgctaccaacacgagcactggcactgcctttggcacgggtaccggactctttgggcagaccaataccgggttcggtgcagttggaagtaccctcttcgggaacaacaaactaactacctttgggtcttccactacttccgctcctagtttcggcacgacaagcggaggcctgtttggtttcgggaccaacaccagcgggaactctatattcggctcaaaaccagcccccggtactttgggaactggactcggtgccggcttcggaactgcacttggagccggccaggcttcgttattcggaaataaccagcctaagatcggcggtcccctggggaccggcgccttcggagctcctggcttcaacactaccacggcaaccctgggctttggagctccgcaggcccctgttgcactgaccgacccaaacgccagcgctgctcagcaagcggtactccagcaacacattaactctcttacctactcacccttcggcgacagtccactgttccggaaccccatgtccgatccaaagaagaaagaggagcggctaaagccaactaatcccgcggctcagaaggcactgacaactcccactcactataaactgacgccaagacctgccacgagggtccggcctaaagcactgcaaacaacgggtactgctaaatctcacctgttcgacgggctggatgacgacgaaccctccttggctaacggggcattcatgccaaagaagtcaatcaagaaactcgtactgaagaatcttaacaattcgaatctgtttagcccagtgaatagagatagcgaaaatctggcatccccatcagaatacccagagaacggggagcggttttcattcctgtccaagcccgtcgatgagaatcaccagcaggacggcgacgaagactcgctggtgagtcatttctacacaaatcccattgctaagcccatccctcagacccctgagtctgccggaaataaacactccaatagcaattctgtcgacgatactatagttgccttgaatatgagagccgcgctacgcaatgggctggagggctcttcagaggagacatcatttcatgatgaatcgctgcaggacgacagggaggaaatagagaacaactcctatcacatgcaccctgccggcatcatactaactaaggtagggtactatactatccctagcatggacgatctggctaagatcacaaacgagaagggggagtgtatcgtcagcgattttactataggaaggaaagggtacggatctatttattttgagggtgatgttaatcttaccaacctgaatctggatgacatcgtgcacatacgccgcaaggaggtcgtggtatatctggacgacaatcagaagccaccagttggcgagggactcaatcgcaaagccgaagtgactttggacggggtgtggcctaccgataagacaagcaggtgcctgatcaagagcccagatagattagccgatatcaactatgaaggcaggctcgaagccgtttcaagaaaacaaggagctcagttcaaggaatacaggcccgagactggctcctgggtattcaaggtgagtcacttcagcaaatacggcctgcaggacagtgacgaggaggaggaagaacacccttctaaaactagcacgaagaaattgaaaacagcccccttgcctcccgcgtcccagaccacacctctccagatggcactcaatgggaagcccgcaccaccacctcagtcacaaagtccagaggttgagcagttagggagggtagtggaactggacagtgacatggtggacatcacacaggaaccagttctggatactatgctggaggagtctatgcccgaggaccaggagcctgtcagtgcctcgacccacatcgctagctcactgggaatcaacccccacgtgcttcagataatgaaagccagcctgctgactgatgaggaggacgtggatatggcattagatcagaggtttagtaggctgcccagtaaggcggacacttcacaggaaatatgcagcccacgcttacccatttctgcaagccactccagcaagactaggagcctcgttggcggactgttgcagtccaaattcacctcaggtgctttcctgtccccatcagtgtcagtgcaagaatgtcgcacacccagggccgcaagtctcatgaatatcccctctacatcgtcatggagcgtgccaccacctctaacttctgtcttcaccatgccttctccagctcccgaagttcctctgaaaacggttggtacccggagacagctgggtttggttcctagagaaaagtctgtaacgtatgggaagggaaagctgctgatggatatggctttgttcatgggccgctccttccgtgtaggatggggacccaattggaccttagccaatagtggggaacaactgaacgggagccatgagctggaaaaccaccagattgcagactccatggagtttgggttcttgcccaaccccgtggccgtgaagccactcactgagtcccctttcaaggtacatttagagaagctgagtctgaggcagcgcaaaccagatgaggacatgaagctgtatcagacacctctagaattgaaacttaagcatagtactgttcacgttgatgagctctgcccattgattgtgcccaatctgggagtggccgtcatccacgattatgccgattgggttaaagaggcatccggcgatctgcccgaggcccaaattgttaagcattggtcgttgacatggaccctttgcgaagctctgtggggtcatctgaaggagctcgattcacagcttaacgagccacgggaatacattcagatcctggaaagaaggcgagctttctcccgttggctgagttgtacagccactcctcagatcgaggaggaggtctctttgacccagaaaaactcacccgtggaagctgtgttttcctacctcacgggtaaaagaatcagcgaggcttgttctctcgcacagcaatctggagaccaccgactagcacttctgctgtctcagtttgtgggaagccaatctgtccgcgagctgctgaccatgcagctggtcgactggcatcagctccaagcagatagctttatccaagacgagcgcttgaggatcttcgctcttttggcaggcaagcctgtgtggcagctgtcagaaaagaagcaaatcaatgtctgtagtcagctcgattggaaacgatccctggcgatccacctctggtacttactccccccgacggcctcaattagtcgggctctgtccatgtatgaagaagcttttcagaatacctcagatagcgacagatatgcatgttctcctctacccagttatttggaaggatctgggtgcgttatcgcagaggagcaaaactcccagacaccgctccgggacgtttgctttcatctcctcaaactctattcagacagtataagggaaaaggccgtgcgcgagctcttgacacggcactgtcaactgctagagactcctgagtcctgggcaaaagagacgttcctgactcagaaactgcgagtaccggcaaagtggatccacgaagctaaggcagttcgcgctcacatggagtctgacaagcatctcgaggccctctgcttattcaaggccgaacactggaatagatgccacaagctcatcattaggcatctggcctccgatgcgatcataaacgagaactacgactacctgaagggctttctcgaggatttagctccccctgagaggtccagtctcattcaggattgggaaacatcaggactagtttatttggattatattcgggtcatagagatgttgagacacattcaacagatcgcactcttttgtgttgaatggattgcgcaagttatgacatggagctcttatacctcgaagtag

SEQ ID NO: 197968 - DNA, 2763 bp, Artificial Sequence
  Description of Artificial Sequence: Synthetic coding sequence
atgttcaacaagagcttcggcacccccttcggcggcggcaccggcggtttcggtaccacatcaacattcgggcagaataccggtttcgggacaaccagcgggggggctttcggtacatctgctttcggctcttcaaataataccggagggctgttcggcaactcccagacaaagcctggtggactattcggcacttccagtttctcccagcccgctacctctaccagtaccggttttggctttgggacctccacaggaactgccaacacactctttggaactgcaagcacaggtacatctcttttctccagtcagaataatgcatttgcccagaataagcccacgggttttggcaactttggcacatctacttctagcggcggcttattcggcaccaccaatactacttccaatccctttgggtcaacttctggctcactatttggtccctcatctttcacagctgctcctaccgggaccaccataaagtttaacccacctacggggacggatacaatggtcaaggccggggtgtctacaaatatttctaccaagcaccagtgcattaccgcaatgaaggaatacgagagcaaatccctggaagaactccgcctggaggactatcaggccaaccgcaaaggaccgcagaaccaagtgggggcggggactacgaccggactgttcggcagctcacccgccacgtcttccgccacaggcctattctcgagtagcactacaaacagtggatttgcatacgggcagaacaaaacagcctttggcactagcacaacgggttttggcactaaccctgggggcctgtttggacagcagaaccagcagacaacatccctgttttctaaaccattcgggcaggccaccactacccagaataccgggttctcattcgggaatacttcaaccataggccagccctccaccaatacaatgggactgtttggagtgacccaagcttcacagcctggcggcttattcggcaccgctacaaatacaagcacaggcaccgcttttggaactggaacgggcctgtttggacagacaaatactggctttggggcagtcgggagcaccctcttcggcaacaataagttaaccactttcggatcttctactacatccgccccatcttttggtactacgtcaggcggcctctttgggttcggcacaaacactagtggcaactctatctttggttctaagcctgccccgggcacactagggacaggcttgggcgccgggtttggcaccgctctgggcgctggtcaggcatcgttatttggtaataatcagcccaaaatcgggggccctctgggaaccggggcattcggtgcacccggctttaacacaacaactgcaacactcggatttggcgcacctcaggcaccggttgctctcactgacccaaatgccagtgccgctcagcaggccgtcctccagcagcatatcaattccctgacatatagtcctttcggggattcacccctgttccggaatcccatgagcgacccaaagaaaaaggaagagaggctgaagcctacgaatccagccgctcagaaggctctaaccacaccaacacattacaagttgacgccccggccggccacacgcgtgagacctaaagcccttcaaactaccggaaccgccaaatctcatctcttcgacggccttgatgacgatgagccttctttagcaaacggggcctttatgcccaaaaaatccatcaaaaagctggtgctgaagaatctgaacaattccaatttattttcacctgtgaaccgggattccgagaacctggcttcacccagtgaatacccagagaacggtgagcgtttttccttcttgagcaaacctgtggatgaaaatcatcaacaggatggcgacgaagacagcctcgtcagtcacttttatacaaatccgatcgccaaaccgattccacaaactccagagtctgccggaaataagcacagcaactcgaatagcgttgacgatactatagtggctctcaatatgagggcggctctcaggaatgggctcgagggctcctctgaagagacatcctttcacgatgaatccctacaggacgatagagaggagatcgaaaacaattcttaccacatgcacccagccggtattatcctaactaaggtagggtactacactattcccagcatggatgacctggctaagatcaccaacgaaaaaggagaatgcattgtttctgactttactattggaaggaaaggctacggttccatctactttgagggtgacgttaatttaaccaacttgaaccttgacgatattgttcatatcaggaggaaagaggtggttgtgtatttggatgataaccaaaagcccccagtgggagaaggcctgaacaggaaagctgaagtgaccttggacggagtgtggccaacagataagaccagtcgctgcctgatcaagagcccagacagattagcggatatcaattatgaaggccgcctggaagccgtgagtaggaagcagggggcgcagtttaaggaataccgaccagagactggatcttgggttttcaaagttagccatttcagcaagtacggcctgcaggattctgatgaagaagaggaagagcacccctcgaagacttccacgaaaaagctgaagaccgcccccttgccgcctgcatcccagactaccccactgcagatggccctgaatgggaaaccagcccctcccccccaggtcgagaaaaaaggacaatag

SEQ ID NO: 197969 - DNA, 2814 bp, Artificial Sequence
  Description of Artificial Sequence: Synthetic coding sequence
atgttcaacaagagcttcggcacccccttcggcggcggcaccggcggtttcggcactacgtccactttcggacagaatactggttttggcaccaccagtggcggcgcttttgggacatcagcatttggcagctctaataacaccggcggcctcttcggcaactcacaaacaaagccaggtggccttttcgggacttcatctttctctcagcctgccaccagcactagtacaggattcggcttcggcacatcaacaggcactgctaacaccctctttggcacggcttctacaggaacctcactgttctcctcgcaaaataacgccttcgctcagaacaaacctaccggattcgggaattttggtacctctacgtcatctggcggtttgtttggcaccacaaacacaaccagcaacccatttggctccacttcaggctcattgtttggaccctcaagtttcactgccgccccaaccggaactaccatcaagttcaacccaccaactggtactgacacaatggtcaaagccggggtgtccactaatatttctaccaagcatcaatgcatcaccgctatgaaagagtatgagtccaaatcactcgaagaattgcggctcgaggactaccaggccaacagaaagggcccccaaaaccaggtgggggccggcacgactaccggcctattcggaagcagccctgcaacaagtagtgcgacgggattgtttagcagctccaccacaaactccggctttgcatacggacagaacaagacggcgttcggcacctccaccaccgggtttgggaccaaccccggcggactttttggtcagcagaatcaacagacaacgagcctattttccaagcccttcggccaagctacgaccacccagaacacagggttttccttcggcaataccagcacaatcgggcagccatccacaaataccatgggcctgttcggcgtgacgcaggccagccaacccggtggccttttcggcaccgcgaccaacacatctactgggacggctttcggcaccgggaccggcctgtttggccaaacgaacactgggttcggagctgtcgggagtacgcttttcggaaacaataagctcaccactttcggatcttccaccacatcggctccctcattcggtacaacttcggggggactttttggcaataagcctaccttgacattagggaccaataccaatactagcaacttcggctttggcacaaatacgtctgggaatagcatctttggatctaaacctgctcctggaactctcgggaccgggctcggggcgggttttgggaccgcgctgggggctgggcaggcaagtctgttcggaaataatcagccaaaaatcggcggccctctaggcactggcgcattcggcgcacctggattcaacacgacaaccgccacactgggattcggggctccacaagcgccggttgctctcaccgatcctaacgcaagcgccgcccaacaggcagtgttgcagcagcacattaacagcctaacctatagtccatttggtgactcacctcttttcaggaatccgatgtctgatccgaagaagaaagaggagcgtcttaagcccacaaatcctgccgctcagaaggcactgaccactccgacccactataagctgactccccgccctgccacccgcgtgagaccaaaggccctgcaaaccaccgggaccgcgaagagccatctctttgacggcctggacgatgacgaaccttctctcgccaatggagcatttatgcccaaaaagtccatcaagaagctggtcctcaaaaatctgaacaacagcaaccttttctctcccgtcaaccgagattctgagaacctggctagtcctagcgaataccccgagaacggcgagcgctttagctttctgtccaagcctgtggatgaaaatcaccagcaggatggagacgaagattcccttgtcagccatttttacactaacccgattgcgaaacccatcccccaaaccccagaatccgccggcaataaacattcgaattccaactccgtggatgataccattgttgcactgaatatgcgggctgcactacggaacggattggaaggttccagcgaggagacctccttccacgatgagagcttgcaggatgaccgggaagaaatcgagaacaactcataccacatgcatcccgcaggcatcattttgaccaaggtgggttattatactattccctccatggacgacctggctaagattactaacgaaaaaggtgaatgcatagtttctgacttcacaatcggcagaaagggatatggatctatttacttcgaaggggacgtcaatctgaccaatttgaatctagacgacatcgtccatatccggcgcaaagaagttgtggtatacctcgacgataatcagaaaccgccagtcggagagggcttaaacagaaaagcagaggttaccctggatggagtgtggcccaccgacaagacatcgagatgcctgataaagagccctgaccggctggctgacattaattacgagggacggcttgaagctgtcagtaggaaacaaggagcccagttcaaggagtaccgccctgagactggtagttgggtcttcaaagtcagccatttctctaagtatggtctgcaggactcagacgaagaggaagaggaacatcctagcaagacttcaacgaagaagctgaagacagcacctctgccaccagcctctcaaacgactccactgcagatggctctgaacggaaagcccgcgcctccaccgcaggtcgagaagaaaggacagtag

SEQ ID NO: 197970 - DNA, 1731 bp, Artificial Sequence
  Description of Artificial Sequence: Synthetic coding sequence
atgagcaccggcttcagcttcggcaccggcgccagcagcaaccccagtgtaggcctcaacttcggcaaccttggaagtacaagtacccctgccacgactagcgctccctcttctggcttcggcactggactgttcggctctaaacccgctacaggctttacactgggcggaaccaacacaggcatcgctacaacaataacgaccggccttacactgggcaccccagccacgacaagtgccgccacgaccgggttctccctgggctttaacaagccggcggcatctgccacccccttcgccctgccgattacctcaacttccgcctccggccttactttgtcctctgcattgactagcacaccagctgctagcacaggcttcacccttaacaaccttggagggaccacagcaaccacaactaccgctagtacaggactctccctgggtggggctctggccgggctgggcggcagtctattccagagcaccaataccggtaccagcggactaggacaaaacgccctgggccttacgctcggcactaccgcagcaacgtccactgcaggtaacgagggtctcggggggattgacttcagtagctcaagtgataagaagtcagataaaacaggcacccggcctgaagattcaaaggccctgaaggacgaaaatcttccccccgttatctgccaagatgtggagaatctccagaaattcgtcaaagaacagaagcaggtgcaagaggaaatatcacggatgtccagcaaggcgatgctcaaggtgcaagaggacataaaagctctcaaacaattacttagtctcgctgcgaatgggattcagcgcaacaccctgaacattgacaagctgaagatagagactgcccaagaactgaagaatgccgaaatcgctttgagaacacagaaaaccccccctgggttgcagcacgagtacgctgcacctgctgactattttagaatcctggtgcagcagttcgaagtgcagctacagcagtaccggcagcaaatcgaggaactcgaaaaccatctggctacgcaggcgaacaattcgcacattacaccgcaggacctgtcaatggccatgcagaaaatctaccagacgttcgtcgcgctggccgcccagctgcaatcaatccatgaaaacgttaaagtgctgaaagaacagtacctggggtatcgcaagatgtttctgggcgacgcagtcgacgtgtttgagacccggagggctgaggccaagaagtggcaaaatacccctcgggttacaaccggaccaacaccgtttagcacgatgccgaatgcagcagccgtcgctatggccgcaacattgactcaacagcagcagcccgcgaccgggccacagccgagtttgggcgtttcctttggaacaccctttggttcggggatagggacaggcctgcagtcatctggtttaggtagttctaatcttggcggcttcgggacctcctcaggtttcggatgctctaccacaggtgccagtacattcggcttcggtaccacgaacaaaccttccggatctctctcagcaggcttcggttcttctagtacatctggcttcaatttttcaaatcctggcatcactgccagcgcgggcttgaccttcggcgtttcgaatccagcatccgctgggttcggaactgggggccaactgttgcagttaaaaaagccccctgcagggaataagcggggcaaacggtag

SEQ ID NO: 197971 - DNA, 1764 bp, Artificial Sequence
  Description of Artificial Sequence: Synthetic coding sequence
atgagcaccggcttcagcttcggcagcggcaccctgggcagcaccactgtggctgctggtgggacaagtaccggcggtgtctttagcttcggtacaggtgctagctctaacccttcagtcgggttgaattttggaaatctaggatccaccagtaccccagccactacttcagcaccttcgagtgggtttggcactggactgtttggatctaagcccgcgacagggtttacattgggcggaacaaacaccgggactcccgccacaaccagcgccgctacaaccggattcagcctcgggtttaacaagcccgcagcctcagccaccccttttgccctgccaattacaagtacctccgcctccggcctgacgctttcctcagcattgactagtacccctgctgcgtctactggatttacgttgaataacctgggggggacaacagcaaccactacgacagcatccaccggcctgtcgctgggtggagccttggccggactgggaggcagtctgtttcagtcaaccaatacggggacttcagggctcggacagaatgcactgggactcaccttggggaccaccgcagcgacgtccaccgcgggcaatgagggactcggggggatagacttcagctccagcagcgacaaaaagagtgacaagacggggacacgacctgaggactcaaaggccctgaaagacgagaacctgccccccgtcatatgccaagacgtagaaaacctgcagaaattcgtgaaggagcagaaacaagtgcaggaagaaatcagtcgcatgtcctctaaagccatgttaaaggtccaggaggatattaaagctctgaaacagctgctgtcactagcagcaaatggaatccagcgtaacacgctgaacatcgataagttgaagatcgaaactgcccaggagctgaagaatgccgagatcgcactgcgaactcaaaaaaccccacctggtctccagcacgaatatgctgcaccagctgattactttcgcattcttgtgcaacagttcgaggttcaattgcagcagtaccggcagcagatagaggagctggagaatcatctggccacccaggctaataacagccacatcacgccccaggacctctctatggccatgcagaagatctaccaaacttttgtcgctttggcggcacagctgcagtcgattcacgagaacgtcaaagtgctcaaagagcagtatctggggtatagaaagatgtttctcggcgacgcagtggacgtcttcgaaacaaggagggccgaagctaagaaatggcagaatactccacgggtcacgaccgggcccacgcccttctccacaatgcctaatgccgcagccgtcgcaatggccgctaccctcactcagcaacagcagccagcaacgggcccgcaaccatccctcggcgtctctttcgggacccccttcgggagcggcatcggcaccggcctgcagagtagtggactgggaagctcaaatctgggaggctttgggaccagctccggattcggttgtagcaccaccggagcatcaaccttcgggtttggaacaacgaataaaccttcgggttctctgtcagccgggtttgggagctcgtctaccagcggatttaatttttccaaccccggaattactgcaagcgctggtttgacattcggcgtgagtaacccggcatctgcgggatttggcacgggaggtcagttacttcaacttaaaaagccgcctgccggcaacaaaagggggaagcgctag

SEQ ID NO: 197972 - DNA, 1800 bp, Artificial Sequence
  Description of Artificial Sequence: Synthetic coding sequence
atgagcaccggcttcagcttcggcagcggcaccctgggcagcaccactgtcgctgctggcggaacatctacaggcggggttttttccttcgggacaggggccagcagtaacccatcggtgggtctcaactttgggaacttaggctcaacctcgactccggcgaccacttcagctccttctagcgggtttggtactggcctgtttggatcgaaaccggcaactggctttacccttggcggtacaaacaccggaatcgcaacaacgattacaacaggcttgacattgggaacgccggcgacgacttcagccgctaccactggcttttctctggggtttaataaacctgctgcttccgccactcccttcgcactgcccattacaagcacgtccgcctcaggactgacactgtctagcgctctgacttccacccctgcagcttcaactggcttcacccttaacaatctcggtggcaccaccgccacaactaccacagccagcaccggcctaagcctggggggtgctctggccgggctcgggggatcactattccagagcaccaatactggtacttcaggattaggacagaacgctctcggactgacccttggcactaccgcagcgacatccacagcgggcaatgaagggctggggggaatcgacttctccagtagctccgacaagaaaagtgataagaccggcacccgccccgaggatagcaaggccctgaaggacgagaacttgccaccagtgatctgtcaagatgtggagaacctccaaaagttcgtcaaagaacagaagcaggttcaagaagagatttctcgcatgtcatctaaagccatgctcaaagtacaggaggatattaaggcactgaaacagctgttaagtctggcagccaacggcatccagaggaacacccttaatatagacaagctcaaaattgagacagctcaggagctgaaaaacgcggaaatcgcgctcagaacccagaaaacccctcctggacttcagcatgagtatgctgcaccagccgactacttccggatcctggtgcagcagttcgaagtccagctccaacagtaccgccagcagattgaagagctcgagaaccacctagccacgcaagccaataattcgcatattacgccccaagacctcagcatggccatgcagaagatctaccagactttcgtagccctggccgcccagctccagtctatccatgagaatgtgaaagtactgaaggagcaatacctgggttatcgcaagatgttcctcggggatgccgtagatgtctttgaaacacgaagggccgaagctaaaaagtggcagaatactcctcgggtgaccaccggccccaccccattctctacgatgccaaatgcagccgccgtagccatggcagccaccttgacccagcagcagcagccggccacggggccccagccgagcctgggggtgagtttcggcaccccttttgggtcaggaattggaaccgggctgcagtccagcggcttaggctctagcaacctaggtgggtttggaacgtcgtccggctttggatgtagtacaacgggagcttctaccttcgggttcggtactaccaataaaccctcaggctcactaagtgccggatttggatctagttccactagcggatttaacttctcaaatccagggattacagcatcagctggacttacgtttggcgtctcaaatcccgcatccgccggattcggaacaggcgggcagctgctgcagttgaagaaacccccagccggaaacaaacggggaaagaggtag

SEQ ID NO: 197973 - DNA, 1515 bp, Artificial Sequence
  Description of Artificial Sequence: Synthetic coding sequence
atgagcaccggcttcagcttcggcagcggcaccctgggcagcaccactgtcgctgcagggggcacctcaacagggggggtgttttcattcggtacaggggccagcagtaatccctcagtagggctcaacttcggaaatctgggctctacatcaacccccgcaactacttctgcccccagctctgggttcggcacgggcttgttcggctccaaacctgctaccggcttcacactcggggggacaaacaccgggactccagccaccaccagtgctgccaccactggattttcacttgggtttaataagccagcagcaagcgctacaccttttgccttacccattacatctaccagtgcaagtgggctgacgctctcctccgcgcttacctcaacgccggccgcgtctactgggtttaccttaaataacctgggaggcaccaccgctaccacaacaacagcctctaccggtttgtccctgggtggagctctggcgggcctcggtggcagtctgtttcagtccaccaatactgggacttctggcttgggacaaaacgcccttgggttgacactaggcaccaccgctgctacatcgaccgcagggaacgaaggcttaggagggattgatttcagcagtagttccgacaagaagagcgataaaaccggaacccgacccgaagattccaaagccctgaaggacgagaacctgccacccgtcatttgccaggacgttgagaacctgcaaaaatttgtgaaagaacagaagcaggtgcaagaggagatctcccgcatgtccagcaaggcaatgcttaaggtgcaggaggacatcaaggctcttaagcagctgctcagccttgctgcaaatgggatccagaggaatactctgaacatcgacaaattgaaaatcgagaccgcccaggaattgaagaacgctgagatcgcactccggacccagaagactccgcccggcctccagcatgaatacgctgctcccgccgattactttcgcattctggttcagcagttcgaggtacaactccagcagtacagacagcaaatagaggagttggagaatcacctggccacccaggctaacaactcacatataacccctcaggatttatcaatggctatgcaaaagatttatcagaccttcgtcgcactggccgctcaattgcaatctatccacgagaatgtaaaggtacttaaggaacagtatctcggatacaggaaaatgttccttggggatgcggtcgatgtgtttgagactcgcagagctgaggccaagaagtggcaaaacactccaagagtgacaacagggcccacaccctttagtactatgcctaatgccgccgccgtggcaatggcagcgaccctgacccagcagcagcagcccgccactggagataaatggtgcaatgtggctgaacttaagaacaggactcagctgtctttgttcgtcaacaagcttgagttgtcatgctattgcgtcattgatctgctgtacaatgaacaatag

SEQ ID NO: 197974 - DNA, 1458 bp, Artificial Sequence
  Description of Artificial Sequence: Synthetic coding sequence
atgagcaccggcttcagcttcggcagcggcaccctgggcagcaccacagtagctgccggtggtacatcgacaggcggagtgttcagctttggcaccggggcctcctcaaacccctcggtgggtctcaatttcggaaacttggggtctacttctaccccagcgaccacatccgccccgtccagcggctttggcaccggtctgtttgggtccaaaccggcaaccgggttcaccctgggcggtacaaatactggcatcgcgaccacaatcaccacaggactgacgctgggcacccctgctactacctccgctgccactacaggattttctctgggatttaacaaacctgctgctagtgcgacgccatttgccttacccatcacatccaccagtgcttctggactgacattgtcatcggcactgaccagcactcctgcagcgagcacaggcttcacactgaataacctggggggcactacagccactactaccaccgcctctacagggttgtctttgggcggcgcgctcgccggtcttgggggcagcctgtttcagtcaaccaacacaggtacttctggtctggggcaaaatgccctcgggctgaccctcgggaccacagcggccacctctactgccggtaatgagggtctcggaggaatcgattttagttcaagcagtgataagaaatccgataagaccgggacccggccagaggattctaaagccctgaaagacgaaaatctgccgcccgtgatttgccaggacgttgagaacctccagaaattcgtaaaggaacagaagcaggtacaggaggaaatcagccggatgagttccaaggccatgctgaaggttcaggaagacatcaaagccctcaaacagttgctctcactggcggccaatggcattcagcgcaatactctgaacatcgacaagctgaagatcgagacggcacaggagttgaagaacgcagagattgcactcaggacccagaagacccctccggggctgcagcacgagtacgcagcccccgccgactactttcgcatcttagttcaacagttcgaagtgcagcttcagcaatatcgccagcaaatagaggaactcgagaaccatctggcgactcaggccaataattctcacatcacaccccaggatctgagcatggcgatgcaaaagatttaccaaacctttgtggctctagccgcccagctccaaagcattcacgagaatgtcaaagtgctgaaagagcagtatctgggatatagaaagatgttcttgggcgacgctgtggatgtctttgagacgagaagagctgaggccaaaaaatggcagaatacccctagggtgacaaccggccctacgcctttcagtaccatgcctaacgctgcggccgtggcaatggcagctacattgacccagcagcagcagccagccaccgggctgaacgcattcaagctgtag

SEQ ID NO: 197975 - DNA, 1308 bp, Artificial Sequence
  Description of Artificial Sequence: Synthetic coding sequence
atgagcggcttcctggaggagctgctgggcgagaagctggtgaccggaggcggcgaggaagtggacgtgcactctctcggggctcgggggatttcccttctcggcctgtactttgggtgttcactgtcagcaccatgtgcccaactgagtgcctcgttggcagcattctatggacgcctgcggggggatgccgcagcaggtccaggacctggagctggcgcaggtgctgccgcagagccggaacctagacgcaggctggaaatcgtgtttgtgagtagtgaccaagatcaacggcagtggcaggactttgtgcgggacatgccttggctggctctgccttataaggagaaacacagaaagctgaagctgtggaacaaatacagaatctctaacatcccaagcttgatcttccttgatgccacaactggtaaggtggtctgtcggaacggtctgctggtcataagggacgaccccgaagggctggagttcccgtggggaccgaagcccttccgcgaagtcatcgccgggcccctcctacgaaataatggccagtcgctggaaagttcaagtctagagggatctcatgtcggagtatatttctcggctcactggtgtcctccttgtcgatccctgacacgggtactggtggagtcctaccggaaaattaaagaagcaggccagaacttcgaaattatcttcgtgagtgcagataggagcgaagagtcctttaagcagtatttctcagaaatgccatggctggccgtaccatataccgatgaggcccggcgaagccggcttaatcggctgtacgggatacaaggaattcctaccttgattatgctcgaccctcaaggcgaagtgattactaggcaggggagggtggaggtgctgaacgatgaggactgtagagaatttccttggcacccaaagccagtgctggaactgagcgattctaacgccgcacagctgaacgaagggccatgtctcgtcctgttcgttgactctgaagatgatggcgagtcagaagccgctaaacaattaatccagcccattgccgagaagattatcgctaagtacaaggccaaagaggaggaggcaccactattattctttgttgccggtgaagacgatatgacggactccctccgagactataccaatctgcctgaggccgcaccactgctgaccattctagatatgtccgcccgtgctaagtacgtgatggatgtcgaggagattactccagctattgtagaggcctttgtcaatgattttctggccgagaaattaaagcctgagcctatttag

SEQ ID NO: 197976 - DNA, 984 bp, Artificial Sequence
  Description of Artificial Sequence: Synthetic coding sequence
atggccgacgtgagcctgcaccggaaccccgccaccctgaagctgtggaataaataccgaattagcaatatccccagcctcattttcctggacgctacaacagggaaggtggtctgcaggaacgggctgcttgtgatccgggatgaccctgagggcttagagtttccttggggccctaagccttttcgcgaagtgatagcagggccgcttcttaggaacaatggccaaagtctggaaagcagcagcttagaaggatctcacgtgggagtttacttcagcgcacattggtgccctccctgccgaagtcttactcgagtgttggtagagtcttatcgaaaaataaaagaagcaggtcagaacttcgaaattatcttcgtgtccgcggaccgctctgaggaaagcttcaaacagtacttctctgagatgccctggcttgctgtgccatacacagacgaggccaggcgaagcaggctgaatagactgtatggtattcaggggatccccacactcataatgctggatccccaaggagaagtgatcactcgtcaggggagggtggaagtcctgaatgatgaagactgcagggaatttccctggcaccctaagcccgtcctcgaattgtccgatagcaacgctgcccagctgaacgagggaccttgcttagtcctcttcgtggatagtgaggatgatggcgaaagtgaggcggcaaagcagcttatccagcctatcgcggagaaaataatcgctaagtacaaagccaaggaggaggaagcaccgctgttgttttttgtggcaggcgaggacgacatgacggattccctgagagactacactaatctccccgaggccgctcccctcttaacgatcctggatatgagcgcccgggcaaaatacgtgatggacgttgaggaaatcacccccgctatcgtcgaggccttcgtcaacgacttcctcgccgaaaaactcaaacctgaacccatctag

SEQ ID NO: 197977 - DNA, 381 bp, Artificial Sequence
  Description of Artificial Sequence: Synthetic coding sequence
atgccctggctggccgtgccctacaccgacgaggcccggcggagccgcctcaaccggttatacggcatccaagatagtgaggacgatggtgaatccgaagcagcaaaacagctcatacagccaatcgccgaaaagattattgccaaatacaaggctaaggaagaagaggcccccctcctgttttttgtggccggcgaagatgatatgacagattctctgcgcgattacaccaatctccccgaagcagcaccactcctcacaatccttgatatgtccgctcgagccaagtacgtgatggatgttgaagagataacacccgccatagtggaggcctttgtcaatgacttcctcgctgagaaactgaagcccgaaccgatctag

SEQ ID NO: 197978 - DNA, 984 bp, Artificial Sequence
  Description of Artificial Sequence: Synthetic coding sequence
atggccgacgtgagcctgcaccggaaccccgccaccctgaagctgtggaacaagtaccgtatttctaatatacccagtctcatcttcctggacgctactacaggaaaggttgtttgtagaaatggcctgttggtgatcagagacgacccagagggcctggagtttccctggggtcccaagcccttccgcgaagtcatcgccggcccccttctccgtaataacggccagtcgttggaatcaagttcactggaggggtcccacgtcggagtgtatttttcagctcattggtgccccccatgccggagcttgacgcgtgtgcttgttgagtcgtaccgaaagattaaagaggccggacagaattttgagataatctttgtttctgccgaccgcagcgaagaatctttcaagcaatatttttccgaaatgccatggctggccgtgccctacacggatgaagctaggcgatcacggcttaatcgcttgtacggaatccaaggcatacccacactgatcatgctggatccgcagggcgaggtgattactcggcaggggcgcgtggaagttctgaatgacgaagactgtcgggagttcccatggcacccgaagccggtgttagagctctccgacagtaatgcggcacagcttaatgaaggaccatgtctggtgctgtttgttgattcagaggatgatggggagtccgaggctgctaaacagctgattcaacccatcgccgagaagattatagccaaatacaaggccaaagaggaggaggctcccctcctgttctttgtggcaggggaggacgatatgacagatagcctacgggattatactaacctgcctgaggcggcaccccttctgacaatacttgacatgagtgccagagcgaaatatgtaatggatgtcgaagaaatcactcctgcaatagtggaggcttttgtgaatgatttccttgccgagaagctgaagcccgagccaatctag

SEQ ID NO: 197979 - DNA, 1176 bp, Artificial Sequence
  Description of Artificial Sequence: Synthetic coding sequence
atggccgacatcgacaacaaggagcagagcgagctggaccaggaccttgacgacgtggaggaggttgaggaggaggagacgggagaagaaaccaaattaaaagctcgtcagcttacagtgcaaatgatgcaaaacccccaaattctagccgccctgcaggaaagattagatggtctggtcgagactccaaccggctacatcgaatccctacccagggtcgtgaaacggagggttaacgccctgaagaatctccaggtgaaatgcgctcagattgaggccaagttctatgaagaggtacacgatctggagagaaagtatgcagttctttatcagccattattcgataagagatttgagatcattaatgcaatttatgagcccactgaagaagagtgtgaatggaagccagacgaagaggatgagatctctgaggagttgaaagagaaggcgaagattgaggacgaaaaaaaagatgaggagaaggaagacccaaaaggaatacccgagttttggctgacggtattcaaaaacgtggacttactgtctgatatggtgcaagaacatgatgagcccattttaaaacatctcaaggacatcaaggtcaaattttccgacgccggtcagccaatgtcgtttgtgcttgagtttcacttcgaaccaaatgagtatttcacaaacgaggttctaaccaaaacttacaggatgcgatccgaaccagacgactccgaccccttctcttttgatggtccagaaattatgggatgcactggatgccagatagattggaagaagggtaagaacgtgacgttgaagacgattaagaaaaaacaaaaacacaagggccggggcacagtgcgcaccgtcaccaagaccgtgtccaacgacagcttctttaacttctttgccccccccgaggtgccagagagtggcgacttggacgacgacgcggaagctatcttggctgccgacttcgagatcggacactttttgcgtgagcgaatcatcccccggtctgtcctgtactttactggggaggccattgaggacgatgatgatgattatgacgaggaaggagaggaggctgacgaagagggggaagaggagggggacgaagaaaacgatccggattatgatcccaaaaaggatcagaatcccgccgaatgtaaacaacagtag

SEQ ID NO: 197980 - DNA, 1176 bp, Artificial Sequence
  Description of Artificial Sequence: Synthetic coding sequence
atggccgacatcgacaacaaggagcagagcgagctggaccaggacctggatgatgttgaggaagtggaggaagaggagactggcgaggaaacaaaactgaaggcccgccaactcacagtgcagatgatgcaaaatccacagattctggccgctctgcaggagcggttagacgggctcgtagagacacctacaggatacattgagtctctgcctagggtggtgaagagaagggttaacgcgttaaaaaacttgcaagtaaagtgcgcccaaattgaagccaaattttacgaagaggtgcatgaccttgaacggaagtacgcagtgctgtaccagcccctgtttgataaacgctttgagattatcaatgctatctacgagcccaccgaggaggagtgtgagtggaaacctgatgaggaagacgagatttccgaagagcttaaagaaaaagccaaaatagaagacgagaagaaagacgaagagaaggaggaccccaaaggcatacctgagttttggttgaccgtctttaaaaatgtcgacttactgagtgacatggtacaggaacatgatgaacccatactgaagcacctgaaggatataaaggttaagttttcagacgccggacagcccatgtcattcgtgcttgagttccacttcgagcctaacgaatatttcacaaacgaggtcctgaccaagacgtaccgtatgcggtccgagccggacgacagcgacccctttagcttcgatggtcctgagatcatggggtgtaccgggtgtcagatcgattggaagaagggtaaaaacgtgacattgaagacgattaagaagaagcaaaagcacaagggcagaggtacagtaagaaccgtgacaaaaactgtgtctaatgacagcttctttaacttcttcgcaccgcctgaagtccctgaaagcggagacctggacgatgacgctgaagcaatactcgctgccgattttgagataggccatttcttgcgtgaaaggatcataccccgtagtgtgctgtatttcaccggcgaggcaatagaagatgatgatgacgactatgatgaggagggggaggaagcagatgaagaaggagaagaggaaggggacgaggagaacgacccagattatgacccaaagaaggaccagaatcctgctgagtgtaagcagcagtag

SEQ ID NO: 197981 - DNA, 972 bp, Artificial Sequence
  Description of Artificial Sequence: Synthetic coding sequence
atgatgcagaacccccagatcctggccgccctgcaggagcggctggacggtttggtcgagacacccacgggctatattgaatctctgccccgagtggtcaagagacgggtgaacgcactaaaaaacttacaagtgaaatgtgcacaaattgaagccaagttctatgaggaagttcatgacttggagagaaagtacgctgtgctgtatcagcctctgttcgacaaggaagagttgaaagagaaggccaaaatcgaagatgagaagaaggacgaggagaaggaagaccctaagggcattcctgagttctggctcactgtgttcaagaatgtagacttactgagcgacatggttcaggagcacgacgagcctattctcaagcatctgaaggatattaaagttaagttcagcgatgctggacagccaatgtcctttgttctcgagttccattttgaacctaatgaatactttacaaatgaagtcctgaccaaaacttatagaatgagatcagaacccgatgattctgaccctttctctttcgacggtccagagataatgggctgcactgggtgtcaaattgactggaagaaggggaagaacgtcacattgaagaccatcaagaagaagcagaaacacaagggaagaggcaccgtgaggaccgttacgaagacagtttccaacgatagtttttttaacttctttgcgcctccagaggtgccagagagcggagatctggatgacgatgccgaggccatactggcagccgactttgaaatcgggcattttctgagggaaaggattatccctcggtccgtgctttacttcaccggtgaagcaatcgaggatgatgacgatgactatgatgaggagggtgaagaagccgacgaagaaggggaggaggagggggacgaggagaacgaccctgactatgacccaaaaaaagatcagaaccccgcggagtgtaaacagcagtag

SEQ ID NO: 197982 - DNA, 1050 bp, Artificial Sequence
  Description of Artificial Sequence: Synthetic coding sequence
atgatgcagaacccccagatcctggccgccctgcaggagcggctggacggactggttgaaacgcccacaggctacatagaaagtttacccagagtggtcaagcggagggtaaatgccctcaaaaacctacaggtgaagtgtgcacagatcgaggccaagttttacgaagaagttcacgatctggagcgcaagtatgccgtcctctaccagcccctgttcgacaagagatttgaaatcatcaacgcaatatacgagccgaccgaagaggagtgcgagtggaaacctgacgaagaagacgaaatcagtgaactgaaagaaaaggcaaagatcgaggacgagaagaaggatgaggagaaggaagatccgaagggcattccagagttttggctgactgtgtttaaaaacgtcgatctgttaagcgatatggtgcaggagcatgacgagcctatccttaagcatcttaaagatatcaaagtgaaattttccgacgcaggacagccaatgtcctttgtcctcgaatttcatttcgagccaaatgagtattttaccaatgaggtcttaactaagacatacaggatgaggtccgaacccgacgatagcgacccttttagtttcgatggccccgaaatcatgggctgcacaggttgccagatcgattggaaaaaaggcaagaatgtcacattaaaaaccatcaagaagaagcagaaacacaagggccgcgggaccgttaggactgttacgaaaaccgtgtccaacgattcattttttaatttctttgccccaccagaagtacccgaatctggcgatctcgatgatgacgccgaggctatattggccgctgatttcgaaataggccactttctgcgggaacgcatcatcccaaggtccgtgctctactttactggggaagccattgaggacgacgacgatgattatgacgaggagggggaggaagccgatgaagaaggtgaagaggaaggcgatgaggaaaacgatcccgattacgaccctaagaaagaccaaaatccagccgagtgtaaacagcagtag

SEQ ID NO: 197983 - DNA, 627 bp, Artificial Sequence
  Description of Artificial Sequence: Synthetic coding sequence
atggtgcaggagcacgacgagcccatcctgaagcacctgaaggacatcaaggtcaaattctctgatgccggacagcctatgtcgttcgtactggagttccacttcgagccaaacgagtactttaccaacgaagtgctgactaaaacctaccgcatgagaagcgagcctgatgattcagatccgttttctttcgacggccctgagataatggggtgtacaggctgccagattgactggaaaaagggtaagaacgttacactaaagacgatcaagaagaaacagaagcacaagggccgggggactgtcaggaccgttaccaaaaccgtctcaaatgattctttcttcaacttcttcgcaccccctgaggttcccgagtccggagacctggacgacgatgccgaagccatccttgctgccgacttcgaaattggccacttcctgcgcgaacggattattccaaggagtgttctctacttcacgggcgaagctatagaggatgacgacgacgattatgatgaagagggcgaggaagccgacgaggagggggaggaagagggtgacgaggagaatgacccagactacgaccccaaaaaggatcagaacccggcggagtgtaagcaacaatag

SEQ ID NO: 197984 - DNA, 987 bp, Artificial Sequence
  Description of Artificial Sequence: Synthetic coding sequence
atggccgacatcgacaacctgccccgggtggtgaagcggcgggtgaacgcactgaagaatctgcaggttaagtgtgcacagatagaagccaagttctacgaggaagtgcatgatctggagcgcaagtacgcagtcctgtaccagcccctattcgacaagagatttgaaattattaacgcaatctatgaaccgactgaagaggagtgcgaatggaaacccgacgaagaagacgagatctcggaggaactaaaggaaaaggcgaagattgaggacgagaaaaaggacgaggaaaaagaggatccgaaaggaattccggagttttggctaaccgtgttcaagaacgtggacttattgtccgatatggtacaagaacacgatgagcctatattgaagcatctgaaggatatcaaggtcaaattctccgatgccggacagcctatgtcctttgtgcttgaatttcacttcgagccgaacgagtatttcacaaatgaggtgctgaccaaaacctaccgcatgcggagtgagcccgatgactctgatccattctcttttgacggtcccgagatcatgggctgtaccgggtgccagatagactggaagaaggggaaaaacgtgactctcaagactatcaaaaaaaaacagaaacacaaggggcggggtaccgtcagaactgtgaccaaaacagtgtccaacgattctttctttaacttttttgccccacccgaggtgccggagtccggagacctggatgacgacgccgaggccatcctggcagccgattttgaaattggtcattttttgcgagaacgcatcattcccaggtcagtgctctattttaccggagaggccatagaagacgatgacgatgattacgatgaggagggagaggaggctgacgaagagggtgaggaagagggggacgaggaaaacgatccggactatgacccaaaaaaggaccaaaatccagctgagtgcaaacaacaatag

SEQ ID NO: 197985 - DNA, 1107 bp, Artificial Sequence
  Description of Artificial Sequence: Synthetic coding sequence
atggccgacatcgacaacaaggagcagagcgagctggaccaggacttagacgacgtggaggaagttgaggaggaggagactggagaggagactaaactgaaggcccgccagctgactgtccagatgatgcagaatccccagatactggcggcgttgcaggaacggctcgacgggttagtagaaacaccaacaggctatatcgagtccctgccaagagtcgtcaagcggagagtcaatgccctgaaaaatctccaggtgaagtgtgcccagatcgaggccaaattctacgaggaggtgcacgacctcgaacggaagtacgccgttctgtatcaacccctctttgacaaacgttttgaaatcatcaacgccatctatgaacccacggaagaggagtgtgagtggaaacctgacgaggaagacgaaatttctgaagagttaaaggagaaggcaaaaatagaagatgaaaaaaaggatgaagagaaggaagacccaaaaggtatcccagaattttggttgacagtctttaagaacgtcgatttgttaagcgatatggtgcaagagcatgacgagcctatcctgaagcatctgaaagacattaaggtcaaattctcagacgctgggcaaccaatgagcttcgtgctggagttccactttgaacccaatgagtattttaccaacgaggtgttaaccaagacatacaggatgcgaagcgaacccgacgattccgacccgttcagcttcgacgggcccgagataatgggatgcacggggtgtcagatagactggaaaaaagggaaaaatgtaaccttgaagaccatcaaaaaaaagcagaagcacaagggtaggggtactgtcaggacagtaacgaagaccgtgagcaacgattcatttttcaactttttcgctcctccagaagttccagagtctggcgatctagatgacgacgctgaggcaatcctcgcagcagactttgaaattggccacttcttgcgcgaacggataattccccgatctgtcctgtatttcacaggcgaggcaattgaagacgacgacgatgactatgacgaggagggcgaagaggccgatgaagttatgttcaccaagtag

SEQ ID NO: 197986 - DNA, 795 bp, Artificial Sequence
  Description of Artificial Sequence: Synthetic coding sequence
atggccgacatcgacaacaaggagcagagcgagctggaccaggacttagatgatgtcgaggaagttgaagaagaggagacgggagaggaaaccaagctgaaagccagacagctgaccgtccagatgatgcagaaccctcagatcctcgccgccctgcaggaacggttggatggtctcgtggaaactccaacaggctatatagaaagtttaccacgggttgtaaaaaggagagtgaatgccctgaaaaatctgcaggtgaaatgcgcgcagattgaggctaagttctacgaagaagtgcatgacctggagcgaaagtacgctgtgctatatcagcctctgtttgacaaacgcttcgagatcataaatgccatttacgaacctaccgaggaggaatgcgagtggaagcctgacgaagaagacgagatctctgaagaactgaaggagaaagccaagatcgaggacgaaaaaaaggacgaggaaaaggaggacccgaaaggcatccctgagttctggttgacagtcttcaagaatgtcgacttgctctccgatatggtgcaagaacacgacgagcctattttaaagcacctgaaagatattaaggtgaaattctcagatgccggacagccaatgagctttgtgctcgagttccacttcgaacccaatgaatactttaccaacgaggttctgaccaagacctaccgtatgaggtccgagccagatgatagtgatccgtttagctttgacggacccgaaattatggggtgtacaggatgccagattgactggaaaaagtag

SEQ ID NO: 197987 - DNA, 1158 bp, Artificial Sequence
  Description of Artificial Sequence: Synthetic coding sequence
aaggagcagagcgagctggaccaggacctggacgacgtggaggaggtggaggaagaggagacaggagaagagacaaaactgaaggcccgccagctcactgtgcagatgatgcaaaatcctcaaatccttgctgcgctgcaggaacgcctggacggtttggtggaaacacctacaggatacattgagagtctgcccagagtagtaaaaaggagggtaaatgccctgaagaacctgcaggtcaaatgcgcccaaatcgaagcaaagttctatgaggaggtccatgacctggagcgtaagtatgcggttctgtatcaacccctctttgacaagcggttcgagatcattaacgccatttatgagcccaccgaggaggaatgtgaatggaagcctgatgaggaagacgaaatttctgaggaacttaaagagaaggcaaaaatagaagacgagaaaaaagacgaagagaaggaggatcccaagggaattcctgaattttggttgacggtgttcaagaacgtggatctcctaagtgatatggtgcaggagcatgatgagccaatattgaagcacctgaaggacatcaaggtcaagttctcagatgccggccagcccatgtcgtttgttctggagttccactttgagcctaacgaatacttcacaaacgaagttttaaccaaaacatatcgaatgcgatcggaacccgatgacagcgacccgttttccttcgacggacctgaaattatgggatgtaccggctgccaaattgattggaagaagggtaagaatgtgactttaaaaacgatcaagaaaaagcagaagcataaaggcagggggaccgtaaggaccgtcactaagacagtctccaacgactctttctttaactttttcgccccccctgaagtgccggagtcaggtgatttggatgacgacgctgaagctatcctcgccgctgactttgaaattgggcatttcctgcgggagagaattatcccccggtctgttctgtactttactggggaagccattgaggatgacgacgacgactatgacgaggaaggggaagaggccgacgaagagggagaggaagagggagatgaggagaacgatcccgactacgatcccaaaaaagatcagaatccagcggaatgtaagcagcaatag

SEQ ID NO: 197988 - DNA, 1521 bp, Artificial Sequence
  Description of Artificial Sequence: Synthetic coding sequence
atggccgaggccgacttcaagatggtgagcgagcccgtggcccacggcgtggctgaggaggagatggcaagctctacatccgattcaggcgaagaaagtgacagctctagtagttcaagcagtacttccgattcctcgtcttcaagttcgacttccggatctagttcaggttctgggtcttcatcatcatcttcgggcagcaccagttcccggagcagactatataggaaaaagcgggtgcctgagccttcgagacgggccaggcgggctccccttggaaccaattttgttgataggctgccacaggccgtaagaaaccgggttcaggctctgcggaatatccaggacgagtgtgataaggtagacactctgtttcttaaggccatacacgatctggagagaaaatacgctgagctcaataagcccctttacgaccggagatttcagatcatcaacgcagaatatgagcctacagaagaagaatgcgagtggaacagcgaggatgaagagtttagttccgacgaggaagtgcaggataatactccatcggaaatgccgcctctcgagggcgaagaagaggagaatcccaaagagaatcccgaggtgaaggcagaagaaaaagaagtccctaaagagatccctgaggtcaaggatgaagagaaggaggtccctaaagaaattcctgaggtgaaggccgaagagaaggcggatagcaaagattgtatggaggccaccccagaggtaaaggaagatcccaaggaggttccacaggttaaggccgacgacaaggaacagccgaaagcaacggaggctaaagcacgggctgccgtgagagagacccacaaaagggtccctgaggagcggctgcaggacagcgttgacttgaagagggcccgaaaagggaagcccaagcgcgaagatccgaaaggaattccagattactggctgattgtcctgaagaatgttgataaacttggcccgatgatacaaaaatacgatgagcctattctgaaattcctctcagatgtttcgctgaaatttagcaagcctgggcagccggtttcctacacttttgaatttcactttctgcctaacccctattttagaaatgaagttctcgttaaaacatacatcattaaggcaaagcctgaccacaacgatcccttcttctcctggggttgggaaattgaagattgtaagggatgcaaaattgactggagacggggtaaggatgtgacagtcacaaccacccaatcccgcacgacggctaccggcgaaatcgagattcagcctcgcgtggtgccaaatgcctctttctttaatttcttctccccaccggagatccctatgatcggaaaacttgaaccccgagaagacgcaatcctggatgaggatttcgaaatcgggcaaatacttcacgataatgtgatcttaaagtctatctattactataccggggaggtgaatgggacttactaccagttcggtaaacactacggcaataagaaataccgcaagtag

SEQ ID NO: 197989 - DNA, 1500 bp, Artificial Sequence
  Description of Artificial Sequence: Synthetic coding sequence
atggtgagcgagcccgtggcccacggcgtggccgaggaggagatggcctcctctacaagcgatagcggggaggagagtgactcaagctcgagctctagctccacgtccgactcctcttcaagttcctccacctctggttcctcttctggatccggaagtagctcgtcttccagcggatccacatcttctagaagtagactgtaccggaaaaagagagtaccagagccaagtcgccgggcacgacgcgcgccactcggcactaacttcgtggacagactgcctcaggcggtgcgcaatcgcgtccaagccctgcgcaacatacaggacgagtgtgataaggtcgacaccctattcctgaaggctatccacgatttggaacgaaaatacgctgagttaaataaaccactatatgataggaggtttcagattatcaacgccgagtacgaacccacagaagaggagtgcgagtggaattccgaggacgaagaattctcatctgatgaggaggtgcaggataatactccgtccgagatgccgcccctggaaggcgaagaagaggaaaaccctaaggagaatcctgaggtgaaagcagaggagaaggaagtgcccaaggagattcctgaggtgaaagacgaagagaaagaagtcccaaaggagattccagaggtaaaagccgaggagaaagcagatagcaaggactgtatggaagctacacccgaagtgaaggaggaccctaaagaggtccctcaagtgaaggccgacgacaaggaacagcccaaggctactgaagcgaaggcccgggccgctgtgagagaaacgcataagagggtgcccgaagagcggctgcaagactcagtcgacctcaaacgggctcgcaaaggtaagccaaagcgggaggaccccaaagggattcccgactattggttgattgtcctgaagaacgtggacaaattgggtcccatgatccagaagtatgacgagccaattctgaaatttctgagcgacgtaagtctgaagttcagcaaacctggccagcccgtctcctatacattcgagtttcacttcctgcctaatccttacttccggaacgaagtgctggtgaagacatatataatcaaggccaagccagaccacaacgatccattcttttcgtgggggtgggagatcgaggattgcaagggatgcaaaattgattggagacgcggaaaggatgtgacagtgaccactactcagagcagaacaacagctaccggcgagattgaaattcagcctcgagttgtgccaaacgccagctttttcaactttttctcccccccagagatccccatgattggcaaactggagcctcgagaggacgcaatacttgacgaggattttgagatcggccagattctgcacgataacgtcatccttaagagtatctactactacacaggtgaggtcaatggaacttattaccagtttgggaagcactacggcaataaaaaatacagaaagtag

SEQ ID NO: 197990 - DNA, 1128 bp, Artificial Sequence
  Description of Artificial Sequence: Synthetic coding sequence
atggccgaccacagcttcagcgacggcgtgcccagcgacagcgtggaagctgcaaagaatgcatccaacacagaaaaactgacagaccaagttatgcagaacccgagggtgctcgccgctttacaagagcgcttggataacgttcctcatactccttcatcgtatatcgaaaccctgccaaaggcagtgaaaagacggattaatgccctgaagcaactacaagtcagatgcgctcacatcgaggccaagttctacgaggaagttcatgacttggaacgtaagtacgccgcactttatcagccactcttcgataaacgaagggagtttattacaggagatgtagagccaacagatgcagaatcagagtggcacagcgaaaatgaggaggaggaaaaactggctggggatatgaagtcaaaagtcgtggttacagaaaaggcagccgccaccgccgaagagcctgatcctaaagggataccagagttctggttcaccatctttcggaatgtggatatgctcagtgagctcgtccaggagtatgacgaaccgatcctaaagcaccttcaggacataaaggtgaaattctcggaccctggacagcccatgtctttcgtgcttgaatttcacttcgagcccaacgactattttactaatagcgtactgacaaaaacctataagatgaaatcagaacccgacaaagcagaccctttctcctttgagggacctgagattgtcgattgcgacgggtgtactattgattggaagaagggaaagaacgttacagtgaaaacgatcaaaaagaaacagaaacataagggacgcggcaccgtacgtaccattaccaagcaggtgcccaacgaaagtttcttcaatttctttaatcccctgaaagccagcggggatggcgagagtctcgacgaggactccgagttcactctcgcttccgactttgagattgggcatttctttcgcgaacggatcgttccacgagccgtgctgtatttcaccggcgaagcaattgaagatgacgacaacttcgaagaaggcgaggagggggaggaggaagaactggagggcgacgaagaaggggaagatgaagacgatgccgagatcaaccccaaggtatag

SEQ ID NO: 197991 - DNA, 1161 bp, Artificial Sequence
  Description of Artificial Sequence: Synthetic coding sequence
atggccgaccacagcttcagcgacggcgtgcccagcgacagcgtggaagcggctaagaacgcttctaacactgagaagttgacagaccaggtgatgcagaacccccgagtgctggcagctctacaggaacggctggataacgttccccacaccccctcctcctatattgagaccctgcccaaagcagtcaagcgtcgaattaatgcactcaaacaattgcaggtgaggtgtgcccacattgaggcgaaattttatgaagaggtgcatgatctggaacggaaatatgcagcgttgtatcagcctcttttcgacaaacggcgcgaattcattacaggcgacgttgagccaacagacgcggagagcgagtggcatagcgaaaacgaggaggaggaaaagttagccggggatatgaaaagcaaggtagtggtcacagagaaggctgcagccaccgctgaagaacctgatccaaaaggaatccccgaattttggtttaccatttttcgcaatgttgacatgctgtccgaactggtgcaagagtatgatgaacccatcttgaagcacctgcaggacattaaagtgaaatttagcgaccccggacagccaatgagttttgtgttagaattccacttcgagccgaatgattacttcacaaattcagttcttacaaagacctacaaaatgaaaagcgaacctgataaggcagatcctttttcttttgagggaccagagatcgtggactgtgacgggtgcacaattgactggaagaaggggaagaacgtcaccgtgaagactattaagaagaaacaaaagcataaagggcgagggactgttcgtacgattaccaagcaagtgcccaacgagagctttttcaacttctttaacccactgaagggcaaaggtcagtcaaagagcaaagatgaagactccgagtttactcttgcctccgactttgagattgggcatttcttcagagagcggatcgtaccacgagccgttttatacttcacgggcgaagcaattgaggatgatgataattttgaagaaggagaggaaggcgaagaggaggagctggagggggacgaggagggagaagacgaagacgacgctgagattaatcccaagaaagagccctctcaaccagccgaatgcaagcagcagtag

SEQ ID NO: 197992 - DNA, 537 bp, Artificial Sequence
  Description of Artificial Sequence: Synthetic coding sequence
atggccgaccacagcttcagcgacggcgtgcccagcgacagcgtggaagcagcaaagaatgcctccaatacagaaaagttgacagaccaggtaatgcagaatccccgggtgcttgcagccctccaggagcgcctggataacgttcctcatacaccaagctcttacatcgaaacgctaccaaaggcggtcaaacggcggatcaacgctctgaagcaactgcaggtcaggtgcgcccacattgaagcaaagttctatgaggaagtccatgacctcgaacgcaagtacgctgccctctatcagccactgttcgataaacgccgcgagttcatcactggggacgtggagcccacagatgccgaatctgagtggcactcagagaatgaagaagaggaaaaactggcaggagacatgaagagcaaagtagtcgtgaccgaaaaagcagctgctactgccgaggagccggaccctaaaggaatcccagagttttggttcaccatctttaggaacgtcgatatgctgtctgagctggtgcagtag

SEQ ID NO: 197993 - DNA, 1161 bp, Artificial Sequence
  Description of Artificial Sequence: Synthetic coding sequence
atggccgaccacagcttcagcgacggcgtgcccagcgacagcgtggaagcggcgaagaacgccagtaatacagagaaacttaccgatcaagttatgcagaatcctcgagtactggcagccctgcaagagaggctagataacgtgccccatactcccagtagctacatcgagacactgcccaaggccgtgaaacgcaggataaacgctttaaagcagttgcaggtacgctgcgcacacattgaagcaaaattttacgaagaggtccatgacctggagcgcaagtacgctgccctataccagcctctttttgataaaaggcgcgagtttatcaccggggatgtggagcctaccgacgccgaatcagagtggcattctgaaaacgaagaagaagaaaagctggcaggggacatgaaatccaaggtcgtagtaacagagaaggcagccgccactgccgaagaacccgacccgaagggtatcccagagttttggttcacgattttccgaaatgtggacatgctgtcagaactcgtgcaggagtacgatgagccaatactgaagcacctccaggacatcaaagtgaaattcagtgaccccggccagcctatgtcttttgtgctggaattccatttcgagcctaacgactactttacaaacagcgtgctcactaagacttacaaaatgaagagcgagcctgataaggccgacccattctcattcgagggccccgagattgtggattgtgacgggtgcaccattgattggaaaaaaggcaagaacgtgactgtcaaaaccatcaagaagaaacagaagcataaaggccgaggaacggtaaggaccattaccaaacaagtgcccaatgagtcattctttaattttttcaaccccttgaaggccagtggcgatggggagtctctcgacgaagacagtgagttcactctggccagcgatttcgagattggacacttctttagagaaaggattgtgccacgcgccgtcctgtacttcacgggggaggccatcgaggacgacgataatttcgaagagggggaggaaggcgaggaggaagagctagagggtgatgaagagggcgaggacgaagatgatgcggagattaatcccaagaaggagccctcacagcccgcagaatgtaaacaacaatag

SEQ ID NO: 197994 - DNA, 387 bp, Artificial Sequence
  Description of Artificial Sequence: Synthetic coding sequence
atggccgaccacagcttcagcgacggcgtgcccagcgacagcgtggaagcggccaaaaatgctagtaatactgagaaactgaccgaccaggtgatgcagaaccctagagtgttggcggcactgcaagagcgcctggacaatgtccctcacaccccgtcttcctatatcgaaaccttacctaaggctgtgaagagacgcattaatgcgctcaagcagctccaagtcaggtgcgcccatatagaggctaaattttacgaagaagtccacgatctggaacggaaatatgctgctctgtatcagcctttgttcgacaaacggcgtgagttcattaccggagatgtggaaccaacagacgccgaatccgaatggcattcagagaatgagtag

SEQ ID NO: 197995 - DNA, 423 bp, Artificial Sequence
  Description of Artificial Sequence: Synthetic coding sequence
atggccgaccacagcttcagcgacggcgtgcccagcgacagcgtggaagccgctaaaaatgcctctaataccgaaaagctgactgatcaggtgatgcagaatccaagagtgctggctgcgcttcaggagagacttgacaatgttcctcacacgccaagcagttacattgagactctcccaaaggcagtgaaaagacgaattaatgctctgaaacagctacaggttcgctgcgcccacatcgaggcaaaattctatgaagaggtgcacgacttagaaagaaaatatgcggcactgtaccagcccctctttgacaaacgtcgcgagtttataactggagatgtggaacctaccgatgcagagtcagaatggcacagcgaaaatgaggaggaagagaaattggccggggacatgaaatctaaatag

SEQ ID NO: 197996 - DNA, 402 bp, Artificial Sequence
  Description of Artificial Sequence: Synthetic coding sequence
atggccgaccacagcttcagcgacggcgtgcccagcgacagcgtggaagccgctaagaacgcgtcaaacaccgagaaactaaccgatcaggtaatgcagaatccccgtgtcctggctgcactgcaggaaagactggataatgtgcctcacacaccttcgagctatatagagaccttgcccaaggcagtcaagaggagaatcaacgccctgaaacagctgcaagtgcgatgcgcgcacatcgaggctaagttctatgaggaagttcacgacctggaacgcaagtacgctgctctttaccaacctctgttcgacaagcggcgagaattcatcaccggagatgtggaaccaactgatgccgagtccgaatggcacagtgaaaacgaggaagaggaaaagctgtag

SEQ ID NO: 197997 - DNA, 324 bp, Artificial Sequence
  Description of Artificial Sequence: Synthetic coding sequence
atggccgaccacagcttcagcgacggcgtgcccagcgacagcgtggaagctgccaaaaacgcctctaatactgaaaaattaaccgatcaggtaatgcagaacccaagagtactcgccgcactccaggaaaggctggataacgtcccgcatacaccctcatcctacatcgagactctgccaaaagccgtaaaaaggaggatcaatgctctgaagcagctgcaggtccgctgcgcacatatcgaagccaaattttacgaggaagtgcacgaccttgagagaaaatacgctgccctctaccaaccactctttgacaaacggagatag

SEQ ID NO: 197998 - DNA, 237 bp, Artificial Sequence
  Description of Artificial Sequence: Synthetic coding sequence
atggccgaccacagcttcagcgacggcgtgcccagcgacagcgtggaagcagctaagaatgccagtaatacagaaaagctgacagatcaagtcatgcagaaccctcgtgtcctggccgccttacaggaaagactagacaacgtccctcacaccccaagctcttacattgagacccttcccaaggccgtcaaacggaggattaatgccctgaagcaacttcaggttcggtgtgcatag

SEQ ID NO: 197999 - DNA, 549 bp, Artificial Sequence
  Description of Artificial Sequence: Synthetic coding sequence
atggccgacagcgagaaccagggccccgccgagcccagccaggccgcggcagcggctgaggccgccgccgaagaagtgatggccgaggggggcgcccaaggtggagattgcgatagcgctgccggtgacccagactctgctgctggccaaatggccgaggagccccagacgcccgccgagaacgcccccaaacccaaaaacgactttatcgagtccttaccgaactccgtcaagtgtcgcgtacttgccctgaaaaagctccagaagcgttgcgacaaaatcgaagccaagttcgacaaggagttccaggcactcgaaaaaaaatataatgacatctacaagcctctgctggctaagatccaagagctcactggagaaatggaaggctgtgcttggacgctggaaggagaggaagaggaggaagaagaatatgaggacgacgaggaggaaggcgaagacgaggaagaggaggaagctgcagctgaggcagctgctggggcaaagcatgatgacgcccacgcggagatgccagatgatgctaagaagtag

SEQ ID NO: 198000 - DNA, 438 bp, Artificial Sequence
  Description of Artificial Sequence: Synthetic coding sequence
atggccgacagcgagaaccagggccccgccgagcccagccaggccgcggccgccgccgaagccgccgcagaagaggtcatggccgaaggtggtgctcagggaggcgattgtgactccgcagctggggaccctgacagcgccgctggccagatggccgaggaaccgcagaccccagctgagaacgcccccaagcctaaaaatgactttatcgaatcgctgcccaactcagtgaagtgtagagtgctggccctgaagaaactgcaaaagcggtgcgataaaattgaagcgaagttcgataaggagttccaggccttagaaaaaaagtataacgatatctataaacctctcctcgcaaaaatccaggagcttacaggggaaatggagggatgtgcttggaccttggagggggaggagcgacggaagcgcgtacgaggatag

SEQ ID NO: 198001 - DNA, 963 bp, Artificial Sequence
  Description of Artificial Sequence: Synthetic coding sequence
atggaggaggtgccccacgactgccccggcgccgacagcgcccaggctgggaggggcgcgagttgccaagggtgtcctaatcagcggctctgtgcttccggggctggggctacacccgataccgctatcgaggagatcaaggaaaaaatgaagacagttaagcacaaaatattagtgcttagcggcaagggaggagtgggcaaatcaaccttttcagcccatttggcccacggcctggccgaggatgagaacacccaaatcgcactcctggacatcgatatatgcggcccgtctatccctaagataatgggtctcgagggggagcaggtgcatcagtctgggtcaggctggagtccagtgtatgtggaggacaacctgggtgtgatgtctgtggggtttctcctgtcatccccggacgacgctgtgatatggcggggtccaaaaaaaaacgggatgatcaagcagtttctgcgagacgtggattggggcgaggtagattatctcatcgtggataccccacctggcacatccgacgaacatctctcagtggtccgttacctagccaccgcccatatcgatggcgctgtcataattaccacccctcaagaggtgtcattgcaagacgtccggaaagagataaatttctgtagaaaggtgaagctgcccatcataggggttgtagagaatatgagtgggtttatttgcccaaaatgcaagaaggaatcccaaatttttcctcctactaccggaggcgccgagcttatgtgtcaagacctcgaagtcccattgttgggtcgtgtgccactggatcccttgattggtaaaaattgcgacaagggccagtctttttttatcgatgcacctgatagccctgccaccctcgcttatcggtctatcatccagcggattcaggaattttgcaacctccaccagagcaaggaggagaacctgatctcaagctag

SEQ ID NO: 198002 - DNA, 930 bp, Artificial Sequence
  Description of Artificial Sequence: Synthetic coding sequence
atggaggaggtgccccacgactgccccggcgccgacagcgcccaggcgggaagaggcgcctcatgccagggttgtcccaaccagcgactgtgtgcctccggtgcaggagccaccccagacactgctattgaggagatcaaggaaaagatgaaaaccgttaaacacaagatcctcgtgttaagcggaaaaggcggcgtggggaaatcaactttttccgcccacctggctcacggacttgctgaagacgagaacactcagatcgcgctgctagatattgatatttgtggtccatctatccctaaaatcatgggcttggagggcgagcagtacgtggaagataacctgggcgtgatgtccgtcgggttccttctttccagcccggatgacgctgtaatttggcgagggcctaaaaagaatggcatgataaaacagttcctccgggatgttgactggggagaggtggactatctaatagttgacactccaccgggaacctccgatgaacatctgtcagtggttcgctacctagccactgctcatatcgacggtgcggtaataattacaacaccacaggaagtatccctgcaggacgtccgcaaggagatcaacttctgtaggaaggtcaaactcccaatcattggcgtagtcgagaacatgagtgggttcatctgccccaaatgcaaaaaagaaagccagatctttcctccgactacagggggcgccgaacttatgtgtcaggacctggaggtcccacttctcgggagggtgcccctggatccgctcattgggaagaactgcgacaaagggcagtctttcttcatcgacgctccagatagtcccgcaaccctggcctaccgaagcataatccagcgaatccaggaattctgtaatctgcaccagtccaaagaggaaaacctgatttcgagctag

SEQ ID NO: 198003 - DNA, 816 bp, Artificial Sequence
  Description of Artificial Sequence: Synthetic coding sequence
atggaggccgccgccgagcccggcaacctggccggcgtgcggcacataatcttggttcttagcggcaaggggggggtgggtaagtctactatatctaccgaactggccctggcacttagacacgcaggaaaaaaggttggcatcctggatgtcgacctgtgcggcccaagtattccccgaatgttgggggcccaagggcgcgcagtacaccagtgtgacaggggttgggcgcccgtgtttctggaccgtgaacagagtatctcacttatgagcgttggcttcctgctggagaaaccggacgaggctgtggtgtggcgaggtcccaaaaaaaatgccctaataaagcagtttgtatcagacgtggcctggggggagttggattatctggtggtggacacccctcccggcacatctgatgaacatatggcgaccattgaagctctgaggccttatcagcctttaggagcgctggttgttacaaccccacaggcagtctcggtgggagatgtccgtagggaactaactttttgtagaaagactgggctgagagtgatgggaatcgtggagaacatgagcggcttcacctgtccccactgcacagaatgcacgagcgtcttctcccgcggcgggggggaagaactggcccagctggctggtgtcccattcctgggctctgtgcctttggacccagctctgatgcggacccttgaggaggggcatgattttattcaggaattccccggctccccggcgtttgcagcactgaccagcatagctcagaaaattctggatgccacccccgcctgtctgccctag

SEQ ID NO: 198004 - DNA, 393 bp, Artificial Sequence
  Description of Artificial Sequence: Synthetic coding sequence
atggccaccatcgaggccctgcggccctaccagcccctgggcgccttggtggtgacgacgcctcaggccgtgagtgtgggggacgttcgcagggagctgacattctgcaggaagaccgggcttcgcgtgatggggatcgtagagaatatgtcagggtttacttgtccgcattgcacagaatgcactagtgtcttttcacggggtggcggagaggagctcgcccagttggccggggtgccattcttgggctcagtcccactcgacccggcactgatgaggaccctggaggaaggccatgactttattcaggagtttcctggatcaccggcatttgccgctctgacaagcatcgcacagaaaattctcgatgctacacccgcgtgtttgccttag

SEQ ID NO: 198005 - DNA, 960 bp, Artificial Sequence
  Description of Artificial Sequence: Synthetic coding sequence
atgggcatctggcagcggctgctgctgttcggcggcgtgagcctgagagcaggcgggggggcaacggccccactgggcggaagccgggccatggtttgcgggaggcagctctctggtgcaggatccgaaaccctgaagcagaggcgcacccagatcatgtctcgaggcctgcccaagcagaagcctattgagggcgtcaaacaggtaatcgtcgttgcctccggtaagggaggagtggggaaatccactacagcggtcaatttggccctggccctggcagccaatgactcttcaaaggcgatcggcttattggacgtcgacgtttatgggcccagtgtgccaaaaatgatgaacctaaagggcaatcccgaactgtcccagagcaatctgatgcgccccctgttaaactacggaatcgcatgcatgagtatgggctttcttgtggaggagtcggaaccagtggtgtggaggggcctaatggttatgagtgcgattgaaaagctgctgaggcaggttgactggggtcagctcgactatttggtagtcgatatgccacccggaacaggcgatgtccagttgtcagtgtcacagaatattcccataacaggggcagtgatcgtgtctacacctcaggacattgcccttatggatgcccacaaaggggcggagatgttccggcgcgtgcacgtacctgtcctcggactcgtgcagaatatgagcgtcttccagtgtcctaagtgtaagcacaaaacccacatttttggcgccgacggtgcccggaaattagcccagacccttggtttggaggtgctcggggacattcctctccacttaaatatccgggaggcttccgacacgggccagccaatcgtgttttcccagcctgagagcgacgaggccaaggcgtacctacgcattgccgtggaagtcgtcaggcgccttccgtcaccgagcgaatag

SEQ ID NO: 198006 - DNA, 672 bp, Artificial Sequence
  Description of Artificial Sequence: Synthetic coding sequence
atgagcaaggccatcggcctgctggacgtggacgtgtacggcccctcggtccccaaaatgatgaacctcaaagggaatcctgagctgagccagagcaacctcatgagaccgctactgaattatggcatagcttgtatgtccatgggcttcctggtggaagaaagcgaaccggtcgtgtggagaggactgatggtaatgtctgccatcgagaagctcctccggcaggtcgattggggtcagctcgactatctagttgttgatatgcccccagggactggtgatgtccaactctctgtctctcagaatattcctattacgggcgcagtcatcgtgagtaccccacaggatatagcattgatggatgcacacaagggtgccgagatgttccgccgggtacatgtacctgtcttaggattggtgcagaacatgagcgtatttcaatgcccgaaatgtaagcataaaacccacatatttggcgccgatggcgcgagaaagctggcgcagacacttggactggaagtattaggagatatacccctgcacctgaacatccgcgaggccagcgacaccgggcaacccatagtttttagccagcctgagagcgatgaggccaaagcgtacctgcgaatcgctgttgaagtcgttcggcggctgccatctccatccgagtag

SEQ ID NO: 198007 - DNA, 3123 bp, Artificial Sequence
  Description of Artificial Sequence: Synthetic coding sequence
atgggcgaggagggcggcagcgccagccacgacgaggaggagcgggcttccgtcttgttgggtcattcacccgggtgtgaaatgtgctctcaagaggccttccaagcccagcgtagccagcttgtggagttgctagtgtccgggtctctcgaaggtttcgagtccgtgctggactggcttttgtcttgggaggtactttcctgggaggactacgagggctttcacctcctgggacagccactgtctcatctggcccggcggctgttggacaccgtatggaataaaggaacatgggcatgccaaaagctcatcgctgccgcacaggaagcgcaagccgatagtcagtcccctaagctgcatgggtgttgggatccgcacagcttacacccagcccgggatctgcaatcccaccgtcccgctatcgtgagacgactgcactcacatgttgagaacatgctggatctcgcatgggaacgtggatttgtttctcaatatgaatgcgacgagattagacttcccattttcactccctcacagcgcgcacgtaggcttcttgacttggccaccgttaaggccaacggactggcagcctttctcctacaacacgtgcaggagctgcccgtaccgctcgcgctgcccctagaagccgcgacctgcaaaaaatatatggcgaagctgcgcacaacggtctcggcccaaagccgcttcttgtcaacctacgacggagctgagactctctgcctagaagacatctacacggaaaatgtgctcgaggtctgggccgatgtcggcatggctgggcctccacagaaatcacctgcaaccttgggactggaggagcttttctctactcccggacacctgaacgacgacgctgatactgtgttggtcgtgggtgaggcaggaagcggaaagtcgaccctgcttcagcgcctgcaccttctttgggccgctgggcaagattttcaggagttcctgtttgtgtttcccttctcatgccgtcaactgcaatgtatggccaagcccctaagcgtgcgcacattgctattcgaacactgttgttggcctgacgtcggacaggaagacattttccagctgttacttgatcacccggaccgtgtattgcttacttttgatggtttcgacgagttcaaattccggtttactgacagggagcggcactgctcccccactgacccaaccagcgtacagacactgctcttcaatctgctgcagggtaaccttctgaaaaacgctaggaaagtagtgacttctcggccagccgcagtgtccgcctttctgcggaagtatatccggaccgagtttaatctgaaaggcttcagtgaacaaggcattgagctctacctaaggaagaggcaccacgagcccggagtggctgatcggctgatccgcctgctgcaggagacctccgctctccacgggctctgccatttgcctgtattctcttggatggtcagcaagtgccatcaagagcttctccttcaggagggcggttccccgaagactaccacggatatgtacttgctgatactgcagcactttctcctacacgctacccccccggatagcgcttctcaaggactggggcccagccttcttagaggaagacttcctaccctgcttcacctgggcaggcttgctttatggggtctggggatgtgctgttatgtcttttcagcccagcaactccaggccgctcaggtgagtccagacgatatttcgctggggtttctggtcagagccaagggcgtggtacccggttcaaccgcacctctggagtttctccacattaccttccagtgcttcttcgccgccttctatcttgccctctccgccgatgtgccacctgcattgctgaggcatctcttcaactgcggccgccctggcaatagcccaatggccagactcctgccaacgatgtgtattcaagccagtgaagggaaggatagcagcgtggctgccctcctacagaaagcagaaccccacaatcttcaaattacagctgcttttctagccggcctgctgtcccgcgagcactggggccttcttgcagaatgtcagacaagcgagaaggccttgctcaggcggcaggcctgtgccaggtggtgcttagcgagaagcctgaggaaacatttccattctatacctccggctgcaccaggagaggccaagtccgtgcacgctatgcctgggtttatctggctgattcggtcactatatgaaatgcaggaggagcgcctggcccgcaaggctgcccgtggcttgaatgtcggccatctcaagttaaccttttgtagtgtggggcccaccgagtgtgccgcactggccttcgtcctacagcatctgagacgcccagttgcactgcagttggattataacagtgtgggtgacatcggtgtggagcagctgctgccttgcctcggcgtgtgtaaagctctgtatctgcgagataataacatctcagatcgtgggatatgtaagctgatcgaatgtgcactgcattgtgagcagctgcagaagctagctttattcaataacaagctgaccgatgggtgcgcgcactccatggctaagctactagcctgcagacagaatttcctggccctgcggctcgggaacaattacatcaccgccgctggtgcacaggtgctggccgaaggactgagaggcaacacctctttgcagttcctcgggttctggggcaacagagtgggcgatgagggtgcacaagctctggccgaagctctgggagaccatcaaagcttgcggtggctctccctagtcggtaacaacatcggcagcgtcggcgcacaggctttagcccttatgctggcaaagaatgtaatgctggaggagttatgtttagaagaaaatcacctgcaggatgagggtgtatgttccttagccgagggccttaagaaaaactcaagtttgaaaatcctgaagctctcgaacaactgcattacttacctcggcgccgaggcccttctgcaggcattagagagaaacgacaccatcctggaagtttggctgaggggcaacacgttcagtttagaagaggtcgataaactggggtgtcgggatactcgcctgttgctgtag

SEQ ID NO: 198008 - DNA, 543 bp, Artificial Sequence
  Description of Artificial Sequence: Synthetic coding sequence
atgtggctgctgccccccggccaggtgttcaacgccttcttccccagccggctgggcaacaattatattactgctgcaggggcacaggttctggcagaaggactacggggaaatacttcactccagtttctgggcttctgggggaatcgggtcggtgatgaaggagctcaagccctagcagaagctctcggcgatcaccagtcattgaggtggctttctctcgtgggcaacaatatcggatcagtcggcgctcaggctcttgctctgatgctggctaaaaacgtgatgctggaagaactgtgcctggaagagaatcatttacaggatgagggtgtgtgcagtttggctgaaggattgaagaaaaatagcagtctcaaaattttgaagctatcaaacaactgcataacatacctgggagctgaggcgctactccaggccttagaacggaacgacaccatcctggaggtctggttacgcgggaatacgttttcacttgaagaggttgataagctgggttgccgcgatacaaggcttcttctgtag

SEQ ID NO: 198009 - DNA, 1008 bp, Artificial Sequence
  Description of Artificial Sequence: Synthetic coding sequence
atggaggacagcggcaagaccttcagcagcgaggaggaggaggccaattactggaaggaccttgccatgacctataagcagagagccgagaatacccaagaagagttgcgtgaatttcaggaggggtcccgtgaatacgaagcggagctcgaaacgcagttacagcagatcgagacaaggaatagagacctcctgtcagagaacaatcggctccggatggaattggagacgatcaaggaaaagttcgaagtgcaacattccgaggggtatcgccaaatctccgccctcgaggacgatctcgcgcagaccaaagccatcaaggaccagctccagaaatacattcgtgaactggagcaggccaacgatgacctcgaaagagcaaaacgcgcaaccatcatgtcactggaagattttgaacagaggcttaaccaggctatagagaggaacgcatttctggaatctgaactagacgagaaagagaacctgctggagtccgttcagagactcaaggatgaggctagagacttacgacaagaactggcggtccagcagaaacaagaaaagccacgtactcccatgccttcctctgttgaagctgaaaggacagacactgctgtgcaggcaacagggtcagtgccatctacccctatagcacacaggggcccttccagtagcctaaatacccccggcagcttcaggcgaggcttggatgacagtaccggggggacccctctcacccccgctgcccgcatcagtgctctaaacatcgtgggcgatcttctccgcaaggtgggtgcactggaatcaaagctggctagctgtcgaaatctggtgtatgaccagtctccaaacagaacaggcgggccggcatccgggcgctcctcgaaaaatcgggacggaggcgagcgccgcccctctagtacgtcggtcccgctgggagataaagggctggacacatcttgcagatggcttagcaagtcaaccacacggagctcctcgtcttgttag

SEQ ID NO: 198010 - DNA, 1041 bp, Artificial Sequence
  Description of Artificial Sequence: Synthetic coding sequence
atggaggacagcggcaagaccttcagcagcgaggaggaggaggccaattactggaaggatctggccatgacatacaaacagagggcagagaatacacaagaggaattgcgcgaatttcaggaaggttcacgcgagtacgaggcagagctggagacccagctgcagcagattgaaacccggaacagagacctcctgagcgagaataaccggttacgcatggagttggagacgatcaaagaaaagtttgaagtccagcattcagagggttataggcaaatctcagcgctcgaggacgatctcgctcagacaaaagcaattaaagatcaattgcagaagtatatacgcgagcttgaacaggctaacgacgacctggaacgcgccaagcgcgccacaataatgtcactggaagacttcgagcagcggcttaatcaggctattgagagaaatgccttcctcgaatccgaactggacgagaaagaaaatcttctggagagcgtacagagattgaaggatgaggcccgggacttacggcaggaactagccgtgcagcagaagcaggagaaaccccgcaccccaatgccctcttccgtggaggcagagagaactgacaccgctgtccaggctacagggagtgtcccaagcacaccaatcgctcatagaggcccgtcatcttcacttaacacgcctggctctttcagaaggggcctagacgactccacaggaggcacccccctgacgcctgccgctcgcatttccgcactgaacattgttggtgatctcctcaggaaggtgggagctctcgagagcaaactggccagctgtagaaatctggtctacgatcagtcccccaatcgcaccggcggtccagcctctggtcggtcctctaagaaccgagacggtggagaaagacgcccatcctccacttctgtgccacttggtgataaaggcttaggcaagagactggaatttggtaagccgcctagccacatgtcttcttcacccttgccttccgcgcagggggtggtgaagatgctgttgtag

SEQ ID NO: 198011 - DNA, 1008 bp, Artificial Sequence
  Description of Artificial Sequence: Synthetic coding sequence
atggaggacagcggcaagaccttcagcagcgaggaggaggaggccaactattggaaagacctcgctatgacctataaacagagagctgagaatacgcaagaagaactgcgcgaatttcaagaaggcagccgagaatacgaagcggagctggagacacagttgcagcagatcgagactagaaatagggatctgctctccgaaaacaaccgtctgagaatggagctcgaaacaataaaagaaaagttcgaagtgcaacactccgaggggtaccgacagatttccgccctggaagacgatttagctcaaacaaaagctataaaggaccaactgcaaaagtacattcgtgagctcgaacaagcaaatgacgacctggagcgggccaaaagggccaccatcatgtctctcgaagacttcgagcagagactgaatcaggccattgaacgcaatgcattcctggagtctgaactcgacgagaaagaaaatctgctggagtctgtgcaacggctgaaagatgaagcgagagacctcagacaagagctagccgtccaacagaaacaggagaagcctcggactcctatgccttccagcgtggaggctgaacgtacagacacggctgtccaggccaccgggtcagtgccctccacacctattgctcatcggggcccatctagcagcttaaacacaccagggagcttccggagaggactcgacgactcaaccggggggactccactcacaccagctgctcggattagcgccctgaacatcgtgggagacctgctcagaaaggttggggcactggaatccaaactggccagttgcaggaatctggtgtacgaccagtcccccaaccgaaccggtggcccggcgagtggccgaagctccaaaaaccgtgacggcggcgagcgtcgccccagctcgacctccgttcccctcggagacaagggactagatacatcatgtcgctggctgagcaagagcaccaccaggagctcctctagttgctag

SEQ ID NO: 198012 - DNA, 1008 bp, Artificial Sequence
  Description of Artificial Sequence: Synthetic coding sequence
atggaggacagcggcaagaccttcagcagcgaggaggaggaggccaactattggaaggatttggccatgacgtacaagcagagagccgagaacactcaagaggagttgagggagtttcaggaaggcagccgggaatacgaagcggaattagagacccagctccagcagatcgagacaaggaaccgcgatttgctgtccgaaaataaccgtctgcggatggagttagaaacgattaaagaaaaatttgaagttcaacactctgaaggctacaggcaaatttctgccctggaggatgatctcgctcagaccaaagctattaaggaccagctgcagaagtacatacgcgagctcgaacaagcaaacgatgacctcgagagagctaaacgggccaccattatgtcactggaagacttcgaacaacgtctgaaccaagccatagaacggaacgctttcctagaatctgaactggatgaaaaagagaacctcctggagtccgtacagcgcctcaaagacgaagccagggatcttaggcaggagttggcagtccagcaaaagcaagaaaagccgagaaccccgatgccttcctcagtggaagccgagcgaacagacacagccgttcaggcaacaggcagcgtcccttccacccctatcgctcacagaggcccaagcagctccctgaacactcctggctcttttcgccgaggtctggacgacagtaccggaggcacacctcttaccccggccgccagaatttccgctctgaacatcgtaggggaccttcttcggaaggtgggggccctcgaatcaaagcttgccagctgccggaacctcgtgtacgaccagtcccccaacaggaccgggggaccggcttctggaaggagtagcaaaaaccgggacggcggtgagaggcgcccaagttctacttcggtgcctctgggggataagggtctggacacttcatgtcgctggttaagcaagagtactactcggagtagttccagttgttag

SEQ ID NO: 198013 - DNA, 471 bp, Artificial Sequence
  Description of Artificial Sequence: Synthetic coding sequence
atgggcgccagccggctgtacaccctggtgctggtgctgcagccccagagggtgctcctggggatgaagaaacgcgggtttggagcagggcgctggaatggcttcggcggcaaagtgcaggagggcgaaacgattgaggacggcgcccgtagggaactccaggaggaaagtgggctgacggtggatgcactacataaagtcgggcagatagtgtttgagttcgtaggcgagcccgagctgatggatgttcatgtattctgtactgattctatccagggaactcccgtcgagtctgacgaaatgaggccttgttggtttcagctggatcaaattcccttcaaggacatgtggcctgatgatagctattggttccccctactgttacagaagaagaaatttcacggatacttcaaattccagggccaggacaccatcctggattacacgctgcgggaggtggacactgtatag

SEQ ID NO: 198014 - DNA, 540 bp, Artificial Sequence
  Description of Artificial Sequence: Synthetic coding sequence
atgagcggcatcagcccccagcagatgggcgagcccgagggcagctggtcgggcaaaaaccccggcacaatgggagcaagccggctctacactctcgtcctggtgctccagcctcaacgcgtgctgctgggaatgaagaagcggggcttcggagccggtcgctggaatgggttcggtgggaaagtccaggagggggagacaatcgaagacggtgctcgccgagagcttcaggaagagagtggattaacggtggacgctctacacaaggtgggtcagatcgtgtttgaatttgtgggcgagcccgaacttatggacgtccatgtgttctgtacagacagcatccagggaacacccgtggagtccgacgaaatgcgtccatgctggtttcagcttgatcagattcccttcaaggacatgtggcccgacgactcatattggttcccgctactactacagaagaaaaagtttcatgggtattttaaatttcaggggcaagacaccattctcgactacactcttagagaggtggataccgtgtag

SEQ ID NO: 198015 - DNA, 471 bp, Artificial Sequence
  Description of Artificial Sequence: Synthetic coding sequence
atgggcgccagccggctgtacaccctggtgctggtgctgcagccccagcgggtactgctggggatgaagaaacggggcttcggcgccggaagatggaatggttttggcggaaaggtgcaggaaggcgaaaccatcgaagacggggccagaagggagctgcaggaagagtcaggcctcacggtggatgctctgcataaggttgggcaaattgtctttgagtttgtaggggaacctgaactgatggacgtacatgttttctgcacggacagcatccagggaactccagtcgagtctgatgaaatgcggccatgctggttccaactcgatcagattccattcaaggacatgtggccagacgactcctattggtttcctctcctattgcaaaagaagaaattccacgggtactttaagttccaaggccaggatactattttggactacactttgagggaggtggacaccgtctag

SEQ ID NO: 198016 - DNA, 471 bp, Artificial Sequence
  Description of Artificial Sequence: Synthetic coding sequence
atgggcgccagccggctgtacaccctggtgctggtgctgcagccccaaagggtgttactcggaatgaagaaaagaggtttcggtgctgggagatggaacgggttcggggggaaggtacaagagggggagaccattgaagatggagcccggcgcgagctacaagaggagtccggactgaccgtcgatgccctacacaaggtgggacaaatagttttcgaatttgttggtgaacccgaactgatggatgtacatgtgttttgtacagacagcatacagggtactcccgtcgagagcgacgaaatgcgaccttgctggtttcagctggaccaaattccgttcaaggatatgtggccagatgatagctactggtttccacttttgttacagaagaagaagtttcacggctatttcaaatttcaagggcaagataccattctcgattatacactgagggaggtggacaccgtgtag

SEQ ID NO: 198017 - DNA, 540 bp, Artificial Sequence
  Description of Artificial Sequence: Synthetic coding sequence
atgagcggcatcagcccccagcagatgggcgagcccgagggcagctggagcggcaaaaacccaggaaccatgggcgcttctcgtttatacaccttggttttagtcctgcagcctcagcgggttctcctcggcatgaaaaagaggggctttggggccggcagatggaacggtttcggtggtaaggtgcaggagggggaaactattgaggacggggctagacgcgagctacaggaagaaagcgggctgactgtggacgcgctgcacaaggttggccagatagtgttcgagtttgtgggggagccagagttaatggacgtacatgtcttctgcacagattctattcaggggacccccgtggaatcagatgaaatgcgaccatgttggttccaactggatcagattcctttcaaggatatgtggcccgacgattcgtattggttccccctgttgctccagaagaagaagttccatgggtacttcaagttccaaggccaggacaccattttagattacacactccgagaggtggatacagtctag

SEQ ID NO: 198018 - DNA, 540 bp, Artificial Sequence
  Description of Artificial Sequence: Synthetic coding sequence
atgagcggcatcagcccccagcagatgggcgagcccgagggcagctggtccggcaagaatccggggacgatgggagcctctaggctgtacaccctcgtattggtccttcaaccacagagggtcctgctggggatgaagaaacggggattcggggccggcaggtggaacggttttggcggcaaggtacaggaaggcgagaccattgaagacggcgcccggagagaactgcaggaagagtctggattaacggtggacgccctgcataaggtgggacaaattgtatttgagtttgtgggggaacccgagctgatggatgtccacgtcttctgtacagacagcattcaggggacccccgtggagtccgacgagatgcgcccttgctggtttcaactggaccagatcccctttaaggacatgtggccagatgactcatattggttccccctgctgctccagaaaaagaagtttcacggctacttcaagttccaggggcaggacaccatcttggattacacgctccgtgaagttgatacagtgtag

SEQ ID NO: 198019 - DNA, 114 bp, Artificial Sequence
  Description of Artificial Sequence: Synthetic coding sequence
atgggcgccagccggctgtacaccctggtgctggtgctgcagccccagagagtgctcctcggcatgaagaaacgcgggtttggcgctggaaggtggaacggatttgggggatag

SEQ ID NO: 198020 - DNA, 495 bp, Artificial Sequence
  Description of Artificial Sequence: Synthetic coding sequence
atgaagtgcaagcccaaccagacccggacctacgaccccgagggcttcaagaagcgcgccgcatgtctctgcttccgctccgagagggaggatgaagtgctgttggtcagttcaagtcggtaccctgatagatggatagtgcccggaggtggcatggaacccgaagaagagccaggcggggctgccgtgcgagaggtctacgaagaagccggcgtgaaaggcaaactgggtcgccttctcggcgtgtttgaacaaaaccaggacccgaaacaccggacctacgtctacgtgctaactgtaaccgagttgctggaagactgggaggacagcgtaagcattggccgcaagagagagtggtttaaagtcgaagacgctataaaggtgttgcagtgccacaaaccagtccacgccgagtatctggaaaagctaaaactcggcggttcccccactaatggcaactcaatggctcctagcagcccagactccgacccctag

SEQ ID NO: 198021 - DNA, 495 bp, Artificial Sequence
  Description of Artificial Sequence: Synthetic coding sequence
atgaagtgcaagcccaaccagacccggacctacgaccccgagggctttaaaaagcgtgccgcttgtttgtgctttaggtccgagagggaagacgaggttctgcttgtgagttcctcaaggtacccggatagatggatcgtgccggggggcggaatggaacctgaagaagaaccgggaggcgccgccgtgagggaggtgtatgaggaagctggggtcaaaggaaagctcggtaggcttctaggcgtcttcgaacagaaccaagatccaaaacatcgtacctatgtgtacgtgctaacggttacagaactgttggaagactgggaagacagtgtgtcaatcggccgcaagcgagagtggtttaaggtcgaagatgctataaaggtgctgcaatgccacaagcccgtccatgccgagtacctagaaaagctgaagctaggaggcagtccaacaaatggaaacagcatggctccttctagcccagatagcgatccctag

SEQ ID NO: 198022 - DNA, 444 bp, Artificial Sequence
  Description of Artificial Sequence: Synthetic coding sequence
atggccctgcgggcctgcggcctgatcatcttccggcggtgcctgatccctaaagtggacaataatgccatcgaatttctgctgctgcaggcatcggacggtattcatcattggaccccaccgaaaggtcacgtggaacctggcgaagatgatctggagaccgccttgagagagacccaagaagaggcaggaattgaagccggacaattgaccatcattgaagggtttaaacgagaactgaattacgtggccaggaataaaccaaagaccgtgatatattggctcgctgaagttaaagattatgatgtggaaattcggttaagtcacgaacatcaggcctatcggtggctcggcctggaggaggcttgtcagctcgcccaatttaaggagatgaaggctgcactgcaggaaggacatcagtttctatgttccatcgaggcctag

SEQ ID NO: 198023 - DNA, 444 bp, Artificial Sequence
  Description of Artificial Sequence: Synthetic coding sequence
atggccctgcgggcctgcggcctgatcatcttccggcggtgcctgatccccaaagtggacaacaacgccattgagttcttgctacttcaggccagcgacggcatccatcactggacaccaccgaaaggtcatgtcgagcctggggaggatgatctggagaccgcgttacgcgaaacccaggaggaagcgggcattgaggccggacagctgactattattgaaggctttaagagggagttaaactacgtagctcgcaataaacctaaaaccgtcatatattggcttgccgaggtgaaagactacgatgttgagattagactttctcacgaacatcaagcctatagatggctggggcttgaggaggcctgtcaactggctcaatttaaagaaatgaaggccgctctacaagaggggcaccagtttctgtgttccatagaagcatag

SEQ ID NO: 198024 - DNA, 444 bp, Artificial Sequence
  Description of Artificial Sequence: Synthetic coding sequence
atggccctgcgggcctgcggcctgatcatcttccggcggtgcctgattcccaaggtcgataacaacgctatcgagtttttactcctacaggcctcagatggtattcaccactggaccccaccgaaaggtcacgttgagcccggagaggacgacctggaaactgccctcagggagacccaggaggaggccgggattgaggccgggcagctcacaatcatcgagggattcaagcgcgaactgaactacgttgcaagaaataagccaaagacggtgatttattggctggcagaggttaaagattatgacgttgagatcaggctatcccacgaacaccaggcataccggtggttaggcctagaggaggcctgccagctggcccaatttaaggaaatgaaggctgcattacaggagggtcaccagtttctgtgcagtatcgaggcctag

SEQ ID NO: 198025 - DNA, 444 bp, Artificial Sequence
  Description of Artificial Sequence: Synthetic coding sequence
atggccctgcgggcctgcggcctgatcatcttccggcggtgcctgatccctaaggtggataataatgccatagaattcttgctgctccaggccagcgacggcattcaccactggacaccacctaaaggccacgtggagcccggcgaggacgacctcgagaccgctctgagagagacgcaggaagaagctggaatcgaggcagggcaacttactataatcgaggggtttaaaagagagctgaactatgttgctcgtaacaaacccaaaactgtgatctattggctggctgaagtcaaagattacgacgtggagatcaggttatcgcacgaacaccaagcgtacaggtggctgggccttgaagaggcgtgccaacttgcccagtttaaagaaatgaaggccgctctccaggaagggcaccagttcctatgttccattgaggcttag

SEQ ID NO: 198026 - DNA, 444 bp, Artificial Sequence
  Description of Artificial Sequence: Synthetic coding sequence
atggccctgcgggcctgcggcctgatcatcttccggcggtgcctgattcccaaagttgataacaatgctatagagttcttactattgcaggcaagcgatggcatacaccattggacgcccccaaaagggcacgtagagccaggcgaggacgacttggagaccgccctgcgggaaactcaggaggaggccggaatcgaggccggacaactgactataattgagggctttaagcgggagctgaattacgtcgctcggaataagccgaaaacagtaatatattggctcgcagaagtcaaagactacgatgtagagattagactgtctcatgaacatcaggcatatcggtggctgggcctggaagaggcatgccaactcgctcagttcaaggagatgaaagccgctctccaggaaggccatcagttcctctgttccattgaagcttag

SEQ ID NO: 198027 - DNA, 1395 bp, Artificial Sequence
  Description of Artificial Sequence: Synthetic coding sequence
atggagaccctgagcttcccccggtacaacgtggccgagatcgtgattcacatccgcaataaaattctgacaggagcagatggaaaaaacctgaccaagaatgatttgtaccctaaccccaagccagaagttctgcacatgatttatatgcgagccctgcaaatcgtctatggaatcaggttggagcacttttacatgatgccagtcaactctgaggtgatgtatccacatctgatggaagggtttctgccgttttctaatctggtgacccacctggactcttttctcccgatttgccgcgtaaatgattttgaaaccgcggacattctgtgccctaaagccaaacgcacctctaggttcctcagcggcattattaacttcattcacttccgcgaagcttgccgagagacatacatggaattcctgtggcaatataagtcttcggccgataaaatgcagcagctgaacgctgcacaccaggaagccctcatgaagcttgaacgtcttgactctgtcccagtggaggaacaagaggaattcaaacaactctccgatggaatacaggagctccagcagagcctaaatcaagacttccatcagaaaacgattgtacttcaggagggtaacagccagaagaagagtaatattagtgaaaagactaaacgacttaacgaactgaagttgtctgtggtcagcctgaaagaaatccaggaaagcctgaagacaaaaatcgtcgacagccctgagaagctcaaaaactacaaagagaagatgaaggacactgtgcagaagctgaagaacgcccggcaggaggtagtcgagaaatacgagatttacggcgactcagtcgattgtttgccaagttgccagctggaggtccagctttaccaaaaaaaaatacaggatctgagtgataatcgcgaaaaattggcatctatcctaaaggaatccctcaacctggaggaccaaatcgagagcgatgagtccgaactcaaaaagttgaagactgaggaaaattcattcaaacggctgatgatcgtcaaaaaagagaaactcgctactgctcagttcaagattaataagaaacacgaggatgtaaagcagtataagaggaccgtcattgaagattgtaataaggtacaggagaaacggggcgcagtttatgagcgggtgaccacgattaaccaggagattcagaagatcaaactgggaatccagcagttaaaagatgctgccgaaagagagaaactgaagtcccaggaaatctttttgaatctgaagacagcgctcgagaaataccatgatggaatcgagaaagcagccgaggactcatacgcaaagattgacgagaagacagccgagctgaagcggaagatgttcaaaatgagtacctag

SEQ ID NO: 198028 - DNA, 1395 bp, Artificial Sequence
  Description of Artificial Sequence: Synthetic coding sequence
atggagaccctgagcttcccccggtacaacgtggccgagatcgtgattcacattcgtaataaaattctgaccggggctgacgggaagaatctgacaaaaaacgacctataccctaatccaaaacccgaggtgctacatatgatctacatgagggccttgcagattgtctatggtatccggctggaacacttctacatgatgcctgtcaactcggaagttatgtatcctcacttgatggaaggatttttgccattctctaacctggtgacccacttagacagctttttgccaatctgtagggttaatgattttgaaaccgctgacatattatgccctaaagcaaagagaacctcacgatttctgtcaggaatcattaattttattcattttcgagaggcatgtagagaaacgtatatggaattcctgtggcagtacaagtcctccgctgacaaaatgcaacagttaaacgccgctcatcaagaagctttgatgaagctggaaaggctggactctgtccctgtggaagagcaggaagaatttaagcagctgtccgatgggattcaggaattgcagcagtccctgaaccaggattttcaccagaaaacgattgtgttgcaagaaggcaattcccaaaaaaagtccaacattagcgaaaaaactaaaaggttgaatgaactgaagctatccgttgtaagcttgaaagagatccaagagagtctgaagacaaagattgtggacagccccgaaaaattaaagaattataaggaaaagatgaaagatactgtgcagaaactgaaaaatgctaggcaggaggtggttgaaaaatacgagatctacggggactcagtcgattgtctccctagctgtcagctcgaagtgcaactgtatcagaagaagatacaggatttgtcagataaccgggaaaagttggcatctatcctaaaagagtccttgaacctggaagatcagatcgagagtgatgagtcagagcttaaaaagctcaagaccgaagagaatagctttaagcgactaatgattgtgaagaaggaaaagctggccactgcccaatttaaaatcaataagaaacacgaagacgtgaagcagtacaaaaggactgtgatcgaggactgcaacaaggtgcaggagaaaagaggagcagtatacgagcgagtgactacaataaatcaagagatccagaagataaaactcggcatacaacagttgaaggatgcagccgagagagaaaaattgaaaagccaggaaatctttctgaacctcaagacagcccttgagaaataccatgacggcattgagaaagccgccgaggattcctacgcaaaaattgatgagaagacagcagaactcaagcggaagatgttcaaaatgtcgacctag

SEQ ID NO: 198029 - DNA, 609 bp, Artificial Sequence
  Description of Artificial Sequence: Synthetic coding sequence
atggagaccctgagcttcccccggtacaacgtggccgagatcgtgattcatattcggaacaaaatcttgactggagcggatgggaaaaacctgactaaaaatgatctatatcccaaccctaagcccgaagttctgcacatgatctatatgagggccttgcagatcgtgtatgggatccgattggagcatttctatatgatgccggtaaattccgaggttatgtacccgcatttgatggagggattcttaccgttctcaaacttggttacgcatctcgacagcttcttgcccatttgtagggttaatgacttcgagactgcagatatcctgtgccccaaagcaaagagaaccagccgtttcttgtcagggatcatcaactttattcatttcagggaggcttgccgcgagacctatatggaatttttatggcagtataagtcttccgccgataagatgcaacagctcaacgcagctcaccaagaggctttgatgaagttagagaggttggactcggtcccagtcgaggagcaggaggagtttaaacaactgtctgatggtatccaggagttgcagcagtccttgaaccaggattttcatcagaaaacatag

SEQ ID NO: 198030 - DNA, 438 bp, Artificial Sequence
  Description of Artificial Sequence: Synthetic coding sequence
atggagaccctgagcttcccccggtacaacgtggccgagatcgtgattcacatacggaacaaaatcctgaccggtgccgatgggaagaacttgaccaagaatgatctgtaccctaatcctaagcctgaagtccttcacatgatttatatgagagctttacagatcgtttacggtatccgtcttgaacatttttacatgatgccagtgaacagcgaagtgatgtaccctcatctgatggaaggcttcctcccattctctaatttggtgacgcatctcgacagcttccttccgatttgcagggtgaatgacttcgagacagccgatatactttgcccaaaagcgaaacgtacttcccgcttcctgtcagggatcatcaatttcatacatttccgcgaggcatgccgagagacttacatggaatttctgtggcagtattag

SEQ ID NO: 198031 - DNA, 666 bp, Artificial Sequence
  Description of Artificial Sequence: Synthetic coding sequence
atggagaccctgagcttcccccggtacaacgtggccgagatcgtgattcacattcgtaataagattctgacaggagcagatggcaagaatcttactaagaacgacttgtaccctaatcctaagccagaagtgctccacatgatttacatgcgggccctgcagattgtgtacggaattcgactggaacatttctacatgatgcccgtgaacagcgaagtcatgtatccgcatcttatggagggcttcctgcccttcagtaatctcgtcacccatctagactcgttccttccgatctgtcgggtgaacgattttgagactgcagacattctgtgtccaaaagccaagaggaccagtaggttcttatccgggatcattaacttcatccatttccgggaggcatgtagagaaacatatatggagttcctgtggcaatataaaagttcggcagacaagatgcagcagctgaacgcggcccaccaggaggccctaatgaagttagagagactcgactctgtccctgtggaggaacaggaggaatttaagcagctctccgatggaatccaggagctgcaacagagcctgaaccaggacttccatcagaagacttgctgcaaaagggaaattcccaaaagaagccagatctttcagaggaagccatccgtgtag

SEQ ID NO: 198032 - DNA, 1254 bp, Artificial Sequence
  Description of Artificial Sequence: Synthetic coding sequence
atggagaccctgagcttcccccggtacaacgtggccgagatcgtgatccacattcgtaataagatacttacaggtgctgacggaaaaaacctgactaaaaacgacctctatccaaatcctaagcccgaggtactacacatgatctatatgcgagctctgcagatcgtttacggcatacgcctagagcatttctacatgatgccggtcaacagtgaggtcatgtatccccatttgatggaaggattcctgcccttttccaacctggtgacacacttagactcatttctgccgatatgtagagtcaacgacttcgagaccgcagacatattatgcccaaaggccaagagaaccagtaggttcttatccggcatcataaacttcatccatttccgggaagcttgccgtgagacatacatggagtttctttggcaatacaaatcaagcgccgacaaaatgcagcagttgaatgccgcacaccaagaggccctgatgaagctcgagaggctcgattctgtgcccgtggaggagcaagaggagttcaaacagctgtcagacggaatccaagaattacaacagagcttgaaccaggatttccatcaaaagacaattgtcctgcaggagggaaattcacagaagaagtccaacattagcgagaagacaaagagactgaatgagctcaagctgtctgtcgtcagtcttaaggagatccaagagtctttgaaaaccaaaattgtggatagcccagagaaactgaaaaattacaaggaaaagatgaaagatacagtccaaaagctgaagaacgcacgctcactcaatctggaagaccagattgaaagcgacgaaagtgaactgaagaaactcaaaaccgaagaaaacagcttcaaaaggctgatgatagtaaaaaaggaaaagctggccactgcgcagtttaaaattaacaagaaacatgaagacgttaaacagtataagaggacggtcatagaagactgcaacaaggtgcaggagaaacgcggcgccgtatacgaaagagtgacaaccattaatcaggagattcagaaaataaaacttggcatccagcagctgaaagatgccgctgagcgagaaaaattaaaatctcaggagatctttctgaacttgaagactgcactcgaaaaatatcacgatggtatagagaaagccgctgaagatagttacgcaaagatagacgaaaaaaccgccgaattaaagaggaaaatgtttaagatgtccacctag

SEQ ID NO: 198033 - DNA, 375 bp, Artificial Sequence
  Description of Artificial Sequence: Synthetic coding sequence
atggagaccctgagcttcccccggtacaacgtggccgagatcgtgatacacattcggaacaagattttgacaggcgctgacgggaaaaacctgaccaaaaacgacctttaccccaatcctaagccggaggtcctgcacatgatttacatgcgcgcactacaaatcgtgtatggcatccgcttagaacacttctacatgatgccagtaaacagcgaagtgatgtatccacaccttatggagggcttcctccctttcagcaacttagtgacccaccttgactcctttcttcccatttgccgggtcaacgactttgaaaccgccgacatcctgtgtcccaaagccaagcgaacatcccgatttttatctggcatctag

SEQ ID NO: 198034 - DNA, 702 bp, Artificial Sequence
  Description of Artificial Sequence: Synthetic coding sequence
atgaacaagctgcggcagagcttccggcggaagaaggacgtgtacgttccggaagcatcccgcccccatcagtggcaaaccgatgaagagggcgtgcgaacggggaaatgtagctttccagtcaaaaccggcaaaaaggccgtgaaggccgtgctgtgggtcagtgcagacggcctgcgagtcgtcgatgaaaaaactaaggaccttattgtggatcagacaattgagaaggtctccttctgcgcgcctgatagaaatttcgatagggcttttagttacatctgtagggatgggaccaccaggagatggatctgtcattgttttatggccgtgaaggatactggggagaggctcagtcatgccgtggggtgtgccttcgcagcctgcctcgagcgaaagcagaaaagggaaaaagagtgcggcgtaacagcaaccttcgacgcaagtagaacaactttcacacgggagggatccttccgagtcaccacggctacggaacaagcagagagagaagaaattatgaaacagatgcaggacgcaaaaaaagcggaaaccgataagatcgttgtcggcagctcagtcgctccaggcaacactgcacctagcccatcaagccccacaagcccaactagtgatgcaaccacttcactggagatgaataatccgcatgccatcccccgtagacatgccccaatcgagtag

SEQ ID NO: 198035 - DNA, 1956 bp, Artificial Sequence
  Description of Artificial Sequence: Synthetic coding sequence
atgaacaagctgcggcagagcttccggcggaagaaggacgtgtacgtccccgaggccagcagaccacaccagtggcagaccgacgaggaaggcgtccgcacaggaaagtgctccttccctgtgaagtatctcggtcatgttgaggtggatgaatcgaggggcatgcacatatgtgaggacgccgttaagcgtctgaaagcggaacggaaattctttaagggtttctttggcaaaacggggaagaaggctgtgaaagcggtgctctgggtatccgccgatggcctgagggtggtggacgagaagacgaaagacttgattgtggaccaaacaatcgaaaaagtctctttttgtgcaccagatcgaaattttgatagagcatttagttatatctgccgggatggcactacacgcagatggatttgccactgctttatggcagtcaaagacacaggagaacggctctcccatgccgtcggttgcgctttcgcagcgtgtctggagcgcaagcaaaaacgggaaaaggagtgtggggtaacggcgaccttcgacgcctctagaacgaccttcaccagggaaggcagttttagggtgactaccgctacagaacaggccgagagagaagaaattatgaaacagatgcaagacgccaaaaaagctgagacagacaagatcgttgtggggagtagcgtggcccccggaaatacggccccgtccccatccagtcctacgtcacccaccagcgacgctacaacgtcacttgagatgaataaccctcacgcgatcccgaggcgacatgcacctatagaacagttggctcgccaaggatccttccgaggtttccctgctctttcccagaagatgagtcccttcaagcggcagttgagtctgaggattaacgagctgccatcgacgatgcagaggaaaactgatttcccaatcaagaacgcagtgcccgaggtggaaggtgaggccgagagcatcagttccctgtgcagccaaatcaccaacgcattttcaacccccgaggatcctttctcctccgcccctatgactaagccagtcacggtggttgcccctcaatccccgacctttcaagcaaatgggacagattccgctttccacgtgctcgctaaaccagctcataccgcattggcacctgtggccatgccagtacgtgagactaatccatgggcccacgcaccggacgcagctaacaaagagattgcagccacatgttctggcactgaatggggtcagagctccggggcagctagcccaggactgttccaggccggccataggcgcactccctcagaagctgatcgctggttagaagaggtgagtaagagtgtgcgggcgcaacaacctcaagcatctgccgcccctttgcagccggtcctgcagcctccgccccccaccgctatctcgcagcccgccagccctttccagggaaacgctttcctgacctcccagcctgtgcctgtaggtgtcgtgcctgctctgcagccagcattcgttccagcacagtcatacccagtggctaatggcatgccataccccgctccaaacgtgcctgtagtggggatcaccccttctcaaatggtcgcgaatgttttcggaaccgcgggacacccccaggccgcccaccctcaccagagcccatcactggtccggcagcaaaccttcccacactatgaggcctcatcagcaaccacctcaccattcttcaagcccccagcccagcacctgaacggctctgcagcttttaatggcgttgacgatggccggctagcatctgcagaccggcataccgaggtacccacaggtacttgccctgttgaccctttcgaagcacaatgggccgcgctggagaataagtccaaacaacgcacaaacccttcaccaaccaatcccttttctagcgatctgcagaagacatttgaaatcgagctttag

SEQ ID NO: 198036 - DNA, 1812 bp, Artificial Sequence
  Description of Artificial Sequence: Synthetic coding sequence
atgaacaagctgcggcagagcttccggcggaagaaggacgtgtacgttcctgaggcatctcgcccgcatcagtggcaaaccgatgaagagggcgtgcgaacaggaaaatgcagcttcccagtcaaatatcttggtcacgttgaggtggatgaatcacggggaatgcatatctgtgaggacgcagtaaagcggttgaaagctgagagaaaattttttaagggattcttcgggaaaactgggaagaaagcagtgaaagccgttctctgggtgtctgcagatgggttacgtgtggtcgatgaaaaaactaaagaccttatcgtcgaccagactattgaaaaagtgtctttttgcgcaccagaccggaatttcgaccgcgcattctcttacatatgtcgggatggcactactaggaggtggatctgtcattgcttcatggccgttaaggacacaggtgaacggctgagtcacgcagtggggtgcgcgtttgcagcctgcctggagagaaagcagaaacgcgaaaaggagtgtggcgtgaccgcaacctttgatgcttcccgtacaaccttcacacgagaggggagctttcgtgtgacaacagccaccgagcaagcggagagggaggagatcatgaagcagatgcaggatgctaaaaaggccgagacagacaagattgttgtgggatccagcgtggctcctggcaatacggctccatctccttcctccccaacgagccctacatctgacgccaccacctcgctagagatgaataatccccatgcaataccccgccggcatgctccgatcgagcagctggcaagacagggatcgttccggggattccctgctttatcacaaaagatgagtcctttcaagcgccagctgtctctccgaatcaatgaattgccgtcgacaatgcagaggaagaccgacttcccgatcaaaaatgccgttccggaagtggagggcgaagctgaaagcatatcgtcgttatgctcccagataaccaacgctttctccacacctgaggatccctttagcagcgctccaatgactaagccagtaactgtcgtggccccacaaagcccaactttccaagggactgagtggggccagtcatccggagcagcaagtccaggacttttccaggccggccacaggaggacaccgtcggaagcagatagatggttggaagaagtttccaaaagcgtgagggcccaacagccccaagctagcgcagccccgttgcagcctgtgctgcagcccccccctccaactgctatcagtcagcccgcgtctccgttccagggtaacgctttcctcacttctcaacccgtgccagtgggggtggtgcctgctctgcagcctgcatttgttcccgcacagagttaccctgttgctaatggcatgccctatcctgcccccaacgtgcccgtcgtgggtataactccgtcacagatggtggcaaacgtatttggcactgcaggccacccccaagctgcccatcctcaccagagcccgtccctagttaggcagcagacattcccccattacgaggcgtccagcgcgactactagcccgttttttaagccacccgcccagcatctcaacgggagcgcagcctttaatggagtcgatgacggaaggcttgcttcagctgatcgtcatacggaggtgccaaccgggacttgccctgtggacccattcgaggcacagtgggccgcactggagaataagagtaaacagcggaccaacccctctccaactaacccctttagttccgatcttcaaaagacattcgaaatagaactttag

SEQ ID NO: 198037 - DNA, 1923 bp, Artificial Sequence
  Description of Artificial Sequence: Synthetic coding sequence
atgaacaagctgcggcagagcttccggcggaagaaggacgtgtacgtccccgaagcctccaggcctcaccaatggcagaccgatgaagagggggtgagaactgggaagtgttcttttccagttaagtacctggggcacgttgaggtagacgagagccggggtatgcacatttgcgaggatgctgttaaaaggctgaaggccaccggcaagaaggccgttaaagctgtcttgtgggtcagtgccgacggtctgcgcgtcgtggatgagaagaccaaggacctgattgtagatcagactattgaaaaagtctccttctgtgcaccagataggaatttcgatagggccttcagctatatctgccgagatgggaccacccggcggtggatctgtcattgttttatggccgtcaaggatacaggggagcgcctgtctcacgccgtcggttgtgctttcgcagcctgcctggagcggaagcagaaaagggaaaaagagtgcggagtgaccgctacttttgacgcctctcggacaacgttcacaagggaggggtctttccgcgtgactactgctacagagcaggcagaaagagaggagataatgaagcaaatgcaggacgcgaagaaggccgaaactgacaaaatagttgttggttcctccgtcgcccccggtaataccgcccccagtccgtcaagtcccacctcccctaccagcgacgcgactacgtcactggagatgaataaccctcatgccatccccagacggcacgcacctattgagcagctcgccaggcaaggcagctttagagggttccccgccctcagtcagaagatgtcgccattcaaaagacagctgagtctgagaatcaacgagttgccatcaaccatgcaaagaaaaaccgactttcctataaaaaatgcggtgccagaggtggagggggaagccgagtcaattagttctctctgtagccagattacaaatgcattctctacaccggaagaccccttcagcagtgcccctatgactaaaccggtgaccgtcgtcgctccccagagccctaccttccaggcgaacggaaccgacagcgctttccatgtactcgctaaaccagctcatacggccttagcaccggttgcgatgcctgttcgtgaaaccaacccatgggctcacgctcccgatgctgctaataaagagattgctgccacttgcagcggaacagagtgggggcaaagttccggcgccgcctctcccggtttattccaagctggacacaggagaaccccatccgaagctgaccgctggctagaagaagtgtccaagagcgtgcgtgcacagcagcctcaggcatctgcggcacctctacaacctgtacttcaaccacccccacctacagcgatatctcagccagccagcccattccagggcaacgcatttctgacctctcagccagtaccagtcggcgtcgtgcctgcgttacagcccgcctttgtacctgcccagagctaccccgtggcaaatggaatgccctaccctgcaccaaatgttccagtggtagggatcactccgtcacagatggttgccaatgtcttcggtacagctggacacccccaagccgcacatcctcaccaaagcccgagcctggttcggcagcagacattcccgcattatgaagccagcagcgctacaactagcccgttcttcaagcctcctgcccagcatctgaatggttcagcagcctttaacggggtggacgatggccgcttggcctctgctgatcgacataccgaggtaccgacaggcacctgccccgtggatcctttcgaagctcaatgggcagcactcgaaaacaagtctaagcaacggaccaacccctctcccacaaatccctttagttccgatctccaaaagacttttgagattgagttgtag

SEQ ID NO: 198038 - DNA, 1518 bp, Artificial Sequence
  Description of Artificial Sequence: Synthetic coding sequence
atgaacaagctgcggcagagcttccggcggaagaaggacgtgtacgttccagaggcttcccgtcctcaccagtggcagactgatgaggagggcgtaagaacaggtaagtgctctttcccggtgaagtacctgggccacgtggaggtggacgagtctcgaggcatgcacatctgtgaagacgctgtgaagcggttgaaggctgagcgtaaattctttaaaggatttttcgggaagacaggaaagaaggccgtgaaggcagtactgtgggtcagcgctgatgggttgcgcgtggttgacgaaaaaacaaaggatcttattgtcgaccagaccatcgagaaagtctctttctgcgctcccgatagaaattttgatcgagccttttcatatatatgtagggatggtacgacacgtaggtggatttgtcattgcttcatggctgtgaaagacaccggtgagcgtctgtctcatgccgttggatgtgctttcgccgcttgcctagaaaggaagcagaaacgcgaaaaagagtgcggagtcaccgcaacctttgacgcctcccggaccacattcacccgagaaggaagcttcagagtgacgacagccacggaacaagccgagagggaggaaataatgaagcagatgcaagacgctaagaaggtgccagaggttgagggtgaagccgagtccatatcctccctctgttcgcagattaccaatgcgtttagcacccctgaggaccctttctcttccgcaccaatgaccaagccagtgacagtggttgctccacagtctcccacatttcagggaaccgagtgggggcagtctagtggggccgcgagcccaggtctttttcaagccggacaccgccgcacgccgtccgaagcagatagatggcttgaagaggtctccaaatccgtgcgtgcccagcagccacaggcttctgctgctccactgcagccagtacttcagccccctccgcctactgccatctcccagcctgctagccctttccagggaaatgcattcctgactagccagcctgtgcccgtaggtgttgtacctgctcttcagccagccttcgtccctgctcagtcttatccagtggctaatggcatgccatatcccgcgccaaacgtgccagttgtggggatcacgccttctcagatggtggccaatgtttttgggacagccggccacccacaggcagcacatccacaccaatctccaagcttagtgcggcagcagacctttccccactatgaagcttcctccgcaacaactagtcctttctttaaacctcctgcccagcacttgaacggttctgccgccttcaatggcgtggatgatggacgtctcgccagcgccgataggcatacagaagtgccaacaggaacctgcccggtggaccccttcgaggctcaatgggccgccctagagaataaaagtaaacaacggacaaatccctctccaaccaacccattctcaagcgacctgcaaaagacctttgagatcgagctgtag

SEQ ID NO: 198039 - DNA, 1923 bp, Artificial Sequence
  Description of Artificial Sequence: Synthetic coding sequence
atgaacaagctgcggcagagcttccggcggaagaaggacgtgtacgtgccggaggcctctcgccctcaccaatggcagacagacgaagagggcgtgcgcacaggtaagtgctcttttccagtgaagtatctcggacacgtggaagttgatgagtctcgaggcatgcacatttgtgaagacgcagttaaacgcctgaaagccaccggaaaaaaagctgtaaaagcagtgctgtgggtgagcgcggacggcctgcgcgtggtagacgaaaagaccaaggatctcatcgtagatcagacgatcgagaaggtcagcttttgcgccccagaccggaatttcgacagggcgttctcttacatttgccgtgatggcaccactagaaggtggatctgtcattgctttatggctgttaaggacaccggggaacgactgagtcacgcggttggctgtgcttttgccgcctgtctggagcgaaaacaaaagcgagaaaaggagtgtggcgttacagccacttttgacgctagtcgcaccacattcacaagggagggcagcttcagggtgacaaccgcgaccgagcaggcagaacgggaagagattatgaaacaaatgcaagatgcgaagaaggccgagaccgacaagattgtcgtgggctcgtctgtggcgcccggcaacacggccccctcgcctagtagtccaacctccccaacgtccgatgcaactacttccttggagatgaacaatccacacgcaatccctcgcagacatgccccaattgagcagcttgcccggcaggggtcctttcgaggcttcccagctttgagtcaaaaaatgtccccctttaagaggcagctttccctgcgaatcaacgaacttccttccaccatgcagaggaagactgactttcccattaagaatgcagtgcccgaggtcgagggagaggctgagagtattagctccctttgcagccagattaccaatgcttttagtaccccagaggatcccttcagcagcgcccccatgacaaagccagtgaccgtagtcgcaccccagagtcccacctttcaagcaaacggcaccgattctgccttccatgtgctggcgaaacccgctcacacagcactggctcccgtagccatgcccgttagagaaacaaatccatgggcccatgcgcccgacgctgcaaacaaagagatcgctgctacctgctctggcaccgagtggggccaaagcagcggggccgcgtctcccggcctgttccaggctggacacagaagaaccccctccgaggccgaccgttggctggaggaggtttccaagagcgttagggctcagcagcctcaggcaagtgcggcacctttacagcccgtactccagccccctccacccactgccatcagccagccagctagtccctttcaggggaatgcctttctcacaagtcagcctgtgcccgtcggcgtggtcccagctctccagcctgcctttgtgcccgcccagtcttacccagttgcgaatggtatgccttatcctgctcccaacgttcccgtggtggggatcaccccgtcacaaatggtggctaacgtcttcgggaccgccggccaccctcaagctgctcaccctcatcagagccccagtcttgtacggcagcaaacgtttcctcactacgaagcatcctcagccaccaccagtccattctttaagcctccggcccagcatctgaatggcagtgcggcgttcaacggtgtggacgacggaagactggccagcgctgatagacacactgaggtgcccacaggcacatgtcctgtcgaccctttcgaggctcaatgggccgctttggagaacaagtccaaacaaagaacaaacccatctccaacgaatcccttctccagtgatctacagaaaacatttgagattgagctgtag

SEQ ID NO: 198040 - DNA, 1371 bp, Artificial Sequence
  Description of Artificial Sequence: Synthetic coding sequence
atgaacaagctgcggcagagcttccggcggaagaaggacgtgtacgtaccagaggcgtcccgtccacaccagtggcaaaccgatgaggaaggggtcaggactggaaaatgcagttttcccgtgaagtatctgggccacgtcgaagtcgacgaaagtcgcggcatgcacatctgcgaggacgcagttaagaggttaaaggctgagcgcaagttcttcaaaggcttctttggcaagaccggaaaaaaggcagtgaaagctgtactctgggtgagcgccgatggcctgagggtagtggatgaaaagacgaaggatctcatcgtcgaccagaccatagaaaaggtgagtttctgcgccccggacagaaattttgatagagcattttcatatatctgcagagatgggactacgaggagatggatatgccattgtttcatggcagtgaaagacaccggggaacgtctgtcccatgcagttgggtgcgcgttcgccgcctgcttggagaggaagcaaaagagagaaaaagagtgtggggtgacagcgacgtttgacgcctcacgaacgacgtttacccgagaggggagcttcagagttaccacggccactgagcaggcagagagagaggagatcatgaagcagatgcaggacgccaaaaagggtactgaatggggacagtccagtggagcagcatccccgggactatttcaggccgggcatcggcgcactccctccgaagccgataggtggctggaagaggtttctaaaagcgtgagggcccagcagccacaggctagcgctgccccactgcagcctgtgcttcaaccgcctccccccaccgccatttctcagcctgcatcacccttccagggcaacgcctttttaacctcccagcctgtgccagtcggagtggtccccgctctgcagccagccttcgttcccgcccagagctaccctgtagcaaacggaatgccgtaccccgcgccaaatgtacccgtggtcggcattacacccagtcagatggtagctaacgtttttgggaccgcagggcacccccaggccgcccatcctcaccaatcccctagtctagtaaggcagcaaacatttccccattatgaggcaagttctgccacaacgtctcctttttttaagccccctgcccaacatctgaatggttctgcggcatttaacggggttgacgatggcagactcgcctccgctgatcggcacaccgaagtgcctaccggcacttgtccagtggacccattcgaggcacagtgggcagcccttgagaacaaaagcaagcagcgcactaacccgagtccaacgaatccttttagtagcgacttacagaaaaccttcgagatagaactttag

SEQ ID NO: 198041 - DNA, 777 bp, Artificial Sequence
  Description of Artificial Sequence: Synthetic coding sequence
atgaacaagctgcggcagagcttccggcggaagaaggacgtgtacgtccccgaggcctcacggccacatcagtggcagacagacgaggaaggagtaaggaccggtaaatgttcattccccgtcaagtaccttggccatgtcgaagtggacgaatcccggggtatgcacatctgcgaggacgctgtgaagaggttgaaggccgaaaggaaattttttaaagggttttttggtaaaacaggaaaaaaggctgtgaaagctgtgctctgggtgagtgctgacggactacgggtcgtggacgagaagactaaggatctgatagtcgatcagacgattgaaaaagtgtctttttgtgcgccagaccgtaattttgaccgggcctttagctacatttgccgagacggcacgactagacgctggatctgccactgcttcatggccgtgaaagataccggagagaggctttcccacgcggtgggctgtgcattcgccgcttgcctggaacggaaacaaaagcgcgagaaagagtgtggcgtgaccgcaacatttgatgccagtcgaacaacttttacgcgggagggaagcttcagagtgacgactgctaccgagcaggcagaaagggaagagataatgaagcagatgcaggatgctaagaaggccgaaacggacaaaatagtggtcgggagcagcgtcgcccccggcaataccgccccctctccatcttcacctacatctccaactagtgatgcaacgaccagtttggaaatgaacaacccctag

SEQ ID NO: 198042 - DNA, 1779 bp, Artificial Sequence
  Description of Artificial Sequence: Synthetic coding sequence
atgaacaagctgcggcagagcttccggcggaagaaggacgtgtacgtacccgaagccagtcgtccccaccaatggcagaccgatgaagaaggggtgcgtacaggcaaatgcagcttcccagtcaagtacttagggcacgtggaggtcgatgagtctagaggcatgcacatatgtgaggacgccgttaaaaggctgaaggccacaggcaaaaaggccgtgaaagccgtattatgggtgagcgctgatggactgcgagtggtagacgagaagactaaggacctcattgtggatcagaccatagagaaagtgagcttctgtgcccccgatcgaaactttgaccgggccttttcatacatttgcagggatgggaccaccagaagatggatttgtcattgttttatggcggttaaggacactggtgagcgtctcagtcatgccgtgggctgcgcgtttgctgcttgtctcgagcgaaagcagaaacgagagaaagagtgtggggttactgcaacatttgatgcctctcgcacaacctttactcgggaggggagttttcgggttactacagctacggagcaggccgagcgcgaggagatcatgaagcagatgcaggatgccaagaaggccgaaactgacaagatcgtggtcggaagttcagtcgcccccggaaatactgccccctctccctctagtcccacatcaccaacctcagacgccaccacttcactggagatgaataatcctcatgccatcccgcgtagacatgctcccatcgagcagttggcccgacagggctcattcagaggctttcccgcgctaagccaaaaaatgtccccatttaagcgccagctgtcactgcgcattaatgagctccctagtacaatgcagagaaagactgacttcccaatcaaaaatgccgttccagaagtggagggtgaggcagaatctataagttccctatgttctcagatcactaatgcctttagcactcccgaggacccattttcaagtgcccccatgaccaagccagtgacggttgtcgctcctcagagccctacgtttcaaggaaccgaatggggccaatcctccggagctgccagtcccggattatttcaggcagggcatcgacgcaccccgagcgaggcagacaggtggctcgaagaggtcagtaagtccgttcgcgcacagcagccccaagcatcggccgctccattgcagccagtactccagcctcctccgcccacagcaatttcccagcctgccagtccatttcagggcaatgcattcctcacctcgcaacctgtaccagtgggcgtggtacctgccttgcagccagcctttgtcccggcacagagctacccggtcgcaaatggcatgccctatcccgcaccgaatgtccctgtggtgggtattacaccctcccagatggttgctaatgtgttcggaacagcaggccatccacaagccgcgcatcctcatcaaagccccagtttagtgcgccagcagacgttcccccactatgaggcatcatccgctaccaccagccctttttttaagcctcctgcccaacatctgaatggttccgccgcctttaatggggttgatgatggcaggctggcctccgcagatcggcatactgaggtgccaacaggaacttgtcccgtggacccctttgaagcgcagtgggctgctctggagaacaaatccaaacagcgaaccaatccctcacccactaacccgttttctagtgatctccagaagactttcgagatcgagctgtag

SEQ ID NO: 198043 - DNA, 204 bp, Artificial Sequence
  Description of Artificial Sequence: Synthetic coding sequence
atgaacaagctgcggcagagcttccggcggaagaaggacgtgtacgttcccgaggctagcaggccgcaccagtggcagacggatgaggaaggggtgcgcacaggtaagtgcagctttcctgtcaaatacctgggccacgtggaagtcgatgaatctagagggatgcacatatgcgaggatgccgttaagcgcctcaaagcatag

SEQ ID NO: 198044 - DNA, 1956 bp, Artificial Sequence
  Description of Artificial Sequence: Synthetic coding sequence
atgaacaagctgcggcagagcttccggcggaagaaggacgtgtacgtcccggaggctagccgtccccatcagtggcagacagacgaagagggagtgaggacaggaaagtgttcctttccagtaaaatatctaggacacgtcgaggtcgacgagagtcggggcatgcacatttgtgaggacgccgtaaaacggttgaaagccgaacgcaagttctttaaaggtttctttggcaagaccggcaaaaaagctgtaaaggcggtattgtgggtctccgcagacggactccgcgttgtggatgaaaagaccaaggatctgatagtggaccagacgatcgagaaagtaagcttttgtgccccggatcgtaactttgatcgggcgttctcctacatctgtcgtgacggcaccacaagacgatggatttgtcattgttttatggcggtcaaggatacgggagagagattatctcatgccgttgggtgcgcctttgcagcctgtctggagcgcaagcagaaacgtgaaaaggagtgcggagttactgctaccttcgacgcctctagaaccacatttacaagggaggggtctttcagagtcactacagctactgagcaggccgaacgggaggaaatcatgaagcagatgcaggacgctaagaaggcagagactgataagatcgtggtgggctcatccgttgcacccggtaatacagctccaagtccaagcagccctacttcacctacctccgacgctacaacgtcgctggaaatgaacaatccccacgctattccacggcggcacgcccctattgaacagcttgctagacagggcagctttcgaggatttcctgctttatcacagaagatgtcaccctttaaaagacaactgtctttgagaatcaatgaattgccatctactatgcagagaaagactgatttcccaatcaaaaatgccgtcccagaggttgaaggggaggctgagagcatatccagtctctgttcacaaattacaaatgccttttccacacctgaggacccattctcatctgccccaatgacaaaacctgtcaccgtagtcgctccccagtccccaacatttcaggccaacggtactgacagcgcctttcatgtgctcgccaagccggcacataccgctttggcgccagtagccatgccagtgcgagagacgaatccctgggcacatgctcctgatgcagctaacaaggagatcgctgcaacttgctcaggaacggaatggggccagtcttcgggcgccgcttctccaggcctctttcaggccggtcacaggcggacaccatccgaagccgaccgatggctagaagaggttagcaaaagtgtgcgggcccagcagccacaggcctccgctgcccccttacagcctgtactgcagccaccgccacccaccgccatttcccaaccagcgtcaccctttcaggggaatgcctttttaacctcacagccagtccccgtcggagtggtgcccgcgctacagcctgcgtttgttcccgcacagtcctatcctgtcgctaacgggatgccctatccagctccgaatgtaccggtggtcggaattacgcccagccagatggtcgcaaatgtgtttggaactgccggacatcctcaagctgctcatccccaccagagcccatccctagtgcgtcagcaaacttttccccactacgaggcctcatcagcaacaacctcacctttcttcaaaccacccgcccagcacctcaatggttccgctgcattcaacggagtggacgacgggagattggcaagtgccgacagacacaccgaggtgcccaccggcacttgccctgtcgacccctttgaggctcagtgggcggctctggaaaacaagtcaaagcagcgcaccaaccctagccccacaaacccatttagttctgatctgcagaaaaccttcgaaattgaactgtag

SEQ ID NO: 198045 - DNA, 777 bp, Artificial Sequence
  Description of Artificial Sequence: Synthetic coding sequence
atgaacaagctgcggcagagcttccggcggaagaaggacgtgtacgttcctgaggcatcccggccccaccaatggcagactgacgaggagggggttaggaccggcaaatgctcattcccagtaaaatatctgggacatgtagaggtggatgaaagtaggggtatgcacatctgcgaggacgctgtaaagcgcctcaaggccgagcgtaagttctttaaaggtttttttggaaaaacagggaagaaagcagttaaagcagtcctgtgggtaagcgcggatgggctgagggtagtcgatgagaagactaaagatctgatagtggaccaaactattgagaaagtgagtttttgcgcccccgaccgaaatttcgaccgtgccttttcttatatctgcagagacgggaccaccagacgatggatctgtcactgtttcatggccgtgaaagacactggagagcgactcagccacgcggtaggctgcgctttcgctgcctgtctggagcgtaaacagaaaagggagaaggagtgtggggtcacggctacctttgacgcatcccgcactacgtttacccgcgaggggtcttttcgcgtgaccactgccactgagcaagccgaacgcgaggagattatgaagcagatgcaggacgcaaagaaggctgagaccgacaaaatagtggtcggctcctccgtggccccgggaaatacagccccaagccccagtagccctacgtcccccacctctgatgctacaacttccctcgagatgaacaacccttag

SEQ ID NO: 198046 - DNA, 1812 bp, Artificial Sequence
  Description of Artificial Sequence: Synthetic coding sequence
atgaacaagctgcggcagagcttccggcggaagaaggacgtgtacgtgcctgaggcgtcccggccgcatcagtggcagaccgatgaagaaggcgtacgtaccgggaaatgctccttccctgttaaatacttagggcatgtagaagtagacgaaagcagggggatgcatatctgtgaggacgctgtgaaacgtctgaaagccgagaggaagttcttcaagggatttttcggaaagacagggaaaaaagcagtaaaggccgtgctctgggtgtccgctgacggcctgagagtggtggacgagaaaaccaaagatctcatcgtggatcaaaccattgagaaggttagtttctgtgcaccagatcgcaactttgatcgtgcattttcatacatctgcagagacggcactacgaggcgatggatctgccactgcttcatggcagtgaaggataccggagagaggctgagccatgccgtggggtgtgcatttgcagcctgtctcgaaaggaaacaaaaaagagagaaagaatgtggcgtaacagctacttttgatgcatccaggaccacatttactagagagggtagctttcgggtgaccactgcaacagaacaggccgaacgcgaggagattatgaagcaaatgcaagatgccaagaaggcagagacagacaagatagtagttggctcctcagttgcccctggtaacacagcccccagcccttccagcccgacttcccccacctctgatgccaccactagcctcgagatgaacaacccgcacgcaatccccaggcggcacgctcccatagagcaactcgcccggcagggatcatttcgaggctttcctgcattgagtcagaaaatgtcaccgttcaaacgccagctctccctgcggatcaacgaactgccttccactatgcagcggaaaactgatttcccaatcaaaaacgctgtcccagaagttgagggggaggccgagagcatcagttcattatgctctcagataactaatgccttttctacacctgaagatcccttttcaagtgctcctatgactaagccagttacagtggtggctccccagagcccaacgtttcaaggaaccgaatggggccagtcaagcggcgccgccagtcccgggcttttccaggctggtcataggagaactccctctgaggctgacagatggctcgaagaggttagtaagtcagtccgagcccagcaaccccaagcgtcggccgccccactccagccggtcctccagcctccaccaccgaccgcaatttctcagcctgcaagcccatttcaagggaatgcatttctgacgagccagccagtgcccgttggagttgtgccagcacttcagccagcgtttgttccagctcagagctatcctgtcgcaaacggcatgccatatccagctccaaacgttcctgtcgtgggcattaccccatctcaaatggtagctaacgtgtttggtacagcgggacatccccaggccgcgcacccacatcagtcccccagtctagtcaggcagcagacattccctcattatgaggctagttctgccaccacttccccttttttcaagccacccgcccagcacttaaatggaagcgccgccttcaacggggtcgatgacgggcgactggcttctgctgatcgtcacactgaggtgcctacaggaacctgcccagtggaccccttcgaggcccagtgggctgccctcgaaaataagagcaagcagcgcaccaacccttccccaactaaccccttctcgtctgacttgcagaagacatttgaaatcgagctgtag

SEQ ID NO: 198047 - DNA, 1923 bp, Artificial Sequence
  Description of Artificial Sequence: Synthetic coding sequence
atgaacaagctgcggcagagcttccggcggaagaaggacgtgtacgtgcccgaggcgtccagaccacaccagtggcagacagacgaggagggcgtacgcacagggaagtgctcttttccagtgaaatacctcggtcatgtcgaagttgacgaatcccggggaatgcacatctgcgaggatgccgtgaaacggcttaaggctaccggaaaaaaggcagtgaaagctgtactgtgggtttccgctgatggtctgagggttgtggacgagaagactaaagatctgatagttgaccaaaccattgaaaaggtctctttctgcgcccctgaccggaattttgacagggctttctcctacatttgtagagatggtaccactagacgctggatctgtcattgcttcatggcagtgaaagacaccggggaaagactgtcacacgctgtagggtgtgctttcgccgcctgtctggagaggaaacagaagagagagaaggagtgcggtgtcaccgccacctttgatgcgtccaggaccacttttaccagggagggcagcttccgtgtgacaaccgccaccgagcaggccgagcgtgaagaaattatgaaacagatgcaagacgccaaaaaagcagagacagataagattgtcgtcggatcctccgtggcccctggaaataccgcaccaagccccagttcacccaccagtccaacatctgatgccaccacatcccttgaaatgaacaatccacacgctattccgagacggcacgctcctatcgagcagcttgcaagacagggctcttttcgcggctttcccgccctgagccaaaaaatgtctccatttaaaaggcagttgtccctaagaattaatgagttaccctccaccatgcagcgcaagaccgacttccccattaagaacgccgtgccggaagttgagggggaagcagagtccatttcctcattgtgttcccagatcactaatgctttcagtacccccgaggacccctttagttcagcccccatgactaagcccgtgaccgttgttgctccacaaagcccaacattccaggctaatgggacggattctgccttccatgtgctggcgaagcctgcacacaccgcgttggcgcccgtggccatgcccgtgcgtgaaacaaacccctgggcccacgccccagatgcggcaaacaaagaaattgccgccacatgctccggcaccgagtggggccagagttcgggtgctgcttctcccgggctgtttcaggcgggacaccgcaggaccccttctgaggctgacaggtggttagaagaggtctctaagagcgtgagggctcagcagcctcaagccagcgcggctcccctgcaaccagtgctgcaacctcccccaccaacagccattagccagcccgcctcaccattccagggcaacgccttcctaacctcgcagcctgtccccgtgggtgtggtgccagcactgcagccagccttcgtacctgcccaaagctacccagtagcaaatggaatgccttatccagcacctaatgttccagtggtgggcatcacacctagccagatggtcgccaacgtttttggtacggctggacacccgcaggccgcacatccccatcagtctcctagtcttgtgcgacaacagacctttccacactatgaggcatcatccgcgaccacgtctcccttcttcaaacctccagcccaacacctcaacggctcagctgcatttaacggtgtcgatgacggcaggctggcatccgccgacaggcataccgaggtacccaccggcacatgtccagtcgatccatttgaggcccagtgggccgcacttgagaacaaatccaaacagcggaccaatccctccccaactaaccctttcagcagcgacttgcaaaagacatttgaaattgaactctag

SEQ ID NO: 198048 - DNA, 1830 bp, Artificial Sequence
  Description of Artificial Sequence: Synthetic coding sequence
atgagccggagcgccgccgccagcggcggcccccggcggcccgagagacatctaccacccgccccttgcggagcacctggaccgccagagacatgcagaaccgagcccgatggagctgggactatgaacaaactccgacaaagtttgcgccggcgcaagcccgcatacgtgccagaggctagcagaccacatcagtggcaggcagatgaggacgcagtgcgcaagggcacttgttcgtttcccgtcaggtatttaggacacgtagaagtcgaggaaagccgaggtatgcacgtttgcgaagacgctgtgaaaaaacttaaggcaatggggagaaagtcggtcaaatcggtgctctgggtgtctgccgacggcttgcgtgtcgtcgacgacaaaacgaaggacctcttagtagatcagacaatagaaaaggtgtccttctgtgcgcccgaccgcaaccttgacaaagccttcagttacatatgcagggatgggacaacccgtcgctggatctgccactgcttcctagcattaaaagattccggcgaacggcttagtcacgcagtgggctgtgcctttgcagcttgtctggagcgtaagcaacggcgagaaaaggagtgcggggttaccgcagcttttgacgccagtagaacctcttttgccagggagggatcctttcgcctgtccggaggaggccgccccgcagagcgtgaagccccggacaaaaaaaaagctgaggccgcggccgctccgactgtcgcacctggacctgcgcaacccgggcatgtgtcgcctacccccgcgaccactagtccgggagaaaagggagaagccggcacacctgtagccgccggcacgactgcagctgctattccccggaggcatgcacccctagagcaactggtgcgccagggatcgttccgaggcttccctgctctgagccagaaaaactcccccttcaagaggcagctgtcactgaggctcaacgaactgccctccactctgcaacgcagaacagattttcaagtaaaaggtactgtcccagagatggagccccctggcgccggcgacagcgacagcataaatgcactgtgtacgcagatcagcagttccttcgcttcagctggagcccctgccccgggtccacccccagccaccaccgggaccagcgcctggggggagcctagtgtaccacctgctgcagccttccagccaggacataagagaaccccctcagaagctgagcgctggctcgaggaagtgtcacaggtcgccaaagcacaacagcagcagcagcaacagcagcaacagcagcagcagcagcagcaacagcagcagcaggcagcttctgtagcacctgtgcccacaatgccacctgctctgcagcccttcccggctcctgtgggccctttcgatgctgcccctgctcaggttgctgtttttttacccccgccacacatgcagcctcctttcgtacctgcctaccccgggttgggctatcccccaatgcctagggttcctgttgtcgggattacaccatctcagatggtggccaatgccttttgcagcgcagcccaactgcagccacagccggcaaccttattagggaaagctggcgccttccctccccctgccattcctagcgccccaggctctcaggcgaggccacgtcctaacggggcgccctggcccccagagcctgccccggcccctgcccctgaactagaccctttcgaagctcagtgggccgctctcgaggggaaggctaccgttgaaaagcctagtaatccattcagtggggatctgcaaaaaacttttgagatcgagctttag

SEQ ID NO: 198049 - DNA, 1707 bp, Artificial Sequence
  Description of Artificial Sequence: Synthetic coding sequence
atgaacaagctgcggcagagcctgcggcggcggaagcccgcctacgtccccgaggcctccaggcctcaccaatggcaagctgatgaggatgccgtacgtaagggtacctgtagtttccctgtgagatacttgggccacgtggaggttgaagaaagtcggggcatgcatgtctgcgaggatgctgtgaaaaagctgaaagcaatgggccggaagtctgtcaaaagtgtcctctgggtatctgccgacggccttcgagtagtcgatgacaagactaaggacctgctggtggatcagaccatcgaaaaggtgtcattttgcgcacctgaccggaacctggacaaggctttttcttacatctgtcgcgatggaacaacgaggaggtggatctgccactgtttccttgcgctgaaggatagcggtgaaaggctgagccatgcagtgggatgcgcattcgccgcgtgtctggagcggaagcagcggcgtgagaaggaatgcggtgtgacagccgctttcgatgccagtagaacaagtttcgcccgcgagggatcttttcggttgtccggtggcgggaggcctgctgaacgggaggcccctgataagaagaaagcggaggccgcagccgcccctaccgtggcccctgggcccgctcagccggggcacgtttcaccaactccagccacaacctccccaggcgagaaaggcgaggcgggcacacccgtggctgcagggacgacggccgctgccatccctcggcgccatgccccgctagaacagttggttcggcaaggcagttttagaggatttcctgccctatcacagaaaaattctccatttaaacggcagctgtcactccgtctgaatgagcttccaagcacattgcagagaagaaccgacttccaggttaagggcacagtacccgagatggagccgccaggagcaggcgactctgactctatcaacgccttgtgcactcagatcagctcttcctttgcctcagctggggcgcccgcgccaggcccgccccccgccacaaccggcacttctgcttggggagagccttctgtgccccccgcagcggcctttcagccaggtcacaagcgcaccccctccgaagcagagcgctggttggaagaggtgagtcaggttgcgaaagctcaacagcaacagcagcagcaacaacagcagcagcagcagcagcaacagcagcagcaacaggccgctagcgtcgcccccgttcctaccatgcctccagctcttcagcctttccctgccccggttggtccgtttgacgctgccccggctcaagtcgccgtgttcctccctcctccacatatgcaacctccatttgtccccgcatatcctggccttggatacccacccatgcctagagtgcctgtagtgggaattacgccaagtcagatggtcgccaacgctttctgcagtgccgctcagttacagcctcaacccgccacccttctgggcaaggccggcgcttttccccctccagccattccctccgcaccaggcagtcaagcacggccaagacccaatggggcaccttggccacctgagcccgcgcccgccccagcaccagagttggatcctttcgaggcacaatgggctgctctggaagggaaggcaactgtggaaaaaccaagcaatccgtttagtggtgatctgcagaagacattcgagatcgagctttag

SEQ ID NO: 198050 - DNA, 1446 bp, Artificial Sequence
  Description of Artificial Sequence: Synthetic coding sequence
atgaagggccggggcatgctggtgctgctgctgcacgccgtggtgctgggactcccttctgcatgggctgttggcgcatgtgcacgggcgtgtccggctgcttgtgcctgtagcacggttgagcgaggatgctctgtgcgatgcgatcgagccggccttttgagggtcccagccgagctgccctgtgaggcggttagcatcgacctagaccggaatggactccgcttcctcggcgaaagagcatttggaactctcccctccctcagaaggttgagcctccgacataacaacttgtccttcatcacgcccggcgcattcaaaggccttcccaggttggccgagctcaggttagcacataacggcgacctgcggtacctccacgcccggacttttgccgccctctccagattgcggagattggacctcgcagcttgtagactcttttcagtgcctgagcgtctgttggccgaactgccggcactcagggaactcgccgcttttgacaacttatttagacgggtccctggcgcacttaggggcctagccaacctcactcatgcccatctcgaacgaggtcgcatcgaggcggtcgcctcctctagcctccaggggttgcggcgcctgcggagcttatcccttcaggcaaaccgggttagggcggtgcacgcaggcgctttcggggattgcggtgtgctcgagcatctgttgcttaatgataatttgctcgctgaacttccagcagatgcattcaggggtcttcggaggcttcggacattgaatttagggggtaacgcattggatcgggttgctagggcgtggttcgccgatcttgctgaactcgaactgctttacttggaccgcaactcgatcgcattcgtggaagagggagcattccagaacctgagcggtctgttggcccttcatttaaatggtaataggctcaccgtcctggcttgggtagcctttcagccgggttttttcctgggcagattgtttctgtttaggaatccatggtgttgcgactgtcgactcgaatggctcagagattggatggaggggtctggccgagtcactgacgtaccatgtgcatcccctgggagtgtcgcaggcttagacctgagtcaggtcaccttcgggagatcaagtgacgggttgtgcgtcgaccccgaagagcttaacctcactacctcttccccgggaccttctcccgagcccgctgcgaccaccgtgagccggttctccagtctcctatctaagctattagcgccccgagtgcctgtcgaagaggctgccaacaccaccggcggcttagcgaatgcctccctgtccgattctctgtcctcccgtggtgtgggcggtgccggacgccaaccttggttcctcctggcttcctgtcttcttccatctgtggctcagcacgtcgtgtttgggcttcaaatggattag

SEQ ID NO: 198051 - DNA, 1446 bp, Artificial Sequence
  Description of Artificial Sequence: Synthetic coding sequence
atgaagggccggggcatgctggtgctgctgctgcacgccgtggtgctggggttaccttcagcttgggccgtgggagcctgcgccagggcgtgtccagccgcatgcgcgtgctctaccgtggaaaggggctgctcagtcagatgcgatcgcgccggcctgttgagagtgccggccgagctgccatgtgaagctgtttccattgatctcgatagaaacggtcttagattcctgggggaaagggcttttgggacgcttccctccttgagaagattaagtctcagacacaataacctgtctttcatcaccccgggcgcctttaaagggctcccacgactggccgaacttagactagcgcacaatggcgatttgcgatacctgcatgctagaacattcgcagccctctccaggctccgacgactcgaccttgccgcttgcagactgtttagcgttccggaacgactgcttgccgagctacccgctctgcgggagctcgcggcctttgacaacctcttccgacgagtacctggagccctgagggggttagcgaacctgactcacgcccacttagagcgcggccgcatcgaagcagtggcctcgagcagcttacaggggctcagacgcctcagatccctcagcctccaagcaaatcgagtgagggccgtgcatgcgggagcctttggcgattgcggggtgcttgaacatttgctgctgaatgataatctgctggctgaactgccagccgatgcgtttagaggactgcgtcgactacggacactgaatctgggggggaacgctctggatcgggtagctcgcgcgtggttcgcagatctagccgagctcgagctattgtacctcgatcgaaatagcatagcctttgtggaggagggtgctttccagaacctgtccggcttattggccttacaccttaacggcaacaggttgactgtgctcgcctgggtcgcctttcagcccggatttttcttgggccggctgtttcttttcaggaatccgtggtgctgtgactgccgattagaatggttacgggactggatggagggatccggacgcgtgaccgacgtgccttgtgcgagtcctggcagcgtggcaggccttgacctttcccaggtgacgtttggcagaagctcagacggcctctgtgtggacccagaggagctcaatctgactaccagcagccccggaccatctcccgaaccagcagcaacaacagtgtcaagattctctagcctgctgagtaagctactggcccctcgggtgccagtggaagaagcagctaacactacaggcggacttgccaatgctagcctgtccgactctctgtcctctcggggggtaggcggggccggtcggcagccctggttccttctggcatcgtgcttgctgccaagcgtggctcaacacgtggtgttcgggcttcagatggactag

SEQ ID NO: 198052 - DNA, 1191 bp, Artificial Sequence
  Description of Artificial Sequence: Synthetic coding sequence
atgccccccaagaagggcggcgacggcatcaagcccccccccatcattggacgctttggcacctcactgaagatcggaatcgtcgggctgcccaatgtagggaagtccaccttttttaatgtgttgactaacagtcaggcctctgcagaaaactttcctttttgcactatcgatcctaatgagtccagggtccccgtccccgatgagaggtttgatttcctgtgtcaatatcataagcctgcttccaaaatccctgccttcttgaacgtggtggatatcgccggattggtcaagggggcccacaacggacaaggccttgggaatgcctttctctcacatatctccgcctgcgacggcatctttcacctcacacgggcctttgaggacgatgatatcacacatgtagagggaagtgttgaccccatacgtgacatcgagataatccacgaggaactgcagttaaaggacgaagaaatgattgggccaattatcgataaactagagaaagtggcagttagaggtggggataaaaagctcaaaccggagtatgacattatgtgcaaggtgaaatcttgggtgattgaccagaaaaagccagttaggttttaccacgactggaatgataaggaaatcgaggtgctcaacaaacatctatttctgacttccaagcctatggtgtacctcgttaatttgtctgaaaaagattatatccgcaagaagaacaaatggctgatcaaaattaaggagtgggtggataagtacgaccctggagcacttgtgattccatttagtggcgccttggagctcaagctgcaggagctgtccgctgaggaacgccagaagtatctggaagccaacatgacacagtcagccttgccaaaaataataaaggccggctttgctgcacttcagctggagtatttctttaccgccggccccgatgaagtacgagcctggaccataagaaaaggcacgaaggctccacaagctgcgggtaaaatccacaccgattttgagaaaggctttattatggccgaagtgatgaaatatgaagacttcaaggaagaaggctctgaaaatgctgtaaaggcagccggcaagtatcggcaacaggggagaaattatattgtcgaagacggagacatcatcttctttaaattcaatactccgcagcaacccaaaaagaagtag

SEQ ID NO: 198053 - DNA, 717 bp, Artificial Sequence
  Description of Artificial Sequence: Synthetic coding sequence
atgatcggccccatcatcgacaagctggagaaggtggccgtgcggggcggagacaagaagttgaaaccagaatacgatatcatgtgcaaagtgaagagttgggtcatcgatcagaaaaaacctgtccgtttctatcatgattggaatgataaggagattgaagtgctgaacaagcacctgttcctgacgtccaagccaatggtatatttagtgaacttatccgaaaaggattacatacgcaaaaaaaataagtggttgattaaaattaaagaatgggtcgataaatacgacccgggggctctggtgattcccttcagcggcgcactggaactgaaactacaggaactctccgcagaggaaagacagaagtatcttgaagctaacatgactcagtctgccctgcctaaaataattaaagctggattcgctgctttgcagcttgaatatttcttcacagcgggtcccgatgaagtacgtgcttggacaatccgcaaagggactaaagcccctcaggcagcagggaaaattcacacagatttcgagaaaggattcattatggcggaagtgatgaagtacgaagattttaaggaggaaggttccgaaaatgccgtgaaggccgcaggtaaatatagacagcaagggcggaattacattgtagaggatggcgatattatcttcttcaagttcaatacccctcagcagcccaagaaaaaatag

SEQ ID NO: 198054 - DNA, 1251 bp, Artificial Sequence
  Description of Artificial Sequence: Synthetic coding sequence
atgagccggaccttcagcgccaagggcggccgggacctggtggaggggccccaatacctaatgccccctaagaagggcggcgatgggatcaaaccaccgcctataatcgggcgctttggaactagtctcaagatcggaatcgttggccttcctaacgtggggaaaagtacattcttcaatgtgctaacgaattctcaggcatctgcggaaaacttccccttctgcaccatcgacccaaacgaaagtcgagtgccagtcccggacgagaggtttgacttcttgtgccagtaccataaaccggcttcaaaaatccccgcatttcttaacgttgtcgatatagcaggtttggtgaaaggtgcgcacaacggccagggactaggcaatgcgttcctcagtcacatctccgcgtgtgacggtatttttcacctgactcgtgctttcgaggatgacgatattactcatgttgagggcagtgtcgatcccatcagagacatcgagattatacacgaagagttgcaactgaaagacgaggagatgatcggcccgattatcgacaaacttgagaaagtggcagtccggggaggggacaagaaacttaagcccgagtacgacattatgtgcaaagtgaagtcctgggtcattgatcagaagaagcctgtaaggttttatcacgattggaatgacaaggagattgaagtgctaaataaacaccttttccttactagcaagccgatggtgtacctggtgaatctgtcagagaaggactacattcgcaagaagaacaagtggctgatcaaaattaaggaatgggttgacaaatacgatcctggagccctagtgattcctttctctggggcgctcgaactgaaactgcaagagctgtccgcggaggaacgccaaaaatatctggaagcaaatatgacacagtccgcactgcccaagataataaaagctggattcgcagctctgcaattggagtacttttttaccgcaggccccgatgaggtgagagcctggacaattagaaagggcacaaaagccccccaggctgcgggaaaaattcacactgactttgaaaagggttttataatggctgaggtgatgaagtatgaggatttcaaggaagagggcagtgaaaacgcggtgaaagctgctggcaagtacaggcagcaagggcggaattatatagttgaagacggcgatattatatttttcaagtttaatactccccagcagccgaaaaaaaaatag

SEQ ID NO: 198055 - DNA, 351 bp, Artificial Sequence
  Description of Artificial Sequence: Synthetic coding sequence
atgccccccaagaagggcggcgacggcatcaagcccccccccatcatcgggagatttggcactagtctgaagattggcattgtcgggctgcctaatgtcggtaaatccacgttctttaacgtcctgaccaattctcaagccagcgctgagaactttcctttctgtacaatcgatcctaacgagagtcgggtccccgtacccgatgaacgctttgacttcctgtgtcagtatcataagcctgcgtctaaaatcccagccttcttgaacgtggttgatatcgcaggccttgtgaagggggctcataacggtcagggactcggcaatgctttcctgtcccatatatctgcatag

SEQ ID NO: 198056 - DNA, 837 bp, Artificial Sequence
  Description of Artificial Sequence: Synthetic coding sequence
atgccccccaagaagggcggcgacggcatcaagcccccccccatcataggccgcttcggcacctcgttaaagatcggtatcgtcggactccctaatgtggggaagagcacttttttcaacgtactaaccaactcacaggcgagcgccgagaactttcccttctgtacaatcgatcctaatgagtcaagggttccagtgccagacgagcgctttgatttcttgtgtcaataccacaaacccgcctcaaagataccagcatttttgaacgttgttgatattgccggccttgtgaaaggcgcccacaacggccagggcttaggcaacgcattcttaagtcacattagcgcctgcgacggaatcttccatcttacaagggctttcgaagatgacgacatcacacacgtcgaaggcagtgtagatcccatcagagacattgagattattcacgaagagcttcaactaaaggacgaggagatgattgggccgatcattgataagctcgaaaaagttgcagtgagaggcggggataagaaactcaaacccgaatatgacattatgtgcaaagtaaaaagctgggtgatagatcaaaagaaacccgtgaggttttaccatgactggaacgataaggagattgaagtcttgaacaaacacctgtttttgacaagtaaaccgatggtttatcttgttaacttgagcgaaaaagattatatccgaaagaagaacaagtggctgctggagtcaaccgacaacaaggccgagattattctacttaagatggagattttgtcaagctccaacctcactcacctgaataataggcgaagaaataaaatatag

SEQ ID NO: 198057 - DNA, 312 bp, Artificial Sequence
  Description of Artificial Sequence: Synthetic coding sequence
atgatcggccccatcatcgacaagctggagaaggtggccgtgcggggcggagacaagaagcttaagccggaatatgatattatgtgtaaagtgaaaagctgggtcatcgaccaaaagaaaccagtgcgcttttaccacgactggaacgataaggagatcgaagttttaaataagcatctcttcttaacgagcaagcccatggtttatcttgtcaaccttagcgagaaggattatatcaggaaaaagaacaagtggttgatcaaaattaaagaatgggtggacaaatacgatcccggcgccctggtcatctag

SEQ ID NO: 198058 - DNA, 1329 bp, Artificial Sequence
  Description of Artificial Sequence: Synthetic coding sequence
atgtgcgagctgagccgggaggacgcccccgtgcggtggtacaaggacgggctcgaagttgaggagagtgaggctttagtgttggaaagagacggccctagatgtaggctggtcctacccgccgcccaacccgaggacggaggagaatttgtatgcgacgcaggagacgactctgctttttttacagtgaccgtgaccgctcctcctgagagaattgttcatccggcagcccgtagcctagatctgcatttcggcgcacctggtcgagtcgagttgcgctgtgaagtcgcccccgccggtagtcaggtgagatggtataaggatggtctggaagtggaggcttccgatgccctacaactcggagcagaaggccccacccgcacccttacattaccgcacgctcagccggaggatgccggtgagtacgtctgtgagacaagacatgaggcgataacattcaacgttatcttggctgaacctcccgtccagttcttggcccttgagaccaccccttctcccctgtgcgttgcccctggcgagccagtagtcctgagctgtgagctcagccgcgccggagcccctgtggtgtggtcacacaacggtagaccagtccaagaaggagagggcctcgagctgcatgcagagggcccccgacgcgtcctttgcatccaggctgcgggtccggcccacgcaggcctgtacacttgtcagagcggcgccgccccaggcgcaccctccctcagttttactgtacaagtcgccgagcctttgttagtgaagctggtgagtgaactgactcccttgaccgtgcacgaaggtgatgatgctaccttcaggtgtgaggtttccccacctgacgcagacgtcacatggttacggaatggtgccgtcgtgaccccagggccgcaggtcgaaatggcccagaacggttcctctcgcattcttactctaagaggctgtcagctgggggacgccggtacagttacgcttagggccggatccacagctacgagtgcacggctgcacgtacgagaaacggaactgctttttctgcggcgcctgcaggatgtgagggccgaggaggggcaggacgtttgtctggaggtggagaccgggagggttggtgctgccggagcagtgagatgggtgagggggggacagcccctgccccacgacagccgtctgtcaatggcccaagatggacatatccatagactgttcattcatggggttattctggccgaccagggaacctacggatgcgagtctcaccacgatcgaacactggctcgcctgtcagttagacgggagtgccctgtactgagctag

SEQ ID NO: 198059 - DNA, 4206 bp, Artificial Sequence
  Description of Artificial Sequence: Synthetic coding sequence
atgaaggccagcagcggcgaccagggcagccccccctgcttcctgcggtttccaaggcccgtgagagtggtgtctggagccgaagctgagttgaagtgtgtagtgctgggggagcccccaccggtggtcgtgtgggaaaaaggcggccagcagctcgccgcctctgagcgactatccttccccgccgacggtgcagagcacggactgctgttgactgccgccttaccaactgatgccggcgtgtatgtgtgtagggcccgaaacgctgctggcgaagcatacgcagcagccgccgtgaccgtcctcgagccgcctgcatcagatccagagctccagcccgctgaacggccactaccctcccccggctcgggcgagggggcacccgttttcctgaccgggcctcgctcccagtgggtgctgaggggggcagaggttgttctaacttgccgcgctgggggcctaccagaaccaacactgtattgggagaaagatggaatggcactggacgaggtgtgggactctagtcactttgcactgcagcccggaagggcagaggatggtcccggagcctccctggcgctgagaattctcgcagctagattgcccgactcaggagtctatgtttgccatgctagaaacgcccacggccatgcacaagccggcgctctcctgcaggtgcaccaaccgcccgagtctcctccggccgatccagatgaggcaccggctcccgtagtggagcctctgaaatgcgctcccaagacgttctgggttaatgaaggcaaacatgcaaagttcagatgttacgtgatgggcaaacccgaaccggagattgagtggcattgggagggcagacctctcctgccagatcgacgtcgcctcatgtatcgagaccgtgacggaggcttcgtcctgaaagttctctattgtcaggccaaagacagggggctctatgtctgcgctgcccgcaatagcgcggggcagactttatcagctgtgcagctccatgtcaaggagcctcgcctgagattcaccagacctcttcaggatgtagagggcagggagcacgggatcgccgtgctggaatgcaaagtgcctaactcacggatcccaaccgcctggttccgcgaagatcagaggctgctcccttgcagaaagtacgagcagattgaagaagggacagtcagaaggctgatcatccataggctgaaggcagacgatgacggcatctacctgtgtgagatgcggggtagagtgcgaaccgtggctaacgtgacggtaaagggccccatattaaagagactgccaagaaagcttgacgtgttggaaggagaaaatgctgtgcttctagtggagaccctggaggccggcgtagaaggtagatggtctcgcgatggggaggagctccccgtgatctgccagtcctcctctgggcatatgcatgctctggtattgccgggcgtgactcgtgaggacgccggtgaagttaccttctctttggggaatagccggacgacgaccctcctaagggttaaatgcgtgaagcattctccacctggtcctcctatcctcgccgagatgtttaagggccacaagaataccgtgctgctgacctggaaacctcccgagccggcacctgagacacccttcatttaccgactggagagacaggaggtggggtcagaggactggatccagtgtttttcaatcgagaaagccggcgccgtggaagtgcctggcgactgcgtgccatcagagggagactacagattccggatttgtactgtttccggccacggtcgttcgccccatgttgtgttccacgggtccgcccacttagtcccaactgccagactggtcgcagggctggaagatgttcaggtctacgacggggaagatgctgttttcagtctcgacttgtcgactattattcagggtacgtggttcctgaatggagaagaacttaaaagcaacgagccagaagggcaagtggaacctggtgcactgcggtatcggatcgagcagaaaggactgcaacaccgactgatattgcatgcagtgaaacaccaggacagcggagccctcgtgggtttcagctgccccggggtgcaagattcggcagccctgaccatacaagagagcccagtacacatactctctccacaggatagggtaagtcttaccttcaccacatcagagcgagtggtgttgacatgcgaactgtcgcgggtggactttccagccacttggtataaggacggacagaaagtggaggagagcgaactgctcgtagtgaagatggacggacgaaagcaccgactcatcttgcccgaggctaaagtgcaggattcgggggaatttgaatgcagaaccgagggtgtgagcgcttttttcggtgtcactgttcaggatcctcccgtacacatagttgaccccagggaacatgtcttcgtgcacgctatcacctctgagtgcgtcatgctggcctgcgaggtcgatcgggaagatgcgcccgtgaggtggtataaggacggccaggaggttgaggaatcggacttcgtggtccttgagaacgaaggtccacacaggcggcttgtgctccccgccacccaacctagtgatggcggagagttccagtgcgtggcgggcgacgagtgcgcatacttcactgtgacgatcaccgatgttagtagttggatcgtgtacccaagcgggaaggtgtatgtggccgcggtccggctggagcgagttgtgctcacatgtgagttgtgccggccgtgggctgaggtgaggtggaccaaggacggggaagaggtcgtggaaagtcccgcactcctgctccagaaggaggacaccgtccggagactggtgcttcccgcagtccaactggaggacagtggggaatacctgtgtgaaatcgatgatgaatccgcatctttcacagtgaccgttacggagccacccgtccgcatcatctacccccgggacgaagtcactttgatcgcagtcaccctcgagtgtgtggttctcatgtgcgaactgtctcgcgaagacgccccagtcaggtggtacaaggatggacttgaagtggaagaaagcgaagccctcgttctggagagagatggccctcgctgcaggttggttttgccagctgcccagcccgaggatggcggtgaattcgtgtgcgatgccggcgacgattccgccttttttactgttactgttaccgaaccaccagtgcagtttcttgctctagagaccaccccgtcccccctgtgtgtggcccccggggagcctgtcgttcttagttgtgagctcagtcgcgctggcgcacccgtggtttggtcacataacgggaggcccgtacaggagggcgaaggcttggagcttcacgcagagggcccaagacgggtcctgtgcattcaggccgccggtccggcacatgctggactgtatacatgccagtcaggtgccgcccctggcgccccgagtctctctttcaccgtgcaggtcgctgaacccccggtgcgagtcgttgcacccgaggctgcgcagacacgggtgcgctctacaccaggaggtgacctggaactggtggttcacctctcgggcccaggaggaccagtaaggtggtacaaggatggcgagagattggctagccagggcagggttcagcttgagcaggcaggtgccaggcaggttctccgggtccagggtgcccgttccggagacgcgggtgagtacctatgcgacgccccacaggattcaaggatctttctagtgtcagtggaggaaccgctcctagtgaagctcgtgagcgagttgacccccctcaccgtgcacgagggcgatgatgccactttccggtgcgaggtctcgcctcccgacgccgatgtcacatggctgcggaacggcgcggtggtcacacccggacctcagcgccagtcctgttgttcctatggcggatgtcggatgtgcggacagagaaaggcacgaatgtgcgtcagcaagtggcgccaagcggagtgggtgcagcggggaccatgcgcaggctgtgaagtcggatcaccctgtccgacaacactagcttgcccttggccaagaatggggacctcaacggccagctccagcatggtgagttactggccaacccgcgccccaaccgcagcccgggctacaacaattgcaccgtggccgggatccgcttag

SEQ ID NO: 198060 - DNA, 3078 bp, Artificial Sequence
  Description of Artificial Sequence: Synthetic coding sequence
atgaaggccagcagcggcgaccagggcagccccccctgcttcctgaggtttcctagacctgttcgggtggtcagcggagcagaggccgagctgaaatgcgttgtgctgggggaaccccccccagtcgtggtttgggagaaggggggtcagcagctcgctgcttcagaaaggctgtcttttcctgcagatggggccgagcacggtctgctcctgacagccgctctacctactgacgccggcgtctacgtgtgcagggcccgtaatgctgcgggcgaggcctacgctgccgcggctgtcactgttctcgagccacccgcttcggaccccgagctgcaaccagcggaaaggcccttgccctcacctggatctggagagggcgctccagtttttctgacagggccaagaagccagtgggtcctgaggggcgccgaagtggtcctcacctgtcgcgccggagggcttcccgaacctaccttatactgggagaaagatggaatggccttggacgaagtttgggactccagtcacttcgctctgcaaccgggaagagctgaggacgggcccggcgcctccctggctctcaggatcctcgccgcccgcttgcctgattccggggtctacgtgtgccacgccaggaatgcacacggtcatgcccaagctggcgccttgctgcaggtgcatcagccaccagaatcacctcctgctgatccagacgaggcccctgctcccgtcgtcgagcccttgaagtgcgcccctaaaacattttgggtcaacgagggtaaacacgccaaatttcggtgctacgtgatgggaaagcccgagccagagattgaatggcattgggagggacgcccactgctgcccgaccgtaggagactgatgtaccgtgacagggacggtgggttcgtgctgaaagtcctctactgtcaggctaaagaccggggcctctatgtgtgcgccgccaggaacagtgctggacagactttatcagccgtccagctacacgtgaaggaacctcgtctcagattcaccaggcctctccaggacgtagagggccgtgaacacggaattgcagtgcttgaatgtaaggtaccaaatagccggatcccgaccgcctggtttcgggaggaccagcgcttgctcccatgccgaaagtatgagcagatcgaggaggggacagtacggcgattgataatccacaggctgaaagccgacgacgatggaatctatctctgcgagatgcgaggacgcgtaaggaccgtggctaatgtgactgtcaaaggacctattctcaagaggcttccaaggaagctcgacgtgctagagggggagaacgcagtgctgctggtagaaaccctcgaggctggcgttgaggggaggtggagtagagacggtgaggaactgcctgttatttgtcagtcttcttcggggcacatgcatgctctggtcctgcctggagtaacaagggaagacgccggcgaagtgactttctcactgggaaactcccgcacaaccacccttttacgtgtgaaatgcgtgaagcatagcccccccggacctcctatccttgcagagatgttcaaagggcacaagaacaccgttctgctgacctggaagccacccgagcctgcgcctgaaacaccattcatttataggctcgagcgacaggaagtggggagcgaggactggattcagtgtttctcaatcgaaaaagccggagcagtcgaggtccctggggattgcgtcccctcagagggagactatagattcaggatctgtacagtctccggacatgggagatctccccatgtcgtttttcacggcagcgcccatctggttcctactgcccggttggtggcgggactcgaagatgtgcaggtgtatgatggggaggatgcggtgttttccctagatctgtccacaattattcagggaacatggttcttgaatggcgaggagctgaagagtaatgaacccgaaggacaggtggagccaggggccctgcgttaccgaatagagcagaaaggcttgcaacacagactgatactacatgcggtcaaacaccaggactcaggggctctggtcggattttcatgccctggtgtgcaggactctgctgcccttacaatccaggaatctccagtccacattctctccccccaagatagagtgagtctcacttttaccacctccgagcgggtcgtattgacctgcgagctatccagagtggatttccctgctacctggtataaggacggccagaaagtcgaagagagtgagctcctcgtggtgaaaatggatgggaggaaacaccggcttatcctgcccgaggctaaagttcaggattccggcgaatttgaatgtcgcaccgagggtgtgagcgctttctttggggtgacggtccaggaccctcccgtgcacatcgtggatccaagagaacacgtgtttgtgcatgcaatcactagcgaatgtgttatgctagcctgtgaagttgatcgggaagacgcacccgtgcgctggtacaaggatggccaagaggtggaggaaagcgacttcgtcgtcttggaaaacgaagggccccaccgaaggctagtccttccagctactcagccttctgacgggggtgaattccagtgtgtggcaggggacgagtgcgcctacttcactgtgactattacggatgtgtcctcctggatcgtgtatccatccggcaaggtgtatgttgccgctgtgaggcttgaacgcgtcgtgctgacctgcgaactgtgcagaccatgggccgaagtcagatggactaaggacggcgaagaggtcgtggagagcccagctctgctgctccagaaagaggacactgtcaggaggctggtgctgcctgccgtgcagctggaagattcaggcgagtacttgtgtgagattgacgacgaatccgcctcctttacagtaacagtgacagagtcataccagtcacaggactctagtaataacaatccagagctctgcgtgctgctgaaaaagcccaagacaagacggctctggagcagatttcctccatggaggagaactgccggtactgagtag

SEQ ID NO: 198061 - DNA, 5691 bp, Artificial Sequence
  Description of Artificial Sequence: Synthetic coding sequence
atgaaggccagcagcggcgaccagggcagccccccctgcttcctgcgttttcccagaccagtgcgcgttgtgagcggagcggaggctgaactcaaatgtgtggtcctgggagagccacctcctgtggtcgtgtgggagaaaggcggccagcagctggctgcgagtgaacgactaagctttccagccgacggcgccgaacacggtctgctgttaactgccgcattgccaacggatgccggggtatacgtgtgccgggccagaaacgccgcaggcgaagcctacgcggctgctgctgtgaccgtgctggagccgccagccagcgatccagaactgcagccagctgaaaggcctttaccctctccaggaagtggcgagggggcaccagtctttctaacaggtcccagaagtcagtgggtgctgaggggtgccgaagttgtcttgacttgcagggctggtggtctccctgaacccacattatattgggagaaggatgggatggccctcgacgaagtctgggattcttcacacttcgctttgcagccaggccgggctgaggacgggcctggtgctagtctggctctcagaatcctcgctgccagactccccgattcaggggtgtatgtgtgtcatgccaggaacgctcatggtcatgcacaagctggagctctgctgcaggtgcaccaaccccccgagtctccccctgctgatccggatgaagcccccgcccctgtggtcgaaccccttaagtgtgcacccaagacattttgggtgaacgagggcaaacacgcaaagtttagatgctatgtcatgggtaagcccgaacccgaaatcgagtggcactgggaaggccgacctttgctgcccgaccgccgcaggcttatgtaccgcgatagggacggggggtttgttcttaaggtgctttattgtcaggcaaaagataggggactctatgtgtgcgccgcccgcaacagcgctggacagacccttagtgccgttcagctccatgtgaaagaaccaagactccggtttactcgccccctgcaggatgtggagggacgagaacatggtattgccgtcctggagtgtaaagtccctaactcccgcattccgacagcttggtttagggaagaccaaagactgttgccatgccgaaaatacgagcagattgaggaggggaccgttaggagactgattatccatcgactgaaggccgatgacgacggaatatacctttgcgagatgcggggcagagtgcgcaccgtagcaaatgtcacagttaaggggcccatcctgaagcgcttacctcgaaagcttgacgtgctggaaggtgagaatgccgtgctcctcgtggagacccttgaggccggcgttgagggtcgatggtcccgcgacggagaggaactacctgtgatttgccaatcaagctcaggccacatgcacgcacttgtgcttccaggcgtaaccagagaagacgccggggaagtgaccttttctttaggcaacagtcggaccacaactcttctgagggtcaaatgtgtcaagcacagcccaccaggcccccctatactggcagagatgttcaaaggccacaaaaacacagtcttgctgacctggaagccccccgagccagctccagagactcctttcatctaccgcctggagcgccaggaagtaggctccgaagattggattcagtgtttttctatcgaaaaagccggagccgttgaagtgcccggcgactgtgtgcctagcgagggagattacagatttcgtatttgcacggttagtggtcatggacgttccccccatgttgtatttcatgggtcagctcaccttgtgcctacggccagactggtcgctgggctggaggatgtgcaggtctatgacggcgaggacgcggtatttagcctggatctcagcaccattatccaggggacctggtttcttaatggtgaagagctgaagtctaatgaaccagaaggccaggtagaacccggcgccctgcgatatagaatcgagcagaagggcctgcagcaccgcttgattctgcatgctgtcaaacaccaggatagcggcgccctcgtgggtttttcctgcccaggcgtgcaggacagcgccgccctgaccattcaggaatctccagtccatatcttgtcgccccaggatcgtgtgtccctgactttcaccacgagtgaacgcgtggtgttgacctgcgaactatcaagagtagacttcccagcaacctggtacaaagacggacagaaggtggaagagtcagagttgctcgtcgtcaagatggacgggagaaagcatcggctgattttgccagaagcgaaagtacaggacagcggtgagttcgagtgccgaacagagggcgtctccgccttcttcggtgttaccgtacaggacccgcccgtgcatatcgtggacccaagggaacacgtgtttgtacacgccatcaccagcgagtgcgtaatgctcgcttgcgaagtggacagggaggatgcaccggtgcgatggtataaagacgggcaagaggtggaggaaagtgactttgttgttctggaaaatgagggaccccatcgccgtttggtattacccgctacgcaacccagtgacggcggcgagttccaatgcgtggctggagatgagtgcgcatacttcaccgtcactattacagacgtgagtagctggatagtgtatccttctgggaaagtgtacgtagccgcagtgcggctagaaagagtggttctgacgtgtgaattgtgccgcccatgggccgaggttaggtggaccaaagatggggaagaggtggttgagagtccggcactcctgctgcagaaggaggatacagttaggcgcctggtcctgcctgccgttcagctggaagatagcggagagtacctgtgtgagatcgatgatgaatccgcgtccttcaccgtcacagttacagaaccaccggtccgcatcatctatccgagagacgaagtgactctcatcgccgtgacacttgagtgcgttgtgctcatgtgtgagctgagtagggaggacgctcctgtaaggtggtacaaagatggcttagaggtagaggaaagtgaagccctggtgctcgagagggacgggccacgctgcaggcttgttctgccggctgcccagccggaggatggaggggagtttgtctgcgacgctggtgacgatagtgcattctttacagtcacagtgacagctcctccagaaagaatcgtgcatcccgccgcacgatccttggatctccatttcggggccccaggccgcgtggagttgcggtgcgaagtggcaccagccggctcacaggtgaggtggtacaaggatggcttggaagtggaggcaagcgacgccttgcagctgggtgccgagggccccacacgtaccctcaccctgcctcatgctcagcccgaggatgctggcgagtatgtgtgtgagactcggcatgaggccataaccttcaacgtcatcctggccgagccgcctgtgcaattcttggctttagagaccacaccttccccactgtgcgtcgctcccggcgagccagtggtgctctcttgcgaactcagcagagccggggctcccgttgtgtggtcacacaacggccggcctgtccaggaaggcgagggactggaactgcatgctgaaggacctagacgtgtgctgtgcatccaggctgctggtccagctcatgccggtctctacacatgtcaatctggggccgctcccggagccccttctttgagctttaccgtgcaggtggcagagcctccagttagggtggtggcccctgaggcggcacagacccgcgttcggtctaccccgggtggagaccttgaactcgttgtgcacttatccgggcctggaggtcctgtccggtggtacaaagacggggagcgtttggccagtcagggtagagtccagctggaacaagcaggcgctcgccaagtgttacgcgtgcagggagcgagatcaggtgacgcaggggagtacctatgtgatgccccccaggactcccgcatcttcctggtgagcgtggaggaaccactcttagttaagctggtgtccgaactcactccactaaccgtgcatgaaggggatgatgccacatttagatgcgaagtgagccccccagatgcagatgtgacctggctacgtaatggagccgtggtgaccccaggcccgcaggtggagatggcccaaaatggctcctcccggatcctgacactgcgaggttgtcagttaggggatgcaggaacagtgacactgagggccggatctaccgctactagtgcgagattgcatgtacgggaaaccgagttactttttcttcggcgcctgcaggacgtcagggccgaagaaggacaggacgtctgcttggaggtcgagactgggcgtgtgggggcggctggcgccgttagatgggtgagggggggccaaccgctgccacacgattcccgcctgtccatggcacaagacggccatatccacagattatttattcacggggtgatcctggccgaccagggtacatatgggtgcgaatctcaccacgatcggaccctcgccaggcttagcgtccgtcctagacagcttcgcgtgctccgcccactggaagacgttaccattagcgaagggggaagcgccaccttccagctcgagctgagccaggaaggggtgaccggggaatgggccagaggtggggtgcagctctacccaggcccaaagtgccacatccatagcgatggacaccgtcatcggcttgtcctgaatggtttaggcttagctgacagcgggtgtgtctcatttacggccgactccctccgctgcgccgcaagactgattgtcagagaggtgcccgtgaccatcgtgcggggcccacatgatctggaggtcaccgaaggcgataccgctacttttgagtgtgagttgtcccaggccctggcggacgtgacttgggagaaggacgggaacgcactcacccctagtcctcggctgcgcctccaggcattggggacccggaggctgttgcagctacgcagatgcggccccagcgacgctgggacgtatagttgtgccgtgggaacggctcgtgctggtcccgtaagactcacagtgcgcgagaggaccgtggcagtgctgtctgagcttcggtccgtatcagcccgcgagggagacggcgctacctttgagtgtactgtttccgaggttgagacgactgggcggtgggaacttggaggcaggccactgagacccggtgcccgggtgcgcatccgacaggagggaaaaaagcatatcctggtcctgtctgagttaagggctgaggatgccggagaggtcagatttcaggcaggcccggctcagtccctcgccctcctggaagtggaggccctccccctgcagatgtgtcggcaccccccaagagaaaagactgtcctagtaggccggagggcagtgctggaggtcactgtttcgcgctctggcgggcatgtttgctggcttagggaaggggccgagctctgccccggggataagtatgaaatgagaagccacggccctacacacagcctggtcattcatgatgtacgccctgaagatcaaggaacctactgttgccaagcaggacaggactcgacccatactcggctcctcgtggagggcaattag

SEQ ID NO: 198062 - DNA, 2682 bp, Artificial Sequence
  Description of Artificial Sequence: Synthetic coding sequence
atggagccccccctgcccgtgggcgcccagcccctggccaccgtggaaggcatggaaatgaaagggccacttcgtgagccatgcgccttaacattagcacaaaggaatggccaatatgagctgattatacagctgcacgaaaaggagcaacacgtacaggacattattccaattaattctcactttcgatgcgttcaggaagctgaggaaacactgttgatcgatatcgccagtaactcaggatgtaaaattcgggttcagggggactggatccgtgagaggcgcttcgagattccagatgaagagcactgcctgaagtttttaagtgcagtgttggcagctcagaaagcacagagccagcttctagtacctgaacaaaaagatagcagcagttggtaccaaaaattggacactaaagacaagccttcagtattttcgggtctcctaggcttcgaggacaacttcagcagcatgaatcttgataaaaagattaacagtcagaatcagccgaccggcatccatcgggagccccctcctccccctttctcagttaacaaaatgcttccacgtgaaaaagaggcatctaataaggagcagcctaaggttacaaacactatgcgcaaactcttcgtgccgaatacacagagcgggcaacgggagggtctgattaagcacatcctcgctaaaagagagaaggagtacgtcaacatccagacattcaggttctttgtgggcacatggaatgtgaacgggcaatcgcccgattcaggcttagaaccctggctgaattgtgatccaaatccccctgatatatactgcatcggtttccaggaactggatctgtctacggaggcctttttctatttcgaaagtgtgaaggagcaggagtggtcgatggccgtcgaaagaggcctgcactcaaaggctaagtacaaaaaagtccaactggtccgccttgtgggaatgatgttgctgattttcgcccgcaaggatcagtgcaggtatattagggatattgctactgagactgtaggaactggcatcatggggaaaatgggcaacaaaggcggagttgcggttcgtttcgtgtttcacaacactacattttgcatagtgaacagccatttggcagcgcatgtcgaagacttcgagcgaaggaaccaagactacaaggatatttgtgctcggatgagtttcgtggtgcccaaccagactttgccccaacttaacatcatgaaacatgaggtggttatatggctgggcgatctgaactaccggctatgcatgcccgacgccaacgaagtcaagagcctgattaataagaaggacctgcaacgcctcttgaagtttgatcagttgaatatccagaggacacagaaaaaagcgtttgtggacttcaacgagggtgagatcaaatttatacctacgtataagtacgactcaaaaactgatagatgggactcatctgggaagtgtcgtgtccctgcctggtgcgaccggatcctctggcggggaacaaacgtgaaccagcttaactatcgttctcacatggagttaaaaaccagtgaccacaaacctgtctctgccctcttccacattggtgtgaaagtggtggacgagaggcgttatcgaaaggtctttgaagactccgtgcgtattatggacagaatggaaaacgactttctcccatccctggaattgagcaggcgtgagttcgtcttcgagaatgtgaagtttcgtcagctccagaaggagaaattccagatttctaataacggacaggtgccttgccacttcagctttatacctaagctcaacgattctcagtattgtaaaccctggttgagggctgagccatttgaagggtatctggagcctaatgaaaccgtggacatcagtctggacgtgtacgtaagtaaggactccgtcactattctgaattccggcgaggacaagatagaggacattttggtgcttcatttggatcgcgggaaagactattttctgaccatttccgggaactatttgcccagttgcttcgggacctctcttgaggcattgtgtcgtatgaaaagacctatccgcgaagttcccgttaccaaactaattgatctggagaaaagcctgctacagatggtgcccttggacgagggagcctcagagagacctctccaggtccccaaggaaatatggctgctggtggatcacttgtttaaatatgcctgccaccaggaagaccttttccagacacctgggatgcaggaagaactgcagcagattattgattgtttggatacttccattcctgagacaatccctggttccaatcattctgtcgcggaagccctcttgatcttccttgaagccctgcctgagcccgtgatctgctacgaactgtaccagagatgtctcgattcagcttacgatcccaggatttgtcgccaagtgatctcccagctcccccgctgccatcggaatgtgttcagatatctgatggctttcttaagagagctgttgaaatttagcgaatacaactccgtcaatgctaatatgatcgctaccctgtttacctccctgttgttacggccacctcccaacctcatggcgcggcagacgccgagtgatcgacagcgtgcaatccagttcctgctgggttttctgctaggctcagaggaagactag

SEQ ID NO: 198063 - DNA, 2706 bp, Artificial Sequence
  Description of Artificial Sequence: Synthetic coding sequence
atggagccccccctgcccgtgggcgcccagcccctggccaccgtggaaggcatggagatgaaaggacctctacgtgagccctgcgcgctaactctggcgcagcggaacggccagtatgaactgattatccaactccacgaaaaagaacagcatgttcaagacattataccaatcaatagccattttcggtgcgtacaggaggccgaggagacactactcatcgacatcgcatcaaatagcggctgcaaaatcagagtgcagggcgattggattcgggaacgcaggttcgagatccctgacgaggagcattgcctcaagtttctgtccgctgtcctggccgcccagaaggcccagagccaactcctggttcccgagcagaaggacagttcttcttggtatcagaaactggacaccaaggataaaccgtccgtgttttctggtctgctgggctttgaggataattttagttccatgaatcttgacaaaaagattaattcccaaaaccagcctaccgggattcaccgagagccacctcctccccccttttcagtgaataaaatgttgccacgagaaaaggaggccagcaataaagagcaaccaaaagtgacgaacacaatgagaaagctgttcgtccccaatacacagtccggccagagagaaggcctgatcaaacatattctggctaaaagggagaaagagtatgtaaatatacagaccttccggtttttcgttggcacatggaacgtgaacggacaatcaccggacagcggtctggagccctggctcaactgtgacccaaacccacctgacatttattgcataggtttccaggaattggatttatctactgaggcatttttttacttcgagtctgtcaaggaacaggagtggtcaatggctgttgagcgcggcctgcactcaaaggccaagtacaaaaaagtccaactggtgcggctcgtagggatgatgctactgatctttgcacgtaaggaccagtgtaggtacataagggatattgccacagagactgtgggaacgggcattatggggaagatggggaacaaagggggggtggctgttagatttgtgttccacaacaccaccttttgcattgttaatagtcatttagccgctcacgtcgaggatttcgaaaggaggaaccaggactacaaagacatatgcgccaggatgtcattcgtggtgcccaatcaaactctcccccagttaaatatcatgaaacacgaggtggtcatctggttaggcgatctaaattatagactttgcatgccagacgcgaatgaagttaagtcactcattaataagaaggacctgcagcgtctcttgaagttcgatcaactaaacatccagcggacgcagaagaaagcgttcgttgattttaatgaaggtgagattaagttcattccaacatacaaatatgatagcaaaacggatcggtgggactcttctggcaagtgccgagtccccgcctggtgcgacaggattctctggagagggacaaacgttaatcagttaaattatcggtcccacatggagcttaagactagcgaccataagcctgtgtctgccctttttcatataggtgtcaaagtggtggatgagaggcggtatagaaaagttttcgaggactccgtgcggattatggatagaatggaaaatgacttcttaccctcattggaactgagcagaagggagtttgttttcgaaaatgtaaagtttaggcagttacagaaagagaaattccagatcagcaacaatggccaggttccctgccacttttcctttattcctaagctgaatgactcccagtactgcaagccctggttgagagcagaaccgttcgagggatatctggaacctaacgaaacggtggacatatctcttgacgtttacgtatccaaagacagtgttactatcttgaatagcggcgaggacaaaattgaagatattctggtgctgcatctggatagggggaaagattacttcctgactattagtgggaactacctcccatcctgtttcggcaccagtcttgaggccctatgtaggatgaagagacctatccgagaagtgcctgtgaccaaactaattgatttagaagaagatagctttctagagaaagagaaaagcctgctgcagatggttcccttagatgagggggcctccgagcgtcctctccaggttcctaaggagatatggttactggttgatcacttgttcaaatacgcctgtcatcaggaagacttattccagactcccggaatgcaggaggaactgcagcaaatcattgattgtttggatacaagcatcccggaaacaatccccggatctaaccatagcgtcgccgaggcccttctcattttcctggaggctctgccggaacccgtcatctgttacgaattgtatcagagatgtctcgatagtgcttacgatccacgcatctgccggcaagttatatcacagctgccacgctgccaccggaacgtattcaggtacctgatggcctttttgcgtgagctcctgaagttcagtgagtacaacagcgtgaacgctaatatgatagccaccctgttcacctctctgttacttagacccccccccaaccttatggcccgacagactcccagcgatagacagcgcgccatccagttcttgttgggttttctgttaggctcggaggaggattag

SEQ ID NO: 198064 - DNA, 2445 bp, Artificial Sequence
  Description of Artificial Sequence: Synthetic coding sequence
atgcacctggagggccgggacggccggcggtaccccggcgcccccgcagtagagctgctgcagactagtgtcccctccggtctagccgagctcgtggcagggaaaaggaggttgccccggggtgctggcggcgcggacccaagccatagctgtccgagaggggccgcaggccagtcctcttgggcacctgccgggcaagagtttgcctctttcctgaccaaaggaagatcccattcttcactaccgcaaatgtcttcgtccagaagcaaggacagctgcttcactgaaaacactccactactgaggaactccctgcaggaaaaaggcagccgctgtataccagtctaccatccggaatttatcaccgccgaagagagctgggaggacagttcagctgactgggaacgtcgttacctactgtcccgagaggttagtggattgtctgcctcggcttcatccgagaagggggatctccttgactcgccccatatcagactgcgattgagcaaactgcggcggtgcgtgcaatggctgaaagttatgggactcttcgctttcgtggtgctgtgttccattctgtttagcttatatcccgaccaggggaaactgtggcagctgctggctctctcaccactggagaattactctgtcaatctgtcttcacacgtcgactcgacactcctgcaggtggatttagcgggcgcactggtcgcaagcgggccatcccgccccggaagggaagagcacatcgtggtggagttgacacaggcggatgcactggggtcgaggtggaggaggccacagcaggtaactcacaattggactgtgtatttgaaccctcggcgctccgaacattcagtcatgtcacggacctttgaggtccttacaagggaaacagttagtattagtattagggccagcttgcaacaaacccaggctgtaccactgctgatggcccaccaatatctccggggatctgtggagacacaggtcacaattgcaactgccatcctggctggggtctatgctctgatcattttcgagcgaccttcactgacgcatgtagtggaatggatcgacttcgagaccctggctcttctcttcggcatgatgattctggtggcaatttttagcgaaactgggttcttcgactattgtgcagtgaaagcctacaggttatcccgtggccgagtgtgggccatgatcatcatgctgtgtctgatagctgccgttttatccgctttcctcgacaacgtgaccaccatgttactatttactcccgtgactatcaggctgtgtgaagttctcaacttggacccccgacaggtgctgatagctgaagttatttttactaacatcggaggcgccgcgacagccatcggcgatccccctaatgtcattatcgttagtaatcaagagctgagaaaaatgggccttgacttcgcagggttcactgcccatatgttcatcggaatctgtctggtgctgctggtgtgctttcctctcctaaggttgctgtattggaaccgcaaactctataacaaagaaccttccgagatcgtcgaactgaagcatgaaatccacgtttggaggctgacagcacagcggatctctccagcgtcaagggaggagactgcagtgaggcgcttgttacttggaaaagtactggctctcgaacacctgctagcaaggagactccacacattccataggcagatcagccaagaggataagaactgggagactaatattcaagagctgcagaaaaagcacagaatctcagacggaatactcttagctaaatgcctgaccgtgctcggcttcgtgatattcatgttttttctgaattcttttgtaccaggaattcatctggaccttggatggatagctattctcggggccatttggctgcttattcttgccgacatacatgacttcgagatcatcttacaccgggtggaatgggcaactctgcttttcttcgctgcactgtttgttctgatggaagccctcgcccacctgcaccttatcgagtatgtcggcgagcagacagcacttcttataaaaatggtgcctgaagaacagcggttaattgccgctattgtcctagttgtctgggtgagcgccctggcctccagtttgatagataacatccccttcaccgccacaatgattcccgtcttactcaatttgagccacgaccctgaggttggcctccctgccccaccactcatgtacgccctggccttcggcgcctgtctgggcggaaacggaacactgataggcgcctccgccaatgttgtatgcgcaggtatcgcagaacaacacggctacggctttagtttcatggaattcttccgactgggctttcctatgatggtggtttcttgtaccgtgggaatgtgctacctgctggtggcccacgtggttgttggctggaattag

SEQ ID NO: 198065 - DNA, 2517 bp, Artificial Sequence
  Description of Artificial Sequence: Synthetic coding sequence
atgcacctggagggccgggacggccggcggtaccccggcgcccccgcggttgaactccttcagacatcggtgccgagtggtttggcggaattggtagcggggaagcgtcgcctgcccaggggcgcaggtggagctgacccatcccatagctgtcctagaggagcggccgggcagagttcttgggcccccgctgggcaggaatttgcgagtttcctgacaaaggggaggagccattcctcccttcctcagatgagctcgagccgcagcaaagacagctgttttacagagaacacccctctcctacggaatagcctacaagaaaagggtagcaggtgcattcccgtctaccacccagaatttatcacagccgaggagagttgggaggactcttcggcagattgggaaaggaggtaccttttgtcaagagaggtttcaggactgagcgcaagcgcctcaagcgagaaaggtgacctgctggactctccacacataagactgcgcctgtcaaagttgcggcggtgcgtccagtggctgaaggtgatggggctctttgctttcgtcgtcctgtgttccatcctcttttcgttatatccagatcaaggcaagctttggcagttgctggcgctgtcgcctttagagaattattctgttaacctgagctctcatgtcgactcaaccctgttacaagttgacctggctggagccctggtggcctccggccctagtaggccaggccgcgaagaacatatcgtggtggagcttactcaagcggatgccctgggatcgaggtggaggcgcccgcagcaggtgacacacaactggactgtctatctgaatcctaggaggagcgagcactctgtcatgtcaagaacatttgaagtgttgacaagagagacggtgtcaatatccattagagcctcactccagcagacgcaggcagtgccactgctgatggcccaccagtatctcaggggctcagtagagactcaagtaacgatcgccacagccatactggcgggagtgtacgccctgatcatttttgagatagtgcatagaacattggcggccatgctagggagcctcgcagcgcttgcagccctggctgtgattggcgaccggcccagcctgacacatgtggtggaatggattgatttcgaaacccttgccttgctgtttgggatgatgatactggtggctatattcagcgagaccggcttcttcgactactgcgcggttaaagcttaccgcctcagcagagggagagtgtgggccatgatcatcatgctttgcctgatcgccgccgtgttatccgcgtttttagataatgttactacgatgttactcttcactcccgtgaccatccgactttgtgaggttcttaacctcgatccacgccaggttctcatcgccgaagtgatttttaccaatattggtggggctgccacagctattggcgacccacccaacgtgatcatagttagtaatcaggaattgcggaagatgggactggacttcgccggctttacagctcatatgtttatcggcatatgcttggttttgctggtgtgcttcccgctgctccgcctgctgtactggaatagaaaactttataacaaggaaccatctgagatcgtggagctgaagcacgaaatccatgtgtggaggctcactgcccaaagaatctcacctgcttccagagaggagacggcagtgcggagattgctccttggcaaggtgcttgctttggagcacctcttggctagacgtttgcacacttttcacagacagatcagtcaggaggacaagaattgggagaccaacatccaggagctgcaaaagaagcaccgtatctccgatggaatattgctggccaagtgtttgacagttctgggatttgtgattttcatgtttttcctgaattcctttgtgccaggaatccatctagacctggggtggatcgccatcctgggcgccatatggttattgatcttggccgatatccacgacttcgagatcatactgcacagggtcgaatgggccactctgctctttttcgccgcactattcgtgctaatggaggccctcgcccatctccatttgatagagtacgtgggagagcagacagcactcctgataaaaatggttccagaggagcagagactcatcgctgctatcgtgttggtcgtctgggtgtccgcactggcctcctctctgatcgataacattccctttactgccaccatgatccccgttctgctgaacttaagccatgatccagaagtcggactaccagccccccccttaatgtacgccttagcatttggagcctgtcttgggggaaatggcacactgatcggggcatcagccaacgtggtctgtgcggggatagccgagcagcacggctacgggttcagttttatggagttcttcaggcttggatttccaatgatggtggtcagctgtacagttggcatgtgttacttgctggtcgcacacgtggttgtcggatggaattag

SEQ ID NO: 198066 - DNA, 2007 bp, Artificial Sequence
  Description of Artificial Sequence: Synthetic coding sequence
atgcacctggagggccgggacggccggcggtaccccggcgcccccgccgtggaactcctgcagacatcagtaccctctggccttgcagagctagtggcggggaaacggagactgcccaggggtgcaggtggggcagatcctagccacagctgccctcggggtgccgcgggccaatcgtcctgggctcccgcaggtcaggagttcgcgtcattcctcaccaagggaagatcccactccagcttgccacagatgagctctagtcggtctaaggacagctgctttaccgaaaacaccccactgttgagaaattcattacaggagaaggggagcagatgtatcccagtctatcatccagagttcattactgcggaagagtcctgggaggattcatctgcagactgggaaaggagatacctgctgagcagagaggtctctggcctcagcgcctcagccagctccgagaagggtgatcttttagattccccacatatcagacttcgcctttccaagctgcgcaggtgcgttcagtggctgaaggtgatgggcttgtttgccttcgttgttctgtgctctatcctcttctctctttaccccgaccaaggaaaactgtggcagcttctcgccctaagcccgctggaaaattacagcgtaaatctttcctctcacgtcgatagcaccctgctgcaggtcgacctggctggagcactcgtggcttccggcccttcaaggccgggtcgtgaagagcatatcgtggtggagctgacgcaggctgatgcattagggagtcgatggcgtcgccctcaacaggtgacccataactggaccgtctatctgaaccctcggcgctccgaacacagcgtcatgtctaggactttcgaggtgttgacgcgagagacggtctcaatttccatccgggcaagcctgcagcaaacccaggctgtgcctctgctgatggcccatcaatatctgcgcgggtctgtggagacccaggttaccatcgccaccgccattctggctggagtgtacgccctgattattttcgagatagttcatcgtacacttgcagccatgctgggttctctagcagcactcgccgcactggcagtgatcggtgatcggccctccctaactcatgttgtggagtggattgatttcgagacactcgctttactgtttggcatgatgattctggtcgccatcttcagcgagaccggcttctttgattactgcgcggtgaaagcatacaggctgtctcggggccgggtgtgggccatgataatcatgctttgcttgatcgccgccgtgctgagcgccttcctggacaacgtaacaactatgctgttgtttaccccggtgacaatcaggctttgcgaagtattaaacctggacccccggcaggttctgatcgccgaggtgatcttcaccaatattggcggcgcagcaacagctattggggacccccctaatgtgataatcgtttcaaatcaggagctacggaagatgggccttgatttcgccgggtttacagcccacatgttcatagggatctgcctggtgctgttggtctgctttccgctcctccggttgctgtactggaaccggaagctctacaacaaggaaccatcagaaatcgtagagctaaaacacgagattcacgtctggcgccttaccgcccagaggataagcccggctagccgggaagaaactgcggtgcggaggctgctgctcggcaaggttctggcgctcgaacaccttctggctagaaggctccatactttccacaggcagatctctcaagaggataagaactgggaaactaacattcaggagcttcaaaagaaacataggattagcgacggaattctgctcgctaaatgcctcacagtccttggcttcgtgatttttatgtttttcctcaactctttcgtcccaggaatacatcttgaccttggtggcctaggccttgtccaggccggccgctactacctatccacgcctgaatcttag

SEQ ID NO: 198067 - DNA, 795 bp, Artificial Sequence
  Description of Artificial Sequence: Synthetic coding sequence
atgcacctggagggccgggacggccggcggtaccccggcgcccccgccgttgaactcctgcagacttctgtaccatccggccttgccgaattggtcgcggggaaaaggagactccccagaggagctggaggtgccgatccaagtcactcttgtccccgcggggccgcaggacagtcatcttgggctcccgccggtcaagaatttgcttccttcctgacgaagggccgcagccactctagtttgccgcagatgtcaagtagccgcagcaaggattcatgctttacagagaacacccccttactgcgcaattcattacaggaaaaaggaagcaggtgcatccccgtttatcacccggagtttataaccgcagaggagagttgggaggatagctctgcggattgggagagacgatacctgctatctcgcgaagtgtcaggtctctctgcttcagcatcttctgaaaaaggcgatcttctggactcaccccacattcgactgcggctgtctaaattgagaagatgcgtgcagtggttaaaggtcatgggcttattcgcgtttgtggtgctctgcagtattttgttctcactgtacccagatcagggcaagctatggcaactattagccttgtccccgcttgagaactactcggtcaatctctcaagtcacgtggattcaacactgctccaggtcgatctggccggtgctctggtggctagtgggccctctaggcctggcagggaagagcacatcgtggtggagctcacacaggccgacgcactaggctcacgttggtag

SEQ ID NO: 198068 - DNA, 657 bp, Artificial Sequence
  Description of Artificial Sequence: Synthetic coding sequence
atgcacctggagggccgggacggccggcggtaccccggcgcccccgccgtcgagctgctgcagacctctgttcctagcggtctcgccgagctcgtagccggaaagaggcgacttccaaggggcgctggaggggccgatccttcacattcctgccccagaggtgctgccggccagagttcttgggccccggctgggcaggagtttgcttcatttcttacgaaaggccgcagtcactctagccttccccagatgtcttcttctcgctctaaggactcttgctttacagagaacacaccccttcttcgaaatagtctccaagaaaaggggtcaagatgcatccccgtgtatcaccccgaattcatcacagcagaggagagctgggaggactcgagcgccgattgggaaagacgatacttgctgtctagggaagtaagcggtttgtccgcgagtgcctcctcagagaaaggagacttgctggattcgccacatattagacttagattatccaagctgcgaaggtgcgtacagtggttgaaggtcatgggcctctttgcgtttgttgttctctgctccgtgacacataactggacagtctatctgaatccccggcggtccgagcacagcgtgatgagcaggacatttgaagtacttacgtag

SEQ ID NO: 198069 - DNA, 801 bp, Artificial Sequence
  Description of Artificial Sequence: Synthetic coding sequence
atgggcagcaagaccctgcccgcccccgtgcccatccaccccagcctccaactaactaactacagtttcctccaggccgttaatggcctccccaccgtcccctctgaccatctcccaaatctgtatggattcagtgccttacacgctgtccatttgcaccaatggactcttggttatccagctatgcacctacctagatctagcttcagcaaagtacccgggacggtgagctccctggtagacgccagattccagctgcccgcattcccatggtttcctcacgtaattcagccgaaaccagaaattactgcgggcggttcggtccctgctctcaagaccaagcctcggtttgatttcgctaatctggcacttgctgcgactcaggaagacccagcaaaactgggccgtggagaggggcctggcagtcccgctggcggccttggcgctcttcttgacgtgaccaaactgtcacctgaaaaaaaacccacacgaggtcggttaccatctaaaactaaaaaggaattcgtatgtaagttttgcggccgccattttaccaagtcctataacttgctaatccatgagaggacccacaccgacgaaaggccctatacctgcgacatttgtcataaggcattcaggaggcaggatcatctgagggaccatcgttacattcattccaaggaaaaaccttttaagtgtcaggaatgcggaaagggtttctgccagagtagaaccctggcagttcacaaaaccctgcactcccaggttaaagaactgaaaacctccaaaataaagtgctag

SEQ ID NO: 198070 - DNA, 801 bp, Artificial Sequence
  Description of Artificial Sequence: Synthetic coding sequence
atgggcagcaagaccctgcccgcccccgtgcccatccaccccagcctgcagctcacaaactattcctttctccaggccgtgaacgggcttccaaccgtcccctccgaccatttacctaatctatatggcttctccgcactgcacgccgtccacctgcaccaatggaccctgggttacccagcaatgcacctcccaagaagctctttttcaaaggtcccggggaccgtgtcatctctggtggacgcaagatttcagttacccgctttcccgtggttcccgcacgtcatccagcccaagccagagataacagctggcggctccgtccctgcattaaaaaccaaacctcggtttgattttgcaaacctggcgttagccgccacccaagaagaccccgcaaaattggggcgtggtgaaggaccgggaagccccgctggtgggctgggagccctactggacgtgacaaaactctccccagagaaaaagccaacccggggccggctgccctcaaagaccaagaaggagttcgtatgcaaattttgtggaagacactttacaaaatcttacaacctgttaatccatgagcgcacccacaccgacgagaggccttatacttgtgatatctgccacaaagctttccgcagacaggaccacctgcgggaccaccggtacatccactcaaaggagaaaccttttaaatgccaggaatgtggaaagggattttgccagagtcgcaccctcgccgtccacaaaacactgcactcacaggtcaaagaactaaaaacttctaaaatcaaatgttag

SEQ ID NO: 198071 - DNA, 939 bp, Artificial Sequence
  Description of Artificial Sequence: Synthetic coding sequence
atgggcagcaaggccctgcccgcccccatccccctgcaccccagcttacagttaaccaactatagcttccttcaagccgtcaatacatttcccgccaccgtagaccatctgcagggtttgtatggtttaagcgctgttcagaccatgcacatgaatcactggaccctcgggtaccctaatgtgcacgaaatcaccagaagtactattactgagatggccgcggcacaggggctggtagatgcccgttttccgttcccagctctccccttcaccactcacctctttcacccaaagcagggagccattgcccatgtccttcctgctttgcataaggacaggcccagattcgacttcgcgaatctggcagtggccgcgacccaggaggatcccccaaagatgggagatttgtctaaactatctcctggactgggctcacccatttccggacttagcaaactcacgcccgatcggaaaccatcccgcggccggctaccatctaagacgaagaaagagttcatatgcaagttctgtggacgccacttcacaaaatcatacaacctgcttattcatgagcgcacccacaccgacgaacgtccttatacatgtgacatttgtcacaaggccttccggcgacaggaccatcttcgtgaccatagatatattcatagtaaggagaaaccatttaagtgtcaggagtgcggcaagggtttttgccagtcgagaacattggcagtacataaaaccctgcatatgcaagaatctcctcataagtgccctacctgcggccggacatttaaccaacggtctaatcttaagacacacctgttaactcacactgacattaagccctatagctgtgagcagtgtgggaaagtgttcaggcgtaattgtgacctgaggcgccacagcctcacacatactcccagacaggacttttag

SEQ ID NO: 198072 - DNA, 831 bp, Artificial Sequence
  Description of Artificial Sequence: Synthetic coding sequence
atgggcagcaaggccctgcccgcccccatccccctgcaccccagcctgcagctgactaattacagtttcctccaagctgtcaatacgttccccgctacagttgaccacctgcagggcctgtacggcctgtctgctgtgcaaaccatgcatatgaaccactggacgttaggatatcccaacgtgcatgagataacaaggtcaaccatcacagagatggcagctgcacaaggactggttgatgctcgcttccctttcccagccctgccttttaccactcacctcttccaccctaagcagggggcaattgcccacgttctccctgcactccacaaagataggccccgatttgatttcgccaatctcgcagtcgctgcaacgcaggaagatccacccaagatgggcgatctcagcaagctctcccctggactggggtcaccaatttccggcctttcgaagcttacccctgatcgaaaaccttcccggggaagattgccgtccaagactaagaaggagtttatctgtaagttctgtggacgtcactttactaagtcatataacctcctgatccatgagagaacccatacagacgagagaccctatacctgtgatatatgccacaaagcttttagaagacaggatcatttgcgcgatcacaggtatatccactccaaggaaaaacccttcaagtgtcaggaatgtggaaaaggcttctgccagtctcggacactggcagtgcataagactcttcacatgcagacgtcgagcccgaccgccgcctccagcgcggcaaagtgtagtggtgaaaccgtgatttgcggcggtacagcctag

SEQ ID NO: 198073 - DNA, 1302 bp, Artificial Sequence
  Description of Artificial Sequence: Synthetic coding sequence
atgggcctgcgggccgaggagggcaagcggaagcccccccggagcgtccggggagaggtgagtccaagccagggtccactcgcccaggaggatgaggcacggcggctgcgaagctgtacccctgcatgccacccaggaaaacgaggaaagggtgggcatagggctaggaggcagaggagcgcatgggacttgacaacacatcccctgacccataggagtcaggaattgaggggagccgccgcgactgagggtttcttatacgttctcttgagccattgggtcttcgtgggggcccctaggccccccgcgagcgactcatggaaaaagggtctggtgccaagcgcaccaccagcctcccggaagatgggctcgaaagcactgccagctcctataccccttcaccctagccttcaactgacaaactatagtttcctgcaggcggtgaatacttttcccgctacagtcgaccatctccaggggttatacggactgtcagcggttcagacaatgcatatgaatcactggaccttgggctacccgaacgttcacgagattacacggagcaccatcactgaaatggccgccgcccagggactggtagacgctcggtttccattccctgctctgcctttcaccacgcatctgttccaccccaagcaaggtgccatcgcccacgtgctgccagccttacacaaggaccggccgagatttgatttcgccaatctagcagttgctgccacccaggaagaccccccgaagatgggcgatctgagcaaattgtcacccgggctgggcagcccgataagcggactgtcaaagctcacccctgaccggaaaccatcacgcggtagactgccaagcaaaactaagaaagaattcatctgcaaattttgcgggcgtcatttcaccaaatcctacaaccttctgatccacgagcgaactcataccgacgagcggccctatacctgtgatatatgtcataaagccttcaggcgtcaggatcatctgcgagatcaccgttacattcattctaaggagaaacctttcaaatgtcaagaatgcggtaaaggtttttgccagtctcggaccctggctgtccacaaaacactgcatatgcaggaatcccctcataaatgccccacctgtggaagaacctttaatcagcgatcgaacctcaagacccacttactgactcatacagacatcaagccctattcatgcgagcaatgtggcaaagtttttagacggaactgcgaccttcggagacacagccttacccatacccctcggcaggatttttag

SEQ ID NO: 198074 - DNA, 642 bp, Artificial Sequence
  Description of Artificial Sequence: Synthetic coding sequence
atgggcagcaaggccctgcccgcccccatccccctgcaccccagcctgcagctgaccaattatagtttcctccaggctgtgaacacctttccggctacagttgaccatcttcaaggattgtacggcctcagcgctgtccagaccatgcatatgaaccactggacactgggttaccccaatgtgcatgaaattacccgtagtacgataacggaaatggccgcagcgcaagggctcgtcgatgcgcgattccccttcccggctcttccatttaccacacacttattccatcccaaacaaggcgccatagcccacgtgctgcctgcgctccacaaggatcgcccgagatttgacttcgcaaatctggccgtggctgccacacaggaagacccacccaagatgggggatctctcaaaactgtctcctgggttgggaagtccaatatcaggcctctctaagctcacgccggatcggaagccttcccgtgggaggctgccatccaagacgaagaaggagtttatttgcaagttctgcggccgtcatttcaccaaaagctataatctcctgatacacgagcgcacgcacactgacgaaagaccatacacttgcgacatttgtcacaaggccttccgcagacaagattag

SEQ ID NO: 198075 - DNA, 939 bp, Artificial Sequence
  Description of Artificial Sequence: Synthetic coding sequence
atgggcagcaaggccctgcccgcccccatccccctgcaccccagccttcagctgactaattattctttccttcaggcagtcaatacattccccgctaccgtggaccacctccagggcctttatgggttatccgctgtgcagacgatgcacatgaatcattggaccctggggtatccaaatgttcatgagatcacccggtcaaccattaccgagatggccgccgcgcagggtctcgtcgatgctcggttcccttttcctgccctccccttcactacccatctgtttcatccgaaacagggcgcaatagcccacgtgctgccagctttacacaaagacaggccgcgattcgactttgccaacctagcagtggcagcgacccaggaggaccctcccaagatgggtgacctgtcgaaactgtccccaggtcttggcagcccaatctctggacttagcaaattgactcccgacaggaagccctcccgaggtagactgccctctaagaccaaaaaagagttcatctgtaagttttgcggcagacattttaccaagtcatataatctgctgatacatgagcgcactcacactgacgagcgcccatacacatgcgatatctgccataaagccttcagacgccaggaccatttgagagaccaccgttacattcatagtaaagagaaaccatttaagtgccaggaatgtgggaagggattctgtcagagccgtacactggccgtgcataagacactgcacatgcaagagagtccccacaagtgtcctacctgtggtagaaccttcaatcaaaggagcaatctgaagacacatttgctcacccatactgatataaagccatactcctgcgagcagtgcgggaaagtctttaggcgcaactgtgacctgaggcgacactcactcactcacacgcctaggcaggacttctag

SEQ ID NO: 198076 - DNA, 687 bp, Artificial Sequence
  Description of Artificial Sequence: Synthetic coding sequence
atgaagaccctgttcctgggcgtgaccctgggcctggccgccgccctctcttttactctggaggaggaggacatcaccggaacatggtatgtgaaggcgatggtggttgacaaagactttcccgaagaccgccggcccaggaaagtttcccctgtgaaagtgaccgctctggggggaggtaacttagaggccaccttcacatttatgcgggaagacaggtgtattcaaaagaaaatcttgatgcgcaaaactgaagaacctgggaaatttagcgcatatggaggcaggaaactgatatatctgcaggaacttcctggaaccgatgattacgtgttctattgtaaagaccagcgtcgcggcggcttgagatatatgggcaagcttgttgcaagcgcgccgtgccgggcagtgcccctctccccaccatggcttacctggcctcctcacctccaggtcggcatcctgatccctacatggcggccatggaaaaaccttcgaaactggtgcagcacacgggatagcagacgccggacattttcttgtccttgcagaagggaggccgcatttagtaatactcggcagccccctgggctgcatctgcagtcacccccctatcaccaaacgcagtccccggatcatctggacctcccgagctcacatgatccaagcttgctgccgcctacatag

SEQ ID NO: 198077 - DNA, 444 bp, Artificial Sequence
  Description of Artificial Sequence: Synthetic coding sequence
atgaagaccctgttcctgggcgtgaccctgggcctggccgccgccttgtccttcacactcgaagaagaggatgagggcggatctgtgcatcctgaggaaaaccctgacgccgaagatggtggggcatggcagattcaaaggctgtggggccaggaagcccacatccccgccggcgcagcacgagatggccgccttagattactacttcagcgccccgcaccttgggggcctgctctgcacggtaaagcctgcggaatctgcagcctgcaaggaagggccgccgtgcctactctagcacacctcgccaccagcccagcaggccggaatcccaatactaacctggaggctcttgaggagttcaagaagctggtccagcacaagggtctgtctgaggaggatatcttcatgcctctgcagacgggttcatgcgttctcgaacactag

SEQ ID NO: 198078 - DNA, 513 bp, Artificial Sequence
  Description of Artificial Sequence: Synthetic coding sequence
atgaagaccctgttcctgggcgtgaccctgggcctggccgccgccctcagcttcactctggaagaagaagacatcacaggaacatggtacgtgaaggccatggtcgttgataaagatttcccagaagaccgacgtccgaggaaagtctcaccagttaaggtcacagccctgggaggcgggaacttagaagctacctttacgtttatgagggaggatagatgtatccagaagaagattctcatgcgaaagaccgaagagccaggcaagttcagtgcctatggtggaagaaaactcatctatttgcaggaacttcctggcaccgacgattatgtcttctactgtaaagatcagagaagaggagggttgcgctatatggggaaactcgtgggcagaaaccccaacacaaacctggaggcactggaagaattcaaaaagctagtgcagcacaaggggctctctgaagaggacatttttatgcccttgcaaactgggtcttgtgtgttggaacattag

SEQ ID NO: 198079 - DNA, 513 bp, Artificial Sequence
  Description of Artificial Sequence: Synthetic coding sequence
atgaagaccctgttcctgggcgtgaccctgggcctggccgccgccttatccttcacattggaagaggaagacatcaccggaacctggtatgtaaaagccatggttgttgataaagatttccccgaggatagacggcccaggaaagtgagccccgtcaaagtaaccgctctcggcgggggtaatcttgaggctacgttcaccttcatgcgggaggacaggtgtattcagaagaagatcctgatgcgaaagacggaggagcccggcaagttctctgcttacggtgggcggaaactgatttatctgcaggaacttccagggacagacgattatgtgttctactgcaaggaccagaggcgtggcgggctccgctacatgggtaaactggtgggacgcaaccctaataccaatctcgaggcacttgaggagtttaagaagcttgtccaacataaagggcttagtgaggaggacatcttcatgccactgcagaccggaagttgtgtcttagagcactag

SEQ ID NO: 198080 - DNA, 258 bp, Artificial Sequence
  Description of Artificial Sequence: Synthetic coding sequence
atgaagaccctgttcctgggcgtgaccctgggcctggccgccgccctgtcttttactctagaggaggaagatgatggcccttgggtgcatcctgaggagaatcccgacgcagaggacgggggggcttggcaaattcagagattgtggggtcaggaagctcacgtacccgccggcgcagcacaggagggccctctgcatctgctgctgcaaaggcccgctccatggggcccagccccacacggcaaggcttgcggatag

SEQ ID NO: 198081 - DNA, 513 bp, Artificial Sequence
  Description of Artificial Sequence: Synthetic coding sequence
atgaagaccctgttcctgggcgtgaccctgggcctggccgccgccctcagttttaccctggaggaagaagacatcactggcacctggtacgtcaaggctatggtcgtggacaaagactttcctgaagacagacgcccgaggaaggtttcacctgttaaagtgacagcattaggaggagggaagctcgaggccacctttacttttatgagagaggacagatgcatccagaagaaaatactcatgcgtaaaactgaggaacctgggaagtattccgcctacggagggagaaaattgatgtatctgcaggaactgcctcgacgagaccactatatcttctattgcaaggaccagcaccacggcggtctgcttcatatggggaagctcgtggggcgcaactcagacacaaacagagaggccctggaggagtttaaaaagctggtccagcgcaaaggactctctgaggaagatattttcactccattgcaaaccgggagttgtgtgcctgagcattag

SEQ ID NO: 198082 - DNA, 8310 bp, Artificial Sequence
  Description of Artificial Sequence: Synthetic coding sequence
atggacgtgaaggagcggaagccctaccggagcctgacccggcggagagacgcagagcggaggtacacaagctcatctgccgacagcgaagagggtaaagctcctcagaagagctattcttcaagcgaaacactcaaagcttacgatcaggacgcccgactggcttatggaagtagggtcaaggacattgttcctcaggaggctgaagaattctgccggactggggccaactttacacttcgggagctaggcttggaggaggtgacgcctccacatggtacgctctataggacagacataggactgccacactgcggctacagcatgggagccggaagcgacgccgacatggaggccgatacagttctgtcacccgagcacccagtgcgcttatgggggaggtcaactaggagcggacggtcaagctgtctgagcagccgagccaattcaaacctcacgctcactgacacagagcacgagaatacggagaccgaccaccctgggggcctgcagaatcacgcgcgactcagaacacccccaccaccactcagccatgctcacactcccaaccaacatcacgcagcttccatcaactcacttaataggggcaacttcacaccacgaagtaatccttccccagctcccactgatcactctctgagcggcgagcctccagccggaggagcccaggaaccggcgcacgctcaggaaaactggttattgaatagcaatatcccactggagactcgaaacctgggaaagcaacccttcctaggtaccctccaggataacctcattgaaatggacatcctgggcgcctctcgccacgacggcgcatatagtgacggccacttcctgttcaagcccggtggtacaagcccacttttctgcacaacttcacccggatatcccctgaccagcagtactgtgtattcacccccgcctcggcccctcccgcggagcacctttgcaagaccagcattcaacctgaaaaaaccatctaagtactgcaactggaagtgcgctgcccttagtgcaatcgtgatctcggctacactggtgatcttacttgcttacttcgttgcgatgcacctcttcggactgaattggcatttgcagcccatggaggggcagatgtatgaaatcaccgaggacacggcttcttcctggccggtccccacagatgtgagcctgtacccaagcggagggacagggctggaaacccctgaccgcaaaggaaagggaacaacagagggcaagccctcctcctttttccctgaggactccttcattgattcaggtgaaattgacgtgggtcgtcgggcaagtcagaaaatccctccaggtactttctggaggtcccaagtctttatcgatcacccggtgcacctcaagttcaacgtgagtctgggcaaagcagcactcgtcgggatctacggtcgtaagggcctgccacccagccatacccagttcgacttcgttgaacttctggacggtcgccggctccttacacaggaagcgagaagtctagaaggaaccccacgacagtcacgcgggacagtccctccgtcctcccacgaaactggcttcatacagtatctagactccggcatttggcatctggccttctacaacgatggtaaagagagtgaggtagtgagctttcttacaaccgccattgagtcggtcgacaattgtccaagcaactgttatggtaatggtgactgtatttctggcacttgccattgttttttgggtttcctgggccccgattgtggacgggcctcctgcccagtcctttgtagcgggaatgggcagtacatgaaaggtcgatgcctatgtcatagcggctggaagggagccgagtgtgatgttccgaccaatcagtgcatcgacgtcgcctgctctaatcatgggacctgtatcacaggaacctgcatctgtaaccctggctataaaggcgaatcatgcgaggaggttgactgcatggatcccacctgcagtggacgaggcgtgtgcgtaaggggagagtgccattgcagcgtggggtggggcggcactaactgtgaaacacctagagctacatgtctggatcagtgctctggccacggcacttttctgcccgacactgggctgtgttcatgtgacccaagttggacggggcacgattgtagcatcgagatctgcgccgcagactgtggcggccacggcgtgtgcgtcggaggcacatgccgatgtgaggacgggtggatgggcgccgcatgcgatcagcgcgcatgtcatcctcgatgcgccgagcacggcacttgcagggatgggaagtgtgagtgtagtcccggttggaacggtgagcactgtacaatcgcccactacctggatagagtggtgaaagagggctgcccaggactttgtaacgggaatggacgctgcaccctggacctcaatgggtggcactgtgtatgccagttaggatggcgaggggctggatgtgacacaagcatggagaccgcctgcggggattcaaaagataacgatggcgatggcctcgtggactgcatggatccagactgctgtttgcaacctctttgtcacattaatcctttgtgcctgggctcccccaacccactggacatcatccaggagacccaagtgccagtgtcgcagcagaatctgcattctttttatgacagaataaagtttctggtggggagagattccacacatatcattcctggtgagaacccatttgacggcgggcatgcctgcgtgattcgagggcaagttatgacgtccgacgggacgcccctggtgggcgttaatataagcttcgttaacaatccacttttcgggtataccatctctagacaggatggcagctttgatctcgtcacaaacggcggcatttcaataattctgcgctttgaaagagcccctttcatcacgcaggaacataccctgtggctcccttgggaccgattcttcgttatggagacaatcatcatgcgccatgaagagaacgaaatcccaagctgcgatctgtcaaatttcgctagacctaaccctgttgtgtcaccctcacctctgacctcttttgcctccagttgcgctgaaaaaggccccatcgttcccgagatccaggccttacaggaggaaatttctatctctggatgtaaaatgcgtctgagctacctgagtagccggaccccaggttataagtcagtactaagaatatccctgacccatcccaccatcccttttaacctgatgaaagtgcacctgatggttgcagtggagggtcgtctgtttagaaagtggtttgctgcggcgccggacttgtcttattatttcatatgggacaagactgacgtctacaaccagaaagtgtttggcctctccgaggcctttgtgagcgtcggctatgagtatgagtcgtgccctgacttaatcctgtgggaaaaacgcacaacagttctgcaaggctacgaaatcgatgcttcaaagctgggtggatggtcactggataagcaccatgctctgaacatacagagtggaattttgcacaagggaaatggggagaaccagttcgtgagccagcagccacctgtgattggttctatcatggggaacgggcgacggaggtccatctcctgcccctcatgcaacggcctcgcagatggaaataagttgctagctccggttgcccttacctgcggctctgacgggtccttgtacgtcggagatttcaactatatcagacggatctttccctcgggcaatgtgacaaacatcctggaactccgcaataaagattttaggcattctcattcccctgctcacaaatactacttagctactgatcccatgagcggagcagtattcctgagcgattcaaactccagaagggtctttaagattaaatccaccgtcgtggtgaaggacctcgtgaaaaacagtgaggtggtggccggcaccggggaccaatgcctgccgtttgacgacaccaggtgtggcgatggcggcaaggccactgaggcaaccctcacaaaccctagaggcatcaccgttgacaaattcggcctgatctacttcgttgatggtaccatgattcgccgtattgaccaaaatggaatcatttctacactgctgggaagtaatgatcttacaagtgcccgacctttgagctgcgactcagttatggacatttcccaggttcatctggaatggcccaccgaccttgctataaacccgatggacaacagcctttacgttctggacaataatgtggtacttcagataagtgagaaccaccaggttagaatcgtcgccggcaggcccatgcactgccaggttccagggattgaccatttcctgttaagcaaagtggcaatccacgctaccttggagagcgccaccgccctcgctgtgagccacaatggggtactttacattgccgaaacagatgaaaaaaaaatcaaccgcattaggcaggtcacaacctcaggcgaaatttcattagtggccggcgctccatcaggatgcgactgcaagaatgacgcaaattgtgactgcttcagcggcgatgatggatatgccaaagacgctaaactgaacactccctcatcactcgctgtctgtgctgacggggaactatatgtcgccgatcttggtaatatcagaatccgatttattagaaagaacaagcctttcctcaacacacagaatatgtacgaattgtcatcccccatcgatcaggagctttatctcttcgatacgactggcaagcatctctacactcagtcactccccaccggcgactacctgtacaactttacatatacaggggacggagatatcaccctcatcacagataacaatggaaatatggtgaatgtcaggagggactcaacaggcatgcctctgtggttggtggtccccgacgggcaggtgtactgggtgacgatggggaccaattctgccctgaagtctgtgactactcagggacacgaactcgccatgatgacatatcatgggaatagcgggctgctcgccactaagtctaacgaaaatggctggaccacattctacgaatatgattccttcggacgcctgactaacgtcacttttcccactggacaggtgtcgagttttcggagcgacacagatagttccgtacacgtccaagtggagaccagtagcaaagatgacgtcactattacaactaatctcagtgccagtggcgccttttacaccttacttcaagatcaggtgcggaattcttattacattggtgccgacggcagccttaggctccttctggctaatggtatggaggttgcactgcaaacagaaccgcatctactggccggtaccgtgaatcccacggtgggaaaacgaaacgtcacactgcctatagacaatggactgaacctggtggagtggcgccaacggaaggagcaagctaggggtcaagttactgttttcgggcgccgtctgcgagtgcacaacaggaatctcctttctcttgactttgacagagtgacacgtactgaaaagatttacgatgatcaccgaaagtttacattaaggattctttacgaccaggctggtcgcccatccctatggagcccttcttccagattaaatggcgtcaacgtgacatattccccgggtgggtatattgctggcattcagcgaggcattatgtcagaacgaatggagtacgatcaggccggaagaattacttctagaatatttgctgacggtaagacttggtcttatacttacctcgagaagtcaatggtgcttcttctgcattcccagagacagtatatatttgagttcgacaagaacgatagactttcatcggtgactatgccgaatgttgccaggcaaaccttagagaccattcgcagtgtcggctactatcggaacatctaccagccccccgaaggtaacgcctcagtgatacaggacttcacagaagacggtcacctcctgcacaccttttatctcggtacagggagaagggtgatctacaagtacggcaaactgagtaagctggcagaaaccctctacgacaccaccaaggttagcttcacctacgacgaaaccgccggcatgctgaaaaccatcaacctgcaaaacgaggggttcacctgtaccatccgctatcggcagataggcccactaattgatcgtcagatttttcgattcaccgaggaaggcatggtgaatgcaaggtttgactacaattatgacaattcatttagagttacttcaatgcaggcagttattaatgagacccccctccctatcgacctctaccgctacgacgacgtttccggaaaaaccgaacagttcggcaagtttggcgtgatctattacgacatcaaccagatcatcacaacagccgtcatgacgcataccaagcattttgatgcgtacggaagaatgaaggaggtgcagtacgagatttttaggagtctcatgtactggatgactgtacagtacgacaatatgggtagagttgtcaagaaggagctcaaagtgggaccttacgcaaatactactcgttattcctatgagtatgacgctgacggtcagctccagactgtgtcaatcaacgacaagcctctttggcgctactcctacgacctgaatgggaatttgcacctgttgtctccgggcaactccgcgcgcttgaccccactccgttatgacatccgcgataggataactaggttaggagatgtccagtataagatggatgaggatggattcctaaggcaacgcggcggcgatatcttcgagtacaatagcgccggcttattgataaaggcttacaacagagccgggtcttggtcagtgcgctatcggtatgacggactcggtaggcgcgtatcatctaaaagtagccattcgcatcacctccagtttttctacgcggatctcactaaccctacaaaggtgacacacctttataatcacagctcctccgaaattacatctctgtactacgatttacaaggacatctatttgccatggaacttagtagtggcgatgagttttacatcgcttgcgacaatattggaacccctttggccgtcttcagcggaacaggccttatgattaagcagatcttatacactgcctatggtgagatttacatggatactaaccctaactttcagataatcatcggataccatggcggcttgtatgatcccctcacaaagttagttcatatggggagacgggactacgacgtgctcgctgggcgttggacttcccctgatcacgagctttggaagcacctgtcatcttcaaacgtaatgccttttaatctctacatgtttaagaacaacaacccgatcagcaactctcaggacataaagtgctttatgactgacgtcaactcttggctgctgacatttggatttcagctccacaatgtcatcccgggctaccccaagccagacatggatgctatggagccgagttacgagctgatacatacccagatgaagactcaggagtgggataacagcaagagcattcttggagttcagtgcgaggttcagaagcaactgaaagccttcgttaccctggaacgattcgatcaattatacggcagcaccataacgtcctgtcagcaggccccaaagacaaaaaaatttgctagtagtggctcggtgtttgggaaaggtgtgaagttcgccctcaaggacggtcgggtgaccacagacattattagcgtcgctaacgaagacggtagacgggtggccgctatcctgaatcatgcacactatctggagaatcttcattttactatagacggagtggacacccactacttcgttaaaccagggccatctgagggagaccttgcaattctgggccttagtggaggtcgtcgcacgctggaaaacggggtgaatgtgacagtgtcccagataaatacagtccttaatggcaggacgcgacgctataccgatattcagctccagtatggcgcactttgtctgaacactaggtatggcacaaccctggacgaagagaaagccagagttcttgaactcgcaaggcagagagctgtgcgccaggcctgggcccgagaacagcagagacttcgcgagggagaagaggggctccgggcatggacggagggcgagaaacaacaagtgttgagtacaggacgagtccaggggtacgacggattctttgtcatcagcgttgaacagtacccggagttgtctgattcagccaacaacatccactttatgcgacaatccgaaatgggcagaagatag

SEQ ID NO: 198083 - DNA, 6 bp, Artificial Sequence
  Description of Artificial Sequence: Synthetic coding sequence
atgtag

SEQ ID NO: 198084 - DNA, 1404 bp, Artificial Sequence
  Description of Artificial Sequence: Synthetic coding sequence
atgcccggccggtggcggtggcagcgggacatgcaccccgcccggaaactgctgtctctgctgttccttatcctgatgggaaccgaactgacccaggtgttgcctacaaacccagaggagagctggcaggtgtattcatccgcccaagattccgaggggaggtgtatctgcactgtggtggctccccagcagacgatgtgtagtcgagacgctcgaacgaagcaactgcgacagctcctcgagaaggtgcaaaatatgtctcagtctatagaggtgctggatcgtcgaactcagcgtgacttgcagtatgtggaaaaaatggagaatcagatgaaagggcttgaaagtaagttcaagcaggtcgaagagagccataaacagcatctcgcacgacaattcaaggcaatcaaggcaaagatggatgaactgcggccactgatacctgtcctggaggagtataaggctgacgcaaagctcgtgctccaatttaaggaggaggttcagaacttgacctcagtcttgaatgagttgcaggaggaaatcggcgcttatgattatgacgagctgcaatcccgcgtatccaatctcgaggaacgtctccgggcatgtatgcagaaactcgcatgtggcaagttgacaggcattagtgatccggtgactgttaaaacatcaggaagcaggttcgggagctggatgacagaccctttggcccccgagggagacaaccgagtttggtacatggatggctaccacaacaaccggtttgtacgtgagtataaaagcatggttgatttcatgaacaccgacaattttacctcccaccgcctcccccatccctggtcaggcaccggccaggtggtctacaatggaagtatctatttcaacaagttccagtctcacattataatccgcttcgacctaaagactgagactattctgaaaacacgcagtctagactatgcaggctacaataatatgtatcattatgcctggggaggacatagcgacattgatcttatggtggacgagtcgggactctgggccgtttatgctactaatcagaatgcgggaaacatcgtggtcagccgattggacccagtttccctccagacattacagacctggaacacctcttacccaaagagaagtgccggagaggcattcatcatttgtggaacgctgtatgttacaaacgggtattcggggggtactaaggtccactatgcatatcagactaatgcttctacatatgaatacatcgatattccttttcagaacaagtatagccacatctccatgttagattataatcccaaagatagggcactgtatgcctggaacaatggacaccagatcctgtataatgtcacactcttccatgtaattcgatcagatgaattatag

SEQ ID NO: 198085 - DNA, 408 bp, Artificial Sequence
  Description of Artificial Sequence: Synthetic coding sequence
atgcccggccggtggcggtggcagcgggacatgcaccccgcccggaagctgctctccctgctgtttcttatcttaatggggaccgaactgacacaggtgctccccacaaaccccgaggagagctggcaggtctatagttcggcacaggattccgaaggcagatgcatctgcacagttgtcgccccccagcagacaatgtgtagccgagacgcccgcactaagcaacttcggcagcttttggaaaaagtacagaacatgagtcagtctattgaggtcctagatcgcaggactcagcgtgacttgcagtatgtcgagaaaatggagaaccaaatgaagggtttggaaagcaagtttaaacaggtagaagagtctcataaacaacaccttgccaggcagttcaaggggtag

SEQ ID NO: 198086 - DNA, 1458 bp, Artificial Sequence
  Description of Artificial Sequence: Synthetic coding sequence
atgagcgtgcccctgctgaagatcggcgtggtgctgagcaccatggccatgatcactaactggatgtcacagacgctacccagcctggtggggttgaatactactaaattgtccgccgccggcgggggcaccttagataggtcaactggggtgctccctacaaaccccgaggaatcctggcaggtgtatagctccgcgcaggactctgaaggtagatgtatttgcacagtcgtggcccctcagcaaaccatgtgttctcgcgacgccaggaccaaacagctccgccagcttctcgagaaagtccagaacatgagccagtcgatcgaggtgttggatcgccgcacacaaagggatctccagtacgtggagaaaatggaaaatcagatgaaggggctagagtctaaatttaaacaagtcgaagaaagccataagcaacatctggcaagacaatttaaggctataaaagcaaaaatggatgaacttcgccctttgattcctgtccttgaggaatacaaggccgacgccaagttagtgttacagtttaaagaagaagtgcagaacctgacaagcgtactgaacgagttgcaggaggaaatcggcgcatacgactacgacgaactccaatcccgcgtcagcaacctcgaagagcgccttagagcctgtatgcagaagctggcctgcggtaaacttaccggaataagcgaccccgtaacagtgaagacttctggcagcagatttgggtcgtggatgactgatcccttggctcctgaaggtgacaatagagtgtggtatatggacggttaccacaataataggtttgtgcgggagtacaaatcaatggttgatttcatgaacacagacaatttcaccagccatcggctgccacatccatggagcggaacgggccaggttgtttacaacggcagtatttattttaacaaatttcagtcacacattataattcgctttgacctgaaaaccgaaacgatcctcaagactaggagccttgactatgccggctacaataatatgtatcactacgcctgggggggacattctgatattgatctgatggtcgacgagtcaggcctgtgggccgtgtacgctaccaatcagaatgctggaaacattgtggtgtctcgcctcgatcctgtgagcctgcaaactctccaaacgtggaatactagctacccaaaacggtcggcgggggaggcctttatcatctgtggcacactctacgtgacaaatggttacagcggcgggactaaggtacactacgcctaccagacaaatgcctcaacatatgagtacattgatatcccttttcagaacaagtacagccatatctctatgctggattataaccccaaagatcgcgcgctgtatgcttggaacaacgggcaccagatactgtacaatgtcaccctgtttcacgtgatcaggtccgatgagctctag

SEQ ID NO: 198087 - DNA, 1377 bp, Artificial Sequence
  Description of Artificial Sequence: Synthetic coding sequence
atgggcgaggcccccggccgggagggccggggcccctgcccccagctggaaagccctagaagaaggcgggtgctcccaaccaatcccgaggagtcatggcaggtttactcatccgcccaggattccgagggacgttgtatttgtacggtggttgctccacaacagaccatgtgttcgcgcgacgcacgtactaagcagctccgccaactgctggaaaaagtgcaaaacatgagccagtccattgaagtattggatcgcagaacacagcgggacctccaatacgtggagaagatggagaaccagatgaaaggcctggagtccaagtttaagcaagtcgaagagtcacataagcagcatctggctcgtcagtttaaagccatcaaggcaaaaatggacgaactccgcccattgataccggtccttgaggaatacaaggccgatgccaagctcgtgctgcagttcaaggaggaggtacaaaatctgacatctgtgctgaacgaattgcaggaggagatcggcgcttacgactatgatgaactccagagcagagtgtccaaccttgaggaaaggttgcgggcatgcatgcagaagctggcttgcggaaagttaacaggaatctctgatcccgtcactgttaagacctccggctctaggtttggatcctggatgacggaccccctcgcccccgaaggtgataatcgggtgtggtatatggatggttaccacaataacaggtttgttcgggagtataagtctatggtcgactttatgaacaccgataacttcaccagtcacaggctccctcatccctggtcagggaccggacaggtggtgtacaatggcagcatttactttaataagtttcagtcccatatcataatccggtttgacctaaaaactgagaccattctgaaaacccggtctttagattacgccggatataataacatgtatcattacgcttgggggggacactccgatatagacctgatggtggacgagtctggtctctgggccgtctacgctaccaaccaaaatgctggcaacattgtagtctctaggttggaccccgtcagtctacagaccctgcagacttggaacacctcctatcctaaacgatccgccggagaggcctttatcatttgtggtacgctctacgtgacaaacggatatagcggaggcacaaaagtgcattacgcctatcagacgaatgcttccacctacgagtatatcgacattccttttcagaacaagtacagccatatttctatgctggactacaaccccaaggacagggccttgtatgcatggaacaacggccaccagattttgtataacgtgactctgtttcacgtgatccgctctgacgaactgtag

SEQ ID NO: 198088 - DNA, 462 bp, Artificial Sequence
  Description of Artificial Sequence: Synthetic coding sequence
atgagcgtgcccctgctgaagatcggcgtggtgctgagcaccatggctatgatcacgaattggatgagccagacactcccaagcctggttgggcttaacaccacaaagttgagcgcggccggcggcggcaccttggaccggtccacaggcgtgctgcccaccaatcccgaggagtcatggcaggtgtactcctccgcgcaggatagcgaagggcgctgtatatgcaccgtcgttgctccacaacaaaccatgtgctcacgtgatgccagaacaaagcagctcaggcagcttctggagaaggttcagaatatgtcccagtctatagaagtgcttgataggcgcacccagcgagacctccagtacgtggagaaaatggaaaatcagatgaaggggctggaatccaagtttaaacaggtcgaggagtcacacaagcagcatctggctcgacagttcaagggctag

SEQ ID NO: 198089 - DNA, 729 bp, Artificial Sequence
  Description of Artificial Sequence: Synthetic coding sequence
atgaacctgcacgtgaagaccctgagcctgatgacctggcggagccgttttctggaggagtctttctggagcctcgaggagactgccgctctggccaagcagctcccattaaagtctcccagcgagaatattttcttgcatatcgtggatctgtccgatcccaaacagatatggaaattcgtggaaaatttcaagcaggaacataaactgcatgttctgataaacaacgcggggtgtatggtgaacaaacgagagcttactgaagacggactggaaaagaatttcgctgctaatacgttaggagtctacatattgacgacaggattaatccctgtcttggagaaagagcacgacccgcgggtcattacagtatcatcgggtggaatgcttgtgcaaaagctcaacactaatgaccttcagtccgagcgcacgccttttgatggaaccatggtctacgctcaaaacaagcgtcagcaggtggtcttgaccgagcggtgggcccaagggcatcctgctatccatttctcctccatgcatccaggctgggccgatactcccggcgtgagacaggctatgcccggcttccacgctcgctttggagatcggctgagaagcgaagcacagggagcagacaccatgctgtggctggctctctcatcggctgcagccgcacagccatctggacgtttcttccagggagattttctccctggttgcgaaggttcctag

SEQ ID NO: 198090 - DNA, 492 bp, Artificial Sequence
  Description of Artificial Sequence: Synthetic coding sequence
atggccgaggaccggccccagcagccccagctggacatgcccctggtgctggatcagggcctgacaagacaaatgagattgagagttgaaagcttgaagcagcggggtgaaaaacggcaggacggggagaaattgctacagcccgcagagtcagtgtaccgcttgaatttcactcagcagcagcgactgcagttcgagaggtggaatgtggtgctggataagcccggaaaggtgaccattactgggacttcccaaaactggacccccgatctgacaaacctgatgacaaggcagctgcttgatcccactgccatcttctggagaaaggaagacagcgatgccatcgactggaatgaagcggatgctctggaatttggggaaaggctgtcagatctcgctaagattagaaaagtgatgtacttcctggtgactttcggtgaaggggtggaaccagctaacctgaaagctagcgtagtgttcaatcagctatag

SEQ ID NO: 198091 - DNA, 939 bp, Artificial Sequence
  Description of Artificial Sequence: Synthetic coding sequence
atggacggcggcaaccagagcgagggcagcgagttcctgctgctgggaatgtctgaaagtccagaacagcagcggattctgttctggatgttcctgtccatgtatctggtcaccgttgtcggtaacgtgttgatcattttagccatcagctcggactcccgcctgcatactcctgtctacttcttcctggctaatttatcctttacagaccttttttttgtgaccaacactatacccaagatgctggtaaatctacagtcccataataaagccatcagttatgcgggttgcctcacccaactgtacttccttgtcagcttagtggcactggataatcttatcctggcggttatggcctatgatcggtacgtggccatctgttgcccgttacactacaccacagctatgagtccgaaactctgtatcctgttgctgtctctgtgttgggtcctgtcagtgctttatggtctgatacacacgctgctcatgacaagggttacattctgcgggtcgcggaaaattcactacattttttgtgagatgtatgttttgttgcgaatggcttgctccaatatccagattaatcacactgtcctcattgctaccggttgtttcatttttctgatcccctttggtttcgtaataattagctatgtccttatcatccgcgccatacttcgcatccctagcgtttctaaaaaatataaggcattcagcacctgcgccagccacttaggggcagtgtctctgttttatggtaccctctgcatggtgtatctgaaaccactccatacttatagcgtgaaggacagcgtcgccaccgtgatgtatgcagtcgtgacccccatgatgaacccatttatctactcactacggaataaagatatgcacggcgcactagggcgtttactggataaacattttaagcgactcacatag

SEQ ID NO: 198092 - DNA, 939 bp, Artificial Sequence
  Description of Artificial Sequence: Synthetic coding sequence
atgagcggcaccaaccagagcagcgtgagcgagttcctgctgctggggcttagcaggcaacctcagcagcagcacctactctttgtgttcttcctttcaatgtatctggctactgtcctcggtaacttgttaataattcttagcgtgtccatcgatagctgcctgcacacacctatgtatttctttctgtcaaatctctcctttgttgacatctgcttcagctttacaaccgtgccaaaaatgcttgctaaccatattctcgagacacagaccatcagcttttgtgggtgcctcacgcagatgtacttcgtgttcatgtttgtcgacatggacaatttcttgctggccgtgatggcctacgatcattttgttgcagtgtgccaccccctgcattatacagccaagatgacccaccagctgtgtgccttgctagtcgcgggcttgtgggtggtggcgaatcttaatgtgttactccacaccttactgatggccccgctgtcgttctgcgccgacaacgccattacgcacttcttctgcgatgtcactccattgctgaaattaagttgctctgacactcacttgaacgaggtgattattctctctgagggggccctggttatgatcaccccttttctctgcattcttgccagctatatgcacattacatgcacagtgctgaaggtgccgtctaccaaggggcgctggaaggcattctctacttgcggctctcatctggctgttgtcctgttgttctacagtaccattatcgccgtttacttcaatccgttgtcctcccactccgcagagaaggataccatggcaaccgtgctctacactgtagtcacaccaatgctaaacccatttatttatagtctacggaatagatatttgaaaggtgctctcaaaaaggtggtcggaagggtcgtgtttagtgtgtag

SEQ ID NO: 198093 - DNA, 924 bp, Artificial Sequence
  Description of Artificial Sequence: Synthetic coding sequence
atgaaccacagcgtggtgaccgagttcatcatcctgggcctgaccaaaaagccagagctgcagggaatcatctttttgttcttcttgatagtgtaccttgtcgcttttctgggaaacatgttgatcattatcgctaaaatctacaataacacccttcatactcccatgtacgtgtttcttttgacattggccgttgtcgatatcatctgcacaacatctattatcccaaaaatgcttggaaccatgctcacctcagagaataccatctcctatgctggttgcatgtcccagctgtttctgttcacttggtccctgggggcggagatggtcttattcaccacaatggcttacgaccgctacgtagctatctgctttcctctgcactattccacgattatgaaccatcacatgtgcgtcgcgcttttgtcaatggtcatggcaattgcagtgaccaactcatgggtccacaccgcactcataatgcgactgaccttctgtggcccgaataccatcgatcacttcttttgcgagatcccaccacttcttgcgctaagttgcagtcccgtacgaattaacgaagttatggtgtatgttgctgatataaccctggctataggagattttattctgacgtgtatctcctatggcttcatcatcgtggcaatccttcgtatccggactgtcgaaggaaaaaggaaggccttctcaacttgctcaagccatttaaccgtagtgactctgtactactcacccgtgatctacacatacatccggcctgcctcctcttatacttttgagcgtgataaggtagtggccgccctgtacaccttggtgacgccaacactgaatcctatggtttactcttttcagaatcgtgaaatgcaggctggaatccggaaagtgtttgctttcttaaagcactag

SEQ ID NO: 198094 - DNA, 930 bp, Artificial Sequence
  Description of Artificial Sequence: Synthetic coding sequence
atggagaaccggaacaacatgaccgagttcgtgctgctgggcctgacggagaatcccaaaatgcagaagatcattttcgttgtgttctttgtcatatatattatcacagttgttggttatgttttgattgtcgtcacaatcactgccagcccatctttaggttctccaatgtacctaagtttagcctacttgagcttcatcgacgcctgttattcgtcggtcaatacccccaatcttatcacacattcgttgtacggcaagaaggctattctgtttaacgggtgcatgactcaggttttcggcgagcactttttcggcggggcggagggcatactgctgacggttatggcttacgatcactatgttgccatctgcaaacctttgcattatatgacaatcatgaatcagtgtgtctgcgctctgctcatgggtgtagtttggatgggaggatttcttcacgctacaatccagattctgtttatctttcaactgccattctgcggacctaatgtgatcgatcactttatgtgcgacctgaacccactgctcaacttggcgtgcaccgacactcacatgttggaattattcatcgccgccaattctggctttatctgcctgcttaacttcgccctgttgcttgtgtcctacgtcgtgatcctctgttcgttgaggactcactctctggaggccaggcataaagcactgtctacctgcgtgtcacacatcacagttgtgatcctgttctttgttccttgtattttcgtgtacatgagaccggctgccacgctcccaatagacaaagctgtggctatcttttacacaatgatcacccccatgctgaaccccctgatctatactcttaaaaacgcccaaatgaagaatgctatcaggaaattatgcagtagaaaggatatctccggtgacaagtag

SEQ ID NO: 198095 - DNA, 978 bp, Artificial Sequence
  Description of Artificial Sequence: Synthetic coding sequence
atgttcctgtacctgtgcttcatcttccagcggacctgcagcgaggaaatggaggaggaaaacgccacacttctgaccgagttcgtgttaaccggattcctgcaccaacctgattgtaaaattcctctgttcctggcgttcctggtgatttacctgataacaattatgggcaacttaggactcatcgttttgatatggaaggacccccatctgcacattcccatgtacctgttccttggaagcctggcattcgtggacgcaagtctctcttccacagtcacacctaagatgttgattaacttcctcgcgaagagcaaaatgattagtcttagcgagtgcatggttcagttttttagcctggtgacaaccgtgaccacggagtgctttctgttagccaccatggcttacgacagatacgttgccatttgcaaggctctgctctacccggtcatcatgacaaacgagctgtgcatacagctgctagtattaagttttattggcggcctgctgcatgccctgatccatgaggcctttagttttagattaaccttttgcaatagcaacatcattcagcacttctattgtgacatcataccattactaaaaatcagttgtacagattctagcatcaactttctcatggtgttcattttcgccggtagcgtccaagtgtttaccattgggacgatcttaattagttacacaataatcctgttcaccatcttggagaaaaaatcgattaaggggattcggaaagcagtttccacatgcggcgctcatctgctgagcgtgtcactttattacgggcccctgaccttcaagtatctggggtccgcatcaccccaagcggacgatcaggacatgatggagagcctcttttatacagtgatcgtgcccctcttgaatccaatgatatacagcctgaggaataagcaggttatagcctccttcaccaagatgtttaagtccaatgtttag

SEQ ID NO: 198096 - DNA, 963 bp, Artificial Sequence
  Description of Artificial Sequence: Synthetic coding sequence
atggagaccggcaaccagacccacgcccaggagttcctgctgctgggtttttctgcgactagcgaaattcagttcattctgttcgggttgttcctgtcaatgtacctggtcacgttcactggaaacctactaattattctggctatctgctccgattctcacctccacacgccgatgtacttttttctttctaacctcagtttcgccgatctatgttttaccagcaccacagtgcctaagatgctgttgaatattctgacgcagaacaaatttattacgtacgccggatgtctaagccagattttcttctttacctcattcggatgtctggacaatctgcttctgacagtaatggcctacgaccgcttcgtggctgtgtgtcacccacttcattacacagttattatgaatccgcagctgtgtgggctgttggtcctcggaagttggtgcatatccgtcatgggcagcctcttggagactctcaccgtactgaggttgtccttttgtaccgagatggagataccccactttttttgcgatctgctggaggtgctgaagttggcatgttccgacactttcattaacaatgtcgtcatctacttcgccactggtgtgctgggagtgatttcatttactggcatattcttcagctattataaaatagttttttcaatattgcggatctcaagtgctggccgcaagcacaaggctttttccacatgcgggagccatctgagtgtcgtgaccctattctatggcaccggattcggagtgtatctgtcaagcgctgccaccccatccagccgtaccagcttggtagctagcgtgatgtacactatggtgacccctatgctgaaccccttcatttactccctaagaaatactgacatgaagcgggcactgggacgattgttaagtcgggctacattcttcaacggagacatcactgccgggttgtcctag

SEQ ID NO: 198097 - DNA, 960 bp, Artificial Sequence
  Description of Artificial Sequence: Synthetic coding sequence
atggagcggggcaaccagaccgaggtgggcaacttcctgctgctgggatttgccgaagacagtgacatgcagttgctcctgcatggcctattcctgtctatgtaccttgtgactatcatcggaaacctgctaatcatactgacaatatcctccgatagccacctgcacacgcccatgtatttttttctcagtaatctgtccttcgcggacatctgctttacatcgaccaccgtgcccaagatgcttgtgaacatccagacacaatccaagatgataaccttcgccggatgcctgactcagatattcttcttcattgcctttggctgtcttgacaacctgctgcttacaatgaccgcatacgacagattcgtagctatctgctatccactgcattacaccgttattatgaatccacggctttgtggcttgctggtgcttggcagctggtgcatctcggtgatgggatccttgttggagactttgaccatcctgcgtctttccttttgtacaaacatggagattcctcacttcttctgtgacccgtcagaggtgctaaagttagcatgttccgacacattcattaacaatattgttatgtacttcgtcacaatcgtgcttggggtgtttcctctctgcggcatactgttcagttactcccagatcttctccagcgtgttgcgcgtctcagcccgcggccagcacaaagccttcagcacatgcggatctcatctctcggtcgtctccctgttctatgggaccggactcggggtttacctgagctccgcggttacgccacccagtcgtactagtctggctgcctcagttatgtataccatggtaacccccatgctgaaccccttcatttattccttaagaaacaaggacatgaaaggttctctcggacgcctgctgctccgcgcaaccagcttaaaggagggcactatagcaaagctgtcctag

SEQ ID NO: 198098 - DNA, 939 bp, Artificial Sequence
  Description of Artificial Sequence: Synthetic coding sequence
atggaggccgagaacctgaccgagctgagcaagttcctgctgctgggcctgtcggatgaccccgaactccagcccgtgctctttgggctcttcctttcgatgtatttggtgactgtgttagggaacctgcttataatcctggccgtgtcctccgacagccacctgcacactcctatgtatttcttcctcagcaatctatcgttcgtcgacatctgctttatctcaaccactgtgcccaaaatgttggtatccattcaggctcgtagtaaggacatctcttatatgggttgcttgacccaggtgtattttctcatgatgtttgctggaatggacactttcctattggccgtaatggcctatgatcgattcgtagccatttgtcacccgctgcactacactgtgataatgaatccatgcctgtgcggcctgttggtcctcgccagttggtttatcatattctggtttagtctggtacacattctgctcatgaaacgcctcacatttagcacagggactgagattccacacttcttctgtgaacctgcccaggttcttaaggtggcctgtagcaacactctgctcaataacattgttctgtacgtcgctacggcccttcttggagtattcccggtggcggggatcctgttctcctattcccaaattgtcagctccctgatggggatgagctctacaaaaggcaaatacaaagcatttagcacttgcggcagccacctgtgcgtggtgtccctgttctacgggacgggcctgggggtgtatctttcgagtgcagttactcattctagtcagtcatcctccaccgcctccgtgatgtacgctatggtaaccccaatgctgaatcctttcatttacagcctgagaaacaaagacgtgaagggcgccttggagagactgctttcaagggccgacagctgcccatag

SEQ ID NO: 198099 - DNA, 972 bp, Artificial Sequence
  Description of Artificial Sequence: Synthetic coding sequence
atggacagcgacgccagcctggtgagcagccggcccagcagccccgaaccagatgatctgtttctgccagcacgatccaaaggaagttctgggtctgcgttcacaggaggaacggtgagcagtagcaccccatccgactgtccaccagagctttcggccgagcttcgcggcgcgatggggtcggctggagcgcacccaggcgataagctcggtggcagcggtttcaagtcttcttcttcctcaacgtctagtagcacttcatcagccgcggcatctagcactaaaaaggacaagaaacagatgaccgagccagaactgcaacagctgaggctgaagattaatagcagggaaaggaagaggatgcacgacctaaacatcgccatggatggactgagggaggtcatgccttacgcgcacggcccttctgtccggaaactgtctaagatcgcaacattgctgttggcgcggaactacattctgatgctgacgaacagcctggaggagatgaagcgcctggtgtccgagatctatggcggccatcacgctggcttccatcccagtgcttgcggaggtctggcacactccgcccccttgcccgctgccaccgctcaccccgctgccgcggcccacgccgcccaccatcctgccgtgcaccatccgattctgccacctgccgctgcagcagcggcagccgcggcggccgctgccgccgttagtagcgcatccctccctggtagcgggctgcccagtgtcggttccattagacctccccatggactgttgaagtccccctcggccgccgccgcagcaccactgggaggaggaggtgggggctccggcgcttctggaggcttccagcactggggggggatgccatgtccctgctcaatgtgccaggtacctccgccccatcatcatgtgtcggcaatgggggcaggatccctgcccagactgactagtgacgcaaagtag

SEQ ID NO: 198100 - DNA, 972 bp, Artificial Sequence
  Description of Artificial Sequence: Synthetic coding sequence
atggacagcgacgccagcctggtgagcagccggcccagcagccccgagccagacgatctgttcctgccggcaaggagtaaaggctctagcggtagcgccttcacaggcgggacagtgagttcctctaccccatcagactgcccccccgaactgagcgccgagctgagaggcgcaatgggttctgccggtgcccaccccggggataagctgggcggctccggctttaaaagttcatctagtagcacttcctcctccaccagctccgcagcagcctcctcaactaagaaggacaagaagcagatgaccgaacccgagcttcagcaactgaggttgaagattaattcacgggagcggaagcgaatgcatgatttgaacatcgcgatggacggtctccgcgaggtgatgccttatgctcatggccccagcgtcaggaaactgtcgaagatcgccactctgctcctggcacggaactatatcctgatgctcaccaattcacttgaggagatgaaaagattggtctcagagatctacggtggtcatcatgctggctttcatccgagcgcttgtggaggcctggcgcactccgctcctctgcctgctgctacggcccacccggccgccgcagcgcatgccgcgcaccacccagctgtgcaccacccaattctccctccggcggccgccgcggccgccgctgccgccgccgcagccgctgtgagctcggctagcttacctggatccggattgccttcggtggggtctattcgccctccacatggcttgttgaagagcccatcagccgccgctgctgcccctctcggcgggggtggaggcggatccggtgcaagcggcggattccaacactggggtggaatgccttgcccttgctcgatgtgtcaggttccgcctcctcaccaccacgtgtctgcaatgggtgccggatcactcccccgtctcacctcagacgcaaaatag

SEQ ID NO: 198101 - DNA, 189 bp, Artificial Sequence
  Description of Artificial Sequence: Synthetic coding sequence
atggacagcgacgccagcctggtgagcagccggcccagcagccccgagccggatgacctgtttctgccagcccgtagcaaggggagcagcggatcagccttcaccggcgggactgtgagtagtagcaccccctcagattgccccccggagctctctgcagaactgagaggagctatggggtcagcctag

SEQ ID NO: 198102 - DNA, 1323 bp, Artificial Sequence
  Description of Artificial Sequence: Synthetic coding sequence
atggagtaccagatcctgaagatgagcctgtgcctgttcatcctgctctttttgactccgggtatactgtgcatttgtcctctgcaatgcatttgcaccgagcgacaccgtcatgtggattgtagcggcaggaacctgagcactctccccagtgggctgcaggagaacataatccacttaaacttgtcttataatcattttacagatctgcataaccagctcacacaatacactaacctgcgcacgctggatattagtaataacaggctcgaatccctccctgctcacttgccaagatctctgtggaatatgtcagcggctaacaacaatattaagctcctggataagtccgacacggcataccagtggaaccttaagtatttagacgtttccaagaacatgctcgagaaagtggtcctgattaagaatacgctgcgcagcctcgaagtactgaaccttagtagcaacaaattgtggacggtacctaccaatatgccgtctaaacttcacattgtggatctctctaataatagcctgacccagattctccccggaaccctcatcaatctcactaacctcacacatctgtatttgcacaacaataagtttaccttcatccccgatcaatcattcgatcaactgttccaactgcaggagattacactctacaataacaggtggtcttgcgaccataagcaaaatatcacatacctgctgaaatggatgatggaaactaaagcccatgttattggcactccatgttctacccagatatcctccctgaaagagcataatatgtaccccacaccatctggattcacgtcctctctttttacagtgtcaggcatgcaaactgtggataccattaatagcctctcagttgttacgcaaccgaaggttacaaagatccccaaacagtacaggactaaggagaccacttttggggccacactcagcaaggatacaacttttacatccaccgacaaggctttcgtgccttacccagaggacacgagcacggagactatcaactcccacgaggctgctgcagctaccctgaccatccacctgcaggatgggatggtcaccaacacatcattaacgtccagcacaaaaagctcaccgacaccgatgacactgagcattacaagcggaatgccaaacaatttcagcgagatgcctcagcagtcgacgaccctgaacctgtggagagaggagacgacgacaaacgtgaagaccccgctaccatccgttgcgaacgcttggaaagtcaatgcctctttcctcctgctgctgaatgtagtggtgatgttggctgtttag

SEQ ID NO: 198103 - DNA, 819 bp, Artificial Sequence
  Description of Artificial Sequence: Synthetic coding sequence
atgaacagcgacagcagcagcgtgagcagccgggccagcagccccgatatggatgagatgtatctgagagaccaccatcacagacaccaccaccaccaagaatcgcgactcaattctgtgtcctctacacagggagacatgatgcagaagatgcccggcgaatcactctctagagcaggcgcaaaggccgccggtgagtcttcaaagtataagatcaaaaagcaactctcagagcaggacttgcagcaactgcgcctgaaaatcaatgggagggaacgcaaacgcatgcatgatttgaacttggccatggacggtttgcgcgaagtgatgccatatgcacacggcccatccgtgcggaagctgagcaaaatcgcaaccctcctccttgccagaaactatatccttatgttaacttcttcactagaggagatgaagagactggtcggagagatatatggagggcaccactctgcttttcattgcggcactgtgggccactctgccggtcatcccgcgcatgctgctaacagcgtgcacccagtccatccaattctggggggcgctctgtcttcagggaatgcttctagccccctaagcgctgccagtctccctgccatcggcactataaggcctcctcactccctgttaaaggctccaagcacacccccagcgctacagttaggcagcggattccaacactgggctggactcccgtgcccttgtaccatatgccaaatgcccccacctccacacctgagtgcattgtccacagctaatatggcccggctctcagccgagtcaaaagacttgctcaagtag

SEQ ID NO: 198104 - DNA, 375 bp, Artificial Sequence
  Description of Artificial Sequence: Synthetic coding sequence
atgtggaagggctgcctgaccctgtacaccggccggggcggcgagcttcaaaaaattggggaattttgcatggtgtatagtgaggtgccaaacttttctgagccaaaccccgattacagggggcagcagaacaagggcgcccagtcagaacagaagaataattcaatgaacagtaacatgggaacgggtacattcggtccagtgggcaatggtgttcatacagggcctgaatccagagagcatcagttctcgcacgccggtagatcaaacggaaggggtctgattaatccccagctacagggaaccgcaagcaatcagaccgtcatgaccacgatcagcaatggaagggatccacgcagagccttcaagcgatag

SEQ ID NO: 198105 - DNA, 375 bp, Artificial Sequence
  Description of Artificial Sequence: Synthetic coding sequence
atgtggaagggctgcctgaccctgtacaccggccggggcggcgagttacagaagattggcgagttttgcatggtgtattctgaggtcccaaacttttccgaacccaacccagactaccgggggcagcaaaacaagggggcacagtctgagcagaaaaacaacagcatgaacagcaacatgggtactggcacctttggtcccgtgggaaacggcgtccacactggaccagagtccagggagcaccagtttagtcacgcagggcgctcaaacggtcggggccttatcaatccacagctgcaggggaccgcctcaaaccagacagtgatgacgacaattagcaatggccgagaccccagacgagccttcaagcggtag

SEQ ID NO: 198106 - DNA, 615 bp, Artificial Sequence
  Description of Artificial Sequence: Synthetic coding sequence
atgaaccgggtgaacgaccccctgatcttcatccgggacatcaagccagggctcaagaatctgaacgttgtgtttattgtgttggaaatcggtagagttacaaagacaaaagacgggcatgaggttaggagctgtaaggtggccgacaagacgggtagcataaccatctcagtttgggatgagatcggcggcctgattcaaccaggcgatattattcgtttaactcgcgggtatgctagtatgtggaagggctgtctaaccctgtatacaggtaggggcggagaattgcagaagattggagaattttgcatggtgtactccgaagtgcctaattttagcgagcctaaccccgattaccgaggccagcagaataaaggggcccagagtgagcagaagaacaactcaatgaattcaaatatgggaaccggtaccttcggcccggtcgggaatggggtgcatactggacccgaatcacgagagcatcagttttcacatgccggtcgctctaacggtcgtgggctgatcaatccccaattgcagggcacagccagcaaccagactgtcatgacgacaatctcgaacgggagggatccccgtcgggcattcaagaggtag

SEQ ID NO: 198107 - DNA, 636 bp, Artificial Sequence
  Description of Artificial Sequence: Synthetic coding sequence
atgaccaccgagaccttcgtgaaggacatcaagcccggcctgaagaatctcaacctcatatttatcgtgcttgaaacagggagggtgactaagaccaaggatgggcacgaggttcgaacttgcaaggtggccgacaaaaccggcagcataaatattagcgtgtgggatgatgtgggaaatctgatacagcctggggatatcatacggctcaccaagggttacgcttcggtcttcaagggttgtttaactctctataccggacgaggcggcgatttgcagaagatcggagagttctgcatggtgtacagcgaggtccccaacttctcggaaccaaaccccgaatacagcacccagcaggcacccaacaaagccgtgcagaacgatagcaacccatccgcttctcagcctactacaggcccgtctgctgcctctcccgcctccgagaatcagaatggaaacggtttgtcagccccaccagggcccggcggtggacctcatcccccacacacaccttcacaccctccatctacccggattacacgaagccagcccaaccacacccctgccggaccacccggcccctcctccaacccagtcagcaacggaaaggagaccaggaggtcttctaagaggtag

SEQ ID NO: 198108 - DNA, 636 bp, Artificial Sequence
  Description of Artificial Sequence: Synthetic coding sequence
atgaccaccgagaccttcgtgaaggacatcaagcccggcctgaagaatctaaacttgatttttattgttctggaaactggacgtgtgaccaagacaaaggatgggcacgaggtgcgtacgtgtaaggtggccgataagaccgggagcattaacataagtgtctgggacgacgtcggcaacctgattcagccaggtgatatcataaggctcaccaaaggatacgcttccgtgtttaagggttgtcttaccctgtacaccgggcgcggtggtgacctgcagaaaataggggaattttgcatggtatacagcgaggtacccaatttttcagagcccaatcccgagtattcaacacaacaggcacccaataaggctgtacagaatgactcaaatccaagtgctagccaacccacgaccggaccttcagcagcgtcccctgcttcggaaaaccaaaacgggaacggcttgagtgcacctccgggtcctggcggcggtcctcatccacctcataccccaagccatccccctagcactagaataacacggtcccagcctaaccacacacccgccggaccgcccggccccagcagtaacccggtttccaatggaaaagaaactcgtcgctcctccaagaggtag

SEQ ID NO: 198109 - DNA, 636 bp, Artificial Sequence
  Description of Artificial Sequence: Synthetic coding sequence
atgaccaccgagaccttcgtgaaggacatcaagcccggcctgaagaatcttaaccttatctttatagttctggaaactggaagggttaccaagacgaaggatggacacgaggtgcggacctgcaaggtggcagataaaacaggttccattaacatcagtgtgtgggacgatgtggggaatctcatacagcccggggatatcattcggctgacgaagggatatgcctctgtgtttaaaggttgcttaactctatacaccgggaggggaggggatttgcagaagattggtgagttctgcatggtgtacagtgaggttccaaactttagcgagcctaatcccgaatacagtactcagcaggcccctaacaaagcggttcagaacgattccaaccctagtgcctcccaaccaactactgggccctctgccgcttcaccagcgtccgagaaccagaacggcaatgggctctccgccccccctggccctgggggcggaccccatccgccacatacccccagtcatcccccatcaaccaggatcactcgctcccagcctaaccatacaccagccggaccccctggtccctcctcaaatcccgttagcaacgggaaagagactagaaggagctcgaaaagatag

SEQ ID NO: 198110 - DNA, 459 bp, Artificial Sequence
  Description of Artificial Sequence: Synthetic coding sequence
atgaccaccgagaccttcgtgaaggacatcaagcccggcctgaagaacctgaacttgatatttatcgtactcgagacaggaagggtgactaaaacaaaagatggacatgaagttagaacatgcaaagtagcggacaaaaccggctctattaacattagtgtttgggatgacgtaggcaatctgatccaaccgggcgatatcattcgcttaacaaagggttatgccagcgtctttaagggctgcctgactctgtatacggggaggggaggcgatctccaaaagatcggggagttttgcatggtgtactccgaagttcccaatttctccgagcccaaccccgaatactccacacagcaagcccctaataaggccgtgcagaacgattctaacccgtcagccagccagcccaccaccgggccctcagcggcctcgcccgccagtgagaaccagaatggctag

SEQ ID NO: 198111 - DNA, 435 bp, Artificial Sequence
  Description of Artificial Sequence: Synthetic coding sequence
atgaccaccgagaccttcgtgaaggacatcaagcccggcctgaagaatctgaaccttatcttcatcgtcctggaaactggccgggtgaccaaaacaaaagacggacacgaggttcgcacgtgtaaagtggctgacaaaactggcagcatcaacatttcggtttgggatgacgttggcaacctgatccagccaggcgacattattcggttaacgaaaggctatgcgtctgtgttcaaggggtgcctgactctctacacaggccgaggcggggacctacaaaagatcggtgagttctgcatggtgtactcagaggtgccgaatttctctgagcccaaccctgagtattcaacacagcaggccccaaataaggccgtgcagaatgatagtaatcccagtgcttcacagcctaccactggacccagtgctgccagctag

SEQ ID NO: 198112 - DNA, 2409 bp, Artificial Sequence
  Description of Artificial Sequence: Synthetic coding sequence
atgggccacccccccctggagttcagcgactgctacctggacagccccgattttagagaaaggctgaagtgctacgagcaagaattggaacgtactaacaaatttattaaagatgtgattaaggatggaaacgcattaatctccgcgatgagaaactactcttccgccgtacagaaattctcgcagactctgcaatccttccagttcgacttcatcggagacacgctcaccgacgatgagatcaatatagcggagtcgtttaaggagtttgcggaactattaaatgaggtggagaatgagaggatgatgatggtgcacaacgcaagtgacttgttgatcaaacctctagaaaatttcagaaaagagcagattggattcaccaaggagagaaagaagaagtttgaaaaggatggggaaaggttctactctctgcttgaccgccatcttcacctttcgtccaaaaagaaggaatcacagctccaggaagcagatctacaggtcgataaggagcgacacaacttctttgagagctctctggactatgtatatcaaatacaggaggtgcaggaaagcaagaaatttaacatcgtcgagccggtgctggcctttctgcattccctcttcataagcaattctttaactgttgaactgacccaggactttctcccttataagcagcagcttcagctcagcctgcagaacacccgcaatcacttcagctcgacacgggaagaaatggaggagttgaagaagcgcatgaaagaggcaccccagacatgcaaacttcctggacagcccaccatcgaaggatatctgtatactcaagaaaagtgggccttaggaatttcctgggttaagtattactgccagtacgagaaagaaacaaagaccttgacaatgacaccaatggagcagaagcccggagctaaacaggggccactcgacttgacattaaaatattgcgtccggcggaagacggagtccatcgacaagcgattctgttttgatattgagaccaacgagagacccgggaccattaccctccaggccctctctgaggccaatcggcgactgtggatggaggctatggacggaaaggaaccaatctatcacagcccaatcactaaacagcaagaaatggagctgaatgaggttgggtttaaatttgtaaggaaatgcattaacattatcgaaacaaagggtatcaaaacggaaggcctataccgcacagtgggctccaacatacaggttcagaagctgctgaacgcctttttcgaccctaaatgtcctggggacgttgactttcacaattctgattgggacatcaagacgatcaccagttctctgaaattctatctccggaacctcagtgaacccgtaatgacctacagactgcataaggagctggtaagtgctgctaagtctgataatctggattaccgtcttggagctatccactcacttgtttataagttacccgaaaaaaacagagagatgctggaacttcttatcaggcacctggttaacgtctgtgagcacagcaaggagaatttgatgactcctagcaacatgggcgttattttcggtcctacattgatgcgcgcccaagaggacaccgttgccgccatgatgaatatcaagtttcagaatatcgtggtagaaatcttgattgagcatttcggcaaaatctaccttggcccccccgaggaatccgccgctcctccagtgcccccccctagagtgaccgccagaagacacaagcccattaccatttccaaaagactgttacgagaaaggacggtgttttatacttcaagcttggacgagtccgaagatgagattcagcatcaaacccctaacgggacgattacatccagtatcgagccacccaagcccccccagcatcctaagctgccgatccaacgcagcggtgagacggacccgggaagaaaaagtccttccaggcctatcctggacggaaagctcgagccttgccctgaggtggacgtgggtaaactggtatctagacttcaggatggaggcaccaagattactccaaaggccacaaacggtcccatgcccggctcaggccccactaaaacgccttcctttcacattaagcgacctgccccaaggccactcgctcaccacaaggaaggggacgccgattcgttttccaaggtgaggccgcctggcgaaaagccaacgattatcaggccgcctgtgcgccctccagatcccccttgccgcgctgcaactcctcaaaagcctgaaccaaagccagacattgtagcaggaaatgccggcgagatcacaagctctgtggtggccagtaggacacggttcttcgaaacggcctctaggaagactggctcaagccagggccgcctgccaggcgacgagagctag

SEQ ID NO: 198113 - DNA, 2085 bp, Artificial Sequence
  Description of Artificial Sequence: Synthetic coding sequence
atgggccacccccccctggagttcagcgactgctacctggacagccctgactttcgcgagcgacttaaatgttacgagcaagaactcgagagaaccaataagttcattaaagacgtgatcaaggacgggaacgctctcattagtgcaatgagaaactactcctccgctgtgcagaagttttctcaaacgctgcagagcttccagtttgatttcatcggagataccctgaccgatgacgagataaatatcgccgagagtttcaaagagtttgccgaactgcttaacgaagtggagaatgagagaatgatgatggtccacaacgcctcggacctgctcattaaaccacttgaaaatttcaggaaagaacagatcggattcacaaaggaacgcaaaaaaaaattcgagaaagacggtgaacggttttattccctgcttgacaggcacctgcatctttcctcaaagaagaaggaaagccagcttcaagaagccgatctccaggttgacaaggagcgtcacaactttttcgagagctccctcgactacgtgtaccaaattcaagaagtgcaggaatccaagaaattcaacattgtagaaccagtacttgccttcctccacagcttattcatttctaactccctgaccgtggagctgacccaagacttcctgccatataagcagcagttgcagctgtctcttcagaatacaaggaaccacttctccagtactagggaggagatggaagaactcaaaaagcgaatgaaggaggccccccaaacatgcaaattgcctggacagcccacgatcgagggctatttgtatactcaggaaaagtgggcgctagggatttcctgggtaaagtattattgtcagtatgaaaaagaaacgaaaacattgactatgactccaatggagcaaaagcccggagctaaacagggacctttagatctgactctcaagtactgtgtgcggagaaagacggagagcatcgataagcgcttctgcttcgacatcgagaccaatgagcgccccggcactattacgctgcaggccctgtcagaggccaaccggagactgtggatggaggcaatggacggcaaagagcctatctaccacagtccgatcaccaaacagcaggagatggaactgaatgaggtgggctttaagttcgttaggaaatgcataaatatcatcgagacaaagggcataaaaactgaaggcttgtataggacagtgggttcaaatattcaggtccagaagcttctgaacgccttcttcgatccgaaatgtccaggcgatgtagacttccacaatagcgattgggatatcaaaacaattaccagctccctgaaattctacctgcggaacctcagtgaacctgtcatgacatatcgactccacaaggagctggtttctgcagccaagtccgacaacctggattatcggctcggggccattcactctctggtctacaagttaccagaaaaaaacagagagatgctggagctacttattcgccatcttgtgaatgtctgcgagcatagtaaagaaaatctcatgaccccaagcaacatgggcgtgatatttggtcccacgctcatgcgagcacaagaagatacggtcgctgcaatgatgaacataaaattccagaatatagtggtcgagatactcatcgagcacttcgggaaaatatacctgggaccccctgaggagtccgccgctcctcccgtgccacccccaagagtgactgcccgcaggcacaagcccatcacgatctctaaacgcctgctgagagagcgcaccgtgttctacacctcatcgctcgatgagtctgagggcgatgccgattcattctccaaggttagacctccaggcgagaaaccaactataatcaggccccctgttcgccctcctgaccccccatgcagggctgctacacctcagaagccagaacccaaacccgacattgtggccggcaacgccggagaaatcacgagttccgtggtcgccagccgcacgcgctttttcgagacagccagtcggaagacaggaagctctcaggggagactcccgggagatgagtcttag

SEQ ID NO: 198114 - DNA, 225 bp, Artificial Sequence
  Description of Artificial Sequence: Synthetic coding sequence
atgctggagctgctgatccggcacctggtgaacgtgtgcgagcacagtaaagagaatctcatgactccttctaacatgggcgtaatttttggtccgactctcatgagagctcaggaggacaccgtggccgcaatgatgaacatcaagttccaaaatattgtggtggaaatattgatagagcactttgggaaaatctcctcattctttctgcaccggagtatttag

SEQ ID NO: 198115 - DNA, 3111 bp, Artificial Sequence
  Description of Artificial Sequence: Synthetic coding sequence
atggccagcagcgtgggcaacgtggccgacagcaccggcctggccgaattggcccacagagaataccaggccggtgactttgaggcagccgaacgccactgcatgcaattgtggcgccaggagcctgataataccggcgtgctactgctgctttcttctatccacttccagtgtcggcgcttggatcgatcagcccattttagcaccctggccatcaagcagaatcccctcttggcggaagcctactctaacctgggcaacgtctacaaggaacgtggccagcttcaagaggcaatcgaacattatcggcacgctcttaggttgaaacccgacttcatagatggctacataaatctggccgccgccctggttgctgccggcgatatggaaggcgccgttcaggcctacgtgtctgctctgcagtataaccctgacctgtattgcgtcaggtcggatttaggaaatctgctaaaggcactcgggaggctggaggaggccaaggcttgttatcttaaagcaatcgagacccagccgaactttgccgtagcctggagtaacttggggtgcgtgttcaatgcgcaaggtgaaatttggttggccatacaccattttgaaaaggctgttacccttgaccccaatttcctggatgcctacattaatctcggaaatgtgttaaaggaagccagaatctttgaccgggcggtcgccgcatacctaagggcactctcgctgagccccaatcacgcagttgtgcacgggaatctagcatgtgtgtattatgagcagggcctgatagacttggccatcgatacttatcgtcgcgctatcgagcttcaaccccactttcctgacgcctactgtaacctggctaacgctctgaaagagaaaggttctgttgctgaagccgaggactgttacaatacagccttaagattgtgtccgacccatgctgactcattaaacaacctggctaacataaagcgggagcagggcaacatcgaggaggcagttcgcctctacagaaaggcccttgaggtgtttcccgagttcgccgcggcccattcaaacttggccagcgtattacaacagcagggaaaactgcaagaagcactaatgcactataaagaggccatacgtatctctcctacctttgctgatgcgtactctaacatgggaaacactctgaaagagatgcaagacgtgcagggcgccctccagtgctatactcgcgctattcagattaaccctgcctttgctgacgcacactctaatctcgcttccattcacaaggacagcggaaacattccagaggctattgcaagctataggaccgccttgaagctcaaacctgattttcctgacgcctactgtaatctcgcgcactgccttcagatcgtgtgcgactggaccgactatgacgagaggatgaaaaaacttgtgagtatcgttgccgatcagttagagaagaacagacttccatctgtccacccacatcactctatgctgtatcccctgagccacggtttcagaaaagcgattgccgaacgacacgggaatttgtgcctcgacaagattaatgtgctgcacaagccgccctatgagcacccaaaagacttgaagctctccgatggtaggctcagagtcggttacgtgtccagcgatttcggcaatcaccctacgtcccatctgatgcagtccataccgggaatgcacaaccccgataaattcgaagtcttttgttacgccctgtcacctgatgatggcactaatttcagggtgaaagtcatggctgaggccaaccacttcatcgaccttagccagattccatgtaacggtaaagccgccgatcggattcaccaggatggaattcacattctggttaatatgaatggatacacaaagggggcccgcaacgaactctttgccctgcgccctgcacctattcaagccatgtggctgggctatccggggacttccggggccctgttcatggactatattattaccgatcaggaaaccagccccgcagaggtggcagaacaatatagtgagaaactcgcctatatgccgcacactttcttcattggcgatcacgccaacatgtttccccatttgaaaaagaaagccgttatcgacttcaagagtaatgggcatatttacgataaccggatcgttcttaatggtatagacctgaaggcatttctcgatagcctccctgacgttaaaatcgtaaaaatgaaatgccccgatggcggcgataatgccgatagctccaatacggcactgaatatgcctgttatccccatgaacaccattgcagaggcagttatagaaatgatcaacagaggccagattcagatcactattaacggttttagtatcagcaatgggttggcaactactcaaatcaataataaagctgctactggcgaggaagtaccccgtactatcattgtgaccacgaggagtcagtatggcttgccagaggatgcaatcgtctactgtaatttcaaccagctgtacaagattgatccgtccaccctgcagatgtgggctaatatactcaagcgagtcccaaattcagtgctctggttattgcggttccctgctgtcggcgaacctaatatacagcaatacgcccaaaatatgggtctccctcagaatcggattatcttttctcctgtagcccccaaggaggagcatgtccgcagggggcagctggctgacgtgtgtctggacactcccttgtgtaatggacacacaacgggaatggatgtcttatgggcgggaacgcctatggttaccatgccaggagagactttagcctcacgcgtcgccgcttcccagctgacgtgtctgggctgtctggaactcattgccaaaaatcgtcaggaatatgaagacatagccgttaagctgggtacagatctggagtatcttaaaaaggtgcggggtaaggtgtggaagcagcgcatatcatcacctctattcaatacaaaacagtacacgatggagctagaaagactctatctccagatgtgggagcactacgccgccgggaataagcccgatcacatgattaagccagtggaagtaaccgagagtgcatag

SEQ ID NO: 198116 - DNA, 3141 bp, Artificial Sequence
  Description of Artificial Sequence: Synthetic coding sequence
atggccagcagcgtgggcaacgtggccgacagcaccgagcccaccaagaggatgctgagttttcagggtctcgctgagctggcccatcgggagtaccaagctggtgatttcgaggcggcagaaagacattgtatgcaattgtggagacaggagccagataatacaggagtattgctactactgtcatctatccatttccaatgcaggcgcctcgatcgaagcgcgcactttagcacccttgcaataaaacagaacccactgcttgctgaggcgtacagcaatcttggaaatgtgtacaaggagcggggccagttacaggaagcgattgaacactatcggcatgctctccggctgaagccggacttcattgacggctacataaatttagctgccgccctcgtagcggctggagacatggaaggtgccgtgcaggcctatgtaagtgcattacagtacaacccagatctatactgcgtgcggtcagacttaggcaatcttcttaaagcccttggccgccttgaggaggcaaaggcttgttacctgaaggccatcgaaacccagccaaactttgcagttgcctggtcaaacttgggatgcgtgtttaacgcccaaggggaaatctggcttgccatccaccattttgagaaagccgtcactctggaccccaactttcttgacgcatatataaacctgggcaatgtgctgaaggaggcgcgcatttttgaccgagcagttgccgcctacttgcgagcgctatctctatcccctaatcacgctgtggtgcatggcaatttggcctgtgtttactacgagcaggggcttatcgatctggcgattgatacgtacagacgagccattgagctgcagccccattttcctgacgcctattgtaatctggcaaatgccctcaaagagaaaggctctgtcgcagaggcagaagattgctataataccgccctaagattgtgtcccacacacgccgactcactgaacaacctggccaacataaaaagagaacagggcaacatcgaagaggccgtccgcctctaccgaaaagccctggaggtttttcccgagtttgccgcagcacattccaaccttgcatcagtcctgcagcaacagggaaaacttcaggaagccctgatgcattataaagaagccattcggatctctcctaccttcgcagacgcttactcgaacatggggaacaccctgaaggaaatgcaggatgtccaaggggccctgcaatgttatacccgcgccattcagattaatcccgcttttgctgacgcacactctaacctggccagcatacacaaagattcaggtaacattcctgaagcaattgcctcctaccgcaccgccctgaaactcaagcccgactttcctgacgcatattgtaacctggcacactgtctgcagatcgtctgtgactggacagattacgatgagaggatgaagaaacttgtgtcaattgtcgccgaccagctggagaagaaccgactaccctccgttcacccgcaccacagcatgctctatccattgtcccacgggttcaggaaagctattgctgagagacacggcaatttgtgtctggataaaatcaacgtgctgcacaaacctccatacgagcaccctaaggacctcaagctgtccgacgggcggctgagggtgggttatgtctcatccgactttggaaatcacccaacatctcatctgatgcagagcattcccggaatgcataaccccgacaaatttgaagtgttttgttacgcactgagccccgatgacgggactaattttagggtaaaggttatggctgaagctaaccattttatcgatctctctcaaataccctgcaacggcaaagccgcagataggattcatcaggatgggatacacatccttgtaaacatgaacggctataccaagggagcacgcaacgaactgtttgcactgcgaccggctcctattcaggccatgtggctgggttaccccggaaccagcggagccctattcatggactacattattaccgaccaggaaacttctccagcggaggtggccgaacagtattcagagaaactggcatacatgccgcacactttcttcattggggatcatgctaatatgttcccgcatctgaagaaaaaagcggttattgacttcaaatccaatggccatatctacgataacagaattgtgctgaatggaattgacttgaaagcattcctcgacagtctccctgatgttaagatcgttaagatgaagtgtccagacggcggcgataatgccgattcttctaacacggcacttaacatgccggtaatcccgatgaacacaatagctgaagctgtgatagaaatgatcaataggggccagattcagattactattaacggcttttccatctccaacgggctggccacaacccagatcaataacaaagcagctaccggagaagaggtacctcgtacaataatcgtgaccactcggagccagtacggcctccccgaggatgcaattgtatactgcaatttcaatcaactgtataaaatagatccctcaaccttgcagatgtgggctaatatcctgaagcgtgtgcccaactccgtcctgtggttgttacggttccctgctgtgggggagcctaacattcagcagtacgcacagaacatggggctgccacagaacagaataatcttttctcccgtggctcctaaagaggagcacgttagaagaggacagttagcagacgtgtgtctggatacacctctgtgtaatgggcatacaactggcatggacgttctctgggctggcacgccaatggtaacaatgcctggggaaaccctggcgagtagagtggctgctagccagctaacgtgcctcggatgtctggagctgatcgccaaaaacagacaggaatacgaggatatcgccgtcaagctgggtacagatttggagtacttaaaaaaggttaggggcaaagtttggaaacaacgcatttcttccccgctgtttaacaccaagcagtacactatggagctcgaacgcctgtacttgcaaatgtgggagcattatgcagcaggtaacaagccagatcatatgattaagccagtggaagtaacagaatctgcttag

SEQ ID NO: 198117 - DNA, 330 bp, Artificial Sequence
  Description of Artificial Sequence: Synthetic coding sequence
atgagcatcaccgacgtgctgagcgccgacgacatcgccgccgccctccaggaatgccgtgaccctgacactttcgagccccagaagttcttccagacatcagggctatctaagatgtcagccaatcaggtaaaggatgttttcaggtttattgacaacgatcagtcaggctatctcgatgaagaggagctcaagttcttcctgcaaaaatttgagagtggggcccgggaattaactgaaagcgagaccaaatctctgatggccgcagccgacaatgacggggatggtaagattggtgccgaggagttccaagagatggtacattcttag

SEQ ID NO: 198118 - DNA, 330 bp, Artificial Sequence
  Description of Artificial Sequence: Synthetic coding sequence
atgagcatcaccgacgtgctgagcgccgacgacatcgccgccgccctgcaggaatgccgggaccctgacacattcgaacctcagaagttttttcagacatccgggctttctaagatgtcggcaaatcaagtcaaggacgtgttccgttttatagacaacgaccagtcaggctaccttgatgaagaagaactcaagttctttctccagaagtttgaaagcggcgcccgagaattgacagaaagcgagactaaaagcttaatggctgccgcagacaatgacggagacggcaagataggagctgaagagttccaagagatggtgcatagctag

SEQ ID NO: 198119 - DNA, 1638 bp, Artificial Sequence
  Description of Artificial Sequence: Synthetic coding sequence
atgccccccttcctgctgctgacctgcctgttcatcaccggcaccagtgtctcccctgtggccctggatccgtgctctgcttacataagcctcaatgagccctggcggaataccgaccaccagctggacgagtctcaggggccacccctgtgtgacaatcatgtcaacggggaatggtaccatttcactggaatggcaggcgacgccatgcccactttttgcattcctgagaaccactgtggcacccacgcccctgtatggcttaatggctcccatccgctcgaaggtgacgggattgtgcaaagacaagcttgtgcttcattcaacggtaactgctgcctgtggaacaccactgtggaggtgaaggcatgcccagggggatattatgtgtacagactcaccaagccctccgtatgcttccacgtctattgcgggcatttttatgatatctgtgacgaggactgtcacggctcttgttccgatacttccgagtgtacgtgtgccccaggcacagttctgggacctgaccgtcagacctgcttcgacgagaacgaatgtgaacagaacaatggtggatgttcagagatttgtgtcaacctaaaaaactcctacaggtgtgagtgtggcgtgggacgcgttctccgcagcgacggcaaaacgtgcgaagatgtggaggggtgccacaacaataatggcgggtgctctcactcttgtttgggttcagagaaagggtaccaatgcgaatgtccccgcgggctggttctttctgaagacaatcacacctgccaagtgccagtgctctgcaagtccaacgctatcgaagtgaacatccccagagagctcgtcggcggcctcgagctctttctaaccaacaccagttgtaggggcgtcagtaatgggacacacgtgaacattctgttcagtctgaagacgtgtggcacggtggtggacgtggtgaatgataagatagtggcctcaaacctggtcactggtcttccaaagcagaccccaggatcctctggagattttataatacggacaagcaaactgctaattcccgtgacgtgcgagtttcctcgcctatatacaatttccgaaggttacgtccctaacttaagaaactcccccctggagattatgtccaggaaccacgggattttccccttcaccctagaaatttttaaagacaacgagttcgaagagccctatcgcgaagccctgcccacccttaagctgcgcgattccctttacttcggtatcgagcctgtagtacatgttagtgggttagaatcattggttgaaagctgtttcgccacacctacatcaaagattgatgaggttctgaagtactatctcatcagagacggatgcgtttccgacgattccgtgaagcagtacaccagtagggatcacttggcaaagcattttcaggtcccggtatttaagtttgtgggcaaggatcacaaggaagtgtttcttcactgtagggtcctcgtatgcggtgtactcgatgagaggtccagatgcgcacagggctgccacaggaggatgaggcgcggcgcgggtggggaggattcagccgggctgcaggggcagactctcacaggaggccctataagaatcgattgggaagactag

SEQ ID NO: 198120 - DNA, 966 bp, Artificial Sequence
  Description of Artificial Sequence: Synthetic coding sequence
atgccccccttcctgctgctgacctgcctgttcatcaccggcacctctgtgtcaccagtggccctggatccatgtagcgcctatataagcctgaatgaaccatggcgaaatacagatcaccagttagatgagtctcagggaccccccttgtgtgacaatcatgtgaatggggaatggtatcactttactggaatggcaggggatgcaatgcctactttctgtatcccagagaatcactgcggcacacatgcccctgtgtggctgaacggtagccatcccctggaaggcgatgggatagtccagcggcaggcatgcgccagtttcaacgggaactgctgtttgtggaacactaccgtggaagttaaggcatgcccaggggggtattatgtgtatcgcctaacaaaaccgagcgtgtgcttccacgtttactgcggccatttctacgacatatgtgacgaagactgtcatggatcctgcagcgatacaagcgagtgtacatgtgccccaggcacagtactaggccccgaccgccagacctgcttcgacgaaaatgagtgcgagcagaacaacggcggctgttcagagatctgtgtgaatttaaaaaattcttacagatgtgagtgcggagtaggacgagtgctcagatccgacgggaagacgtgcgaagacgtggagggatgccataacaataacggtggttgtagccacagttgtctgggctctgagaaaggttatcagtgcgagtgcccaagaggcctagtcctgagcgaggacaaccacacgtgccaagtgcccgttctgtgcaagtccaatgcaatcgaagtaaatattccacgcgaactggtgggtggcctcgagctttttttgaccaatacttcttgccgcggcgtgagcaacggcacccacgttaatatcctcttttccttgaaaacttgcgggaccgtcgtggatagttgtttccagtag

SEQ ID NO: 198121 - DNA, 735 bp, Artificial Sequence
  Description of Artificial Sequence: Synthetic coding sequence
atgggcctggagctgttcctggacctggtgagccagcccagccgggccgtgtatatcttcgctaaaaagaatggtatccctctagagctgcgtacggtggaccttgttaaggggcagcataaaagtaaggaattccttcaaatcaactccctgggaaaactgcctactctcaaggatggagatttcatcctgaccgagagctctgcaatcttgatttatctttcctgcaaataccagacgcctgatcactggtaccctagcgacctgcaggcgagagcaagggttcacgagtatctcggttggcacgctgactgcatcagggggacgtttggaatccctttgtgggttcaagtcctgggcccactgatcggtgtgcaggtgcctaaagaaaaggtcgagaggaaccggaccgcgatggatcaagctttgcagtggctggaggataagttcctgggcgatagaccgttcttagcaggtcagcaggtaacactagctgacctcatggccctggaggagttgatgcaaccagtggccctcggttatgagcttttcgagggacgccctcgcctggccgcctggaggggacgagtggaggccttcctcggggccgagctctgccaggaggctcattccataatcttatctatcttagaacaggccgccaagaaaactctccccacgccttcacctgaggcataccaggctatgctgctcagaattgctcggataccatag

SEQ ID NO: 198122 - DNA, 696 bp, Artificial Sequence
  Description of Artificial Sequence: Synthetic coding sequence
atggccagcatggccgccatcggcagctgcagcaaggagtaccgggtgctcttaggccaactgcagaagcagactgatctcatgcaagacacgtcccgcctccttgacccttacatcagaatacaaggcctggacgtgcccaagttaagggagcactgcagggagcggccaggggcatttccatcagaggagacactgaggggacttggcaggcgcggcttcctccaaaccttgaatgcgactttggggtgtgtgcttcataggctggccgacctggagcagcggcttccaaaggctcaggatctcgagcggagcggactgaatattgaagacctggaaaagttacagatggccaggcctaacattctcgggctaagaaacaacatctactgtatggctcaactcctcgataacagcgacacagcagaaccaacaaaggctggaaggggcgcatctcagcctcctacaccaacccccgcaagtgacgctttccagaggaagttagaaggttgcaggtttctccacgggtaccacagattcatgcacagcgtgggacgcgtgttttcgaaatggggcgaatcgccgaaccgatcccgtagacactcaccacaccaggccttgcgcaagggagtccgtcggacacgccccagtagaaagggcaaacgcttgatgacccgtggacagctgcctcggtag

SEQ ID NO: 198123 - DNA, 2940 bp, Artificial Sequence
  Description of Artificial Sequence: Synthetic coding sequence
atggccctgttcgccgtgttccagaccaccttcttcctgaccctgctctctctcaggacttaccagagtgaggtgttggctgaacggttgcccctcaccccggtttctcttaaagtgtcaaccaattcaaccagacaaagtctccacctgcagtggaccgtgcacaacctgccatatcaccaggaactgaaaatggtttttcagatacaaatcagcaggatagagacctccaatgtgatctgggtcggcaattattctacaacagtgaagtggaatcaggttctacattggagctgggagagcgagctcccactggagtgtgcaacccacttcgtgaggattaagtccttggtcgacgacgccaagttcccagagcctaatttctggagcaattggtcctcttgggaggaggtgagcgtacaggactctactgggcaggatatccttttcgtcttcccgaaggataagctggtcgaggaaggcacaaatgtcactatatgttacgtttctcgtaacatccagaataacgtgtcctgctacctggaggggaagcaaatccacggcgaacaactggatcctcatgtgacagccttcaatctgaatagcgtcccctttattcgcaataaggggaccaatatttactgcgaggctagccaggggaatgtgtcggaagggatgaagggtattgtattattcgtgtcgaaagtactcgaggaacctaaagacttttcttgcgaaacagaagacttcaaaaccctgcactgcacctgggatcctggcacagacaccgcactcgggtggagtaaacaacctagtcagtcatacacactgtttgaaagcttctccggggaaaagaagctgtgtacccataaaaactggtgcaattggcagatcactcaagacagtcaggagacctacaactttaccctgatcgccgaaaactacctccgcaagcgctctgtgaacatcctgtttaatctgactcacagagtctacctgatgaatccattctccgttaacttcgaaaacgtgaatgccacaaatgccataatgacatggaaagtgcattcaatacgaaataatttcacctacctgtgccagatcgaattacatggagaaggaaaaatgatgcagtacaatgtgtcaattaaagtgaacggcgaatactttcttagcgagctggagcccgctacagaatacatggcccgggtacggtgcgctgacgcttcacacttttggaagtggtctgagtggtcaggacagaacttcaccacgttggaggccgctccttccgaggcacctgacgtatggcggatcgttagcctggagcctggaaatcacacagtcacacttttttggaagcctttgtccaagctccacgcgaatggaaaaattctattttacaatgtagttgtcgaaaatctggataagccttcttcatcggagcttcattctatcccagcacctgccaatagcacaaaactgatactggaccgatgttcatatcagatctgtgtgattgccaacaactcagttggcgcgtcccctgctagtgtgatagtgatcagtgcggaccccgaaaataaggaagtcgaggaggagcggatcgccggcacagagggagggttttctttaagctggaagcctcaacccggtgatgtcatcgggtacgtggtcgattggtgcgatcacacacaggatgtacttggggattttcagtggaagaatgtgggacccaataccactagcactgtgatttccactgatgctttccgacccggtgtccgttacgatttccgcatatacggacttagtacaaagcgcatcgcctgcctactcgaaaaaaagacgggatactcccaggagcttgcccccagcgacaacccccacgtccttgtcgacacactgactagccacagctttaccctcagctggaaggattatagcacagagtctcagcctggcttcatccagggctatcatgtgtatcttaagtccaaggcaagacaatgccatccgcgttttgagaaggctgtcctatctgatggatcagaatgttgcaagtacaaaatcgacaaccccgaggagaaagcccttatcgtggacaatctgaagcctgagtccttctatgagttctttatcactcccttcacttcagccggggaagggcctagcgcgactttcacaaaggtgactactcctgacgaacactcttctatgctgatccacattctgcttcctatggtgttttgtgtgcttttgatcatggtgatgtgttatctgaagtcccagtggattaaagagacttgctaccccgacattcctgacccatacaaatcctcaatccttagcctgataaagttcaaagaaaatcctcatctcattattatgaatgtttcagattgcattcctgatgctattgaagtggttagcaagccggaggggaccaagatccagttcttggggacccgcaagagtcttaccgaaactgagctgacaaaacctaactacttgtacctgctccctactgagaaaaaccactcagggcctggcccctgtatctgtttcgaaaacttgacttataatcaggccgcatccgacagcgggagttgcggacatgtccccgtatcccctaaagcgccgagcatgctcggactgatgaccagtccagagaacgtgctgaaagccttggagaaaaactatatgaactccttaggtgagatccccgccggtgagacatccctcaattatgtctctcaactagcatctcccatgttcggagacaaagattcactcccaacgaatccggttgaagcaccccattgctctgaatacaaaatgcagatggccgtctccctccgtttggcccttccccccccgaccgagaactcaagcctcagctccatcaccttgctcgatccaggggaacactattgctag

SEQ ID NO: 198124 - DNA, 1029 bp, Artificial Sequence
  Description of Artificial Sequence: Synthetic coding sequence
atggccctgttcgccgtgttccagaccaccttcttcctgaccctgctgagcctgaggacgtaccagtctgaagtactcgcggagagactgcccctgacacccgtgtccctgaaggttagtaccaactctactcggcagtcattgcatctgcagtggacagtccataatctcccttatcatcaggagttgaagatggtgtttcagatccaaatttcccgtattgagacttccaacgtgatctgggtggggaactactctaccaccgtgaaatggaatcaggtgctccactggagctgggaatcagagctcccattagagtgtgcaacccacttcgtgcgaattaaatccctggtggacgacgctaagttccccgaaccaaatttctggtccaattggtcttcttgggaagaggtaagcgtgcaggacagtaccgggcaggatattctctttgttttccccaaggataaactggtagaggaaggcacgaatgtgactatctgttatgttagcagaaacattcagaataacgtgtcatgctatctcgagggcaagcagatccatggcgagcagctcgatccacatgtgaccgcatttaacctgaattctgtgccattcataaggaataagggcaccaacatctattgcgaagcgtctcagggaaacgtaagtgaaggtatgaaagggatagttctcttcgtttccaaggttcttgaggaacctaaggatttttcgtgtgagaccgaggatttcaaaacgctccactgtacttgggatccagggaccgacactgcgctcggttggtccaagcagccttcgcagtcctacacactgttcgagtcgtttagcggggagaagaagctttgcacacacaagaattggtgcaactggcagatcacacaggattctcaggaaacatacaatttcaccctgatagcagagaattacctgcgcaagaggtccgtaaacatcctatttaatcttacccatcgtggggagacaagggtggttacagcacaccggggacactag

SEQ ID NO: 198125 - DNA, 1398 bp, Artificial Sequence
  Description of Artificial Sequence: Synthetic coding sequence
atgaacgcccagctgaccatggaggccatcggcgagctgcacggcgttagtcacgaaccagtacctgctccggcggacctgctgggcggttcgcctcacgcacgttcttccgtggctcaccgtggctcccacctgccccctgcccaccctaggagcatgggtatggcaagcttgctagatggggggtctggagggggagactaccaccaccaccacagagccccggaacattctctggctgggcctctgcacccaacaatgaccatggcttgtgagaccccccccgggatgtccatgcccacgacgtatacaactctcactccactgcagcccctgcctcccatttctacggtgagcgataagttcccacaccaccaccaccaccaccatcatcatcaccaccctcatcatcaccaacgtcttgctggaaacgtgagtggcagttttacactaatgagagacgagcgcgggcttgccagtatgaacaacctttatacaccctaccataaggacgtggcagggatgggccagagcctcagccctctttcttctagcggattgggaagcatccataattcacagcaaggccttccacattacgcccacccaggggcagcaatgccgacagataaaatgctgacaccaaacggttttgaggctcaccaccctgcaatgctgggtcgccacggagagcagcatctgaccccaaccagtgccgggatggttccgattaatgggctcccccctcaccacccccatgcacacctgaatgcgcagggccacggacagttactgggtacagcaagagagccgaacccttcagtgacaggagctcaggtctctaacgggtctaattccggccaaatggaagagatcaatacaaaggaagtagcccagcgcatcaccacagagctaaagaggtactcaatcccccaggcaatcttcgcgcaacgggtcctgtgtcgctctcagggcactcttagtgacctcctgagaaatccgaagccttggtccaaactgaaaagcggcagagagactttccgccgcatgtggaaatggttgcaggagcctgaatttcagcggatgagtgcccttcggctcgctgcgtgtaaacgtaaagagcaagaacacggaaaggaccgcggcaacacccccaagaaaccaagactagtttttacagatgttcagcggcgaacactgcacgccatcttcaaggaaaataaacgaccatctaaggaactacaaatcacaatttcccaacagctgggcctggagctgtcaaccgtgtctaatttttttatgaatgccagacgtagatcattagataaatggcaagacgagggcagcagcaactccggcaactcgtcatcctcatcgtccacttgtacaaaagcatag

SEQ ID NO: 198126 - DNA, 1515 bp, Artificial Sequence
  Description of Artificial Sequence: Synthetic coding sequence
atgaaggccgcctacaccgcctaccggtgcctgaccaaggacctggagggttgtgctatgaatccggaactgacaatggagtccctcggcacacttcacggacccgctggaggaggttctggtggaggggggggcgggggcggtggcgggggtggtggaggccccggacacgagcaggagttactggcgtcgccatcgccccaccatgctggaagaggagctgctggtagcctaagaggacccccacccccccctactgcccaccaagagcttgggactgctgctgctgcagcggctgccgcatcaagatcggcaatggtgacatcaatggcaagtatcctagatggaggcgattataggcctgagctgtcgatccccttgcatcacgccatgtctatgagttgcgattcctctccaccaggaatggggatgtcgaacacctacactactctcacacccctccagcccctgcctccaatcagcactgtctctgacaagttccaccatccacacccccaccaccacccccatcaccaccaccaccaccatcaccagagattgtcaggcaacgtcagtggtagttttacactgatgcgcgacgaaaggggcttacctgctatgaataatctgtatagcccttacaaggaaatgcctgggatgtcacagagtttgtccccactggccgccactcctctaggcaacgggctgggcggattgcacaatgcccaacagtcgctgcctaactacggtcctcccggtcacgacaagatgttgtcaccaaacttcgacgcgcaccacaccgccatgctgaccagaggcgaacagcatttaagccgcggactcggcacaccacctgcagccatgatgagccacctgaacggcttgcatcaccccgggcatacacagagccacggacccgtactagcgccgtctcgggaaaggcctccaagttcaagctcaggctcccaagtggcaacctccggccagcttgaggaaattaatacaaaagaagtagctcagcggatcacagcagagctgaaacgctacagtattcctcaggctatttttgcacagagagtcctatgccgctcccaggggactctttcagacctgcttcgtaatccaaagccatggtccaaactgaaatccgggagagagacttttaggcgtatgtggaaatggttgcaagagcctgaatttcagcggatgtctgctcttcgtctcgctgcctgtaagagaaaggagcaagagcccaataaggataggaacaatagccagaaaaagagtaggttagtgtttactgatcttcaaagacggactctatttgccattttcaaagagaataagcggccctctaaggagatgcagatcaccatcagtcaacagctggggctggaactgactactgtttccaacttttttatgaacgcccggagaaggagcctcgagaagtggcaagatgatttatctacaggaggctcctcctcaacttcctcaacttgtacaaaggcttag

SEQ ID NO: 198127 - DNA, 1458 bp, Artificial Sequence
  Description of Artificial Sequence: Synthetic coding sequence
atgaaccccgagctgaccatggagagcctgggcaccctgcacggccccgccggtggcggatcaggtggcggcggcggcggcggtggcggggggggtggaggaggccccggtcatgaacaggagctcctggcaagccccagtccacatcatgcaggccgtggtgcagccggcagcctgaggggccctccacctccaccaaccgctcatcaggagcttggaactgccgcagcggctgctgctgctgcttcacggtcagccatggtaacgtccatggccagcatcctggacggcggagactatcgccctgaactaagcataccactgcatcacgccatgagcatgtcctgcgatagcagcccccccggcatggggatgagtaacacctatacaaccctcacccccctgcaacctttacctccgatttccaccgtcagcgacaaattccaccatccccatccccaccaccaccctcatcatcaccaccaccaccatcaccagcgactatctggcaacgtatccggatcttttacacttatgagagatgagcgtggcctccccgccatgaataacctgtactcaccatataaagagatgcccggtatgagccagagcttaagcccccttgctgcaactcctcttggaaatgggcttggagggctgcacaatgcacagcagtcactgccgaactacggccccccagggcatgacaaaatgttgtctcctaattttgacgcccatcacacagcgatgctgacgagaggagaacaacacctatctagaggcttgggcactccgcccgccgctatgatgagtcacctgaatgggctgcaccaccctggacatacacaaagccacggccccgtcctcgctccatcacgtgagcgtcctccttcatcgtcctcaggcagccaagttgccaccagtggacagcttgaagagataaatacaaaagaagtggcccaacggattacagccgaactgaaacgctacagcattccacaagccatcttcgcccagagagtgctatgtcggagccagggcacgcttagcgacctcctgcgtaaccccaagccctggtctaagctgaagtctgggcgagagacttttagaagaatgtggaagtggctccaagaacctgagttccagagaatgagtgccttacgtctggcagcctgcaagcgtaaagaacaggagccaaataaagaccgtaataacagccaaaagaaaagcaggctcgttttcaccgatctgcaacgacgtacactcttcgctatttttaaggagaacaaaaggccatcaaaggagatgcagatcactataagccagcagctgggcctggagttgacaactgtgagcaatttttttatgaacgcacgccggaggtccctggagaagtggcaagatgacctctcaaccggaggatcaagtagtacttcctcaacatgcacaaaggcctag

SEQ ID NO: 198128 - DNA, 450 bp, Artificial Sequence
  Description of Artificial Sequence: Synthetic coding sequence
atggtggacgacgccggcgccgccgagagccagcggggcaagcagacacctgcccatagtctagagcagctcaggcggctgccactgcctcccccccagatacgtattaggccctggtggtttcctgtacaagagctgcgcgatccactcgtcttttatttggaggcttggctggccgacgaattgtttgggcccgatcgagccattatcccagaaatggagtggacttcccaagccttactgacagttgacatagtggactctggcaatttggtcgagatcacagtatttggccgacctagagtgcaaaaccgtgttaaaagcatgttgctctgcctggcgtggtttcatcgtgagcatcgcgccagagcagagaagatgaaacatcttgagaagaacctgaaagcccacgcttccgatccacactctccccaagacccggtggcctag

SEQ ID NO: 198129 - DNA, 387 bp, Artificial Sequence
  Description of Artificial Sequence: Synthetic coding sequence
atggcccccgtgaagaagctggtggtgaagggcggcaagaagaagaaacaggtcctgaagtttacactggactgcacccatcccgtggaagatgggatcatggacgcagcaaatttcgagcaattccttcaggaaaggatcaaggtaaatgggaaagcaggaaatctgggtgggggcgtggtgaccatagagaggagcaagagcaaaatcacagtgacctctgaagttcccttctccaagcgttacttgaaatatctgacgaagaaatacttgaaaaagaataacctgcgcgattggctgcgtgtagtggccaatagcaaggaaagttacgaactgaggtactttcagatcaatcaggatgaggaagaggaagaagacgaggattag

SEQ ID NO: 198130 - DNA, 975 bp, Artificial Sequence
  Description of Artificial Sequence: Synthetic coding sequence
atggagcccgcccccagcgccggcgccgagctgcagccccccctgtttgctaatgcttctgacgcctaccccagtgcatgtccgtctgccggagctaacgcctcaggccctcccggcgccagatctgcaagctccctggcccttgcaattgcaattactgctctgtactcggcagtttgtgccgtgggattgctgggaaacgtgcttgttatgttcggaatagtccgctacaccaagatgaaaaccgctaccaatatctacattttcaacctggctctggctgatgcactcgccacctctaccctgccttttcagtcggcgaaatacttgatggaaacctggccctttggtgaattgctatgcaaggccgtactgagcatcgactattataatatgttcacatccatatttactctcaccatgatgtccgtggatagatatatcgcggtctgtcacccggtcaaggctttggattttcgcacacccgctaaagccaaactgatcaatatctgcatttgggtcctcgcgtcaggtgtcggtgtccctataatggtaatggccgtcacaaggccgcgtgacggagccgtggtgtgtatgctgcaatttcctagcccgtcctggtactgggacactgtgacgaagatctgtgtcttcctgttcgcgttcgtggtgtgttgggcccctattcacattttcgtcatcgtgtggacgcttgttgacatagatcggcgggaccctctagtagtggcagccctccatctctgcatcgccttggggtacgcgaactcctctctaaaccctgtgctgtatgcctttttagacgagaacttcaagagatgtttcagacagctctgccgaaaaccctgcggaagacctgacccttcatccttctctcgggcccgtgaggccacagcaagagagcgagtgaccgcatgtaccccttctgacggtcccggtggaggtgccgccgcttag

SEQ ID NO: 198131 - DNA, 1143 bp, Artificial Sequence
  Description of Artificial Sequence: Synthetic coding sequence
atggacagccccatccagatcttccggggcgagcccggccccacctgtgccccttccgcctgcttacctcccaactcctctgcctggttcccaggctgggccgagccagattccaacgggtcagcagggagcgaagatgcccaacttgaacccgcacacatctccccagcgattcctgtgattatcacggcggtgtactcagttgtttttgtagtgggactggtaggtaacagcctcgtgatgttcgtgattattaggtacacaaaaatgaagactgccactaacatctatatctttaatctggcattggcggatgccctcgtgaccactactatgccgtttcaatctacagtgtatctgatgaattcatggcctttcggagacgtattgtgtaagatagtcatttccatagactattacaatatgtttaccagcatcttcactctgactatgatgtccgtagaccgctatattgctgtgtgtcacccagtcaaggcactcgatttcaggacacctttgaaagccaaaattatcaatatctgcatttggctgctcagctccagcgtcggtatcagcgcgattgtcctaggcggaactaaggtgcgcgaggatgtggatgtgatcgaatgtagcttgcagtttcccgacgacgattacagttggtgggacctgtttatgaaaatttgtgtgttcatctttgcctttgtaataccagtcctcatcatcatcgtctgctataccctgatgatactgcgtctcaagagtgtgcgcctcctgtccggcagccgcgaaaaggacaggaacctgaggaggattactcgactggtgctggtggttgttgcagttttcgtcgtatgctggacgcccatccacatctttatcctggttgaggccctgggctccacaagccactctaccgcagccctctcatcatattacttttgcatagccctcggatacacaaattcatccctgaatccaatcctgtacgcttttcttgatgaaaattttaaacggtgttttcgggatttctgcttcccgctgaagatgagaatggaaaggcagtctacgagtcgagtgaggaatacagtgcaggacccagcctatcttagggacatcgacggtatgaacaagccagtctag

SEQ ID NO: 198132 - DNA, 1101 bp, Artificial Sequence
  Description of Artificial Sequence: Synthetic coding sequence
atggacagccccatccagatcttccggggcgagcccggccccacctgtgccccatccgcgtgcctgcccccaaattcatctgcgggatccgaggacgcccaactggaaccagcacatatcagccccgctatacctgtcatcatcactgccgtctacagcgtggtgtttgtcgttggcctggtcgggaactcactggtgatgttcgtaataatcaggtataccaagatgaagaccgctaccaatatctacatattcaatttagccttagccgacgccctcgtaacaactaccatgcctttccagagcaccgtttacctaatgaacagctggcctttcggcgatgtactctgcaagatagtaatatccattgattactataatatgtttacctccatcttcaccctgacaatgatgagtgttgatcgatacattgccgtatgccaccctgtcaaggccttagactttaggacaccgcttaaagccaagattattaatatctgcatctggttacttagttcaagtgttggcatctctgccattgtgctaggcggtacgaaggtgagagaggatgtcgatgtcatagagtgttccctgcagtttcctgacgacgattactcttggtgggatctctttatgaaaatttgtgttttcatttttgcatttgttatccctgtattgattattatcgtctgctacacactgatgatcctgagacttaaatctgtccgcctgctcagtggtagcagggagaaagacaggaacctgcggcgaatcacccgccttgttctggtagtggtggccgtgttcgtggtgtgctggactcctatacatatttttatcctggtggaggcgcttgggtcaacctctcatagtacagccgcattatcatcctattatttctgtatcgccctggggtacaccaactcatctctgaaccccattttgtacgccttcctggatgagaattttaaaagatgcttcagggatttctgtttcccccttaagatgagaatggagcggcaatccacttccagggttcggaacacagtccaggacccggcataccttagggacattgatgggatgaataaaccagtctag

SEQ ID NO: 198133 - DNA, 1143 bp, Artificial Sequence
  Description of Artificial Sequence: Synthetic coding sequence
atggacagccccatccagatcttccggggcgagcccggccccacctgcgcccctagcgcctgtttgccacccaactcgtctgcatggttccctggctgggccgagccggattcgaatggaagcgcaggctcagaggacgcccagctcgagcccgcccacatttctcctgcgatcccggtcattatcactgcagtgtatagcgtggtgtttgtcgtcgggttagtgggaaactccctagtgatgtttgttatcattagatacactaaaatgaagacagccactaacatttatatatttaacctggctctggcagacgccctggtgacaaccactatgccattccagtcaacagtgtatctcatgaattcatggccgttcggggacgttttgtgcaagattgttatttcgatagattattacaacatgttcactagtatttttacactcacaatgatgagtgtggatagatatattgccgtctgccatccagtgaaggccctcgattttcgaacacccctgaaagcaaaaatcatcaatatctgcatctggctcttgagctcttccgtcggtatttcggccattgtgctggggggaacaaaggtgcgcgaggacgtggacgtcattgaatgttctctgcaatttcctgacgatgattacagctggtgggacctgttcatgaaaatttgcgttttcatcttcgcattcgtgatccccgtcttaatcatcattgtatgttacacattaatgattctgaggcttaaatctgtgcgtctgctttctggctcccgagagaaggataggaatctgagacgcatcactaggctggtgctggtggtggtggccgtgtttgttgtctgctggacacccattcacatcttcattctagttgaggctctcggcagcacttcacactcgacagccgccctctcctcatattatttctgcattgcgctcggctacaccaactccagcctcaaccctatcctttatgctttcttggacgagaattttaaacggtgtttccgggatttctgttttcctctcaaaatgcgcatggagagacagtctacctctcgcgtacgaaacactgtccaggacccagcataccttcgggatatcgacgggatgaacaagcccgtctag

SEQ ID NO: 198134 - DNA, 1344 bp, Artificial Sequence
  Description of Artificial Sequence: Synthetic coding sequence
atgagccggcggccctgcagctgcgccctgcggcccccccggtgctcttgctccgcgtccccatccgctgtgaccgccgcagggaggccccggccttccgacagttgcaaagaggaatcctccacccttagcgtgaagatgaagtgtgacttcaactgtaaccatgtccactctggcctcaagcttgttaagcccgacgacattggccgattagtcagctacactcccgcttatttagagggtagctgcaaagattgtattaaggattacgaacgactcagctgtataggatcccccatcgtctcaccgaggatcgtccagcttgaaacagagtcaaaaaggctgcataataaagaaaatcaacacgtccaacagaccctaaactccacgaatgagatcgaggcattggagacctctagactgtatgaagactcgggctattcttctttctccctgcaatccggactgagtgaacatgaggagggctcgctgttagaggagaattttggcgatagtcttcagagctgcctgctccagatacagtcccccgaccaataccccaacaaaaatctcctccctgtgctgcactttgaaaaggtggtttgtagtacgctgaagaaaaatgcaaaacgcaatcctaaagtggacagggaaatgctaaaggaaataattgcacgaggaaacttcaggctgcagaacatcatcggaagaaaaatggggctcgagtgtgtcgacatcctgagcgagttattccgccggggtctacgccatgttctagccaccatactggcacagctgtccgacatggatttgatcaatgtgtcgaaggtgtcaaccacatggaaaaagattctcgaagacgataaaggggcattccaattatacagcaaagcaattcagcgagtaactgagaacaataacaagttttcgcctcacgcatcgacccgagagtatgtcatgtttcgcacaccactggcttcagttcagaaatcggctgctcaaacatctctgaaaaaagacgcccagactaaactgtccaatcagggcgaccagaagggcagtacgtacagtcgacataatgagtttagcgaggtggccaaaaccctcaaaaaaaacgagtccctgaaggcttgcataagatgcaacagccctgcgaagtacgactgctatctgcagcgtgccacctgcaaacgggaaggatgtgggttcgattattgcactaagtgcctgtgtaattaccacacgactaaagactgctccgacgggaagctgctcaaggcctcgtgtaaaatcggacccctgcctggcactaaaaaatcaaaaaagaatctgaggaggctttag

SEQ ID NO: 198135 - DNA, 1203 bp, Artificial Sequence
  Description of Artificial Sequence: Synthetic coding sequence
atggacagcagcgccgcccccaccaacgccagcaactgcaccgacgctctcgcctattcatcctgtagtcccgcacccagtcccggttcttgggtaaacctttcccacctggatggtaacttgagtgatccttgtggcccgaataggacggatttgggcggacgcgattccctgtgtccgccaactggatccccctctatgataacagcgataactattatggctctgtattccatagtatgcgtcgtcggcctgtttggcaatttcctggttatgtatgtaattgtgagatacaccaaaatgaagacagctactaatatctatatctttaatcttgctcttgcagatgctttggccacatctaccctgcccttccaaagcgtcaattatctcatgggcacatggccatttgggacaatcctgtgtaagattgtcatttctattgattactacaacatgttcacctctatttttactctgtgcacaatgagcgttgaccggtacatcgccgtgtgccatcccgtcaaggctcttgacttccgcacaccacgcaatgccaagatcattaacgtgtgtaactggatcctcagttcagccattggtctgccagtgatgtttatggcaaccactaagtacagacaggggtctattgactgcacactgacattcagtcatcccacctggtactgggaaaacctgctgaaaatatgcgtgtttatttttgcctttattatgccagtgctgatcatcacggtgtgctatggcctgatgatcctgcggctaaaatccgtgaggatgctgtccggatccaaagaaaaagataggaacctgagacgcataaccagaatggtgttggttgttgtggcagtgttcatagtctgctggacgccaatccacatctacgtgatcatcaaagctctggtcaccatacctgaaactaccttccagacagtgtcttggcacttttgcatcgcccttggctacacaaactcctgcctgaatccggtgctgtatgccttccttgatgaaaatttcaaacgctgcttcagagaattttgtattcccacctcctcgaacatcgaacagcagaactctactaggattagacagaacacaagagaccatccatcaacagcaaacactgttgaccgcaccaatcatcagctggagaacctagaggccgaaacagccccgctcccatag

SEQ ID NO: 198136 - DNA, 1257 bp, Artificial Sequence
  Description of Artificial Sequence: Synthetic coding sequence
atggacagcagcgccgcccccaccaacgccagcaactgcaccgacgcactcgcgtattcatcctgcagtccagccccttctcccggctcctgggtgaacttgtcacacctggacggcaacctgtccgacccctgtggtccaaacaggactgatctagggggtcgggattccctctgtcccccaactggcagtccaagcatgattactgctatcacaataatggctctctatagtatcgtttgcgttgtgggcctgtttgggaatttccttgtgatgtacgtcatagtcagatacactaagatgaagactgccacaaacatttacatctttaatctcgctctggccgatgccctggccacaagcacgctaccctttcagtcagttaattacctgatgggtacgtggccctttggaacaatcctttgcaaaattgtaataagtatcgactactataatatgtttaccagcatattcaccctctgtacaatgtcagtcgatcgctacatcgctgtgtgtcaccctgtgaaggccctcgacttccggacgccgcgtaacgccaagattatcaacgtttgtaactggattctttcaagtgccatcggtctcccggtgatgtttatggcaactaccaagtaccgtcagggaagcatagactgtactctgaccttcagccaccctacttggtactgggaaaatctactgaaaatctgtgtatttatcttcgctttcattatgcctgttctcattatcacagtctgttacggattgatgatcctgcgccttaagtccgtcaggatgctctccgggagtaaagagaaggataggaacctgcgaaggattacaaggatggttctcgtggtggtggcagtcttcatcgtctgctggacgccaatccacatctatgttattatcaaagccctggtgaccattcctgaaacaacctttcagaccgtcagttggcacttctgcattgctctgggctacacgaattcatgtctaaatcctgtcctctatgctttcctggatgaaaactttaaacgatgcttcagagaattttgcatccctacttcatcgaatattgagcagcagaacagcacaaggataaggcaaaatacacgggaccacccttccacggcgaacaccgtggaccggacaaaccaccagcccccactggctgtgtcaatggctcagatcttcaccagataccctcctcctacccatagagaaaaaacctgtaacgactacatgaagcgctag

SEQ ID NO: 198137 - DNA, 1209 bp, Artificial Sequence
  Description of Artificial Sequence: Synthetic coding sequence
atggacagcagcgccgcccccaccaacgccagcaactgcaccgacgcgcttgcctactctagctgttctcccgctccttcaccaggaagttgggttaatctgtctcatctcgacggaaaccttagcgacccttgtggccctaaccggacagatctgggcggccgggatagcttatgtcctcccacaggatccccaagcatgattaccgccatcacaattatggctttgtattcaatcgtgtgtgtagtagggctgttcggcaactttttagtgatgtacgtgattgtgaggtatacaaagatgaagactgcaacaaatatttacatcttcaatctggccctggccgatgcgctcgccacttcaactctaccatttcagtccgtcaactacctgatgggcacttggccgtttggaacaattctctgtaaaattgtgatctccatcgattactataacatgttcacctccatcttcactctttgcacaatgagcgtggacagatatatcgccgtgtgccaccctgttaaagctctcgactttaggacgccccgcaacgctaagatcattaatgtatgcaattggatattgagcagcgcaatagggctgccagtgatgttcatggccacaacaaagtatagacagggctcgatagactgtacactgactttcagtcaccccacttggtactgggaaaatttgctcaagatctgtgtgtttatttttgcatttatcatgcccgtgctgataattactgtgtgttatggtctgatgattctcagactcaaatcagtacgtatgttatctggctcaaaggaaaaggatcgtaatctacgtagaataaccaggatggtgctcgtcgttgtcgctgtgttcatcgtatgttggacgcccattcatatttacgtgattatcaaggcccttgtcaccatccctgagactacttttcagaccgtgtcctggcacttttgtatagcacttggctacacgaactcttgtcttaatcccgttctctatgcttttctagacgagaacttcaagagatgcttcagagagttttgcattcctaccagttcaaacatcgaacagcagaactcaacacgaatccgacagaatacacgagatcacccaagcactgcgaatactgtagatcggaccaatcatcagataagagacccgattagtaacctacccagggtaagtgtgttctag

SEQ ID NO: 198138 - DNA, 1212 bp, Artificial Sequence
  Description of Artificial Sequence: Synthetic coding sequence
atggacagcagcgccgcccccaccaacgccagcaactgcaccgacgccctggcctacagtagctgctctcctgccccctctcccggaagttgggtgaatctgagccacctggacgggaatttatctgatccatgcgggccgaatcgaaccgacttgggcgggagagatagcctgtgcccgcccactggaagtccctccatgatcaccgcaatcaccattatggccctttatagcatcgtctgcgtggtgggacttttcgggaacttcctggtcatgtatgtcattgtcagatacactaagatgaaaactgcaaccaacatctacatttttaatctcgcactagctgatgccctggctaccagtactctgccttttcaatctgtcaattatctgatgggaacatggccattcgggaccattctgtgtaaaatcgtcatctcgattgattactacaacatgttcacaagcatcttcactctctgtacaatgagcgtggatcgttatatcgctgtgtgtcaccccgtgaaggcacttgatttccgcaccccaaggaatgcaaaaatcataaatgtctgtaactggatcctgtcaagcgcaattggcttacccgtgatgttcatggccaccaccaagtaccgccaaggttccatagattgtacactgaccttttctcatccaacgtggtactgggagaacttattgaaaatctgcgtgtttatcttcgcatttataatgccggttctcattatcacagtgtgctacggactgatgatcttgcgcctcaaatcagttcgcatgctgtccggcagcaaagagaaggataggaacctgcgacggataacccgaatggttctagtggtggttgccgtctttattgtgtgctggacacctatccatatctacgtgataataaaggctctcgtgacaattcctgagacaacattccagactgtcagttggcacttttgtatagccctcgggtacaccaatagctgtttgaacccggtcctctacgccttcctcgacgaaaactttaagaggtgttttagagaattctgtatccctacctcctctaatatcgaacaacagaattccactaggattaggcagaacacaagggaccatcccagcaccgcaaacaccgtggatcgtacaaatcatcaagggcctcctgcgaaattcgtagccgaccaattagcaggctcatcctag

SEQ ID NO: 198139 - DNA, 1263 bp, Artificial Sequence
  Description of Artificial Sequence: Synthetic coding sequence
atggacagcagcgccgcccccaccaacgccagcaactgcaccgacgccctggcctattctagttgcagcccagccccgtcacccggttcctgggttaatttgagccacctggatggaaatcttagtgatccatgcggcccaaataggactgacttgggcggcagagacagcctctgcccgcctactggaagcccgtctatgatcaccgcgataacaatcatggccctttacagcattgtctgtgtggttggtctttttggtaacttcttagtcatgtacgtcatcgtacgttacactaaaatgaaaacagctacgaacatttatatttttaacctggccctggcagacgctctggccacatctactctgcctttccaaagcgtcaactaccttatgggaacctggcctttcggcactatactctgcaaaatcgtcatttcaatcgactactacaatatgttcacatctatttttaccctgtgcacaatgtcagttgaccgatatatcgcagtttgccatcctgtgaaagctttagacttccgaactccacggaatgcgaaaatcatcaacgtctgcaattggattctctcttccgctatcggccttcctgttatgtttatggctacaactaagtaccgccaagggagtatagattgtacacttaccttttcccatccaacctggtattgggagaacctgcttaagatatgcgtgtttatattcgccttcatcatgccagtgcttatcattacggtctgttacggacttatgatcctgaggttgaaatcagtgcggatgctgtctggctccaaggagaaggataggaacctgaggagaatcacccggatggttcttgtcgtggtggccgtgttcattgtctgttggaccccgattcatatatatgtaataatcaaggctttggtgacaatacctgagaccacctttcaaacagtttcttggcacttttgcatcgcactggggtatactaattcctgcctgaaccctgtactttatgccttccttgacgaaaatttcaaacgctgctttcgagagttctgcatcccaacttcttctaacattgaacagcagaattcaacacgtattagacaaaatactcgagaccatccaagcaccgccaacactgtcgatagaacaaatcaccaggtggagttgaatcttgactgtcactgcgagaacgcaaagccatggcctctgtcatacaacgctggacagtctccctttccttttccagggcgagtatag

SEQ ID NO: 198140 - DNA, 1179 bp, Artificial Sequence
  Description of Artificial Sequence: Synthetic coding sequence
atggacagcagcgccgcccccaccaacgccagcaactgcaccgacgctctggcatatagctcatgcagccccgcaccttcccctggcagctgggtgaatttgtctcatctcgatggaaaccttagtgatccttgtggccctaatagaaccgatctgggcggacgagacagcttatgcccccccaccggaagcccaagcatgatcacagccattacgattatggccttatatagcattgtgtgtgttgtggggctattcgggaacttcctagtgatgtacgttattgtccgatatacgaaaatgaaaacagcgactaacatttatatcttcaatctggctcttgccgacgcactggccacttccaccttgccattccagagtgtcaactatctcatgggaacatggcctttcgggaccattctctgcaaaattgtaattagtattgattactacaatatgttcacatccattttcacactgtgtaccatgagcgtggataggtacattgctgtgtgccatcccgtaaaagcactagattttaggacacctcgcaacgccaagatcatcaacgtctgtaactggatactgtcaagcgccatcgggctgcccgtgatgttcatggcaaccacaaagtaccgacagggcagcattgattgtaccctgaccttcagccaccctacctggtattgggaaaaccttctgaagatctgtgtttttatattcgcgttcataatgccagtcctgataataacggtttgctacggcctcatgatcctgcgcctgaagtcagtcagaatgttatcagggtcaaaagaaaaggacaggaacttaaggcgaattacgcgtatggttttggtggttgtcgccgttttcattgtctgctggacacctatccatatttacgtgataattaaggctttagtgactatccctgagaccacattccagacagtcagttggcatttttgcatcgcgctgggctatacgaattcatgccttaacccagtactgtacgcctttttggatgagaattttaagcgctgtttccgtgagttttgtattccaacatcttctaacatcgagcagcagaatagtactagaattaggcaaaacactcgtgaccatccatctaccgcgaatactgttgatagaacgaaccaccaggtcagatcactctag

SEQ ID NO: 198141 - DNA, 1482 bp, Artificial Sequence
  Description of Artificial Sequence: Synthetic coding sequence
atgtgcctgcaccggcgggtgcccagcgaggagacctacagcctggacagatttgctcagaaccccccgctgtttccacctccttctctgccagcttcagaaagccgtatggcacatgcccctctcctgcagaggtgtggggccgccagaaccggattctgcaagaagcagcaagaactatggcagcgcagaaaggaggctgccgaggcgctgggcacacgtaaggtgagcgtgctgctcgccacctctcatagcggtgcgaggccagccgtttccacaatggactcaagtgcagcccctactaatgcgtcgaactgtactgacgctctggcctactcgtcttgttcgcctgccccatcccccgggtcgtgggtaaatttgtcgcaccttgatggaaatttaagtgacccctgcgggcctaaccgtactgacctcggaggcagggactccctgtgccctcctaccggcagccctagtatgattaccgccatcactatcatggcgctctactcaatcgtctgcgtagttggcctgtttggtaacttcctcgtaatgtatgtcatcgtccgttacacaaaaatgaagaccgccaccaacatttatattttcaacttggctctggctgacgcgcttgctacctctacattaccattccaaagtgtcaattacctcatgggaacctggccctttgggactatactttgcaagatcgtgatctccatcgactactacaacatgttcacctctatcttcactctttgtacaatgtcagtcgaccgctatatcgcagtttgccatcccgtgaaggcactggattttcggaccccgagaaatgccaaaataatcaacgtgtgcaattggattctgtcgagcgctattgggctgccggttatgttcatggctacgacaaaataccggcagggcagtatcgattgcactctgacattctcccaccccacctggtactgggaaaacttactcaaaatctgcgtctttatatttgcattcatcatgccagtcctgataattaccgtgtgttatggactgatgatcctgagactgaagtcagtaaggatgctgagtggtagcaaggaaaaagaccgaaatctcagacgcattactagaatggtgctggtcgtcgtcgctgtcttcatagtgtgttggaccccaatccacatttacgttatcataaaagccctcgtgacgatacccgagaccacatttcagaccgtatcatggcatttttgtattgccctaggatatacaaacagttgcctgaaccccgttctgtatgccttccttgatgagaacttcaaacgatgcttccgagaattctgcatccctacctccagtaacatagaacagcagaacagtacccgaatcaggcagaacacccgcgatcacccgtccaccgccaacacggttgatcgaaccaatcatcagttagaaaatctggaggctgagacagctccactcccttag

SEQ ID NO: 198142 - DNA, 1194 bp, Artificial Sequence
  Description of Artificial Sequence: Synthetic coding sequence
atggacagcagcgccgcccccaccaacgccagcaactgcaccgacgctcttgcatactcttcttgcagcccagcaccctctcctggtagttgggtcaatctgagtcaccttgatggtaacctctccgatccgtgtgggccgaaccgcaccgacctcggcggcagggattccctgtgtccccctacaggatcaccaagcatgattactgcaatcaccattatggccttgtattctatcgtctgcgtggtgggcctgttcggaaactttctggttatgtatgtaatcgtacgctacacaaagatgaaaacagccactaacatctacatctttaacctggctctggcagacgctttagccacatccacactgcctttccagtcggtcaattacctaatgggtacctggccctttgggactatactatgtaagatagtgatttcaattgactactacaacatgtttacaagcatatttacgttgtgtactatgtcagtagaccgatacatcgccgtgtgccaccccgtcaaggctctggacttccggacaccccgcaatgccaaaattataaacgtttgcaattggattctgtcatctgctatcggcctcccagtaatgtttatggcaaccaccaagtatcgccaaggaagtattgactgtactctgaccttctcgcacccgacttggtattgggagaacctgttaaagatctgcgtgtttatcttcgcattcattatgcccgttcttatcatcaccgtttgctatggcctgatgatcctgcggttaaagtctgtgcgcatgctgtctggctctaaggagaaggatcgaaatctcagaaggatcactcgtatggtgctcgttgtggtggcagtgttcattgtctgttggacccccattcacatttatgttataattaaggcactggtcacgattcctgaaaccacctttcagaccgtgagctggcatttttgtatcgcgcttggctacactaactcctgtctgaaccccgtactttacgccttcttagacgagaacttcaaacgatgtttcagggagttctgcatccccaccagctccaacattgagcagcaaaacagtacaaggatccggcagaatacgagagatcatccctccacggcaaacactgtcgacaggacgaaccaccagcgtgagcgccgacagaaatctgattggtag

SEQ ID NO: 198143 - DNA, 1221 bp, Artificial Sequence
  Description of Artificial Sequence: Synthetic coding sequence
atggacagcagcgccgcccccaccaacgccagcaactgcaccgacgctctcgcttatagttcatgctctcctgctcctagccctggctcttgggtgaacttatcacacctggatggaaacctgagcgacccgtgtgggcccaaccgcactgatctaggtggacgtgattcgctgtgtcctcctaccggctctccctccatgattacagctatcaccattatggctctctattctattgtctgcgtggtgggcctgttcggaaattttttggtgatgtacgtcatcgtgcgttacaccaaaatgaagactgcaacaaacatttatatttttaacctggcgcttgctgatgcactggccacttctaccctgcctttccaatccgtcaattatctaatggggacttggcctttcggtaccattttatgcaaaatcgtgatctcaatcgattattataatatgtttactagcatctttacattatgtactatgtccgtcgatcggtacatcgctgtatgtcaccccgtgaaggcgctggatttccggactccaagaaatgcgaagattatcaatgtatgtaactggatcctgtcctctgcaatcggcctgcccgttatgttcatggctacaactaagtacagacagggcagtatcgactgcacacttactttttcccatccgacatggtattgggagaaccttctgaaaatttgcgtctttatttttgccttcataatgcctgtcctaatcatcacagtctgttacggcctcatgattttacgtctcaaaagtgtgagaatgctgtccggcagcaaggagaaagacagaaatttaaggcggatcacaagaatggtcttggtggttgtggccgtgttcatcgtgtgttggacccctatacacatctatgtcatcatcaaggctcttgtcaccatccctgagactacttttcaaactgtgtcttggcatttttgtattgcattgggatacacgaattcttgcctgaatcccgtcctctacgcatttctcgacgaaaatttcaaacgttgcttccgagagttctgcataccgacctctagtaatattgagcagcagaatagtactagaatcagacagaatacccgagatcaccctagcactgcaaacacagtcgatcggacgaatcaccagaaaattgacctgtttcagaagtcttcccttttgaactgcgagcacacaaaaggatag

SEQ ID NO: 198144 - DNA, 960 bp, Artificial Sequence
  Description of Artificial Sequence: Synthetic coding sequence
atgatgcgggccaagagcatcagcaccaaggccggcaagcccagccgctacacaaaaatgaagactgccacaaacatctacatttttaaccttgcgctcgccgatgctctagcaacctcgactttaccctttcaaagcgttaattacttgatgggaacctggccatttgggaccatactgtgcaagatcgttatatcgattgactattataatatgttcacatccatttttaccctgtgcaccatgagtgttgacaggtacatcgctgtgtgccatcctgtgaaggcattggattttagaacacctcggaatgcaaaaattatcaacgtatgcaactggattctctcatctgccataggtctgccagtcatgtttatggcgaccacaaaatataggcaaggttcgatcgattgtacgctgaccttcagccatccaacgtggtattgggagaacctactcaagatctgtgtgtttatcttcgcttttattatgccggtgctcattatcacagtgtgttacggactgatgatcctgaggcttaagtcggtgaggatgctctcaggaagcaaggaaaaggatagaaacctgcgacgtatcacacgaatggtactggttgtagttgccgtcttcatcgtgtgttggaccccaatccatatttatgtgattatcaaggccctggtaactattcctgagaccacttttcagacagtgagctggcacttttgcattgccctgggatataccaacagttgccttaaccctgtactgtacgcctttctggacgagaatttcaagagatgtttccgagagttttgtattccgacttcatcaaacattgaacagcagaatagcacaagaatccgccagaacacccgtgatcaccccagtacagctaatacagtggaccgaacaaatcaccagctagagaacctagaggctgagacagcccccctgccctag

SEQ ID NO: 198145 - DNA, 1209 bp, Artificial Sequence
  Description of Artificial Sequence: Synthetic coding sequence
atggacagcagcgccgcccccaccaacgccagcaactgcaccgacgccctagcatactcctcatgttctccggccccatccccagggtcctgggtgaacctgagtcatcttgatggcaacttaagtgatccctgcggtcctaaccgaaccgacctgggcggccgagactctctttgcccccccactggatccccatcaatgatcacagcaatcacgatcatggcactgtacagcatcgtttgtgtcgtgggactgttcggtaattttttggtgatgtacgttattgtgaggtacacaaagatgaaaacggccacaaacatttacatctttaatttagcgctggcggacgccctggctacatctactctgccattccaaagtgtgaactatcttatgggcacatggcccttcggcactattttgtgcaagatcgtaatctctatagactactataatatgtttacgagcatattcacgttatgcactatgtccgtagataggtacatcgccgtgtgtcatccagtcaaggccctcgacttcagaacgccccgtaacgccaagattatcaatgtttgcaactggatcttgagcagcgccataggtctccctgtcatgttcatggcgactaccaagtataggcaaggatccattgattgtacactcacatttagccatcccacctggtactgggaaaatctgttgaaaatttgtgtctttatctttgctttcattatgccggtactgattataacagtgtgctacggactgatgatacttagactgaagagcgtcagaatgctctcgggatctaaagagaaggaccggaacctgaggcgcataaccagaatggtgctagtcgtcgtcgccgtgtttattgtctgttggactcctattcacatctacgtgatcatcaaagccctcgtgacaatccctgaaacaacatttcagactgtcagctggcacttctgtatcgccctgggctacaccaactcttgcctaaatcccgtgctttacgcttttctggatgagaacttcaaacggtgtttccgagagttttgtattcctaccagcagtaatatagaacaacagaattcaacccgcataagacaaaacacgcgagaccatcctagcacagccaatactgtcgacagaaccaatcaccagatccgtgaccctataagtaacctgccacgagtgtctgtgttttag

SEQ ID NO: 198146 - DNA, 492 bp, Artificial Sequence
  Description of Artificial Sequence: Synthetic coding sequence
atggtgcaggcccggaccggcttctgcaagaagcagcaggagctgtggcaacgcagaaaggaagccgccgaagcactgggcacaagaaaagtctctgttttacttgcgacatcacactcgggcgctcggcccgctgtcagtacaatggattcatcggctgctcccacaaatgctagtaattgcactgatgccttagcttacagctcatgctcccccgcaccatcccctgggtcatgggtaaacctgagccatctggacggcaatctgtcagacccatgcggcccaaaccgtacggatctgggtggacgggatagcctatgcccccccaccggctcccccagtatgattaccgccatcacaatcatggcactgtatagcatagtgtgcgttgtgggtctgttcgggaactttctggtcatgtacgtgatagtccgctatacaaagatgaaaactgccacaaatatctacatctttaacctcgctctagcctag

SEQ ID NO: 198147 - DNA, 903 bp, Artificial Sequence
  Description of Artificial Sequence: Synthetic coding sequence
atgaagaccgccaccaacatctacatcttcaacctggccctggccgacgctcttgccacaagcaccctcccattccaatcagtcaactaccttatggggacttggccatttgggacgattctatgcaaaatcgtgatttccattgattattataacatgttcacctcaatttttactctgtgtaccatgtctgtcgatcgctacatcgctgtctgccatcctgttaaggcactggattttcgcaccccccgcaacgcgaagataataaacgtctgtaattggatcctgtccagcgctattgggctgccagtcatgtttatggccactacaaagtatagacagggttccatcgactgtactctgaccttttctcatcccacatggtactgggaaaacctgctcaaaatctgcgtctttatatttgccttcatcatgcctgttctgattattaccgtttgttatggattgatgatcctgagattaaagagcgtccgtatgctgtctggctcaaaggaaaaagacagaaatctgagacggatcaccaggatggtgttggttgtggtcgcggtgttcatagtgtgctggactcctattcatatttacgtgatcataaaggccctcgttacaatcccagaaaccactttccagactgtgtcatggcacttttgcatcgcgctcggttatacaaactcttgtctcaatcccgtcctgtacgcatttctggacgaaaattttaaacggtgttttagggagttctgcatccccacaagttcaaacatcgagcagcaaaattccactagaatccggcagaacacacgggaccacccaagtacagccaatacagtagaccgcacaaaccatcagcttgaaaatctcgaggctgagactgcccctttaccctag

SEQ ID NO: 198148 - DNA, 903 bp, Artificial Sequence
  Description of Artificial Sequence: Synthetic coding sequence
atgaagaccgccaccaacatctacatcttcaacctggccctggccgacgcgctggccactagtaccttgccttttcagtccgtcaactatctcatgggtacctggccatttggaaccatcttgtgtaagattgtcatctccattgactactataatatgttcaccagcatcttcacactctgtacgatgagtgtcgaccgctacatcgcagtgtgccacccagtgaaagcactggatttccggaccccccgtaacgccaaaattataaatgtgtgtaactggatcctgtcaagcgccatcgggctccctgtgatgttcatggctaccaccaaatatcgtcagggctcgatcgactgcacgttgaccttttctcatccaacatggtattgggaaaacctccttaaaatttgcgtgtttattttcgccttcatcatgcccgtgctcatcatcactgtctgctacgggcttatgattcttcggttgaaaagcgttaggatgctgtccggatctaaggagaaagatcgcaacctgcgtcgaatcactcgaatggttctggtcgtggttgccgtgtttattgtgtgttggactcccatccacatctatgttataattaaggccctggtgacaatcccggaaactactttccagaccgtgtcttggcacttttgtattgcattgggttatacaaattcttgcctgaaccccgtcttatacgccttcttggacgagaatttcaaaagatgcttccgggagttctgcattccgacatcgagcaacatcgaacagcagaacagtacccgcatccggcagaacacccgcgaccatccatctaccgccaatacagttgacaggactaaccaccagttagaaaacctggaggcagagacagctccactgccctag

SEQ ID NO: 198149 - DNA, 903 bp, Artificial Sequence
  Description of Artificial Sequence: Synthetic coding sequence
atgaagaccgccaccaacatctacatcttcaacctggccctggccgatgcgctggctacttctaccttgccttttcagtcagtcaattatctcatgggaacatggccgtttggcaccatcctctgcaaaatcgtgatttccatcgactactacaacatgttcacctctatttttacgctgtgtaccatgtctgttgatcgatatatcgccgtctgccatcccgtgaaggcactcgatttcaggaccccccggaacgcaaaaataatcaacgtgtgcaattggatcctatcatcggctattggtctgccagtgatgttcatggccacaactaagtatcgacagggttccatcgattgtacattgacttttagccaccctacatggtactgggagaatttgctgaaaatctgtgtgttcatcttcgcctttataatgcccgtgctgatcattactgtatgttatggactgatgatactgcgactgaagagcgtgcgaatgctttctggtagtaaggagaaagatcgtaatctgcgtaggattacaagaatggttttagtggtggttgccgtgtttatcgtttgctggacccctatccatatttacgtaatcattaaagcattagtgactatccccgaaactacctttcagactgtttcatggcatttctgtatcgctttgggctacactaatagttgcctgaaccctgtgctgtacgccttcctagacgaaaattttaagcgatgcttccgcgaattctgtataccaaccagcagcaacatcgagcaacaaaacagcacacggatcagacagaacactagagatcacccgagtacagcaaatacagtagaccgtacgaatcaccagctggaaaatcttgaagcagaaaccgcaccgctcccctag

SEQ ID NO: 198150 - DNA, 1209 bp, Artificial Sequence
  Description of Artificial Sequence: Synthetic coding sequence
atggacagcagcgccgcccccaccaacgccagcaactgcaccgacgctctcgcctactccagctgttcccctgctccgtcccccgggagctgggtgaacctgagtcacctagatggaaatctttcggacccatgcggaccaaaccggactgatctcggcggtagggactccttatgccctcccacagggagcccttctatgattacggcaattaccataatggccttgtattcgatcgtgtgtgtggttggcctgtttgggaattttttggtgatgtatgtgatagtgcgatatacgaaaatgaaaacggccaccaatatttatatctttaacctggccctggctgatgcccttgccacaagcacacttcctttccagtcagtaaattatctaatgggcacctggcctttcggcacaatactatgtaaaatcgtcatctctatcgattactacaacatgttcacatccatttttacactgtgcaccatgtctgtggaccgttacattgccgtgtgccatcctgtgaaagctcttgactttagaaccccacgaaatgccaagattatcaatgtgtgtaattggatcctgtcgtccgccatcgggctgcccgttatgtttatggctacaaccaaatatcgccagggctcaatcgactgtactctgacatttagccacccgacctggtactgggaaaaccttcttaagatctgtgtgttcattttcgccttcataatgcctgttttaatcataactgtatgctatgggctgatgatcctgagactgaagtccgtacggatgctttccggcagtaaggagaaggacaggaacctacgcaggataacccggatggtgctcgtagtggtcgctgtgtttatcgtgtgctggacgcccatccatatctatgtgatcatcaaggctcttgtcactatcccggaaaccactttccaaactgtgtcttggcacttctgtattgccttgggttatacaaactcctgcctcaaccccgtcctctatgcatttctcgacgaaaactttaagagatgcttcagagagttctgcatccctaccagttcaaacatagagcagcagaattcaactcgtattcggcaaaatacgcgagaccacccgagcaccgctaacacagtggaccgaactaatcaccagatccgcgaccctatttcaaacttgccgagagtctctgtcttctag

SEQ ID NO: 198151 - DNA, 561 bp, Artificial Sequence
  Description of Artificial Sequence: Synthetic coding sequence
atggacagcagcgccgcccccaccaacgccagcaactgcaccgacgcattggcttattcgagctgctctcccgccccgagcccggggagctgggtgaatctttctcacctggatggaaacctttctgatccttgtggacctaaccggacagatttaggaggcagggactctttatgtcccccaacgggctctcctagtatgataaccgccattactattatggccctatatagcatagtgtgcgtcgtgggcttattcgggaattttctagtgatgtatgtcatcgtccgctttcatcgcctgtacacaaatatcttatccagtaaccttgtgctgggaaagccggccgaagatctttgcttccatctgcgcctgcactatgcttcagcccaccactaccgcgtgctgtggactgatgatctcgccccgcaagaatgtccccacgctctatggttgcagcggaaagggcaggaatccagcaaggatcaccaggatggagccggggggggaggctgtgtgcataggctgcttgattcacattctcatctaaggcaccactag

SEQ ID NO: 198152 - DNA, 1170 bp, Artificial Sequence
  Description of Artificial Sequence: Synthetic coding sequence
atggacagcagcgccgcccccaccaacgccagcaactgcaccgacgcgcttgcctacagttcctgcagccccgccccctcacccggctcctgggtgaacctttctcatcttgatgggaacctgagtgatccttgtgggccaaatcggaccgatctgggaggccgcgattctttgtgtcctcctacaggttccccatctatgatcacggccattacgattatggccctgtactctatcgtttgtgtcgtggggttattcggtaactttctcgtgatgtatgttatcgttcgatataccaaaatgaagaccgctacaaatatctacatttttaacctggccttagctgacgcgctcgccacatctaccctgccattccagagcgtaaactatctgatggggacatggccttttggaaccattttatgcaagatcgtaatttctattgactattataatatgtttacatctattttcaccctttgcaccatgtcagtggaccggtacattgcagtgtgtcacccggtaaaagcccttgatttcagaacgccccggaatgcgaaaatcatcaatgtgtgtaactggatacttagcagtgccatcggcttacctgtcatgtttatggcaacaaccaaatacaggcagggatctattgattgcacgctcactttcagtcaccccacttggtactgggagaatctgctgaaaatctgcgtgttcatttttgccttcattatgcccgttcttatcattactgtttgttatggccttatgattctccgcctcaagtcggtccggatgctctccggcagcaaagagaaagacaggaacctgcgaagaatcactcggatggtgctcgtggtcgttgctgtgttcatcgtctgttggaccccgatacatatctacgtcatcattaaggcactggtcactattcccgagacaacatttcagaccgtgtcgtggcatttttgcatcgccctgggctacactaacagttgtctcaacccagttctgtacgcctttctggatgaaaattttaagagatgtttcagagaattttgtattcccaccagctctaacatcgagcagcagaacagcactcggattcggcagaacaccagagaccatccaagcaccgccaacacagtggataggactaaccaccaaagctag

SEQ ID NO: 198153 - DNA, 1095 bp, Artificial Sequence
  Description of Artificial Sequence: Synthetic coding sequence
atggcccagcagtggagcctgcagcggctggccggccggcacccccaggattcatacgaagactccactcagtctagcatcttcacttacacaaatagtaactccactaggggaccatttgagggaccaaattatcacattgctccaaggtgggtgtatcacctgacctccgtctggatgatttttgtggttactgcttccgtgtttactaacggtctcgtgctggctgctacaatgaaatttaagaaactgaggcacccattgaactggattctggtcaacctggcagtggccgacctggctgagacagtcatagccagtacaatatccattgtgaatcaagtctccgggtactttgtgttaggtcaccccatgtgcgtcctcgaaggctatacagtcagcctgtgcggcatcactggtctttggagcctagcaatcatcagctgggagagatggttggtggtgtgcaaaccatttggtaatgtacgttttgacgcaaaactagctattgtgggaattgcctttagctggatctggagcgctgtgtggacggcacctccaatatttggatggagcagatactggccccatggtctgaaaacttcctgtggccctgacgtattttccggtagcagctacccaggtgtccaaagctatatgatcgttttgatggtgacatgctgtataatccctctggcaatcatcatgctttgttacctgcaagtctggcttgcaatacgggccgtcgcaaagcaacaaaaggagtccgagagtacacagaaggccgagaaggaggttactagaatggttgtagtgatgatctttgcatactgcgtgtgttggggtccctacaccttttttgcttgtttcgctgccgccaaccccggttacgcttttcaccctctaatggctgccctgcccgcctacttcgcaaagagcgcaacgatatacaatcccgtcatctacgtcttcatgaaccgccagttcagaaattgcatcctccagctcttcggcaaaaaagtggacgacggaagcgaattatcctccgcctccaagacagaagtgagttctgtttcaagcgtatccccggcgtag

SEQ ID NO: 198154 - DNA, 1095 bp, Artificial Sequence
  Description of Artificial Sequence: Synthetic coding sequence
atggcccagcagtggagcctgcagcggctggccggccggcacccccaagactcatatgaggactcaacgcaaagctctattttcacctacactaatagtaatagtacacgagggccatttgaagggccaaactaccacattgcgccacggtgggtgtaccacctcacctccgtgtggatgatattcgtagtcatcgctagcgtttttaccaacggtctggtgcttgccgccactatgaagtttaaaaagctgaggcacccactcaactggatcctggtgaatctagccgtcgctgatctagccgaaacagtgattgcctcgacaattagcgtggtgaatcaagtatacggatatttcgtacttggccaccctatgtgcgttctggaaggctatacagtgagtctgtgtggcatcaccggattatggtcacttgccattatttcttgggagcgatggatggtcgtttgtaagcccttcgggaatgttaggttcgatgccaaattggctatagtaggcattgccttttcgtggatctgggccgccgtctggaccgctccaccaatctttgggtggtctagatactggccgcacggccttaaaacctcctgcggccctgatgttttttccggctctagctaccctggggttcaatcttatatgattgtgctgatggttacatgttgcattacacccctcagtattatcgtgctttgttatctgcaggtctggctggctatccgggccgtggctaagcagcaaaaggaatccgagagcacacagaaggctgaaaaagaggtgacacgcatggtggtggtgatggtgctggcattttgtttctgttggggcccatatgcattttttgcatgttttgccgccgccaatcccggttacccgttccaccctctcatggctgcccttcccgccttcttcgccaaatccgctaccatatataaccctgtgatttacgtcttcatgaataggcagttccggaattgcatactccagctctttggaaaaaaggtcgacgacggcagtgagctgagtagtgcctccaaaacagaggtgtctagcgtcagcagcgtgagcccagcttag

SEQ ID NO: 198155 - DNA, 1047 bp, Artificial Sequence
  Description of Artificial Sequence: Synthetic coding sequence
atgcggaagatgagcgaggaggagttctacctgttcaagaacatctcttctgttgggccgtgggacggaccccaatatcatatcgcccctgtctgggccttctacctgcaagccgcttttatgggtaccgtcttcctgattgggtttcctctcaatgccatggtcttggttgccactttacggtataagaaactgaggcagcctctgaattacatactggttaacgtttcatttggaggattcttactgtgcatattttccgtctttccggtgttcgtggcatcgtgcaatggatatttcgtgttcggccggcatgtgtgcgccctcgaagggtttctaggcacagttgcgggtttggtaactggctggtcccttgcctttttggcgttcgagagatacatagtgatatgcaaaccttttggtaactttcgcttttcttctaaacacgcgctgacagtggttctggcgacgtggacaatcggcatcggcgtgagcattcctccgtttttcggctggagcaggtttatcccagagggacttcagtgcagttgcggccctgactggtacaccgttggaaccaaataccggtctgaatcatatacctggttcctgttcattttttgcttcattgtgcctttgtcactaatctgcttctcatacactcaacttttacgagccctgaaggccgtcgctgcccagcaacaggagagcgctacaacacaaaaagcggagcgagaggtctcccgaatggtggtggtgatggtcggttcgttttgcgtgtgttatgtcccttacgcagccttcgccatgtacatggtgaataaccgtaatcacgggctagacttgagattggtgactattcccagctttttctcaaagagtgcttgcatctataaccctatcatttactgctttatgaacaaacagttccaggcatgcataatgaagatggtgtgcggcaaggctatgaccgatgagtctgacacgtgttcgtcgcagaagaccgaggtgagcaccgtgtcctctacacaagtgggacctaattag

SEQ ID NO: 198156 - DNA, 972 bp, Artificial Sequence
  Description of Artificial Sequence: Synthetic coding sequence
atgtacagcggcaaccggagcggcggccacggctactgggacggcggcggagccgctggcgctgagggtcccgcccctgcagggaccctcagccccgccccgcttttctctcccggaacgtacgaacggctggcactgctccttgggagcattggacttctgggcgtgggaaataacctcctggtgctggtactttactacaaatttcaacgcttgaggaccccaacccatctgctgttagtgaatatttctctgtctgatctgctggtctccctgtttggagtgacatttacctttgtgagctgcctgagaaatggctgggtgtgggacacagtgggctgcgtgtgggacggctttagcggttccctcttcggatggattagccagctgcaggcagcaacacgggaggcccgagcctctatgggtcccgtccagcagggaaccatttgtatgcagcttagatgtgtggaggacctgcaaactatccaggtcatcaaaatcttgaagtacgagaagaagctcgcgaagatgtgttttcttatgatttttaccttcctggtatgctggatgccatacattgtgatctgctttctcgtggtcaatggacacggacatttagtgacacccaccatcagcattgtttcctatctatttgctaaaagcaatactgtgtacaatcccgtgatctacgtgtttatgatccgaaagtttaggcggtcccttcttcagctactctgtctgcgattgctcagatgccagcggcccgctaaagatctacccgctgctgggtctgagatgcagatcagacctatcgtgatgtctcaaaaggatggggacagacctaagaaaaaggtgacgtttaattcttctagcataatcttcattatcaccagcgacgaaagcctgagtgtggacgacagtgacaaaacaaacgggtccaaggtggacgtcatccaggtgcgccccttgtag

SEQ ID NO: 198157 - DNA, 1209 bp, Artificial Sequence
  Description of Artificial Sequence: Synthetic coding sequence
atgtacagcggcaaccggagcggcggccacggctactgggacggcgggggggcagcgggagcagagggccccgcacctgcaggcacactgtcgcccgcaccactgttcagccccggcacctacgagcgcctggctcttctcctcggaagcattgggcttctaggtgttggaaacaacctgcttgtgctggtcctgtattacaagttccagcgcttgcggacccctacacatctcttgctggtgaacatcagcttatcagacttattggtgtctttatttggagtaacattcacattcgtaagctgtcttaggaatgggtgggtatgggatacagtggggtgcgtgtgggacgggtttagtggaagcttgttcggcatcgtgtcaatcgccacccttactgtgctggcatacgagcgatacattcgagttgtgcacgctagagtaattaatttctcttgggcatggcgagcgataacctacatctggctatacagcctggcctgggccggcgcacctttactgggttggaaccgatatattctggacgtacacggattggggtgtactgttgattggaagagtaaagatgcgaacgactcctcctttgtgctgtttctgtttctcgggtgcctagtggttccattgggtgttatcgcccattgttacggtcacattctctattctatccgcatgcttcgctgtgtggaggacctgcagacaatccaggttattaagatactgaaatatgagaaaaaactggcgaaaatgtgtttcctcatgatatttacattcctcgtatgctggatgccatatatagtcatttgttttctcgtcgttaatggccatgggcacttagtcacccctaccatttcgatagtgtcatacctatttgctaaatctaacaccgtgtacaacccagtaatctacgtgtttatgatcagaaaattccgaaggagcctcctccagcttctttgcttacgactgctccgctgccagagacctgccaaggatctgccagccgcagggtctgagatgcaaatccggcccattgtcatgagtcagaaagacggagacaggccaaagaaaaaggtcacattcaactcctcttccattatctttattatcacaagcgatgagtccctcagtgtggatgactccgataaaacaaatggatccaaggtggacgttattcaagtccgacccctctag

SEQ ID NO: 198158 - DNA, 2886 bp, Artificial Sequence
  Description of Artificial Sequence: Synthetic coding sequence
atgtggcggctgcggcgggccgccgtggcctgcgaggtgtgccagagcctggtcaagcacagctcaggcatcaagggaagccttcccctgcagaagctgcatctggtgtccagatcaatctatcactcacaccaccctacccttaagcttcaacgcccccagctgagaactagttttcaacagtttagctcactgacgaaccttccactgcgtaagcttaaattcagtcccatcaagtatggataccagccccgtcggaatttttggcctgccaggctggccactcggctccttaagctgagataccttatactgggaagcgctgtgggaggaggatataccgctaagaagacctttgatcagtggaaggatatgatcccagacctgagcgaatacaaatggatcgtgccagatattgtgtgggagatcgatgagtatatagacttcggctcccccgaggagactgcattccgcgcaacagaccgtggttccgagtcagacaagcacttccggaagggactccttggtgaactcatcctgcttcaacagcagattcaggaacacgaagaggaggcccgtagggcggcaggccagtattctacaagctacgctcagcaaaaacgtaaagtatctgacaaagaaaagatcgaccagctacaggaggagctgcttcacacacagctaaagtaccaacgcatcctcgaacgactggagaaggaaaataaggaactgaggaagctggtactgcagaaggatgataaaggcattcatcaccgcaagttaaagaagtcattaattgacatgtatagtgaggtgctggatgtgctatctgactatgacgcctcatataacacgcaagatcacctaccacgggtcgtcgtggtaggtgatcagagcgctggaaagaccagcgttttggagatgatcgcacaggctaggatttttcccaggggatccggtgaaatgatgacccgcagtcccgtaaaagttaccttgtctgaagggccgcaccatgtggctctttttaaggactccagccgcgagttcgatctgaccaaagaggaagatctggccgctcttcggcacgaaattgaactgcggatgcggaaaaatgtgaaggaaggttgcacagtaagccctgagaccatttctctaaatgtcaaaggcccagggcttcagagaatggtcctggttgatctacccggtgtgatcaacacggttacttcaggcatggccccagacacaaaagaaacgatcttttctatctcaaaagcttacatgcagaaccccaatgccattattctttgtatccaagatggctctgtggatgccgaacgaagcattgtgaccgacctcgtgtcccagatggatccccacggacgaagaacaatcttcgtgcttacgaaggttgacctggcggagaaaaatgtagcctctccaagccggattcagcaaattattgagggaaaactgttcccaatgaaagcactggggtacttcgccgtcgtgaccggcaaggggaattcctctgaatcaatagaagctatacgagaatatgaggaggagttttttcaaaacagcaaactgctaaaaacttccatgctcaaggcacaccaggttacaaccaggaacctgagcctcgctgtgtctgactgtttctggaagatggtgagagagtccgtggagcagcaggccgattcatttaaggcaacgagatttaacttagagacagaatggaaaaataattacccaaggctgcgggagctcgaccgaaacgagttgttcgagaaggctaagaatgagatcttagacgaggtgatttctctgagtcaggtgacacctaaacattgggaggagattttgcaacagtccttgtgggagagggtgagcacccatgtcatcgagaatatatatcttcctgcagcacagactatgaacagtggaacgtttaacacaactgtagacatcaagctcaagcagtggacggataaacaactccctaataaggcagtagaggtcgcttgggagaccctacaagaggaattctcccgattcatgaccgagccgaagggcaaagaacacgatgacatctttgataagttgaaggaggccgtgaaggaggagagtatcaagcgccacaaatggaatgatttcgccgaggacagcctcagggtcatccaacacaatgccctggaggatcgaagtatttccgacaaacagcagtgggatgcggcaatctacttcatggaagaggcattacaggcacgtcttaaagacactgagaatgccatagaaaatatggtaggcccagactggaagaagaggtggctctactggaaaaaccgaacccaggagcaatgtgtacacaacgagacaaaaaacgaattggaaaaaatgctgaagtgcaacgaggagcaccccgcatacctggcatcggatgaaataacaacagtgaggaagaatctggagtccagaggcgtggaggttgatccgagtctgatcaaggacacgtggcaccaggtttacagacgtcattttctgaagaccgccctgaatcactgcaatctgtgtcgcagaggcttctattactaccaacggcactttgtcgacagcgagctggagtgcaacgacgtcgtgttattttggcgcatccagcggatgttagcaatcaccgccaacacgctgcgccagcagctgactaacactgaggtccggcgactcgaaaagaacgtgaaagaggtattggaggactttgccgaagatggcgagaaaaaaattaagctcctgacaggtaaacgggtccagcttgcagaagatctcaagaaagtgcgagagattcaggagaaactggatgctttcatcgaagctttgcaccaagaaaaatag

SEQ ID NO: 198159 - DNA, 3048 bp, Artificial Sequence
  Description of Artificial Sequence: Synthetic coding sequence
atgtggcggctgcggcgggccgccgtggcctgcgaggtgtgccagagcttggtgaagcactcctctggcataaagggtagcctcccactgcagaagctgcaccttgtgagtaggtctatctatcacagtcaccaccctacactcaagctgcagagaccacagctgaggacctcttttcagcagttcagtagcctgacgaacctgcccctccgtaagctgaaattctccccaattaaatatggttaccaacctaggaggaacttctggccggccagacttgcaacaagactgttgaagctgcggtatctgatcctgggctccgccgtcgggggcggctacaccgccaaaaaaaccttcgatcagtggaaggatatgatccctgatttgagcgaatataagtggatcgtgcccgacatcgtgtgggagatcgacgagtacatagatttcgagaagatccgcaaggctctgccatcaagcgaggaccttgttaagctggcccctgattttgacaagattgtggagtccttgtccctccttaaagatttttttacctccggtcataaattggtgtccgaagtcatcggagcctccgatctcctcttgctgctgggttctcctgaagagacagcatttcgggccactgatagagggtccgagagcgacaaacactttaggaagggactgttaggggagctcatcttgctgcagcagcaaattcaggaacacgaggaagaagccagaagggcggccggtcagtactcgactagttatgcccaacaaaaaagaaaagtttccgacaaggagaagattgatcagctgcaggaagagctcctgcatactcagctgaaataccaaagaatcctcgaacgtctggagaaggagaacaaggaactgcgtaagctagtccttcaaaaggacgacaagggtattcaccaccgcaagcttaaaaaaagcttgatcgatatgtacagtgaggtcctcgacgttctgtccgactacgacgcctcctataacacacaggatcatctgccgcgtgttgtggttgtcggcgatcagtcagctggaaagactagtgtgctggagatgatcgctcaggctcgcatctttcctaggggaagcggagagatgatgacaaggagtcctgtaaaggtgactctgtcagagggccctcaccacgtcgcactgttcaaggactcctcaagagagtttgatctgactaaagaagaagacctggcggcactacggcatgagatagagttacgaatgaggaagaacgtgaaggagggctgtaccgtgtctcctgagacaatttctcttaacgtgaaggggcctggactgcaacgcatggtgcttgtagatctgcccggtgtgattaataccgtgacaagcggcatggcgccggatacaaaggagacaatcttttctatcagcaaagcttacatgcagaaccctaatgcaatcatactctgcatccaagacggatccgtcgatgctgaaaggagcatcgtgaccgatctggtatcacagatggacccacacggaagaaggacaatttttgtgttgactaaggtcgacctcgctgaaaagaacgtagctagcccttcacggatccagcagatcatcgagggcaaactgtttcccatgaaggctttaggctattttgccgtcgtaaccggtaaggggaactccagcgaaagcatcgaagcaataagggagtatgaggaggagttttttcagaactccaagttgctgaaaactagcatgctcaaggcccaccaggtcacaacacgaaatctgagcttagccgtgtctgactgtttttggaagatggttagggagtctgtggaacagcaggccgactctttcaaagcaactaggtttaacttggaaacagagtggaagaacaactacccacgtttaagggagttggatcgcaatgaactcttcgagaaggccaaaaatgaaattttggatgaggtgatatcactgagccaggtgacccccaagcactgggaggagattctgcagcaatcactgtgggagcgcgtgtctacacacgtgattgagaatatctacctgcccgccgctcaaactatgaatagtggaacctttaataccacagtagatattaaactgaagcaatggacagataaacagttgcctaacaaagccgtggaagtcgcttgggaaacactacaagaagagttctcacggttcatgacagaaccgaaaggcaaagagcatgacgacatatttgataaactcaaagaggccgtaaaagaggagtcgatcaaaaggcacaaatggaacgatttcgccgaggatagccttcgcgtgatacagcacaatgccctggaggatagatcaatctctgacaagcagcagtgggatgccgccatttatttcatggaggaagccctgcaggccagactgaaggatacggagaacgctatagagaatatggttggcccagactggaaaaaaagatggctctattggaaaaaccggactcaggagcaatgtgtccataacgaaaccaaaaacgagctcgaaaaaatgcttaagtgtaatgaagagcaccccgcatacttagcctcagacgagattaccactgtccgtaaaaacctggagagcagaggtgttgaggtggacccatcgctgatcaaagacacatggcaccaggtgtaccgacggcactttctgaagacggctcttaaccactgtaacttgtgccgacggggcttttactactaccagagacacttcgtcgactcggaactggagtgcaatgacgtcgtgctgttctggcgtattcagcggatgctggctatcactgctaatacactcaggcagcaactcacaaacacagaagtccggcgcctcgagaagaacgtcaaagaagtcttggaggacttcgctgaggatggggaaaagaaaatcaaactgctcaccgggaaaagagtgcagctggccgaagacctcaagaaagtgagagagatccaggagaaactcgatgcgtttatagaggccctccatcaggaaaagtag

SEQ ID NO: 198160 - DNA, 2940 bp, Artificial Sequence
  Description of Artificial Sequence: Synthetic coding sequence
atgtggcggctgcggcgggccgccgtggcctgcgaggtgtgccagtctctcgtcaagcattcctcaggtatcaagggctccctccctctccagaagctacatttggtcagccggtctatctaccatagtcaccatcctaccctgaagctacagcgtccacagttacgtacttcctttcaacaattcagctccctgaccaatctgcccctacggaagctgaagttcagtcccattaaatatgggtatcaaccccgccgcaatttctggcccgccagactggctacacgtctcctcaaactgaggtatcttatactgggtagcgccgttggggggggatatacagcaaagaaaaccttcgatcaatggaaagatatgatccccgacctgagtgagtacaaatggatcgtgcctgacatagtgtgggaaatcgatgagtatatagactttggacataagctggtatctgaagtgattggcgcatcagatcttctcttgctcctgggctctccagaggagaccgcctttcgggccacggaccgtggctctgaaagtgacaagcacttccggaagggtctgctgggggagctcatcctcttgcaacagcagatccaggaacatgaagaggaagccaggcgcgctgctggtcaatattctacgtcctatgcccagcaaaaacggaaggttagtgataaggagaagattgatcagcttcaggaggagctgcttcatacccagctaaagtaccagagaatcctcgagcgcttggagaaagaaaacaaggagctgagaaaacttgttctgcaaaaagatgacaaaggcatccaccaccggaaattgaagaagtctctgatcgacatgtactctgaggtccttgacgttctgtctgactacgacgcctcttacaatactcaggaccacttacctagagtggtggtggtgggagaccagagtgctgggaagaccagtgtccttgaaatgattgcccaggcgagaatttttcctaggggaagtggggagatgatgacgaggtccccggtcaaagtgactctgtccgaaggcccccatcacgtggcactctttaaagattcaagccgtgaatttgacctcacaaaggaggaagaccttgctgccctgcgccatgagattgaattgagaatgcggaaaaatgtgaaggagggatgtactgtaagccccgagacaatctcgctcaatgtgaaggggcctgggctgcagagaatggtcttagtggaccttcctggcgtaattaatacggtgacctccggaatggccccggatacaaaagagacgattttctccatcagtaaagcctacatgcagaaccccaacgcaatcattctttgtatccaggacggctctgttgacgcggaaagatctatcgtgacagacttggtatcccagatggatccacatggccggaggacgattttcgtcctcacgaaggtggaccttgctgaaaaaaatgtggcctcaccctcaagaatacaacagattattgaagggaaactctttcctatgaaggcgttgggttactttgccgttgtcactggaaaaggaaacagtagtgagtccatcgaggccattagagaatatgaggaggaattttttcagaattcaaaactgctcaaaacatcaatgttgaaagcccaccaggttacaacacgtaatttgagcttggcagttagtgattgtttctggaagatggtccgtgaatctgtggagcagcaagccgactccttcaaagctacccgattcaatctcgaaaccgagtggaaaaacaattatcctagactgagggagctggataggaatgaactctttgagaaagccaagaacgaaatcctggacgaggtcatctctctgtcacaggtcaccccaaaacattgggaagagattttacagcagtcactttgggagcgcgtgagcacccacgtaattgaaaacatctatctccctgctgcccagactatgaatagtggcacattcaatactacagtagatataaaactgaagcagtggaccgacaaacagctgcctaataaggccgttgaagtagcttgggagactcttcaggaggagttcagcagatttatgacggagcctaagggtaaggaacacgacgatatcttcgacaaactcaaggaggcagtaaaagaggagtccatcaagcgccacaagtggaacgatttcgccgaagactccctgcgagtcattcaacataatgcactggaggataggtcgatctcggataagcagcagtgggacgctgcgatttatttcatggaggaggctctgcaggccagacttaaggacacagagaatgccattgagaacatggtgggcccggattggaagaaacgctggctatactggaaaaacaggacccaggaacagtgcgtgcataacgagactaagaacgaactcgagaaaatgctgaaatgcaatgaagagcaccctgcttatctggcttctgacgagataaccacagtcaggaagaaccttgaatcacgtggggtcgaggttgatccttcactcatcaaggacacttggcatcaggtctatcggaggcattttctgaaaacagccttgaaccactgcaacttgtgccgtaggggcttctactactaccagcgccattttgtggacagcgaacttgaatgtaacgatgttgttctcttttggaggatccaacggatgctcgccatcaccgctaacacactgcggcaacaattgactaacacggaggtacggcgcctggagaagaacgtgaaagaggtgttggaagattttgctgaagatggggaaaagaaaatcaaactactcacagggaagagggtgcagctcgcagaagacctgaagaaggttagggagattcaggaaaaactggatgcattcattgaggcgctccaccaggagaagtag

SEQ ID NO: 198161 - DNA, 2937 bp, Artificial Sequence
  Description of Artificial Sequence: Synthetic coding sequence
atgtggcggctgcggcgggccgccgtggcctgcgaggtgtgccagagtctggtgaaacactccagcgggattaaaggatcgctgcctctgcaaaagctacacctagtaagcaggtccatatatcattcccaccacccgaccctgaagttgcagcgacctcagctgagaacgagtttccagcagttttctagccttacaaacttgccactacgaaaactgaaattttcccctatcaagtatggttatcagccacgaaggaacttttggcctgccaggctggccactcgcctactgaagttgcgctatctgatactgggaagcgccgtgggcggcggctacaccgccaagaaaactttcgatcagtggaaagacatgatacccgacctgagtgaatacaagtggattgtgcccgacatcgtttgggaaattgatgagtatatcgattttgagaaaatccgcaaagccctccctagctcggaggatctagtgaaactggctccagacttcgacaagattgtagagtcgctcagcttgctgaaggacttttttacttccggccataagttggtgtcggaggtgatcggggcttccgatctcctgctgttactgggaagtcctgaagaaaccgcattccgagcaacagatcgcggctcagagtccgacaagcattttaggaaagtctccgacaaggagaagattgaccagctgcaggaggagctactccacactcagctaaaatatcaaaggatcctggaaagactagagaaagagaataaggaactcagaaagctggtcttgcaaaaggacgacaagggtattcaccatcggaagttgaagaaatccctgattgacatgtatagcgaggttctcgatgttctttccgactatgacgcatcatataacacccaggaccatctcccgcgtgtggtggtggtcggtgatcagtctgctggtaagacaagcgtactagaaatgattgcacaggcaaggatctttcctcggggctcaggagaaatgatgacgaggagtcccgtgaaggttacgctgtctgagggccctcaccatgtcgccctgttcaaggactctagcagagagttcgacttgacaaaggaagaagacctagcggccctgcgacatgaaatagagctccgtatgcgaaaaaatgttaaggaagggtgcaccgtctctcctgagactatatcattgaacgtgaagggacccggcctccagaggatggtcttggttgacctgccaggagtcattaacaccgtgacatcgggcatggctcccgacacaaaagagaccatattctcaatctcgaaggcctacatgcagaaccccaacgccatcatcctgtgcatacaggacggatcagtcgacgcggagcgatctattgtaactgatctggttagccaaatggacccccatggcagacgcactatatttgtgctgacaaaagtcgatctcgccgaaaagaatgtggcttctccaagcagaattcaacagataatcgaggggaaactgtttcccatgaaagccctggggtacttcgctgtcgtcacgggaaaagggaatagctcggagtcgattgaagccatcagagaatatgaggaggaattctttcagaatagtaagctccttaaaacatcgatgcttaaagctcatcaggtgacaacgagaaaccttagcctggcagtttcagattgcttctggaagatggtgagggagtcagtggaacagcaagcagatagttttaaggctactagattcaacttggaaaccgaatggaaaaataactacccccggctgcgcgagttggaccgcaatgagttgttcgaaaaagccaagaatgagattctggacgaagttataagcctttctcaagtgactccaaagcactgggaggagatactccagcagagtctttgggagcgggtcagcacccatgtgatcgaaaatatttatctgcctgctgcccagacaatgaactctggcacattcaatacaactgtggatatcaaactgaaacagtggacagacaagcagctgcccaacaaggctgttgaagtggcatgggagacattgcaagaggagttctcccggtttatgaccgagcccaaaggaaaagaacatgacgatattttcgacaagctaaaagaggcagtgaaggaggaatctatcaagcggcacaagtggaatgacttcgctgaggattcgcttcgagttatccagcataatgctctagaggatagaagtatctccgacaaacaacagtgggacgccgcaatatattttatggaagaagccctgcaagctcgccttaaagacaccgagaacgccatagaaaacatggtgggccccgattggaagaaacggtggctgtactggaagaatcggacacaagagcagtgcgtgcacaatgaaacaaagaacgaattggagaaaatgcttaagtgtaacgaagagcacccggcatacctggcctcagacgagatcaccacagttcgcaagaaccttgaaagcaggggagtagaggtcgaccccagtctgatcaaagatacctggcaccaggtgtacaggcgtcactttctcaaaactgctcttaaccactgcaacctgtgtcgccgaggcttttattattatcaacgccactttgtcgactctgagctcgagtgtaacgacgtggtcctattttggaggatacagagaatgctggcgataactgctaatacactgcgacaacagctgaccaatacggaagtgcgacgcctggaaaagaatgtaaaggaagtcctggaggattttgccgaagacggagagaagaagatcaagctcctgaccggcaagcgtgtgcaacttgccgaggacctgaagaaagttagggagatccaagaaaagctggacgctttcatcgaggccctgcatcaggaaaaatag

SEQ ID NO: 198162 - DNA, 2994 bp, Artificial Sequence
  Description of Artificial Sequence: Synthetic coding sequence
atgtggcggctgcggcgggccgccgtggcctgcgaggtgtgccagtctctcgtcaaacactcctccggaatcaagggcagtctgcctctgcagaaattgcacctggtcagccggagcatctatcactcccatcatcctactctgaaacttcaacgaccacagctacgcacttcatttcagcagtttagcagtctcaccaaccttcccctccggaaactgaagttcagtcctattaaatacgggtaccaacctcgtcggaacttttggcccgcccgcctggcaacccggcttctgaaactgaggtatctgattcttggttcggcagtgggtgggggttacacagcaaaaaaaactttcgatcagtggaaggacatgattcccgacctgtcggaatataaatggatcgtacccgatatcgtctgggaaatcgacgagtatatcgattttgagaaaattcggaaggcacttccttcatccgaagacttagtcaaattggcccccgactttgataaaattgttgaaagtctgtcattgctgaaggatttctttacgtcaggcagtccagaagagacagcattccgcgctactgatagggggagtgaatcggacaagcattttagaaagggtttgctgggtgagctaattcttctgcagcaacaaatccaggaacacgaggaggaagccagaagagccgcaggccagtactccacaagttacgcccagcaaaagcgcaaagtcagcgataaggaaaagatcgatcagctgcaggaggagctgttacacacccagctgaagtaccagagaattctggagcggctggagaaggaaaacaaggagcttcgaaagctggtcctccaaaaggacgacaaaggaattcaccaccggaaactgaaaaagtctttgatcgacatgtactcagaagtcctggacgttctttctgattatgatgcatcctacaacacacaggaccacctgccacgggtggttgtagttggagaccagtcagccgggaagacctctgtactggagatgatcgctcaagcgcgcatctttcctaggggcagtggagagatgatgacgcggtccccagtgaaggtaacccttagcgagggaccacaccatgtggccctcttcaaagacagctccagggagttcgatctcactaaagaggaggacctggctgccttaaggcacgaaattgagctgcgaatgagaaagaacgtaaaggaaggttgtactgtcagccccgagaccatctcattgaacgtgaaaggacctggattacagagaatggtgctggtggatctccccggagtcattaatacggtaacctctggaatggccccagataccaaggaaaccattttcagcatctctaaggcctatatgcagaacccaaatgccattattctctgtattcaggacggtagcgtagatgcagagcgtagcatcgtgaccgacctcgtctctcagatggacccccacggaaggcggaccattttcgtgctgacgaaggtagatctggccgagaagaatgtagctagtccgagccggatacagcaaatcattgagggtaagttgttccccatgaaggctctggggtattttgcagtggttactggtaaagggaattccagcgagtccattgaggctatccgcgagtatgaagaagagtttttccagaacagtaagctgctcaagacgtccatgctaaaggcccaccaggtgactacacggaacttaagcctggctgtgtccgactgcttctggaaaatggtgcgggaatccgtagaacagcaggctgacagttttaaagcgacacggttcaacctggaaactgagtggaagaacaattatccccgactgcgtgagctcgatcggaacgagctgttcgaaaaggctaagaacgagatacttgatgaggtcattagtctgagccaggtcacccctaagcactgggaggagatcctacagcaatctctgtgggaaagagtatcaacacacgtgattgaaaacatttacctgcctgcggcacagaccatgaattctggaaccttcaacaccacagtggacatcaagttgaaacagtggacagataaacaacttcctaacaaggccgtggaggtagcttgggagacattacaagaagaatttagccggttcatgaccgagccaaagggcaaagaacacgacgacatttttgataagctgaaagaggccgtcaaagaggagagcatcaagagacacaagtggaacgactttgcggaagactcccttcgagtgatccagcacaacgctttagaagatagatccatcagcgataaacagcaatgggatgccgccatctactttatggaggaggccttgcaggcacgcctcaaagacaccgagaacgcaattgaaaatatggtgggcccagattggaaaaaacggtggctatattggaaaaatagaacccaagagcaatgtgtccataatgaaacaaagaacgagttagaaaaaatgttgaagtgcaatgaggaacaccccgcatatctggcctccgacgaaatcacgactgtccgcaagaatctcgagagtcggggcgtggaggttgacccctctctgattaaggacacctggcaccaggtgtatagacgtcatttcttgaaaacggctttaaaccactgcaatttatgtcgcaggggtttctactattatcaacgccactttgtggactctgaacttgagtgtaacgacgtcgttctgttttggcggatccagcgaatgttggcaatcactgccaacacgctgcggcagcagctgactaacactgaggtgagaaggctggagaagaacgttaaagaggttctggaggactttgccgaggacggagagaagaagatcaaactgctaacagggaaacgcgtccagctggctgaggacctgaagaaggtgcgcgaaatccaggaaaagctcgatgcctttattgaggcgcttcaccaggaaaaatag

SEQ ID NO: 198163 - DNA, 501 bp, Artificial Sequence
  Description of Artificial Sequence: Synthetic coding sequence
atgtggcggctgcggcgggccgccgtggcctgcgaggtgtgccagagtttagtgaagcatagttcgggaatcaagggcagcctccccctgcaaaagctccatctcgtgagccgctccatctaccactcgcatcaccctactctcaaactccagaggccccagcttcgcacctcgttccagcagttcagttccctgactaacttgccgctgcgtaagcttaagtttagccctattaagtatgggtatcagcctagacgaaacttctggcctgctcggctggccacccgacttctcaaactgcgctatttgattcttggcagtgcagtgggtgggggctacactgctaagaagacctttgatcagtggaaagatatgatccccgatctctcagagtacaaatggattgtgcctgatatcgtatgggagatagacgagtacattgatttcggctccccggaagagactgccttcagagcaaccgatagggggagtgaaagctag

SEQ ID NO: 198164 - DNA, 2883 bp, Artificial Sequence
  Description of Artificial Sequence: Synthetic coding sequence
atgtggcggctgcggcgggccgccgtggcctgcgaggtgtgccagagtctggtcaaacactcatcaggcattaaggggagtttgcctctgcaaaagttgcatttagtcagccgcagcatataccactctcaccacccaacactaaagttgcagagaccgcagctgcgcactagctttcagcagttcagtagcttgaccaatttaccactccgcaagctgaagttcagcccaatcaaatatggataccaaccccgaagaaacttctggccagccagactagccaccaggcttctcaaactgcgttatcttatcctgggatctgcggtggggggagggtatacagctaagaagaccttcgaccagtggaaggacatgattcctgatctctccgaatacaagtggattgtgccagatatagtttgggagattgatgagtatattgatttcgagaaaatccgcaaagccctcccaagttccgaagacctagtgaaactggcaccagactttgacaagatcgtggagagcctgtctttgctgaaagatttctttacctccgggtcgcctgaggaaaccgccttccgcgcaaccgaccgcggaagcgaatccgataaacacttccgtaaggtgtcagataaggagaagatcgaccaactgcaagaggaactgctgcatacgcagctcaaatatcagcgcatactagagcggctggagaaggagaacaaggaacttcgcaaactggtgctacagaaggatgacaagggcatccatcatcgcaaactgaagaaatcattgattgacatgtatagtgaagtcctggacgtgctgagcgactacgacgcatcctacaatacccaggatcacttgccaagggtggtggtggttggcgatcagagtgccggcaaaacgagtgtgctggagatgatcgcccaggctcgtatctttcctaggggatctggtgaaatgatgacaagaagtcctgtgaaggtcaccctctctgagggcccacaccacgtggccctgtttaaagacagttcaagggagtttgacctgacaaaagaagaagacctcgcggccctgcgccatgagatcgagctgcgcatgaggaagaacgtgaaggagggctgtaccgtgtcccctgaaacgatttccctcaatgtcaagggcccaggactgcaacggatggtgttagtggacctacctggagtgattaacacagttacatccgggatggcccccgacacgaaagagacaatcttttcgatatcaaaggcctacatgcagaacccaaacgccatcatcctgtgcattcaagatggatctgttgatgccgaacgtagtatcgttaccgacttagtgtcccagatggatccccacggacgccggactattttcgtcctaaccaaagtggacctagctgagaaaaatgtggcctcgccgagcagaatccagcagattatcgagggcaagctgttccctatgaaagcactcgggtacttcgccgtggtcacagggaaggggaactccagcgaaagcatagaggcgatccgagagtatgaggaagaatttttccagaattccaagcttttgaagacgtccatgctgaaagcccaccaggttaccacccgaaacctgagcctggcagtatccgattgcttttggaaaatggtgagagaatccgtggaacaacaggccgacagtttcaaggccactcgattcaatctagagaccgaatggaagaataactatcctcgcctgagggaactggatcggaatgaactctttgaaaaggctaagaacgaaatcctcgacgaagtcatcagtctctctcaggtgacgccaaaacactgggaggagattttgcagcaaagtctgtgggagcgggtgtccacccacgtgatcgagaacatctatctccctgcagcgcagactatgaattcaggaacatttaataccacagtggacattaaactgaagcaatggaccgataaacaactgccgaacaaggcggtagaagtggcctgggagactctgcaagaggaattctctcgattcatgaccgaaccaaaggggaaagagcacgacgatattttcgataaacttaaagaagcagtgaaggaagagagcattaagagacataagtggaacgatttcgctgaagatagtcttcgggtaattcagcataatgctctggaagaccggagcatttcagataaacagcagtgggacgccgccatctatttcatggaggaggctcttcaagccaggctgaaagatactgaaaacgctatcgagaatatggtcggacctgattggaagaaacgatggctgtattggaagaaccgtacacaggagcagtgtgtgcacaacgagactaaaaatgagctcgagaagatgttgaaatgcaacgaggaacatcccgcgtacctggcgagcgatgaaattaccacggttcgtaagaacctggaaagtcgtggcgtggaagttgacccttctttaattaaggacacatggcatcaggtgtatagaaggcacttcctgaaaaccgctttaaaccactgtaacctgtgtaggagaggcttttactattatcagaggcatttcgtggactccgagcttgagtgtaacgatgtggtgttgttctggaggatacagcgcatgctggctattacagcaaatacacttaggcaacaactgaccaacacggaagtcagacgtctggaaaagaacgttaaagaggtgctcgaggactttgcagaagatggagagaagaaaattaagctgttgactggtaagcgagtgcagctcgccgaggatctcaaaaaggttcgcgaaatccaagagaagctggacgcattcatcgaagctctgcaccaggaaaagtag

SEQ ID NO: 198165 - DNA, 558 bp, Artificial Sequence
  Description of Artificial Sequence: Synthetic coding sequence
tgatacctgatcctgggcagcgccgtgggcggcggctacaccgccaaaaaaacattcgaccagtggaaggacatgatccctgacctgtcagagtataaatggatcgtcccggatatcgtctgggaaattgatgagtacattgacttcgaaaagataaggaaggctctgccgagttcagaggaccttgtgaagctcgcacccgatttcgataagattgtggaatccctatccctgctcaaggactttttcaccagcgggcataaactggtttccgaagtgattggtgcatcggatctactcttgctccttggcagccctgaggagaccgcgtttcgcgccacggatcgaggctctgaatccgacaaacacttccggaaggtatcagataaagaaaagattgaccaattacaggaggaactcctgcatacgcagctgaaataccaacgaatacttgagagactggaaaaggagaacaaggagctccggaagcttgtgttgcaaaaggatgacaagggtatacatcaccggaagcttaaaaaaagtcttattgatatgtag

SEQ ID NO: 198166 - DNA, 540 bp, Artificial Sequence
  Description of Artificial Sequence: Synthetic coding sequence
atggtggtgggcgccttccccatggccaagctgctgtacctgggcatacgtcaggtgtccaaaccgctcgccaacagaataaaagaagccgcccgcaggtcggaattttttaaaacatatatttgtttaccaccggcacagctctaccactgggttgagatgcggaccaagatgcgcatcatgggttttcggggcacagtcataaaacccctaaacgaggaagccgctgccgaactcggagcagaattgctgggggaggccactatctttatcgtgggcggcgggtgtctagtcctagagtactggagacatcaagcacaacagcggcacaaagaggaagagcagagagcagcttggaacgccctgcgggacgaggtgggccacctagctctggcactggaagcccttcaggctcaggtgcaagcggctccaccacagggagccctggaggaactgagaacagaacttcaagaagtgcgcgctcagctgtgtaaccctggcagaagcgcctctcatgccgtccccgcatccaaaaaatag

SEQ ID NO: 198167 - DNA, 543 bp, Artificial Sequence
  Description of Artificial Sequence: Synthetic coding sequence
atggtggtgggcgccttccccatggccaagctgctgtacctgggcatcaggcaagtctcaaagcccctggcaaatagaattaaagaagctgctcgtcggtcagaattctttaagacgtacatttgcctcccccctgctcagctataccattggcttgagatgcggaccaaaatgcggatcatgggttttaatgccgctgccattaagccacttaatgagggtgcagccgccgaactgggcgcagaactccttggcgaaggtataattttcatcactgcttgctcctgcctaatgctcgaatactggcggcaccagctgcagcagcggaggaaagagaaagagaggcgagtcgcgcgtgaggctctaagaggcgaggtggggcacctgggtttggcattagaggaactgcaggcacaggtccaggccaccagcacacaactcgctctggaggagctccgggcacagctgcaggaagtgcgagctcatctctgcctgcgagatcctccgccagcacctcccgtggcaccggcgtctgagaagtag

SEQ ID NO: 198168 - DNA, 381 bp, Artificial Sequence
  Description of Artificial Sequence: Synthetic coding sequence
atgcggaccaagatgcggatcatgggcttccggggcaccgtgatcaagccgctcaacgaagaagctgccgcagaactgggagccgaactactgggagaggccacgatttttatagtgggcggcgggtgcctggtgctggaatattggcgccatcaggcccaacaaagacacaaggaggaagaacagagggcggcttggaatgccctacgcgatgaggttggccacttagcactggccctcgaggccttgcaggctcaagtccaggctgctcccccccagggcgcactggaggagctgagaacagaactgcaggaagtccgtgcgcagctatgtaatcctggacgatcagctagccatgctgtcccagcaagcaaaaagtag

SEQ ID NO: 198169 - DNA, 1734 bp, Artificial Sequence
  Description of Artificial Sequence: Synthetic coding sequence
atgagccaccagcccctgagctgcctgaccgagaaggaggacagcccatctgaatcgaccggtaatgggcctccgcacttagcccatccaaatctggacacgttcacccctgaggaacttctgcagcaaatgaaggagttacttaccgagaatcaccagctgaaggaggcgatgaaactgaataaccaggctatgaagggcagatttgaagagttgtctgcttggactgaaaagcaaaaggaagagcgacagttctttgaaatacaatctaaggaggccaaggagcggttgatggcattgtcccatgagaatgaaaagctcaaggaagaacttgggaaactgaaaggcaaatccgagcggagctctgaggacccgactgatgatagtcggctgccccgcgcagaagctgaacaagagaaggaccagttacgcacccaggttgtcagactacaggctgagaaggccgacttgctcggaattgtgtctgagcttcagttgaaacttaattcttctggctcttcagaggatagctttgtggaaattagaatggctgagggagaagccgaaggtagtgtgaaagagataaagcactcaccaggacccacccgcaccgtgtctaccggtactgctctgtcgaagtatcgttcaagatcagcagatggggccaagaactacttcgagcacgaagagttgactgtgagccagttactcctctgccttcgcgaaggcaaccagaaggttgagagactcgaggtggccttgaaagaagccaaggaaagggtcagcgactttgagaagaagacttcaaacaggagcgaaattgagactcagactgagggctcgaccgaaaaagagaatgatgaggaaaaagggcccgaaacagtggggtcagaggttgaggcactgaacctgcaggtcaccagcctgttcaaggaactgcaggaagcacatactaaactgagcaaggccgagctaatgaagaagagattgcaggagaaatgtcaggccctggagcggaagaactcagctatcccaagtgaactgaatgagaagcaagaactggtgtacacgaacaagaaactagagctgcaagtcgaatcaatgttgagtgagattaagatggagcaagccaagaccgaggacgagaagtctaagctcaccgttctccagatgacacataataagttgctacaggagcataataacgcattgaaaactattgaggaactgacccgaaaggagagtgaaaaggtggaccgagctgtactgaaggagttatctgagaagctggaactggccgagaaggctctcgcatccaagcagctgcaaatggatgagatgaagcagacaatcgcgaagcaggaagaggatctggaaacaatgactatcctccgagcccagatggaggtctattgcagtgatttccacgccgaacgcgcggcccgcgaaaaaattcacgaggagaaagaacaattggcattgcagttggctgtcctgctcaaagagaacgatgccttcgaggatggtgggcggcaatctctcatggaaatgcagagccgacacggggcaagaacttcagacagcgaccaacaggcctatctcgtgcaaaggggcgcagaggatcgcgactggaggcagcaaagaaatatccctattcattcatgccctaagtgcggagaagtcttgcccgatattgatactttgcagatccacgtcatggactgcatcatttag

SEQ ID NO: 198170 - DNA, 1734 bp, Artificial Sequence
  Description of Artificial Sequence: Synthetic coding sequence
atgagccaccagcccctgagctgcctgaccgagaaggaggacagcccatcagaatccaccggaaacgggcccccacatcttgcccatccaaatctggacactttcactccagaagagcttctgcagcagatgaaggaacttctcactgagaatcaccagttaaaggaggctatgaagctgaacaaccaggccatgaaggggaggttcgaagaactcagtgcatggaccgagaaacagaaggaagaaagacagttttttgaaatacagtctaaagaggccaaagaaaggcttatggcgctttcacacgaaaatgagaaattaaaagaagagttaggaaagctaaaagggaagagtgaacggtccagtgaggatccaaccgacgactcccgcttaccccgcgctgaagccgaacaggaaaaagatcagctaaggacccaagtggttaggttgcaagccgagaaggccgatctactggggatcgtcagtgagctccaattaaagctgaactcttcaggttcatcagaagattcttttgtcgagatccgcatggcagaaggcgaagctgagggaagcgtaaaagaaatcaaacactcccccggccccactagaacagtttccaccggtaccgcactttccaagtatagaagccgaagcgcagatggcgctaagaattactttgagcatgaggagcttaccgtttcacagcttctgctgtgccttagagaaggtaaccagaaggtggagcggttggaggtggccttgaaggaggccaaagaaagggtgtccgacttcgaaaaaaaaacttccaataggtctgagattgaaactcagacggagggttcaaccgagaaagagaatgacgaggagaagggccctgagactgtggggtcagaggttgaagcgctcaaccttcaggtgactagcttattcaaggagttgcaggaggcccacacaaaactgtccaaagctgaactcatgaaaaagcgactgcaggagaagtgtcaagctttggaacgcaagaacagcgctattccatcggagctcaatgagaaacaggaactagtgtataccaataagaagctggagcttcaggtggaatccatgctgtcagagatcaaaatggaacaggccaagaccgaggacgagaaaagtaagctcaccgtattgcagatgacccacaataagctgctgcaggaacacaacaatgcccttaaaacaattgaggagctcacaaggaaggagagcgaaaaggttgaccgtgccgtgctgaaagaactcagtgaaaaactggagctggccgaaaaggcactggcaagcaagcagctgcagatggacgagatgaagcagaccatagctaaacaggaagaagacctggagactatgactattctccgggctcaaatggaagtctactgtagcgatttccatgccgagagagccgcaagggaaaagatacatgaggagaaagaacagctggccctacaacttgccgttcttttgaaagaaaatgatgcattcgaggatgggggtcgccaatcactgatggagatgcagtctaggcatggcgctcgcactagtgactcggatcagcaagcgtatctggtccagcggggcgcagaggacagggactggcgccagcagagaaatattcccattcatagctgcccaaagtgtggagaagtcctgcctgacatcgacaccctgcagattcatgtcatggactgtatcatttag

SEQ ID NO: 198171 - DNA, 1734 bp, Artificial Sequence
  Description of Artificial Sequence: Synthetic coding sequence
atgagccaccagcccctgagctgcctgaccgagaaggaggacagcccatccgaatccactggcaacggccctccccatcttgcccacccaaacttggataccttcacgccagaggagctgctgcagcaaatgaaagagctactgactgaaaatcatcagctgaaagaggcaatgaaattgaacaatcaggctatgaaaggaagattcgaggagctgagtgcctggacagagaaacagaaagaagagaggcagtttttcgagatccagtctaaggaagccaaggagcggctgatggccttatcccacgagaatgagaagcttaaggaagagctgggcaaactgaagggtaagtctgaacgttcttctgaggatccaactgacgactcacgacttcctcgcgcagaggccgaacaagagaaggatcaactgcgtacccaggtggtccgtttacaggccgaaaaagcggatttactagggatcgtgagcgagctccagctgaagctgaatagtagcggcagcagcgaggatagtttcgttgaaattcgaatggcggaaggcgaggcagagggaagcgtcaaggagattaagcattctcccgggccaacccgtacagtgtcaaccggcaccgctttaagcaagtatcggtcccggtctgctgatggggctaagaattacttcgaacacgaagagctaaccgtgagtcaactgttactgtgcctgagagaagggaaccagaaggttgagaggttagaagttgctctgaaggaagctaaagagcgggtttctgatttcgagaaaaagacctccaatagaagcgaaatcgaaacccagaccgaggggtccactgaaaaagaaaacgacgaggaaaaaggacccgagaccgttggttctgaggtggaggccctcaatttacaagtcacctccctattcaaggagctgcaggaggcccacaccaagttgtccaaggctgagctgatgaagaaacggctccaggagaaatgccaggcactcgagcgcaaaaacagtgctatcccaagcgagctgaacgagaagcaagagctggtttacacaaataagaaactggagctccaagtggaatctatgttatccgagatcaaaatggaacaggccaaaactgaagacgaaaagtccaagcttactgtcctgcaaatgacccataataaactgctccaggagcataataacgccctgaagacaatcgaagaactgacacgcaaggagagtgaaaaggtagaccgggcagttttgaaggagctgagtgaaaagctggagttagctgagaaagcattagctagtaaacagttgcagatggatgaaatgaagcagaccattgccaagcaggaggaggacttagaaactatgaccattctgagagcacaaatggaggtgtattgctccgatttccacgcagagcgagccgccagagaaaaaatccacgaggaaaaagaacagttggctttgcaattggctgtattattgaaggagaacgacgcattcgaggacggaggaaggcagtctcttatggagatgcaaagcaggcacggcgctaggaccagcgacagtgatcaacaagcctatctcgtccagcggggtgctgaggacagggattggaggcagcagaggaatattcccattcactcctgccccaaatgcggtgaggtcctccctgacatcgacactctgcagattcatgtgatggattgtataatctag

SEQ ID NO: 198172 - DNA, 1716 bp, Artificial Sequence
  Description of Artificial Sequence: Synthetic coding sequence
atgagccaccagcccctgagctgcctgaccgagaaggaggacagcccatcagaatctaccggcaacggcccaccacatttggcgcatccgaatctggataccttcactcctgaggagctcttgcagcagatgaaagagcttcttaccgaaaatcaccagctgaaagaagcaatgaagcttaataaccaggccatgaagggtcggtttgaggagctgtcggcctggactgagaagcagaaggaagagcgacagttctttgagatccagagtaaggaggcaaaggagcgcctaatggcgcttagccacgagaatgagaagttaaaggaggagctgggcaagctcaaagggaaatccgaacgctctagcgaggatcccactgatgactcacgcctgccccgcgccgaagcagagcaggaaaaagaccagctgcgtacacaggtagtcagactccaggccgaaaaggccgacctgctgggaattgtgtccgagctgcaactgaaactcaatagcagcgggtcctccgaggactctttcgtggagatccgcatggccgagggagaagccgaaggcagtgtcaaggagatcaagcactcccctggacccacacggacagtctctaccggaacctctcgttctgcagacggagcgaagaactattttgagcatgaggaattgacagtttcccagctcctattatgcctgagggaaggaaatcagaaggtcgagcggctggaagtggccctgaaggaagctaaggagcgggttagtgacttcgagaaaaagaccagcaaccgctcagagatcgaaacccaaaccgagggaagcacagagaaagagaatgatgaagagaagggacctgaaactgtgggctctgaggttgaagctctcaaccttcaggtgactagcttgttcaaagaactgcaggaggcacataccaaactgagcaaggccgaactgatgaagaagagactgcaggaaaaatgccaggcgctggaaaggaagaattcagccataccatccgaactgaacgagaaacaggagctggtgtatactaacaagaagctcgagcttcaagtagaaagcatgctgtccgaaataaaaatggagcaggctaagactgaagatgagaagtcgaagctcaccgtgctacagatgacacataacaagctgctacaggagcacaataacgccttgaagaccatagaggagcttacgagaaaggagtccgagaaagtggaccgcgctgtgttgaaggagttatcagaaaagctggagttggcggaaaaggcattagccagcaagcagcttcagatggacgagatgaagcagaccatcgccaaacaggaggaagacctggagactatgaccatcctgagagcacaaatggaggtctactgctctgatttccatgccgagagagcagcacgagagaaaatacacgaggaaaaggagcaacttgccctacaacttgccgttctgctaaaagagaatgacgctttcgaagacggcgggcgacagagcctgatggaaatgcagagtcgccatggtgcgagaacttctgatagtgaccagcaggcgtatttggttcagcggggtgctgaggatagggactggcgccaacaacgcaacatccccattcactcatgccccaagtgtggtgaggtgctgcccgatatcgacacattgcagattcacgtcatggactgtattatctag

SEQ ID NO: 198173 - DNA, 1734 bp, Artificial Sequence
  Description of Artificial Sequence: Synthetic coding sequence
atgagccaccagcccctgagctgcctgaccgagaaggaggacagcccgagcgaatctaccggaaatggaccaccacacctggcacaccccaacctggacactttcacccccgaggagcttctgcagcagatgaaggagcttctgaccgaaaaccatcaactcaaggaggccatgaagctcaacaatcaggcgatgaagggcagatttgaggaattgagcgcttggactgagaagcaaaaggaggaacgtcagtttttcgagatccagtccaaggaagctaaggagcggttgatggctctgtctcatgaaaacgagaaattgaaggaggaattggggaaactcaagggcaagtctgaacgcagcagcgaggatccaaccgacgacagccgcctccctagagcagaggctgagcaagagaaagaccagctgcgaacccaggtggtgcgactgcaagcagagaaggcggacttgctgggaatagtatccgaactgcaacttaagttgaattcctccggttccagtgaagacagctttgtggagatacgaatggcggaaggcgaggcagagggcagcgtgaaagaaataaaacatagccccggtccgacacgcaccgtgagtacaggcacagccctgagtaagtaccgcagcagaagtgcggatggcgcaaaaaactatttcgaacatgaagaactcacagtgtctcagttattgctgtgtctgcgagaaggtaaccagaaggtagagcggctggaggtcgcactgaaagaggccaaggaaagagtgtccgatttcgagaagaaaacttccaacaggagcgagatagagactcaaaccgagggcagtaccgaaaaggagaacgatgaagaaaaggggccggagacggtgggttccgaggtggaggcactgaatctccaggtgactagcctgtttaaggaacttcaagaagcgcacaccaagctgtccaaagcagagctcatgaagaaacggctgcaggaaaagtgccaggccctcgagcgcaagaactcagctatcccttcggagctgaacgagaaacaagaacttgtatacaccaataaaaagctggagttgcaggtcgagagcatgctgagcgagatcaagatggagcaggctaagactgaggacgagaagtcaaaactcaccgtcctgcagatgacccacaataagctacttcaggagcataataacgcgttgaagacgatcgaagagctgacacgaaaggaatcggaaaaggtagaccgggccgttctgaaggagttatcagagaagttggaattagccgagaaggctctcgcatccaaacagctgcagatggatgagatgaaacagacgatcgcaaagcaggaggaggacctggaaaccatgaccattctccgcgctcaaatggaagtctactgtagcgactttcatgccgaacgcgcggccagagagaagatccatgaggagaaggagcaactcgctctccagctggcggttctgctgaaggaaaatgacgccttcgaagacggcggcagacaatcactgatggaaatgcaatcccgccacggcgcacggaccagcgattctgaccaacaggcctatctggtgcagaggggtgccgaagatagagattggcggcagcagaggaatatccctatccatagctgcccaaagtgtggggaggtactgccggatattgacacactgcagatacatgtcatggattgtattatatag

SEQ ID NO: 198174 - DNA, 1716 bp, Artificial Sequence
  Description of Artificial Sequence: Synthetic coding sequence
atgagccaccagcccctgagctgcctgaccgagaaggaggacagcccaagtgagtctaccgggaatggccccccccacctagcacatccaaacctcgacacctttacaccagaggagcttctgcagcagatgaaggaacttctcactgagaaccaccaactaaaagaggcgatgaagctgaacaaccaggcaatgaaagggcggtttgaggaactgtcggcttggacagagaaacagaaggaggaaaggcagttctttgagatccagtctaaagaagctaaggagagattgatggccctttctcatgagaacgagaagctgaaggaggagctgggcaagttgaagggcaaatccgaaaggtcaagtgaagatcctacagatgactcaaggctcccgagagctgaggccgaacaagagaaggatcagttgaggacccaagttgtgcggctgcaggcagagaaggctgacctgcttggcatcgtctctgagctccagttgaagctaaactcaagcggtagcagtgaagattcttttgtcgagatccggatggctgagggcgaggctgaaggcagcgtaaaggaaatcaagcactctccaggtcccacccggactgtgagtactggtactagccgaagtgctgatggcgccaagaattacttcgagcatgaggagctgactgtgtcccaacttttgctgtgcttaagggagggtaatcagaaggtggagcgattagaagtagcccttaaagaggccaaggagcgtgtttccgattttgagaagaagacctcaaacagaagcgaaatagaaacccagaccgagggctctaccgagaaagagaatgatgaggaaaaggggccagagacggtcggtagcgaagtcgaggcactcaacctgcaggtaacatcactatttaaagaactgcaggaagctcacaccaagctctccaaggcagaactcatgaaaaaaaggctgcaggaaaagtgtcaggcccttgaacggaaaaattcagccatccccagcgaactgaacgagaaacaggaattagtctacactaataaaaaactcgaactccaggttgaaagcatgttgtcagagattaaaatggagcaggcaaaaacagaggatgaaaagtccaaattaaccgtactccagatgacacataataaactgctgcaggaacacaacaatgccctcaagactatagaagaactgacgcgtaaggaaagcgaaaaagtcgaccgagccgtattaaaggaattgagcgagaagctggaactggccgaaaaagcattagcctccaagcaactccagatggacgaaatgaaacagacgatcgccaaacaggaggaggatcttgagacgatgacaatcttacgggcccagatggaggtgtattgcagtgattttcacgctgagcgtgcagcaagagaaaagatccacgaagaaaaggaacagttggcactgcagttagcagtactcctgaaggaaaatgacgcattcgaagatgggggaaggcaatcattgatggagatgcagagcagacatggcgctcgcaccagcgactctgatcaacaagcttacttggtgcagcggggtgcggaggatagggattggcggcagcagaggaacattcccattcacagctgccctaagtgcggggaagtcctgcctgatatagataccctgcaaatccacgtcatggactgcataatatag

SEQ ID NO: 198175 - DNA, 381 bp, Artificial Sequence
  Description of Artificial Sequence: Synthetic coding sequence
tgaggcgaggccgagggcagcgtgaaggagatcaagcacagccccggtcccactcgcaccgtgtctacaggtaccgcgctgagcaagtacagaagcaggtcggcggacggtgctaagaactactttgaacacgaagagttgacggtttcacaactcctcttatgcctccgcgagggtaaccagaaggtcgagcgcctagaggttgctctgaaggaggccaaggaacgagtgtcagactttgaaaagaagactagcaacagaagtgaaattgagacccagactgaaggtagcacagagaaggaaaacgacgaggaaaaaggccccgagaccaccggcttccatcacgttggtcaggatggcttggacctcttaacttcctag

SEQ ID NO: 198176 - DNA, 444 bp, Artificial Sequence
  Description of Artificial Sequence: Synthetic coding sequence
atgaagctgaacaaccaggccatgaagggccggttcgaggagctgtccgcttggacggaaaagcagaaggaggagaggcagttctttgaaatacagagcaaggaagcgaaagaacgtttaatggctctcagccatgaaaatgagaaactcaaggaggaattggggaaactaaagggaaagagtgagcggagcagcgaggaccccacagatgactctcggctgcccagagctgaggccgagcaggaaaaggaccaattacggactcaggtggtaaggctccaggcagaaaaggcggatctgctgggtattgtgagcgagttgcagctgaaactcaactcctccggcagctctgaggattctttcgtcgagatccggatggctgagggtgaagctgaaggatcagtcaaggagatcaaacattcccctggacctacccggacatag

SEQ ID NO: 198177 - DNA, 912 bp, Artificial Sequence
  Description of Artificial Sequence: Synthetic coding sequence
atgcaccccgagcccgcccccccccccagccggagcagccccgagctccccccatctggcggctctacaacttcggggagtcgacggtctcggcggagatcaggtgacggcgagcctcccggggctcctccccccccaccgccaccaagcgcggtgacttaccctgactggattggccagtcatactccgaggtgatgagcctcaacgaacactccatgcaagcgcttagttggcgcaagctctacctgtccagggccaagctgaaggcctcttcccggaccagtgctctgctgtctggttttgccatggtggcgatggtggaagtgcagctcgacgcagaccatgattatcctccaggccttttgatcgcgtttagcgcatgcacaactgtcctggtggccgtgcacctttttgccctgatgatctctacgtgtatactgcctaatatcgaggcagtgtccaacgtacataacttgaatagcgtgaaggagtcccctcatgagaggatgcatagacacatcgagctggcttgggccttctcaactgtgataggtaccctgctcttcctagccgaggtggttctcctctgttgggtcaaatttctgcctctgaagaagcagcctggacagccaagacccacatctaagcctcccgctagtggcgctgcagcgaatgtttccacctcagggatcacaccaggccaagccgctgcaatagcctccactaccattatggtgccattcggtcttatcttcatagtgttcgctgtccacttctaccggtccctggtttcacacaaaacggaccgacagttccaggagttgaatgagctggccgaatttgccagattgcaggaccagctggatcataggggggaccacccactgacgccaggaagccattacgcttag

SEQ ID NO: 198178 - DNA, 765 bp, Artificial Sequence
  Description of Artificial Sequence: Synthetic coding sequence
atgagcgccgagctgaacgtgcccatcgaccccagcgcccccgcctgcccggaaccaggtcataaaggcatggattatcgtgattgggtgagacgaagctacctggaactggtgacctctaatcaccactccgttcaagccctgagttggcgcaagctttacctatcaagggcaaagctgaaggcttcgtctcgaacgtcagccttgctatctgggttcgccatggtggctatggttgaagtacagttggaaacacagtaccagtatcctcgcccattgctgattgccttcagtgcatgcaccacggtgctggtggccgtgcacttgtttgccttgttaatttcaacctgcattctgccaaatgtggaggccgtttctaatatacacaacctcaatagcatatctgaaagcccccacgaaagaatgcacccttatatcgaactcgcgtgggggttttcaacagtcctgggcattctgctgtttctcgccgaggtagtgttgctctgttggatcaagttcctgccagtcgacgcgagaagacagccaggtcctccacccggacccggctctcacacgggttggcaggctgctctggtgagcaccatcattatggtgcccgtagggctgatcttcgtggtgttcaccattcacttctatcgtagcttggtgcgccataagaccgaaagacataatagagaaatcgaagagctgcacaaactaaaggtgcagcttgacgggcacgaaaggagcctgcaggtcttgtag

SEQ ID NO: 198179 - DNA, 765 bp, Artificial Sequence
  Description of Artificial Sequence: Synthetic coding sequence
atgagcgccgagctgaacgtgcccatcgaccccagcgcccccgcctgtcctgaaccggggcataaaggcatggactatagagattgggtgcgtcgctcgtacctggaactagtgacttctaaccaccactccgtgcaggcactgagctggaggaagctgtacttaagccgggctaaattgaaggccagtagccgaacttctgccttgctcagcgggttcgccatggtcgccatggtggaggtgcaattagagacgcagtaccagtatccgcgtcctctgcttatcgcattcagtgcatgcactaccgtactcgttgctgtgcacttgtttgctctgttgatcagcacttgtatcctgccgaatgtggaggctgtgtctaatatccataatctgaattccatcagcgagtccccccatgaaagaatgcatccctacatcgagctcgcatggggcttttctacggtattggggatcctgctctttttggcagaagtagttctgctttgctggatcaaattcttgcccgtggatgccaggcgccagcccggacctcccccaggacccgggagccacaccggatggcaggcagcgttagtctccacgattattatggttcccgtagggctgatcttcgttgtttttactatacacttttatagatctctggttcgacacaaaacagagcgacacaaccgcgaaattgaggaattgcataaactgaaagtccagctggacggacacgagaggtccctgcaggtactttag

SEQ ID NO: 198180 - DNA, 639 bp, Artificial Sequence
  Description of Artificial Sequence: Synthetic coding sequence
atgagcgccgagctgaacgtgcccatcgaccccagcgcccccgcctgtccagagcccggccacaaaggaatggactacagagattgggtccgaagaagctatctcgagctggttacgtctaatcaccactccgttcaggccctgagctggcggaagctgtacttgtctcgagcaaagcttaaggcgagcagcaggacaagcgccctactctccggatttgccatggtggccatggtggaagtacagcttgagacccagtaccagtatccaagaccgctcctgatcgctttctctgcctgtacaacggtgctggtagcagtccacctttttgccctcctgatcagtacctgcatcttaccgaacgtcgaggcagtctccaacatacacaacctgaattccatcagtgaatcaccccatgaaagaatgcatccatacatcgagctggcatgggggttcagcactgtcctgggaatcctgctgttcctggccgaggtcgtgctgctgtgttggatcaagtttctgccagtggacgcccggcggcaaccgggtccaccgccaggaccaggcagccacaccggatggcaagccgctctggtgtcaaccattataatggttcccgtaggactgatctttgtctag

SEQ ID NO: 198181 - DNA, 765 bp, Artificial Sequence
  Description of Artificial Sequence: Synthetic coding sequence
atgagcgccgagctgaacgtgcccatcgaccccagcgcccccgcctgtccagagccaggccataaaggtatggactaccgggattgggtgagacggtcttacctggagctcgtgacgtctaaccaccacagcgtgcaggctttgtcatggcggaagctctatcttagtcgcgccaagctgaaagcttcttcgcggacgtctgcgctgctgagtggcttcgcaatggttgctatggttgaggtgcagttagagacccagtaccagtatcccagaccgcttctcattgccttttcggcctgtacgaccgtactcgtggctgtgcaccttttcgctctcctcatctcaacctgtatactacccaatgtggaagccgtgtcaaatatccacaacctgaactctatctcagaatcgccccatgagcggatgcatccatatatagagctcgcgtgggggttctcaaccgttctcggaatattgctatttctcgcagaagtggtgctcctttgttggattaagttcctgccggtcgatgcccgccgacagcctggaccacccccaggccccggctcacataccggatggcaggcagcgttggtttccacgataattatggtgcctgtcggcctgattttcgttgtctttaccattcatttctatcggtctctggtcaggcacaaaacagagcggcacaacagagagatcgaggaattacacaaactcaaagtccagcttgacgggcatgagagatcactgcaggtgctgtag

SEQ ID NO: 198182 - DNA, 765 bp, Artificial Sequence
  Description of Artificial Sequence: Synthetic coding sequence
atgagcgccgagctgaacgtgcccatcgaccccagcgcccccgcctgcccagagcccggacacaaaggtatggactacagggattgggttcgcagaagttaccttgagctggtaaccagtaaccaccactccgtgcaggcactttcttggcgcaaactctacctgtccagagctaaactcaaggcctcatctcgtacttctgccctgctgagtggttttgcgatggtggcaatggtggaggtgcagctagagactcagtatcagtatccgcgccctctgctcatcgccttcagcgcctgcactacagtacttgtggctgtgcacctgtttgctttactaatctccacatgtatcctgcccaacgtggaggccgtgtcaaatattcacaaccttaattctatttcagaatctccgcacgaacgcatgcatccatacatagagctggcatggggtttcagtacagtgcttggcatcctgttgttcctggccgaggtcgtgttattatgctggatcaagtttcttccagttgatgcccggcgtcaaccaggacccccccctgggccaggcagtcacacaggttggcaggctgccctggtttctaccatcatcatggtgccagttggtctgattttcgtggttttcaccatccatttttatcgatcactagtgaggcacaagactgaaagacataatagggaaatagaggagctgcacaaattgaaagtccaattggacggtcatgaacgatcactgcaggttctctag

SEQ ID NO: 198183 - DNA, 93 bp, Artificial Sequence
  Description of Artificial Sequence: Synthetic coding sequence
atgagcgccgagctgaacgtgcccatcgaccccagcgcccccgcctgccctgaaccaggtcacaagggtatggattacagggactgggtgtag

SEQ ID NO: 198184 - DNA, 690 bp, Artificial Sequence
  Description of Artificial Sequence: Synthetic coding sequence
atgagcgccgagctgaacgtgcccatcgaccccagcgcccccgcctgtcctgaacccggacataagggcatggactatagagattgggttaggcgttcatatctggagttggttacaagtaaccatcacagcgttcaggctctgtcttggcgtaagttgtatctgtccagggcaaagctgaaggcctccagccgcacttccgcactgttatcggggttcgcaatggtagccatggtggaagtgcagttggaaacgcagtatcaatatcctagaccgctcttgattgccttctctgcctgcaccacagttttagtagctgtccatctgttcgctctactaatttctacttgtatccttcccaacgttgaagccgtttcaaatattcataacctcaatagtatctctgagtcacctcatgaacgtatgcatccatacatagagctggcatggggttttagcacagtgcttggaattctgctgttcctggccgaggttgtcttgctctgttggattaaatttctgcccgtggatgccagacgtcagcctggaccgcccccaggtccaggcagccatacaggctggcaggcagcattggtttccacaatcatcatggtgccagtgggcttaattttcgtggtcttcacaattcacttttatcgaagtctcgtgcggcacaaaaccgagcgatag

SEQ ID NO: 198185 - DNA, 294 bp, Artificial Sequence
  Description of Artificial Sequence: Synthetic coding sequence
atgagcgccgagctgaacgtgcccatcgaccccagcgcccccgcctgtcccgagccaggccacaagggcatggattaccgggattgggtccgacggtcttacctggagctagtcactagcaaccaccactcggttcaggcgttaagctggagaaagttgtatctcagtagggccaaactgaaagccagttctagaacatccgctttactgagtgggtttgccatggtggccatggtggaggtgcagctggagacgcagtaccagtacccccgcccactgttgatagcgttctag

SEQ ID NO: 198186 - DNA, 888 bp, Artificial Sequence
  Description of Artificial Sequence: Synthetic coding sequence
atgaagggcggcgagggcgacgccggcgagcaggcccccctgaaccctgagggcgaatcccctgccggcagtgccacatatagagagtttgtgcatcgggggtacctggatctcatgggagccagccagcacagcttaagagcactgtcatggaggcgtctctacctgtctcgggctaagctgaaagcgtcttcacggacctccgctttattgagcggctttgcaatggttgctatggtggaggttcaacttgagtcggatcatgaataccctccaggcctactggttgctttcagcgcctgcaccaccgtgctggtggctgtccatctctttgccttgatggtctccacctgcctgctgccgcacatcgaggccgtgagcaacattcataatctcaactcagtccaccagtctccgcaccaaagactgcaccgttacgtggagctggcatggggtttcagcaccgcattgggcaccttccttttcctggctgaggtggtgctggttggttgggtgaaatttgtgccaatcggggccccgctggatacccctacaccaatggtgcctacttcccgtgttcccggcaccctggcccctgtggcgactagcttgagtccagctagcaacctgccacgcagctcggcctccgccgcgccctcgcaggccgagcccgcatgccccccaagacaggcctgtgggggaggaggggctcacggtcccggatggcaggcagcaatggccagcaccgctattatggtccccgtgggattggtattcgtcgcctttgctcttcatttctatagatctctggtcgcccataagactgatcgctacaaacaggagctagaagagctgaaccgcctgcagggcgagttgcaagcagtttag

SEQ ID NO: 198187 - DNA, 822 bp, Artificial Sequence
  Description of Artificial Sequence: Synthetic coding sequence
atgaagggcggcgagggcgacgccggcgagcaggcccccctgaaccccgaaggggagagtcccgccggcagcgccacttatcgagagtttgtgcacaggggttacctggacctgatgggcgccagccagcactccctcagggcactcagttggcggagactatacctctctagagccaaactcaaggccagtagccgcacttctgccctcttatcagggtttgccatggtcgccatggtggaggtgcagcttgaatctgaccatgagtaccctcctggattactggtggccttttccgcatgcaccacagtgttggtcgcagtccacctgttcgctctgatggtgagcacatgtctacttccacacatcgaagctgtatccaatattcataacctgaattcagtgcaccagtcgccacaccagcgcctgcatcggtacgtggaactggcctggggatttagcaccgcactggggaccttcttgttcctcgccgaggtagtgcttgtcggatgggtgaagtttgtacctataggcgctccactggacactcccacaccgatggtcccgacctctagagttcccggcactctggcacccgtggcaaccagcctgtccccagcttctaacttgcctaggtcgtccgccagcgctgctcccagccaggcggagccggcttgcccacctcgtcaagcctgtggcgggggtggcgcccatgggcctggctggcaggctgctatggcctcaacattcccaggtatttttccaatctccctcagcctaggcttctgtaagctgctctgcacgtgggccgggctgtcctag

SEQ ID NO: 198188 - DNA, 414 bp, Artificial Sequence
  Description of Artificial Sequence: Synthetic coding sequence
atggccggcagccaggacatcttcgacgccatcgtgatggccgacgagagattccacggcgaaggctaccgcgaagggtacgaagaaggaagttccctgggtgttatggagggtcgacaacacggtaccctgcacggggctaaaatcggaagcgagatcggctgttaccagggatttgcttttgcttggaagtgcctcctccacagctgcacaaccgagaaagattcaagaaagatgaaggtgttggagagcctgattggaatgatccaaaagtttccttacgatgatcccacatatgacaagctgcacgaagacctagacaagatccgtggcaaatttaagcagttctgtagcctgctgaatgtacagcctgactttaagatctccgctgagggttcagggctgtctttctag

SEQ ID NO: 198189 - DNA, 666 bp, Artificial Sequence
  Description of Artificial Sequence: Synthetic coding sequence
atggccggcagccaggacatcttcgacgccatcgtgatggccgacgagcggtttcacggtgaggggtaccgggaagggtacgaggaagggagcagcttgggggttatggagggcagacagcatggtactctccacggagcgaagatcggatctgaaataggttgctaccagggatttgcattcgcctggaaatgcctgttacactcctgtactacagagaaagattcgagaaaaatgaaggtgctcgagagcctgatcggtatgatccagaagttcccctacgatgatccgacgtacgacaaactgcacgaagacctggacaaaattcgtggaaagtttaagcagacaggcctgtcaccctccgctgtaatggtgcgccctcccagctatgttgagctgccagttacttgctggtgttgggaggcaccacgatgtaatcagaagtgtacagaccctgcagcccggagacctgatccccagacctgcgcttctcaggaccgcctgcgatgcgcaccttgtacctgtcatcaaccactagcgtccaggtatacccagcatcccggcctggttcctctccctcatcatgaccggcagtccgtaccacaggggcccagagtagtgcagacagatgctgcagcccggatggtggagcaacagacaatgtag

SEQ ID NO: 198190 - DNA, 414 bp, Artificial Sequence
  Description of Artificial Sequence: Synthetic coding sequence
atggccggcagccaggacatcttcgacgccatcgtgatggccgacgagcgcttccacggcgagggctaccgagaagggtacgaggaaggctcgtctctcggggtcatggagggccgccagcatggaacgttacatggggccaaaataggttccgaaatcggctgttatcagggttttgcctttgcctggaaatgtctcctgcactcatgtacgacagagaaggacagtcggaaaatgaaagttcttgaatctcttatcggcatgattcagaagtttccatatgacgatcccacttacgataaactccacgaggatctcgataagattagaggaaagtttaaacagttctgctccttgctaaatgtgcagccagattttaaaataagtgccgaaggaagcggactgtccttttag

SEQ ID NO: 198191 - DNA, 237 bp, Artificial Sequence
  Description of Artificial Sequence: Synthetic coding sequence
atggccggcagccaggacatcttcgacgccatcgtgatggccgacgaaagcagaaagatgaaggtcctagagtccctaattgggatgattcagaagtttccctacgacgaccctacatacgataagctccacgaggacctcgacaagattagaggaaaattcaaacagttctgcagcctgctcaacgttcaaccggactttaaaatcagtgccgaagggtctggattatcattttag

SEQ ID NO: 198192 - DNA, 3039 bp, Artificial Sequence
  Description of Artificial Sequence: Synthetic coding sequence
atgatggcccagagcaacatgttcaccgtggccgacgtgctgagccaggatgagcttaggaagaagttataccagacattcaaagataggggcatcctcgatactttgaaaacacaactgcggaatcaactgatccatgagcttatgcaccccgtgctcagcggcgaactgcaaccgaggagtatttcggttgagggctccagccttctaattggtgcctccaacagtctagtggctgatcacctgcagcgatgtgggtacgaatattccctgtctgtgttttttcccgaaagcggactggcgaaggagaaagttttcactatgcaagacctcctccaactgattaaaatcaatcctacatcctccctctacaaaagcctggtgtctggatctgacaaagagaatcagaaaggcttcctgatgcattttttgaaagaactggctgagtaccatcaagcgaaggagagctgtaacatggagacccagacctcaagcacgtttaatcgggatagtctcgctgagaaacttcagctgatcgacgaccagtttgcggatgcatatcctcagcggatcaaattcgagagcttagagatcaagctcaacgagtacaagcgggagatcgaagagcagttacgggccgagatgtgccagaagctcaagttctttaaggacacggaaatcgctaaaatcaaaatggaggccaagaagaagtacgagaaagagctgaccatgttccaaaatgacttcgagaaggcctgtcaggcaaagtccgaagctcttgttctgagagagaaatctaccttagagaggattcataaacaccaagagatagagactaaagagatctacgctcagaggcaactcttgcttaaggacatggatctgcttaggggccgtgaggccgaactcaaacaaagggttgaagccttcgagcttaatcagaagctgcaagaagaaaagcacaaaagcatcactgaagccctgcgccgccaggagcagaatatcaagtcctttgaagaaacatatgatagaaagctgaagaatgagctgctgaagtaccagttggagctcaaggacgactacatcatacgaacaaatcgccttatcgaggacgaacggaaaaacaaggaaaaagcggtgcacttacaagaagagctcatagcaatcaacagcaagaaagaagaactgaaccagagcgtcaaccgggttaaggaactggaactcgaactcgagtccgtgaaggcccagtctctggccatcaccaaacagaaccatatgttgaacgagaaagtgaaggagatgtccgactattctctgttaaaggaggagaagctggaattgctggctcaaaataagctgcttaagcaacagctggaagagagccggaacgagaacctgcggctactgaataggctcgcccaacccgcacccgagctcgcagtattccagaaggaactacgcaaggctgagaaggcaattgttgtggagcatgaggagtttgagagttgtcggcaagctctgcataaacaactgcaagatgagattgaacactcggcacaactcaaagcccaaatactgggctataaagcctccgtgaaaagcctgaccacccaggtggctgatctgaaattgcagctcaaacagacacagacggcactggagaacgaggtttattgcaatcccaagcagagcgtgattgaccggagtgttaacggactcatcaacgggaacgtcgtaccatgtaatggtgaaatcagcggcgacttcctcaacaatcccttcaaacaggagaacgttctcgcacggatggtggcctcccgtatcactaactaccctactgcctgggttgaaggttcatcccccgatagtgacctcgaatttgttgctaacaccaaagccagagtcaaagaattacaacaagaagccgagcgactggagaaggccttcagatcctatcatagacgcgtgattaagaattctgccaagtcaccactcgcggctaagagccctccttctctgcatctgctagaagctttcaagaatattacatcctcttcacccgaaagacacatcttcggggaggaccgagtggtgagcgaacagccacaagtgggcactctggaggagcgaaatgatgttgtcgaggcgctaacgggttctgccgctagtaggttacgcgggggtacaagctcacggagattatcaagcacgcccctacccaaagcaaagcgcagtctggagtccgaaatgtatctggaggggcttgggaggtcacacatcgcatcaccctcaccatgcccagaccgcatgccactgccaagcccaacagagagtaggcacagcttgagtatacccccggtctcctcgccccccgaacagaaggtaggactctacaggaggcagaccgagctccaggataaatcagaattttccgatgtggacaagctcgcgtttaaagataacgaagagttcgaatcatcatttgagagtgccgggaatatgcctaggcagttggagatggggggcctctctcctgcgggcgacatgtcacacgtggatgccgcagcagcagctgtccctctgtcctaccagcacccctctgtagatcaaaagcagatagaggagcagaaggaggaagaaaaaataagggaacagcaggtgaaggagcggcgacagcgggaggagcgccggcaatcaaatcttcaggaggtgctggagcgagaaagaagagagctcgaaaagctctatcaagaacgcaagatgatcgaagagtcactcaagatcaagattaaaaaggaactcgagatggagaacgagcttgagatgagcaaccaggaaatcaaggacaagtccgcccattccgagaatcccttggaaaaatacatgaagattatccagcaggaacaggaccaagagtccgcggacaaatcaagcaaaaagatggtgcaggagggatcgttggtggacaccttacagagctcagacaaagtggagtccctcactggcttttcacatgaggaacttgacgactcttggtag

SEQ ID NO: 198193 - DNA, 2919 bp, Artificial Sequence
  Description of Artificial Sequence: Synthetic coding sequence
atgatggcccagagcaacatgttcaccgtggccgacgtgctgagccaggatgagctgaggaagaaactgtatcagacttttaaagatcggggcatcctggacacattgaaaactcagttgcgcaatcaactgatccatgagctgatgcatcccgtgctgagcggcgaactccaaccccgaagcatcagtgtggaggggtcttccctgttaattggggcctcaaattctctggtggccgaccaccttcagaggtgcggctacgagtacagcctgtcagtcttttttccagagagtggattggccaaggaaaaggtcttcacaatgcaggatctccttcaattgatcaaaatcaatcccacctcctcactttataaaagtctggtcagtgggtctgacaaagagaaccagaagggattcctgatgcatttcctcaaagagttggcagagtatcaccaggccaaggaatcatgtaatatggagacgcagacctcatcaactttcaatcgggattcgctggctgagaagctgcagcttatcgacgatcaattcgccgacgcctaccctcaacgaatcaagtttgagtccttagaaatcaagctcaatgaatataaaagagagatagaagaacagttgcgcgcagaaatgtgtcagaaactgaaatttttcaaggacacagaaatcgccaaaataaaaatggaagcaaaaaaaaaatatgaaaaggagttgacaatgtttcaaaatgacttcgaaaaagcatgccaagcgaagtccgaggccttagtgttgagggagaaatcaacactggaaagaatccacaaacatcaagagattgagaccaaggaaatttatgcccagaggcagctactactgaaggatatggacctgctgcgaggaagagaggccgaactcaagcagcgggtggaggcttttgaactttaccaactcgagcttaaagatgattacattattcggaccaatcgcctgatagaggatgaacgcaagaataaggaaaaagccgtccatctccaggaggagttgatcgcaataaatagcaagaaggaggagctgaaccaatccgtgaatagagtaaaagaactggaactggagctcgaaagtgtgaaggctcagtcgctcgccatcactaagcaaaaccatatgctaaatgagaaggtgaaggaaatgtccgactatagtctgctcaaagaagaaaaacttgaattactggcgcaaaataaactcctaaagcagcaattggaggagagcagaaatgagaatctgaggttgctaaataggctggcccagccggcacccgaacttgccgtcttccagaaggagctaagaaaggcagagaaagccatcgtggtggagcacgaggaattcgaaagttgccggcaggcactgcacaagcagctacaggatgagatcgagcacagcgcccagttaaaagctcaaattcttggatataaagcatccgtcaaaagtctcaccacacaagttgcggacctaaagctacagctgaagcagacacagacagctctggagaatgaggtgtactgcaacccaaagcagagcgtgatcgatcggagtgtgaacggccttattaatggaaacgtagtgccatgtaatggtgagatctccggtgatttcctgaataatccctttaagcaggagaacgtgctggctcgaatggttgcgagcaggattactaattatcctacagcctgggttgagggatcctccccagactcagatctggaatttgttgcaaataccaaagcccgtgtgaaagagctgcagcaggaagcagaaagactcgaaaaagcgtttagatcctaccaccgcagggtgataaaaaattctgccaagtccccccttgctgcgaaatctcctccctccctgcacctcctagaggcatttaaaaacatcactagctcgtcacccgaacgacacattttcggagaggatcgggtggtgtccgagcaaccgcaggtgggcaccctggaggagagaaacgacgtagtcgaggcactgactggctcggctgcctcaaggctcaggggtgggacttcatcaagacggttaagctccacaccgctaccaaaggctaagagatcattagaatccgagatgtatctggaggggctcggacgttcgcatatagctagcccaagcccctgcccagatcgtatgcctctgccatctcccactgagagccgccactcactctcgatcccaccagtcagcagccccccagaacagaaggtcggtctctaccgaaggcagacggaactgcaggataaatcggagttcagtgatgtcgataaattagcttttaaagacaatgaagaatttgaatcctctttcgagtccgccggcaatatgcccagacaacttgagatgggcggtctgtctcctgcaggtgatatgagccacgtcgatgccgccgctgccgctgtgcccctctcttatcagcacccttctgtcgatcaaaagcaaatcgaggagcagaaggaggaagaaaaaatccgagaacagcaggtcaaggagagacgacagcgagaagaacggcgccagagcaatctgcaggaggtgttggagcgggagcgccgagaactcgaaaaactgtaccaggagcgaaagatgatagaagaatcattaaaaattaagattaagaaggagctcgagatggagaacgagctcgagatgtccaaccaggaaataaaagataaaagcgcccacagcgagaatccacttgaaaagtatatgaaaattattcaacaggaacaggatcaggagtctgctgataagagcagcaaaaaaatggtccaagaaggaagcctggtggacacactgcagtctagtgacaaagtggagtcacttactgggttctcacacgaggagctcgatgatagctggtag

SEQ ID NO: 198194 - DNA, 2619 bp, Artificial Sequence
  Description of Artificial Sequence: Synthetic coding sequence
atgcacttcctgaaggagctggccgagtaccaccaggccaaggagagttgtaatatggaaactcagactagcagtactttcaacagggatagcttggcagagaaactacagctaatagacgatcaatttgcagatgcctacccccaacgcattaaattcgagtccctagagattaaattaaatgaatataaacgtgagatcgaggagcaactgcgcgccgagatgtgtcagaaactgaagttctttaaagatacggaaatagcaaagatcaagatggaggctaaaaagaaatatgagaaagaactgaccatgtttcagaatgattttgagaaggcctgccaggctaaatccgaagcccttgtgttgagagagaagtctactttggagcgtatccataagcatcaggagatcgagaccaaagaaatatatgcacaacgtcaattactgcttaaagatatggatttactgagggggagagaagctgagctcaaacaacgggtggaggcattcgagctcaatcagaagttgcaggaagagaagcataagagtattaccgaagctctgcgtcggcaagaacagaatatcaaatcattcgaagagacatacgatcggaagctcaagaatgaactgctgaaataccagttggaactcaaagacgactacatcattcgcactaacagacttatcgaggatgagaggaaaaataaagaaaaggccgtgcatctccaggaagagcttatcgcgattaattccaagaaggaggaactcaatcagtccgtgaaccgcgtcaaagagcttgagcttgagctcgagagcgtgaaggcgcagtcgctggctatcaccaaacagaatcatatgctcaatgagaaagtcaaggagatgtctgattattccctgctcaaggaggaaaaattggagctgctggcccaaaacaagttgctgaagcaacaactggaggaaagcagaaacgaaaacctacgcctgctgaataggctggcacagcctgctcccgaactggcggtgtttcagaaggagctgagaaaggccgagaaagcaatagtagtagagcacgaggagttcgaatcatgtaggcaagcgttgcacaaacaacttcaagacgagattgagcattctgcacaattaaaggcccagatactgggatacaaggcgagtgtgaagtcacttaccacacaagtggccgacctaaagctccagctgaagcaaacccaaaccgccctggaaaatgaggtctactgtaacccaaagcaatcagtgatcgaccggtcagtgaacggcctgatcaacggcaatgtggtcccttgcaatggggaaatctctggcgatttcctcaataacccctttaaacaggagaacgtgctggctaggatggttgccagccggatcaccaattatccaactgcctgggtagaggggagcagccccgactcagacttggaatttgttgcgaatactaaggcccgtgtaaaagagttgcaacaggaggcggaacggctcgagaaggcgttcagaagttaccacaggcgtgtgattaagaattctgcaaagtccccccttgctgcgaagtcacctccgtctctccatctcctggaggcttttaagaacatcacaagttccagcccagaacggcacattttcggtgaggacagagtggtgagcgagcagcctcaggtagggactctggaggaacgaaatgatgtggtggaggccttgaccggctcggccgccagcaggttgcgcggggggacctcttctcgacgcctgagctccactccactgcctaaagccaagcggtctctggagagcgagatgtacttagaagggctcggccgatctcacatcgcctccccttctccatgcccggataggatgccccttccttctccgactgaatcccggcatagtctatctataccccctgtttcttccccgcctgagcaaaaggtcggtctgtatagacgacaaactgagttgcaggacaagtccgaattcagcgacgtcgacaaactggccttcaaagacaacgaggaattcgaaagttccttcgagtccgcaggcaatatgcctcgacagctagagatgggcgggctgagcccggctggtgatatgagtcacgtcgacgctgcggcagctgcagttcccctgagctatcaacatccctctgtcgatcagaagcagattgaggagcagaaggaagaagaaaagattagggaacagcaagtgaaagaacgcaggcagagagaggaacggaggcagtcaaacctccaggaagttctcgagagagaacgccgcgaactcgagaaactctatcaagaaaggaaaatgattgaagagtccttaaaaattaagatcaagaaggagctggaaatggaaaacgagctggagatgagtaaccaagaaatcaaagacaaatcagcacattccgaaaatcctcttgaaaagtatatgaagataatccagcaggagcaagaccaggagagtgccgacaagagtagtaaaaagatggtgcaggaagggtcactcgtggataccctgcaatcttccgataaggtagaatccttaactgggttttcacacgaggagctggacgactcatggtag

SEQ ID NO: 198195 - DNA, 1104 bp, Artificial Sequence
  Description of Artificial Sequence: Synthetic coding sequence
atgatggcccagagcaacatgttcaccgtggccgacgtgctgagccaggatgagctgcgcaagaaattgtatcagaccttcaaggacaggggaatcctagacaccctgaagacgcagctccgtaatcagctcatccacgaactgatgcacccagtcttgagcggcgaactgcaacctcgaagtatttccgtcgaaggtagctctctgttgattggcgcctccaatagtctcgtggcagatcacttgcagcggtgtggatacgagtattcactgtcggtcttcttccccgagtctggcctggctaaagagaaagtctttacaatgcaagacctcctccaattgattaaaatcaatcccacctcctcactatacaagtcccttgtctcaggctccgacaaagaaaatcagaagggatttcttatgcactttctcaaggagctagctgaatatcaccaggccaaagagagctgtaatatggaaacccagacaagttccacattcaacagagattccctggccgagaagctgcagctgattgacgaccaattcgcagacgcctacccgcagcgcatcaaatttgagagtttagagattaagttgaatgaatataaaagggaaatcgaggagcagcttcgcgcagaaatgtgtcaaaagttgaagttcttcaaggatactgagattgccaagattaagatggaagccaagaaaaaatacgaaaaggagctcactatgtttcagaacgattttgagaaagcctgccaagccaaaagtgaagccctggtgctgcgcgagaagagcacgctggagcggatccataaacatcaggaaatcgaaacaaaagagatttatgcacagcgccagttgttgctcaaggacatggatctgctccgcggccgcgaagcggagcttaagcagcgagtggaggctttcgagctgaaccagaaactgcaggaggagaagcataagagcatcaccgaagctctgcgtcggcaggagcagaatatcaaatcctttgaggaaacgtacgaccggaagttgaagaacgaattgctgaatttccatagattgcacggggtctgcttagctctgggtattcttatatag

SEQ ID NO: 198196 - DNA, 1017 bp, Artificial Sequence
  Description of Artificial Sequence: Synthetic coding sequence
atggtgttcctgtgcatcttcaaggagctggccgagtaccaccaggccaaagaaagttgtaatatggagacgcagacctcttctacatttaaccgggacagcctggctgagaagttgcagctcattgatgaccagttcgcggatgcctatccccagcggattaagttcgagagcttagagatcaaactgaacgagtataagcgcgagatcgaggaacagctgagggcagagatgtgtcagaaactcaaattcttcaaggatacagagatcgctaagattaaaatggaagccaaaaagaagtatgagaaggaactgacaatgttccagaacgacttcgaaaaagcttgccaggctaagtccgaggctctggtgctccgggaaaagtctaccttagagagaattcacaagcaccaagaaatcgaaaccaaagagatctatgcacagaggcagctgctactgaaagatatggatctgttaagagggagggaggccgagctcaagcagcgcgtggaagcgtttgaactctatcaactagaactgaaagacgattacattatcaggactaatagactgattgaagacgagcggaagaataaagagaaagcggtgcacttacaagaagagctcatagccattaattccaagaaagaagaacttaaccaatctgtgaatagagtcaaggagctggagctggagctggagagtgttaaagctcagagtttggccattacgaagcagaatcacatgcttaacgaaaaggtcaaagagatgagtgattattcccttcttaaggaagaaaaactggagctcctggctcagaataagcttcttaaacagcaactggaagaaagccggaacgaaaaccttcgcttgctgaatcgacttgcccaaccagcacctgaattggcagtgtttcaaaaggaactccgaaaagctgagaaagccattgtggtagagcatgaggagttcgaaagctgtagacaggccctgcataaacagttacaagacgagccctag

SEQ ID NO: 198197 - DNA, 2586 bp, Artificial Sequence
  Description of Artificial Sequence: Synthetic coding sequence
atggcccactaccccacccggctgaagacccggaagacctacagctgggtcggtcggcccctgctggacaggaagctgcactaccagacttaccgtgagatgtgtgtcaagacagagggctgctctaccgaaatacatatacaaattggacagttcgttttgatcgaaggagacgacgatgaaaatccatatgtggcaaagctgctagagctcttcgaagacgactctgatcctccgcccaagaaacgcgctcgcgtccaatggttcgtgagattctgcgaagtcccagcctgtaaaagacatctgttgggaaggaaacccggcgcacaggagattttttggtacgactaccccgcgtgtgatagtaacatcaatgcggagacaatcataggcctcgttcgggtcatcccactcgctcccaaggatgtggtgccgacaaacctgaagaatgagaagacacttttcgtgaaactctcgtggaacgagaagaagttccgaccattgtcatcagaattatttgccgagttgaacaagccccaggagtcggccgccaaatgtcagaagccagtgagagctaaaagcaagagcgccgagtcaccttcctggaccccggccgaacatgtagccaaaaggattgagtctcgtcacagtgcgagcaagtccagacaaacccctactcacccacttacccccagagcccggaaacgactcgaattggggaatctaggcaacccccaaatgtcccagcagacatcttgcgcctctctggactcccccgggaggattaaaaggaaagtggctttcagcgagatcacctcaccctccaagagaagccaacctgataagcttcagacgctttcaccagcgcttaaagctccagagaaaacacgggaaaccgggttatcttacacagaggacgacaaaaaggcctcacccgagcaccgcatcattctccggacacggatagcggcatcaaaaaccattgatatcagagaggagcgcaccctcaccccaatatccggggggcagcggtcctccgtggtccccagcgtgatcctgaaaccggagaatataaagaagagagatgccaaagaggcaaaagcccagaacgaggccacaagcactccccaccgtatcaggcgcaaaagcagcgttttaaccatgaaccgtatcaggcagcagcttaggtttctgggaaacagcaagagtgatcaggaggaaaaagagatcctgccagccgctgaaatctccgattcatcatccgatgaggaagaagctagtactccccccttacccaggcgtgctccccgcaccgttagtagaaatctgcggtcctccctaaagagctctttgcataccctgaccaaggttcccaagaagagcctgaagccgagaacaccaagatgtgccgcgccacagatccgttcacggtccctggccgcgcaggagccggcgagcgtgctcgaggaggcgcgactgcggctgcacgttagcgccgtcccagagagccttccctgcagggagcaggagtttcaggatatttacaacttcgtggagtcaaagctgttggatcacacaggcgggtgtatgtacatctctggagtcccgggaacaggaaaaacagctacagttcatgaggtgattagatgcctgcagcaggctgcccaagccaacgacgtccctcctttccagtacattgaggtaaacggaatgaagctcactgaaccccatcaggtttacgtccagatcctccagaaacttactgggcagaaagctacagcaaatcacgccgccgagctgctcgctaagcagttctgcactcgcggaagtccccaggaaacaaccgtcctgctcgtggacgagttggatttgctgtggacccacaagcaggatatcatgtataacttgtttgactggccaactcacaaagaagctcgtcttgtagtcctagctattgcaaacacaatggatctccctgagcgcattatgatgaacagggtttcgtctagactgggtttaacccggatgtgttttcagccctacacttacagtcagttgcagcaaattctccggtccagactgaagcatctcaaggcgtttgaggacgatgccatccagctggtggcgagaaaggtggctgcactcagtggtgacgcgcggcgatgtctggacatctgtcgccgagctacagagatttgtgagttcagccagcagaaacccgattcaccaggcctggtgaccatcgcccactccatggaagccgttgacgagatgttctcaagttcatatatcactgcaatcaagaactcttccgtactagagcagagcttcctgcgggctattctggccgagttcaggcgatctggcctggaagaggcaacctttcagcagatctattcccagcacgtcgctttatgccgaatggagggcctgccgtacccaaccatgtccgagaccatggcagtttgctcccatctgggtagctgccgcctcctgttggtcgagccgtcccgaaacgaccttctacttcgggtgcggctgaatgtctcccaggacgatgtcctatacgctctcaaggatgagtag

SEQ ID NO: 198198 - DNA, 2586 bp, Artificial Sequence
  Description of Artificial Sequence: Synthetic coding sequence
atggcccactaccccacccggctgaagacccggaagacctacagctgggtcgggaggcctctcctagatcgcaaattacattatcaaacttacagagagatgtgcgtaaaaaccgaaggctgctctacggaaattcacattcagataggccagttcgttcttatcgagggcgacgatgatgaaaatccgtacgtcgccaaactgctcgaattattcgaagacgattctgaccctcctccgaaaaagcgggcaagggttcagtggtttgtgcggttctgtgaggtgcctgcatgcaagcgacacctgctggggcgcaaacctggagcccaggagatcttttggtacgactatccagcctgcgactcaaacatcaatgccgagactatcattggtctggtgcgggtgattccactggcacctaaagacgttgtccctaccaatcttaagaacgagaaaacattatttgtgaaattgtcatggaatgaaaagaaatttcggcctctctcgtccgagctcttcgccgagcttaacaagccgcaggaaagcgccgccaaatgccagaagccagtacgcgctaaatctaagtccgctgagtcgccaagctggactccagcggaacatgtggcaaagcggatcgaaagtagacattccgcctccaaatcccggcaaactcctacccacccgcttaccccccgggcacgcaaaaggctggaactcgggaacctgggtaacccccaaatgtctcagcagacgtcctgcgcctctctcgacagtcccggtcgcatcaagagaaaagtggccttctctgaaatcactagtccatctaaaaggagtcaacccgataagctgcagactttaagtccagctctcaaagcgcccgaaaaaacccgcgaaacggggctatcctatacggaggacgacaagaaagcctccccagagcaccggattatcctgcgcacccgaatagcagcttcgaaaactatagacatccgggaagaaaggacactcactcctatttctggaggccagcgcagttccgtggtcccctcagttatcttaaagccagagaacattaaaaaacgcgatgccaaggaggcaaaagcccagaacgaagcaacctccacaccccatcgcattcgccggaaatcatctgtgctgactatgaaccgcattaggcaacagctcaggtttcttggcaattcaaagagcgatcaagaagaaaaagaaatcctccctgcagccgagattagcgattcctcttccgacgaggaggaagcctcaacgccgcctctgccacgacgagccccgcggaccgtgtctcgcaatctgcgcagctctctgaagagctctctgcacacactgactaaggtaccgaaaaagagtctgaagcctcggacgccacgatgcgctgcccctcaaattaggtcacgttcattggccgctcaggaacctgcttctgtgttggaggaggccaggctcaggctgcacgtgtcagccgtcccagagtcgctgccctgcagggaacaggaattccaggacatatataatttcgttgaatctaaactactggatcacacaggcgggtgtatgtacattagtggggttcctggcacggggaagactgctacagtgcacgaagtaattcggtgcctgcagcaagccgctcaggccaacgacgtaccccccttccagtacatagaggtgaacggcatgaaactgaccgaaccccatcaggtttacgtgcagattctgcagaaactcactggacaaaaggctactgccaatcatgctgcagaactcctggctaagcagttctgcacaagggggtctccgcaggagaccactgtgttgctcgtggatgagttagatttactgtggacccacaaacaggatatcatgtacaacctgttcgattggcccacacataaagaagctcgcttggtcgttctggcaattgccaatacaatggaccttcccgagaggatcatgatgaatcgggttagcagtcgactgggcttgaccaggatgtgtttccagccatatacttatagccaactccagcagatcctccgctcacgccttaagcacctaaaggccttcgaggatgatgctattcagctggttgcccgcaaggttgccgccctttcgggcgatgctcggaggtgccttgacatctgtagacgcgcgactgaaatctgtgagttctcccagcagaaacctgatagcccaggactggtcaccatcgcacacagcatggaagctgtggatgagatgttcagttcatcttatattactgctatcaaaaatagtagtgtgctggagcagagcttcttgcgcgccattctcgccgagtttcgccgaagcggattggaagaggccacttttcagcagatctatagtcagcatgttgccctctgccggatggagggcctgccttacccaacaatgagcgagacaatggcagtgtgcagtcacctcggttcctgtcggttgcttctggtggagccaagccgcaacgatctgctgctacgcgtcaggctgaatgtttctcaggacgatgttctctatgccctgaaggatgagtag

SEQ ID NO: 198199 - DNA, 1599 bp, Artificial Sequence
  Description of Artificial Sequence: Synthetic coding sequence
atggagaagagcaacgagaccaacggctacctggacagcgcccaggcgggccccgccgccggccctggcgcccctgggaccgccgcaggacgggcaagaaggtgcgcaggcttcctacgtcgtcaggcgctcgtgctactgaccgtgtctggtgttttggctggcgccgggctgggcgcggccttgcgcgggctgtccctgtctaggacacaggtgacttatctggcgttccctggagagatgctgcttcgtatgctcaggatgatcatcctcccattggtggtatgctccctggttagtggtgccgccagcttggacgcctcctgcctcgggcgtctggggggaattgccgtggcgtattttggactaacaacgttatcagcttctgccctcgccgtggctctggccttcatcatcaagcctggtagcggcgcgcaaacgcttcagagctccgatctggggcttgaggacagcggtcctcccccagtcccgaaggagaccgtggatagctttctggacctggcacgcaacctgttcccctcaaatctagtcgtcgcagccttcagaacatacgccactgattacaaggttgtcacacagaattcatccagtggaaacgtgacacacgagaagatccccatcggaactgaaatcgagggaatgaatatactgggtttagttctgtttgcccttgtgctcggtgtcgctctaaaaaagctgggcagcgagggagaagatctgattaggttcttcaactctttgaacgaggctactatggtcctggtaagctggattatgtggtacgtccccgtaggtattatgtttctggtggggtcgaagattgtagaaatgaaagacataatcgtgctggtcacctctcttggaaaatacatcttcgcaagcattctgggccacgtaatccacggaggcatcgtactgccgcttatctacttcgtgttcaccaggaaaaatccctttcgatttttactgggtctactcgcaccattcgcgacggcttttgcgacatgtagcagcagtgccaccctacctagtatgatgaaatgcatcgaagagaataacggagtcgacaaaaggatcagccgttttatcctgcctatcggcgcaaccgtgaacatggatggtgctgccatcttccagtgcgtggccgccgtgtttattgctcagctgaataacgtcgaacttaacgccggccagatcttcactattttggttaccgcaacagcgtcttccgtcggagcagcaggcgtgcccgccggaggagtgctgaccatagccattattctggaagccatagggctccccacccacgatctcccccttatcctggccgtcgactggatagtggaccgtacaactacagtcgtgaatgtggaaggggatgccctgggagctggaattctgcaccacctgaatcagaaagctaccaagaagggggagcaggagttagctgaagttaaagtggaggcaataccgaactgtaagtccgaagaggagaccagccccctggtgacccaccagaatcccgcaggccctgtggcaagcgcacccgagttagaaagcaaggagtctgtgctctag

SEQ ID NO: 198200 - DNA, 330 bp, Artificial Sequence
  Description of Artificial Sequence: Synthetic coding sequence
atgagcaagcccgagctgaaggaggacaagatgctggaggtgcacttcgttggagacgacgatgtcctgaatcacattctcgacagggagggcggcgccaagttgaagaaggaaagagctcagttactcgttaatcctaagaaaatcattaagaaaccagagtacgatcttgaggaagacgaccaggaagtcctgaaggaccaaaattacgtggaaatcatgggtcgagacgtccaggaatcactcaaaaatggctcagcaacgggtggtggcaacaaagtatactcttttcagaacaggaaacatagtgaaaagatggctaaactctag

SEQ ID NO: 198201 - DNA, 219 bp, Artificial Sequence
  Description of Artificial Sequence: Synthetic coding sequence
atgagcaagcccgagctgaaggaggacaagatgctggaggtgcacttcgtgggtgacgacgatgtactgaatcatattctggacagagagggcggcgcaaaactaaagaaggagcgtgctcaactgctggtgaatccaaagaaaatcatcaaaaaacctgaatacgatctggaggaggacgaccaggaagtgttgaaagatcagaattatgtcgagtag

SEQ ID NO: 198202 - DNA, 2139 bp, Artificial Sequence
  Description of Artificial Sequence: Synthetic coding sequence
atggccaccagcagcatgagcaagggctgcttcgtgttcaagcccaacagtaagaaaaggaagataagcttacctattgaagattatttcaataaggggaagaatgagcctgaagactcaaaactccgtttcgagacttaccagttgatctggcaacagatgaaatcagagaacgagagactgcaggaagaactcaacaagaatctgttcgataacctcatagagttcttacagaagagccactcgggattccagaaaaacagcagggatttgggagggcagatcaagctgcgagagattcccacagccgccctggtcctgggggttaatgtgacagaccacgatttgacgtttgggtccctcaccgaggctctccagaacaacgtcacgccttacgtggtgtccctccaggctaaagactgcccagacatgaaacatttcctgcagaaactgattagtcaattgatggactgttgtgtggatatcaagagtaaagaggaagagagtgttcacgtcacccagaggaagactcactatagcatggactccctcagctcttggtatatgactgtaacccagaagaccgaccccaaaatgctgtcaaagaaacgaaccacatcctcccagtggcagtcccccccagtcgtggtcatcctgaaggatatggaaagcttcgcaacaaaggtactccaggacttcatcatcatatcctcgcagcacctgcatgaatttccattgatcctcatattcgggattgccacctcccccatcatcatccaccggctgctgccccatgccgtaagcagcctcctttgcatcgaactgtttcaatcgcttagctgtaaagagcatctcaccactgtattagacaaactacttctgactacgcaatttccattcaagattaatgagaaagtgctgcaggtcctgaccaacatctttttgtaccatgatttcagcgtccaaaatttcatcaaggggctccagctttcactactagagcatttttattcacagccgctgagcgtgctctgttgtaatctcccagaagccaagcggaggattaatttcctcagtaataaccagtgcgagaatatccggaggctcccttcgtttcgcagatacgtggaaaagcaggcttctgaaaaacaggtggccctgttaacgaatgaaagataccttaaagaagaaactcagctgctattggaaaatcttcacgtataccacatgaactattttctagtgctgcgctgccttcataaattcacctctagccttccgaagtatccactgggacgacaaatcagggagttgtactgcacctgtttggaaaagaatatctgggactctgaagaatacgcctccgttctgcagttgttgagaatgctcgcaaaggacgaacttatgaccatactggagaaatgttttaaagtctttaaatcctactgtgaaaaccatttagggagcaccgccaagcgcatagaggagtttttagctcagtttcagagtcttgacgctgaaacgaaggaggaagaggatgcctccggttcacagcccaagggcctccagaaaactgacctctatcacctgcagaaatccctgttggaaatgaaagagctaagacggagcaagaagcagactaagtttgaagttttgagggaaaacgtcgtcaacttcatagactgcttagtgcgggaatacctactcccccccgagacacagcccttgcatgaggtggtgtacttctcggccgcccacgccctccgggagcacctgaatgcagcgcctagaatcgcactgcacacggcgctgaacaacccgtactactatcttaagaacgaggccctgaaatccgaagagggatgcattcccaacatcgctccagacatctgcattgcatataagttacatttagaatgtagccgcctcataaatctggtggactggtcagaggccttcgcgacggtagtaaccgcagccgagaagatggacgccaactccgcaactagtgaagaaatgaatgagattatacacgctagatttatcagggccgtgtcggagctcgagctactcggcttcatcaaacccacaaaacagaaaactgaccatgtggcccgactgacctggggaggttgttag

SEQ ID NO: 198203 - DNA, 2136 bp, Artificial Sequence
  Description of Artificial Sequence: Synthetic coding sequence
atggccaccagcagcatgagcaagggctgcttcgtgttcaagcccaacagcaaaaagcgaaaaattagtctacccatcgaggattatttcaacaaagggaaaaacgagcctgaggacagcaagctccgttttgaaacttaccagctcatttggcagcagatgaaaagcgaaaacgagagacttcaggaagaactgaataaaaatttgttcgacaatctgattgagtttcttcaaaaatctcacagcggattccagaaaaacagtcgggatttgggaggccagattaaactgagggagattccaactgcagccttagtgttaggcgtcaacgtgaccgaccacgatctgacatttggctccctcaccgaggctctacagaacaacgtgaccccgtacgtagtgtcactgcaggcaaaggattgcccagacatgaaacacttcttgcagaaactgatttctcagctaatggattgctgtgtcgatataaagagcaaggaggaggaatccgtacatgtcacgcaaaggaagactcactacagtatggattccttgagctcctggtacatgacagtaacgcagaagactgacccgaaaatgctctcgaaaaaaagaacgaccagctcccagtggcaaagccctcctgtcgtcgtcatcctgaaagatatggagagcttcgccaccaaggtcttacaggattttatcattatctcctcccagcacttacatgagtttcctttgatcctgatattcggaatcgcaacgtctccaataattatccataggctccttccgcatgctgtcagcagcctcctttgcatcgaactgttccagtctctcagctgcaaggaacatctcactactgtacttgacaaactgctccttacaacacagttcccctttaaaatcaacgaaaaggttctgcaagtactgaccaacatcttcttatatcatgacttcagcgtgcagaactttatcaaggggttgcagttgtctctgctggaacacttctatagtcagcccctgagcgttttgtgctgtaaccttccagaagcaaagcggcgaatcaacttcctcagcaataaccagtgcgagaacataaggcgactcccttccttcaggagatatgtcgagaaacaagccagtgagaagcaagtcgctttgttaactaatgaacgctatctcaaggaggaaacgcagctgctcctggagaatttgcatgtgtaccatatgaattattttttggttctgagatgtcttcacaagtttacttcttccctccccaaatatcccctggggcggcagatacgggagctctattgcacctgtctcgaaaagaatatatgggattccgaagagtatgccagcgtcctgcagctgcttcgtatgctggccaaagacgaactcatgactatcctggaaaagtgcttcaaggtctttaagtcctactgtgaaaatcacctggggtccacagcaaagcgaattgaagagtttttggctcagtttcaatctctagatgagacgaaggaagaggaagacgcttccggtagccaacccaagggcctgcaaaagaccgatttgtatcatctgcagaagtccttactagagatgaaggagctcagacgctccaagaaacagacaaagtttgaagtccttagggaaaacgtcgttaattttattgactgtctggtgcgtgagtatttgctgccacccgaaacacagcccctgcatgaagtggtctacttcagcgccgcacatgccctgagagaacacctcaatgcagcgccaaggattgcgctgcataccgcacttaataatccctattactacctgaagaatgaagccctgaagagcgaggaggggtgtattccgaacatcgcacctgatatttgtatcgcatataagctccatctggagtgttctcgtctgatcaatctggtagactggtcagaagcgttcgctacagtggtaacagccgccgaaaagatggatgctaatagcgcaacctcagaagaaatgaacgagattattcacgcccggtttatcagggcagtgtccgagctagagctcctcggatttatcaaacctaccaaacagaagaccgaccacgtagctcgcttgacctggggggggtgctag

SEQ ID NO: 198204 - DNA, 1335 bp, Artificial Sequence
  Description of Artificial Sequence: Synthetic coding sequence
atgaagagcgagaacgagcggctgcaggaggagctgaacaagaacctgttcgataatctgattgagttcctgcagaaatcccattccggttttcagaagaactcacgagatcttggcggccagatcaagctgcgggaaattccaacagccgccctggtactgggcgtgaacgtgactgatcatgacctgaccttcggcagtctcaccgaagccttgcagaacaatgttaccccttacgtggtctcactccaagccaaggattgtccagacatgaaacacttcctccaaaaactgatttcccagttgatggattgttgtgtggatatcaaaagcaaggaggaagaatcggtgcatgtaacacaacgcaaaactcactattccatggattcactgtctagctggtacatgacagtgacacagaaaacagaccccaagatgctttcaaaaaagcgaacaacaagttcccagtggcagagccctcctgttgtggttatccttaaagatatggagtcgtttgcaaccaaagtgctgcaggacttcataatcatatcctcgcaacacttacatgagttcccactcattcttatctttggcatcgctacgagcccaattattatccatcggctcctgccacatgcagtgtcatcactcttgtgtatcgagctcttccaatcactgtcgtgcaaggagcacctgaccactgtcctcgataagctcctactgaccacccaatttccatttaagattaacgagaaggtgctacaagtactgacaaatattttcctctaccatgacttttctgttcaaaacttcatcaaggggctgcagcttagccttctggagcatttttactcccagccactgtcggtcttgtgctgcaacttgcccgaggccaagcggagaatcaacttcttgagtaataaccaatgcgaaaacataagaagattgccgtccttccgccgttatgtcgaaaagcaggcaagcgaaaaacaggtggccttacttacgaacgagcgctacctcaaggaggagacccagcttttacttgaaaatctccatgtgtaccatatgaactacttcctggtccttcggtgcctgcacaaattcacctccagtttgccgaagtacccgctaggtaggcagattcgagagttgtattgcacctgcctagaaaagaatatctgggattccgaggaatacgcatccgtgcttcagttattgagacttggattagcctttttggacattcaactcttcggagcccaatctgggcaggagctcctccttcctctgtcctgggaagccaacccctctcacgccgccaatctgggatag

SEQ ID NO: 198205 - DNA, 1707 bp, Artificial Sequence
  Description of Artificial Sequence: Synthetic coding sequence
atgaagcacttcctgcagaagctgatcagccagctgatggactgctgcgtcgatatcaaaagtaaggaagaagagtcagtgcacgtgacacagcgaaaaactcattacagtatggactcactttcgtcctggtacatgactgtgacccagaaaacggatccaaaaatgttgagcaagaagaggacaaccagctcacaatggcaatcaccgcctgtcgtggtgatactgaaggacatggagtcattcgccacgaaagtactccaagatttcattatcatatcgtctcagcatctccatgaatttcccctaattctgatattcgggattgccacgtctccaattataatccatagattgctgccccatgctgtgagcagtctcctttgcatcgagctgttccaatcactctcctgcaaagagcatctgacaacggtacttgataaattactgttgaccactcagtttccttttaagatcaatgagaaagtactccaggtcctcacaaatatcttcctctaccatgacttctcagtccagaattttatcaaaggccttcagctgtcactgctggagcatttttactcacagccgcttagtgtcctgtgttgtaatctgcccgaggcaaagcgccgcattaattttttgagtaataaccagtgtgagaacatccgacggctcccctctttccgtcgctatgttgagaagcaggccagtgagaaacaggtggccctattaaccaacgaacggtacctcaaggaggaaacacagctgcttctggagaatctacacgtgtaccacatgaactattttctggttctcagatgcctccacaaatttacttcaagtctccctaagtaccctttaggccggcaaattagggagctgtactgtacatgcctggaaaaaaatatctgggacagtgaggagtatgccagcgtgctgcaacttctgaggatgctggctaaagacgaactgatgactattcttgaaaagtgttttaaagtattcaagagttattgtgagaatcacctcggctccacggctaaaagaatcgaagaattccttgcgcagttccagtcactcgatgaaactaaggaggaggaggacgcatccgggagccaaccaaagggcttacagaagactgacctataccatttgcagaagtctctgcttgagatgaaagaactccgcaggtcgaagaagcagactaaattcgaggttctaagggagaatgtggtcaattttatcgactgtcttgttcgggagtacctgttgccccccgagactcagcccctgcatgaagtcgtgtacttcagcgcagctcatgccttgcgggaacatttaaatgccgcacccaggatcgctcttcatactgccctaaataatccatattactacctcaagaacgaagccctcaaaagcgaagagggatgcataccaaatatcgccccagatatttgtattgcttacaaattgcatttggagtgtagccgcctgattaatctggtagattggagcgaggcatttgccacagtggtcactgccgctgaaaaaatggatgccaattccgctacatctgaggaaatgaatgagatcatacatgccaggttcatccgtgccgtcagtgagctggaactgctgggattcattaagcctaccaaacagaaaaccgaccacgtggctcgcctgacgtggggcggatgttag

SEQ ID NO: 198206 - DNA, 1311 bp, Artificial Sequence
  Description of Artificial Sequence: Synthetic coding sequence
atgagcagccggaagagcaagagcaacagcctgatccacaccgagtgtctttctcaggtgcagagaatcctcagagagcgtttctgccggcagtctccacattccaatctgtttggagtacaagtccaatataagcacctatccgagcttctgaaaaggaccgcgctgcatggagaatccaattctgtgctgatcatcggacccaggggctccggcaagaccatgttaatcaaccacgcgttgaaagaactcatggaaatcgaagaagtttccgaaaatgttctgcaagttcaccttaacggcttgctgcagattaatgataagattgcgcttaaggagatcactaggcagctgaacttagaaaacgtggtgggcgacaaagtgttcgggtcgtttgccgaaaacctgagctttctgctggaggctctgaaaaaaggcgaccggacatcttcctgtccggtgatctttatactggacgagtttgacctctttgcacatcacaaaaaccaaacactcctgtacaatttgtttgatatctcccaatcagcccaaactcccatagcggtaatcggacttacctgtcggttagatatccttgagttactcgagaagagagtcaagtccagattctcacatcggcagatacaccttatgaactctttcggcttccctcaatatgtcaagatcttcaaagagcagttatctctgccagcagaatttcccgataaagtgtttgccgagaagtggaatgaaaatgtgcaatatctgtcagaggaccgttccgttcaggaagtcttgcagaaacacttcaacatttctaagaaccttaggagtcttcatatgctgttaatgctggctttaaatagagtcaccgcctcccaccccttcatgacagcggtggatctgatggaagcatcacagctctgcagcatggactccaaagcaaacatcgtccatggcctaagcgtgttggaaatttgcctgataatcgcaatgaagcacttgaacgacatctacgaggaggagcctttcaatttccagatggtctacaatgagttccagaaatttgtgcagagaaaggcccacagtgtgtataattttgagaagcccgtggtgatgaaggccttcgagcaccttcaacagctcgaattaattaagcccatggagaggaccagcgggaattcgcagcgcgagtatcagctgatgaaacttctgctggacaatacccagatcatgaatgcgctccagaagtatcctaactgccctacagacgtgaggcaatgggctacctcttccctgagctggctgtag

SEQ ID NO: 198207 - DNA, 1311 bp, Artificial Sequence
  Description of Artificial Sequence: Synthetic coding sequence
atgagcagccggaagagcaagagcaacagcctgatccacaccgagtgtctgtcacaagtgcaaagaattctgcgtgagaggttttgccgccagtctccgcattccaatctgtttggtgtgcaggttcagtacaagcatttgtccgaactgttgaagagaactgctctgcacggtgagtcaaattcggtactgataatcggaccacgcggctcaggaaagactatgctcataaaccatgcattgaaggaactcatggagatcgaggaggtttccgagaatgtcctacaggtgcacttgaatggactgttgcagattaacgacaagatcgcactcaaggagatcaccaggcaactgaatctggaaaatgtggtgggagataaagtgtttgggtcattcgcggagaacctcagtttcttgttggaggcactgaaaaagggagatagaacatccagctgccctgtaatattcattctcgacgagttcgacctcttcgcccaccacaaaaaccaaaccctgctgtataatctgtttgacatctcacagtctgcccaaacccctatcgccgtgataggccttacgtgcaggcttgatatacttgagctgctggaaaagcgggtgaagtccaggttctcccacagacaaattcatctgatgaattccttcggtttccctcagtacgtgaaaattttcaaagagcaactgtccttaccagcagagttccctgataaggtattcgctgagaagtggaatgagaatgtacagtacttgagcgaggatcgtagcgtgcaagaggtcctgcagaagcacttcaatatctccaagaacctacgcagtttgcatatgctgctgatgctagcgcttaaccgggtgacagccagtcatcccttcatgactgcggtcgatctaatggaagcctcgcagttatgctccatggacagcaaagcgaacatcgtgcacgggctgtccgtcctggaaatctgtctgatcattgctatgaagcatctgaacgatatatatgaggaggaaccattcaacttccagatggtatataatgaattccagaaattcgtgcaaaggaaggctcatagcgtgtacaattttgaaaaaccggtggtaatgaaagctttcgagcacctacagcagctggagctcatcaagccaatggagagaacaagcgggaatagtcagagggagtatcagctgatgaagctgttattggacaacacccagattatgaacgctctgcaaaaatacccgaactgtccaaccgacgtccgacagtgggccacaagtagcctcagctggctatag

SEQ ID NO: 198208 - DNA, 1311 bp, Artificial Sequence
  Description of Artificial Sequence: Synthetic coding sequence
atgagcagccggaagagcaagagcaacagcctgatccacaccgagtgcctgtcccaggtgcagcggatcctacgggagaggttttgtcgacagtctccccacagcaatctctttggagtgcaggttcagtataaacatctatccgagctgctcaagagaacagccctgcacggagaatccaatagcgtactcattatcggcccaaggggaagtggcaaaaccatgctaatcaaccatgccctgaaagagctgatggaaattgaagaggtctccgaaaacgtgctacaagtgcatctgaacgggctgctccagataaacgacaagattgcccttaaggagatcacacgtcaactcaacctggaaaacgttgtcggagataaggtgtttgggagtttcgccgagaatctctcgttcctattagaggcactgaaaaagggagatcgcactagctcttgcccagtcatttttatccttgatgaattcgatctgttcgcacaccacaagaatcagaccctactatacaacttatttgatattagccagagcgcgcaaacccctattgcggtgattgggttgacctgtagactggatattctagaactgcttgaaaaaagagtaaaatccaggttttcacacagacaaattcacctgatgaactcgttcggattccctcagtacgtgaagatattcaaggaacaactctccctccccgccgagttccctgataaggtgtttgccgaaaaatggaacgagaacgtccagtaccttagtgaagatcgctcagtgcaggaggtcttacagaaacatttcaatatcagtaagaatttacgtagcctgcacatgctcctcatgcttgccttgaaccgtgtcaccgcctcacatcctttcatgaccgccgtcgatctaatggaagcctcacagttatgcagtatggactcaaaggccaatatagtgcatggactgtcagtgctcgagatatgcctgatcatcgctatgaagcatctgaatgatatttatgaggaggagccatttaacttccagatggtctataatgaatttcagaagtttgtgcagaggaaagcccacagtgtatacaattttgaaaagcctgtggttatgaaggcatttgagcatctgcagcagctcgaactgatcaagccaatggagagaactagcgggaactctcaaagggagtaccagctgatgaaactgctgctggataacacacaaattatgaatgcactacagaagtacccaaactgccctaccgatgtaagacaatgggcaacaagctccctgtcatggctctag

SEQ ID NO: 198209 - DNA, 438 bp, Artificial Sequence
  Description of Artificial Sequence: Synthetic coding sequence
atgagcagccggaagagcaagagcaacagcctgatccacaccgagtgtctctcgcaggtacagcgtatccttagggagagattttgccgacaatcccctcattccaatctgttcggggttcaagtgcaatacaagcacctctccgagctgctcaagcgaacagcactccacggcgaaagcaacagtgtgcttattattggaccccgaggtagtgggaagactatgcttatcaatcatgccctcaaagaactcatggagatagaagaggtcagcgagaatgtgctgcaggtgcatctgaacggactgttgcaaatcaacgacaagatcgcactaaaggagattactcgccagttgaatttagagaacgtggtgggcgacaaagttttcggctcgtttgcggagaatctctcttttttgctggaggcactaaaaaagtag

SEQ ID NO: 198210 - DNA, 384 bp, Artificial Sequence
  Description of Artificial Sequence: Synthetic coding sequence
atgagcagccggaagagcaagagcaacagcctgatccacaccgagtgcctctctcaggttcaacgaatcctgcgcgagagattctgtcgtcagtctccccacagtaatctgtttggtgtgcaggtgcagtacaaacacctaagcgagttgctcaaaagaaccgccctccatggtgaaagcaacagcgtgttgatcattggccctcgaggaagcggaaagactatgcttataaaccacgccctgaaggaattgatggaaattgaggaggtgtcagagaacgtgctgcaggtgcaccttaacgggttgcttcaaattaacgataagatcgctctcaaggaaataactcgccagctgaatctggaaaacgtagttggcgataagtag

SEQ ID NO: 198211 - DNA, 387 bp, Artificial Sequence
  Description of Artificial Sequence: Synthetic coding sequence
atgagcagccggaagagcaagagcaacagcctgatccacaccgagtgcctgagtcaggtgcagcgaatcttgagagagaggttttgcaggcagtcccctcatagtaacctgtttggagtgcaggtacagtacaagcacctctctgagctgctgaagcgcactgctttacacggggagagcaattcagtgcttattatcggtccacgcggttccgggaagaccatgctcattaatcatgctctgaaggagctaatggagattgaggaagtgagcgagaacgtgctgcaggtccatttgaacggactgctgcagattaacgataagatcgctctcaaggagatcaccagacagctgaacctcgaaaatgtcgtaggggacaaagtttag

SEQ ID NO: 198212 - DNA, 1311 bp, Artificial Sequence
  Description of Artificial Sequence: Synthetic coding sequence
atgagcagccggaagagcaagagcaacagcctgatccacaccgagtgcctcagccaggttcagagaattctgagggagcgtttttgtagacagagtccacacagcaatctattcggggtccaggtgcagtacaagcatctgagtgaactgctgaaaagaaccgcattgcatggcgagtcgaatagtgtcctcattatagggcctcgggggtcaggcaagacaatgctgatcaaccacgccttgaaggagctcatggagatagaagaagtctccgagaacgttttacaggtgcatctaaatgggttgctgcagattaacgacaagatcgcgctgaaggagatcacccgtcagctgaatcttgagaatgtggtgggggataaggttttcggatcattcgccgagaatttatctttcttattggaagccttgaagaagggagaccgcactagcagctgtcctgttattttcatcctcgatgaatttgacctctttgcacaccataaaaatcagacattactctataacttgttcgacatttctcagtcagctcaaaccccaatcgcagtgataggcttgacttgccgcttagatattctggagctgctagagaaacgggttaaatctaggttttcccatagacaaatacaccttatgaactcctttggcttcccccagtacgtcaagatattcaaagagcagctgagtctgcctgctgagttcccggacaaagttttcgctgaaaaatggaatgagaacgtacagtacctttcagaagatcggagcgtccaggaggtgttacagaaacacttcaatatctcaaaaaacctgagatccctgcatatgctcctcatgctggctcttaacagagtgaccgcttcacatcccttcatgaccgccgttgacttgatggaggcgtcacagttgtgctctatggatagcaaggctaatattgtccatggcttatctgtcctagaaatctgtctcattattgctatgaagcacctcaacgacatctacgaggaggaaccctttaacttccagatggtctataacgagtttcagaagttcgtgcaacggaaggcacactcagtgtataatttcgaaaagcccgtagtgatgaaggcttttgagcatctgcagcaactggagctgataaagcccatggagaggacttccggaaatagccagcgagagtaccagttgatgaagctattgttagacaatacccagattatgaatgctctccagaaatatcctaactgtcccacagatgtgaggcagtgggctacgtccagtctgtcgtggctgtag

SEQ ID NO: 198213 - DNA, 1059 bp, Artificial Sequence
  Description of Artificial Sequence: Synthetic coding sequence
atggagatcgaggaggtgagcgagaacgtgctgcaggtgcacctgaacggcctgctgcagatcaacgataagatcgcactgaaagagatcacccgacagctgaacctcgagaatgttgtcggggataaagtatttggctcctttgccgagaacctgtcctttctgctggaggccttgaaaaaaggggatcggacctcctcatgtcccgtcatttttatcctggacgaattcgacctgtttgcccaccacaagaatcagaccctgctgtataacctatttgatatttctcagagtgcacagaccccaattgctgtaataggcctgacctgtcgcctggatatcctggaattgctggagaagagggtcaagtctaggtttagccatcgtcagatccacctgatgaattcatttgggttcccccaatacgtgaagatatttaaggagcagctgtcccttccagctgagttccccgataaggtatttgcggaaaaatggaacgaaaatgtccagtacctctcagaggaccggagcgtccaagaagtgctacagaagcatttcaacatcagtaagaatctccggagtttgcacatgctgctgatgttggccttgaaccgggtaaccgcctcccacccttttatgactgcagtcgatctgatggaggctagccagctgtgctccatggactccaaggcaaacatagtccatggtctgagtgttctcgagatctgtctgattatcgccatgaaacatttgaatgacatctacgaagaagagccatttaacttccagatggtttacaacgagttccagaaattcgtccagcggaaagcccatagcgtttacaactttgagaagcctgtggtcatgaaggccttcgagcacctccagcagctggaacttatcaagcccatggagaggacgtcagggaattcacagcgtgaataccaattaatgaaattactgctggacaatacccagatcatgaacgcacttcaaaagtacccaaattgccccaccgatgtccgccagtgggcgacgagttcactttcctggctctag

SEQ ID NO: 198214 - DNA, 1089 bp, Artificial Sequence
  Description of Artificial Sequence: Synthetic coding sequence
atgctgatcaaccacgccctgaaggagctgatggagatcgaggaggtctccgagaatgtccttcaggtgcacctcaatggcctcctccaaatcaacgacaaaatcgcccttaaagagatcacacggcaactgaacttagagaacgtggtgggtgataaggtattcggttcctttgctgagaacctgagcttcctcctcgaagctctgaagaagggagacagaactagtagctgtccagttatctttatcttagatgaatttgacctatttgcccatcataagaatcagactctgctttataacctttttgacatctcccaaagtgcacaaacgcctatcgcagttatcggcctgacatgccggctggacattctcgaactgctggagaagagggtgaaaagcagattttcccatcgccagatccatctgatgaactcttttggattcccacagtacgtaaaaatctttaaggagcagttgtctttgccagccgagtttcctgacaaagttttcgccgaaaaatggaatgagaacgtgcaatacctgtccgaggatcggagcgttcaggaagtcttgcagaagcactttaacattagtaagaatttgcgctccttgcacatgctgctcatgctggctctgaatagggtcacagcatctcacccctttatgacggcagtcgacctaatggaagcgagccagttgtgctccatggactcgaaagccaacatcgtacacggactgtctgttctggagatctgcctgattatcgcgatgaaacacttgaacgacatctatgaagaggagcccttcaatttccaaatggtatataacgaatttcaaaagtttgtgcagagaaaggcacactccgtgtataacttcgaaaagccggtagttatgaaagcttttgaacacttacagcaactcgagctcatcaagcctatggaacgaacgtctggcaattcacagagggaatatcagctgatgaaactactgctagataatactcagatcatgaacgcgttgcagaaataccctaattgtcctactgacgtacgacagtgggcaacctcaagcttgagctggctgtag

SEQ ID NO: 198215 - DNA, 660 bp, Artificial Sequence
  Description of Artificial Sequence: Synthetic coding sequence
atgaacagcttcggcttcccccagtacgtgaagatcttcaaggagcaactctccctgccagctgagtttccagataaggtctttgccgaaaaatggaacgaaaacgtgcagtatctgagtgaggacaggtccgtgcaggaagtattacagaagcacttcaacatcagtaagaacttacggagtctgcacatgctcttgatgctggccctgaacagggtcaccgcctcccacccattcatgacagccgtggacctcatggaggcatcccagctgtgtagtatggatagtaaggccaatatcgtgcacggcctcagcgtcctagaaatatgcttgataattgctatgaagcatctaaatgacatttacgaggaggaaccatttaattttcaaatggtgtacaatgagtttcagaaatttgtgcaacggaaggctcactccgtgtacaactttgagaaacctgtggtgatgaaagcgttcgagcacctccagcagctggagctgatcaaacccatggagcgaacttctgggaactctcagagggaataccagttaatgaagcttctgttggataatacccagattatgaatgccctgcagaagtatccgaattgtcccactgacgtgcgacagtgggcaaccagctctcttagctggctctag

SEQ ID NO: 198216 - DNA, 1308 bp, Artificial Sequence
  Description of Artificial Sequence: Synthetic coding sequence
atgccccacctggagaacgtggtgctgtgccgggagagccaggtgtctatcctgcaatcactgttcggggagcggcatcatttttctttcccctccatttttatttacggccatacagcgagtggtaagacgtacgttacccagactcttctgaagacattagagctgccccacgtctttgtgaactgcgtggaatgcttcacgcttcgcctcctacttgaacagattttaaacaaactgaatcacctgagcagctccgaggacggctgcagtacagagatcacctgcgagactttcaacgacttcgtacggctatttaagcaggtaacaaccgcagaaaatctaaaagaccaaactgtgtacattgttttagacaaagcagaatacctgcgggacatggaggccaatctcttgcctggctttctgcgcctgcaggagctcgcagatagaaacgtaacagtgctgtttctgagtgagatcgtctgggagaaatttcggcctaacacaggatgcttcgaacccttcgtgttgtattttcccgactatagcattggcaatctgcaaaaaattctcagccacgaccacccccccgagtacagcgcagacttttatgcagcatatattaatattttgctcggggtgttttatacagtatgcagggatttgaaggagctccgacatctcgccgtcctgaatttcccaaagtactgtgagcccgtggttaaaggcgaggcctccgaaagagatacccgcaagctgtggaggaacatcgagcctcacctgaagaaggccatgcaaaccgtgtacttgagagaaatctcgagttcccagtgggagaaactccaaaaggacgatacagatccaggtcaactgaagggactctcagcccacacccacgttgagctgccctattactctaaatttatcctgatcgcagcttatctggcatcgtacaacccagccaggaccgataaacggttcttcctcaagcaccacggcaagatcaaaaaaactaactttctgaagaaacatgagaaaactagcaaccatctgctcggccccaagcctttcccgttggatagattgctcgcaatcctatacagtatagtggatagccgtgtagctcctactgctaacatttttagtcagataacttccttggtaaccctgcagctcctgacactggtgggccacgatgatcagctcgatggacccaaatacaaatgtacagtgtcgctggattttattcgagctattgctcgtactgtgaatttcgacataatcaagtatctgtatgactttctgtag

SEQ ID NO: 198217 - DNA, 975 bp, Artificial Sequence
  Description of Artificial Sequence: Synthetic coding sequence
atgccccacctggagaacgtggtgctgtgccgggagagccaggtgtccatactacagagtctgtttggagagaggcatcacttctcgttcccaagtattttcatatacggccatacagcgtctggaaagacctacgtgacgcaaaccctgctgaaaaccctcgagctcccacacgtgtttgtgaactgtgtggaatgttttaccctgcgcttactcttagagcagatcctgaacaagttgaatcatctgtccagttccgaggacggttgcagtactgagatcacttgtgagacctttaatgacttcgttaggctatttaagcaggtgacaactgctgaaaacttgaaggaccagaccgtatacatagtcctggacaaagccgagtatttacgcgacatggaggccaacctgttacccggatttcttcggctgcaagaactcgctgacagaaacgttacggtgctctttttgtcagagattgtgtgggaaaagttccggcctaatactggctgtttcgagcctttcgtgctgtacttccctgactattctattggcaatctgcaaaaaattcttagccacgatcatcctccagaatacagcgcggacttctacgctgcttatatcaatatcctgctaggggtgttttacactgtctgccgcgacctaaaagaactgagacacctggccgtcttaaacttcccaaaatattgcgagccggttgttaaaggcgaagccagtgaacgcgacacacggaaactgtggaggaatattgaaccacatcttaagaaggctatgcaaaccgtctacttacgggagatatcttcctcgcagtgggagaaattgcagaaggatgacacagaccctggccaacttaaaggcattcgcgggtctatagagaccgtgactggagacacctctagcgcaaactaccaggatacaaaggtgaacacaaaggagcattccgtgcgtaagtag

SEQ ID NO: 198218 - DNA, 912 bp, Artificial Sequence
  Description of Artificial Sequence: Synthetic coding sequence
atggaggccaacctgctgcccggcttcctgcggctgcaggagctggcagaccgcaacgtgacagttctgttcctgagtgaaatcgtgtgggagaagttccggcctaataccggttgtttcgagcccttcgttttgtattttcctgactactccatcggcaacctgcagaaaatactgagccatgatcatccgcctgaatactcagcagatttctacgccgcctacattaacatcctactgggcgtgttctacacggtgtgccgggacctgaaggagctgaggcatctcgccgttttgaatttccccaagtactgcgagcccgtagtgaagggtgaagcatcggaacgagacacacgcaagctttggagaaatatagagccccatctgaagaaagccatgcaaactgtgtacttaagagaaatttctagctcacagtgggagaagctgcagaaagacgacacagaccccggacaactgaagggcctgtccgcccacacccatgtcgaactaccatattattctaaatttatacttattgccgcctatttggcctcatacaaccccgcccggacggataagcggtttttcctaaagcaccacggaaagattaagaagaccaattttttaaaaaagcatgaaaaaacctccaaccaccttctaggccccaaacctttccccttagatagactcctggctattctttattctatagtggattctcgggtcgctcccacagcaaacatattctcccagatcacttcattggtcaccctgcagttattgactctggttggacacgatgatcagttggacggaccaaagtataagtgcacggtgtccttagactttatcagggccatcgcccgaacggtgaacttcgatattatcaagtacctgtacgactttttgtag

SEQ ID NO: 198219 - DNA, 1665 bp, Artificial Sequence
  Description of Artificial Sequence: Synthetic coding sequence
atgagcgccgacggcggcggcatccaggacacccaggacaaggagacccctcccgaggttccagacagggggcacccccaccaggagatgcccagcaaactcggggaggctgttccctctggcgatacacaagagtcactccatatcaagatggagcctgaggaacctcattcagaaggagcttcacaggaagatggggcgcagggagcatggggctgggctccactgagtcatggaagtaaggagaaggctctctttctcccaggtggcgcactgccatcccccaggattccagttctgtctcgcgagggaaggactcgcgaccgccagatggcggccgccctcctgacggcttggtcccagatgcccgttacattcgaggacgttgcactgtatctctctagggaggaatggggcagactggaccatacgcaacagaatttctatagggatgtccttcagaaaaaaaacggcctgtctcttggctttcctttcagcagacctttttgggcacctcaggcacacggcaagggggaggcctctggatcctctaggcaagccggtgatgagaaggagtggcggggtgcatgtaccggcgctgtagaagtcgggcagcgagtgcagaccagctccgttgccgccctcggcaatgttaaaccatttaggacgcgggccggccgagtacagtggggggtgccccaatgcgcccaggaggccgcttgcggccgcagctcagggccagccaaggatagcggacagcccgccgaacctgaccgcaccccagacgcagctcccccagacccctcccctactgagccccaggaatacagagtgccagagaagcccaatgaagaggagaaaggggctcccgagtccggcgaagagggcctggctccagatagcgaggtcgggagaaaaagctatcgctgcgagcagtgtggaaagggcttcagctggcactctcacctcgtgacccaccgtaggacccatacaggtgaaaaaccctatgcctgcactgattgcgggaaacggttcgggcggagttcccaccttattcagcatcagatcatccatacaggggagaaaccctatacttgtcctgcatgcaggaagtcattcagccatcactctaccctcatacagcaccaaagaatccacacaggggagaagccatacgtgtgcgaccggtgtgctaagcgctttactcgacgttccgatctggttacccaccaggggacccataccggcgccaaaccacataaatgccctatctgtgcaaaatgctttactcaaagttccgctcttgtgactcaccagagaacacacactggggtgaagccttacccgtgccctgagtgtggcaaatgcttctctcagcggtccaatctgattgcacacaatagaacccacacaggagagaaaccctaccactgcctcgactgcggcaaatcattctcccatagctcacacttgactgcccaccagcgcacgcacaggggcgtgcggccctatgcctgccctctttgtgggaaaagcttttcacggcggtccaatctgcaccgccacgagaagattcacaccaccgggcccaaagcgctcgccatgctgatgcttggagctgccgcagcaggtgctctcgctactcctcccccagcgccgacatag

SEQ ID NO: 198220 - DNA, 462 bp, Artificial Sequence
  Description of Artificial Sequence: Synthetic coding sequence
atgaacgtgggcgtggcccacagcgaggtgaaccccaacacccgggtgatgaattcacgcggcatgtggctaacatatgcccttggcgtcgggctcctccacatcgtgttattaagcattccgttttttagcgttccggtggcttggaccttaacgaatatcatccacaaccttgggatgtacgtgttcctgcatgccgtgaagggaactcccttcgagacgccggaccaggggaaggcgcgactcctgacccattgggaacaactcgactatggcgtgcagtttacttcttcccgtaagttctttaccatcagccctatcatattgtatttcctggctagtttctacactaaatatgaccctacacactttatactgaatacagcaagtctactgtctgtgcttatcccgaaaatgcctcagttgcacggagtcaggatctttggaattaacaaatattag

SEQ ID NO: 198221 - DNA, 462 bp, Artificial Sequence
  Description of Artificial Sequence: Synthetic coding sequence
atgaacgtgggcgtggcccacagcgaggtgaaccccaacacccgggtgatgaacagtcgcgggatgtggctgacctacgctctgggtgttggcctcctgcacatcgtgcttctatccatcccattcttcagcgtgcctgtcgcgtggactctgaccaatattatccataacttgggaatgtacgttttcctacacgccgtgaaaggcacacctttcgaaacacccgatcaggggaaggctcgtcttctgacacactgggaacagctagactatggtgttcagtttacatccagtaggaaattcttcactattagccctatcatcctgtatttcctggccagcttttacacaaaatacgaccccacgcatttcatacttaacaccgccagtctgctgagcgttctgattcccaaaatgcctcagctgcacggggtccgcatatttggcatcaataaatactag

SEQ ID NO: 198222 - DNA, 462 bp, Artificial Sequence
  Description of Artificial Sequence: Synthetic coding sequence
atgaacgtgggcgtggcccacagcgaggtgaaccccaacacccgggtgatgaatagccggggcatgtggcttacctacgccctgggggtaggactccttcacattgttctactttcgattccattcttttcggtgcctgtggcttggaccctcaccaatatcattcacaatcttggcatgtacgtttttctccacgcagttaaaggcaccccctttgaaacaccagaccagggcaaggctagacttctcacacactgggagcagctggactatggtgtgcagtttacttcaagtcgcaaattttttactatcagcccgataatactgtacttcctggcgtccttctacacaaaatatgacccaacgcacttcatcctcaacaccgcctctctcctgtctgttctgatcccaaaaatgccgcagcttcacggcgttaggatctttggcatcaacaagtactag

SEQ ID NO: 198223 - DNA, 330 bp, Artificial Sequence
  Description of Artificial Sequence: Synthetic coding sequence
atgaacgtgggcgtggcccacagcgaggtgaaccccaacacccgggtcatgaattcacggggcatgtggctgacatacgcattgggggtcgggctgttgcacattgttctcctgagtataccctttttctccgtgcccgtggcatggaccctgacaaatattatacacaatcttggcatgtacgtctttctgcatgcggtgaaggggacgcccttcgagacccctgatcagggtaaagcgcgcctgctgacacattgggaacagctggactacggagtgcaattcacttctagtcggaagttcttcaccatttctcccatcattctgtag

SEQ ID NO: 198224 - DNA, 330 bp, Artificial Sequence
  Description of Artificial Sequence: Synthetic coding sequence
atgaacgtgggcgtggcccacagcgaggtgaaccccaacacccgggtgatgaatagtcgaggaatgtggctcacttacgctctgggagtgggccttctgcatattgtgctgctaagcatacccttctttagcgtacctgtagcctggaccctgacaaacataatccacaacctgggtatgtacgtgttcctgcacgcagtgaaagggactccctttgagacgccagaccagggaaaggcaaggcttttgactcactgggagcagcttgactatggtgttcagtttacatcttctcgtaaattcttcactatttctcccattatcctgtag

SEQ ID NO: 198225 - DNA, 462 bp, Artificial Sequence
  Description of Artificial Sequence: Synthetic coding sequence
atgaacgtgggcgtggcccacagcgaggtgaaccccaacacccgggtgatgaattcccggggcatttggctcgcatatataattctcgtgggcttactacatatggtcttgctgagtattccattcttttccattcctgttgtttggaccctcactaatgtgatccacaatttagcaacttacgtcttcctgcacacggttaagggcacgccattcgagaccccggatcaggggaaggcacgactgctgacccactgggagcagatggactacggactgcagtttacaagttcccggaaattcctgtctataagtcccatcgtgctgtatctgctggctagcttttacacaaaatatgacgctgcgcatttcctgattaataccgcttccctgctctctgtgctgctgcccaagttgccccagttccacggcgtccgcgtctttgggatcaataaatattag

SEQ ID NO: 198226 - DNA, 462 bp, Artificial Sequence
  Description of Artificial Sequence: Synthetic coding sequence
atgaacgtgggcgtggcccacagcgaggtgaaccccaacacccgggttatgaactctcgcggaatctggctggcctatattattctcgtgggactgcttcacatggttttgcttagtattccgttcttctctattcccgtagtgtggacccttaccaatgtgatccataacttggcaacgtatgtgttcctgcacaccgtgaaggggacgccgtttgagacccctgatcagggaaaagcccgactattgacacattgggaacagatggactacggattgcagttcacttctagccgcaagtttctgtcaataagccctattgttctgtatttgctagcctcgttttatacaaagtacgatgccgcccattttctgattaacaccgcaagcctgctgtctgtcctgttgccgaagcttccccaatttcacggggttagggtctttgggataaacaagtattag

SEQ ID NO: 198227 - DNA, 462 bp, Artificial Sequence
  Description of Artificial Sequence: Synthetic coding sequence
atgaacgtgggcaccgcccacagcgaggtgaaccccaacacccgggttatgaactcaagggggatctggctgagttatgtactggctattggcctattgcatatcgtgctgttatccatacccttcgtgtctgtgccggttgtgtggacattaacgaatctgattcataatatgggcatgtacatatttttgcacaccgtgaaaggtacgcctttcgagacacctgatcagggtaaggccagactcctaactcattgggagcagatggactacggagtgcagtttactgcctctaggaagttcctgacaatcacacccatcgtcttgtattttctgacaagcttctacactaaatatgatcaaatccacttcgtgttgaataccgtctccctgatgtcagttttgatcccgaagcttcctcagctgcatggcgtccgcatctttgggatcaacaagtactag

SEQ ID NO: 198228 - DNA, 462 bp, Artificial Sequence
  Description of Artificial Sequence: Synthetic coding sequence
atgaacgtgggcaccgcccacagcgaggtgaaccccaacacccgggtgatgaatagtagaggaatctggctctcctacgttctggctataggcctgctgcacattgtgctcctgtcaatccccttcgtgtcagtgcctgtggtctggacactgacgaaccttattcataacatgggtatgtatatttttctgcacacagtcaaaggtacccctttcgaaacccccgaccaggggaaggccaggctactgacccactgggagcagatggattatggggtccagtttaccgcctcacgcaaatttctgacgataacacctattgtgttatactttttgacgagtttttacacaaaatacgaccagattcattttgtgctaaataccgtgtctctgatgagcgttcttatccctaagttacctcagctgcatggcgtgcgtatcttcggtatcaataagtactag

SEQ ID NO: 198229 - DNA, 1320 bp, Artificial Sequence
  Description of Artificial Sequence: Synthetic coding sequence
atgttcagcaagctggcccacctgcagcggttcgccgtgctgagccgcggggtgcattcttccgtggcttcagcgacgagcgttgccaccaagaaaacagtgcaaggaccaccgacatctgacgatatttttgagagagaatataaatacggcgcccacaattatcaccccctacccgtcgcactagagcgcggcaaaggcatctatctatgggacgtcgagggacggaagtacttcgactttctgtccagttactcagccgtcaaccagggacattgtcaccccaaaatcgtaaatgcgctgaaaagtcaggtggacaagctcacactgactagccgtgctttctacaacaatgtgcttggcgagtatgaagaatatattacaaaattgtttaactaccacaaggtcctgcccatgaacaccggtgtggaagccggggagacagcctgtaagctggcgaggaagtggggatacacagtcaaggggattcagaagtacaaagcaaagatcgtatttgcagctggtaacttctggggacgaacactgagcgccatcagcagctctaccgatcccacctcttatgacggatttggtcccttcatgccgggcttcgacattattccatataacgacttaccagctctggaacgcgcactgcaggacccaaacgtggcagcgtttatggtggagccgatacaaggcgaagccggtgtggtagtccccgatcccggataccttatgggcgtaagagagctatgtacgaggcaccaagtgttgttcatcgcagacgaaattcagaccgggctggcccgtaccggccgctggttggccgtcgattatgaaaacgttcggcccgacattgtccttctgggaaaagccttaagcggcgggttatatcccgtctctgcagtactgtgcgacgacgatattatgcttacaatcaagcctggggagcacggctctacatacggcggcaacccactgggatgtcgggtcgctattgcagctctggaagttctggaagaggagaacctggccgaaaatgccgataaattgggtattatccttcgcaatgaattgatgaagctacccagcgatgttgtgactgcagtgcgcgggaaaggtcttttgaacgcgatagtgataaaggaaacaaaggattgggacgcctggaaagtgtgccttaggctaagggacaatggcctgctggccaaacccacccatggcgatatcatacgcttcgcaccacccctggtcattaaggaggacgaactccgggagtccatcgagatcatcaacaaaacaattctctcattctag

SEQ ID NO: 198230 - DNA, 906 bp, Artificial Sequence
  Description of Artificial Sequence: Synthetic coding sequence
atgaacaccggcgtggaggccggcgagaccgcctgcaagctggcccgtaagtggggttacaccgtgaaaggaattcaaaagtacaaagctaagattgtatttgcagctgggaatttctggggcaggacgctatctgctatttccagcagtacagaccctactagttatgatgggttcggcccgtttatgcctggattcgacatcataccttataacgacctgccagctctcgaacgcgctctgcaggatcctaatgtggctgccttcatggtggagccgatacagggcgaggctggagtggttgttcccgaccctggttacctcatgggagtccgcgagctgtgcaccagacaccaggtgctgttcatcgcagacgaaatccagacaggactcgcccgcacaggccgatggctggccgtggactatgagaatgttaggcccgatattgtcttactgggtaaagcactgtccggtgggctgtatccagtctctgccgttctgtgcgatgacgatatcatgctcacaatcaaacccggcgagcatgggtcaacatacggcgggaacccactggggtgcagggtcgcaatcgcagctcttgaagttttagaggaggaaaatctggccgagaatgctgataaactagggatcattctccgcaacgagctaatgaagctgccaagtgatgtggtaactgccgtgcgtggaaagggattactcaacgccatcgtcattaaagaaacaaaggactgggacgcttggaaagtttgcttgagactgagagacaacgggttacttgccaagcctacacatggggatataatccgattcgccccacccctggttatcaaagaagatgaactccgagaatctattgagatcattaataagactatcctgtctttctag

SEQ ID NO: 198231 - DNA, 405 bp, Artificial Sequence
  Description of Artificial Sequence: Synthetic coding sequence
atgaaggccttcagccccgtgcggagcgtgcggaagaacagcctgtcagatcattcattagggataagccgctctaaaactcctgttgatgacccaatgagcctcctttacaacatgaatgattgctattcaaagctgaaagaattagtgcctagtattccacagaataaaaaggttagtaaaatggagatcctgcaacatgtcattgattacatactggaccttcagattgctttagactcacatccaacgatagtatccttgcaccatcagcgtccaggccagaatcaggcatccagaaccccattaacaaccttaaacactgatattagcatccttagtctacaggcctccgaatttccaagcgaacttatgagcaatgactccaaagcattgtgtggttag

SEQ ID NO: 198232 - DNA, 1386 bp, Artificial Sequence
  Description of Artificial Sequence: Synthetic coding sequence
atgaacaacttcggcaacgaggagttcgactgccacttcctggacgaggggttcacggctaaggacatcctggaccagaaaatcaacgaagtgagttccagcgatgataaggacgctttttacgtggctgaccttggcgacattttaaaaaaacacttacgatggctgaaagcgctcccacgggtgaccccgttctatgccgtgaaatgtaatgacagtaaggctatcgtaaagacgcttgcagcaaccggcaccgggtttgactgcgctagcaagactgaaatccagcttgttcagagcctgggagtccctcctgagagaatcatttacgccaacccatgcaaacaggtgagtcagatcaaatatgcagcgaacaacggggtacagatgatgacttttgactccgaagtggagctgatgaaggtggcaagggcccacccaaaagccaaactggtcctcagaatagcgactgacgatagcaaggcagtgtgcagattgagtgtcaagtttggagccaccctgagaacaagtcgtttgctactcgagagggctaaagagcttaatatcgatgtggtgggggttagttttcacgtgggaagcggatgcacagaccccgagacattcgtacaggccatttccgatgcaaggtgtgtgttcgacatgggggcagaagtgggcttcagtatgtatctgcttgacatcggcggaggatttcccggctccgaagatgttaaattgaagttcgaagaaatcactggggtaatcaatcctgcgctcgacaagtacttcccgtctgatagtggcgtccggatcatcgcagagcccggcagatattatgtagcgtcggcctttacccttgcggtgaatatcatcgcaaaaaaaatcgttcttaaagaacagacaggatcggacgacgaggacgagtccagcgagcagacctttatgtactacgtgaacgacggcgtgtatggctctttcaattgtatcctgtacgatcacgcccacgtcaaacccctgctgcaaaaaagacctaagccggacgagaaatactattcaagctctatttgggggcccacctgcgacgggctcgacaggatagtggaaagatgcgacctaccagagatgcacgtaggggactggatgctgttcgagaacatgggagcttacacagtcgcggccgcgagcactttcaacggctttcaacgcccaacaatctattatgtgatgtccgggcccgcctggcagctgatgcagcagtttcagaatcccgactttccaccggaggtagaggaacaggacgcttcaaccttgccagtatcctgtgcctgggaaagcggcatgaagagacatcgcgctgcgtgtgcatctgccagcattaacgtatag

SEQ ID NO: 198233 - DNA, 207 bp, Artificial Sequence
  Description of Artificial Sequence: Synthetic coding sequence
atgaacaacttcggcaacgaggagttcgactgccacttcctggacgaaggatttacagccaaggatatcctggatcagaaaatcaatgaggtatcgtcctccgatgataaagatgcattctacgtcgctgacctaggggacatcctgaagaagcatctgaggtggctgaaggccctccctagggttacgcccttctatgctgtttag

SEQ ID NO: 198234 - DNA, 927 bp, Artificial Sequence
  Description of Artificial Sequence: Synthetic coding sequence
atgatgaccttcgacagcgaggtggagctgatgaaggtggcccgggcgcaccctaaagccaagttagtgctgagaattgcaacagacgattccaaggccgtttgcagactgtcggtgaaatttggagctactcttcggacttccaggctccttcttgagagagctaaggaattgaacattgacgttgtgggagtgagtttccacgtgggctctggttgcacagatcctgagacttttgtacaggctatttcagatgccaggtgcgtttttgatatgggagccgaggttggcttctctatgtacctgttggatattgggggcggatttcccgggtccgaggatgtgaagctgaagtttgaggaaatcacgggagtaattaatcctgcccttgacaagtacttcccttccgactcaggcgttcggattatcgccgagccgggacgctactacgtggcttccgcattcacacttgctgtaaacatcattgctaaaaaaattgtcctaaaagagcagaccggtagtgacgatgaggatgagtccagcgagcagacattcatgtactatgttaacgacggagtatacggatccttcaattgcatcctttacgaccacgctcatgtcaaaccgcttttgcagaaaagacctaagcccgatgagaagtattattcttcaagcatttggggccccacctgtgacgggttagacaggatcgtggagcgatgcgatctgcccgagatgcatgttggcgactggatgttattcgagaatatgggcgcttatacagtggcggcagcaagtacatttaacggatttcagaggcccactatatattatgtgatgtctggccctgcctggcagctgatgcagcagttccaaaaccccgactttcctccctgtttgtgccttgtgccgggtcgcgtggggtag

SEQ ID NO: 198235 - DNA, 684 bp, Artificial Sequence
  Description of Artificial Sequence: Synthetic coding sequence
atggtgaagagcagcctgcagcggatcctgaacagccactgcttcgctcgggagaaggaaggggataaacctagcgccacaattcacgcctcccgcaccatgcccttgttatcccttcacagccggggtgggtccagcagtgagtcgtctagagtgagtcttcactgttgtagtaaccccggaccagggccgaggtggtgtgatgctcctcacccccccctgaagatccccggaggcagggggaattctcagagagatcataacttgtctgcaaacctcttttactctgacgatcgtctgaatgtcacagaggaattgaccagtaatgacaagacgcggatcttaaacgtgcagagccggttgaccgatgctaagcgtattaactggaggacagtgctcagcggcggcagcctctatattgagatccctggcggtgcactccccgaagggagcaaagactcttttgcagttctgcttgagtttgccgaagaacagctgcgcgctgaccacgtctttatctgcttccacaaaaatcgcgaggatcgcgccgcgctcctcaggacattttctttccttggatttgagatagtccggcccggccaccctttagtgccgaaaagacccgatgcttgtttcatggcctacaccttcgaaagggaaagctccggagaggaggaggagtag

SEQ ID NO: 198236 - DNA, 831 bp, Artificial Sequence
  Description of Artificial Sequence: Synthetic coding sequence
atgtggatcaccagcctgatcaccatgaaggacgaggacatcttcgacttagctggcgaccctcaggatagcctgatccccgggccaagtcccacgccaaagcagaatcccgtgtgcaatgaagcctttttcggccatcaaactttctccctgcgggaaactggcctgaagtcggttcactgccagggccaggaggccgagaatatggagcgtgagaagttccagcagaaggccctcaagcagacgaagcagaagaagtccaagtcagctgaatttctcatggtgaaagaggacagagaggcaactgagggcaccggcaaccctgccttcaatatgtcttcccccgacctgtccgcatgtcagacagccgagaaaaaagtgataagacacgacatgcctgatcgtacgcttgccgcccatcagcagaagtttagactcccagccagcgctgagccgaaggggaatgagtacggcaggaactacttcgacccactaatggacgaagaaataaatccacgtcagtgcgcaactgaggtgtcacgggaagacgagtcagggagagaggaaacgttaaatagcgaggcacccggctctagcaacaagagccatgaaattcacaaggaagcgtcagaagccacaaccgctcatttggaagagtttcagagaagccagaaaacgataatcctgttaggttcgagccccctggagcaggagattcgtagtacatccctgcactgcatggaggacgaaatgtcacatccctggatcctgctcttgaaagttaccgccgttatacgcagtaggcgctattacagggaacagagattttag

SEQ ID NO: 198237 - DNA, 1443 bp, Artificial Sequence
  Description of Artificial Sequence: Synthetic coding sequence
atggagcgggagaagttccagcagaaggccctgaagcagaccaagcagaaaaaaagcaagtccgctgaattccttatggttaaggaggatcgtgaggcgaccgagggaacaggtaaccccgccttcaatatgagtagcccagacctttccgcctgtcagaccgccgaaaagaaagtgatccgacacgatatgcctgaccgtactcttgccgcacaccaacaaaaatttcggcttccagcctccgcagagccaaaggggaatgagtacggtcgcaattacttcgatcctctgatggacgaagaaatcaaccctcgccaatgcgcaacagaggtctcgagggaggtctgcttgatggccaagggggaaaaggctgaatcgggggtcgataacaccgcagggctgagtgagaaggagactcagaagaaccctcgcgcacctatggatgaagcagacgtaaagagcgcggcccacagctcacaaggatccattccgaaaaagattggcccctgtagcatggactacgatccaaatctactggaagaagacgacgaactgcactcgcagggggactctttaacagaccattcagtgaagggcaagtctaccgtatggcggataggagaagctgaggattacagtcaggatattagttaccttgaggagctggaagagcaccgcttttctgtgtgctgctcctccgtggcggacagccggtacggcgattttttcaagcacctgcactttgtgctggtatcagccagcagtgaactccagctgtcccagtggcagtcccagggcttctggtatatcatcctgctgatgttcttcctgtggtttcttaggctctacctgcactatctgggccaatggttgtttctgcaagctatcagcacccccgtcaccaagttccatttctcgctgcacatagtggagctgtgttacccaaccagtagcctgcacattggcgaggaactgccagtggtagtgatgggccccctaatgctcaatgctattctactgctgctggtcctgattagatgggggtgccagctcctgtttgcaagctgtcccgatgtgttgtcaaagctgatcatcacaatggggctgtggaccatcctggatcctctggccgtcttcattctagacacgcttttgggacggcttacagacaacgaggaaacaccagtggcagacgcagctaaactgtattggatgttcgttcgcactgtgcagcctgggatccttggcgtcgtcatcactgtgctgctatacattctccttttcgtcatctcaagcctgattctctacctgtattgccttaggctgcacaacgatagttggatcctggacgcgttccaacgtatacactctgaggagacaaaattcttcatcccatacgacctggagatcagcaaccaagagctctcgtatatcgtgaagtag

SEQ ID NO: 198238 - DNA, 606 bp, Artificial Sequence
  Description of Artificial Sequence: Synthetic coding sequence
atggccctgagctgggtgctgaccgtgctgagcctgctgcccctgttggaagcacagattcccttgtgcgctaacttggtgccagtccccattactaatgctaccctggacagaatcacaggaaagtggttctacattgcctctgctttcagaaatgaggagtacaacaaaagcgttcaggaaatccaggcgacctttttctactttacaccgaataagacagaggacacaatttttctccgcgaataccaaacaagacaggaccaatgcatctataataccacttacctgaacgtgcagagagagaacggcaccatctccaggtatgtgggtggccaggaacacttcgcgcacctgctgatccttagggacactaagacctacatgctggcctttgacgtgaatgacgagaaaaattggggactcagcgtctacgcagacaagcccgaaaccacaaaggaacaattgggtgagttttacgaagccctcgattgtctgagaattcctaagagtgatgtggtctatacagactggaagaaagacaagtgcgaacctttagagaaacagcacgagaaagaaagaaagcaggaggaaggcgaatcctag

SEQ ID NO: 198239 - DNA, 585 bp, Artificial Sequence
  Description of Artificial Sequence: Synthetic coding sequence
atggccctgagctgggtgctgaccgtgctgagcctgctgcccctgcttgaggcacagattccactgtgcgccaatcttgtccctgtgcctatcacaaacgccacactggaccgggttagtgcatgggcatctcctgtgctcagtacttgggctgctgccagcctactctgggcctcgctcagcctcctcgctgtggtgggtcccccactgcctgctctaccgttctctctactgggaccccagggtgaaatcctgaccagcccaggtgatagcggcggcaccccatgcctgcagacccagaagccccattgcagggtgctgcatggcggtcgcttttgtgctggccctgggggcgccgcctggggcgccatgacggatccacagggtgaactgttgcatgctcattgtcccccgggagcatcctcacctcacctgcaaaatcagggagagatttgcctcagtctgttgccagccgatagtcagagattcagcattaagccgccttcccccgcaccaaccttcagtcccgaccattggcaggtggtgctgtatcggatcgggctgtcgaagcgaggagtccagtag

SEQ ID NO: 198240 - DNA, 585 bp, Artificial Sequence
  Description of Artificial Sequence: Synthetic coding sequence
atggccctgagctgggtgctgaccgtgctgagcctgctgcccctgctggaggcgcaaatccctctctgtgccaacctcgtcccggtcccaattacaaacgcaactcttgatagggtgtccgcctgggcctccccagttctgtccacctgggcagccgcctccctactgtgggcttccttatacctgctggccgtggtagcgcctcctctccccgccctgccatttagcctcttgggcccgcagggcgagatcctgacaagtcccggggacagcgggggaactccctgtctgcagacacaaaagccacactgccgagtcctgcacggaggacggttttgtgctggacctggaggtgcggcctggggggccatgaccgacccacaaggagaactgttgcatgctcactgtccaccaggagccagcagtcctcacttacagaaccagggtgaaatatgtctgagccttctgccagctgactctcaacgattcagcatcaagcccccttctccagccccccccttttcccccgatcattggcaggtagttctctaccgcatcggcttaagtaagagaggagtgcaatag

SEQ ID NO: 198241 - DNA, 606 bp, Artificial Sequence
  Description of Artificial Sequence: Synthetic coding sequence
atggccctgagctgggtgctgaccgtgctgagcctgctgcccctgttggaggcacagatccctttatgcgctaatctggtaccagtaccgattacgaatgccaccctagatcggatcaccggcaagtggttctatatcgccagcgcttttcgcaacgaggagtacaataagtctgtccaagagatacaggccacttttttttattttacccccaataagactgaggacacaatattcctgcgtgagtatcagacccgccaaaaccaatgcttttacaactccagctacttgaacgttcagcgcgagaatggcactgttagccggtacgaaggcggcagagagcacgttgcgcacctgctcttcctgagagatactaaaacccttatgttcggatcctatctggacgatgagaaaaactgggggttgtccttttacgccgacaagcctgagacaaccaaggagcaactgggcgagttctacgaggccctggactgcttgtgtatcccacgcagtgacgtgatgtacactgattggaaaaaggataagtgcgaaccactggagaagcagcacgaaaaggagcggaaacaagaggaaggcgaatcgtag

SEQ ID NO: 198242 - DNA, 1065 bp, Artificial Sequence
  Description of Artificial Sequence: Synthetic coding sequence
atgatgagctacctgaagcagcccccctacggcatgaacggcctgggattggctggtcctgccatggatctgctgcatcctagtgtgggttaccctgccaccccaagaaagcagcgacgggagagaaccacgtttacccggagccagttggatgttttagaggcactgttcgccaaaacccggtaccccgacatcttcatgcgggaagaagtagcactaaaaatcaatctgcccgaatctcgcgtgcaagtctggtttaaaaataggcgggctaagtgtaggcaacagcaacagagcggttcgggaactaaatccagaccggccaagaagaagagtagccccgtgcgtgaatcaagtggatcagaatcttcaggacagtttacgccgccggcggtcagtagcagcgcctcgtcctcttcctctgcctcctcatcttccgcaaatccagccgccgctgccgcagccggactgggcgggaatcccgtggcggccgcttcttccctcagcacgccagctgccagttctatatggagcccagccagcatttcaccaggctccgcacctgcttccgtgtcagtccctgagcctctcgcagccccatccaatacgagttgcatgcaaaggtctgtggctgctggtgctgccacggccgcggcatcatacccaatgagctatgggcaggggggaagttacggccagggttaccctaccccctcctcgagctattttggcggcgtggactgttccagttatctggctcccatgcacagccaccaccatcctcaccagctgtcacccatggctccgtcttctatggcaggtcaccaccaccaccacccacacgcccaccacccccttagccagtccagcggccatcatcaccatcaccaccatcatcatcatcaaggctacggtggctcaggcttggcttttaactccgccgattgcctggactataaggagcctggagcagcagcagctagctccgcttggaagctgaactttaactccccagattgcttggattacaaggaccaagcatcatggcggttccaggtgctgtag

SEQ ID NO: 198243 - DNA, 1065 bp, Artificial Sequence
  Description of Artificial Sequence: Synthetic coding sequence
atgatgagctacctgaagcagcccccctacggcatgaacggcctgggcttggcaggcccagcgatggacctgctccaccccagcgttgggtatcccgccacgcccagaaagcagcgtagagagcgaaccaccttcacaagatcacagctggatgtgctggaagccctgttcgcaaaaaccagataccccgatatctttatgcgtgaggaagtcgccctcaaaattaatttgccggagtcccgcgtgcaagtctggtttaagaataggcgggccaaatgcagacagcagcaacagtccggttccggtaccaaaagcagaccagccaaaaaaaaaagcagccctgtgagggagagcagcggatctgagagctccggccaatttacacctcctgcagtttcttcatctgcatctagttcctcatccgcaagtagctcatcagcaaatcctgctgccgcagccgctgcgggcctcggcggaaaccccgtcgcggccgcgagttcattgagtacacccgctgcgtcaagcatttggagtcctgccagtatctcaccaggctctgcgccagctagtgtgtcagtccccgagcccctggcggccccatcaaatactagctgcatgcagaggagcgttgccgccggagctgccactgctgctgccagctacccaatgtcctacggacaaggaggatcctatggccaaggctatccgacgcctagttctagttatttcggaggtgtggattgctcctcatatctcgcaccaatgcattctcatcaccacccccaccagctttcgccaatggcgccaagcagtatggccgggcaccaccatcatcaccctcatgcgcaccatcctctcagccagtcctccgggcatcatcaccaccaccaccatcaccatcaccaaggttatggcggatctgggctggctttcaactctgcagattgtctggactacaaggaacccggggcagctgcagcaagcagtgcctggaagctcaacttcaatagtcctgattgtctggattacaaagatcaagcatcttggaggttccaggtgctatag

SEQ ID NO: 198244 - DNA, 894 bp, Artificial Sequence
  Description of Artificial Sequence: Synthetic coding sequence
atgatgagctacctgaagcagcccccctacgccgtgaacggcctgagcctcacaacgtcaggcatggatctgctgcacccaagcgttggctacccaggaccgtgggcttcctgtcctgccgctaccccaaggaagcaacggcgagaacgaacaacattcacaagggcgcaactggacgttctggaagctttattcgccaagaccagatatcccgacatctttatgagagaggaggtagctctgaagatcaatctgcccgaaagtcgggtccaggtctggttcaagaacagacgggctaaatgtagacagcagcagcagcaacagcagaatggcgggcagaacaaagtccgcccagcaaagaaaaaaacctcccctgctagggaggtgtccagcgagagcggcacaagcgggcagttcacccccccttcatctacgtctgttcctaccattgctagctcttcagctcctgttagcatctggtcccccgccagtatttccccactgtcagacccattgagcactagcagcagctgtatgcagcggtcctacccaatgacttacactcaggcatcaggctacagtcaggggtatgcgggcagtactagctatttcggtggcatggattgcgggtcttacctaacgcctatgcatcaccagttacccggacccggggctacgctgtcgcccatgggcactaatgcagttacaagtcacctgaatcagagccctgcttccttgtctacgcaggggtatggtgcatcctctcttggattcaattccaccacggactgtctcgattacaaggaccagaccgcctcctggaaactgaattttaacgcagactgcctggactacaaagaccagacgtcctcgtggaaattccaggtgctctag

SEQ ID NO: 198245 - DNA, 870 bp, Artificial Sequence
  Description of Artificial Sequence: Synthetic coding sequence
atgatgagctacctgaagcagcccccctacgccgtgaacggcctgagtctgacaacatctggaatggacttgctgcatcctagcgtcgggtacccagcaactccacgcaagcagcgtcgggagcgcactaccttcactagagcccagttggatgtgctggaagcacttttcgccaaaacccgttatcctgacatttttatgagggaggaggttgctctgaaaatcaatctcccagaatcacgcgttcaagtctggtttaagaatcgtagagcaaagtgtcgccagcagcaacaacaacagcagaacggcggacagaataaagtgcggcccgctaagaaaaagacaagccctgccagggaggtatcaagtgagtccgggacaagcggacagttcacgccccccagctctacctctgtgcctaccatcgcaagttcctccgccccagtcagtatctggtctcccgctagcatcagccctctctccgaccctctgtccacctcttcatcctgtatgcaaagaagttacccgatgacgtacacacaggcttccggttactcccagggctatgccggttccacttcttacttcggcggcatggactgtggctcctatctgactccgatgcatcatcagctcccaggccccggggctacactgtctccaatgggaacgaatgctgtcacgtcccatctgaaccagtcgccggcctcgctgtctacccagggatacggcgcaagcagcctggggttcaattcaaccacagactgtctggattataaagatcagacagcatcctggaagttgaattttaacgccgattgtctggattacaaagatcagacctcctcttggaagtttcaagtactttag

SEQ ID NO: 198246 - DNA, 720 bp, Artificial Sequence
  Description of Artificial Sequence: Synthetic coding sequence
atgatgagctacctgaagcagcccccctacgccgtgaacggcctgagtttaaccacatccggcatggaccttctccatccctcagttgggtaccccggcccgtgggccagctgcccagctgcaactccgcgcaagcaacggcgggagcgaacaaccttcaccagagcccagttagatgtgctggaggcgctgttcgctaaaaccaggtaccctgatatatttatgcgtgaggaagttgccttgaaaataaatcttcctgagtcccgggttcaggtgtggtttaaaaatcgtcgggcgaagtgcagacagcaacaacagcagcagcagaacggcgggcagaacaaagtgcgtccggctaaaaaaaaaacgagcccagctcgggaagtttcttcagagtccggtacaagtggccagttcacccccccttcgtccacctcagtgccgactatcgctagcagttccgcgccagtttccatctggagcccagctagtatttcaccattgagcgaccccctctctacttcgagtagctgcatgcaacggtcatatcccatgacgtatacccaggcatccggatacagccagggctatgccggtagcaccagctacttcggaggtatggattgcggcagctatttaactccaatgcatcatcaacttcctggtccgggtgcaaccctctcacccatgggcacaaatgctgtgacctcacatctgtag

SEQ ID NO: 198247 - DNA, 870 bp, Artificial Sequence
  Description of Artificial Sequence: Synthetic coding sequence
atgatgagctacctgaagcagcccccctacgccgtgaacggcctgtcactgaccacctccggcatggacctgcttcacccgtctgtcggctacccagctaccccacgcaaacagcggcgagagaggaccaccttcacaagggctcagctggacgtgctcgaagccctgttcgcaaagacacgctacccagacatcttcatgcgcgaggaagtcgccctgaagattaacttgcccgaatcccgtgtgcaggtctggttcaaaaacaggcgcgccaagtgccggcagcaacagcagcaacagcagaatgggggccaaaataaagtcaggccagctaaaaagaaaacttccccagcaagggaagtcagctcggaatcaggaacaagtgggcagttcacacccccatccagcacctcagttcctacaatagctagttccagcgccccagtgtcaatatggtccccagcctcaatctcgcccttgagcgatccactctccacgtcatcatcctgcatgcagcgatcctaccctatgacctacactcaggccagcggatatagccaaggatatgcagggtccacgagctacttcggcggcatggactgtgggtcttatctgacgcccatgcaccaccagctgccaggacccggcgccaccctctcacccatgggcacgaatgctgttacatctcacctgaaccaatcccctgcatctttaagcactcagggttatggagcttcaagcctgggatttaattctacaactgattgtcttgattacaaagaccagactgcgtcatggaagctgaatttcaacgctgactgtcttgattacaaggaccagacaagcagttggaagttccaggtcctgtag

SEQ ID NO: 198248 - DNA, 492 bp, Artificial Sequence
  Description of Artificial Sequence: Synthetic coding sequence
atgatgagctacctgaagcagcccccctacgccgtgaacggcctgtcgttaacgacctctggcatggacctgttgcacccgtccgtcggctatccggctacaccgcgcaaacagagacgggagcgcaccacgttcacccgcgcacaactggatgtgctggaagccctgttcgctaagactagataccctgatattttcatgcgcgaggaagttgcactgaaaatcaatctgccagaatctcgggtgcaggtctggttcaaaaatcggagggccaaatgtaggcaacagcaacagcagcagcagaacggcggccaaaataaggtgcggcctgctaagaaaaaaaccagcccagcaagagaagtcagctcggaatcagggacctcgggacagtttactccacctagcagtaccagtgtccctaccatagcttcttcctcggcccccgtctccatttggtcacctgccagcattagccctctgagcgatccctag

SEQ ID NO: 198249 - DNA, 978 bp, Artificial Sequence
  Description of Artificial Sequence: Synthetic coding sequence
atgctgagccacgccgacctgctggacgcccggctgggcatgaaggacgcggctgagctcctgggtcatagggaggctgtcaaatgtcgcctgggagtgggaggttctgacccgggcggacaccctggcgatttggcacctaacagcgaccccgtggaaggggctacgctgttaccgggcgaggatataaccactgtggggtccaccccagcatcactagccgtgagtgcaaaagaccccgacaagcagccaggccctcaaggtggaccaaacccctcgcaggctggtcaacagcagggccagcaaaaacagaaaagacaccgaacacgctttactcccgcccagctcaatgagctagagagatcattcgctaagacccactatcctgatattttcatgcgagaggagttggccctccgtatcggtctgacggagagccgcgtgcaggtgtggttccagaataggagggctaagtggaaaaagaggaaaaagaccactaacgtgttccgggcaccaggcacactgctgcctaccccaggactcccccaatttccaagtgccgctgcagcagcagcggccgcgatgggtgatagtctgtgctctttccacgcgaacgacaccaggtgggctgctgccgccatgccaggggtaagtcagctccctttgcctccagcgctggggagacaacaggcgatggcacagtcccttagccagtgttcactggctgccggaccaccacctaacagcatgggtctgtcaaattccctggctggaagtaatggggcaggactccagtcacacctctatcaacccgcattcccaggtatggttccagcctccctcccaggtcctagcaacgtaagcggaagtccacaactctgcagttctccagattcgtccgatgtttggcggggaacatcaatcgcctccctccgaaggaaagccctggagcacactgtcagtatgagtttcacttag

SEQ ID NO: 198250 - DNA, 912 bp, Artificial Sequence
  Description of Artificial Sequence: Synthetic coding sequence
atgggcatcgtgcagatctgcaagggcgagtacttctggctggagcccaaaaatgcgttcgaaaactttcaggagcctgacattggattggtggcactggccttccttcaggggtccttcgcatacggagggtggaactttctcaattacgtcactgaggagctggtagacccttacaagaacctgccacgggctattttcatttcaattccgctggtgacttttgtatacgtgtttgccaatgtggcctatgtcactgctatgtcacctcaggagttgctcgcaagcaatgccgttgcagttacctttggagagaagctgctgggcgtgatggcatggattatgcccatttcagttgcacttagtacctttggaggcgtgaatggctcactgtttacaagctcacgcttgttcttcgctggcgcaagagagggccatttaccctcagtcctggccatgatccacgtcaagaggtgcacacctatacctgccctgttgttcacctgcatatcgactctgcttatgttggtgacatctgacatgtacacactgatcaactatgtgggcttcatcaactatctgttctacggcgtcacggtggccggccagattgtgctgcgttggaagaaaccggatataccccggcctattaaaatcaacctcttgttccctattatttatctcctcttctgggcttttttgctcgtgttcagcctatggtcggagcccgtcgtgtgcggcatcgggttggcgatcatgttgaccggtgtgcccgtttacttcttgggagtgtattggcaacacaaacccaaatgtttttcagattttatagaactattgaccctggtgagtcagaagatgtgcgtggttgtgtatccagaggtggagggtcttcgagacagagggggatag

SEQ ID NO: 198251 - DNA, 861 bp, Artificial Sequence
  Description of Artificial Sequence: Synthetic coding sequence
atggccctggtgctgatcctgcagctgctgaccctgtggcccctgtgccacacagacataacgccatccgttgctatcatcgtgccgccggctagctaccatcccaagccatggttaggcgcccagccagccacggtcgtgactccaggcgtgaacgtcacactgcgatgccgggctccccaacctgcctggcgttttggactgtttaagcccggagagatcgcgccgctccttttcagggatgtgagtagcgaacttgccgagttctttctggaggaagtgaccccagctcaaggcggaatttacaggtgctgctatagacggcccgactggggtccaggagtttggagccaaccatctgacgtcctggagctcttagtgaccgaggagttaccgcgccccagccttgtggcgcttcccgggccagtggtgggccccggggcaaatgtgtcgttaaggtgtgccggtcgactgcggaacatgagctttgtgttgtatagagaaggggtcgcggcccccttacagtaccgccattccgcacagccatgggcagatttcacactgctgggggctcgggcacctggcacgtactcatgttattatcacacccccagcgccccttatgttctttctcagaggtccgaagtcctggtaatatcatgggaaggcgagggcccagaggctagaccagcttcgagcgctcctggaatgcaggccccgggccccccccctagcgatcccggggctcaagcaccaagcctgagctcattcagaccaagaggcctggtgctgcaacccctgttgccgcagacacaggactcctgggatcccgccccaccccccagcgatccgggtgtgtag

SEQ ID NO: 198252 - DNA, 849 bp, Artificial Sequence
  Description of Artificial Sequence: Synthetic coding sequence
atggccctggtgctgatcctgcagctgctgaccctgtggcccctgtgtcataccgatattactccaagcgtcccacctgcttcataccatccgaagccctggctgggggcgcagccggccactgtggttactccaggcgttaacgttactctccggtgccgggctccccagcctgcttggcggtttggattattcaagcctggagagatagcacccttgctgttccgagacgttagctccgaacttgccgaattcttcctagaagaagtgacgcctgcccagggagggatctaccgctgttgctacagacgccccgactggggtcccggggtttggagccagccaagcgatgttctcgagctcctcgtaacagaagaattgccccgccccagcttagtggctttgccaggccccgtggtcggccctggggccaatgtctccttgcgctgcgccgggagactgcgaaatatgagtttcgttctctatagagaaggggtcgccgcccccttacaatatcggcactccgcccaaccatgggctgactttacactcttgggagccagagcacctggcacgtactcctgttactaccatacaccttcagctccatatgtcctgtcacagaggtctgaagtgttggtgatcagctgggagggcgagggacctgaggcaagacccgcaagcagtgcacctgggatgcaggcacctggacccccgccgagcgaccccggcgcccaggcgccatctctgagcagtttcaggccaaggggactcgttcttcagccgctactgccccagacccaggactcttgggacccggctccccctccttccgacccaggagtgtag

SEQ ID NO: 198253 - DNA, 759 bp, Artificial Sequence
  Description of Artificial Sequence: Synthetic coding sequence
atggccctggtgctgatcctgcagctgctgaccctgttcccccccgctagttaccaccccaaaccgtggcttggggcacagcccgcaaccgtcgttacacccggagttaacgttaccttgcgctgtcgcgcaccacagcccgcttggcggttcggattatttaagcccggggagatcgccccactgctcttccgcgacgtatcctccgaacttgctgagttctttctcgaagaagttacacctgcacaggggggcatctacaggtgttgctaccggcgtcctgactggggccccggggtgtggtcacagccatctgacgtcttggagcttctcgttactgaagagttgccgaggcccagcttagtcgccctccccggtcccgtggtggggcctggcgctaacgtcagcctgcgctgtgccggcagactaaggaacatgtcctttgtactttaccgcgaaggagttgccgcccccctacagtatagacatagtgcccagccctgggcggattttacattattaggggccagagctcccggtacatatagttgttactatcatacccccagtgcaccctatgtactgagtcaacggagcgaagttttggtcattagttgggaggactcaggatccagtgactatacacggggcaatctagtgcgtctagggcttgctggactagtactgatctcattaggggcactcgtgacctttgactggagatctcaaaaccgcgctccagccgggatccgaccgtag

SEQ ID NO: 198254 - DNA, 804 bp, Artificial Sequence
  Description of Artificial Sequence: Synthetic coding sequence
atggccctggtgctgatcctgcagctgctgaccctgtggcccctgtgccatacagatattaccccatccgttgccataattgtgccccctgcttcataccaccctaaaccgtggctcggcgctcaaccagcgaccgtggtcacaccgggggttaacgttaccttgagatgccgggccccccagcctgcctggcgatttggtctgttcaagccaggagagatagcaccccttttgttccgagacgtgtcctctgaactggccgagtttttcctggaggaagtgactcctgctcaggggggcatttataggtgctgctacaggaggcccgactgggggcctggggtttggtcacaaccatccgacgtgctggaactccttgttacagaggaactaccacgtcctagtctggtggctctgcctggaccggtggtgggtcccggggctaatgtgtccttaaggtgtgcaggccggttgagaaacatgtcattcgttctctatcgagagggggtggccgcacctcttcagtatcgacactctgcacagccctgggccgactttaccctgctaggcgccagagcccctggtacttatagttgctactatcacaccccctccgccccgtatgttcttagtcagcgaagtgaggttttagttattagctgggaagattccggctcctctgattacacccgaggaaatctcgtccgcctgggcctagcagggctcgtgcttatctctttgggtgcactggtgacttttgattggaggtcccagaaccgggcgccagccggtattcgcccatag

SEQ ID NO: 198255 - DNA, 792 bp, Artificial Sequence
  Description of Artificial Sequence: Synthetic coding sequence
atggccctggtgctgatcctgcagctgctgaccctgtggcccctgtgccataccgacattacaccttctgtacctcctgccagctatcaccctaagccttggctgggcgcacaacctgcaaccgtggtgacccccggggtgaatgtgacgctccgttgccgggccccgcagcccgcatggcgattcggcctgtttaagcccggcgaaattgcccctttactgttcagggacgtgtcaagcgagctggccgaattttttctggaggaggtcacccccgctcagggcggtatttaccgatgttgttaccgccggcctgattggggcccaggtgtgtggtcacagccttcggacgtgctcgagctgctggtgactgaggagcttcccaggcccagccttgtggcactgcctggacctgtggtcgggcccggtgcaaatgtttcactgcgttgcgcaggacggttgaggaacatgtcattcgttctctacagagaaggtgttgcagccccactccaatataggcactcagctcagccttgggctgacttcacccttctcggagccagggccccgggtacgtatagctgctactaccacactcccagtgcaccatacgtcttatcacagcgcagcgaggtactggtcatttcctgggaagattccggtagctcagattacactaggggcaacctcgtaaggttgggcctcgccggccttgtccttataagtttgggggctctggtaacatttgactggaggtctcagaatcgagctccagccggcatacgaccgtag

SEQ ID NO: 198256 - DNA, 645 bp, Artificial Sequence
  Description of Artificial Sequence: Synthetic coding sequence
atgagcaagcccccccccaagcccgtgaagcccggccaggtgaaggtgttccgggccctgtatacatttgagccaagaacacccgacgaactttactttgaagaaggagatatcatatacataactgacatgtccgacacaaattggtggaaaggcacatcaaagggtaggaccggtttgattccttctaattatgtggctgagcaggccgaaagcatcgataacccactgcacgaggcggccaagagggggaatctctcttggcttagggaatgcctcgataacagagtaggggtcaatggacttgataaggcaggatcaactgccctctactgggcctgccacggagggcacaaggatattgtggaaatgttattcactcagccaaacatcgagttgaaccaacagaacaagctgggagacactgctttgcacgcggccgcttggaagggctatgctgatattgtgcaactcctgctcgctaagggcgctagaaccgatctgcggaatattgagaagaaactggcctttgatatggccaccaatgccgcttgcgcgtcgctgctgaaaaagaaacaaggaacagacgctgtgcggacattaagtaatgctgaagactacctggacgacgaggacagcgactag

SEQ ID NO: 198257 - DNA, 897 bp, Artificial Sequence
  Description of Artificial Sequence: Synthetic coding sequence
atgaagaccctgcagagcaccctgctgctgctgctgctggtgcccctcataaagcccgcacctccaactcagcaggattcccgtattatctacgactacggtactgataatttcgaggaatccatcttctcgcaagattacgaagacaagtacctggacggaaaaaatatcaaagaaaaagaaacagtcataatcccgaacgagaaaagtctccaactacaaaaagacgaggctatcacccccttgccgcccaagaaggaaaacgacgagatgccaacctgtctgctgtgcgtctgtttatccggcagtgtgtattgtgaggaagttgatatagatgcagtgccacctctgccaaaagaaagtgcctacctgtatgcgagattcaataagatcaagaaactgaccgccaaagatttcgccgacattccaaatctgagaaggctggactttaccggtaaccttattgaagacattgaggatggcactttcagcaagctttccctgctcgaggaactgtcattagcagagaatcagctcttaaaacttccggtgctgccccctaagctgaccctgtttaacgccaaatacaacaaaatcaaatcacgaggaatcaaagccaacgccttcaagaagcttaacaatctgactttcttatatctcgatcataacgctctggaatccgtgccattgaatctgcccgagagtcttagggtcattcatttacaattcaataacatagcctccatcacagatgacacattttgtaaggcaaacgatacatcttatattagggaccggatagaggaaatccggttagagggcaaccccatagtcttaggaaaacacccaaattcctttatctgtctgaagagacttccgatcggtagctatttttag

SEQ ID NO: 198258 - DNA, 897 bp, Artificial Sequence
  Description of Artificial Sequence: Synthetic coding sequence
atgaagaccctgcagagcaccctgctgctgctgctgctggtgcccttaattaaaccagcccccccgacccagcaagatagcaggatcatctatgactacggtaccgataatttcgaagagagtatattctcccaggattatgaagacaagtatctggacggaaagaatataaaagagaaagagactgtgattattcctaatgaaaaatctttgcagctgcagaaggacgaagctataaccccgctgcctcctaaaaaagaaaacgacgaaatgccaacttgtttactttgtgtttgcctttccggttcggtttactgcgaggaagtggacatcgacgccgttccgcctctgccaaaggagtctgcctatctgtacgcccgctttaacaagattaaaaaactcaccgccaaggatttcgcggacattccgaatctccggcggctcgattttactggcaaccttattgaggatattgaagacggtacatttagcaaactaagtctgctggaagagctgtcactggcagagaatcagctgctgaagctgcctgtgctgccccctaaattaacactgttcaacgccaaatacaataagatcaagtcgaggggaattaaggccaacgcgtttaaaaagctgaacaacttaaccttcctgtatctggatcacaatgccctggagagcgtgcctctgaacctgcccgagtctctcagagtgattcaccttcagtttaacaatatcgctagcatcaccgacgatacattttgcaaggccaatgataccagttacatcagagaccgcattgaggagattagactggaaggcaaccctatagtgctggggaagcaccctaattcattcatctgtctaaaacggcttccaatcggctcgtacttttag

SEQ ID NO: 198259 - DNA, 807 bp, Artificial Sequence
  Description of Artificial Sequence: Synthetic coding sequence
atgctggccaagatcagcaccacctggaagctgttcctgaagctgctgggccctgagattctgctgagttcgctcaagtcacgccattcgttttcacactcgccaagtcatttaggcctcatgcaccggcacgaacatctgctccgcaagactactaagaatttcaagaccgctaccacaaccctgcagagcacattgttactactgctgcttgttccactgattaaaccagctccacccacccagcaagactcccgaatcatctacgactacgggacagataacttcgaagaaagcattttcagtcaggactatgaggataaatatctggacggcaaaaatattaaggagaaagagacagttattatccctaatgagaaatctttgcagctgcagaaggatgaggcaataacgcctcttccgcctaagaaagagaatgacgaaatgcctacctgtctgttgtgtgtatgtctgtccggctcggtgtattgcgaagaggtcgatatcgacgccgtcccgccgctgcctaaagaaagtgcgtacttatacgcacgcttcaataagatcaaaaagctgacagcaaaagactttgctgatatccctaacctgaggagactggattttacagggaatctaatcgaggatattgaggatgggacattcagcaaactgtccctcctcgaagagctgagcttggccgaaaaccaactgctcaagctgcccgtgctcccaccgaagctgacccttttcaacgcaaagtataataagataaaatctcggggcatcaaggcgaacgcttttaagtag

SEQ ID NO: 198260 - DNA, 1842 bp, Artificial Sequence
  Description of Artificial Sequence: Synthetic coding sequence
atggccgccgagaccctgctgagcagcctgctgggcctgctgctgctgggtctcctactgcctgcaagtttgaccggcggcgtcggtagcctgaacctcgaggagctaagcgaaatgagatatggcatcgaaatactgccacttccggtgatgggggggcagagtcaaagttcagatgtcgtaattgttagctccaagtacaagcaacgatatgagtgtcgtctgcccgccggcgcgattcattttcagcgcgaaagagaagaagagacacctgcttaccaaggccccggtattccggaactactcagtccaatgcgtgatgccccatgcctcctcaaaactaaggattggtggacatacgaattttgttacggacggcatatccagcaatatcacatggaagactcagagatcaaaggcgaggttctgtatcttggctactaccagtccgcttttgattgggatgatgagactgccaaggcttcaaaacagcatagattaaagagatatcattcccaaacctacggtaatggtagtaagtgcgatctgaatggacgaccgcgcgaggccgaagtccgatttctgtgcgacgaaggtgccggtataagcggtgactatatagaccgagtggacgaacccctgtcatgtagttacgtgctcacaattcgtacccccaggctttgtccacatcctctgttaaggccccctccgtccgccgcaccacaggccatcttgtgccacccgagccttcagcctgaggagtacatggcgtacgtgcaacggcaggccgtagactctaaacagtacggtgataaaatcatcgaggaactgcaggaccttggacctcaggtctggtccgaaacgaaatctggcgtggccccccagaaaatggccggcgctagccctactaaggatgatagcaaagactcggatttctggaagatgttaaacgaaccggaagaccaggcccccggcggcgaggaagtccccgccgaggagcaagatccctcaccagaagcagccgactccgcctccggtgcacccaatgattttcaaaataacgtgcaggtcaaggtgatccgttctccagctgatcttataagattcatcgaagagctgaagggtgggaccaagaagggcaagccgaacatcggccaggagcaaccagtggatgatgcagccgaggtaccgcagagagaaccagaaaaagaacggggcgatcctgagagacaaagagagatggaagaagaggaagacgaggatgaagatgaggatgaagatgaggacgagcgtcagctgctgggcgagttcgagaaagagcttgaggggattctcctgccttccgatagagaccgtctgcgatccgaagttaaggctggaatggaaagagagctcgagaacatcatacaggaaacagaaaaggagttggatcctgacggtctgaagaaggaaagcgaaagggaccgtgctatgctggcgctgaccagtacactgaataaactaatcaagcgcctcgaagagaaacagagccctgagctcgtgaagaagcacaagaaaaaacgggtcgtgccaaagaagccaccaccgagccctcaacctaccggtaagatcgaaatcaaaatagtcaggccatgggcagaggggactgaagagggcgcgaggtggctgacagacgaggatacccgtaacctgaaagaaattttcttcaatatcttagtcccaggagcggaagaagctcagaaggagcggcagcgccagaaggaacttgaatctaattaccggcgcgtctggggttcacccgggggcgaggggaccggagaccttgatgaattcgatttctag

SEQ ID NO: 198261 - DNA, 1959 bp, Artificial Sequence
  Description of Artificial Sequence: Synthetic coding sequence
atggccgccgagaccctgctgagcagcctgctgggcctgctgctgcttgggctgctgttaccggcaagcctgacagggggggtaggatccctcaatttggaggagctcagcgagatgcggtacggcatagaaatactcccgctcccagtcatgggggggcagagccagtcatcggatgtagtaatcgtcagttccaaatataagcagcggtatgagtgccggctgcccgcaggtgctatccacttccagagggaaagggaagaggagacccctgcctatcagggtcccggcattccggaactactatcacccatgcgagacgctccctgcttgctgaaaaccaaggactggtggacctatgagttctgttacggccgtcacatccagcagtatcacatggaggatagcgagatcaaaggcgaggttctctaccttggctattaccagtctgcattcgactgggatgacgagacagctaaagcttcaaagcagcaccgactcaaaagataccacagccaaacctacgggaacggctccaagtgtgaccttaacgggcgcccaagagaagccgaagtcaggtttctctgcgatgagggcgctggtattagcggggattatattgatcgcgtggatgagccgcttagctgtagctatgtcctgacgatacgcactccacgtttatgtccacacccgcttcttcgtccccccccatcagcggccccacaagccatcctgtgccatccatccctccagcccgaggagtatatggcatacgtacagcggcaggccgattccaaacagtacggagacaagatcattgaagaattgcaggacctcggcccacaggtctggagtgagactaaaagcggagttgcaccacagaaaatggccggggccagtccgacaaaagacgactcgaaggattctgacttctggaaaatgttgaatgaacccgaggatcaagccccgggcggcgaggaagtgcccgcggaggagcaggatccaagcccggaagccgctgattctgcttccggagccccgaacgactttcagaataatgtacaggtcaaggttatccgaagccccgccgatctgattagatttatagaggaactgaaggggggaacaaagaaggggaagcccaacatcgggcaggagcagcctgtggatgacgctgccgaggtgccccaaagggagcccgaaaaggaaaggggagaccctgaacgccagcgcgagatggaagaagaggaagacgaagatgaagacgaagacgaggacgaggatgagcggcagctcctgggagagtttgagaaagagctcgagggaatactgctgccttccgacagggatagacttcggtctgagactgaaaaagagctggatcctgacggtctgaagaaggaatctgaacgcgatagagcaatgctcgccctgacaagcactctgaataagctcataaagcggcttgaagaaaaacagtcgcccgagttggtgaagaagcacaagaagaagcgcgtagtgcctaagaagccaccaccgtcaccgcagccgactgaggaagatcccgagcatcgtgtgagggtgagagtaactaagttacgcctgggtggtccaaatcaggaccttactgtactcgagatgaaaagagagaacccccagcttaaacagattgagggtcttgttaaagagctcctggagagagaaggtttaactgccgctgggaagatcgagatcaagattgttcggccctgggctgaaggcacagaggaaggtgcccgatggctgacagatgaagacactcgaaacctgaaggagatctttttcaatatccttgtccccggggccgaggaggctcagaaagagagacaaagacagaaggagctggaatccaactacaggagagtatggggatcgccagggggagaaggcacaggggaccttgatgagtttgatttttag

SEQ ID NO: 198262 - DNA, 1683 bp, Artificial Sequence
  Description of Artificial Sequence: Synthetic coding sequence
atggccgccgagaccctgctgagcagcctgctgggcctgctgctgttgggacttctactgccagcctccctcaccggtggagtcggtagcctgaacctggaggagctcagtgagatgcgctacgggatcgagatcctcccgctgcctgtcatgggcggccagagtcagtcctctgacgtggtgatagtaagcagtaagtacaaacagaggtacgaatgccgcctaccggctggcgctatacatttccagagggaaagggaagaggaaactcccgcttatcaaggccctggaattcctgaacttctgtctcctatgagagatgccccatgcttgttgaagactaaggattggtggacatatgaattctgttatggaaggcacattcagcagtatcatatggaagacagtgagattaagggagaattcctgtgtgacgagggggccgggatctccggcgattacatcgatagggtggatgagcccttgagttgctcttacgttctgacaatcaggacaccgaggctgtgtccccatcctctgctccgccctcccccaagcgcagcccctcaggccatactgtgccatccttctctgcaacccgaagaatacatggcttatgtccaacgacaagccgactcaaagcagtacggagacaagattatagaagaacttcaggacctcggccctcaagtatggtccgagacaaaaagcggtgtcgcgccacagaaaatggctggagccagtcccaccaaggatgatagcaaggacagtgacttttggaaaatgctcaatgaacccgaggaccaagccccggggggggaggaggtgccggctgaggagcaggacccatcacccgaggctgcggatagtgcttctggagctccgaacgattttcagaacaatgtgcaagtgaaggtgatacggagcccagccgatctaataagatttattgaggagctgaagggtggtacaaagaagggaaagccaaacattgggcaggaacaaccggtcgacgacgccgccgaagtgcctcagcgtgagcctgaaaaggaaaggggcgacccagagaggcagagggaaatggaagaggaggaggatgaagacgaggacgaggacgaggacgaggatgagaggcagctgctgggcgagtttgaaaaagagctcgaaggcatcctgcttccctccgatcgggacagactacgatccgaagtcaaagcaggcatggagagagagcttgagaacattatccaagaaacagagaaagagctagaccctgacggtctgaagaaggagtcagagagagatcgcgctatgctggccctcacctccacactaaacaaacttatcaagaggctggaagagaaacagagcccagagctggtcaaaaagcacaagaaaaaaagagtggttcccaagaagccacctccctctccgcagccaaccggtaagatcgaaataaagatagtccgcccgtgggcagagggcactgaggaaggcgcccggtggctgaccgacgaagataccaggaatctgaaagagatattttttaatatacttgtgccaggcgctgaagaggctcagaaggagaggcagagacaaaaagagctggagtccaactaccggcgtgtatggggttcgccagggggtgagggaacaggcgacctcgacgagttcgatttctag

SEQ ID NO: 198263 - DNA, 1743 bp, Artificial Sequence
  Description of Artificial Sequence: Synthetic coding sequence
atggccgccgagaccctgctgagcagcctgctgggcctgctgctgcttgggttgcttctcccggcttctctaaccggaggtgtgggcagcctcaacttggaggaattgagcgagatgagatatggtattgagatcctgccactgcctgtcatgggcggccagagtcagagctctgacgtggtgattgtctcatctaaatacaaacagaggtacgagtgccggctacccgctggggccatacactttcaacgtgaacgagaagaggaaactccagcttatcaaggacccggcatcccggaacttttgagtcctatgagagatgccccgtgcctcctgaagaccaaggattggtggacttatgagttctgctatggcaggcacattcagcagtaccatatggaggacagcgagatcaagggcgaggtcctgtacctcggctattaccagtcagcattcgattgggatgacgagactgcaaaatttctctgtgacgagggtgctggaataagcggcgattatatcgaccgtgtggatgagcccctctcttgctcctatgtactgaccatccgaactcccagactctgtccacaccccctgctgcgaccccctccatctgctgccccacaggcgatcttatgccacccgtctttgcaaccagaagagtacatggcctatgtgcagcggcaagccgtggatagcaagcagtatggcgataagattatcgaggagctgcaggatcttggaccacaggtgtggagtgagactaagagcggcgttgcccctcaaaaaatggctggcgcctcccccactaaagacgatagcaaggacagcgacttctggaagatgctgaatgaacccgaggaccaggccccgggcggggaggaggtgcccgctgaagagcaagatccctcaccagaagcggcggactctgcctccggggccccaaatgacttccaaaacaatgtacaagttaaggttatcaggagcccagcagacctgattagattcatcgaagagctgaagggtgggacaaagaagggcaagcctaatattggacaggagcaacctgttgatgacgcagcagaagtgccacaacgggaaccggagaaagagagaggcgatcctgaaagacagcgcgagatggaagaagaggaggacgaggacgaggacgaggatgaggacgaagacgagcgtcagttgttgggggagtttgagaaagagctggaaggaatcctgctgccgagtgatcgcgataggctgcggagcgaagtcaaagcaggcatggaaagagagcttgaaaacatcatccaagagacagaaaaagagctggatcccgacggcctcaagaaggaaagtgaacgcgatcgggcaatgcttgcactgactagcactcttaacaagctcatcaagaggctagaggagaagcagtcacccgaattggtaaaaaaacacaaaaagaagagggtggtcccaaaaaagccacccccttcaccacagccgaccgggaaaatagaaataaaaatagtgagaccatgggcagaaggcacagaagagggagcaaggtggctgacagacgaagacacacgcaacttgaaagagatattcttcaatatccttgtgcccggggctgaagaagcccagaaggagaggcagagacagaaggagttagaatccaactatcggcgtgtgtggggatcacccggaggcgaaggcactggtgatctagacgagtttgacttttag

SEQ ID NO: 198264 - DNA, 2004 bp, Artificial Sequence
  Description of Artificial Sequence: Synthetic coding sequence
atggccgccgagaccctgctgagcagcctgctgggcctgctgctgctgggcctactgttgcctgcctcactgaccggaggagtcgggtctctgaacctggaggaactctccgagatgcggtacggcatagagatactgcctctgcctgtcatgggaggtcagtctcagtcctctgacgtagtcatcgtgtcaagcaagtataaacagcgctatgaatgtagactgccagcgggcgcaatccacttccagcgcgaacgcgaagaagagacaccagcttaccaaggtccaggcattccggagctgcttagtcccatgcgcgatgctccttgtctgctcaagacgaaagactggtggacctacgagttttgttatgggaggcatatccagcagtaccatatggaagattctgaaatcaaaggagaggtgttatatttaggatattatcagagcgccttcgattgggatgacgaaaccgccaaggcttctaaacagcacaggttaaagcgctatcattctcagacgtatgggaacggaagtaagtgtgacctgaacggccggccaagagaagcagaggtgcggttcctttgcgacgagggcgcgggaataagcggggattatatcgatcgggtagatgagcctttgtcttgctcctacgtactgactattcggacaccgcgcctctgtccccatccgttattacgacccccgccaagtgccgccccacaggctattttatgccatccctccttacaaccagaagaatacatggcgtacgtccagcgccaggctgattctaaacagtatggcgacaagatcattgaggaacttcaggacctggggcctcaagtgtggagcgaaacgaaaagcggagtcgctccgcagaaaatggccggggccagtcctactaaggatgactcaaaagattctgacttctggaaaatgttgaacgaaccggaagatcaagcccctggaggggaggaagtacctgctgaagaacaggatcccagccctgaggcagccgactctgcgtctggcgcacctaacgatttccagaataatgtgcaggtaaaggtgatcagaagccccgcagatctgattagattcatagaagaactcaaagggggtacgaagaagggaaaacccaatattgggcaggagcagcccgtcgacgatgccgctgaggtgccccagcgtgaacccgagaaggagagaggcgatcctgagagacagagggagatggaggaggaggaggatgaggacgaggatgaagacgaagatgaggacgagcgacaactgctgggggaatttgagaaagagttggaaggaattttactcccctctgacagggatcgattgcgcagcgaagtgaaggctggcatggagcgtgagctggaaaacatcatccaggagaccgaaaaagagctagatcccgatggcttaaagaaagaatcagaaagagatagggccatgctggcacttacttccaccctgaacaagttgatcaaacgactggaagagaagcagtcccccgaactagtgaagaagcataagaagaaacgggtagtcccaaagaagcccccgccttcaccgcagcctaccgaggaagatcccgagcatcgggtccgggtgagggtcacgaagctgcgactgggtggaccaaaccaggatctgacggtgttggagatgaaacgggagaatccccagctcaaacagatagagggccttgtaaaggaacttcttgaaagagaagggctgacggccgccggtaagattgagatcaagatcgtgaggccttgggccgagggcactgaggagggcgcacgctggcttaccgacgaggacacacgcaatctgaaagagatcttcttcaatatattggttccaggggctgaggaagctcagaaggagaggcagcggcagaaggagttagagtctaattaccgcagagtttggggaagtcccggcggcgaagggacgggcgacctggatgaattcgatttctag

SEQ ID NO: 198265 - DNA, 1794 bp, Artificial Sequence
  Description of Artificial Sequence: Synthetic coding sequence
atggccgccgagaccctgctgagcagcctgctgggcctgctgctgctcgggctgttgctccccgctagcctgactggcggagttggctctctgaacctagaggaactgtccgagatgaggtatggaatagagatccttcctctgcctgtcatgggaggccagagccagtcttcggacgtggttatcgtaagcagtaagtacaagcagagatacgaatgtcgtttgcccgccggcgctatacactttcagcgagaaagggaggaagaaaccccagcatatcagggacctggaattcctgaattattatcccctatgcgtgatgcgccttgtctgctgaaaaccaaagattggtggacgtacgagttttgttatggaaggcatattcaacagtatcatatggaagacagtgagattaaaggcgaagtgctgtatctgggatactaccagtccgctttcgattgggatgatgaaactgcaaaggctagtaagcagcaccgtctgaaaaggtatcacagccaaacatacggcaatggttccaagtgtgatcttaatggacggcctagggaagccgaggtgagatttctgtgtgatgaaggcgcgggtatcagcggagactacatcgacagagtggatgaacccctaagctgctcatatgttctgacaatccgaacaccacgactgtgcccccaccccctactgcgtccgccccctagcgcagctccccaggcaatactctgtcaccctagcctgcaaccggaggagtacatggcttatgtacagcggcaagccgactccaaacaatatggcgataagatcatcgaagaactgcaagatctcggtccacaggtgtggtctgaaacaaagtcaggcgtggccccccagaaaatggccggtgcgagtccaaccaaagatgattctaaggactctgatttttggaagatgttgaacgagcctgaagaccaggcccccggcggcgaagaggtgccagcagaggagcaggatcctagccccgaggcagccgactcagctagcggtgctcccaacgatttccagaataacgtacaagtcaaagtgatccgaagtccagctgaccttatccggtttatcgaggaattgaaagggggcaccaaaaaggggaagcctaacatcggtcaggagcagcccgttgatgacgcagcagaagtgccccagagagaaccagaaaaagaacgtggcgaccccgagcggcagcgggagatggaggaggaagaggatgaagatgaagatgaggatgaagacgaagacgaacggcagctgttaggggagtttgaaaaagagctggagggaatcctgctgcccagcgatcgcgatagactgcgcagtgaaaccgagaaagagttggatcctgatggcttgaagaaggaaagtgagcgagaccgggccatgctggcattaacaagtacacttaacaaattaatcaagaggttggaagaaaaacagtcaccagagctggtgaagaaacacaagaagaagagagtggtgcccaaaaaacctccaccttctcctcaacccaccggcaagatcgagatcaagattgtgaggccctgggccgaagggactgaagagggggcgagatggctcacagacgaggacacacgcaacttaaaagagatcttttttaacatcctcgtcccaggggccgaggaggcccagaaagagcgccagcgacagaaggagctggagtcaaactacagacgagtgtgggggagtcccggaggggagggtacgggcgacctggacgaattcgatttctag

SEQ ID NO: 198266 - DNA, 1839 bp, Artificial Sequence
  Description of Artificial Sequence: Synthetic coding sequence
atggccgccgagaccctgctgagcagcctgctgggcctgctgctgctagggctcctcctgcctgcttctttaactggcggagtcggcagcctgaacctagaggaactgagcgagatgaggtacgggatagaaatactgcccttgcccgtgatggggggccagagtcagtcttcggatgtcgtcattgtgagcagcaagtacaaacagagatatgagtgtcgtttgcccgcgggcgccatccattttcagcgagagagggaagaggagacaccagcataccagggaccagggatacccgagctcctctctcctatgagggacgccccttgtctgctcaaaacaaaagactggtggacatatgagttctgttacgggcgacacattcagcagtatcatatggaggactctgaaattaaaggagaggttctgtatttaggctactaccagtccgcctttgattgggatgacgagacagccaaggcctcaaagcaacatcgtcttaagcggtatcacagccagacttatggtaacggatctaaatgtgatctgaacggccggccacgggaggctgaagtaagattcctgtgcgatgagggggccgggatctcaggcgattacatcgaccgcgtggatgagcctctgtcttgctcatatgtgctcacaatccggaccccacgcctgtgcccccacccattgctgcgaccaccacctagcgccgccccccaagctatcctgtgtcacccaagtctgcaacctgaggaatatatggcttatgttcagcgccaggccgatagcaagcagtacggcgataagatcatcgaggagcttcaggatctcggccctcaggtgtggagcgagacaaaaagtggtgtggcaccacaaaagatggccggtgcttcgccaacaaaagatgattccaaagactccgatttctggaaaatgctgaatgagcctgaggaccaggcccctggtggagaagaggtcccagcggaagaacaggacccgagtccagaggccgctgactcagcgagcggagcaccaaacgattttcaaaacaatgtgcaggtaaaagtgatcaggtcacccgctgacctgattcggttcatagaggaattaaaaggaggcacaaaaaagggcaaacccaatattggtcaggagcaacccgtagatgacgccgctgaggtgccccaaagggagcccgaaaaagagaggggcgacccagagcgtcagagagaaatggaagaagaagaagatgaagatgaggatgaagatgaagatgaggacgagagacagctgctaggggagtttgaaaaagagctcgaaggaatactgctgccgagtgaccgcgataggctccgtagtgaagtgaaagcaggtatggagcgagagctggaaaatattattcaggaaacagagaaggagctggaccccgatggcctgaaaaaagaaagcgagagagaccgggccatgctggctctcacttctaccctcaacaagctcatcaagcgattagaagagaagcagtccccagaactggtgaaaaagcacaaaaagaaaagggtggttccgaaaaagcccccccctagcccccagcccactgggaagattgagatcaagatcgtcagaccttgggccgagggcacagaggagggagctagatggctgaccgacgaagacacccgcaaccttaaagaaattttcttcaatatcctggtgcctggagctgaagaggctcagaaagagagacagcggcagaaggaactcgagtctaactacaggcgggtttgggggtctccaggaggtgaaggcaccggagacctcgatgagtttgatttttag

SEQ ID NO: 198267 - DNA, 3462 bp, Artificial Sequence
  Description of Artificial Sequence: Synthetic coding sequence
atgagccaggagcccaccacctacagcctgttcctgttcctgttcttatcccacggagtgtcgtcttatacggtgcccaattcacgtcaggatctccatcctcttctgcagaatatggcagaagaaatcattgacggatcgtatctaaatgcacttctggatttaatacagttccagtcctcgcacgtgtggaccgatgacctgtcccatcgggtacttgcatacctgaactctaggaacgtggcctttaccatccccagcctccaggccgcagtggagaatcacctggagcagcggttgcatcaacctcagaagctgctagaagacctgagaaaaacggacgcacagcaatttcggaccgcgatgaagtgccttctggaggacaaaaaagacggtctcgacttaaaggatatcatcatcgaccttggggagattcgcgaaagagcgctgcagtctcctggcgttaatagaagcttgtttcttatcaccctcgaacggtgctttcaaatgctgaattcactggaatgcgtggaaatactgggcaaggttctcagaggcagttctggcagcttcctgcagcctgatatcaccgaaagactgcctagagacctgagggaggatgcatttaaaaacctgagtgctgtgttcaaggacctgtacgataaaacttcagcgcacagtcagcgggccctctattcgtggatgactggtattttacaaacatccagcaacgccacggatgactccgccagttgggtatccgccgagcacctgtgggtcttaggccggtatatggtgcatctcagctttgaagaaatcaccaaaatatccccaatagagataggtctcttcatatcttacgataacgccacaaaacagttagatatggtttatgatatcactccagaactggcccaggcttttctggaaagaatatcctcgtccaatttcaacatgcgcaatacaagcacaatccaccggcaagctcatgagctctgggcgctcgaaccttttccaaagatgttaggactactcgtgtgtttttacaatgacctagaattactggatgccaccgtagcgcaagtgttgctttaccagatgataaaatgttcccacctgagaggcttccaggcgggagtgcagaagctaaaagccgaactactggatatagcaatggagaaccagaccttgaacgaaacacttgggtccctgtccgacgcggttgtaggtctaacctactctcagctggagagcctcagtccagaggccgttcacggagcaatttcaacgttaaaccaggtctcaggctgggctaaatcccaggtgatcatcctgtctgcaaaatacctggcacacgagaaggtgctgagcttctacaacgtgagtcagatgggggccctcctggctggggtatctacacaagcgttctgctctatgaagagaaaggatatctcacaggttttacgtagcgccgtatctcagtacgtcagtgatctgtcccccgcacagcaacagggcattttgtctaagatggtgcaggcggaggacacggcacccggtatcgtggaaatacagggcgccttttttaaagaggtgtctctgtttgacctgcgccgccaacctgggtttaactctacagtgcttaaggataaagagttggggaggagtcaggcactctttctgtatgagttgctgcttaagaccacgcgcagacccgaagaacttctgtccgcaggacaactagtcaagggagtgacatgttctcacattgacgcgatgtctaccgattttttcttagctcactttcaggattttcaaaacaatttcgccctgttgtcgccctatcaggtgaactgccttgcttggaaatactgggaagttagcaggctgagcatgcctcccttcttgctggccgccctgccagcccgatacctggcatcggtccctgctagtcagtgtgtgccattcctgatcagcctgggcaagagctggcttgattcactcgtgctagacagccacaagaaaacgagcgtactaagaaaagtacagcagtgtctggacgattctattgccgatgagtacactgttgacatcatgggaaaccttctgtgtcatctccctgctgccatcatcgatagaggaatctcccctcgggcgtgggccactgccctgcatggacttagggattgtcccgacctgaaccctgagcagaaggctgctgttcggctgaagctgctggggcagtacggtcttccccagcactggaccgcagaaaccaccaaagatttaggcccatttttagtcctgttcagtggcgacgagctctcgagtatcgcaaccaagttcccagagattctgttacaagccgcttccaagatggcaaggacgctgcccaccaaggaattcctatgggcagtgtttcagtctgtacgaaactctagtgacaagattcccagctatgaccctatgcccgggtgccacggggttgtggctcctagctcagatgacatctttaagctggcagaagcaaacgcctgctgggccctggaagatctgcggtgcatggaagaagatactttcatccggacagtcgagctcctcggagccgttcagggattcagtcgacctcagttgatgacactgaaagagaaagctattcaggtttgggatatgccatcctattggcgcgagcatcatattgtgtctctgggtcgtattgcactggcactgaatgagtccgagcttgaacagctggatttgtcctctatcgacaccgtagccagtctctcctggcagactgaatggaccccgggtcaagccgaaagtattctgcagggctacctggacgacagcggctacagcatccaagatctaaagtccttccacctggtgggactgggcgcgaccctgtgcgccattaatataaccgagattccacttatcaagatctcagaattccgggtcgttgttgccaggattggaactctgctatgttctacccacgtgctcgccgagttcaaaaggaaggcagaggttgtctttggagatccaacagagtggacctccagtgtcctccaggaactggggaccatcgctgccggactcaccaaggccgaactgagaatgctggataaggatctgatgccttattttcagcccagcgccatcaagtgtctcccagatgagatattcaaggaactgagcgctgaacagattgcctcactgggccctgagaatgccgccgctgtgactcacgcacagaggagacgcctaagccctcttcagctgcagagccttcagcaggctctagacggcgccaagactcacagctggcaagatgcacccgcgagcgccgggcctacacggacttcttcaagcagatctccagcaggggctttgcaatcatgggggctctggcttggctgccccctgctggtgctgatggcgaagttgctgtggtag

SEQ ID NO: 198268 - DNA, 1647 bp, Artificial Sequence
  Description of Artificial Sequence: Synthetic coding sequence
ccccgggccgtgtgggtggaggcccggggcggcgcccagcaccccacaatgagacgaactgctccactgcaccgaggcacctggtctaaaatgtccatcatactcagagccaggtacttagcatccgtgccggccagccagtgtgtcccctttctgatctccctcggcaagagttggctggacagtctggtgctggatagccacaagaagacctccgtactgcgcaaggtacagcagtgcttagatgacagcatagctgacgaatacactgttgatatcatgggcaatctgctgtgccatcttcccgcagcaatcattgataggggaattagtcctagagcatgggccaccgcactacatggcctgagagactgcccagatctgaacccagagcagaaagcggcagtgcgtcttaaactcctcggccagtacggtctcccacagcactggaccgctgagaccacaaaagaccttggtccttttctcgtactcttcagcggagatgagctgagctctatcgctaccaagttcccggagattctgttgcaggctgcctctaaaatggcccggacattgcccactaaggagttcctgtgggcggtgtttcagtccgtccgaaacagcagtgacaagattccgtcctatgatcccatgccgggctgccacggggtcgtcgccccctcttcagatgatatcttcaaactggccgaagctaacgcctgctgggccctggaggatctccggtgtatggaggaggatacattcattcgaacagtcgagctgcttggcgccgtgcaggggttttcacgcccacagctgatgacgctgaaggaaaaggctatacaagtgtgggacatgccttcatattggagggagcatcatatcgtctctttgggccgcatcgcgctggcccttaatgaatccgaactggaacagttagatctctccagcatcgatacagtggccagcctaagttggcagaccgaatggactccagggcaggcagaatcaatcctgcagggttacctggacgacagcggctatagcattcaggaccttaagagctttcacctggttggcctcggggccactctgtgcgcaatcaatatcaccgaaatccctcttattaaaatttctgaattccgcgttgtagtggccaggattgggaccctcctgtgtagtacccacgtcctggccgaatttaaacggaaggccgaggtcgtgttcggcgatcccacagaatggacctcatcagtccttcaagaacttggtaccatagccgccgggctcacaaaggcagagctccgaatgcttgacaaggatctgatgccttactttcagcctagtgctatcaaatgtctgccagatgagatttttaaggagctgagcgcagagcagatcgctagtttaggtcccgaaaacgctgcggcagtgacccatgcccagaggcgaagacttagcccactccaattgcagtccctccaacaggccctggatggagccaaaacacattcctggcaggacgcccccgcctcagcgggacctacccggacctcaagttcgcggtctcccgcaggggccctccagagctgggggctctggctggggtgtccgcttctggttttgatggcaaaactcctttggtag

SEQ ID NO: 198269 - DNA, 3183 bp, Artificial Sequence
  Description of Artificial Sequence: Synthetic coding sequence
atgggcaacagcatcacctaccgggaccaggccgccgtggagaaccacctagaacagaggctccaccagccacaaaaactgttggaagatctgcgaaaaactgacgcacagcaatttaggactgctatgaagtgtctgcttgaggacaagaaggatgggctggacttgaaggacattatcatcgacctaggggaaatccgagagcgtgccctgcagagtcctggggtgaaccgctcactcttcttgatcaccctggaaaggtgcttccagatgctgaattccctggagtgtgtcgaaatcttaggtaaggtactcagaggatcttctgggagcttcttgcagcccgacataacagagagactgccaagggatcttagagaagacgcattcaagaacctctcagcagttttcaaggacttatacgacaaaacgtccgcccattcacaaagagcgctgtactcctggatgaccggcattctacagacatcttccaatgccacagatgactcagccagttgggtgagcgccgagcatctgtgggtcctgggtaggtacatggtgcacctgtccttcgaagagattaccaaaatcagccctatagagatcggcctgtttatttcttatgataacgcgacaaagcagctggatatggtgtacgacataactcctgagctggctcaggcgtttctggaaagaatttcttcctccaacttcaacatgaggaacacgtccaccattcacagacttggactccttgtttgcttctacaatgatctggaacttctcgatgcaactgtcgcccaagtgctgctctatcagatgattaagtgtagccacctgcgggggttccaggccggggtccagaagcttaaagcggaactactggatatcgccatggaaaaccaaacccttaacgagaccttagggtcactgagcgatgcggtggtcggcctgacttattcacagctggagtcattgagccctgaggccgttcatggagcaatcagcacactgaaccaggtctcagggtgggcaaaaagccaggtcattatattaagcgccaaatacttggcacacgagaaggttctctcattttacaacgtgtcccagatgggcgcactgctggcgggggtcagcactcaggcgttctgttcgatgaagagaaaggacatttcccaagtgttgagatcagccgtgtcacagtatgtgtctgacctgtcacccgctcaacaacaaggtattctctctaagatggtgcaggccgaggacacagcccccggtatcgtcgagatacagggtgctttcttcaaggaggtgtccctctttgatctaagacgccagcctggatttaatagcaccgtgctcaaggataaagaacttggccggtctcaggcgctgttcctgtacgaactcctcttgaagaccacgagacgcccagaggaactcctgtcggcaggccaactagtgaaaggagtcacgtgcagccatattgacgccatgagtaccgacttctttttggcccatttccaggatttccagaataattttgccctgctcagcccctatcaggtgaactgcttagcgtggaagtactgggaggtgagccgcctgtctatgccccctttcttgctcgcagcccttcccgctaggtacctcgcaagcgtgcctgcatcccagtgtgttccttttctgatttctctgggaaagtcgtggctcgactctctagtgttggatagccacaaaaagaccagcgtgctacgcaaggtgcaacaatgtttggatgattctattgccgacgaatacaccgttgacatcatgggcaatcttctgtgccatctgcctgctgctatcatcgaccggggcatcagcccccgagcatgggcaaccgctctacacggcctgagggactgccctgacctgaatccagaacaaaaggcggccgtacggctcaaactgcttggacaatacggtttaccccagcactggacagccgagacgaccaaggatttggggcctttccttgtccttttttcgggtgatgaactctcaagtattgcaaccaagtttccggagatcctactccaggcagcttctaaaatggcacgaacactcccgactaaggaatttctgtgggccgtgttccaatctgtgaggaactcttccgataagattccctcctacgatcccatgcctggctgtcacggtgtcgtcgctcctagttctgacgatatttttaagctggctgaagcgaatgcatgctgggccctcgaagatctgcgttgcatggaagaagacacctttatccggacagtggaactcctcggcgcagtccaaggcttctcacgaccacagctcatgaccctgaaggaaaaggccattcaggtgtgggacatgcctagttactggcgcgaacaccatatagtgtccctggggagaattgctctggccttgaatgagtccgaacttgagcagttagacctgagcagcattgacactgtcgcaagcctgtcatggcagactgaatggactccaggccaggcagaatcaatactgcaagggtacctggacgactccggctattccattcaagatctcaagtcatttcatctggtgggcctaggggccacactatgcgctattaatattaccgagataccactgatcaaaatctccgagtttagggtcgtggtcgcaagaatcgggaccctgctctgttcaacccatgttctggccgaatttaaacgaaaggcagaagtagtattcggagatccaacagagtggacgtcatcagttttgcaagagctcggtactatcgccgcagggctgacgaaggccgagctgcgcatgttagataaggatctaatgccatatttccaaccctccgcaatcaaatgtctgcctgatgagatcttcaaagagctaagcgctgagcagattgcgtcgctgggcccagagaatgcagcagccgtgacccacgcgcagagaaggaggctaagcccactccagctgcagtctctgcaacaggccctggatggggctaagacacattcctggcaggatgctccggcttccgcaggccccactaggaccagttcttctaggagcccagccggtgccctccagagttggggcctgtggctaggctgcccactccttgtgctgatggccaaattgctctggtag

SEQ ID NO: 198270 - DNA, 2448 bp, Artificial Sequence
  Description of Artificial Sequence: Synthetic coding sequence
atgttccggctgggcctgctggtgtgcttctacaacgacctggagctgctcgacgccaccgtggctcaagtgctgttgtatcagatgataaaatgttcccatctgcggggattccaggcaggcgtgcagaagcttaaagccgagctgctagatattgccatggagaaccagaccctcaacgagacactagggtctcttagcgacgctgtcgtgggtctcacctactcccagcttgaatctctttctccagaagctgtgcacggagcgatatctaccctcaaccaggtgtcggggtgggccaaatcacaagtgatcatcctgtctgccaagtacctggcacacgaaaaggtcctgtcattttacaatgtgtcccagatgggcgccctccttgctggagtgtcaacgcaggccttttgctcaatgaaacgcaaggatatcagtcaggttcttcggtccgccgtaagtcaatatgttagcgacctgtcaccagcgcaacaacaaggcattctgtccaagatggtacaggcggaggatacagcaccaggtatcgtggagattcagggtgctttctttaaagaagtgagcctgttcgatctgagacgccagcccggattcaactctaccgtactgaaggacaaggaactcggtcgctcgcaagccctcttcctgtatgagctcctcctgaaaacaactcgcagacccgaagagttgctttcagcaggccagttagtgaagggagtaacttgttcacacattgatgcgatgtccacggatttttttctggcccattttcaggatttccagaataacttcgctctgctgagcccttatcaggtcaattgcctcgcttggaaatactgggaagtgtctaggttatctatgcccccttttttgttggccgccctcccggctcgttacctggcttctgtgcccgcatcccaatgtgtgccatttttgataagcctcgggaaaagctggctcgactccctggtgctggactcccataaaaaaacctcagttctgcggaaggttcagcaatgcctggacgattctatcgccgatgagtacacagtagatatcatggggaatttgctctgccacctccccgccgctattattgaccgaggaataagccctagagcttgggccacagcgctccatggcctccgagattgtccagatttaaatccagagcaaaaggccgccgtgcgcctgaagctgctgggacagtatgggctgccccaacattggacagccgaaactacaaaagacttgggaccgtttcttgtcctgtttagcggggacgagctgtcgtctattgctactaaatttcctgagatcctgctgcaggctgcgagtaagatggcgagaacactgcccactaaagagtttctatgggccgtattccagagcgtcaggaacagtagcgataaaattccctcctacgatccaatgccaggttgtcatggagtggtggcccccagtagtgatgatatttttaaactggcagaagctaatgcatgttgggcactggaggatctgcgatgcatggaggaggatacatttattcgtacagtggaactcctcggagccgtgcaaggtttttcacgcccccaattgatgaccctgaaggaaaaagccattcaggtgtgggacatgccttcctactggagagagcaccacatcgtgtccctaggacggatagcactcgcacttaatgaaagtgagctggaacagctggatctttcttccattgatacagtcgcatccttgagctggcagacagagtggacaccggggcaggccgagtccatactccagggctacctggatgatagcgggtatagcattcaggacctgaagagttttcatctagtcggattgggcgcaacgctttgtgctattaatatcacagaaatacccttgattaagatttccgagtttagagtggttgtggccaggattggcacactcctgtgctccactcatgtgctcgccgagtttaaacggaaggccgaagtcgtgttcggagaccccactgagtggacctcttcggtgctacaggagttaggcaccattgccgccggccttaccaaagccgaactgcggatgctggacaaggacctcatgccctatttccagccctcagcgatcaagtgtctgcccgacgagatcttcaaggagctcagcgccgaacaaattgcctcgttagggcctgaaaatgcagccgcggtaacgcatgcccagcgtaggagactctcacccctgcaactacagtcactacagcaggccctggatggggccaagacacactcatggcaggatgcccctgcatctgccggacctacgaggacctcttcttcaagaagcccagcaggagctctgcagtcttgggggctgtggcttgggtgtccactgctggtgctcatggcaaaacttttatggtag

SEQ ID NO: 198271 - DNA, 3420 bp, Artificial Sequence
  Description of Artificial Sequence: Synthetic coding sequence
atgagccaggagcccaccacctacagcctgttcctgttcctgttcctgagtcatggggtgagcagctacaccgtcccaaatagtcgtcaggatctgcacccgctcctccagaatatggctgaggaaataatcgacgggtcttatctcaatgccctcttggaccttattcagtttcaatcttcgcatgtgtggaccgacgacttgtctcatagggtgctagcctatcttaattctcgcaacgtcgcttttaccattcccagtcttcaagccgctgtggagaaccacttagagcagagactccaccagccacagaagctgttagaggatttgcgaaagaccgatgcccaacagttccgcaccgctatgaagtgcctgctcgaggataagaaggacggcctcgatctcaaggatatcattattgacctgggtgaaattcgcgaacgggctctccaatccccaggcgtgaatagatctttatttctgataactttagagcggtgcttccagatgctaaacagtctggagtgcgtcgaaattttgggcaaggtcttgcggggcagcagcgggagcttcctacaacccgacattacagagcgactccctcgcgacctccgcgaggatgcattcaaaaacctgtcagctgtcttcaaggatctgtatgacaagactagcgcccatagtcagcgcgcactgtactcatggatgaccggcatactacagacgagctctaatgccacggatgatagtgcatcttgggtgtccgccgaacatctctgggtgctgggtaggtacatggttcatctttcgttcgaggaaataaccaagatttcccccatcgagatcggcctttttatttcttatgataacgccacgaagcagcttgacatggtatatgatataactcccgagctcgcgcaggccttcctcgaaaggatcagtagttctaatttcaacatgagaaatacgagtaccatacacagattggggttacttgtttgcttctacaatgatttagagctccttgatgccactgtagcccaggtcctcttataccagatgattaagtgctcccatctcagaggctttcaggctggcgtacagaaactcaaagcagagcttcttgacatcgccatggaaaatcagacattgaacgagacacttggttccctgagtgacgcggtggtgggactgacatactcccagctggaatcattgagccccgaggcagtgcatggagccatttctacgctgaaccaggtcagcgggtgggccaaatcccaggtcatcattttgagcgcaaagtaccttgcacacgagaaggtactatctttctataacgtatcacaaatgggggctctactagccggcgtgtccacccaagctttctgctctatgaagcggaaggacatttcgcaagtgctccgaagcgctgtgagccagtacgtcagcgacctctccccagcccagcagcaaggaattttgtcgaagatggttcaggctgaagacaccgcaccaggaattgttgaaattcagggagcttttttcaaggaggtttctctttttgatctaaggagacaaccaggctttaactccactgtattgaaagacaaagagctgggcagaagccaggcgctctttctatatgaacttctgctaaagaccacccgccggcctgaggaactgctgtccgctggtcagctggtcaagggagtgacatgttcccatatagacgcgatgtctaccgactttttcctggcccactttcaagatttccagaacaacttcgcactcctttccccgtaccaggtcaactgtctcgcctggaagtactgggaggtgagccgacttagcatgcccccgttcctgcttgccgctttacccgcacgatacctggccagtgttccggcaagtcagtgcgtccctttcctcatttcactcggcaaatcctggctcgacagcctcgtgctggatagccacaaaaaaactagcgtcctgaggaaagtccagcaatgccttgatgacagtatcgctgacgagtatacggtggacattatgggcaatttgttgtgtcacctgccagctgcaatcatcgatcgcggaatctcgcctagagcctgggccactgcactacacggcctgagggactgtccagacttgaatcccgaacagaaggctgctgttagactcaaacttttagggcagtatggtctgcctcaacactggactgctgagactacgaaagacttaggcccttttttagtgttgttttctggcgacgaactctcatctatcgcaacgaaatttccagaaatcttattgcaagcagcttctaagatggctagaactctacccacaaaggagtttctctgggcagtgtttcagagcgtcaggaattcatcagacaagatacccagttacgatcctatgcctggctgccatggcgtggtggctccctcctcagatgacattttcaagctggcggaggctaatgcgtgctgggcgctcgaagacctcaggtgtatggaggaagacacctttataagaaccgtggagctcctaggcgccgtgcaaggtttcagcaggcctcaactcatgaccctgaaggagaaggctattcaggtgtgggacatgccatcctactggagagagcaccacattgtgtcactcggccggattgcccttgccctgaacgagtctgagcttgagcagttggacctgtccagcatagacactgtagcgtcactgtcctggcagaccgaatggactcctggacaagcagagagcattctccagggctaccttgacgactccgggtattccatccaggacctcaaatcttttcatctggtgggtctcggcgccactctttgcgccatcaacataactgaaattcctttaatcaaaatttctgagtttagggtcgtcgtggccaggatcggcaccctgttgtgttctacacacgtcttggcggaatttaagaggaaggccgaagtggtgtttggcgacccgacagaatggaccagttcagtgctgcaggagctcgggacaatcgctgctggtctaactaaggcagagttgcgaatgttagacaaggaccttatgccatatttccaaccctccgcaattaaatgcctccccgacgagatcttcaaagagctgagcgcagagcagattgcgagcttggggccagagaatgctgcggcagtgactcacgctcagagaagacgcttatctcctttgcagcttcagtctttgcagcaggctctggatggggctaagacccatagctggcaggacgctccggcatcagcaggcccgacccgaactagcagttcacggagtcccgcaggcgccctgcagtcgtgggggctgtggcttggctgtcctctcctggtattgatggccaagctgctgtggtag

SEQ ID NO: 198272 - DNA, 1434 bp, Artificial Sequence
  Description of Artificial Sequence: Synthetic coding sequence
atgatcgccttcctgctgaccagcgtgctgatgatcccccacgccggaggacacccactcgatacaccacacctgcctcaggaactccccccaggactgcccaataacattaacataacatttttcagcgggatgtttaagaatgttgagagtgtcgccgaaatttttgactgtctgggtccgcactttacttggctccaggccgtatttacaaactttcccgtgttaatacagttcgtaaatggaatgaagtgcgtggctggactgtgcccacgagactttgaggattacgggtgtacttgtaggttcgagatggagggtctgccggtggatgagtccgatagttgctgctttcagcatcgcaggtgttatgaggaggccgctgagatggattgccttcaagaccctgcgaagctatcaactgaggtgaattgtgtgtccaaaaaaatcatttgcgaatcgaaggataattgtgaacatttactctgcacatgcgacaaagctgccattgaatgtctcgccagatcctcactaaactccagcctcaatctgttggacacttctttttgccttgcccagacaccggagacaacaatcaaggaagatttgactacgttgctcccgcgggttgtacccgtcgaacccactgacaccagcctgacagcgctgtccggagaagaggccggacatgatcaggaaggtgtgggcgcggctagagcgaccagcccaccaggctccgccgagatagtcgccactcgcgtcaccgcaaagatagtcaccctggtgcctgctggtatcaagagcctcggcctggccgtgagcagtgttgagaatgaccctgaggagaccacagagaaggcatgcgaccgattcacttttctgcatttaggctccggagacaatatgcaagttatgccccagctgggcgaaatgttgttttgtctaacctccaggtgcccagaagagtttgaatcttatggctgttactgcggacaagagggtcgaggcgagcctcgcgatgacttggaccggtgctgtctatcccatcactgctgcctggagcaggtgagaagactgggctgtctgctcgaaagactcccgtggtcccctgttgtgtgcgtggaccatacacccaaatgtggagggcagtctctgtgtgaaaagcttctgtgcgcctgcgatcagactgctgcagagtgcatgacctccgcctcctttaaccagagtctcaaatccccgtccagacttggctgccccggacaaccagccgcctgcgaggatagtctccaccctgtaccagccgcccctacgttgggatcgagtagtgaagaggattctgaggaggatccccctcaggaagacttgggccgggccaagaggttcctcagaaagagcctcgggcccctcggaatcggcccgctgcacggccgatag

SEQ ID NO: 198273 - DNA, 1482 bp, Artificial Sequence
  Description of Artificial Sequence: Synthetic coding sequence
atgatcgccttcctgctgaccagcgtgctgatgatcccccacgccggggggcatccactggacaccccccacctgccccaggagttacccccgggcctgccaaataatatcaacatcacctttttctctggaatgtttaagaatgtggaatcagtggcggaaattttcgactgcttaggacctcattttacatggctgcaagcggtgttcactaactttcccgtgctgatccagttcgtgaacggtatgaagtgtgttgctggactgtgtcctagggacttcgaggattacggttgcacatgcagatttgagatggagggtctgcctgttgacgagagtgattcttgctgtttccagcatcgccggtgctatgaggaggcggcagaaatggattgtctgcaagacccagccaaactgagcaccgaggtgaattgcgtctctaaaaagatcatttgcgagagcaaagacaactgtgagcacctgctgtgcacctgcgacaaggcggcgattgaatgcttggctaggtcttctctaaactcatctcttaacctccttgacacatctttctgtctcgcccagacacccgaaaccaccatcaaagaagacctcacgacactgctacctagggtagtgcctgttgagcccaccgacacttctcttacagcgttaagcggggaggtcgccgccgaaacagaagcagaccgcctcatcacactcagcaaaaagaaggcagggcacgatcaggagggcgtgggcgccgcccgagcgacatctccccctggatctgccgagattgtggccacgcgcgtcacagcaaaaattgtgactctcgttccagctggcattaagtccctggggttagcggtaagtagtgtggagaacgacccagaggagaccaccgaaaaagcatgtgacaggttcaccttcctccacttgggcagtggagataatatgcaagtcatgcctcaactcggggaaatgctgttctgcctcacaagcagatgtcctgaagaattcgagtcatatggatgctactgtggtcaggaggggcggggggaaccacgtgacgatctagacaggtgttgcctgtcacaccactgttgcctagaacaagtcaggcgactgggctgcctcctggaaagattgccttggagccccgtcgtgtgtgtggatcatacacctaaatgtggggggcagagcctgtgtgagaaattgctttgtgcttgcgaccaaactgccgctgagtgcatgacatccgcctcgttcaaccagtctttgaagagcccgagccggcttggatgtcctggtcaaccagcagcgtgcgaagacagcctgcaccccgttcctgccgcgccaaccctcggctccagcagcgaggaggattctgaggaggacccccctcaagaggacctcgggcgcgcaaaaaggttcctgcgtaagtcactggggccgctgggtattgggcccctgcacggccggtag

SEQ ID NO: 198274 - DNA, 5994 bp, Artificial Sequence
  Description of Artificial Sequence: Synthetic coding sequence
atggccctgctgatccacctgaagaccgtgagcgagctgcggggccggggtgacaggattgccaaagtgacgttccgaggtcagtctttttactcccgggtattggagaattgtgaagacgtcgccgacttcgatgagacttttcggtggcccgttgccagctctattgacaggaacgaaatgttagagattcaagtatttaactattcaaaagttttctcaaacaagttaatagggacattcaggatggtgctgcagaaggtagtcgaagagagccacgtagaagttacggatactctcattgacgataataacgctattataaagacatccctctgtgtcgaggtccgctaccaggcgacagacggcacggtggggagctgggatgacggcgatttcttgggcgatgaaagcctccaggaagaagaaaaagattcacaggaaacggatggcctcctgcccggttcaaggccctcctcacgaccaccgggtgaaaagtccttccgtcgcgcaggccgaagtgtgttcagtgccatgaagctaggaaagaataggagccacaaagaagaaccacagagaccagacgaacccgccgtactagagatggaggacctggatcacctggctatcagactgggcgatgggttggaccctgatagtgtgagcctcgcctccgttacagcgttgaccacaaatgtatcaaacaaaaggtctaaaccggacattaaaatggagccctccgcagggcgtcccatggactatcaggtgtcaatcacagtcatcgaggccagacagctcgtcgggttgaatatggatcccgtagtttgtgtggaagtaggagacgataagaaatatacatctatgaaggaaagtactaactgtccatattataatgaatactttgtgttcgactttcatgtaagccctgatgttatgttcgacaagataatcaagatttcggtgatccatagcaaaaaccttctaaggtccggtactctggtgggatccttcaaaatggacgtgggtacggtgtattcacagcctgagcatcagttccaccacaagtgggcgatcctgtccgacccagacgacattagtagcggtcttaaaggatatgtaaagtgcgacgtcgctgtagtcggaaagggcgacaacatcaagaccccccataaggctaacgagacagatgaggatgatatcgagggaaatctgctgttaccagaaggcgttccaccagaacggcagtgggctagattctacgtcaaaatttacagagcagagggtctgccgcgcatgaatactagtcttatggccaatgtgaaaaaggcatttattggcgaaaacaaagacctcgttgacccttatgtccaggtattcttcgccgggcaaaaagggaagacgtccgtgcagaagtcgagctacgaacccctgtggaacgagcaagtggtgtttaccgatttattcccaccactgtgcaagcgaatgaaagtgcagattcgggactccgataaagtgaacgacgtggccatcgggacacatttcatcgatctgagaaaaattagtaacgacggagacaaggggttcttaccaactctgggtccagcatgggtcaacatgtatggctccaccaggaattacaccttgctagacgagcaccaggacttgaacgaagggttgggggagggcgttagctttcgggctcgtttactgttaggtctggccgttgagatagtggacacgtccaatccagagctgaccagcagcacagaggttcaggtggagcaagctactccaatttcagaaagctgtgccggtaagatggaagagttttttctttttggagccttccttgaagcctccatgattgatagacgaaacggcgataagccaattacattcgaggttactatcggcaactatggcaatgaagtagacggcctatcccggccacagaggcctagaccacggaaagaacccggagatgaggaagaggttgacctcattcagaatgcatccgatgacgaagccggcgatgccggagatctggcgtccgtgtcatctaccccccctatgcggccacaggtgaccgatcgaaattacttccacctaccgtacctcgagcggaaaccctgtatttacataaaatcctggtggcccgaccaaagaaggcgactgtacaacgcgaatatcatggatcatatcgcagacaagctggaagaggggcttaacgacatccaggagatgatcaagacagaaaagtcctaccccgaaagaagattgagaggtgtgctggaagaactatcatgcgggtgttgtcgcttcctgtcactggcagacaaggatcagggccacagctcacgaaccagactggacagggaaagactgaagtcatgcatgagggagttagaaaatatgggccagcaagccagaatgctcagggcccaggtcaagagacacaccgtgcgggacaaacttcggttgtgtcagaacttccttcagaagctcagattcttggccgatgagccacagcattctatcccagacatatttatatggatgatgtcaaacaacaagagggtcgcctacgctagagttccctccaaggatctgctgtttagcatcgtggaggaggagaccggaaaagactgtgccaaggtgaagaccttgttcttgaagctgcccggcaagagaggcttcggaagcgcaggatggacggttcaggccaaggtggaactttacctttggttgggactgtctaagcagcgtaaggagtttctgtgcggtctgccttgcgggtttcaggaagtcaaggccgcacaggggttgggactgcacgccttccccccagtctccctcgtttatacaaagaaacaggcttttcagctccgggcacacatgtatcaggccaggagcctgtttgcggccgattccagtgggctttctgacccttttgccagggtgttcttcataaaccagagccagtgtaccgaggttctcaacgagaccctatgccccacctgggaccaaatgctcgtgttcgacaatttggagctgtacggtgaagcacacgagttgagagatgacccacctatcatcgtaatcgaaatctatgatcaggactcaatggggaaggctgactttatgggacggaccttcgccaagcctctcgtcaagatggcagacgaggcatactgcccccctagattcccccctcagctggagtattatcagatctatcgcggaaacgccactgcaggcgacctcctcgcggctttcgaactgctgcagatcggcccagccggcaaagcggatcttccccctattaacggtcccgtggacgtcgaccgtggtcctataatgcccgtgcctatgggtatcagacctgtccttagcaagtatcgggtggaggtgctcttttgggggctcagggacctcaagcgcgtaaatctggctcaggttgaccggccgcgagtggacattgagtgcgcaggtaagggtgtccagtcatcactcattcacaattacaagaaaaaccctaatttcaacaccctagtaaaatggttcgaagtggatcttcctgaaaacgagcttctccaccccccattgaacatccgagtggtcgattgtagagcctttgggaggtataccctggtagggagtcacgccgtcagctctctcaggcggttcatttaccgacctcccgaccggagcgcccctagctggaacaccacagtgagattactacgtagatgccgagtactgtgtaacgggggctccagctctcactccaccggcgaagtcgttgtaacaatggagccggaagttcccatcaagaaactcgagacgatggtaaagctcgatgccaccagcgaagcagttgtgaaagtagatgttgccgaggaagaaaaagagaaaaagaagaagaaaaaaggtacagctgaagaacctgaagaagaggaacccgacgaatccatgttagactggtggtcaaagtatttcgcttcgatcgacactatgaaagagcagctaaggcagcaggagccttcggggattgatctggaagagaaagaagaggtggacaacaccgaaggattgaagggcagcatgaaaggaaaggaaaaagctcgcgcagccaaagaggaaaaaaagaaaaagacacagtcttctggatccgggcaaggctctgaggcccccgagaagaagaagccaaagattgatgagctgaaggtctaccccaaagagctcgaatccgagtttgacaatttcgaagattggctgcacactttcaatctccttcggggaaagaccggcgacgatgaagacggatccactgaggaagaaagaatagttggcagattcaaagggtctttatgtgtgtataaggttcctctgcctgaggatgtctctcgtgaagccggctacgattccacctatggcatgttccagggaattccgtcgaacgatccgataaatgtgctggtgagggtttacgtggtgcgagccacggatctgcatcctgcggatattaacggaaaggctgacccctacatcgctattcgactcgggaagacagatattcgagataaggagaactatatctcaaagcaactcaaccccgtgtttggcaagtccttcgacatcgaagcctcattccccatggaatccatgctaacggtggccgtgtatgactgggacctggtcgggacagatgacctgatcggcgagaccaaaattgacttagaaaaccgcttctattcaaagcaccgagccacatgtggcattgcacagacctactcgacacacgggtataatatttggagagaccctatgaagccaagtcagattttgacgagattatgcaaggatgggaaggttgacggcccccactttgggcctcctggtcgcgtgaaagtggcgaaccgcgttttcacaggtccttccgaaatagaagatgaaaacgggcagagaaagccaacagacgaacacgtagctctcctggccctcagacactgggaagatattccgagagcaggctgccggctcgtacctgaacacgtagaaacccgtcccctgctaaaccctgacaagcctgggatcgaacagggccggcttgagttgtgggttgacatgtttccaatggatatgcccgcccccggcacccccctggatatctcaccacggaaaccgaagaagtacgaactgagggtgataatttggaatactgatgaagtggtgctcgaggacgatgatttcttcacgggggaaaagagcagtgatatctttgttcgcggttggctgaagggacaacaagaggacaagcaggacaccgacgtgcactatcacagtctgacgggcgaaggtaacttcaattggagatacttgtttcctttcgactacctggctgccgaagagaagattgtgatcagtaagaaggagtccatgttttcctgggatgagactgagtataaaatccctgctaggctcactctccagatctgggacgccgatcattttagcgcggacgatttcctgggcgcaatcgagcttgatcttaaccgatttccgcggggggcaaagacagccaagcaatgtacaatggagatggctaccggcgaagtcgatgtgcctctggtgagcatcttcaagcagaagcgagtcaagggctggtggccccttctggccagaaatgagaatgatgaatttgaactcactggcaaggtggaagctgagctgcacctcttaacggctgaggaagctgagaagaatccggtgggactggcccgcaacgaacccgaccctctggagaaacctaaccggcccgacacttcattcatctggttcctgaatccattgaagtccgcgcggtatttcctttggcacacctacagatggctgctgctgaaactgctgctacttctgttgctgctgcttctactcgctctattcctgtactctgtgcccggttatctggtgaagaaaatcctgggcgcatag

SEQ ID NO: 198275 - DNA, 3693 bp, Artificial Sequence
  Description of Artificial Sequence: Synthetic coding sequence
atgatcaagaccgagaagagctaccccgagcggcggctgcggggcgtgctcgaggaattaagttgtgggtgctgccgtttcctgagcctggccgacaaagaccaggggcactcttcaaggacgcgtctggatcgtgaacggctgaaaagttgtatgcgcgagctagagaatatgggccaacaggctcggatgctgagggcacaagtcaagcgccatactgtgcgagacaagctgcgactctgccagaacttcttacagaagctgcggttccttgctgacgaaccacagcattcaatacctgacatatttatctggatgatgagcaacaataagcgcgtggcatatgcaagggtcccaagcaaagatctgctattcagtatcgtcgaggaggaaaccggtaaagactgtgccaaggtcaagacgttatttttgaagttgcccgggaagcgaggcttcgggtcggctggctggaccgtgcaggctaaagtggagctctatttatggcttggactgagtaagcagagaaaagaatttctttgcggccttccttgcggattccaagaagttaaggctgcccagggcctgggcttacacgcgttcccgcccgtctccttggtgtacacaaagaagcaggctttccagttaagggcccacatgtatcaagcccggagtctgtttgcggccgattcatccggactgagtgacccctttgctagagtcttcttcattaatcagtcacagtgcacggaggttctgaacgagaccctgtgcccaacctgggatcagatgttagtgttcgataatctggaattatatggggaggcccatgagctgcgagatgacccacctattatcgtgatcgagatctatgatcaggattcaatgggtaaggcggatttcatgggcagaacatttgctaaacccctggtgaaaatggctgatgaggcatattgccccccccgttttcctcctcagctcgagtactaccagatctaccgaggtaatgcaactgccggggatctactagcagcctttgaactgttgcaaatcggtccagctgggaaggccgacctccctcctatcaatgggcccgttgacgtggatcgagggccgatcatgcctgtgccaatgggtatccgtccagtcctctcaaagtatcgcgtcgaagtgcttttttggggcctacgggatctcaagagagtaaacctcgcacaggtggataggccacgggtggatatcgagtgcgctggtaaaggcgttcagagctctcttatccacaattataagaagaaccccaacttcaatacccttgtgaaatggttcgaggtggacctgcctgagaatgaactactccaccccccactgaacatacgagtggtcgactgtagggcattcgggaggtacactctagtcggctctcacgccgtcagcagcctccggcgatttatctacagaccaccagaccgtagcgcacctagttggaataccaccggagaggtggtggtgactatggaaccagaagtgcccatcaagaagcttgaaacaatggtcaagctagacgcaactagtgaggcagtcgttaaggtggacgtggccgaggaagaaaaggagaaaaagaagaaaaaaaaaggaaccgcagaggaacccgaggaagaagagcctgacgagagcatgctcgactggtggtcaaagtactttgcgagcattgacactatgaaagagcagctgagacagcaggaaccttccgggatcgacctggaggagaaggaagaagttgacaataccgaggggttgaaagggtcaatgaagggaaaagagaaagcacgcgctgctaaggaggagaagaagaagaagactcaatccagtggctctgggcagggtagcgaggctcccgaaaagaaaaagcccaagattgatgagttgaaggtgtatccaaaagaactcgagagcgagtttgataattttgaagattggttgcacacgttcaatttattacggggaaaaaccggcgacgacgaggatggcagtactgaagaagaaagaatcgttggccgatttaagggatcgttatgcgtgtacaaggtaccactcccagaggacgtatccagagaggccggatacgacagtacctacggcatgttccaagggattccttcaaacgatcccatcaacgtgctggtgcgcgtctatgtcgtgcgcgctacagacctacacccagctgatatcaacgggaaggctgacccatacatagcaatacggcttggcaaaaccgacattagggacaaggaaaactacatttccaagcagctgaacccagtttttgggaagtcatttgatatcgaagcctcctttcccatggagtctatgctaaccgtcgcagtgtacgactgggatcttgtaggcaccgatgaccttataggagagacaaaaattgatctcgagaaccgcttttacagtaagcacagggccacgtgtggtatcgctcagacttactcaactcacggatacaacatatggcgtgaccctatgaagcccagccaaattctgacgcgattgtgcaaagatggcaaagtagatggtccgcattttggcccacccggtcgggtgaaggtggccaatcgggtgtttactggacccagcgagatcgaagatgaaaatgggcagagaaaacctaccgacgaacatgtcgcactcctggcgctccgccattgggaggacatccctagagctggatgcagactcgtgcccgaacacgtcgaaactaggcccctactcaatcccgacaagcctggtatcgagcaaggaaggctggagctttgggtggatatgtttcctatggacatgcctgcgccaggtacacctcttgatatctctcccaggaagcccaaaaagtatgaactgcgagtaattatctggaacaccgacgaagttgtgctggaagacgatgatttctttaccggggaaaagtcgagtgacatcttcgtccgcggatggctcaagggccagcaggaggacaagcaggacaccgatgtgcactaccactcactaaccggcgagggcaactttaactggcggtatctgtttcctttcgactacctagccgctgaggaaaaaatagtcatctcaaaaaaggaatctatgttttcttgggacgagactgaatataaaataccagcccgcttaacactccagatttgggacgctgaccatttctctgccgatgactttctgggcgctattgagctagatctcaacaggttccctcggggggctaagactgctaaacagtgcacaatggaaatggccacgggagaagtcgatgtgcccttggtgtcgatctttaaacagaaacgcgtgaaaggctggtggccactgctggccaggaatgaaaacgacgagttcgagcttaccggaaaagtggaggctgagctgcaccttttaaccgccgaggaagccgagaagaaccccgtcggcctggcccggaacgaaccggatcccctcgaaaaacctaatcgtcctgatacgtcattcatttggtttctcaacccattgaaaagtgcaagatacttcctctggcacacctatcgctggctcctgctcaagcttttactcctgctcctgctgctgcttttacttgccctgttcctctattccgtgcctgggtacctggtcaaaaagatcctcggggcttag

SEQ ID NO: 198276 - DNA, 3693 bp, Artificial Sequence
  Description of Artificial Sequence: Synthetic coding sequence
atgatcaagaccgagaagagctaccccgagcggcggctgcggggcgtccttgaagagctttcttgcggatgctgcaggttcttgtcgctggctgacaaggaccaggggcactcctcaagaaccagactggatagagagcgactcaaatcttgcatgagggaactggagaacatggggcagcaggcacggatgctgcgtgctcaggtgaagcgccacacagtccgggacaagctcagactctgccaaaacttcctgcagaaactacgattcctggctgacgaacctcagcatagtatacccgacatattcatctggatgatgagtaataacaagcgcgtggcatatgcacgcgtgcctagcaaggatctgctgttttccatcgtagaagaagagaccggcaaagactgcgctaaagttaagaccctttttctcaagctgcctggaaaaaggggttttggatcagccgggtggactgtgcaggctaaggtagaattgtatctctggctcggattaagcaagcagcggaaggagttcctttgtggcttgccttgtggattccaggaagtgaaggccgctcaagggctgggcctgcacgcttttccccctgtatccctggtgtacaccaagaaacaggccttccagctgcgcgcccacatgtaccaggcacgtagtctgttcgcagccgactcttctggactgagcgatccatttgcacgcgttttttttattaatcaatcccaatgcacggaagtgctgaatgaaactctctgtcccacctgggatcaaatgctggtgttcgataatctggagttgtacggtgaagcccacgaattgagagatgatccaccaatcatcgtgattgagatatacgatcaggactcaatggggaaggccgatttcatgggtcgtacatttgctaagccgttagtaaagatggcggatgaagcctattgtcctcctagattcccaccacagcttgagtactatcagatctatcgcggcaatgccacagccggggatctgctggctgccttcgaactgctgcagatcgggcctgccggcaaggctgatctaccgccgatcaacggtcccgttgacgttgaccgcggcccaattatgcctgtgcctatgggtatccggccagtgctgagcaagtacagagtggaggtcctcttctggggactgcgggacttgaagagagtgaatctcgcccaagttgacaggccacgggtcgatattgaatgcgccggtaagggggtccagtccagtcttatccataattacaagaagaacccgaactttaacactttagtgaagtggtttgaagtagacctcccggaaaatgagctgcttcacccgcccctgaatattagagtcgtcgactgcagagccttcggcagatacacgctcgtcggctcccatgccgtttcatcgctgcgccgatttatatatcgcccccctgatcggtcggccccaagctggaacaccacaggcgaggtggtcgtgacaatggagccagaggtcccgattaaaaagctggagaccatggtcaaactagacgccacatccgaagcagtcgttaaggtcgatgtcgccgaggaagagaaagagaagaagaagaagaagaagggcaccgccgaagaacccgaggaagaggagccagacgaatcaatgttggattggtggtccaaatacttcgcctccattgacaccatgaaagagcaactccggcagcaggaaccgtctgggatcgacctggaggagaaggaggaggtcgataatacagagggcctgaaaggctctatgaagggaaaagaaaaggcccgtgccgccaaggaggaaaagaaaaagaagacacaatcgtccggctccgggcaaggttcagaagcaccggaaaaaaagaaacccaagattgacgagctgaaagtgtatcccaaggagctggaaagcgagttcgacaatttcgaagactggctccatacattcaatctattaaggggcaagacgggtgacgacgaagacggtagtacagaggaggagcgaatcgttggccggttcaaaggcagcctctgcgtctacaaagtgcctctgcctgaggatgtctctcgggaggccggctatgattctacttacgggatgttccaaggcattccgagcaatgatcccattaacgtgctggttcgagtgtacgttgttcgcgccaccgatcttcacccagcagacatcaacggcaaggcagacccctacatcgcaatacgcctaggcaagacagatattcgtgataaggaaaattacatttcaaagcagctcaacccagtgttcgggaagagcttcgatatcgaagccagcttcccaatggaatccatgctgactgtggccgtttatgattgggacctggtcggaacggatgacctcataggggaaacaaagatcgacttggaaaaccgtttttattccaagcatcgggccacttgtggcattgctcaaacttatagtacccacggctacaatatatggagggatccgatgaagccatcccagatcctcactcggctttgcaaggacggaaaggtggatggcccacatttcgggcctccaggccgggtgaaggtcgcaaacagggtgtttaccgggccgtcggagattgaagacgagaatggacagcgtaaacctaccgacgagcacgttgccctgctagccctgagacactgggaggatattcctagggccggctgcaggctggtgcctgagcatgtggaaacacgccctttgctcaacccggacaagccaggtattgagcaggggcggctggaactatgggtggacatgtttccaatggacatgcccgctccgggaaccccattagacatctcgccccgcaagcctaagaaatacgagctaagagtgattatttggaatacggatgaggtagtcctcgaggacgacgatttttttactggggagaagagttcagatatcttcgtacgcggctggttgaagggacagcaggaggacaaacaggatactgatgttcactaccattccctgacaggtgagggcaacttcaactggcgctatctgttccccttcgactacctggctgcagaggaaaaaatcgtgatttctaaaaaagagagcatgttctcatgggatgagactgagtacaagatcccagcccggctgacgctccagatctgggatgccgatcacttctctgccgacgacttcttgggggccattgagctcgaccttaaccgatttccaagaggggctaaaaccgccaagcagtgtaccatggagatggccaccggcgaggtggatgtgcctctggtgtccatcttcaaacagaaacgggtgaagggatggtggccactgctcgcaagaaatgagaacgacgagttcgagctgacagggaaagtggaggccgagctgcatctcctaaccgccgaggaggcagagaaaaacccggtcgggcttgccaggaacgaacctgatcctctggagaaacctaaccgccctgacaccgcctttgtttggttccttaaccctctgaaaagcatcaagtacctgatttgcactcggtataaatggctcattataaagattgtactggcgttgctgggactgctgatgctcggactcttcctatactctcttccaggctacatggttaagaaacttcttggggcttag

SEQ ID NO: 198277 - DNA, 234 bp, Artificial Sequence
  Description of Artificial Sequence: Synthetic coding sequence
gaggccgagaagaaccccgtgggcctggcccggaacgagcccgacccattggaaaaaccgaaccggccagataccgcctttgtttggtttctcaatcctctgaaaagcatcaagtacctcatctgtacacggtataaatggttaattattaaaatcgttttggcccttggctgtagttgctgggggcccctgcagcccccgtggctccacggacaaaaggccccctgggggtag

SEQ ID NO: 198278 - DNA, 342 bp, Artificial Sequence
  Description of Artificial Sequence: Synthetic coding sequence
gacttcctgggcgacgagagcctgcaggaggaggagaaggacagccaagagaccgacggattgctgcccggctcgcggccatcatccagacctccgggcgagaagagctttaggagcaagggtagggaaaagactaagggaggacgcgatgatgagcataaggccgggcggagcgtatttagcgcaatgaaactcggcaaaaatcgaagtcataaggaggaaccgcagagacctgacgaacctgcggtgctggagatggaagatctggatcacctcgctattagacttggcgacggattagatcccgactccgtgtctcttgcctctgtcacagcactgtag

SEQ ID NO: 198279 - DNA, 3924 bp, Artificial Sequence
  Description of Artificial Sequence: Synthetic coding sequence
atgatgaccgacacccaggacggccccagcgagagcagccagatcatgcgcagtctaacccctttgattaatagagaagaagcattcggagaggccggcgaggcagggttatggcccagcatcacccacacccctgacagtcaggaggagggtttgaacgacatccaagaaatgataaagactgagaagagctatcccgaacggcgcttacggggagtcctggaagagctctcatgcggctgctgcaggtttctgagccttgcggacaaggaccaaggccacagcagtagaacacgtttagaccgggagcggctaaagagctgtatgagagaactggagaacatggggcaacaagcaaggatgttgcgcgctcaggtgaagagacataccgtgagggataaattgaggttatgtcaaaattttcttcagaaactgaggttcctcgcagacgaaccacagcactccatccccgacatcttcatttggatgatgtccaacaataagagggtcgcatacgcgcgcgtgccctctaaggacctgttgttctcgattgttgaggaggagacgggtaaagattgcgccaaggtgaagactctgttcctgaaactgccaggcaagcgcggcttcggtagtgctgggtggacagtgcaggctaaggtagagctctacttatggctggggttatcaaagcaacgaaaggaatttctgtgtggcctgccttgtggtttccaagaagtcaaggctgcccaggggctcggcctgcatgcctttccccccgtcagtctggtgtacacaaagaagcaggcgtttcagctgagagcacatatgtatcaggccaggagtctcttcgctgctgactcctctggcctaagtgacccgttcgcccgcgtctttttcatcaaccagtcccaatgcaccgaggtgctgaacgagacactgtgcccaacctgggatcagatgttagtcttcgataatcttgagttatatggtgaagctcacgagcttagagacgatcccccaatcatagttattgaaatctatgatcaggattcaatgggcaaagctgatttcatgggcaggacattcgcgaaaccgcttgtgaagatggctgatgaagcctattgcccacccagatttcctccacagctggaatactaccagatctaccgaggaaatgccacagccggtgatttactggcggccttcgagctgcttcagatcggcccagccggaaaggccgatctccctccgatcaatggccccgtggacgtggatcggggccccattatgccagttcccatgggaataagacccgtcttatccaaatatagggtggaggtgctgttctggggccttcgcgatctgaaacgagttaatcttgcacaagtggaccgcccaagagtggatatcgagtgtgctggcaagggtgtacagagcagccttattcataactataaaaaaaacccaaactttaacactttggtcaaatggttcgaggtggatctgccggagaacgaattattgcatcctccccttaatatccgcgttgttgattgtcgagccttcggcagatatactttggtggggtctcatgccgttagcagtctccgacgctttatctatcgacccccggatagaagtgccccgtcctggaatacaaccgtgcggctgctcagaaggtgcagggtgctttgcaacggcggctccagctcacacagcaccggagaggtggtggtgacaatggaaccagaggttccaatcaagaagttagaaacgatggttaaacttgacgctaccagcgaggctgtggtaaaagtcgacgtcgcagaagaagagaaggagaagaaaaaaaagaagaagggtactgccgaagagccagaggaggaagaacccgacgaatccatgctggattggtggagtaaatacttcgcgtcaattgatacaatgaaggagcagctgagacagcaggagcctagcgggatagacttagaagaaaaggaagaggtggacaacacagaggggctgaaaggctccatgaagggtaaggagaaagcccgtgcagctaaagaagagaaaaagaaaaaaacgcagtcatcaggctcaggacagggctccgaggcccctgagaaaaaaaagccaaagatcgatgagctcaaagtgtatcccaaagaactggagtctgaatttgacaacttcgaagactggctgcatacgttcaacctgctccggggcaaaacaggcgatgatgaagacgggtctacagaagaggagcggattgtaggtcgcttcaaaggaagcttgtgtgtttataaggtgcccttgccagaggacgtttctcgggaagccggatacgattctacatacggaatgttccaaggtatcccctctaacgaccccattaacgtactggtgcgcgtctacgtagttagagccactgacttacaccccgctgacataaacggcaaagcggacccgtatatcgctataagactcggtaagacagacatcagggacaaagaaaactatatatccaaacagcttaatcccgtcttcgggaagtcattcgacatcgaagccagttttccgatggagtctatgctgactgtggcagtctatgattgggacctggtcggcaccgacgatttaataggtgaaacaaaaattgacctggagaatcgcttttactccaaacatcgggcaacctgtggcattgcacagacttactctactcacgggtataacatctggcgcgaccctatgaagccctcccagatcctgacccgcctctgcaaagacggaaaggtcgacggcccccacttcgggccccccggacgcgtcaaagtggcaaaccgtgtttttactgggcccagcgaaatcgaagacgagaacggtcagcgaaaacctacggatgagcatgttgcgttgctcgcactcagacattgggaagatattccccgagcgggatgtcgtctcgtgcctgagcatgtggagacacgcccacttctgaaccccgataaacctggtatagagcagggccgactggaattatgggtggatatgtttccaatggacatgcctgcccccggaacgcctttggacattagccctagaaagccaaagaagtacgagcttcgggtaataatctggaatacagatgaagtagtgctagaggacgatgacttcttcaccggtgagaagagttctgatatattcgttagaggatggttaaagggacagcaagaagataagcaggatactgatgttcactatcattcacttactggagagggtaattttaattggcgttacttgttccccttcgactacctcgctgctgaggagaaaattgttatctcaaagaaggagtccatgtttagctgggacgagaccgaatacaagataccagcgcgccttacgctccagatttgggatgccgaccattttagcgctgatgatttccttggggccatcgagctggaccttaacagatttcctagaggtgccaaaaccgcaaagcagtgcaccatggaaatggcgactggcgaggtggacgtgcccctggtttctatctttaaacagaaacgtgtcaaggggtggtggcctcttttggctaggaatgaaaacgacgagttcgagctgacgggcaaggtcgaagccgagttacacttgcttaccgccgaggaggccgagaaaaatcctgtagggctagctagaaatgaaccggatcctctggagaaaccaaatagacctgatacttcatttatctggttcctcaaccctctgaagtccgcccgttattttctctggcacacctaccgttggttactgctgaagcttctgctcctgctgctgcttctcttgctgctcgctctatttctctacagcgtgcctggctacctggttaagaagatcctcggcgcctag

SEQ ID NO: 198280 - DNA, 4527 bp, Artificial Sequence
  Description of Artificial Sequence: Synthetic coding sequence
atgttccccgcccggggcgtgcccctgcacctggagggcgagggcgtgtttccctggggaccaggggacgtgagtttgccatatctgtctacctctgacgtaagcttcagcgtaatcgtcgagaatgtaaactgttactcttctgggatgatttgtagaaaattcatttcaatcaacgttggcaacagcctaatcgtgttcgatgacgatagcggcaatccaagccccgagtcctttctggacgataagcaggaggtgcatacttggagggtgggcttctttacgctcgtgcattttccccaggaacatatcaccttactttgggaccagcgcaccactgtgcacgtgcaggccgggccacagtggcagggccagttggcgggcctatgcggaaactttgatttgaaaaccataaacgagatgcgtacaccggagaatctcgagctgacaaacccccaggagttcggatcgtcctgggctgccgttgagtgtccagacactctggacccccgcgatatgtgcgtgctgaatcctttgagggagccttttgccaagaaggagtgcagcatactgctgtccgaagtgtttgagatctgccatcctgtggtggatgtgacctggttttattctaactgcttgacagacacctgcgggtgctctcaaggaggcgattgcgaatgtttttgcgcctctgtgagcgcctatgcacaccaatgctgtcaacacggcgtggctgtcgattggcgcacacctagactgtgcctgttaggtaaaggcccctatcagctcagcagcctcgctgcaggcggcgctctagttggcatgaaggcagtgggcgacgacattgtactggttcggaccgaagatgtggcccccgcggatatcgtctcatttttgcttaccgctgccctgtacaaagcgaaggcccatgaccctgacgtggtatcactggaggccgcggatcggcctaacttcttcctgcacgtcaccgctaacgggtccctagagctggcaaagtggcaggggcgagatacctttcagcagcacgcatcctttcttctacaccgcggaacaaggcaggcgggactggtcgcactggagagccttgccaaaccgtcttctttcctctacgtctcaggcgcagttctcgcgctacgcctctatgaacacaccgaggtttttcggaggggcaccctgtttcggctgttggatgcaaagcccagtggggctgcataccctatttgtgaatggaggtacgacgcctgcgcctccccgtgcttccagacttgcagggatcctcgggctgcctcttgtcgagatgtgcctagggtggagggatgtgtcccggtgtgccccaccccccaagtgctggacgaggtcacccagaggtgcgtgtacctggaggactgcgtcgaacccgccgtttgggtccctaccgaggcactaggtaatgaaaccctaccacccagtcaggggttgccaactccttcagacgaagaaccacagctgtcacaagagtcacccaggacgcccacccataggccagcactgactccagccgcacctttgaccacagctcttaaccctccagttactgccactgaggaaccagtagtttcgcccgggcccacacagactaccttacagcagcccctcgaactgacagcatctcagcttccggctggacctactgagagccccgcgagcaagggagtaaccgctagcctgctcgcaataccacatacaccagagtcgagcagcctgcctgtggccttgcagacccctaccccgggtatggtgtcaggcgcaatggaaaccacaagagtaaccgttatcttcgccggctctccaaacattacagtgagtagccgcagccccccagcaccaagattcccattgatgactaaggccgttaccgttagaggacacggctctctgccagtccgtacaacacccccccaaccgagcttaacagcaagcccttcatcccgcccagtcgcgagtccaggcgccattagccgttctcctacctcatcaggaagccacaaggctgtactgacacccgctgtgaccaaagtgattagtagaactggggtgccccagcccacacaggcccaatccgcctctagtccatctaccccactcactgtggccggcactgctgctgaacaggtcccagtgagtcccttggccactaggtccctcgaaattgtcctgagcactgaaaaaggtgaggcaggtcacagccaacctatgggttcacctgccagtcctcagccacaccccctgccaagcgcaccccctaggcctgcgcaacacactacaatggcgactcgatcccccgccttgccccccgagacccctgctgcagcatcactaagcactgccacagacggactggcagcaacgccctttatgtctctagaaagtacccggccttctcaactcctttctggtctgccacccgacacctcactacccctcgccaaggtcggtacctcagccccagtcgccaccccaggcccaaaggcaagtgtcatcacgacacccctgcaacctcaagcgaccacccttccagcccagaccctctcacctgttcttccctttacccctgctgctatgacacaggcacatccccctacacatatcgctcctccggccgccggcactgcaccgggcctcctgcttggcgcaacattgcccacctccggcgtgctcccggtggcggaaggaacggcctcaatggtgtccgtggtgccgaggaagtcaaccacgggaaaggtggcgattttgagtaaacaggtgtctttgcctacaagcatgtatggctctgctgaaggcggacccactgaactaaccccagccaccagccatcctttgactcctttggtggccgaaccagagggcgctcaggcgggaacggccctgcctgtccctacgtcatatgccctgagccgggtatccgcaagaacagcaccacaagactccatgctggtcttgctaccccagctggcagaggcccatggcacatccgccggtccacatttagccgcagaacccgtcgatgaggctaccaccgagccatccggaaggtccgctcctgcactctctatcgtggagggacttgctgaggcactggcgacaaccacagaagcaaacacttccaccacctgcgtgcccatcgcagagcaggactgcgtccggcatatatgtctcgaggggcagctcatccgtgtcaatcagagccaacattgtcctcaaggcgcagcgccccctaggtgcggcatcttagggctagccgtccgcgttggtggggaccgatgctgtcccctgtgggagtgtgcttgccggtgtagcatcttccctgacttaagcttcgtgaccttcgacggatcgcatgttgccctgttcaaagaggcaatctacattttgagccagagccccgacgagatgttaacggtacatgtcttggattgcaagtctgcgaatctgggccacctgaattggcctccgttctgtttggtgatgctgaatatgacccacttagcccaccaggtgaccattgatcgctttaatagaaaagtaactgtggatttgcagccagtctggcctccagtgagtaggtacggcttccggatcgaggataccggtcatatgtatatgattctcacaccatccgatatccagattcagtggttacactcatcgggcctaatgattgtggaggcaagcaagacctcgaaggcacaggggcacggtctgtgcggtatctgcgatggcgacgctgctaatgatttgacactgaaggatggcagcgtggtaggcggtgcagaggaccctgccccattcttagatagctggcaagtgccctctagcctaacatccgttggccagacacgcttccgtccagattcctgtgccaccaccgattgctctccatgtctgagaatggtgtccaatcgaacgtttagtgcttgtcatcgctttgtgcctccagagtctttctgcgagttgtggatcagagataccaagtatgtccaacagccctgtgtggcgctgacagtgtacgtggcaatgtgccacaagttccacgtgtgcatcgaatggaggagaagtgattattgcccattcctctgtagttccgattcgacataccaagcctgcgtcacagcctgtgagcctcccaaaacatgtcaggatgggatcctcggacccctggaccctgagcactgtcaggtcttaggtgagggatgtgtgtgctccgaggggaccatcctgcaccggcgccactcagccctgtgcatcccagaagctaagtgtgcctgcggagactgtcctgatagcataccagagtgtcaagagggcgaggcgttgactgttcatcgcaacactacagagctgtgttgcccattgtatcagtgcgtgtgtgagaactttcggtgtccacaggttcagtgcggtctcgggactgctctggtcgaagtgtggagcccagaccggtgttgtccctacaagtcctgtgggtag

SEQ ID NO: 198281 - DNA, 8778 bp, Artificial Sequence
  Description of Artificial Sequence: Synthetic coding sequence
atgggcgtgctggccagcgccctgtgctggctgctgtgcgtgtggctcccttggggcgaacaggccgccgaaagtctgcgcgtccagcgcctgggggaacgcgtggtggacagtggacgctctggcgcacgggggatgcgcaacgtcaaaggcatgcgaaatggacccgcccagaccagggtgtcttcatcatctagccatcaggaggccacactagctatgggggacaaggctaccgtcgttggcggccagcaggcggaggctcccgattctgtcgccatgagtagttgggaaaggcgactgcacagggcgaagtgcgccccaagttacctttttagttgcttcaatgggggagagtgcgtgcaccccgccttttgtgattgtcgccgctttaatgctactggtccgaggtgccagatggtatacaacgccggacccgagcgcgactcaatctgccgcgcttgggggcagcaccacgtggagacattcgatgggctgtattattacttaagcgggaaggggtcctacactttggtgggacgccacgagcccgaggggcagagcttcagcattcaggtgcacaatgatcctcaatgtggaagtagtccatacacctgcagccgcgccgttagtctgttcttcgtcggggagcaggaaatccatcttgcgaaagaagtcacacacgggggaatgagggttcagcttcctcacgttatggggagtgctagactgcagcagctggctggctatgtcattgtgcggcaccagagcgcttttactctggcttgggacggcgccagtgccgtgtatattaagatgagtcctgagctgctggggtggactcacggactttgcggtaacaataatgccgatccgaaggacgatctcgtcacttcctccggcaagctgacagatgatgtggtcgaattcgtccattcatggcaggagcaggccccaaaccaaccacccgggccaaccacctcaagcctgccccgcccaccatgtctgcagcagaatcccgggactatgcagggtgtctatgaacagtgtgaggctctgctgaggcctccatttgatgcttgtcacgcttacgtttctccgctgcccttcaccgcaagttgtacatcagatctttgccagtctatgggagacgttgctacgtggtgtagagccctggccgaatatgcacgggcatgcgcacaggccgggaggcctctccagggatggagaactcagctgagacaatgtaccgtgcattgtaaggaaaaggccttcacctacaacgagtgtatcgcgtgttgccctgcttcttgtcacccccgggctagttgcgtcgacagtgaaatcgcgtgcgtggatgggtgctattgtcccaatggactaatatttgaagatggcggctgtgtggcccccgccgagtgtccatgtgagtttcacggcaccctctaccctccaggctcagtcgtgaaggaggattgcaacacctgcacatgcacatctggcaaatgggagtgtagcaccgcggtgtgtcccgcagagtgttcggtgaccggtgatatacactttactacgtttgatggccggcggtacactttcccagcaacctgccagtatattctcgcaaagtccagaagctccggcaccttcaccgtcaccctgcagaatgctccctgcggcttgaaccaggatggggcctgtgttcagtccgtgagcgtgatccttcatcaggaccctcggcgccaggtgactctaactcaagcaggagacgtactactgttcgatcagtacaaaatcattcctccgtacaccgatgatgccttcgagatacgacgcctgtcatccgttttcttgagggtccgcacgaacgtgggggtaagagttctttacgaccgggaggggcttcgactgtatctgcaggtcgaccagcgctgggttgaagacaccgtggggctctgtggaacctttaacgggaatacacaggacgacttcttgtcacccgtgggcgtcccggagtctacacctcagctatttggtaatagttggaagaccctgtcagcatgttcgccattagtgtccggctcccccctcgatccttgtgacgtgcacctccaagctgcgtcttactcagtgcaggcttgcagcgtactcacaggtgagatgtttgccccctgcagcgccttcctgagtccggtaccttactttgaacaatgcagacgcgacgcctgccgctgtggacagccgtgtctttgcgcaactcttgcacactacgcacacctctgccgaaggcatggactgcccgtggactttagggccaggcttcccgcctgcgccttgagttgcgaggcctctaaagagtacagcccttgcgtcgctccttgcgggaggacctgtcaggaccttgcttctcccgaagcctgcggagtagacggaggtgacgatctcagccgtgacgaatgcgtggagggctgtgcctgccctccagacacctatctcgacactcaagccgatctgtgtgtccctcggaaccagtgttcctgccatttccaaggcgtggattacccccccggagactccgatattccctcacttgggcattgccattgtaaggatggggtaatgtcttgtgactcgcgcgctcccgccgctgcgtgtcctgccggacaagttttcgtcaactgctccgacctgcataccgacctcgaacttagcagagaacgcacttgcgagcagcagctgctgaacctctctgtgtccgctcgagggccttgcctgtccggctgtgcatgtccacagggccttctgcggcacggcgacgcgtgctttctccctgaagagtgcccctgtacatggaaggggaaagagtatttcccaggggaccaggtgatgagcccctgccacacatgcgtgtgtcaacgcggcagcttccagtgcaccttacatccatgtgcctctacatgcacagcgtacggggatcgccactaccggacatttgatggattgccctttgatttcgtcggggcttgcaaggtgcatctagtaaaatccacaagcgatgtttccttctccgttatagttgagaatgtcaattgttactcttcaggtatgatctgtagaaaatttattagcataaatgtgggaaattctttaatcgtcttcgacgacgactcgggaaacccttcccccgaaagctttctcgacgacaagcaggaggtgcatacatggcgcgtgggctttttcaccttggttcatttcccccaggaacacattaccctgttgtgggatcagcgtacgacagtgcatgtgcaggcaggcccccagtggcaaggccaattagcagggctttgcggaaactttgacctgaagaccatcaatgagatgagaactcctgagaatctggaactcacaaatccacaagagtttggcagctcgtgggcagcggtggagtgcccagacacactggaccctagggacatgtgtgtgctcaaccctctccgggaaccctttgcaaagaaggagtgcagcatcctcttgtctgaggtgtttgagatctgtcatccagtggtggacgtcacatggttctattctaactgcctcacggacacatgcgggtgcagccagggtggcgattgcgaatgtttctgcgccagtgttagcgcatatgcacaccaatgttgtcagcatggagtcgccgtggattggcggacaccaaggctgtgtccttacgattgtgacttttttaataaagtattggggaagggtccttatcaactctctagtttagccgcaggtggcgctttagtggggatgaaagccgtgggcgatgacatcgtgctagtccgaaccgaggacgtggcaccagctgacatcgtatcgttcctcctgacagctgctctgtacaaggctaaggcacacgacccggacgtggtgagtttggaagctgctgatcgccctaactttttcctgcatgtaacggccaatggctctcttgagctggccaaatggcagggaagggatacattccagcagcacgcctctttcctgttgcacagagggacccggcaggccggcctggtagccctcgagtccttggctaaaccatcttcattcctctatgtttctggcgccgtgttagccctacggctctacgagcacacagaagtgttccggcggggcactctgtttcggctgctcgacgctaaaccctctggggccgcctatccaatatgtgaatggaggtacgatgcctgtgcgtcaccatgcttccagacctgccgtgatcccagggcagcttcttgcagggacgtcccaagggtggagggatgtgtccccgtgtgtcctacgcctcaggtactggacgaagtcacacagagatgcgtgtacctcgaggattgtgtggaacctgctgtgtgggtgccaaccgaggcactcggcaacgagacgttgcctccttcccagggtcttcctaccccctcagacgaggagccacaattaagccaggaatctccgcgaactcctactcatagacccgcactgacccctgctgctccccttacaaccgctttgaatcccccggtcaccgctaccgaggagccagtggtttcacctggcccgacacaaacaacacttcagcaacccctggaactgacagcctcacaacttcccgccggacccacagagtcccccgcctcaaagggggttaccgccagccttcttgccataccccataccccagagagctcctctttgcccgtcgccctgcagactcccactcccggaatggtctctggcgctatggagacaactcgggttaccgtgatctttgccggatccccaaacatcacagtgtccagtaggtcaccccccgcacctcgtttccccctgatgacaaaggccgtgacagtccgcgggcatggaagcttgcctgtgagaactacacctccacagccttctcttacagcttctcctagttccaggcccgttgcctcccccggggcaatttccaggtccccgacctcatctggaagtcataaggccgtactcacacccgctgtcaccaaagtcatcagcaggaccggtgtcccacaaccaactcaggcacaatctgccagctcaccaagtacacctctgaccgtggcgggaactgcagccgaacaggtcccagtgtcccccctagccactagaagcctggagattgtgctctcaacagagaagggggaggctggacattcccagcctatggggtctccagctagtccgcagccgcaccccttgccttctgctccccctcgccccgcccaacacacgaccatggcaaccaggtcccctgctctcccaccggaaacaccagccgcggcctccttgtctactgccacagatgggcttgctgctacccctttcatgtctttggaatctacgagaccgtctcagctgctgtctgggctgccaccggacacatcccttcccctcgctaaggtcggcacgagtgcccctgtcgctactcccggccccaaggcttccgtgattacaacacccctgcagccccaagcaactaccctgcccgctcagactctctctcctgtgctgccttttactcctgcagctatgactcaggcacatccaccgacacacatcgctccacctgcggctgggaccgcccccgggctgctgctgggcgccacgctgcccacttccggcgttctcccagtggcggaaggaaccgccagcatggttagtgtggttccacgcaaaagtacgacggggaaggtggcaatcctcagtaagcaggtgtctctcccaaccagtatgtacggcagtgctgagggaggcccgaccgagctcacccccgcaacaagccacccgctcactcccctggtagcagagcctgaaggagcccaggctgggacagctctccctgtacctacatcctatgcactgagccgcgtgtctgctaggactgctccacaggatagcatgctcgtcctcctgcctcagctggccgaggctcatgggacttccgctggacctcatctggctgccgagcccgtcgacgaggctacaactgagccatctggacgctccgccccagccctctcaattgttgagggtctcgccgaggcccttgccacaaccactgaggccaatacctctactacctgtgtgcccatcgccgaacaggactgcgtccgacacatctgcctggagggtcagttgataagggtgaaccagagccagcactgtccccagggcgctgccccaccccggtgcggtattctcggcttggcggtacgtgtgggaggcgataggtgttgccctttgtgggagtgcgcatgtagatgcagtatcttccccgacttatcatttgtgacattcgatggaagccatgtcgctttgtttaaggaggccatatacatcctatcccagtcacccgatgagatgctgactgtacacgtgctcgattgcaaatccgcaaatttgggccatcttaactggcctccattttgtctcgtgatgttgaatatgacgcacctggcacaccaggtgactatagatcggttcaataggaaagtgaccgtggacctgcagcctgtatggcctcccgtgagtagatacggctttaggattgaggatacaggccacatgtatatgatactgaccccgtccgatatacagattcaatggttgcactcatctgggcttatgattgtggaagcctcaaaaactagtaaagcccagggccatggtctatgtggcatttgtgacggagacgcagctaacgatctgaccctcaaagacggatcagtcgtggggggcgctgaagaccctgccccgtttctggactcctggcaagtaccaagctcattaacctcagtcggccaaacccgattccgcccagatagttgcgccacaaccgactgttcgccttgcttacggatggtctccaataggacattttccgcttgccaccgtttcgtgccacctgaatctttctgtgaattatggattcgggacacgaagtacgttcagcagccctgcgttgcgttgactgtgtacgtcgcaatgtgccacaagtttcacgtgtgtatcgaatggcggcgctccgactattgtccattcctgtgctcttcagactccacctatcaggcatgcgtcaccgcctgcgaaccccccaagacatgtcaggacggcatcctggggcctcttgaccctgagcactgccaagtcctgggcgaggggtgtgtgtgcagtgagggcactatccttcaccggcggcactctgctctgtgcattccggaggccaaatgcgcatgtacagatagcatgggagtgccgcgggctttgggtgagacctggaattccagccttagcggctgctgtcagcaccagtgccaggctcctgacaccatcgtgccagttgatttgggatgtccttcaccacgccctgaatcttgtctgaggttcggggaggtggctctgctgctcccgaccaaggatccctgctgcttgggaacagtgtgtgtttgcaatcagacactttgtgaaggcttggcccctacgtgccgtcccgggcaccgtctcctcacacacttccaagaggacagctgctgcccatcctattcttgcgagtgtgaccccgatctgtgcgaagccgaacttgtcccaagttgccgccaggatcaaatcctgatcactggacgactgggagactcttgttgcactagctatttctgtgcctgtggggactgtccagatagcattcccgagtgtcaggagggcgaggcgcttacagtgcatagaaacacaaccgagctgtgttgccccctgtaccagtgtgtatgcgaaaactttagatgtccacaggttcagtgtggcctgggaaccgcgcttgtggaggtttggtccccagacagatgctgcccatacaaaagctgtgaatgcgattgtgacaccatacccgtgcctcggtgccatttatgggagaagagccagttggatgaggagttcatgcactccgttgaaaacgtctgcgggtgtgccaagtatgagtgtgtgaaagcacctgtatgtctctcaagagagctgggcgtcatgcagcctggccaaacggtggtggagctctccgccgacggcgtgtgtcatacttctcgctgtacaaccgtcttggatcccctaactaacttttaccagattaacaccacctcagtactgtgcgacatccattgcgaggcaaaccaagagtacgaacacccgcgggatctggctgcttgttgcggcagctgtaggaacgtgtcgtgcctcttcactttccctaatggcacaacctccttgtttctgcccggagcctcctggattgcagattgcgcccgccatcactgcagttcgacccccttgggcgctgtgctggtgcgcagccctattagctgcccacctttgaatgagacagaatgcgcaaaggttgggggctctgtggtaccttcacttgaaggatgttgccgaacttgtaaggaggatggccgctcatgtaaaaaagtcactattcgcatgaccattaggaagaacgagtgtagatcaagtacgcctgtcaatctcgtgtcctgtgatggccgctgcccatcggcgtccatctacaactataacatcaacacctatgcacgcttctgcaagtgttgtagagaggtgggactgcagagaaggagcgtacagctattctgcgccacaaacgctacttgggttccatatacagtacaggaaccaactgactgtgcatgccagtggagctag

SEQ ID NO: 198282 - DNA, 387 bp, Artificial Sequence
  Description of Artificial Sequence: Synthetic coding sequence
atggcccggatcctgctgctgttcctgcccggcctggtggccgtgtgtgccgttcacggaatttttatggatagattggcttccaaaaaactctgcgccgacgacgaatgtgtgtacaccattagcctggcatctgcccaggaagactataatgcaccagactgccgcttcatcaacgttaagaagggccagcaaatatacgtgtattctaaactagtcaaggagaacggggctggcgaattctgggctggatccgtgtacggcgatgggcaagacgaaatgggggttgtcggctattttccccgcaatctcgtgaaagagcagagggtgtatcaggaggcaacgaaagaagtcccgaccactgatatcgatttcttctgcgaatag

SEQ ID NO: 198283 - DNA, 1446 bp, Artificial Sequence
  Description of Artificial Sequence: Synthetic coding sequence
atgcagctgtacagcagcgtgtgcacccactaccccgccggcgccccagggccaaccgctgctgctccagccccccctgcagcagccaccccgttcaaagttagcctgcagcctcctggcgcagccggtgcggcccccgagccagagaccggtgaatgtcagccggccgccgccgctgagcatcgggaagcggccgcagtccccgccgcgaagatgcccgcatttagctcctgcttcgaggtggtgagtggggctgcggctccagccagtgctgccgctggacctccgggcgcttcctgcaaaccacctctgcctccccattatacatccaccgctcaaatcactgttagagcactcggtgcggaccgtttactgctgcacggaccagaccctgtgccaggagcagccggcagtgctgcagctccccgaggtaggtgtctcctcctcgcccccgccccagctgcaccagtcccacccagacggggcagttccgcatggctgttagaagagcttctgcgcccagactgtccagagccagcaggcctcgatgctacccgagagggaccagacagaaacttccgactgtctgaacaccggcaagccctggccgccgccaagcatcgcggaccggcggctactcccggctccccagacccaggacctgggccttggggcgaggagcatctcgctgaacgtggccctaggggctgggaaagaggcggcgaccgttgcgatgcccccgggggcgatgccgctcggaggcctgatcctgaggcagaggctcctccagccggcagtatagaggcagcgccatcctcagcagccgaacccgtgattgttagcagatctgaccccagggatgaaaagcttgctctgtacctcgctgaggtagaaaaacaagacaagtacctgcgtcagcgcaacaagtaccgtttccacatcattcccgatggtaactgcttatatagggctgtgagcaagacagtatacggggaccagtcattgcaccgtgagctcagagagcagacagtccattatattgctgaccacctggaccacttctcacctctaatcgagggcgacgttggcgaattcatcatagctgccgctcaggatggggcctgggccgggtaccctgagttgctggccatgggccaaatgctgaacgtcaatatccatttgactactgggggcaggttggagtcccctacagtgtctacaatgattcactaccttggtccagaggattctcttcggcctagcatttggctctcatggctcagcaacgggcactatgacgccgtgttcgaccatagctaccctaatccggaatatgacaactggtgcaagcagacacaggttcaacggaagcgagatgaggaactcgcgaaatccatggctatttctctgagcaaaatgtatattgaacagaacgcctgtagctag

SEQ ID NO: 198284 - DNA, 1197 bp, Artificial Sequence
  Description of Artificial Sequence: Synthetic coding sequence
atgagccggaagcaggccgccaagagccggcccggcagcggcagccgcaaggcagaggccgaacgcaagagggacgagcgcgcggctcgtagggctctagcgaaggagaggcgtaacagacccgaaagtggcggcggaggcggatgcgaggaggagtttgtgagcttcgcaaaccagcttcaggcgctcggattaaagctgagagaagttccaggggacgggaactgtttgttccgggccctcggcgatcagctcgaaggacactcccgtaatcacctcaagcatcgccaggaaaccgttgattacatgatcaaacagagggaggatttcgagccatttgtggaagatgatataccatttgagaaacatgtggccagtttggctaagcctggcacttttgcaggcaacgatgccatagtcgcattcgctaggaatcaccagttaaacgtagtgatccatcaactgaacgccccactttggcagatccggggaacagaaaagtcctcagtcagggaactgcacatcgcatatcgctacggagaacactacgacagcgttagaagaatcaacgataacagtgaggccccggcccatctccaaaccgactttcagatgcttcaccaagatgaaagcaataaacgcgaaaaaatcaagaccaaagggatggactcggaagatgacctaagagatgaggtggaagacgccgtgcagaaggtctgtaatgcaaccggttgctccgattttaatctgatcgtgcagaacctcgaggcagagaattacaatatcgagtctgcaattattgctgttctcaggatgaatcagggaaaaaggaacaacgccgaggaaaacctggagcctagtggacgagtccttaagcagtgcggccctctgtgggaagaaggaggaagcggagcgagaattttcggaaaccaaggcctgaatgagggaaggacagaaaacaacaaagcccaggcttcaccgagcgaagaaaataaagctaacaagaaccaattagcaaaggtcaccaataaacagcggagagagcagcagtggatggaaaagaagaagcggcaggaggagaggcatcgccataaagcacttgaatctcggggatcccatcgggacaacaacaggagcgaggctgaagccaacacccaggtaacgctagtcaaaacttttgctgctcttaacatctag

SEQ ID NO: 198285 - DNA, 438 bp, Artificial Sequence
  Description of Artificial Sequence: Synthetic coding sequence
atggcctgcatccactacctgcgggagaaccgggagaagttcgaggccttcatcgagggctccttcgaagagtacctgaagcggttggagaatccacaggaatgggttggacaggtagagatatcagctctgagcctgatgtatcgcaaggactttattatctaccgcgagcccaacgtctcaccaagtcaggtgactgaaaataactttccagaaaaggtgttactctgtttctcaaacggaaaccactacgatattgtgtatccaatcaagtataaagaatcgtctgctatgtgccagagcctgctttacgagctactatatgagaaagtatttaagaccgacgtgtctaaaatcgtgatggagctcgacacattggaggtcgctgatgaggataatagtgagatctcagactccgaagatgatagctgtaaatag

SEQ ID NO: 198286 - DNA, 3345 bp, Artificial Sequence
  Description of Artificial Sequence: Synthetic coding sequence
atggaggccgccgtgggcgtgcccgacggcggcgaccagggcggcgcgggtcctcgggaagatgccacaccaatggacgcatatttgcgcaagctgggtctctataggaaactggttgctaaggacgggtcctgcctattccgagcagttgcagaacaggtactgcattctcagagtcgccacgtggaggtgcgcatggcttgcattcattacttaagagaaaacagggaaaagttcgaggcctttattgagggttcatttgaggagtatttgaagcgcttagagaatccccaggagtgggtcggccaggttgagattagtgctctttctctgatgtataggaaagactttatcatttacagagagcctaatgtgtcaccgtcccaagttacagagaataatttcccagagaaggtgctgctctgctttagcaatggcaatcactacgatattgtctaccctatcaagtacaaggagtcttcagccatgtgccagagtctgctatacgaactgctctacgagaaagtctttaagaccgacgtctccaaaatcgtcatggaactcgatactttggaagtggccgacgaggacaactccgagataagcgattctgaggatgattcgtgcaaaagtaagaccgccgccgctgctgcagacgtcaacggattcaaacccctgagcgggaacgaacaactaaaaaataacggcaatagtacctccctcccgcttagtagaaaggtcctgaaatctctcaaccccgccgtctatcggaatgtggaatatgagatttggctgaagtccaagcaagctcaacaaaagagggactactccattgcggcggggctccaatatgaggtgggggataaatgccaggttcggctcgaccacaacggcaagtttctgaacgccgacgtgcagggaatacattccgagaacgggccggtcctggtggaagaacttgggaagaagcatacatctaagaaccttaaagccccaccccctgaatcctggaacactgttagcggaaagaaaatgaagaagccaagcaccagcggtcagaactttcactctgacgttgattaccgggggccaaaaaacccatctaagccaataaaggccccatcagccttgcccccacggttacagcaccctagtggcgtgaggcagcacgcattttctagccatagttccggcagtcagtctcagaagttttcgtcagaacataagaaccttagccgtacacccagccaaatcatacgaaagcccgatcgggaaagagtggaagacttcgaccacacctcacgtgaatccaactactttggcctgagtccggaggaaagaagagagaagcaggccattgaggaaagtaggctcctatatgaaatccaaaaccgggacgagcaagcatttccagctttgagttcctcgtctgtcaaccagagcgccagccagagctcaaatccctgcgtccagaggaagagctcacatgtgggggataggaaggggtctcggcgaagaatggataccgaggagaggaaggataaggactcgatccacggacactcacagctggacaagcggcctgagccttcaacattggaaaacatcactgatgacaaatatgcaaccgtgtctagtccaagtaaatccaagaagttagagtgcccgagccccgccgagcagaaacctgccgaacacgtgagtctttccaaccccgcaccgctgctggttagcccagaggtgcacttgactcccgctgtccccagtctccctgctaccgtccccgcttggccatccgagcctacgacctttggccctacgggcgtgccggcccccatccctgtcctgagtgtcactcagacgctgaccaccggaccggacagtgcggtgtcccaagcacaccttaccccttcacctgtgccggtttctatccaggctgtgaatcaacccctgatgcctctcccacagaccctgtcactttatcaggatcctctgtacccagggtttccctgtaacgagaagggcgatagagccatcgtgccaccatattctttgtgtcagaccggtgaggacctgccaaaagacaaaaacatcttgcgattttttttcaacctcggagtaaaggcgtattcctgcccaatgtgggccccacatagctatttatatcctctgcatcaagcctatctggcagcatgccgcatgtaccctaaagtgccagttcccgtttatccccataatccatggtttcaggaggcacctgcagcacagaacgagtccgattgcacatgtacggatgctcactttcctatgcagacagaggcgagtgtgaatggccagatgccacagcctgaaatcggcccgccaaccttctccagtccactagtaatacccccttcccaggtgtcggagagtcacgggcaactatcctaccaggcagaccttgagtccgagacaccaggacagctcttgcacgcagattacgaagaatcattgtctggcaaaaatatgttcccccagccgagctttggccctaacccatttctgggacccgtgcctattgctccccccttctttccccacgtgtggtatggctatccctttcaggggttcatcgagaatcccgtcatgaggcagaacatagtgttgccttccgacgagaagggggagctggatctgtctctcgagaatctcgacctaagcaaggactgcggtagcgtaagtaccgtcgatgaatttcccgaggctcggggtgagcacgtgcactctctccccgaggcaagtgtctcgtcaaagccggacgaaggaaggaccgagcaatcctcccaaaccagaaaagccgacaccgccctggcctccattcccccagtcgccgagggcaaggcgcaccccccaacacaaattctgaatagagagagagagaccgtcccggtggagctggagccaaagagaactatacagagcttgaaagagaaaacggagaaagtgaaggacccaaaaaccgccgcagacgtggtttcccccggtgctaattcagtggattcacgtgtacagaggcccaaagaagaatcttctgaggacgagaatgaggtgagtaatatcctacgtagcgggcggagcaagcagttttacaaccagacttacggatcgagaaagtacaagtccgattgggggtattcagggaggggtggataccagcatgtgaggagcgaggaaagctggaagggacaacctagcagatctagggacgaaggctatcagtaccatagaaatgtccggggaagaccgttcaggggggaccgtcgcaggagtggcatgggggatggccacaggggacagcatacctag

SEQ ID NO: 198287 - DNA, 3150 bp, Artificial Sequence
  Description of Artificial Sequence: Synthetic coding sequence
atggcctgcatccactacctgcgggagaaccgggagaagttcgaggcttttatcgagggatcatttgaagaatatttgaagcggctggagaacccccaggaatgggtaggccaagtggagatttctgcattgagcttgatgtacagaaaggattttattatctacagagaacccaatgtttcgcccagtcaggtcaccgagaataattttccagaaaaggtgctgctctgcttttccaacggcaatcattacgacatcgtgtatcccattaaatataaggagtcttccgccatgtgccagagcctgctgtacgagctgctttatgagaaagtgttcaaaacagacgtctcgaaaattgtcatggagcttgacaccctcgaggtcgccgatgaagacaactcagagataagtgacagcgaagacgatagctgcaaaagcaagaccgccgcagctgctgccgacgtgaacggcttcaaaccattgtctggcaacgagcagctaaaaaacaacggaaacagtacctccttgccactatccagaaaggttctgaaatcattgaatccagccgtctacagaaatgtggaatacgagatctggttaaaatccaagcaggcccaacagaaaagagactacagcattgctgccgggctgcagtacgaagtgggtgacaagtgccaagtccgccttgatcataatggcaaattcctgaacgccgatgtgcagggcatccactcagagaatggacctgtgctcgttgaggaactgggtaagaaacacacatcaaagaatctcaaggcgcctcctcccgagagctggaacaccgtgagcggaaaaaagatgaagaagccttcaacctctggccaaaactttcacagtgatgtggattatcgcggacccaagaacccttcaaagcctattaaagccccttctgctttgcctccaagactgcaacatcccagtggtgttaggcaacatgcattctcctcccatagttccggatcccagtctcagaaattttcttccgagcacaagaaccttagcaggactccttctcagatcataagaaagcctgatcgagagagggtggaagatttcgatcacaccagccgggagagcaattacttcggcctgtcaccagaggaacgaagagaaaaacaggcaatcgaagagagccgcttattgtacgagatacagaacagagatgagcaggcctttcctgctctctcaagcagcagcgttaatcagagcgcctcccaatcttctaatccctgcgttcagcggaaaagctctcatgtaggcgatcgaaaaggatctcgcagacggatggatacggaggagcgtaaggacaaagacagcatccacggccactctcagctggataaaaggcccgaaccgtctaccctggagaacattactgacgacaagtatgccactgtgtcgtcaccaagcaagagcaaaaagttggagtgcccctcccccgctgagcagaagcccgctgaacacgtgtccctgtccaatcctgcccccctgctagtcagcccggaagtgcacttgactcctgctgtgccttctcttcccgcaacagtgcctgcctggccctctgagcccactacattcggaccgacaggcgtgcccgcgcctattcccgttctgagcgtgacacaaactctgacgaccgggcctgactctgccgtttctcaggcccatctgacccctagtcccgtgcccgtgagtattcaggccgtgaatcagcctctgatgccattgccacagactttaagtctctaccaggatccactttatcccggctttccgtgtaacgagaaaggagatcgggccatcgttcctccttatagtctgtgccagactggcgaggacctacccaaggacaagaatatcttaagattcttttttaatctcggggtcaaggcctacagctgtccgatgtgggcacctcactcctacctgtacccacttcaccaggcctatctcgccgcttgtagaatgtacccgaaggttcctgtccctgtgtatccccataatccatggtttcaggaagcccccgccgcacagaatgaaagtgattgcacatgcaccgacgcacactttccaatgcaaacagaggcgtctgtgaacgggcagatgccccagccagaaatcggcccccctacattttcaagtccacttgttatacccccttcccaggtgagcgagtctcatgggcagctctcctatcaggccgatttggaaagcgaaactcccggccagttgctccacgccgattatgaggaatctctttctggaaagaatatgttccctcagccatcgtttgggcctaaccctttcttgggccctgtgcctatcgcgccaccgttttttcctcacgtctggtatggataccctttccagggttttatcgagaatccagtaatgaggcagaatatcgtcctccccagcgacgaaaagggcgagcttgacctctcccttgaaaatttggacctgtctaaggactgtgggtccgtctccacagtggatgagtttccagaggccaggggtgagcacgtacacagcctcccagaagcgtccgtgtcctctaagcccgatgagggccgaaccgaacagtcgagccagaccagaaaggctgacactgccctggcaagcatccctccagtggcagagggaaaggcacacccccctactcagatacttaatcgggagagggagaccgtccctgtagagctcgagcccaagaggaccatccagtccctgaaggaaaagacagaaaaagtaaaggaccctaaaacagcagctgatgtggtgtccccaggggctaattctgtcgactcacgcgtgcaacggcctaaagaagagtctagcgaggatgagaacgaggtctcgaacatcctgcgctcaggcaggtcaaaacagttctataaccagacgtatggcagcaggaagtacaagagcgactggggctattccggtaggggaggttaccagcatgtgcgcagtgaggaatcatggaagggccaaccgtccaggtcccgcgacgaaggataccagtatcacaggaatgttcgggggcggcccttccgcggggacagacggcggagcgggatgggtgatgggcatcggggtcagcacacttag

SEQ ID NO: 198288 - DNA, 420 bp, Artificial Sequence
  Description of Artificial Sequence: Synthetic coding sequence
atggcctgcatccactacctgcgggagaaccgggagaagttcgaggcttttattgaaggctcattcgaggagtatctaaagaggctggaaaatccccaagaatgggttggacaggtcgagattagcgcattaagcctaatgtataggaaagacttcataatttacagagagcccaatgtctctccatcacaggtgaccgagaacaatttccccgaaaaagtcctgctgtgctttagcaatggcaaccattatgatatagtgtaccccatcaaatataaggaaagcagtgccatgtgccagtctctgctctatgagttgctgtatgagaaggtgttcaaaactgatgtctctaaaatagttatggagctcgacaccctggaggtcgctgacgaggataatagcgagatctcagactcctag

SEQ ID NO: 198289 - DNA, 438 bp, Artificial Sequence
  Description of Artificial Sequence: Synthetic coding sequence
atggcctgcatccactacctgcgggagaaccgggagaagttcgaggcctttattgaaggatccttcgaggagtatttaaagaggttggagaatccacaggaatgggtgggccaggtggagatcagcgccctgtcactgatgtatcgtaaggactttataatttacagagaaccaaacgtgtctcctagtcaggtaacggaaaataactttcccgagaaggtcctgctttgcttcagcaatggaaaccattacgatatagtctatccgatcaagtacaaagaaagttccgctatgtgtcagagcctgctgtacgaacttttgtatgaaaaggttttcaaaaccgacgtgagcaagattgttatggagttggataccctggaggtggctgacgaagataactccgaaatttcagactcagaggatgattcttgtaaatag

SEQ ID NO: 198290 - DNA, 1716 bp, Artificial Sequence
  Description of Artificial Sequence: Synthetic coding sequence
atgaccatcctgcccaagaagaagccccccccccccgacgccgaccctgctaatgagccaccaccaccgggccccatgcctccagccccccgacgcgggggcggagtaggggtaggaggcggtggaaccggtgtgggcggcggagatcgagaccgggattcaggagtcgtcggcgcccgccctagggccagccctcccccccagggacccctccctggcccaccaggcgctctgcaccgatgggctcttgcggttccacctggtgcggtggccggaccccggcctcagcaggcaagtcctcctccgtgcgggggacccggcggtccagggggggggcctggggatgcactgggcgccgcggctgccggtgttggcgcagccggcgtggtagttggggttggtggagccgtgggagtgggcggctgctgtagtggtcctggccacagcaagaggcggcgacaggcccctggagtgggagctgtgggtggaggaagcccggagcgggaggaggtaggggctggatataactcggaggatgagtacgaagcggccgccgcccgcattgaagcaatggatcctgccaccgttgagcagcaggagcactggttcgagaaggcccttcgggacaaaaagggatttattattaagcaaatgaaggaagatggtgcatgcctgttcagagccgtcgccgatcaggtgtatggggaccaggatatgcatgaggtcgtgcgcaaacactgtatggactacttgatgaagaacgccgactatttttcaaactatgtcaccgaggactttactacttatatcaatagaaagcgcaagaacaattgccacggtaatcacatcgagatgcaggccatggcagaaatgtacaacaggcctgtggaggtatatcaatactctactgggacgagtgcagttgaacctatcaataccttccacggtatccaccagaacgaagatgagcctattcgcgtgagttatcacaggaatatacactataatagcgtggtgaaccccaacaaagcaactattggagtggggctaggactgccatcattcaagccaggctttgcagagcagtctctgatgaaaaacgccattaagacttccgaggaatcttggatcgaacagcagatgctagaggataaaaaaagagccacagattgggaagcgactaacgaggccattgaagagcaggtcgcgagggagtcctacctacaatggctgagggatcaggagaaacaggccagacaggtgcgcggtcctagccagccacgcaaggcaagcgctacttgcagttctgccactgccgccgcctcctctgggctagaggaatggacttctaggtccccacggcagcgatctagcgcttccagccctgaacatcccgaactgcatgccgagctcgggatgaagcctccatcccccgggactgtactggcgctggccaagcccccctcgccatgcgctccagggacgagcagccagttctcagcaggagcggacagagccaccagtccgctggtatcactgtaccctgcgctggaatgcagggcactcattcaacaaatgtccccatcggcgttcggcctcaatgactgggatgatgatgagatattggctagcgtcctcgcagtatcccagcaggaatatcttgatagtatgaagaaaaacaaggttcatagggatccccctcctgacaagagctag

SEQ ID NO: 198291 - DNA, 1701 bp, Artificial Sequence
  Description of Artificial Sequence: Synthetic coding sequence
atgaccatcctgcccaagaagaagccccccccccccgacgccgaccccgctaatgaacctccaccaccagggcctatgccgcccgccccccgaagggggggtggcgtcggagtgggcggcggcgggactggggtgggtggtggcgaccgagacagggattctggagtcgtgggagccaggccgcgtgcaagtcctccaccccaaggtcctctccctggacccccgggagccctgcaccggtgggccctggccgttccgcccggcgctgtagccggccccagacctcaacaagccagccccccaccttgcggaggcccgggtgggcctgggggcggccccggcgatgcccttggagctgcggcggctggggtgggggcagctggcgttgtggttggtgtgggaggagccgtcggcgtaggagggtgttgctccgggcccgggcacagcaagcgccggcggcaggccccgggcgtgggggctgtaggaggcgggagcccagaacgggaggaagtcggggcgggctataactcagaggacgagtatgaggctgccgctgcccgaatagaggctatggaccccgccactgtggagcagcaagagcattggttcgagaaggccctgcgagataaaaagggcttcataataaagcaaatgaaagaggacggagcctgcctctttcgcgctgtggcagaccaggtctacggcgatcaggatatgcacgaagttgtgcgcaagcactgtatggattacctaatgaagaatgccgactacttttccaattatgttacggaggacttcacaacctacatcaacagaaagcggaagaataattgtcatgggaaccatatcgagatgcaagctatggcggagatgtacaaccgcccagtggaagtgtatcagtacagcactgaacccataaacacgtttcatggcatacatcagaacgaggacgagccaattcgcgtgagctaccaccggaacatccactacaactctgtcgttaatcccaataaagccaccatcggagtcggacttggtcttcctagctttaaaccggggtttgctgagcaaagtctcatgaaaaatgctattaaaacttccgaagagtcctggatcgagcaacagatgctcgaagataagaaacgtgccaccgactgggaagctacaaacgaggccatcgaggagcaggttgctagagaatcttacttgcagtggcttcgggatcaggagaagcaggcaaggcaggtccgcggcccatcccagcctcggaaggccagtgccacctgcagttcagctactgccgcagctagctcagggcttgaagaatggacatcaaggtccccacgccagagatcttcggcatcttccccagagcatccagaactccatgctgaactgggaatgaaacccccctcccccggcaccgtgttggcgttggctaagccgccctctccttgcgcgccaggcacgagctctcagttctctgcgggtgcggatcgcgctacatctccattagtctctttatatcccgcactggaatgtagggcattgatccagcagatgtcgccatctgcgttcggtctcaacgactgggatgacgacgagattttggcctccgtgcttgcagtcagccaacaggagtatttagactctatgaaaaaaaacaaggtccacagggacccacctccagacaaatcctag

SEQ ID NO: 198292 - DNA, 1701 bp, Artificial Sequence
  Description of Artificial Sequence: Synthetic coding sequence
atgaccatcctgcccaagaagaagccccccccccccgacgccgaccctgcaaatgagcccccacctccgggacccatgccacccgcccctagaagggggggcggggtcggagtcgggggaggcggaaccggagttggcggcggggaccgggacagggactcaggcgtggttggtgcccggccacgcgcttcccctccaccccaggggccacttccaggaccaccaggagcgttgcaccgttgggccttagcagtcccaccaggagcagtcgctggccctcgcccacagcaagcatccccccctccttgtggaggtcctggcgggccagggggaggcccgggcgacgcgctcggggctgccgccgctggggtgggggccgccggggtggttgtgggggtggggggcgccgtcggtgtcggtggatgctgcagcgggccagggcactccaaacggcgccgacaggcaccgggtgtaggcgctgtgggcgggggatccccagagagggaagaagtgggggctggatacaactcagaggacgagtacgaggccgctgcagcaagaattgaggcgatggaccctgccaccgtcgagcagcaggagcattggtttgaaaaggctctgagggacaagaaaggcttcattatcaagcagatgaaggaggatggcgcatgtctgtttcgggcagtggccgatcaagtctacggtgatcaggatatgcatgaggtggtgcgtaagcattgcatggactaccttatgaaaaatgccgattactttagcaattatgtgacagaagacttcaccacctacatcaacagaaagaggaagaataactgccatggtaaccatatagagatgcaagccatggccgaaatgtacaacaggccagttgaagtgtatcagtattctaccgagcctatcaacaccttccacgggattcaccagaatgaggacgagccaatccgggtaagctatcacagaaacatccactataatagtgtggttaatcccaacaaagcgactatcggggtgggcctgggtctacccagtttcaagcccggattcgccgaacagagcctcatgaaaaacgcgataaaaacatctgaagaaagttggatcgaacagcaaatgctggaggataagaagagagcgacagattgggaagccacgaacgaggcgatcgaggagcaagtagctagggagtcctacctgcaatggctccgggaccaggagaagcaggcaaggcaggtgagaggaccaagtcaaccccggaaggctagcgctacttgttcatccgctacagctgcagcttcatctggcctcgaagagtggacgtctagaagtcctcggcaaagaagctcagccagctcccctgagcaccccgagcttcatgccgagctgggcatgaagcctccctccccagggacagttctggccttggctaagccaccctctccctgcgcccctggcacttcgtctcagttctccgcgggggcagatagggcgacttcccccttggtttctctctacccagccctggaatgtcgcgctctaatccagcagatgagtccaagcgcatttggcctaaacgactgggacgatgatgaaatccttgcttctgtgctagccgtgtcccagcaggagtacttagactctatgaaaaagaataaagtccatagggatccgccgccagataagtcttag

SEQ ID NO: 198293 - DNA, 1050 bp, Artificial Sequence
  Description of Artificial Sequence: Synthetic coding sequence
atgaaggaggacggcgcctgcctgttccgggccgtggccgaccaggtctatggagatcaggacatgcacgaagtagtgcgcaagcactgcatggactacctcatgaaaaacgcggactactttagcaattacgtgaccgaggactttaccacatatattaatagaaagcggaaaaacaactgccacggaaaccatatcgaaatgcaagctatggccgagatgtataatcgtcctgtagaggtttaccagtacagtacggagcctatcaacacctttcacggaatccaccagaatgaggatgagcccatcagagtcagttaccataggaatatccactacaacagcgtagtcaatccaaataaggccacaatcggggtgggcttggggttgcccagtttcaaacctggattcgccgaacaatctctgatgaaaaacgcaattaagaccagtgaagagtcttggatcgaacagcaaatgcttgaggataaaaagcgcgccacagattgggaagcaaccaacgaggctatcgaagagcaggtagcaagggaatcgtacctccagtggctgagagaccaggaaaagcaagctaggcaggtcagagggcctagtcagcctcgaaaagcttccgccacctgcagtagcgctaccgcagccgcctcatccggcctggaggagtggacatccaggtcccccagacaaaggtcttcggcaagttccccagagcaccccgaactccatgcggaactggggatgaagccaccatcacccggcacggttctggccttggccaagcctccaagcccatgcgcccctgggacctcctctcagtttagcgctggtgctgacagagcgacctcccctctcgtctctctatatcctgccctcgaatgcagagccttgatccaacagatgtccccatctgccttcgggttgaacgactgggatgacgacgaaatcctggcctcagtactggctgtatcccagcaggagtacctcgactcaatgaaaaaaaacaaggttcatcgtgaccccccgccagacaagagttag

SEQ ID NO: 198294 - DNA, 1629 bp, Artificial Sequence
  Description of Artificial Sequence: Synthetic coding sequence
atgaccatcctgcccaagaagaagccccccccccccgacgccgaccccggaggtactggggtgggaggcggtgatcgggacagggattctggtgtggttggagcgcgccccagggcaagcccaccacctcaaggtccattgcccggcccaccaggagccttgcacagatgggcactagcggtgcctcctggtgccgtcgccggtcctcggccacagcaggcctccccacctccttgcggcgggcctggagggccaggtggcggtcctggcgacgctctgggggctgcggcagcaggggtaggtgcagcaggggtggtagtcggcgtcggcggggccgtcggtgtgggcggatgctgttcggggcccggccatagcaaaagacgtagacaggcgcccggcgtgggtgcggtcgggggcggatcccctgaaagggaggaagtcggcgccgggtacaattctgaggatgagtatgaggccgccgctgcccgcattgaggcaatggaccctgccacagtcgaacagcaagagcattggtttgaaaaagctctgcgggacaagaaaggcttcataatcaagcagatgaaggaagacggtgcatgcctgttccgcgctgttgctgatcaggtttatggcgaccaggacatgcacgaagtggtcagaaagcactgtatggactacctgatgaaaaatgcagattactttagtaactacgtgactgaggacttcactacctatataaacagaaaacggaagaataattgtcacggtaatcatattgaaatgcaggctatggctgagatgtataatagaccagtggaggtctaccagtactcaaccgagccaatcaacactttccacggaatccaccagaatgaggatgagcctatcagagtttcttatcatcgcaacattcactataactccgtggtgaatcctaacaaagctaccattggcgtcggcctggggctgcccagcttcaaaccaggatttgctgagcaatcccttatgaaaaacgccatcaagaccagtgaggagagctggattgagcaacagatgctggaggataagaagagggccacggactgggaagcgaccaatgaggcaatcgaggagcaagtagcaagagagagctatctccaatggctaagagaccaggagaagcaggccaggcaggttcgtggcccatcccagccgcgtaaggcctctgctacctgtagctcagcaactgcagctgcttcatctggcctcgaggaatggacttcacggagccctcggcagcgcagtagtgcctcatcaccggaacaccccgagctgcatgctgaacttgggatgaagcccccatctcccggaacagtccttgctcttgctaaacccccatccccctgtgcccctggtacaagttcgcagttctccgctggcgcggatcgggctacatcccccctcgtcagcttatatccagcacttgagtgccgcgccctcatccagcagatgtccccttctgcatttgggctcaacgactgggacgatgatgaaatcctggcttctgtactcgctgtctcgcagcaggagtaccttgactcaatgaagaagaataaagtgcacagggatccaccgccggataaatcttag

SEQ ID NO: 198295 - DNA, 1335 bp, Artificial Sequence
  Description of Artificial Sequence: Synthetic coding sequence
ggcgtggtggtgggcgtgggcggcgccgtgggcgtgggcggctgctgctcggggcccggccatagcaagcgcaggagacaggccccaggagtcggcgccgtgggaggtggctcaccagaaagagaagaagtaggtgcaggttataatagcgaggacgagtacgaagcagcagctgctcggatagaggccatggaccccgccactgttgagcagcaggagcactggtttgaaaaagctcttcgagataagaagggtttcattattaagcagatgaaagaggacggggcatgtctgtttcgcgccgtcgccgaccaggtttacggggaccaagatatgcacgaggtggtcagaaaacattgtatggactacctgatgaagaatgccgactacttctctaactatgtgacggaggactttacaacatacatcaatagaaagcggaaaaataattgccacgggaaccatatcgagatgcaggcaatggcagagatgtacaaccgtccagtagaggtttatcagtattccactgggactagcgccgttgagcctattaacactttccacggcatccaccaaaacgaagatgaacctattcgcgtgagctatcatagaaacatccattacaacagtgtagtgaatcctaataaagccactataggggttgggctggggctgccgtcctttaaaccgggttttgccgagcaatcccttatgaaaaacgccattaagacatccgaggaatcttggattgagcagcagatgcttgaagataaaaagcgcgctacagattgggaagccactaacgaagctattgaggagcaggttgcgagagaatcatacttgcagtggctcagagaccaagaaaaacaggccagacaggtgcgaggtccctctcagccaagaaaggcctccgcaacctgctcctccgcgaccgccgccgctagttcagggctcgaggaatggacaagccggtcccctaggcaacgttcctctgcgtctagccctgagcacccagagctgcatgctgagctggggatgaaaccaccatcccccggcaccgtgttggcgctggcaaagcctccctccccctgcgctccagggacttcgtcacagttttcagctggggcagacagggcaacttcaccactcgttagcttgtaccctgctcttgaatgccgtgctctcatccagcaaatgtccccttccgcctttggtttgaatgactgggacgatgatgaaatactcgctagcgttttagcagtgtcccagcaggaatatctcgactccatgaagaagaacaaagtccaccgggatccccctcccgacaagagctag

SEQ ID NO: 198296 - DNA, 867 bp, Artificial Sequence
  Description of Artificial Sequence: Synthetic coding sequence
atggacgaccccaagagcgagcagcagcggatcctgcggcggcaccagcgagagcgccaggagcttcaggcacaaattcgttccttgaaaaattctgttccaaagacagacaaaaccaagcggaagcagctgttgcaagacgtcgcccggatggaggccgagatggcccagaaacaccgccaagagctggagaagtttcaggatgattcctctatcgagagtgtggtcgaggacttggcaaagatgaatctggagaatcgtccccccagatccagcaaggcccatcgaaaacgagagcggatggaaagcgaggagagagagcggcaggagtctatcttccaagcggagatgagcgagcacctagcaggtttcaagcgggaagaagaagagaagctcgccgctatcttgggggcgcgcggtctcgaaatgaaagccatccctgccgatggtcactgcatgtacagagcgattcaggatcaactcgtgttctctgtgtctgttgagatgctgaggtgtagaacagcctcttatatgaaaaagcacgtggatgaattcctgccgttcttttctaaccccgaaacatccgacagtttcgggtatgatgacttcatgatctactgtgataatattgtcaggactactgcctggggaggacagctcgaactccgggctctttcccacgtgcttaagacccccatagaggtgatccaggctgattccccaacactgatcattggagaagagtacgtaaagaagcctatcattctcgtatatctgcgttacgcctacagcctcggagaacattacaacagcgttacaccgttggaggccggtgctgctggaggcgtgctccccaggcttctctag

SEQ ID NO: 198297 - DNA, 972 bp, Artificial Sequence
  Description of Artificial Sequence: Synthetic coding sequence
atggagccccgggtgcgggtggagggctggaaggtgcccaccagccggtgtaggttcctgctagctcgagtactgggctatctggtggtcatggaggccgtgctgaccgaggagcttgatgaagaagagcagctcctgagacggcaccgaaaggagaagaaagaactgcaggccaagatccagggcatgaagaatgccgtgccgaaaaatgacaagaaaaggaggaaacagctgaccgaagacgtggccaagctagagaaggagatggagcagaagcatagagaagaattagaacaactcaagctaacgacgaaagaaaataaaatcgattcggtggctgtcaatatcagcaaccttgtattggagaaccagccaccgaggatcagcaaggcccagaaaagaagagagaagaaggctgcccttgaaaaagagagagaggagagaattgctgaggcagagattgagaacctgaccggcgcccgtcatatggaatcggagaaattagcccaaattttggcagccagacaactggagatcaagcagataccttccgacggccactgcatgtataaggccatcgaggaccagttgaaggagaaggattgcgctttaaccgtagtagccctgcgatcacagacagctgaatatatgcagagtcatgtggaagattttctgcctttcctaactaaccctaacacaggtgacatgtacacacctgaagagtttcagaagtactgcgaggatatcgtgaataccgccgcatgggggggccagcttgagttaagggctctctctcatatcctgcaaacacctatcgaaattatccaggcggactcgccccctataattgttggagaagaatactctaagaagcccctgattttagtgtacatgaggcatgcatatggtttgggtgaacactataactccgtcacaagactcgtgaacattgtgacagagaactgcagttag

SEQ ID NO: 198298 - DNA, 579 bp, Artificial Sequence
  Description of Artificial Sequence: Synthetic coding sequence
atgatcagcaaggagaagaaggccgccctggagaaggagcgggaggaacgaatcgcggaagccgagatcgaaaacttgaccggagcccggcacatggagagtgaaaagctcgcacagatcctggctgctcgccagttggagatcaaacagatcccatctgacggccactgtatgtataaagctattgaggaccagctgaaggagaaggactgcgccctaacagtggtggctctcagatcacagacagcagagtacatgcagtctcacgtggaagacttcttgccttttcttactaatcctaataccggagacatgtataccccagaagagttccagaaatactgcgaggacatcgtgaacactgcagcatgggggggtcaattggagctgcgagccctctcccatatcctgcagacccccattgagattatccaggccgactccccgcctatcatcgtgggtgaagagtactccaaaaaacctttaattcttgtatacatgcggcatgcctatggcctcggcgagcactacaacagcgtgacccgcttagtgaacatcgtgaccgagaactgctcctag

SEQ ID NO: 198299 - DNA, 2781 bp, Artificial Sequence
  Description of Artificial Sequence: Synthetic coding sequence
atggtgagcagcgtgctgcccaaccccaccagcgccgagtgctgggccgcccttctgcatgaccctatgactctggatatggatgctgtcctgagcgatttcgtgaggagcaccggagctgagccagggcttgcgcgggacctcttggagggcaagaattgggatctgacagctgcgctgagtgactatgagcaactgcggcaagttcacacggctaatcttccccacgtctttaatgaaggtagggggccgaaacagcctgaacgcgagccacaacctgggcacaaagtggagaggccatgtctgcaaagacaggatgatattgcccaggaaaaacgcttgagcagaggcatttctcatgcctcctctgcaatcgtgtctcttgcccgctcacatgtagcttctgaatgtaacaatgagcagttccccctggagatgccaatctatacatttcagctcccagatctgtctgtgtacagcgaggactttaggtcattcatcgagcgagacctcatcgaacaggccaccatggtagcccttgagcaggctgggcgactgaactggtggtccactgtctgcacctcatgtaaaaggctccttcctctggccactactggagatggaaactgcctgctgcacgccgcaagcctcggcatgtgggggttccacgatcgcgatctggtgctcaggaaagccttatatactatgatgagaactggagccgaacgtgaggccctgaaacgccggtggcgctggcagcagactcagcagaacaaggaggaggagtgggaaagagagtggactgagctgcttaaactcgcaagttccgagccccggacccacttttccaaaaacggtggtacagggggaggagtagataatagtgaggatcctgtgtacgagtctctggaagaatttcacgttttcgttctggctcatatcctgcggcgacccattgtcgtggtcgcagatacaatgctcagggacagtggcggggaagcctttgcaccaatcccatttggcggaatttatctgcctctggaggtgccgcccaatcgctgccactgctcccctctagttctggcgtatgatcaggctcacttctccgccctggttagtatggaacaacgcgaccagcaaagggagcaagcagtgatcccgctcacggactccgagcataagttgctgccactccactttgcagtggatccaggtaaagactgggaatggggcaaagatgacaatgataacgcccgcctagctcacctaattctgtcgctggaagctaagctcaacctccttcacagctatatgaacgtaacctggatcaggattccgtctgagacccgagcccctctggctcaacctgaaagtcccactgccagcgcaggcgaagatgtccagagcctcgccgattctctcgattctgatagggatagcgtgtgttcgaactctaacagtaataatggtaagaacggcaaggacaaggaaaaggagaaacagcggaaggagaaggataagacacgcgctgattctgttgccaataaactgggtagtttctctaagactttgggcatcaagctcaagaagaatatgggcggactggggggtctggtgcacggtaagatgggacgagctaactcagccaatgggaagaacggcgatagcgccgagagagggaaagaaaaaaaagccaagtctagaaaaggcagtaaagaagagtcaggagcgagtgccagcacatcccctagcgagaagaccactccaagtcctaccgacaaggcagcaggtgctagccccgccgagaagggaggcggccctcgcggggacgcttggaagtacagtaccgacgtcaagctgtctcttaatatacttagagccgccatgcaaggagaacgaaagtttattttcgcaggacttctgctcacttcccatagacatcagtttcacgaagagatgatcggatattacctcacatctgcccaggagcggttttctgcggagcaggagcagagaagacgggatgctgctaccgctgcagctgcagccgctgcggcggccgctgccacagctaaacggccgccacgacgccccgaaactgaaggtgtgccggtgccggaacgagcgagccctgggccaccaacgcagcttgttctgaaactgaaggagcgcccttctccaggacctgctgcgggacgtgcagccagagcagccgcaggcggcaccgcgagtcccggcggaggcgcacggagagccagcgccagcggacccgtgcccgggcggtctccccctgcgcccgctaggcagagtgtaatacacgtgcaagcctcgggggctcgagatgaagcctgcgcacctgccgtgggcgcgctgcgcccctgcgccacctacccccagcagaaccgctctcttagtagccagagctactccccagccagagcggccgctttgcgaaccgttaataccgtggagagtctggctcgtgcagtgcccggggccctgcctggagccgccggtaccgccggtgcagcagaacacaaaagtcagacctacaccaacggcttcggggctctgagagacgggttggaatttgcagacgctgacgctcctacagcacgcagtaatggagagtgtggaagaggcgggccagggcctgtccagagacgctgtcagagggagaattgcgctttttatggccgagctgagaccgaacattattgctcatattgttaccgggaagaattgcggaggcgacgggaggccagaggagccagaccttag

SEQ ID NO: 198300 - DNA, 2802 bp, Artificial Sequence
  Description of Artificial Sequence: Synthetic coding sequence
atggtgagcagcgtgctgcccaaccccaccagcgccgagtgctgggctgccctgttacacgacccaatgaccctcgacatggatgctgttttatccgacttcgtgagatcaaccggggccgagcctggtcttgcccgcgacttactcgaagggaagaattgggatctgacagctgcactgtccgattacgagcagttgcgccaggtgcacacagcgaacctgccgcatgtttttaatgaggggcgagggcctaaacaacccgaaagggagccccagcctgggcacaaggtggaacggccctgtctgcaacggcaagatgatatcgcgcaggagaagcgcctctcccgcggaatcagccacgcctcttctgccattgtgagcttggcccggagccacgtggcctctgaatgtaacaacgagcagttcccgctggagatgcccatctatacctttcagctgcctgatctctccgtctacagcgaggatttccggtccttcatcgagcgcgatctaatcgagcaggccaccatggttgcactcgagcaagcggggcggctgaactggtggtcaacggtctgcaccagttgtaaacgacttctccccctggcaaccacaggggacggcaattgcttgttacacgcggctagtctgggcatgtggggcttccacgatagggatctagttttgcggaaagcattgtataccatgatgagaaccggcgccgaacgggaagctctgaaacgccgctggcgatggcagcaaacccagcagaacaaggagtccgggttggtttataccgaggaagaatgggaaagagaatggacagagctgctgaagctcgcctcctctgagccccgcactcacttttctaagaatggaggaacggggggaggagtggataacagcgaggaccccgtctatgagagtctggaggagttccacgttttcgttctggctcacatactcaggaggccaatcgtggtcgtcgccgataccatgttgagggatagcggaggtgaggcctttgcgccaatccctttcggaggaatctacttgcctctcgaagtgcctcccaatcgctgtcactgtagtcccctggtcctggcttatgatcaggcgcacttttctgctctggtttcaatggagcagcgggatcaacagcgtgagcaggccgtcatcccactgacagactcagagcacaaattgcttcctctgcatttcgctgtcgatcctggtaaagactgggagtggggcaaggatgacaacgataatgcccgtctggcacatttgatcctttctctggaagccaagttgaacctgctgcatagctacatgaacgtcacttggatcaggatccctagcgaaactagggcgcccctggcacagccagagagccccacggcaagcgctggcgaagatgttcagtcccttgcagattccttagattccgatcgggactccgtctgctcgaactccaattccaataatggcaaaaacggaaaagataaggagaaagaaaagcagcggaaagagaaggataaaaccagagccgatagcgtcgccaataagctggggagcttcagtaaaacgctgggcattaaattgaagaaaaacatgggaggcctgggaggcctggttcacggcaagatgggtagagccaattcagccaatggcaagaatggagatagtgcagaacgcggaaaggagaagaaggccaagagcagaaagggctcaaaagaggagtccggggctagtgcttcaacctctccttccgagaaaactaccccctcaccaacggacaaggccgccggcgcttctcctgcagaaaagggaggaggccccagaggagatgcatggaaatatagtacggacgtcaaactttcattgaatatcctgcgcgccgctatgcagggcgagcgcaagttcatctttgcgggattgttgttgaccagccatcgacatcagttccacgaagaaatgataggatactacctcacctcagcacaggaaagatttagcgccgagcaagagcaacgtcgtcgcgacgccgccactgccgccgctgcggcggccgctgccgcagctgccacggcaaagaggcctcctaggagacccgagacagagggagtgcctgtccccgaacgggccagtcctggaccccctactcaactggtgttaaagctcaaggagagaccctccccaggccctgctgctggacgagcagcgcgagccgcggccggcggtaccgctagtcctggcggtggcgcgcgccgcgcttccgcttcgggtccagtccccgggagaagtccacccgctcccgcaaggcagtcagtgattcacgtgcaggcctcaggcgctcgggacgaggcctgtgcaccagcagtgggcgcactgcggccctgtgccacatacccacagcagaatcgttccctcagtagccagtcatattcgccggcacgtgcagccgccctgcggacggtcaatactgtggagagtcttgctcgggctgtgcccggcgctctacccggagccgctgggacagccggcgcagccgaacacaaaagccagacatataccaacggcttcggtgccttgagagatggcttagaattcgctgatgctgatgcccccaccgcaagatccaacggggaatgcggacgaggggggcccggtcccgtccagcgccgctgtcaaagggagaattgtgccttttacggtcgagccgaaacggagcactactgctcctattgctatcgtgaggagctaagacgccgtcgggaagcccgcggcgcgagaccatag

SEQ ID NO: 198301 - DNA, 333 bp, Artificial Sequence
  Description of Artificial Sequence: Synthetic coding sequence
atggtgagcagcgtgctgcccaaccccaccagcgccgagtgctgggcggccctattgcatgatcctatgactctagacatggatgccgtgctaagtgatttcgtaagatcaaccggggccgaaccgggcctggctcgcgatttgctggaaggcaagaactgggacctgaccgcagccctaagcgattatgagcagctcagacaggtgcatacggccaacttgccccatgtctttaacgagggccgcggtcctaaacagccggagcgtgaaccacagcctggccacaaggtggagcgaccctgtttgcagcgtcaagacgatattgcacagtag

SEQ ID NO: 198302 - DNA, 2532 bp, Artificial Sequence
  Description of Artificial Sequence: Synthetic coding sequence
atgaccctggacatggacgccgtgctgagcgacttcgtgcggagcacgggagccgaacccggactggccagagatctgctggagggaaaaaactgggacgtgaacgctgccctatcagactttgagcagctgcggcaggtgcatgcagggaaccttccccctagtttcagtgaagggtctgggggttccagaaccccagaaaagggtttttccgacagggagccaacaaggcccccacgtccaatattacagaggcaggacgacatagttcaagagaagcgcctgtctaggggcatcagccatgctagttcttccattgtgtctttagctcgcagtcatgtaagctccaatggtggcggcggtgggtctaacgagcacccattggaaatgcccatttgtgcctttcaactgcccgatctcactgtctataacgaggattttaggtcgtttatcgaacgggacctgatcgaacaatctatgctggtcgccttggagcaggcaggtcggctgaactggtgggtatctgtcgaccccacctctcagcggctcttgcccctagcaacgacaggagatggtaactgtctgcttcacgccgcctctctgggtatgtgggggttccacgatcgggacctcatgctgcggaaggcgttatacgccttgatggagaaaggagttgagaaagaggcccttaagcggcgttggaggtggcagcaaactcagcagaacaaggagtcaggtcttgtgtataccgaagacgagtggcagaaagaatggaacgagcttataaaactcgctagctctgagcctcgcatgcatctggggacaaacggcgccaactgtggtggcgtggagagctcagaggagcctgtgtacgaatccctggaagagttccacgtgttcgtactggcacacgttttgcgcagacctattgtcgtggtcgctgataccatgctgcgggacagcgggggagaggcattcgcacctatcccttttggtggcatttacctgccactggaagtccccgcctcccaatgccatcgcagccctttggtgctggcatacgaccaagcccacttctcagctctggtgagcatggagcaaaaggagaatactaaggagcaggctgtgatccccctgacagacagtgaatataagctgttgccactgcacttcgcagttgatcccgggaaaggctgggaatggggaaaggatgattcagataacgtgcgcttggcctcagtcatactgagtctagaggtaaaacttcacctgctacattcctacatgaacgttaagtggattcctctgagctctgacgcacaagctccactagcgcagccagagtctcccaccgcttctgccggagacgagccccgttccacaccggaatccggggacagcgataaggagtcggtgggctcaagcagcacgtctaatgaaggaggccggaggaaggagaagtctaagagggatagggaaaaggataaaaagcgcgctgactccgtagcaaataaactcggatccttcggaaagactttagggagtaagcttaagaagaacatgggcggcctgatgcattccaagggatcgaaacccggaggggttggaaccgggctgggtggatccagtggaaccgagactttagaaaagaaaaaaaagaattcgctgaagtcctggaagggaggtaaggaagaggctgccggcgatggaccagtaagtgagaaaccgcccgcagagagcgtcggaaatggtggtagtaaatactcccaggaagtaatgcagtccctgagcatcctgaggacagcaatgcagggggaaggcaagttcatattcgtcgggaccctgaaaatggggcatagacaccagtaccaggaggaaatgatccaaagatacttgtctgatgccgaagagcgatttctcgccgagcagaagcagaaggaggctgaaaggaagattatgaacggcggcatcggcggtggccccccccctgctaagaagcccgaaccggacgcaagggaggaacaacccacaggcccacctgccgaaagccgggctatggcgttcagcaccgggtaccccggggatttcactatccccaggccgtccggggggggggtgcactgccaggagcctagacgtcagcttgcaggcggtccctgtgttggtggattaccaccttatgcgactttccctcggcagtgcccacctggtagaccttatccccatcaggacagtatcccatcccttgagccgggcagtcattctaaggatggactgcaccggggcgcgctgctgccacccccctatagagttgcagacagctactctaacggataccgtgagcctccagaacctgacgggtgggcgggaggccttcggggcctcccacccacccagacgaagtgtaagcagcctaactgcagtttttacggccaccctgagaccaataacttttgttcttgctgttatagagaggaattacgaagaagagaacgcgagccagatggtgagctgctggttcacaggttttag

SEQ ID NO: 198303 - DNA, 1284 bp, Artificial Sequence
  Description of Artificial Sequence: Synthetic coding sequence
atgaccctggacatggacgccgtgctgagcgacttcgtgcggagcactggcgctgagcctggacttgccagggacttactggaggggaagaactgggatgtgaacgccgccttatcagacttcgaacaactccgccaggtccatgccgggaatttgccaccgtcttttagcgagggatccggagggtctagaacaccagagaaaggcttcagcgaccgggaacccacaagacctccacggccaattcttcagcgacaggacgatattgtgcaggaaaaaaggctgagcagggggatttctcacgcgtcaagcagcatcgtatccttagcaagatcccacgtgtcctcaaacgggggtgggggcggaagcaatgagcaccctctggagatgccaatctgcgcctttcagttgcctgatctaaccgtgtataatgaagatttccgaagcttcattgagagagatttaatagagcagagcatgctggtggctctcgaacaggcagggcggctgaattggtgggtctccgtcgaccctacatcacagagactcctgccactggccacaacaggcgacggtaactgcttactccatgctgcatcactcgggatgtgggggttccacgacagagatttgatgctgcgaaaggccctgtatgcattaatggagaagggggtggaaaaagaagccctcaagagacgctggagatggcagcaaacccagcagaacaaggaatccgggctcgtatacaccgaagatgaatggcaaaaggagtggaatgagttgataaagctggctagcagcgagcctcggatgcaccttgggactaatggcgccaactgtgggggcgtcgagagctctgaggaaccagtttatgagtcactggaggagtttcacgtgtttgtgctggcccacgttctgagacggcccattgtggtagtagccgacacaatgctccgagactccggtggcgaagcctttgctccgattccattcggaggcatctacctgccacttgaggttcccgcctctcaatgtcaccggtctccattggtgctggcatacgatcaggctcactttagtgctctagtttctatggagcagaaggagaataccaaagagcaagctgtgatcccgctgaccgatagcgaatataaactcctgcctctgcactttgcagtcgatcccggcaagggctgggaatgggggaaagacgactctgacaacgttcgcctggcttcagttatcctgagcttggaagtcaaattacacctgctgcactcttag

SEQ ID NO: 198304 - DNA, 2445 bp, Artificial Sequence
  Description of Artificial Sequence: Synthetic coding sequence
atgaccctggacatggacgccgtgctgagcgacttcgtgcggagcacaggagcagagcctggactcgcaagggacctacttgagggaaaaaactgggatgtcaacgcagccctgtcagactttgagcagctcaggcaagtgcatgccggtaacttgccgccaagcttctcagaaggtagcgggggttctcggacccccgaaaagggtttttcggacagggagcccactcgacccccaagaccgatccttcagagacaagatgacattgttcaggagaaaaggctaagcagaggtatctctcatgcatcttctagcatagtgtcacttgcccgatcacatgtgtcatcaaatgggggaggcgggggcagcaatgagcaccctctggaaatgccgatttgtgcgttccagctgccagacctgaccgtgtataacgaggattttagatcatttattgagcgcgatcttatagagcagagcatgctggtggcactagaacaagctggcagactgaactggtgggtaagtgtggaccctacatcacagcgacttcttcccttagctacgaccggagacggcaactgtctgcttcacgccgcctctctgggaatgtggggcttccatgatcgcgaccttatgctaaggaaagcgctttatgcactcatggaaaagggggtggagaaggaggccctgaaaaggcgctggaggtggcagcaaacacagcaaaataaagagagcggccttgtttatactgaggatgagtggcagaaagagtggaatgagctgatcaaactagccagctctgagccgagaatgcacctgggtacaaatggcgccaattgtggcggcgtcgaatcctccgaggaacccgtgtatgaatcactcgaagagttccatgtgttcgttcttgctcatgtgctcaggcgccctatcgtcgtggtggccgacacaatgctgcgagactccggcggcgaggcatttgccccgataccatttggggggatctatctgccattggaggtgcccgcgtcgcagtgtcacaggagcccactggtgctggcctatgatcaggctcatttcagtgcccttgtttctatggagcaaaaggaaaatactaaggagcaggctgtgattcctctcaccgactcagaatacaagcttctacccctccatttcgctgtggatcccggtaaaggatgggagtgggggaaggatgattctgataatgtgcggctcgcgtccgtaatattatcccttgaggtgaaactccatttgctccattcatatatgaacgttaaatggatccccctgtctagcgacgcccaagccccattggcacagcctgaatcccccacggcatctgctggagatgagccacgcagtaccccagagtcaggtgacagcgacaaggaatctgtgggtagctctagtacttccaacgaggggggccgtcgcaaagaaaagagtaaacgcgatagagagaaggacaagaagcgagcggacagtgtggcgaataaacttggttcttttggcaaaaccctcggaagcaagctcaagaagaatatgggcggcctcatgcattcaaaaggatccaaacctggcggcgtcgggaccggcctcggcggctcctccgggacagaaactttggaaaagaagaaaaagaattccctgaaatcatggaaaggcgggaaagaagaagccgccggcgatggaccggtttcggaaaagccacccgctgagtcggtgggcaacggcgggagcaagtacagtcaggaggtcatgcaatccttgagcatactaagaacagccatgcagggggagggaaaatttatctttgtcggtaccctgaaaatgggtcaccggcatcagtatcaggaagagatgatccagcggtatttgtccgacgccgaagagcgttttctagctgaacaaaagcagaaggaagctgaaaggaagataatgaatggcggaatcggcggtgggcctccacccgccaaaaagccagagccggatgcaagagaggaacagcccactgggcccccggcagaatcccgggccatggcattctcaaccggttaccccggggattttactataccgcggccctcaggaggcggagtgcattgccaagaaccaaggaggcagctcgccggcggcccatgcgtcgggggcctgcccccctacgccactttcccaaggcagtgcccacccgggcgcccttatccccatcaagacagcatcccaagtctggagcctgggtcacactcaaaggacggcctccatcgcggagcgctgttacctccaccctacagagttgccgattcctattctaacggttatagagaacctccagagccagacgggtgggccggcgggttacgaggactccctccgacccagacaaagtgcaaacaaccagacggagaactgttagttcaccgattttag

SEQ ID NO: 198305 - DNA, 927 bp, Artificial Sequence
  Description of Artificial Sequence: Synthetic coding sequence
atgtgcggcgtggagggctgctgccagggcggcgccacccggcggggttctctcccaggagggcgacagctggctacgcgcaagcgttctgtcgtgcgccgttgtctcaaaatggccgctgaagaaccgcagcaacagaagcaggagccactgggctccgactccgaaggggttaattgccttgcatacgatgaggccatcatggcccagcaggaccggatacagcaggaaatcgctgtccagaacccactggtgagtgagcggctggagctgagcgtgctctacaaggagtatgccgaagacgacaacatctatcaacaaaagataaaagacctgcacaaaaagtactcctatatcaggaagacacgacctgatggaaactgcttttatcgagcctttggattttctcacttagaagccctgctcgatgattcaaaggagttacagcggttcaaggctgtgagcgcgaaaagcaaggaggacctggtgtcacagggatttacagaattcacgatagaggattttcacaacacctttatggacctaattgaacaggtggagaagcagacaagcgtggctgacctgctagcttcattcaacgaccagtcgaccagcgactacctcgtggtctacttgaggttgctgaccagtggctatctgcagagagagtcgaaatttttcgaacactttattgaagggggacgcacagtgaaagagttttgccaacaggaggtcgaaccaatgtgcaaagagagcgaccacattcacatcatcgctctcgcccaggcgctttccgtctctatccaggtagagtacatggatcgcggtgaaggcggaactacaaacccccacatatttcccgaaggttcagagcctaaggtgtatctgctgtacagacccggccactatgacatattgtataagtag

SEQ ID NO: 198306 - DNA, 816 bp, Artificial Sequence
  Description of Artificial Sequence: Synthetic coding sequence
atggccgccgaggagccccagcagcagaagcaggagcccctgggcagcgattctgaaggtgtgaactgcctcgcatacgacgaggctataatggcgcaacaggatagaatccagcaggagattgcagtgcagaacccccttgtatccgagcgccttgaactgagcgtactatacaaagagtacgctgaggacgacaatatctatcagcaaaagatcaaagacctccacaaaaagtattcttatataagaaaaacccggcccgatggaaactgcttctatagagctttcggattctcacacctagaagctctgctcgatgattcgaaagaactgcagcgctttaaggctgtgtcagcaaagagcaaagaggacttggtgagccaaggcttcacagagtttaccatcgaagacttccataacactttcatggacctaattgaacaggttgaaaagcagacctcagtcgccgacctgctggcttcctttaatgaccagagtaccagcgactatctggtcgtctacttgcggcttctcacttccgggtatctgcagcgcgagtctaagttctttgagcattttatcgagggcggccgcaccgtaaaggaattttgtcagcaagaggtcgagcctatgtgcaaagaaagcgaccacattcatattatcgctctcgcacaggctctgagtgtgtccattcaggtggagtatatggatcgcggggagggaggcaccacaaacccacatatcttccccgaggggtccgaacccaaagtgtacctcctgtatagacccggacactacgatatactatataaatag

SEQ ID NO: 198307 - DNA, 816 bp, Artificial Sequence
  Description of Artificial Sequence: Synthetic coding sequence
atggccgccgaggagccccagcagcagaagcaggagcccctgggcagcgacagtgagggagttaactgtctggcttacgacgaggccatcatggcacagcaggacagaattcagcaggagatcgctgtacagaacccactcgtgtcagagcgactggaactgtcagtgctctataaagaatacgccgaggatgacaacatctatcagcagaaaatcaaggatcttcataaaaaatactcttatattcggaaaaccaggccagacggcaactgcttctatcgggcctttgggttttcacatctggaggctttactggacgactctaaagaacttcagcgatttaaagccgtatcggccaagtctaaggaagatctcgtaagtcagggattcaccgaatttacaatagaggacttccacaacacctttatggatcttatcgagcaggtggaaaagcaaactagtgtggctgatttactggcatcgtttaacgatcagagcacgtccgactatctggtggtttatttgcggttgttgacctccgggtatctgcagcgggagagtaaatttttcgaacacttcatcgagggaggccggaccgtcaaggaattttgtcagcaggaagtggagcccatgtgcaaggagtcagatcacatccatatcattgccctggcccaggcactgtcggtaagcattcaggtggagtatatggatcggggggagggcggcactacaaacccccatatctttccagaaggcagtgagccaaaagtttatctgctgtaccgcccaggccactacgatattctgtataagtag

SEQ ID NO: 198308 - DNA, 843 bp, Artificial Sequence
  Description of Artificial Sequence: Synthetic coding sequence
atggccgccgaggagccccagcagcagaagcaggagcccctgggcagcgatagtgagggcgtgaattgtctcgcctatgatgaagccattatggcacagcaggaccgaattcagcaagaagacatgaccgacccctgcctgttacagattgctgtgcagaatcccctggtcagtgagcgcttggaattatccgtcctatacaaggagtatgctgaggatgataacatttaccaacagaagatcaaggacctgcataagaaatatagttacattagaaaaactcgaccagatggcaactgcttctacagagccttcggctttagccatcttgaagcactactggacgattcaaaagagctgcagaggtttaaggccgtctccgctaagtccaaggaagatctagtgagccagggttttacagagtttaccatcgaggacttccataatacatttatggacctgattgagcaagtggagaagcaaactagcgttgctgacttactagctagtttcaatgaccagagcactagtgattatctagtcgtgtacctccggctcttgacgtcaggatatctgcagcgagagagtaaattttttgagcacttcattgaaggcgggcggacggtgaaagagttctgccagcaggaggtcgagccaatgtgcaaggagagtgaccatattcacattatcgctttggcccaggcactctcagtttcaatccaggtggagtacatggataggggtgagggggggactacaaatccacacattttccccgagggctctgagcccaaggtttacctgctgtatcgtccgggccactacgacatcctctataagtag

SEQ ID NO: 198309 - DNA, 705 bp, Artificial Sequence
  Description of Artificial Sequence: Synthetic coding sequence
atgagcgagaccagcttcaacctgatcagcgagaagtgcgacatcttgagcatcctgcgggaccacccagaaaatcgaatctaccggaggaaaatagaagaactcagtaaacgtttcactgctatacgcaaaactaaaggcgacgggaactgcttttatagggcattaggttactcctacctggaatcccttttggggaagtctcgagagatcttcaagttcaaggagcgcgtattgcagaccccaaatgatctattggcagccggattcgaggaacataagttcagaaatttctttaacgctttctacagtgtcgttgagctggtggagaaggacggttccgtctcatcgctgctaaaggtgttcaatgatcaaagcgcaagtgaccacatcgtgcagttcctgcggcttctgaccagcgcgtttataaggaatagggccgactttttcagacatttcattgatgaggaaatggatattaaagatttctgtacccatgaggtggaaccaatggcgactgagtgtgatcacattcaaatcaccgcactgagccaagctctctcaatcgccttgcaggtggagtatgtagatgagatggataccgccctgaatcaccatgtctttccggaggcagcgaccccctctgtatacctgctctacaaaaccagtcactacaatatattgtacgctgcagataagcactag

SEQ ID NO: 198310 - DNA, 222 bp, Artificial Sequence
  Description of Artificial Sequence: Synthetic coding sequence
atgagcgagaccagcttcaacctgatcagcgagaagtgcgacatcctgagcattctgcgcgatcatcccgaaaatcgcatctatcggcgcaaaatcgaggagctgagtaagaggttcacggcgatacggaagactaagggggatggaaattgcttttatagggctctggggtactcttacttggaatcactccttggaaaaagccgcgaaattttcaagtag

SEQ ID NO: 198311 - DNA, 753 bp, Artificial Sequence
  Description of Artificial Sequence: Synthetic coding sequence
atggccgccctgagctgcctgctggacagcgtgcggcgggacatcaaaaaagtggaccgagaactgagacaattgaggtgcattgatgagttcagtactcggtgtctgtgtgacctgtatatgcacccgtactgctgttgcgacctccacccctacccatattgcctctgttactcgaaacggtctcgctcttgcggtctttgcgacttgtatccgtgttgcctctgtgattacaagttgtactgcctgcgtccgtcactccgctcactcgagaggaaggcaatcagagcaatcgaagacgagaaacgggagctggccaaactgagacgcacaacaaaccggatcctggctagctcttgctgttctagtaatattctgggttctgtcaacgtatgtggctttgagcctgatcaggtaaaagtgagagtgaaggacgggaaggtatgtgtttccgcggagagggaaaatcggtacgactgtttgggctccaagaagtactcttacatgaacatttgcaaggagtttagtcttccgccctgtgtggatgagaaagatgtgacatactcctacggtctcggcagctgcgtgaagatcgagtctccctgctacccctgtacatccccctgctcaccatgtagtccctgttctccatgtaatccctgctctccatgtaacccatgttctccttacgatccgtgcaacccttgttatccctgcggcagtcggttttcatgccggaagatgatcctttag

SEQ ID NO: 198312 - DNA, 2418 bp, Artificial Sequence
  Description of Artificial Sequence: Synthetic coding sequence
atgaaggaccggagcagcaccccccccctgcacgtgcacgtggacgagaacacacccgtgcatgtgcacattaagaagctacccaagccgtccgccacaagcagccaaaaatctcacaagagagggatgaagggggacactgtaaacgtgcgtagatccgtgagggtgaaaaccaaaaacccgcctcactgtttagaaatcacccccccttcaagcgaaaaactcgtatcagtgatgagactgagcgacctgagtactgaggatgatgattctggtcactgcaagatgaaccgctatgacaaaaaaatcgacagcttgatgaacgcagtgggctgtctgaaaagcgaggtgaaaatgcagaaaggcgagcgccaaatggccaagagattcctcgaggagcggaaggaggagttggaagaagtggctcatgaactggcggaaactgaacacgaaaacacagtgctgcgccataatatcgagcgcatgaaggaggaaaaggactttacaatcctccagaaaaagcacctgcagcaggagaaggagtgcttgatgtccaaactggttgaagccgagatggatggtgccgccgctgcgaagcaggttatggctttgaaagacacgattggcaaactgaagactgagaaacagatgacctgcacggatatcaacacattgaccaggcagaaggagctgctgttacagaaactgtccactttcgaagagactaatcgcactctccgggacttactgcgtgagcagcactgcaaggaggatagcgaacggcttatggagcagcagggtgcactgctgaaacggctggccgaggctgatagcgagaaggcccggctgctgctgctcttgcaggataaggacaaagaagtggaggagcttttgcaagagattcagtgtgaaaaggcgcaggccaagacagctagtgagttgtccaagtccatggagagcatgcgcgggcatttacaggcacagctgagatctaaggaggccgagaacagcaggctgtgcatgcagatcaagaatctggaaagaagtgggaatcaacataaagcagaggttgaagcaataatggaacaactgaaagagctgaaacagaagggcgacagagacaaagagagcctcaaaaaggctattagagctcagaaagaacgagcagaaaaatccgaggaatacgcagagcagcttcatgttcagttggccgacaaagacctttatgtggctgaggccctgagcaccctggagtcttggcgatctaggtacaatcaagtcgtcaaagagaagggagatttagaactcgagataatcgttctgaacgatagagtgacggacttagtcaatcaacagcagaccctggaggagaagatgcgggaggacagagattccctcgtggagcgcctccaccgccagacggctgagtactcagcttttaagctggagaatgagcggctgaaggcctcatttgccccgatggaagacaagctgaaccaggcccatctggaagtgcagcagctcaaggccagcgtgaagaattacgagggaatgattgataactataagagtcaggtaatgaagacacgtttggaggcagatgaggtagcggctcagctggagagatgcgacaaagaaaacaaaatcctgaaagacgaaatgaacaaggaaatcgaagctgctagacggcagttccagtcccagctggctgacttacaacagctcccagacatcctgaagatcactgaggcaaaactggccgagtgtcaggatcagctccaagggtacgagagaaagaacatcgacctcactgcaattattagcgacttgaggtcgcgcatcgaacatcagggagataagctggagatggccagggagaaacaccaggcttcccagaaggagaacaaacaacttagcctcaaggtggacgagcttgaaagaaaactagaggccacgagtgcacaaaatattgagttcctacaagtgatcgcaaagcgggaggaggccattcatcagtcccagctgcgcctggaagaaaagaccagagagtgtggcactctggccaggcagctggaatctgctattgaggacgcccgtagacaggttgagcagaccaaggaacacgctttgtctaaagagagggctgcccagaacaagatcctggatctggagacccagttgtctaggaccaagaccgagttgtcgcagttgcggaggtctagggatgacgccgacagacgataccaaagccgcttgcaagatctgaaagataggttggagcagagcgaatctactaaccgttccatgcagaactatgtccagttcttaaaatcttcgtacgccaatgtttttggagatggtccttacagtacattcctgaccagctcacctatccggtcgcgaagtccaccagcctag

SEQ ID NO: 198313 - DNA, 2475 bp, Artificial Sequence
  Description of Artificial Sequence: Synthetic coding sequence
atgaaggaccggagcagcaccccccccctgcacgtgcacgtggacgaaaacaccccggtgcacgtccacatcaagaagctccccaagcctagcgcgacgtcgtcccagaagtcccacaagcgggggatgaaaggtgacaccgttaatgttcggagatctgtgagggtcaaaaccaaggtgccctggatgcccccaggcaagtcaagcgcaagacccgtcgggtgcaaatgggaaaatcccccacactgtctggagatcacccctccttcatctgaaaagctggtgtcagtgatgagactgagcgatctcagcacagaggacgacgacagtggccattgtaagatgaacagatacgataagaagatcgactctctgatgaacgcagtggggtgtctcaagagtgaggtcaagatgcagaaaggtgaaaggcagatggccaagagatttctggaggagcgtaaagaggaactagaggaggtagcgcatgagctcgccgagactgagcacgagaacaccgtactccgccataatatcgagagaatgaaggaagagaaggactttaccatcctgcaaaagaagcatcttcagcaagagaaggagtgccttatgtcaaaattggtcgaagctgaaatggacggtgccgctgccgctaaacaggttatggccctgaaagatacaatcggtaaacttaagacggaaaagcaaatgacttgcactgatattaatactttgacgaggcagaaagagctgctgttgcagaaactgtctacatttgaggagactaaccgcactctaagagaccttctgcgggagcagcattgtaaggaagacagcgaacgcctgatggaacagcagggtgcactgctgaagaggctcgctgaggcagattctgaaaaggcccgtttgctcctgctgctgcaggacaaagataaggaggtggaagagctcctgcaggaaatacaatgcgagaaggcccaagctaaaacggcttctgaactctctaaatccatggagtctatgcgcggacatctccaagctcaactaagaagcaaggaagccgaaaatagccgtctgtgtatgcagatcaaaaatttagagagaagcggcaaccagcacaaggctgaagtagaagcgataatggagcagctcaaggagctgaagcaaaagggggatcgagacaaggaatcccttaaaaaagccatcagggcacaaaaagaacgtgccgaaaagagtgaagagtacgccgaacagctgcacgtacagctcgccgacaaggacctgtacgtggcggaagccctctcaacgctggagtcatggcgaagccgctataaccaggtggtgaaggagaagggggacctggaattagagataatcgtgctgaatgatagagtgaccgatcttgtcaaccaacagcaaaccttagaggagaagatgagggaggaccgggactcgctagttgaacgtctgcaccgccagactgctgagtactccgccttcaagttggaaaacgagcgactgaaagcgagttttgctccgatggaggacaagttgaaccaggcccatcttgaagtgcagcagctgaaggcctccgtcaagaactacgaaggcatgattgacaattacaaaagccaggtgatgaaaactcgtctcgaggcagatgaggtggcggcacaactggaacgctgcgataaagagaacaagatcctcaaggacgagatgaataaagagattgaagcggcccggaggcagtttcaatcccagctcgccgacctgcaacaactgcctgatattctcaagataacagaggcaaaactcgctgaatgccaggatcagctacaaggttatgagaggaagaacatcgacctaacagccattatctccgacttgagatcacggatcgagcaccagggagacaagctcgagatggcgcgtgagaagcatcaggccagtcagaaagaaaataagcagctctctttgaaggtggatgagctggagaggaagcttgaagccacttccgcacagaatattgaatttttacaggtcatcgctaagcgagaagaggcaatacatcagtcccaattgaggttagaggaaaaaactagggaatgtggaactctggcccgccaattggagtctgccattgaagacgctcggcggcaagtggaacagacgaaggagcatgctctgtctaaagaacgagccgctcagaacaaaatccttgatctggagactcagctgtctcgcactaaaacagaactttctcagttacgcaggtcccgggatgatgctgatcgacggtaccagagtagattacaggatttgaaggataggcttgaacagagcgagagcaccaatagaagcatgcagaattacgtccagttcctgaagtcctcctacgccaatgtctttggagacggcccctactccaccttcctgacctccagcccgatacggagtcgatctcccccagcatag

SEQ ID NO: 198314 - DNA, 1917 bp, Artificial Sequence
  Description of Artificial Sequence: Synthetic coding sequence
atgagcgccagcagcagcggcggcagcccccggttccccagctgcggaaaaaacggcgtgacctctctcactcagaagaaggtacttagggccccttgcggcgcaccatccgtaaccgtcaccaaaagtcacaagcgtggtatgaaaggggatactgtcaatgtccgtaggtctgttagggtgaaaacaaagaaccctccccattgtttggaaattacccctccctctagtgagaagctggtaagcgttatgcgactctcagacctatccaccgaagatgatgatagcgggcactgtaaaatgaaccgatatgacaaaaagatcgatagcctgatgaacgctgttggatgtctaaagtcagaggttaagatgcagaagggcgaaaggcaaatggccaaacgcttcctggaggaaaggaaggaagaacttgaagaggttgcgcacgaactggccgaaaccgaacacgagaatacagtgctaaggcacaatatcgaacgaatgaaggaggaaaaagactttacgatcctgcagaagaagcaccttcagcaggaaaaggaatgcttaatgtctaagcttgtagaggcagagatggatggtgctgctgctgccaagcaggtgatggctctgaaagataccataggaaaactgaagacagagaagcagatgacctgcacagacatcaacacacttacaaggcagaaggagctccttttgcagaaattaagtacctttgaggaaaccaatcgtaccttgcgagatcttctgagagaacagcattgtaaggaggatagcgagcgcctgatggagcagcaaggagcactgctgaaaaggctagcagaggctgattccgagaaagccaggctgctgctcctactccaggataaagataaggaggtcgaagagctcctgcaggaaattcagtgcgagaaagcccaggcaaagactgccagtgagctcagtaaaagtatggagtccatgagagggcaccttcaggctcagctacgatccaaagaggcggaaaactcacggctatgtatgcaaatcaagaacctggaacgctctggaaatcagcacaaggccgaagtggaagctatcatggagcagctaaaagagctgaaacagaaaggcgacagggataaggaatccctgaagaaagccataagggcgcagaaggagcgagccgagaagtcagaggagtacgcggagcagctgcacgtccagttggctgataaagatttgtacgtggctgaggctctgagcaccctggagtcttggcggtccagatacaaccaggttgtcaaggagaagggagacctggagctggagatcatcgtcctcaatgacagagtgaccgacctggtcaatcagcaacagacactggaggaaaaaatgcgcgaagatcgagattctctcgtggagcgcctgcacagacagacagcggaatattctgcttttaagctcgagaacgagagactgaaagcttcttttgcccctatggaggacaagctcaatcaggctcacttagaggtccagcaactgaaggccagtgtgaagaactatgaaggcatgatcgacaactacaagtctcaggtgatgaaaacccgcttggaggcagacgaagtggccgctcaactcgaacggtgtgacaaagaaaataagatactgaaagatgaaatgaacaaagagatcgaggctgcacgtagacagtttcaatcacagttagccgacctgcagcagctccccgatatccttaagatcactgaagccaaactggctgagtgccaggaccagctccaggggtatgagcgaaagaacatagatctaactgccataatcagcgacctcaggtcaagggtgagagactggcagaagggttcccatgagctgacccgagctggcgccagaatcccgcggtag

SEQ ID NO: 198315 - DNA, 2490 bp, Artificial Sequence
  Description of Artificial Sequence: Synthetic coding sequence
atgagcgccagcagcagcggcggcagcccccggttccccagctgcggcaaaaacggggtgacttcccttactcaaaagaaagtgcttagagccccctgcggcgccccatccgtgactgtgactaagtctcataaaaggggaatgaagggcgatacagttaacgtgaggcgcagtgtccgcgtgaagacaaaggtgccatggatgcctcctggaaaaagttcagctcggccagtcggctgtaagtgggagaatcccccacattgtctggagatcactccaccaagctctgagaaattggtttccgtcatgagactgagcgacctttctacagaggatgacgactccggtcactgcaagatgaataggtatgacaaaaaaatagactctcttatgaatgcagtaggctgtctgaagtctgaagttaagatgcagaaaggggaacggcagatggctaaaaggttcctcgaagagaggaaggaagaactggaggaggttgcccatgagctcgcagaaaccgaacacgaaaacaccgtgcttagacacaacatcgaaaggatgaaggaggagaaggacttcacgatccttcagaagaaacacctccagcaagaaaaggagtgcctgatgagcaaacttgtggaggctgagatggacggtgctgctgcagctaagcaggtaatggctctgaaagacacgattggaaagctcaaaacagaaaaacaaatgacctgcaccgacatcaacaccttgactcggcagaaagagttgctcctccaaaaactttctacttttgaagaaacgaataggacactcagggatctcttacgggaacagcactgcaaggaggattcggaaaggctgatggaacagcagggcgcattgctaaagaggttggccgaagcagattctgagaaagcccgcctccttctgctcctgcaggacaaagataaagaggtagaggagctcctgcaggaaatccagtgtgagaaggcacaggcaaagactgcctccgagctctccaagagcatggagtccatgaggggccatctgcaagcccagcttcggagcaaagaagctgagaactcccggctgtgcatgcagatcaagaacttggaaaggtccggcaatcagcataaggccgaagtggaggctattatggagcagcttaaggagctcaaacaaaagggagaccgtgacaaggaatctctgaagaaagccattcgtgcccagaaggagcgcgctgagaaaagcgaggaatatgccgagcagctccacgtccagttggctgataaagacctctacgtggctgaggccctttcaacccttgaatcctggaggtctcgctataaccaggtggtgaaggaaaagggggacttagagctggaaatcatagtcttgaacgacagggtgaccgacctggtcaatcagcagcaaaccctggaggaaaaaatgcgggaggaccgagacagcttggttgaacggcttcaccggcagaccgccgaatactcggctttcaagcttgagaatgaacgacttaaagcctctttcgcaccaatggaagataagttaaaccaagcgcatcttgaggtacagcaactgaaagcatccgtgaagaactatgaggggatgattgacaattacaagagccaggtaatgaagacccgccttgaggccgatgaggtcgcagcccagctcgaacggtgtgataaagagaacaagattttaaaggatgaaatgaataaggagatagaagcagctaggcggcagtttcaatcacagttggctgatttgcaacagctcccagatattctcaaaattactgaagctaaactcgccgaatgtcaggatcagcttcagggatatgagcggaagaatattgatctcactgccatcatatccgacctcaggagcaggattgagcatcagggagacaagctggagatggcccgagaaaagcatcaagctagtcaaaaggagaataagcagctttctctcaaagtggatgagctggagcggaagttggaagccaccagtgcacagaacatcgaatttcttcaggtaatcgcaaagagggaggaagccatccatcagagtcagctgcgactagaagaaaagacgcgggagtgcgggactctggcacggcagctggaaagcgctatcgaagatgctcggcgacaggtggagcagacaaaggaacacgctctaagcaaggagagagcagcccaaaacaagatcttggatttggagacacagctgtcccgcaccaaaacagagttatcccagctgcgtcggagccgggacgacgccgatagaaggtatcaaagcaggctgcaggatctgaaagaccgcttagaacagagtgaatcaactaatagatccatgcaaaattacgtgcagtttctaaaaagtagctacgccaacgtctttggggatggcccatatagtacatttctgacctcgtctcccatacgcagcaggtcaccccccgcctag

SEQ ID NO: 198316 - DNA, 2106 bp, Artificial Sequence
  Description of Artificial Sequence: Synthetic coding sequence
atgggcgagctgcccaccggctgccggaagcggcggcggaagcgggggggcgccgcggcgagggcccgactgcatccacccagacggttgcacggtactacccttgccagcgatttcaatgacttcatacgccggaggttttgggcccagccttgtcggtcttggttcccgtcctgcggaaagaatggcgtcacatccctgactcagaagaaggtgctgagagcgccttgcggcgcccccagtgttacagtgaccaaatcacacaaacggggaatgaagggtgatacagtaaacgttaggaggtccgtccgggtgaaaaccaaggtcccctggatgccaccaggcaaatccagtgcacggcccgtgggatgcaagtgggaaaacccaccacactgcctggagattacaccaccatccagcgaaaagttggtatctgtgatgaggctgagcgacctctccaccgaggatgacgactccggccactgtaagatgaaccggtacgataagaaaatagatagcctgatgaatgccgttggctgcctgaagagcgaggttaagatgcaaaaaggggagcgccaaatggctaagcgctttctggaggagcggaaagaagaactggaagaagtggctcatgaacttgccgaaaccgagcatgagaataccgtgctgcgccataatatcgagagaatgaaagaggagaaggatttcacaatcctccagaagaagcacctgcagcaggagaaggagtgcctgatgtcgaagctggtggaggctgagatggatggtgcagctgctgctaaacaagtcatggctttaaaagatacaatagggaaactgaagaccgaaaagcagatgacctgtacggatataaatacgctgactcggcagaaagagctgctgctgcaaaagctgtctaccttcgaagagaccaaccggactctacgtgacctcctcagagagcaacattgcaaggaagacagtgagcggctcatggaacagcagggcgccttgttgaagcggttggcggaagcagactctgaaaaggcaagactccttcttttactgcaggataaggataaggaagtggaggagctcctgcaagagatccagtgcgagaaagcacaggcgaagaccgcaagcgagctgagcaagtctatggaatcaatgcgaggccatttgcaggcgcagttacgctccaaggaggccgaaaactcaaggctttgcatgcaaattaaaaatctggaacgtagcggcaaccaacacaaagcagaggtggaggccataatggagcagctaaaggaactgaagcagaaaggtgacagggacaaagagtctctgaagaaagcaattagagcccagaaggagcgagccgagaagagcgaagagtatgcagaacagctgcatgtgcaactggccgacaaggatctgtatgtcgcagaagctctgtccaccctggaaagctggcgaagccgctacaatcaggtagttaaggaaaagggcgatttagaacttgagatcattgtgctaaatgacagggtgaccgacctagtgaaccagcagcagacactggaggagaaaatgcgggaggatcgagactctctggttgagcgcctgcacagacaaacggccgaatatagcgcgtttaaattggaaaacgagcggttaaaggccagcttcgctccaatggaagataaattaaaccaggctcatttggaggtccagcagttgaaggcctccgtaaagaactacgagggcatgatcgacaattacaagtctcaggtgatgaagacgagacttgaggccgatgaggtggctgctcaactcgagagatgtgataaggagaataagattctgaaggatgagatgaataaagaaatcgaagccgcccggaggcagtttcaaagccagctcgctgatctccagcagctgccagacattctgaagatcacagaggccaagctggccgagtgccaagatcagctgcagggatatgaacgcaaaaatattgatcttactgctattatcagcgatctgcgtagtcgcgtgcgcgactggcaaaagggcagccacgagctcactcgcgcgggcgcccgcatacccagatag

SEQ ID NO: 198317 - DNA, 1974 bp, Artificial Sequence
  Description of Artificial Sequence: Synthetic coding sequence
atggccgaccagcagggcccccaccagaaccggttccccagctgcgggaaaaacggcgtaacatccctgacccagaagaaagtgctgcgggcaccgtgcggagcgccctccgtaactgtgaccaaaagccacaagcgggggatgaagggagataccgtcaacgttcgtcggtcagtccgcgtgaaaacgaaagtgccttggatgccccctggaaagtcctccgcccgccctgtcgggtgtaagtgggaaaatcctccccattgcctggagattactcctccgagctcagagaaacttgtctcagtgatgaggctctcggacctctctacggaagatgatgactcgggacattgcaagatgaacaggtacgacaaaaaaatagacagtctaatgaacgccgtgggttgcctgaagagtgaggtcaaaatgcagaaaggcgagagacaaatggccaagaggttcctcgaggaaagaaaagaagagctggaggaggtcgcgcacgagctggccgagactgagcacgaaaacacagtcctgagacacaacatagaaaggatgaaggaggagaaggactttacaattctacagaagaagcatttgcaacaggaaaaagagtgtttaatgtcaaagctggtggaggcagaaatggacggtgcagccgccgcaaaacaggttatggccttgaaagataccattgggaagctaaagactgagaagcagatgacatgcactgatatcaacaccctaacaagacagaaggagctgctgcttcagaagcttagtacctttgaggaaaccaaccgcaccctcagggacctgctgcgggagcagcactgcaaagaggacagcgaacggctgatggaacagcagggcgcgcttcttaagcgcctggccgaggcagactctgagaaggcgcgtctgctccttcttctgcaggataaagataaagaagttgaagaactactgcaggaaatacagtgcgagaaggctcaggctaaaacagcctccgaacttagcaagtcaatggagtccatgcggggccatctgcaggcccagttgcgcagcaaggaagctgagaacagtcgattgtgtatgcagattaagaatctggaacgcagcggcaaccagcataaagcggaagtggaggctattatggaacagttgaaggagctcaagcagaagggggatagggacaaagagtctctgaagaaagccatccgagcccagaaggagcgcgctgagaagagcgaggaatacgcagaacagctccacgtgcagttggcagacaaagacctgtacgtagccgaggctctctctaccctggaatcttggaggagccgttacaaccaggtcgtcaaagagaagggcgatctcgaactggaaattatcgtgctcaacgatagggtgacagatctggtcaaccaacagcaaacactggaagaaaaaatgcgggaggatagggacagcctggtggagcgccttcatagacagacggccgagtattctgcctttaagctcgagaacgaaagattaaaggcgtcctttgccccgatggaggataagttgaatcaggcacacttagaagtgcagcagctaaaagcctccgtgaaaaactacgagggaatgattgataactacaagtcccaggtcatgaagacacgactcgaggctgacgaggtcgcagctcagctggaacgctgtgataaggagaacaaaatactcaaagacgagatgaacaaagagattgaagctgctagaagacagttccaatcccagcttgccgatctgcagcagctgcccgacatcctcaagatcaccgaagccaaactcgccgagtgccaggatcaacttcagggatacgaacgaaaaaatatcgatctgacagctattatcagcgacttacgcagtcgggtgagagattggcagaagggcagccatgaactgaccagagcaggcgctcggatccctcgctag

SEQ ID NO: 198318 - DNA, 570 bp, Artificial Sequence
  Description of Artificial Sequence: Synthetic coding sequence
atgaaggaccggagcagcaccccccccctgcacgtgcacgtggacgaaaatacacctgtccacgtccatatcaaaaagctgccgaaacccagtgccacctcttcacagaagagtcataagagagggatgaaaggtgacacagtgaacgtgagacgcagcgtaagggtgaaaacaaaggtgaagatgcaaaagggcgaacgccagatggcaaagagattcctcgaggagcggaaggaggaactggaggaggtcgcacatgagttggctgagacagaacatgaaaacacagtgctccgtcacaacattgaaagaatgaaagaggagaaggactttaccattctgcagaagaagcatctgcagcaggagaaggagtgtctgatgtccaaacttgtagaggctgagatggatggggcagccgcagcgaagcaagtgatggctctgaaagacaccatcggaaaactgaaaacggaaaagcagatgacctgcactgatatcaacactctgaccaggcaaaaagaactgctgctgcagaaactgtccacatttgaggagacgaatcgaaccctgtag

SEQ ID NO: 198319 - DNA, 618 bp, Artificial Sequence
  Description of Artificial Sequence: Synthetic coding sequence
atgagcgccagcagcagcggcggcagcccccggttccccagctgcggaaaaaacggagtcacctccctcacacagaagaaagttctacgcgctccatgcggagctccctccgtgacggtcacgaaatcacataagcgcggtatgaagggcgacactgtgaatgtgaggcgttctgtacgcgtcaagacaaaggtcaagatgcagaagggcgaacggcaaatggcaaaacggttcctggaagagagaaaggaggaattggaggaggtcgcccacgagctggctgaaacagaacacgagaacacagtgttgagacataacatcgaaagaatgaaagaggagaaagacttcactatccttcagaagaagcacttgcagcaagagaaagagtgtctgatgtcaaagctggtggaagcggaaatggacggggcagcggctgctaaacaggtcatggctcttaaagacaccataggcaagctcaaaaccgagaaacagatgacatgcactgacatcaataccctgactagacagaaggaactgctactccagaagctcagcactttcgaagagaccaatagaacattgagagacctgctgcgtgaacagcactgtaaagaatag

SEQ ID NO: 198320 - DNA, 543 bp, Artificial Sequence
  Description of Artificial Sequence: Synthetic coding sequence
atgagcgccagcagcagcggcggcagcccccggttccccagctgcggcaaaaacggagtgacctcactcacccaaaaaaaggtgttgagagcaccatgcggcgcgccaagcgtgaccgtcaccaaaagccacaagagggggatgaagggcgacacggtcaacgtgcgaagaagtgtaagagtgaagacgaaggttccctggatgccgccaggcaagagcagtgcccggcccgtgggttgcaagtgggagaatcctcctcattgtctggagataaccccaccctcctccgaaaaactggtgagtgtaatgagactgtcagacctgtctactgaagatgacgactcaggccactgtaagatgaacagatatgacaagaagatcgatagtctcatgaacgctgtgggttgtttgaaaagcgaggtgaaaatgcagaaaggagagaggcagatggccaaacgctttctggaagaacgcaaagaggagctggaagaggtggcgcatgagctcgcggagaccgaacatgaaaataccgtgctgagatag

SEQ ID NO: 198321 - DNA, 648 bp, Artificial Sequence
  Description of Artificial Sequence: Synthetic coding sequence
atgaaggaccggagcagcaccccccccctgcacgtgcacgtggacgaaaacactccagtccacgtccacattaaaaagcttcctaaaccctctgcaactagctcccaaaagtcacataagcggggcatgaaaggggatacggtgaacgtgcgtcggtcggttagggtcaagactaagaacccccctcattgccttgaaatcactccgccgtcctcagaaaaactggtcagtgtgatgcgactgtcagatcttagtacagaggacgacgactccggccattgtaagatgaatcgatacgataaaaagattgatagcctgatgaatgccgtgggctgcttgaagtccgaggtgaagatgcaaaagggagaacggcagatggcaaaacgcttcctggaagaaagaaaagaagagctggaagaggttgcacacgagttggcagaaacagagcacgagaacactgtgctgcggcacaacattgaacgcatgaaagaggaaaaagatttcacaatattacagaaaaagcacctgcagcaggaaaaggagtgtctgatgtccaagttggtcgaggcggagatggatggagcagcagctgccaaacaggttatggcattgaaagacaccatagggaagcttaaaaccgttggatag

SEQ ID NO: 198322 - DNA, 471 bp, Artificial Sequence
  Description of Artificial Sequence: Synthetic coding sequence
atgagcgccagcagcagcggcggcagcccccggttccccagctgcggtaagaatggtgtgactagtctcacccagaaaaaggttttgagggctccgtgtggtgcccccagcgtcaccgtcaccaagtctcacaaaagggggatgaaaggcgacacagtgaatgtgcggaggagcgtccgcgttaagaccaagaacccacctcactgtctggaaatcaccccccctagtagcgagaagcttgtgtccgtgatgcggcttagcgatttgtcgaccgaagacgatgatagtggccactgcaagatgaacagatacgataaaaagatcgactctctcatgaacgccgtcggttgtctgaagtcggaggtcaaaatgcagaagggggaacggcagatggcaaagagattcctagaggagcgcaaggaagaactagaggaggtggcgcatgaactggcggagaccgaacacgagtag

SEQ ID NO: 198323 - DNA, 1731 bp, Artificial Sequence
  Description of Artificial Sequence: Synthetic coding sequence
atgaaggaccggagcagcaccccccccctgcacgtgcacgtggacgaaaacacccccgtacatgtccacataaagaagctgcccaaaccatctgccactagctctcagaagtctcacaaacggggcatgaaaggggatactgtgaatgtgcggagatcagtgcgtgtgaaaactaaagtgaaaatgcagaagggtgaaaggcaaatggcaaagcgcttccttgaagaaagaaaggaagaactggaggaagtggcccacgagttagctgaaacggagcacgagaatacggtgctgagacacaatatcgagcgtatgaaggaagagaaagactttaccatattgcagaagaaacatttgcaacaagagaaggagtgcctgatgtccaaactggtggaggctgaaatggatggcgctgctgctgccaagcaagtaatggctctgaaggacacaataggcaagctgaaaaccgagaaacagatgacgtgtacagacatcaacactctaaccaggcagaaagagttgctgcttcaaaaactgagtacattcgaagaaactaatagaaccctacgggatcttcttagggagcagcattgcaaggaagactccgaaagactaatggagcaacagggagcgctgcttaaaagattggctgaagcggatagcgaaaaagccaggctactcctgctcctccaagataaggataaagaggtcgaagaacttcttcaggaaatccaatgtgaaaaggcccaagccaagacagcgagcgagctctcaaaatcaatggaatccatgagagggcacctccaagcacaactgcgctccaaggaggcggagaactcccgcctgtgcatgcaaatcaaaaacctggaaagaagcggcaaccagcacaaagcagaggttgaggctattatggaacaactcaaagagctgaaacagaaaggtgaccgtgataaagaatctctcaagaaggcaatccgggctcagaaggagcgagccgagaagagcgaggagtatgccgagcagctgcacgtgcagctggccgacaaagatctgtacgttgctgaagctctgtcaactttggaatcatggcggagcaggtacaatcaggtggtgaaggagaagggcgacctcgagttggaaattatcgtgctgaatgatcgcgtgactgatctagtcaatcagcagcagacccttgaagaaaaaatgcgagaggatagagactccctggtggaacgactgcatcgccagaccgcggaatacagcgcctttaaactggagaacgagagactgaaagcatcctttgctcccatggaagataagttgaaccaagcccatctggaagtgcagcagttgaaggcctccgtgaaaaactatgaagggatgatcgacaactataagagccaggtgatgaagaccaggctggaggcagacgaggtagcagcccagttggaaaggtgtgataaggaaaacaagattctcaaggacgaaatgaataaagaaatcgaagctgcccgccggcagttccagtctcagcttgcagacctgcagcagctacctgacatcctaaagatcaccgaagccaagctcgccgagtgccaggaccagctgcaaggctacgaacgaaaaaatatagacctgacagccattatcagcgatttaagatcccgagtcagagactggcaaaagggcagccacgagctgactcgcgcaggcgcccgcatcccacgttag

SEQ ID NO: 198324 - DNA, 444 bp, Artificial Sequence
  Description of Artificial Sequence: Synthetic coding sequence
atgaaggaccggagcagcaccccccccctgcacgtgcacgtggacgagaatacgcccgtccacgtccatatcaaaaagcttcctaagccatcggcaacgtctagtcaaaagtcccataagcggggcatgaaaggggataccgtcaacgttcgacgtagtgtacgggtcaagaccaaggttccctggatgccccccggaaagagtagcgcacggccagtggggtgtaaatgggagacttccgaagagacaccaacaacaggtgagggagtgccgcacgtgcaggccggcggaggtggtaacggatggggctgtgggtgtcaagctgggcacggactggagggctaccatcgggaagctgaaaaccgtgagacaaatgatttacacggacaccagcaccccgacaaggcggaagggacatctcctgctgaggccgaacacatttag

SEQ ID NO: 198325 - DNA, 1917 bp, Artificial Sequence
  Description of Artificial Sequence: Synthetic coding sequence
atgggccggaaccggtacccccccgcctgctggttccccagctgcggcaagaacggcgtgacttctctcacccagaagaaggtgctgagggctccatgcggcgccccatcagtgacggtgacaaaaagccacaaaaggggcatgaaaggtgatacagtaaacgttcggaggtccgtgagggtgaaaactaaaaaccccccccattgcctcgaaatcacccctccgtccagcgaaaagctggtcagtgtcatgagactcagcgacttgagcacagaagacgacgacagtggtcattgtaagatgaaccggtacgacaagaaaatcgactcactgatgaacgccgtagggtgcctgaagtcagaagttaaaatgcagaagggtgagcggcaaatggcaaaacgattcttggaggagcgcaaagaagagttggaggaagtcgcgcacgaactggcagagaccgagcacgagaataccgtcctccggcacaacattgagcggatgaaggaggagaaagattttactattctccagaaaaagcacctgcagcaggagaaagagtgcctgatgagcaaactcgtggaggccgagatggacggagcagcagcagctaaacaggtgatggctctgaaggacaccataggcaaattgaaaacagagaaacagatgacatgtacagacatcaacacgttaactcggcagaaagagctgttactccagaaactgtctacatttgaagagactaatcgcaccctgcgcgacctcctaagagaacagcactgcaaagaagattcagagcgcttaatggaacaacaaggtgctctgttgaagagattggccgaggcagactccgaaaaggctagacttttgctattgctacaggacaaggacaaggaggttgaagaactcctgcaggagattcagtgcgaaaaggcacaggctaagacagccagcgagctatccaagtctatggaatcaatgaggggtcacttgcaggcacagctgaggtccaaagaggcagagaatagcagactgtgcatgcagattaagaatctggagaggtccgggaaccaacacaaagctgaggtggaagctattatggagcagctcaaggaactcaaacagaaaggtgatcgcgataaagaatcacttaagaaagcaattagggcccagaaggaaagggccgaaaagagtgaagagtacgccgaacagctgcatgtgcaactggccgataaggatctgtatgttgccgaagctttgtcgacacttgaaagctggcgatctcgctataatcaggtcgtcaaagaaaaaggcgacctggaattggagatcatcgtgttaaacgatcgggtgaccgaccttgtgaatcagcagcagacattagaggaaaaaatgcgagaagatcgcgattctctggtggaaaggcttcacagacagacagcggagtactccgcctttaagctggaaaatgagcggcttaaagcgtctttcgcccccatggaggataagttaaatcaggcccaccttgaagtgcagcagctgaaagcatctgttaaaaattacgagggcatgatagacaactacaaatcccaggtaatgaagacccgcctggaggccgacgaggttgcagcccagttggaacggtgcgacaaagaaaacaaaatcctcaaggacgagatgaacaaggagatcgaagccgcaaggcgacagttccaaagccagcttgccgacctgcagcagttgcccgacatcttaaagattaccgaggccaaactggcagagtgtcaggatcagttgcagggttacgaacgaaagaacatcgatctcacggctattatttccgatctcagatctagagttagggattggcaaaaaggatctcatgaattaacccgcgcaggggcgagaatcccgcgctag

SEQ ID NO: 198326 - DNA, 765 bp, Artificial Sequence
  Description of Artificial Sequence: Synthetic coding sequence
atgaccgaggaggtgtggatgggcacctggcggccccaccggccccgaggacctattatggctctttatagcagccctggaccgaagtacctgataccgcctacgacaggctttatgaaacacacaccaacaaagctcagagcaccagcatactctttccgtggcgctcctatgctgctggctgaaaactgctcgcccggaccacggtacaacgtgaaccctaaaatcctgagaacaggaaaggacttagggcctgcctactcaatactcggcaggtatcagacgaaaaccatgctcacccccggtccaggtgactactttcctgagaaatcaacgaagtacgtgtttgactcagccccgtcccactcaatctcagccaggaccaaggccttccgcgtggacagcaccccaggccctgctgcttacatgttgccgatggttatgggccccaacaccgtggggaaggcttcccagccctcttttagcattaagggacgtagtaaattggggggcttcagcgacgatttgcacaagacccccgggccagcagcgtaccgtcaaaccgacgttcgggtcacaaagtttaaagctcctcagtacacaatggctgccagggtggaacctccaggcgataagaccctgaaaccaggtcctggggcccacagtcctgagaaggttacactgacaaaaccttgcgctccggtagtcacttttggcataaaacatagcgattacatgactcccctacttgtggatgtagaatag

SEQ ID NO: 198327 - DNA, 417 bp, Artificial Sequence
  Description of Artificial Sequence: Synthetic coding sequence
atgaccgaggaggtgtggatgggcacctggcggccccaccggcccaggggaccgattatggccctgtatagctccccagggcccaaatacctcattcctccgacaaccggatttatgaagcatacgcccacaaaactcagagcccctgcatacagcttcagaggcgcacctatgctcttggccgagaattgcagccccggaccgagatacaacgtgaaccctaagatcctgcgtacagggaaagacctcggccccgcctattcaatcctgggccgctaccaaacgaagacaatgctgacaccaggtcccgcactgaagtccgccttcccttcatggaccccacctgacccaacttggagtccccccgtgttagaaccaagaggtcccacccctagaatgctgggatcacctccctag

SEQ ID NO: 198328 - DNA, 375 bp, Artificial Sequence
  Description of Artificial Sequence: Synthetic coding sequence
atgaccgaggaggtgtggatgggcacctggcggccccaccggccccggggcccaatcatggctctgtactctagcccaggcccaaagtacttgatacccccaacgacaggcttcatgaagcataccccaacaaaactccgtgcacccgcttactcgttccgcggcgctcccatgctgctggcagagaactgctcaccccctaacaccgtcggcaaggcaagtcaaccatccttctctataaagggacggagcaagctgggcggatttagtgacgacttgcacaaagtgacactcaccaagccttgtgcacctgttgttacttttggtattaaacattctgactatatgacccccttactggtggatgtggagtag

SEQ ID NO: 198329 - DNA, 774 bp, Artificial Sequence
  Description of Artificial Sequence: Synthetic coding sequence
atggacgccgagtacagcggcaacgagttcccccggagcgagggcgagcgcgaccagcatcaacggcccggaaaggagagaaagagcggcgaggccggctggggaaccggcgagttggggcaggatggacgccttctctcttctacactgtcactctctagcaatcggtcactgggtcagcgacagaattcccctctgccctttcagtggcgcatcacccatagctttcggtggatggctcaggtgctggctagcgagctttcattagtggctttcattctgctgctggtcgttgcgttctcaaaaaagtggttagacctctccagatctctgttctatcagaggtggcctgtcgacgtatcaaatcgcattcatacgtcagcccacgtgatgtcaatgggccttttgcacttctacaagtcccgctcatgcagcgatttggaaaatggcaaggtcaccttcatattctcaaccctgatgctgtttccgataaacatctggatatttgagttggaaagaaatgtgtcaattccaatcgggtggagctacttcatcggatggctggtcctgattctgtactttacttgcgctattttatgttacttcaaccataaatctttctggagcctcatcctgagccacccttccggggccgtctcctgtagttcctccttcggcagtgtcgaggaatctcctcgagctcagactatcacagacacacccatcactcaggagggcgttctggatccagaacagaaggacactcacgtttag

SEQ ID NO: 198330 - DNA, 1488 bp, Artificial Sequence
  Description of Artificial Sequence: Synthetic coding sequence
atggtgacctggctgtaccggttcctgcccaccagcaacatggccgccaaacttagatctttgctgcccccagacttgaggctccagttttggctacacgcccgcctccagaagtgtttcctgtcccggggctgcgggagctactgcgccggtgccaaggcttcccccctccccgggaaaatggctatgggcctgatgtgtggccgccgagagctcctgcgactgctacagtcaggcaggcgcgtccattctgtagctggtccttcccagtggttgggcaagcccttgactacaagactgctctttcctgccgcaccttgttgttgtagacctcactatctgtttctggcagcttccgggcctagaagcctgtctacctctgcaattagcttcgccgaggtgcaagtacaggcgccgcctgtggtggccgccacacccagtccgacagccgtcccagaggttgcctctggggagacagccgatgtggtgcagaccgctgctgaacagagctttgctgaactgggactgggctcctacactcctgttggcctgatacagaacctgctcgagtttatgcatgtagacctggggttaccatggtggggggcgattgctgcatgcacagtttttgctagatgcctgatcttccccctaatcgtcacaggacaaagggaggcagcacggatccataatcaccttcccgagattcaaaagttctctagccgaatccgtgaagcgaaattagcaggcgaccacattgaatactacaaggcctcttcggaaatggccctctaccaaaagaagcacggcattaagctatacaagcctttgatcttaccagttactcaggctcctatctttattagtttcttcatcgccctcagggagatggctaacctgccagtgcccagtcttcagactggtggattatggtggttccaggaccttactgtaagtgacccaatatatatcttgcccctcgcggtgacagcaactatgtgggccgtgcttgagttgggtgctgagaccggtgtgcaatcctccgatctccagtggatgcggaatgttattagaatgatgcctctgattaccctccccatcacaatgcacttcccaaccgcagtttttatgtattggttaagttctaacctgttctccttagttcaggtgtcatgcttacggatacccgccgtgcggactgtactgaaaatcccacagagagtggtacatgatttggataagctgcctcctcgcgagggatttctggaatccttcaagaaaggctggaagaatgccgagatgacccggcagctacgggaaagagaacagagaatgcgaaatcagttagagctagctgcccgcggaccactgcgtcagaccttcacccacaatccactgttgcagcctgggaaggacaaccctccaaatataccctcctctagttcgaagcccaaaagcaaatacccctggcacgatacgcttggctag

SEQ ID NO: 198331 - DNA, 1260 bp, Artificial Sequence
  Description of Artificial Sequence: Synthetic coding sequence
atgcggggcacccaggtgcacagcgtggccggccccagccagtggcttggaaagcctcttactactaggttgttattccccgccgccccgtgttgctgccggcctcattatctcttcctggccgccagtggcccaagaagcctttctacctccgcaataagtttcgcagaggtgcaggtccaggcgccaccagtggtcgctgcaaccccttcccccacagctgttcctgaagtggcctctggagagacagccgacgttgtacaaactgcagcagagcagtctttcgccgagctgggtcttgggtcctatactccagttggactcattcagaatctgttggagttcatgcacgttgacctgggacttccatggtggggggccattgccgcatgcaccgtttttgccaggtgtctgatctttccactgatagtaacagggcagagggaagcagcccgaattcataaccaccttcctgagatccaaaagttttcttctaggattcgagaggcgaaacttgcaggggaccacatagaatactacaaggcttcaagcgagatggcgctatatcagaagaagcatggtatcaagctgtacaagcccctgatcttacctgtgactcaggccccaatctttatttccttttttattgctctgagggaaatggcaaatttgcccgtccccagcttgcaaacgggaggcctctggtggtttcaagacctgactgtcagcgatcctatttacatcctgcctctggctgttaccgctaccatgtgggccgtgctggagctgggcgcggaaaccggagtgcagtcctcggacttacaatggatgcggaatgtgatcagaatgatgcccctgattactctgcctattaccatgcactttcccacggccgtgtttatgtattggctgtccagcaatctttttagtttggtgcaggtttcctgtttgcggattccagcagtgcgcacagtcctcaagatcccgcagcgcgtcgttcatgacttggacaagctgcccccccgcgagggattcctggagagtttcaagaagggttggaagaatgctgagatgacccgacagcttcgtgagcgcgagcagagaatgaggaaccagcttgagttggctgcgagaggtcctctgagacagaccttcacgcacaaccctcttctccagccagggaaggacaaccccccgaacataccctcttccagttcaaagcccaaatccaagtatccgtggcacgataccctgggctag

SEQ ID NO: 198332 - DNA, 732 bp, Artificial Sequence
  Description of Artificial Sequence: Synthetic coding sequence
atgagccggctgtggtacggcaagaagggccggcggcaccagcccatcaaccacaaatacacactcgtcgtttccgtggccgagtaccaccgacgaattgatgcactcaacacagaagaactgcggacgctctgtcgcagactgcagatcaccacacgggaggacatcaattccaagcaggtggccacggtgaaggcggaccttgagagtgagagctttagacctaacctcagtgatccttccgagttgctcctgccagaccagattgagaagctgacgaagcatctacccccacgcaccatcggttatccttggacattagtttatgggacaggcaagcatgggacatcacttaaaacactgtataggaccatgactggactcgacacgccagtgctcatggtcatcaaggactccgatgggcaggttttcggagctctggcttcagagccccttaaagttagtgatgggttttacggcaccggggaaacttttgtgtttactttttgccccgagttcgaagtgttcaagtggacaggagataacatgttcttcatcaaaggtgacatggactccttggcctttgggggaggaggcggagaattcgcactctggctggatggagacctgtatcatggccgctctcattcttgcaaaactttcgggaaccggactctctccaagaaggaggatttctttatacaagatatcgaaatttgggcttttgagtag

SEQ ID NO: 198333 - DNA, 2520 bp, Artificial Sequence
  Description of Artificial Sequence: Synthetic coding sequence
atggactacctgaccaccttcaccgagaagagcggccggctgctgcgggggacggccaatcgcttacttggattcggtggaggtggggaagcccggcaggtgcgctttgaagactacctccgagagcctgcacagggtgatttagggtgcggctccccaccccaccggccacctgcccccagttcgccggaaggtccagataccggccagaagaaaacattggataaaaaagacggacgacgcatgagctttcagaagcccaagggcactatcgagtacaccgtcgagtctagggactcactaaatagcattgcactgaaattcgatacaacacctaatgagcttgtccagctcaacaaactgttttctagggctgtggttacagggcaggtcctctacgtgcccgacccagaatatgtgtcctcggtagaatcttccccctcgctcagcccagtgtcccctctgtctcccaccagcagcgaagccgaatttgacaaaactactaaccccgacgtgcaccccactgaggccaccccctcatccacttttaccgggattcggcctgcccgggtggtatcctctacaagtgaagaggaggaagcatttaccgagaagtttctcaaaatcaattgtaagtacattacgtctggcaagggaacagtgtccggagtcctgttagttactcccaacaatataatgtttgatccccacaagaacgacccattagtacaggagaacggatgtgaagagtatgggatcatgtgtcccatggaagaggtgatgtcagccgctatgtacaaggagattctggatagcaaaatcaaggaatccttaccgatcgatatcgaccagctgagcggaagagacttttgccacagtaaaaagatgacaggctctaacacagaagagatagactcccgcattcgcgacgctgggaacgatagtgcctctaccgcacccaggagtacggaggagtccctgagtgaggatgtgtttacagaatcagaactctctcccatacgcgaagagctggtatccagtgatgagttgaggcaagataaatcttcgggcgctagctcggaatccgtgcaaaccgtcaatcaggccgaagtggagtctttgaccgtgaagtcagaaagcactggcacacctggccacctgcgcagcgatacagagcactccaccaacgaggtcgggacgctgtgccacaagactgatttgaacaacctggaaatggctataaaggaagaccagattgccgataacttccagggcattagtggacctaaggaagacagcactagcattaagggtaatagcgatcaggactccttcctgcacgagaactctctgcatcaggaggaatcccagaaagagaacatgccttgcggcgaaaccgctgaatttaaacagaaacagtctgtgaataaaggaaagcagggaaaagagcagaatcaagactctcagactgaagcagaggagttacggaaactatggaagacacataccatgcagcagacgaaacagcaacgagaaaacattcaacaggtatctcaaaaggaggcgaaacacaaaattacatccgccgacggacatatcgaatcatctgcgcttttgaaagagaaacaacgccatcggctgcataaattcttgtgtctgagggtgggtaaaccgatgcgaaagaccttcgtttcccaggcttccgccacgatgcagcagtacgcacagcgtgacaaaaaacacgaatattggttcgccgttccccaggaacgtaccgaccatctatacgcattttttattcagtggagtcccgagatatatgccgaggatactggggaatacactcgcgagcccggtttcattgtggtcaaaaagattgaagaaagcgagactatagaggactctagcaaccaggcggccgcccgggagtgggaaatcacgactcgcgaagacatcaacagcaagcaagtggccactgttaaggcagatttagaaagtgaatctttccgacctaatttgtccgatccgtccgagctcctgctgcctgaccagattgagaagttaacaaagcatctgcccccacggaccatcggctatccctggacactggtgtacggaaccggaaaacacggcaccagcctcaagactctgtaccgcacaatgacagggcttgataccccagtactcatggtgataaaagactcagatgggcaggtgtttggggctttggcaagcgagccccttaaagtgtctgatggattctatggcaccggggaaacatttgtgtttaccttttgtcccgaatttgaggtattcaagtggactggggataacatgttcttcattaagggcgacatggacagcctggcatttggaggcggcggcggggaatttgccctgtggctggacggggacctgtatcatggcaggtctcatagttgtaagacctttggcaatcggactcttagtaagaaagaagacttctttatccaggatatcgagatatgggcatttgagtag

SEQ ID NO: 198334 - DNA, 2625 bp, Artificial Sequence
  Description of Artificial Sequence: Synthetic coding sequence
atgaccaaggacaagaacagccccggcctgaagaagaagagccagagtgtggatattaatgctccggggttcaatccccttgctggtgctggaaagcagacgcctcaggcctcgaaaccacctgcacctaaaacgcccattatagaggaagaacagaacaacgcagctaatactcagaagcatcccagcagacgttccgaactcaaacggttttataccatagacaccggtcagaaaaagacactggataagaaggacggacgccgtatgagctttcagaagcctaaaggcacaatcgagtacaccgtagagtctcgtgattcgctgaactcaatcgccctgaagtttgacactacccctaatgaactagtgcagttgaataagctattcagccgtgctgtggtgacgggccaggtactttatgtgcctgacccagaatacgtctcctccgtggagagctctccatctctctcacccgtcagtcctttgtcccctactagtagcgaggctgagttcgacaagactaccaatccagacgtccatcctaccgaagcaaccccatcgtccaccttcactggcatccgacccgcaagagtcgtgtcgagtacaagcgaggaggaagaggcattcactgagaaatttctgaagattaactgcaaatacatcacctcaggcaaaggcactgtgagcggggttctgctggttacacccaataacatcatgtttgaccctcacaagaatgaccctctggtccaggaaaacggttgtgaggagtatggcataatgtgcccgatggaggaggtgatgagcgcagcgatgtataaagagatcctggatagtaaaatcaaagaatccctccctatcgatattgaccaactctctggtagggatttttgccactccaagaagatgaccggttcaaataccgaggagatcgacagtagaatcagagacgcaggaaacgacagtgcatcaacagcgccccggagcacagaggaaagcctctctgaggacgtgttcactgaatctgagctgtccccgatcagagaagagctggttagcagtgacgaactacgacaagataagtcatcaggggctagcagcgagtcagtgcaaactgtgaaccaggccgaggtggagagcctcactgtgaagtctgaaagcaccggaacaccagggcatttgagatccgatactgagcatagtaccaacgaggtggggaccctatgccacaagaccgacctgaataacctggagatggcaattaaagaggaccaaattgctgacaacttccagggcattagtggaccaaaggaggacagcacaagcatcaaagggaacagcgatcaggattctttcctacatgagaattccctgcaccaggaagaaagccagaaagaaaacatgccatgcggagagacagctgaattcaagcaaaagcagagtgtgaacaaaggcaaacaagggaaagagcagaatcaagacagtcagaccgaggccgaagagctgcggaagttgtggaaaacacacactatgcagcagaccaaacagcagcgcgagaacatccagcaggtgagccagaaggaagctaagcataagataacgagcgccgacggacacatcgagagctccgctttgttgaaggagaaacagcgacatagattgcataaattcctctgcctcagagttggcaaacctatgaggaaaaccttcgtcagtcaagcttccgcaaccatgcagcaatacgcccagcgagacaaaaagcatgagtattggtttgcagtgcctcaggagcggactgaccacttatacgcatttttcatacagtggagtcctgaaatctatgccgaggacactggagaatacacccgggagccgggatttatcgtggttaaaaagattgaggaaagtgaaactattgaagactctagcaatcaggctgctgccagggagtgggaagtggtatctgtcgcggagtaccatcgccggattgacgccctgaacactgaagagctgcgaactctctgccgacgactccagattaccacacgtgaagatattaattcaaagcaggtggcgaccgtcaaggccgatctcgagtcagaaagtttcaggccaaacctgtctgacccctcagagcttctgctgcccgatcagattgagaaactaacaaagcatctgccccccaggaccataggttacccatggaccttggtctacggtaccgggaagcatggtacctctctcaagactctatacaggacaatgaccgggttagatacccctgtactgatggttattaaagacagcgatgggcaggtattcggcgcactggcttccgagcccctgaaggtgagtgatgggttttatggaactggcgaaacgtttgtgtttaccttctgccccgagttcgaggtgtttaaatggaccggcgacaacatgttttttataaaaggtgatatggactctctcgccttcggaggtggggggggtgagtttgcgctgtggttagacggtgacctgtaccatgggaggagtcactcctgcaaaacattcggtaatagaaccctcagcaagaaggaggatttctttatacaggacatcgaaatctgggcatttgagtag

SEQ ID NO: 198335 - DNA, 2541 bp, Artificial Sequence
  Description of Artificial Sequence: Synthetic coding sequence
atgagcgtgagcaacctgagctggctgaagaagaagagccagagcgttgacattaatgcaccggggttcaaccccctggcgggggctggcaaacagactccccaggcatccaagccccctgctcccaagacgcccatcattgaggaagaacagaacaacgccgccaacacccagaagcaccccagccgccgctcagaactgaagcgcttctacactatcgacaccggccaaaaaaagacgctcgataagaaggatggaaggagaatgagcttccaaaagcccaagggcacaattgagtacacggtggagagtagggacagtctcaacagcatcgcgttgaaattcgatacaacccctaacgaactggttcaactcaataaattattctcacgagctgttgtgaccggccaagtgctgtatgtgcccgatcctgagtacgtttcgtccgtggaaagcagtccgagcctgagtcctgtgagtccccttagtccaacatctagtgaagctgaattcgataagactaccaacccggacgtgcaccctaccgaggccacaccatcttctacctttacaggcatcagaccggccagggtggtgagctctaccagcgaggaggaagaggcgtttaccgagaagtttctgaagatcaactgtaagtatattacttctggcaaagggacagtgtccggagttcttctggtgacacccaataatatcatgttcgaccctcacaagaacgatcccctggtacaggagaacggctgtgaggagtacgggattatgtgtcctatggaggaagttatgagcgctgctatgtacaaggagattctggattccaaaatcaaagaaagtctgcctatcgacatcgatcagttgtctggtcgggacttctgtcacagcaaaaagatgaccggcagtaatactgaggagatcgactccaggattcgcgacgctggtaacgattccgccagcaccgctccacggtcaaccgaggagtccctctctgaggatgtgttcacagaaagtgagctgagccccattcgcgaggagttggtctcaagcgacgagctgcggcaagacaagagctcgggagcaagttcagaaagtgtgcaaaccgtcaatcaggctgaagtggagagcttaacagtaaaaagtgagtcgactggcacccccgggcacctgcgaagcgacaccgagcacagtaccaatgaggtgggcacattgtgccacaagaccgatctgaacaaccttgagatggctattaaagaagatcagattgccgataattttcagggcatctctgggcctaaggaagacagcacatctatcaagggcaactctgaccaggactccttcttgcacgagaactccttgcaccaggaagaaagccagaaggagaatatgccctgcggggagacggcagagtttaagcaaaaacagagcgtcaataagggtaaacaaggcaaggagcagaatcaggacagtcagacagaagcagaagagttgagaaagctgtggaaaactcatacaatgcagcagactaagcagcagcgcgagaacatccagcaggtctcccaaaaagaggccaaacataaaattacgtctgccgacggacatatcgaaagcagcgccctgttgaaagagaagcagcgtcatcggctgcacaagttcttgtgcttgagagtgggtaagcctatgcggaagacttttgtgagccaggcgtcagcaacaatgcagcaatacgcgcagagggataagaagcatgagtactggttcgcagtacctcaggagcggactgaccatctgtatgctttctttattcagtggtctcccgagatttacgctgaggatacaggagaatatactcgcgagcccggatttatcgtggtgaagaagatagaggaatcagaaacaatcgaagattcttcgaatcaggccgcagcccgagaatgggaaatcactactcgggaggatattaactctaaacaagttgccacagtgaaagccgacttagagtccgaaagcttccgccccaacttgtccgacccctcagaactcctgctcccagaccagatcgaaaagttgacaaaacatctgccacctcgcactattggatacccctggacccttgtgtacggcactggcaagcacggcacttctttgaaaactctttatagaaccatgactggcctagatacaccagttctcatggtgattaaagacagcgacggacaggtgtttggggcccttgcctcggagcccttaaaagtcagtgatggtttctacgggactggggaaaccttcgtattcacattctgcccagagtttgaggtgtttaaatggaccggggataatatgttcttcataaagggagacatggactccttggcgtttggaggaggcgggggcgaattcgctctgtggctggatggagacctctatcacggcaggtctcattcctgtaaaacattcggaaatagaaccctttctaaaaaagaggacttcttcatccaggatatagagatctgggcctttgaatag

SEQ ID NO: 198336 - DNA, 651 bp, Artificial Sequence
  Description of Artificial Sequence: Synthetic coding sequence
atgagccggctgtggtacggcaagaagggccggcggcaccagcccattaaccataagtacacactgattaccactagagaggacattaattcaaagcaggtggccaccgtcaaagctgatctggagtcagagagtttccggccaaatctatctgacccttctgagctgctcctgcctgaccaaatagagaaacttaccaaacatctcccccccaggactatcgggtacccttggactctggtttatggcaccggtaaacacggtacgtcgttaaagaccttatatcgcacaatgacgggactggacacccctgttttaatggttatcaaagactccgacggccaagtattcggagccctcgccagtgaacccttgaaggtgagtgacggtttctatggtacaggtgaaacattcgtctttacattttgccccgaattcgaagttttcaaatggacgggagataatatgttcttcattaagggtgacatggattctctggcgttcgggggaggaggaggagagtttgctctatggttggatggagacttgtatcatgggagaagccactcttgtaaaacctttggcaatcgcaccctgtccaagaaagaggatttctttatccaggatatcgaaatatgggcatttgaatag

SEQ ID NO: 198337 - DNA, 885 bp, Artificial Sequence
  Description of Artificial Sequence: Synthetic coding sequence
atgcagcagaccaagcagcagcgggagaacatccagcaggtgagccagaaggaggccaagcacaaaatcaccagtgctgatggccacatcgaaagtagtgccctactgaaggagaagcagcgccacaggctgcataagttcttgtgcttacgagtgggcaagccaatgagaaagaccttcgtttctcaagcttcagccactatgcagcaatacgcccagcgtgacaagaagcacgaatactggttcgccgtgccgcaagaaaggacagaccacctgtatgccttctttatccagtggtcaccggagatttacgctgaagataccggcgagtacacacgggaaccgggcttcatagtcgtgaaaaagattgaggaaagcgagactattgaagactcaagtaaccaggctgctgctcgggaatgggagctgacaaaacatctcccacctcggactatcggctatccttggactctggtctacggcaccgggaagcacggaaccagccttaagacactttatcgtacgatgaccggactggacacccctgtactgatggtgattaaggattctgatggacaagtctttggcgccctcgcaagcgaaccactgaaagtctccgacgggttctatgggacgggcgaaactttcgtgttcacattttgccctgaatttgaggtctttaagtggactggggacaacatgttttttataaaaggtgatatggactcgttggcctttggtggcggtggaggtgaatttgctctttggctggacggagatctttaccacgggagaagtcacagttgcaagacctttggcaaccggactctatccaagaaggaggatttcttcatacaggatattgaaatttgggcgtttgaatag

SEQ ID NO: 198338 - DNA, 1512 bp, Artificial Sequence
  Description of Artificial Sequence: Synthetic coding sequence
atgttctgccagcggaaggacaccggccagaagaagaccctggacaaaaaagacggcagaaggatgtcctttcaaaagccaaaaggaacaatagaatataccgttgaatcccgcgattctctaaatagcatagctctgaaattcgacaccacacctaacgagctggtccagctgaacaagctttttagccgcgccgttgtgacaggtcaagttctttacgtacccgaccctgagtatgtctcaagtgtagagtcaagtccatcactcagccctgtttctcctttgtctccaaccagttctgaggccgaattcgacaaaacaaccaacccagatgtgcacccaaccgaagcaacgcccagctccacctttactggaattagacccgcccgcgtcgtctcgtcaaccagtgaggaagaggaagcattcactgaaaagtttctgaaaattaattgcaagtatataacaagcggcaaaggcactgttagcggtgtgctgctggttacacccaacaacatcatgtttgatcctcacaaaaacgaccccttggtgcaggaaaatggatgtgaagagtacggtatcatgtgtcccatggaagaggtaatgagcgcagccatgtataaggagattctagattctaaaattaaggagagcctccccatcgacattgaccagttgtcagggcgagatttttgtcatagcaagaagatgactggcagcaacacagaggagatcgacagtaggatccgtgacgcgggcaacgactctgccagcacagctccaaggtccacggaggaaagcttatcagaagacgtctttactgagtcggagctaagccccatccgggaggagctcgtatccagcgacgagttgcgccaggacaaatcttcgggcgcatcctcggagtccgtgcagactgtcaaccaggctgaagtggaatccctgacggttaaatctgagagtacgggcactcctggccatctccggtctgatacggagcacagcaccaacgaagtcggcacactctgccacaagaccgacctgaataatctagagatggcaatcaaagaggatcagatagcagataatttccaaggaatctccgggcccaaagaggacagcacctctatcaaggggaactccgaccaggattctttcctacacgaaaactctctgcaccaagaagagtcacagaaggaaaacatgccttgcggcgagactgccgaatttaaacagaaacagagtgtgaataaaggcaagcagggcaaggaacagaatcaggactcacagaccgaagccgaggagttgaggaagctgtggaaaacacatacaatgcagcagaccaaacagcagcgagagaacatccaacaggtgtcccaaaaggaggcaaaacataagatcaccagcgctgacggccacatagagtccaaatgctaccgtgtcaatgaggtgagctcatccaattgcatggtatccccatcatttctcacagacagcaaggcagccgtcccgtag

SEQ ID NO: 198339 - DNA, 2622 bp, Artificial Sequence
  Description of Artificial Sequence: Synthetic coding sequence
atgagcgtgagcaacctgagctggctgaagaagaagagccagagcgtggatatcaacgcgccaggctttaaccctttagcgggagcggggaaacagacaccgcaggcgagtaagcctcctgcgcctaaaactcccataattgaagaagaacaaaataacgccgctaacacacagaaacacccatcacggaggagtgagcttaaaagattttacaccattgataccggccagaagaagacgttggacaaaaaggatggacgtcggatgagttttcagaagcccaaaggcaccatcgaatacactgttgaatcacgcgattcattgaactcgatcgccctcaaatttgatacaacgccaaatgagctggtgcaactgaacaaactcttcagccgcgctgtggtgaccggtcaggtgttatacgtgcccgatcctgagtacgtgtcatcagtggagagcagcccttcactgtcacctgtgtctccgcttagcccgacctccagcgaagccgagttcgacaagaccaccaaccccgacgttcatcctacagaagccactccctccagcacattcaccggcattcgcccagccagagtggtctccagtacctctgaggaagaagaagctttcacagaaaaattcctgaagatcaactgtaagtatataacgtctggaaaagggacggtgtcaggggtcctcctcgtgacccccaacaacattatgttcgacccccacaaaaacgatccactggttcaagagaacggatgtgaagagtatggaatcatgtgtcccatggaggaggtcatgtccgccgccatgtataaggaaatcttggactccaagattaaagaatcccttccaattgacatcgatcagttgtccgggcgggacttctgtcactcaaagaaaatgactgggagcaatacggaagagatcgatagtaggatccgggatgctggcaacgatagtgccagcacagctccgcgcagtactgaagaaagcctgtctgaagacgttttcaccgagagtgagctgtcccctattagagaggaattggtctcttcagacgagcttcggcaagacaagagcagcggcgcctcaagtgaatccgtccagacagtaaatcaggccgaggtggaatctttaacagtgaaatcggaaagcaccggtacaccaggccatctgagaagcgatactgaacactcaacaaatgaagttggcacactgtgccacaaaacagatctgaacaaccttgaaatggcaattaaggaagatcagatcgccgacaatttccagggcatcagcggccctaaagaggactctactagtattaaaggaaatagcgatcaggattcgttcttgcacgaaaacagtctccatcaggaagaaagccagaaggaaaacatgccatgcggagaaactgcagagtttaagcagaagcagtccgttaacaagggcaaacagggcaaagaacagaaccaagactctcaaaccgaagctgaagagctgagaaagctgtggaaaacgcacactatgcagcaaacaaaacagcaaagggagaacatccagcaggtcagtcagaaagaggctaagcacaagattactagcgccgatggacacatcgagtcctctgccttgctgaaagaaaaacagagacacaggctgcacaagttcctatgccttagagtgggcaaacctatgaggaaaacgttcgtctcgcaggcatcagccaccatgcagcagtacgcacagcgggacaagaaacacgaatattggtttgccgtgccgcaggaaaggacggatcacctgtatgccttctttatacagtggtcaccggaaatttacgctgaagatacgggtgaatatacacgtgagccagggtttattgttgtcaaaaaaatcgaagagagcgaaaccatagaggactcatccaatcaggccgcagctagggaatgggaagtcgtgtctgtggccgagtaccaccggaggattgacgccctgaatacggaagagttgcgcactctttgccgccggctgcagattactactagagaggacatcaattccaaacaggttgccaccgtgaaagctgatttggaatccgagagttttcgccctaacctgtccgatcctagcgagttgctgctacccgaccaaattgagaaactgaccaaacacctgcctccacgtactattggttatccctggaccctggtgtatggcacaggtaaacatgggacaagtttgaaaacactctaccgcaccatgacaggattggacacacccgtcttgatggtgattaaagattctgacggccaggtctttggtgcgcttgcatcagagccactaaaggtgagtgacggcttctacgggaccggggaaacatttgtcttcacgttctgccctgagttcgaagtctttaaatggactggcgacaatatgtttttcatcaaaggggatatggacagtttagctttcggcggtggcgggggagagtttgcactgtggctagacggtgacctgtaccacggcagatcccattcatgtaagacctttggcaatcgcacactgagtaagaaggaagatttttttatccaggacatcgaaatatgggccttcgaatag

SEQ ID NO: 198340 - DNA, 2541 bp, Artificial Sequence
  Description of Artificial Sequence: Synthetic coding sequence
atgagcgtgagcaacctgagctggctgaagaagaagagccagagcgtcgatataaacgcccctggattcaatcctctggctggcgccggcaagcagacaccgcaggccagtaaacctccagctccaaaaactccaataattgaagaagagcaaaacaacgcagcaaacacacaaaagcatccctccaggcggagtgagctgaagagattttacacaatagataccggccagaagaaaacattagacaaaaaagacggtaggcgtatgagtttccagaaacctaaaggaaccattgagtataccgtcgagtccagagacagcctcaatagtatagctttgaaattcgataccacacctaacgaactggttcaactgaacaagctctttagtagggctgtggtaactggtcaggttctttatgtccccgatcccgaatatgtaagctcagtcgaaagttccccttcgctctcaccggtctcacccctgagccctacaagcagcgaggctgaattcgacaaaactacaaatcctgatgtccaccccacagaagcgaccccgtcctccacttttactggaatcagacccgcgcgcgtcgtcagctcgacgagcgaggaagaggaggccttcaccgaaaaatttctgaaaataaactgtaagtatattacatcgggcaagggcaccgtgagcggagtgctgttggttacaccaaacaatataatgtttgatcctcataaaaacgatcccttagttcaggaaaacgggtgtgaggagtacgggataatgtgcccaatggaggaagttatgtccgcggcaatgtacaaggagattctggatagtaagatcaaggagtctctcccgatcgatatagatcaactgagtgggcgcgacttttgccatagtaagaagatgacgggttctaacacagaggagatcgacagccgtattcgcgacgcggggaacgattccgcgagcacagctcctcggagcacggaggaatctctcagcgaagatgtgttcacagaatcagagttatccccaattagagaggaactcgtatcctctgacgagcttagacaagataagtcatcaggcgcttctagtgagtctgtccagaccgtcaatcaggctgaggtggagtccctgacggtgaaatctgaaagcaccggcacacccgggcaccttaggtcagatactgagcacagcactaacgaggtaggcaccttgtgccacaaaaccgatctcaataacctggagatggcaataaaagaagatcagattgctgacaactttcagggtataagcggacccaaggaggacagtacctctatcaagggaaattccgatcaggactcgttcctgcacgaaaattctcttcatcaggaggaatcccagaaggaaaatatgccatgtggggaaaccgcagaattcaaacagaaacagtctgtcaacaagggtaaacagggaaaagagcagaatcaggactcacaaaccgaggctgaagagttgaggaagctgtggaagacacacacaatgcagcaaaccaagcaacagagagaaaatattcagcaggtgagtcagaaagaggccaagcacaagattactagcgctgacggtcacatcgagtccagtgcacttctaaaggaaaagcagcggcaccgattgcacaaatttctatgtctacgagtgggaaagcctatgaggaaaacattcgtgtctcaggccagtgcaaccatgcagcagtatgcccagcgggacaagaaacacgaatactggtttgctgttcctcaagaaagaactgatcatttatatgcgttcttcattcagtggagtccagagatctatgctgaagataccggggaatatactcgcgaaccaggcttcattgtcgtgaaaaaaattgaggaatccgagaccattgaagatagttcgaaccaggctgctgcccgcgagtgggagatcaccactagagaggatatcaattccaagcaggtggcgacagtgaaggctgaccttgagtccgagtccttcagacctaatttgtcagatccttctgagctgctgcttcccgatcaaattgagaagttgacaaagcacctccctccccgtaccatcggctacccctggacgttggtctatgggactggaaagcatggcaccagtttgaaaactctgtataggacgatgaccggactcgacaccccagtcctaatggtgattaaagactcggacgggcaggtcttcggtgccctcgcctcagagcccctcaaagtgtcagacggattctacgggaccggcgagactttcgtgtttacattttgtccagaattcgaagtattcaaatggaccggcgacaatatgtttttcatcaaaggcgacatggattccttggcttttggtggcggaggcggcgaatttgccctgtggctcgatggggatctgtatcacggtcggtctcattcatgcaagactttcgggaaccgaactctgtccaaaaaggaggatttttttatccaggacatcgagatctgggccttcgaatag

SEQ ID NO: 198341 - DNA, 822 bp, Artificial Sequence
  Description of Artificial Sequence: Synthetic coding sequence
atgaccttcgacgacctgaagatccagaccgtgaaggaccagcccgacgagaagtccaacgggaaaaaagctaagggcttacaattcctgtacagcccctggtggtgcctggccgccgccacactgggagtgctttgccttggcctggtggtgactattatggtcctcggaatgcaattgtcccaggttagtgacctactgacccaggaacaggccaacctgacacaccagaagaagaagttggagggtcagataagtgccaggcaacaggcggaagaagcctcccaggagagcgagaacgagctgaaggaaatgattgagactttggcacggaagctcaatgagaaaagcaaagagcagatggagttacatcatcaaaacttgaatctgcaagaaactctaaaacgagtggccaattgcagcgcgccgtgtccccaggattggatctggcacggagaaaattgctaccttttctctagcggttcattcaattgggaaaagtctcaggagaaatgcctgagtcttgacgccaagctactgaaaatcaacagtacggccgatctggattttattcagcaagctatttcttacagctcctttccattttggatggggctttcacgtcgaaaccccagctacccgtggttgtgggaggacggcagcccgctcatgccccatctctttagagtgcgtggagccgtttctcagacctatccttctggaacttgcgcatacatccaaaggggggcagtctatgctgagaattgcatcctggcagctttctcaatctgtcagaaaaaagccaacctgagggcccagtag

SEQ ID NO: 198342 - DNA, 546 bp, Artificial Sequence
  Description of Artificial Sequence: Synthetic coding sequence
atgaccttcgacgacctgaagatccagaccgtgaaggaccagcccgatgagaaatccaacgggaaaaaagccaaggggctccagtttctatactcgccctggtggtgcctggccgctgctaccctgggggtcctgtgcctcggattggtggttacaatcatggtccttggcatgcagcttagccaagtgtctgacctcttgacgcaggagcaggccaacttaacacaccaaaaaaaaaaactggaaggccaaattagcgccagacagcaggccgaagaggcctctcaggagtctgaaaatgagctgaaggagatgatcgagactctggcacgaaagctaaacgaaaagtccaaggagcaaatggaactgcatcaccagaacctgaatcttcaggagacacttaaaagggtggcgaactgcagtggacttcatcccgcctccaacttcctgtttcagttcagcattcttgacggcgcggtaagcgaagagccccaactcccgatggcacttggaggccgcttctcatttgatgcacctctgatctag

SEQ ID NO: 198343 - DNA, 570 bp, Artificial Sequence
  Description of Artificial Sequence: Synthetic coding sequence
atgaccttcgacgacctgaagatccagaccgtgaaggaccagcccgacgaaaaatccaacggtaagaaggctaaggggctgcagtttctgtactccccatggtggtgtctggcagccgctaccctaggagttctgtgtcttggactggtagtaacgattatggttctgggcatgcagcttagtcaggtgtctgatctactgacccaggagcaggcgaatctgacccaccaaaaaaagaaattggaggggcagatctctgcccggcagcaggccgaggaagcatcacaggagtctgagaacgagctgaaggaaatgatcgagactctggctcggaagctcaatgagaagagcaaggagcagatggagctgcatcaccaaaatcttaacctgcaagaaactctcaagcgggtcgccaactgttctgcaccatgcccacaggactggatttggcatggggaaaattgctacttattttcatcaggctcatttaattgggaaaaatcacaggagaaatgtctcagtctcgatgcaaagctgttaaaaattaacagcacagccgacctgatctag

SEQ ID NO: 198344 - DNA, 1623 bp, Artificial Sequence
  Description of Artificial Sequence: Synthetic coding sequence
atgcagcaggtgctggagaacctgaccgagctgcccagcagcaccggcgccgaagagatcgatctgattttccttaagggaattatggaaaatcccatcgtcaaatctttagcaaaggcacatgagagattggaagactctaagctggaagcagtcagcgacaacaatttagaactagtcaacgaaatccttgaggacattaccccacttatcaacgtggacgaaaatgtcgccgaacttgtcggcattctaaaggaaccccatttccagtcattgctggaagcacacgacatcgtagccagtaagtgctacgattcaccaccctcctcaccagagatgaataactcctcaatcaataaccagctgctaccagtcgacgctatcaggatcctgggaattcataagagggcaggcgaaccattaggagttacctttcgggtagaaaacaacgacttggtcattgctcggatcctgcacggcggtatgattgacaggcagggactcctacatgtgggagacatcataaaagaggttaacggacacgaagttggcaacaaccccaaggagctccaggagctgttgaaaaacatttccggttcagtaaccctaaaaatcctccctagttaccgagacacgatcaccccccagcaagtgtttgtgaaatgccacttcgattataatccatataacgataatctcatcccttgtaaggaggcaggtttgaagttttcgaagggggaaattctccagatcgttaatagggaggatccaaactggtggcaggccagtcacgtgaaagagggtggcagcgctggtctgatcccctctcagttcctcgaagagaagcgaaaagcttttgttagacgtgattgggataactctggaccgttttgcgggactatctcctcaaaaaagaagaaaaagatgatgtatttgaccacccgcaatgcagaattcgatcggcacgaaatacagatatatgaggaggtcgccaaaatgcctccttttcagagaaaaaccctcgtcctgataggggcccaaggcgtggggcgaagaagccttaaaaaccgctttatcgtccttaatcctacaaggtttggcacgacagtgccctttacatctagaaaacccagagaagatgaaaaagatgggcaggcctacaagtttgtgtctcgctctgaaatggaagccgacattaaggcaggcaagtaccttgagcatggggagtatgaaggaaatctgtacgggacaaagattgactccatacttgaggtggtacaaacaggccgcacctgtatactggacgtcaatcctcaagccctaaaagtcctgcgcacttccgagtttatgccctacgtcgtatttatagccgctcccgagttggagaccctccgggcgatgcacaaggcagtcgtggatgccggcatcaccacgaaactgctcacagactcagacctgaagaagactgtggatgagtcagcacggattcaaagagcctataaccattactttgatctgataatcatcaatgataatctggacaaggcatttgagaagctgcagaccgctattgaaaaactgagaatggaaccccagtgggtgcccatcagctgggtctactag

SEQ ID NO: 198345 - DNA, 636 bp, Artificial Sequence
  Description of Artificial Sequence: Synthetic coding sequence
atgttccacctgcggacctgcgccgccaagctgcggcccctgaccgccagccagactgtgaaaacattttcgcagaaccgccccgccgcggcgaggacattccagcaaattcgttgctacagtgctcctgtggcagccgaaccattcctgagtggaacctctagcaattatgtcgaagagatgtactgtgcttggctcgaaaatcctaagtccgtccataagagttgggacatcttctttcgcaatacaaatgccggagctcccccaggaaccgcttaccagtctccattacccctctctcgaggaagcctggcagcagtagctcacgcacaatctctggtagaagcacaaccaaacgtcgataagctggtggaggatcacttagccgtacagtctctgatcagagcttaccagattagaggtcaccatgtagcccaactcgatccactgggcatactcgacgccgatttggacagcagtgtgccggccgacataatctcatcaacggacaaactgggcttctatggactcgacgagtccgatcttgataaagtctttcacctgccgaccacgaccttcattgggggacaagaaagtgccctaccccttcgggagattattcgccgtctggaatag

SEQ ID NO: 198346 - DNA, 1284 bp, Artificial Sequence
  Description of Artificial Sequence: Synthetic coding sequence
atgttccacctgcggacctgcgccgccaagctgcggcccctgaccgccagccagacagtgaaaacattctcccaaaaccgacccgcagcagctcgcacatttcaacagataagatgttatagtgctcccgtggccgcggaacccttcctcagtgggacttccagtaactatgtcgaggagatgtattgcgcctggctagagaaccccaagtcagtgcacaagagttgggatatcttttttcggaacaccaacgcgggggctccacccggtactgcgtaccagagccctcttcccctgtcccggggtagccttgctgcagttgcccacgcacagagccttgtagaagcacagcctaatgttgataagctggtcgaagaccacctggcagtgcaatctctaattagggcttatcaaatcaggggccaccatgtagcccagctagatccactgggaattttggacgctgaccttgacagttcagttcctgcagatattatttcctctaccgacaagctgggattctatggactggatgagtccgatctagacaaggtcttccacttacctacaacgacattcataggtggacaggagtccgctctcccactccgcgaaatcattcgaaggttggagatggcttactgtcaacacatcggagttgaatttatgttcattaatgacctggaacaatgccagtggattagacagaaattcgagacccctggtatcatgcagttcacaaacgaagagaagaggactctgctggccaggctcgtcaggagcacccggttcgaggaattcctacagaggaaatggtcatccgaaaagagatttgggctggaaggatgcgaggtcttgattccggcactgaagaccattattgataaaagttcagagaacggggtggactatgtgatcatggggatgcctcacagggggaggctcaacgtgctagctaatgtgatcaggaaggagctggaacagattttctgccagtttgatagcaaactggaggccgccgacgaagggtccggggatgttaagtaccatttggggatgtatcatcgaaggattaacagggtaactgatcgaaatattactctatcactggtggccaatccatcccacctcgaagccgccgaccccgtggtcatgggaaaaacgaaggccgaacaattttactgtggggacactgaaggaaagaaagtccgtccccgcgagcgtagggccagacagattgtcaaggccccctgctccagcatggaatttcgctcccccacctag

SEQ ID NO: 198347 - DNA, 2925 bp, Artificial Sequence
  Description of Artificial Sequence: Synthetic coding sequence
atgtactgcgcctggctggagaaccccaagagcgtgcacaagagctgggacatcttctttagaaacacaaatgcgggggccccacctggcaccgcctaccaatctccactgcctctgtctcgcggttcgctcgcagcagtagcccacgcccagagtctagtggaggcacagcctaatgtggacaagcttgtcgaggatcaccttgcggtgcagagtcttattcgggcctaccaagtcagaggacaccatatagcaaaattggatcctctcggaataagctgcgtgaatttcgatgacgctcccgtgacggttagcagtaacgtagatttggccgtatttaaggagaggcttcgtatgctcaccgtaggaggattctatggcctggacgagtcagatctcgacaaggtgttccaccttcctacgacaacttttataggagggcaggagtctgctctgcctctacgagaaatcatccggcgcttggagatggcctactgtcagcacatcggggtcgagttcatgttcatcaatgacctggagcagtgtcagtggataaggcaaaaattcgagacaccaggtattatgcaattcacaaacgaagaaaagcgaaccctcttggccaggctggtgcgctctacacgttttgaagagtttttgcagcgaaagtggtcttccgaaaaacgatttgggctggagggttgcgaagtgcttatccccgctctcaagaccattattgacaaatcctccgagaatggcgtggactatgttattatggggatgcctcacaggggaaggttgaatgtgctagccaatgtgatcagaaaggagctcgagcagatattctgccagttcgactccaagcttgaggccgcagatgaggggtccggggatgtcaagtatcacctgggcatgtaccaccgccgcataaacagggtgacagacaggaatattaccctctctctggtcgccaacccatcacatttggaggctgcagatcccgtcgtgatgggtaagacaaaggccgaacagttttattgcggcgataccgaaggcaaaaaagtgatgagcatcctcctgcacggggatgccgcgttcgctggtcaaggaatagtttacgaaacattccatctgtcagatctgccatcttacacaactcatggcacggtgcacgtggtggtgaataaccaaatcggcttcacgactgatccaaggatggctcgctccagtccctatccaactgacgtcgcacgggtcgtgaacgcaccaatcttccatgtgaattcagacgaccccgaggccgtgatgtacgtctgcaaggtggcagctgaatggcgttcaaccttccacaaggacgttgtggtcgacttagtgtgctacaggaggaacggacataacgagatggacgaacccatgttcacacagcctctgatgtataagcagatacgaaaacagaaacccgtgttgcagaaatacgcggaactactggtgtcacaaggtgtggtcaaccagcctgaatatgaagaagagatcagcaagtacgacaagatctgtgaggaggcatttgcccgctctaaggacgaaaagatactgcatatcaaacactggctcgattccccgtggccggggttttttacacttgacggacagcccagatctatgtcctgcccctcaaccggacttacagaggacatcctaacccacatcggtaacgtagcttcttcagtgcccgtcgagaactttaccatccacggaggcctgagccgcatcctcaagacccgcggcgagatggtcaagaaccgtaccgtcgactgggcactggcagagtatatggcattcggctcactgctgaaggagggtatacacattcgcctgagcggccaggatgtggaaaggggtactttcagccacaggcatcacgtgctccacgaccaaaatgtagacaaacgaacttgtataccaatgaaccacctctggccgaatcaggccccttatacggtctgtaatagtagtctgtccgaatacggagtgcttggctttgagctgggattcgcaatggcgtctccgaacgctctcgtgctttgggaggctcagtttggagactttcacaacaccgcacagtgcataatcgaccagttcatttgccccggccaggccaagtgggtgaggcagaacggaattgtactgctccttccccatggaatggagggcatgggcccggaacattcctctgcccgacctgagagatttctgcagatgtgcaacgacgaccctgacgtgctgccagatctgaaggaggcgaacttcgacatcaaccagttgtatgactgcaattgggttgtggtaaactgctccactccaggaaacttctttcatgtcctgagacgccagatccttttgccctttcgcaaaccccttataatcttcacacctaagagtcttctgagacaccccgaggcacggagttcattcgatgagatgctacctggaacacacttccagagagtaatacctgaagacggccctgcggcccagaatcctgagaacgttaaacggcttctattctgtactggaaaagtgtattatgacctcactcgagaacggaaggctcgcgacatggtggggcaggtcgcaattacaagaatagagcaacttagcccttttccctttgacttgcttcttaaggaagtgcagaagtaccctaacgccgagctagcttggtgccaggaagagcacaagaaccagggttattatgattacgtcaaacctcgactaagaacgaccatcagcagggccaaaccggtttggtatgcaggtagggatcccgctgcagctccggccaccggaaataagaaaactcatctgacggaactgcagaggttactagacactgcgtttgacctcgacgtatttaagaactttagctag

SEQ ID NO: 198348 - DNA, 3060 bp, Artificial Sequence
  Description of Artificial Sequence: Synthetic coding sequence
atgttccacctgcggacctgcgccgccaagctgcggcccctgaccgcctcccagacagtcaaaacgttttcccaaaatagacctgctgcagccaggacattccagcaaatccgttgttactccgctccagtggcagcagagccctttttgtccggtacttccagcaactatgtcgaagaaatgtactgcgcctggctcgaaaaccctaaatcagtgcacaagagctgggacatctttttcaggaacacgaacgccggggccccccccggaacagcataccagtcccccctgcctctgagcagagggtccctggccgcagttgcccatgcccagtctttggtggaggcacagcccaatgtggataagctcgttgaggaccacctagcagtgcagtcacttattagagcttatcaggtgaggggccaccacatcgctaagctagaccctctgggtattagctgcgtgaacttcgacgacgcccccgtgaccgtgtctagtaacgtgggattttacggattggatgaatctgacctcgataaagtgtttcatctgcccacgaccactttcatcggggggcaggagagtgccctcccactgcgggagataataaggcgactcgaaatggcttactgtcaacacattggagtggaattcatgtttataaacgatttagagcagtgtcaatggatacgccaaaagttcgaaacccccggaattatgcaatttacaaatgaagagaaaaggaccctgctagcccggctggtcagaagtacacgattcgaggagttcctgcagcggaagtggtcatctgaaaaaaggttcgggttggagggttgcgaagtgctcatccccgcactaaagactatcatcgacaaatccagtgagaatggtgtagattatgtgattatgggaatgccacacagagggaggttaaatgttctggccaatgtgatccgcaaagagttggaacaaatcttttgtcagttcgattcaaaactggaggccgcagatgaaggctccggtgatgttaaatatcaccttgggatgtatcacagaaggataaatcgggttaccgacaggaacattacgctctccctcgtcgcgaaccctagccatctcgaggccgctgatccagtggtcatgggaaagacgaaggcagagcagttctactgcggggatactgaaggtaagaaagtgatgtccatcctgctgcatggggacgcagcctttgccggacaggggatcgtgtacgaaacatttcatttgtctgacctccctagttatacgacccacggcactgtccacgtcgtcgtgaacaaccagatagggttcactaccgacccgagaatggccagatcttccccgtatcctacggacgtcgcccgcgtggtcaatgcacctatctttcacgtcaattccgatgatcccgaggctgtgatgtacgtttgcaaagtggctgcagaatggcgatccacttttcataaagacgtcgtggttgatttagtgtgttacagacgcaatggacacaacgagatggacgaacccatgtttacacagccactgatgtacaaacaaataagaaagcagaaacctgtgcttcagaaatacgccgagctgttggtgtctcaaggtgtcgtaaatcagccagagtacgaggaggagatctctaagtacgacaaaatttgcgaggaagcttttgcaagatctaaggatgaaaagatcctgcatatcaaacactggttggactccccgtggcctgggttcttcaccctggatggccagccccgatctatgtcctgcccatcaacggggttgacagaagatatcctgacgcacattgggaatgttgcgtctagcgtgcccgtggagaattttacaatacacggcggtctgagccgcattttgaagactaggggtgagatggtaaagaataggactgtggattgggctttggccgagtacatggcctttggctcgctcctcaaggaggggatacatattcgcctttccggccaagatgttgagagaggtactttttcccacagacatcatgtactgcatgaccagaatgtggacaaaaggacatgtatcccgatgaaccatttgtggcccaaccaagccccctacaccgtatgtaactcttcactgtccgaatacggtgtgctgggattcgaactcgggttcgcgatggcgtcaccgaatgctctcgttctgtgggaagctcagtttggtgatttccacaacaccgcgcagtgcatcattgaccagttcatttgccctggtcaggctaaatgggtacggcagaatggtatagtgctgctcctcccacatggaatggagggcatgggccccgagcactctagtgcccgcccagaaagattcttacagatgtgcaatgacgaccccgatgtgctaccagacctgaaagaggcgaactttgacatcaatcagctgtacgattgtaattgggtagtggtcaactgctcaactccggggaatttcttccacgtcctgcgacgccagattctgctgcctttccgtaagccactcatcatcttcaccccaaagtctttacttcgccacccagaagccaggtcttctttcgacgagatgctcccaggaacgcatttccaacgcgtaatccctgaggacggccctgcagcccagaaccccgagaatgtgaaacggctgctcttctgcaccgggaaagtgtactatgacctgaccagggagaggaaggcgcgagacatggtcggacaggtcgcgattaccaggatcgagcagctctcaccttttcccttcgacctgctgctcaaggaggttcagaagtacccgaacgccgaattggcctggtgtcaagaggaacacaagaaccagggctattatgactatgtcaaacccaggctcagaactacaatctcccgtgctaagcctgtgtggtacgcaggccgcgacccggctgccgctcccgctactggaaacaagaaaactcacctaactgaattacagagactcctggatacagcgtttgatttggacgtgtttaagaacttctcttag

SEQ ID NO: 198349 - DNA, 2424 bp, Artificial Sequence
  Description of Artificial Sequence: Synthetic coding sequence
atggccgccaccgagctgcggggcgtggtgggccccggccccgccgctatcgcagctctgggaggtgggggggccgggccacctgtcgtaggaggcgggggtggtagaggcgacgccggcccaggtagtggtgcagcctcaggaacggtggtggcagccgccgctggagggcccggacccggggccggcggagtggccgcagccggaccggctccggctcccccaacgggcggttctgggggctccggtgccggaggatcagggtccgcccgcgagggatggttattcaagtggacgaactacattaaaggatatcagcggagatggtttgtgctgtctaatggcctgctgagctactacaggtcaaaagctgagatgcgacatacctgtaggggaaccatcaacctggctactgccaatattacagtcgaggactcctgtaattttattataagcaacggtggggcccagacttaccatttgaaggctagctctgaggtcgaacggcaacgctgggtgacagcactggaacttgcgaaggctaaagcggtaaaaatgctagccgaatctgatgagagtggggacgaagagtccgtgtctcagactgataagaccgagctacagaataccctgagaactctgagttcaaaggttgaggacctgtccacatgtaacgacttgattgcaaaacacgggacggcgctccagcgctccctcagcgagctcgaaagtctcaaactccctgctgaatctaatgagaagatcaagcaggtaaatgaacgagccaccctcttccgcattaccagcaatgccatgataaacgcatgccgggatttcttgatgttggctcaaacccactccaagaagtggcagaagagcctgcagtacgagcgcgaccagcgaatacggttagaagaaacactggaacagctcgccaagcagcacaatcatctggaaagggcattcagaggggccaccgtccttcctgcaaacaccccggggaacgtaggatccggtaaagaccagtgttgtagtggcaaaggagatatgagcgacgaagacgatgaaaatgagttcttcgacgcacccgagattattacaatgccagagaacttgggccacaagcgaacaggatctaatatcagcggcgcctcctctgacatttccctagatgagcagtacaaacaccagttggaggaaaccaagaaagagaaacgcaccaggattccctacaagccgaactactccctaaacctgtggtcaatcatgaagaactgcattggaaaggagttgagtaagatacccatgcctgttaattttaacgaacctctaagtatgctgcagcgcctcacggaagaccttgaataccatgagctcctggaccgggcagccaaatgcgaaaattctcttgaacagctgtgctacgtggcagccttcaccgtgtcttcctactctaccactgtttttagaacttcaaagccgttcaaccccttgttgggcgagaccttcgagctcgaccgactggaagagaatgggtatcgatctctgtgcgaacaggtgagccatcaccccccggctgctgctcatcacgcagaatcaaagaacggctggacgctgcgtcaagaaatcaagatcacgagcaaatttaggggaaaatacctatccattatgcctctgggcaccattcattgtatatttcatgcaacggggcaccattacacatggaaaaaggttacaaccaccgtacataatatcatagtcgggaaactttggattgaccagagcggcgaaattgacatcgttaatcacaagactggcgacaagtgcaatctgaaatttgtaccttacagttatttcagccgcgacgtggctcgaaaagtaacaggggaagtgaccgatccttctggaaaggtgcactttgcgctcttggggacgtgggatgaaaagatggagtgtttcaaagtgcagccagtgataggggagaacgggggcgatgcaagacaaagaggccacgaggccgaggaatctcgggtcatgctatggaagaggaatccccttccaaagaatgctgagaatatgtattacttctcggaactggccctgaccttgaacgcctgggagtccggtacagcccctacggacagtcgacttagacctgatcagcgcttgatggagaatggtcgttgggatgaggcaaacgcagaaaagcagaggttggaagagaaacagagactaagtaggaaaaagagggaggccgaggccatgaaggcaactgaggacggcaccccctatgacccctacaaagccttatggttcgaaagaaaaaaggatcctgttactaaagaactgacacacatctatagaggcgaatattgggagtgtaaggagaaacaagactggtcctcatgcccagatatattctag

SEQ ID NO: 198350 - DNA, 1224 bp, Artificial Sequence
  Description of Artificial Sequence: Synthetic coding sequence
atggccgccaccgagctgcggggcgtggtgggccccggccccgccgctatcgctgccctaggcggtgggggagccggaccgccggtggtcggtggcggcggcggccgaggagacgcaggccctggtagcggcgctgccctgcagcgcctgaccgaggatctagaatatcatgagctgcttgatcgagccgctaaatgcgagaattccctcgagcagctctgttacgttgctgcctttaccgtgagcagctattcgaccacagttttccgcacctcaaaacccttcaacccactattgggtgaaacttttgagctggatcgactggaggaaaatggctatcggagcctgtgcgagcaggtaagccatcacccaccagccgcggctcaccatgccgagagcaaaaacggttggacgttacgacaggagattaaaattacgtctaagttccggggaaagtatctttcgatcatgcccctgggcacaatacactgcattttccacgctacaggtcatcattatacgtggaagaaggttacgactacagttcacaatattatcgtgggaaagctgtggatagaccagagtggagagatcgacatagtcaaccataagaccggtgacaagtgtaacttgaaatttgttccatactcttacttttccagggatgtagcgagaaaggtgactggcgaggtcaccgatccaagtggaaaagtgcactttgctttactggggacgtgggacgaaaagatggagtgctttaaggtgcagccggtgattggtgaaaatggcggcgacgcacgacagagggggcatgaggccgaagagtcacgggtcatgctatggaaacggaatcccctgccaaaaaatgccgaaaacatgtactatttttcggagctcgcactgaccctgaacgcgtgggagtcaggcaccgcccctacagattccaggctgaggccagatcaacggctgatggaaaacggtcgctgggacgaggccaacgctgaaaagcaaaggctcgaagagaagcaacgcctgagtcgaaaaaagcgcgaggccgaagcaatgaaggcaacagaagatgggactccgtacgatccgtacaaggccctgtggttcgagcggaagaaggatccagtgacaaaggagctgacgcatatttaccgaggagaatactgggaatgcaaggagaaacaggactggtcttcttgtcctgatattttctag

SEQ ID NO: 198351 - DNA, 2751 bp, Artificial Sequence
  Description of Artificial Sequence: Synthetic coding sequence
atgggcaaggccgccgcccccagccggggcggcggctgcggcggccgtagccgtggactaagttctctcttcacggtcgtcccatgtctctcctgtcacacagccgcgcctggtatgtcggcctctacgagcgggtccgggcccgagccaaaaccacagccgcagcccgtaccagagcctgagcgcggcccgctgtccgaacaggtatcagaggcagttagtgaagcagttcctcggtccgaaccagtcagcgaaactacatctgaacctgagcccggagctgggcagccaagtgagctgctgcagggctctaggccaggttccgaaagttcttctggagttggagctggccctttcacaaaggccgcaagtgaacccctgtctcgggcggtgggttccgccacttttctgcgcccggagtcaggctccctccccgccctgaaacctctccctctcctgaggccagggcaagccaaaacccccctgggggtgcccatgagcgggacaggcacaacatctagcgccccactcgccctattaccactagatagttttgagggctggctgcttaagtggacaaattaccttaaagggtatcagcggcggtggtttgtgctcgggaacggcctgctttcctactatagaaatcagggggagatggcgcacacatgccgggggactataaatctgagcactgcgcatatcgacacagaggacagctgcggaatcttgttgacctccggggcgcgatcatatcaccttaaggcctccagcgaagtcgaccggcagcagtggatcaccgcactcgagctggctaaggcgaaggcggtccgggtaatgaacacgcacagtgatgatagcggtgatgacgatgaggccacaaccccggccgataagtctgagctgcaccacactctgaagaatctctcactcaagctggatgatctctccacgtgtaacgacttgattgcgaagcatggcgcagcacttcagcgatccctgaccgagctagacgggctgaagatcccttccgagagcggcgagaagttgaaagttgttaacgaaagggccaccctgttccgcataacctccaacgccatgataaatgcttgtagggactttctggagctggccgaaatccacagtagaaaatggcaaagagccctgcagtacgaacaagagcagcgggtgcacctcgaggagacaatcgagcagctagcaaaacagcataactccctcgagagggccttccattctgctcccggccgaccagctaaccccagcaagtcattcatcgagggatccctgcttacgccaaaaggtgaggatagcgaggaggatgaggacacagagtacttcgacgctatggaggacagtacttcatttatcacagtgatcactgaggctaaagaggatagtaggaaggcggagggctctacgggcacctcttccgttgactggagctcggccgataatgtactggacggtgcttcactggtgcccaagggctcttctaaggtgaagagacgagtgcgcataccaaataaaccgaattacagtttaaatctgtggtccataatgaagaattgcatcggtcgcgaattgagtaggattccaatgccagttaatttcaacgagcctctcagtatgctgcaaagacttacagaagacctggagtaccaccaccttctggataaagctgtccactgcacctccagcgtggaacagatgtgtttggtggctgcttttagtgtaagttcttatagtactacagtccatagaattgctaagccgttcaacccgatgctcggcgagactttcgagctggatcgcctcgacgatatgggtctaaggagcctttgtgagcaggtttcccaccatccaccgagcgcagctcactacgtgttttccaagcatggttggtccttgtggcaggaaatcacgatctcgtcaaagttccggggcaagtacatcagtattatgcctctcggagctatacatctggagttccaagcgagtggaaatcactatgtgtggcggaagtctacatctacagtgcacaatataatcgtgggcaagctttggattgaccagtctggcgacattgagatcgttaatcacaagaccaatgataggtgtcagctcaaattcttgccctactcgtatttctccaaggaagcggctcgcaaggtgaccggcgtggtgtccgatagccagggcaaagcccactatgtgctgtcaggaagttgggacgagcaaatggagtgtagtaaggtgatgcatagttctcccagtagcccttcaagcgatggcaaacagaagactgtgtatcagactctgtccgcgaagctcctttggaagaaataccccctgcctgagaacgcagaaaacatgtattacttcagcgaactcgccttgaccctgaatgagcacgaagaaggtgttgcccctaccgattcccgccttcggccagaccagagattgatggagaaaggtaggtgggacgaagctaacaccgaaaaacaacggctcgaagagaaacagagactctcgcgccggcgcaggctggaagcatgcgggccgggatcctcgtgcagtagtgaagaggagaaggaggcagacgcctacactcccttgtggtttgagaagcgtttagaccccttgacaggcgaaatggcatgtgtatacaagggaggctactgggaagccaaggaaaagcaggactggcacatgtgccccaacatcttctag

SEQ ID NO: 198352 - DNA, 2625 bp, Artificial Sequence
  Description of Artificial Sequence: Synthetic coding sequence
atgggcaaggccgccgcccccagccggggcggcggctgcggcggcagaagccgcggactgagctctttattcactgtcgtgccctgcttatcctgtcacaccgctgcacccggcatgtccgccagcactagtggctcagggcccgaacctaagccacagccccagcccgtccccgaacctgagagagggcctttaagtgagcaagtgtctgaagccgtgagcgaggccgtgcccaggagcgaacccgtctccgagacaacctccgagcccgagcctggcgcaggacagccttctgagctgctgcaggggagccggccaggatctgagagttccagcggcgtcggcgccggcccattcacaaaggcggctagtgaaccattatcaagagccgttggatccgctaccttcctgcggcctgaatccgggagcctacccgcactgaagccacttcccctactcaggccaggtcaggccaagacccccctaggggtgccaatgtcaggtacaggcaccacctcctcagcccctctcgcactcctccccctggattcttttgagggttggctgctcaagtggacaaattacttaaagggctatcagagacggtggttcgtccttggcaacgggttgctgagctactaccggaatcaaggtgaaatggcccacacctgccgcggaacgattaacttgagcactgcacacatcgacacagaagactcttgcggaatcttgctcacatccggtgcgcgtagttaccatttaaaagcttccagcgaagttgatcggcaacagtggattacagccctcgagctggcgaaggccaaggccgttcgcgttatgaacacccattccgacgattctggcgacgatgatgaggccacgactccggcagataaatcagagctccaccacacactgaagaacctgtccctgaagctggatgacctttctacttgtaacgatctgattgccaaacacggggcagctctgcagaggtccctgacagagctggatgggctgaaaatcccgtccgaatccggcgagaagttgaaggtcgtaaacgaacgcgctacactgtttcgcataacaagcaacgccatgataaatgcttgccgagattttctcgagttggcagagattcatagccgaaagtggcagcgggcacttcagtacgagcaggagcagcgggtgcacttggaagagactattgagcaactcgccaagcagcacaactcattggaaagagcttttcactctgcacctggcagacccgccaacccttctaagtccttcattgagggcagcctgctgaccccaaagggagaggatagcgaagaggacgaggacaccgagtattttgatgctatggaggattcgaccagcttcattactgttattaccgaggctaaagaggacagtaggaaagcggaggggtcaactggaacttcctccgtggactggtcttccgctgataatgtgaatttcaatgaaccattgtccatgttgcaacggttaacggaagatcttgagtaccaccacttgctcgataaagctgttcactgtacaagctccgttgagcagatgtgcctggtggcagctttctcggtctcttcctatagcacaacagttcataggattgctaagcctttcaaccctatgctgggtgagaccttcgagcttgaccgtctcgacgacatgggcttgcgctccctgtgcgaacaggtatctcatcaccctcctagcgcagcacattatgtattctccaagcacggatggtcactctggcaggaaatcacaatcagttccaaatttcgtggcaagtatataagtattatgcccctaggcgcaatacacttggagttccaggctagtgggaaccattacgtttggcgcaaaagcacatcaactgttcacaatatcatcgtgggcaagctgtggatcgatcagtccggcgacattgagatcgtgaaccacaaaactaacgataggtgccagcttaaattcctgccatatagttatttttccaaagaggctgcgagaaaggtgaccggagtagtgtcagactctcagggcaaggcccactacgtgctatccgggtcatgggatgagcagatggagtgtagcaaagtgatgcactctagtccatctagcccaagctccgacggcaagcagaagacagtttaccaaacgttgtcggcaaaactgttgtggaaaaaataccctctccccgaaaacgccgagaacatgtattatttctccgagctagctctgacacttaacgaacatgaagaaggtgtggcgcctactgacagcaggttgcgcccagaccagcgcttaatggaaaaaggccgttgggatgaagcaaatactgaaaagcagaggctggaggaaaagcagaggctgtctaggagaagacggctcgaggcatgtggtcccggtagctcctgttcctcagaagagggagaggccggtagagaaggacgtccaggaggcgaagagcgcggtgcacgcgtgggggttccccagggcagaatccccggtgagcaagcaactagccctcccacatcccctctttgcttgccttctagggaagggggaggatgccttcatgcaactgtagtgtag

SEQ ID NO: 198353 - DNA, 2253 bp, Artificial Sequence
  Description of Artificial Sequence: Synthetic coding sequence
atgcaccggcagcggacccggaccatgagcagcctggccgccaagcgtctgggcatgaaccgacggcctgcgggaagcggcgggggaggaggcgaggcagccacatggggccatcgtttttggaggccccaggaacgacctactgaccgcaatcagggcgaaatggcccatacttgccgcggaactattaatctcagcaccgctcacatagacacagaagactcctgcggtatactgcttacctcaggggctaggtcgtatcatttaaaggcatcaagtgaagtggacaggcagcaatggatcactgctctcgagcttgctaaagcaaaagccgtgcgcgtgatgaacacccactcagatgactctggagatgatgatgaagcgacgaccccggcggacaaatcggagcttcaccatactctgaagaatctttccctcaaactagatgacctgtcaacctgcaacgatttgattgccaagcacggcgcagctctgcagaggtctctgaccgaactggacggactcaaaatcccctcagagagcggcgagaagctaaaagtggtaaatgaacgcgctacactgttcaggataacttcaaacgccatgataaacgcctgtagggactttttagaactagccgagatacatagccggaaatggcaacgcgcacttcaatatgaacaggagcagagggtgcatctggaggaaaccatcgaacagctagcaaaacagcataacagcctcgagagagcttttcatagtgcgcccggccgaccagcaaatccttccaaatctttcatcgaaggatccctgctgacgccaaagggcgaggattccgaggaggatgaagataccgaatattttgacgccatggaagacagtaccagctttattacggtgataaccgaagctaaggaggatcggaaagccgaaggatccacaggcacgtcatcagtggattggtcaagcgcagacaacgtactggatggagctagcctggttcccaaaggctcgtccaaggtaaagcggcgggtccggataccgaacaagccgaactacagcttgaatctttggagcatcatgaagaattgtataggcagagagctgtccaggattcccatgcctgtgaacttcaatgagcccctgtcaatgttacagcggctcaccgaggacctggaataccatcatctgctagacaaagccgtgcattgtaccagcagtgtagaacagatgtgtcttgtggccgccttttctgttagcagttattcaaccactgtgcatcggattgccaagccattcaacccaatgttaggagagaccttcgagctcgatcgtctcgacgatatgggcctacgctccctctgcgaacaagtaagccaccaccccccctccgctgcccattacgtttttagcaaacacggatggagcctctggcaggagataactatctctagtaaattccgcggcaaatatatcagcatcatgcctctgggagcaatccatcttgaattccaggcctccggaaaccactatgtgtggcggaagtccactagtacagtacacaacattatcgtaggaaaactgtggatagatcagtccggtgatatcgaaatagtcaaccacaagactaacgatcgctgccaactcaagttccttccctacagctacttcagtaaggaagccgcccgtaaagtgaccggcgtggtatccgacagccaggggaaggctcattacgttctcagtggttcatgggatgaacagatggagtgttccaaggtcatgcacagttccccctccagcccaagctcagatggtaaacaaaaaacggtgtaccaaaccctctccgctaagctcctgtggaagaagtacccactccctgagaacgcagaaaacatgtactattttagtgaactggcactaacactcaacgagcacgaagagggtgtggcccctaccgattcacgcctgcgtccggatcaacgcctgatggagaagggacgctgggacgaggccaacaccgaaaaacagcgccttgaagagaagcagcgcttgtcacgcagacgcagactggaagcttgtggtccaggaagcagttgcagctcagaggaggagaaagaagccgatgcctatacgccactgtggtttgagaagagactcgatccactgacaggcgagatggcctgtgtttataagggagggtactgggaggctaaggaaaaacaggactggcacatgtgcccaaatatcttctag

SEQ ID NO: 198354 - DNA, 1980 bp, Artificial Sequence
  Description of Artificial Sequence: Synthetic coding sequence
atgaagggccggggctgctgggacaccgccagcgtgcggagcttctgttctagcggatgtcttaataagttcaaaaaggacgatagtggcgacgatgatgaggctacgacccccgctgataaatccgagctccatcatactcttaagaatctgagcctcaaacttgacgatctttctacttgtaacgatctgattgctaaacacggcgccgcactgcagagaagcctgacggagctcgatggcttaaagatcccgagcgagtcaggcgagaaactgaaggtcgtgaacgagagggctaccctgtttaggattactagcaacgcaatgatcaacgcatgtagagacttcctggagttggctgaaatccactccaggaagtggcagagggcactccaatatgagcaggagcagcgcgtacatctggaggagacaatcgagcagttagccaaacagcacaattctctcgagcgcgcttttcactctgcgccaggtcgtccggctaacccatcaaaatcatttatcgaagggagcctcctgacacctaagggcgaagatagcgaggaggatgaagatacagagtacttcgacgccatggaggatagcacaagtttcatcaccgtcatcaccgaagcaaaggaggattctcggaaggcagaggggtctaccggaacttcatctgtggactggagtagcgccgataatgtgttagacggggcgtcgctcgtccccaaaggaagctctaaggttaagagacgtgtgcggatccctaacaaacctaactactccctcaatctctggtcaattatgaaaaattgtatagggagagaactgtctcggattccaatgcccgtgaactttaacgaaccgttgagcatgctccagagactcacagaagacctggaatatcatcacttgctagataaggcagtccactgtaccagctcagtggagcagatgtgcctggtggctgccttttccgtgtcttcatatagcaccactgtgcacaggatagcgaaaccttttaacccaatgctgggggagacctttgaactggatcggcttgatgatatggggctgaggtccctgtgcgagcaggtgagccatcaccctccgagcgctgcccactatgtcttcagtaagcatgggtggtcattgtggcaagaaattacgattagctccaagtttcggggcaaatacatttccatcatgcctctcggagctattcatctggagtttcaagcaagcggtaatcactacgtgtggcggaagtctacatccaccgttcataacatcattgtcgggaaattatggattgaccagtctggtgacatcgagatcgttaatcacaagaccaacgaccgctgtcagttgaagttcctgccatattcctactttagtaaagaagccgcaaggaaggtcacaggcgtggtcagtgacagccagggcaaggcccattatgtcctgtcgggcagttgggacgagcagatggagtgctctaaggtcatgcactcatcgcccagcagcccctcaagcgatggcaagcagaagacggtgtaccagacccttagtgcaaaactgctgtggaaaaaatatcccctccccgagaacgcggagaacatgtattactttagcgaactggcgctaactctcaatgaacatgaagaaggcgtggcccctactgatagtcgccttaggcctgaccagagactcatggagaaaggaagatgggacgaagctaacacggagaaacaacgccttgaagaaaaacaaaggcttagccgtcgtagacgcctcgaggcttgcggccccggaagctcttgtagcagcgaggaggcggagaaggaggcagacgcttacacccccctgtggtttgagaaacggcttgatccactgacaggggagatggcctgcgtctacaaaggcgggtactgggaggccaaagagaaacaggactggcacatgtgtcccaatatcttctag

SEQ ID NO: 198355 - DNA, 1383 bp, Artificial Sequence
  Description of Artificial Sequence: Synthetic coding sequence
atggaggacagcaccagcttcatcaccgtgatcaccgaggccaaggaggaccgtaaggcggaaggaagcacgggcacttcaagtgtcgactggagctcagctgataatgtcctggacggggcttccttggtgcctaagggaagctccaaggtcaaaagacgcgtgaggatccctaacaaacccaattatagcttgaacctttggtctatcatgaagaactgcatcgggagggaactgtctcgaatccctatgcctgtcaacttcaatgaacccttgtcaatgctacagagattgactgaagatctcgagtatcaccatctgctagataaggctgtacattgcacgagtagcgtggaacagatgtgcctcgttgccgctttcagcgtctcctcatactctaccacagtgcatagaatcgccaaaccctttaatcccatgctgggagagacgtttgagctggaccgcctggacgacatgggactcaggtctctttgtgagcaggtatcgcatcacccaccttccgctgcccattatgtttttagtaagcacggatggagcctgtggcaggaaattaccatctcttctaaatttcggggaaaatatatctcaattatgccccttggtgccattcatctggaatttcaggcgagtggcaaccactacgtgtggaggaagtctacgagcacggtacacaacatcatagtgggaaaactgtggatagaccagtcgggggatatcgaaatcgttaatcataagaccaacgatagatgtcagttgaaatttttgccatatagctacttttcgaaagaggccgctcgcaaagttactggagtagtgagcgacagtcaggggaaagctcattacgtgctcagcggctcttgggacgagcagatggagtgttctaaggtgatgcactcgtctccatcttcccctagctccgacgggaagcagaagaccgtctaccaaaccctgagtgccaagctgctttggaagaaataccctctgcccgagaacgccgagaatatgtactatttcagtgagttggccctgaccctaaatgagcatgaggaaggggtggctcctactgatagccgcctacggcctgaccagagactgatggaaaaaggacggtgggatgaggccaatacggaaaagcagagattggaagaaaaacagagacttagtaggcgaagaaggctcgaggcctgcgggccgggctctagctgcagctcagaagaggagaaagaggcagacgcctataccccattgtggtttgagaaacggctggatcccctaactggcgagatggcttgcgtgtacaaaggtggctattgggaagctaaggaaaaacaggattggcacatgtgccccaacatcttttag

SEQ ID NO: 198356 - DNA, 2295 bp, Artificial Sequence
  Description of Artificial Sequence: Synthetic coding sequence
atggagcgggccgtgcagggcaccgacggcggcggcggcagcaacagcagctcccgctccagcagcagggctaccagcgccgggtcttcaccatcatgcagcttagctggtcgcggtgtctcaagccgcagcgcagccgcaggcttgggtggaggaggcagccgcagttcccccggatctgtggctgcgtcgccatccgggggcggcgggcgccgacgtgagcccgcactggagggcgtattgtcaaaatatacaaacttgctgcaaggatggcagaaccggtatttcgtactggactttgaggcaggcatccttcagtatttcgtaaacgagcagtccaaacaccagaaaccccgtggagttctctcattgtcaggggccatagttagcctgtctgatgaggctccccacatgctcgtggtgtactcagcaaacggcgaaatgtttaagctgcgggctgccgatgccaaagagaaacaattttgggtgacccagcttcgcgcctgcgctaaatatcatatggaaatgaactccaagtcggctccatcttccagaagtcgatcactcaccctgctgcctcacggaacacctaattccgcttctccatgtagccaacgacacctgtccgttggtgcacccggagtagtgaccattactcatcacaaaagcccggcggccgccaggcgcgctaagagccagtactcaggccagctccacgaggttagggagatgatgaatcaggtggagggccaacagaaaaaccttgtgcacgcaattgaatcgctgcctggatctggcccactcaccgccttggatcaggatctcctccttctgaaggctacatcagccgcgaccttaagttgcttgggagaatgccttaacctgctgcagcagagtgtacatcaggcaggccagccctctcagaaaccgggagccagtgagaatattctggggtggcatggttctaaatcccatagcactgagcaactgaagaatgggactttgggctctcttcccagtgcctctgccaacattacttgggcaatcttgccgaactctgccgaggacgagcaaacttctcaaccagaacctgaaccaaattcaggcagcgagcttgtgctcagcgaagacgagaagagcgacaatgaggataaagaggaaactgagctcggagtgatggaagaccagcgatccatcatcctccatctcatctcgcagttaaagttgggaatggacctcaccaaagtagttctcccaacgttcattctcgaaaagcgcagtctgctcgagatgtatgccgattttatggctcaccccgacctgctgctggcaattaccgcgggtgctacaccggaagaacgtgttatctgttttgtggaatactatctgaccgcctttcatgagggtcgtaagggcgccttggccaaaaaaccatataatccaattatcggagagaccttccactgttcatgggaggtgcccaaagatcgcgtgaagcctaagaggactgcctcacgatcgccggcttcctgtcatgagcaccccatggccgatgatccgtccaaatcatataagctgcgctttgtggcagagcaagtgtctcaccacccgcctatcagctgcttttattgtgaatgtgaggaaaagagattgtgtgtgaacactcacgtgtggaccaaatcaaagttcatgggcatgtccgtgggggtgagtatgattggagaaggagtcttacgtctcttagaacatggcgaagagtacgtgtttacgctgccatctgcttatgcccgatcgattcttacaataccctgggttgaactcggagggaaggtgtccatcaactgtgctaagacggggtactctgccacggtgatattccacacgaaacccttctatgggggaaaggtccaccgggtgacagctgaagtgaaacataatcccactaataccatcgtatgcaaggcgcacggcgaatggaacggcaccctggagtttacctataacaacggcgaaacaaaagtcatcgataccacaaccctcccagtgtaccccaagaagattcgaccactcgaaaagcagggtcctatggaatccagaaacctgtggagggaggtgaccagatatctacggctcggcgacattgatgccgcaaccgaacagaaacgccatctggaggaaaagcagagagttgaggagcgcaaacgcgaaaatctccgaacaccttggaaacccaagtacttcattcaggaaggagatggttgggtgtacttcaaccccctctggaaggcgcattag

SEQ ID NO: 198357 - DNA, 2103 bp, Artificial Sequence
  Description of Artificial Sequence: Synthetic coding sequence
atggagcgggccgtgcagggcaccgacggcggcggcggcagcaactccagtagtaggtcctccagtagggctacctccgcaggcagttcaccatcctgctctctggcggggaggggcgtttctagccgcagcgctgctgccggcttgggagggggcggcagtagaagcagccctggttcagtggccgcctccccaagcggcggcggtggcaggcgaagagagccagccttggagggtgtcttgtccaagtatacaaatctgctccagggttggcagaaccgctatttcgtattggacttcgaggccggcatcctccagtacttcgtaaatgagcagtccaagcatcagaaacctcgaggcgtgctgagtctctctggtgccattgttagcctctctgatgaggcgccccatatgctggttgtctatagcgccaacggtgagatgttcaaactgcgcgccgctgatgccaaggaaaagcaattctgggtgacgcagttgcgagcgtgcgcaaagtaccatatggaaatgaactccaaaatgatgaaccaggtcgaagggcaacaaaaaaacctggtgcatgccatcgagagccttcccggaagtggcccattgaccgctctagaccaagatctgctgttgctgaaagcaacgagcgcagctactctgtcctgcctgggcgaatgtctgaatctgctgcagcaatctgttcaccaggccggacagccttcccagaaaccaggcgcctccgaaaatattctggggtggcacggttctaaaagccactccacggaacaactaaagaatggcaccctggggagtctgccatccgcttccgcaaatatcacttgggctattttgccgaatagcgcagaagacgaacagacttcacagccagagccagagccaaattcaggttccgaactggtcctgtccgaagacgaaaagagcgataatgaagataaagaagagactgaactaggagtgatggaggaccagcgatccataattcttcatctgatttctcagctcaagctgggaatggatcttacaaaagtagttttacctacttttatcctcgaaaagcggtccctgctggagatgtacgctgatttcatggcacacccagacttgctcttggctatcaccgcaggagctaccccagaagagcgtgtcatctgttttgtggaatattacctgacagcctttcatgagggtaggaagggcgcactggcaaagaagccctacaaccccattatcggcgaaactttccattgtagctgggaggttccaaaagaccgcgtaaagcctaaaagaaccgcaagtcgatccccggcctcctgtcatgaacatcccatggcagacgacccttctaaaagctacaagttacgcttcgtggccgagcaggtttcgcaccacccccccatttcttgcttttattgtgagtgtgaggagaaacgtctctgcgttaacacacacgtatggacgaaaagtaagtttatgggaatgtctgtgggcgtcagcatgatcggtgaaggtgtcttgaggctccttgagcatggcgaggagtatgtgttcactctgccgagcgcctatgctcggtcgatcctgactatcccatgggtggaactcggcggcaaggtctcaatcaactgcgcgaaaacggggtacagtgcaacagtgatctttcataccaaaccgttctacgggggcaaggtccaccgagttactgcggaggtgaaacacaacccaacgaacactatcgtctgcaaggcgcacggagaatggaacggcacactcgaatttacctacaataacggtgaaaccaaagtgatagacacgaccaccctgccggtttatccaaaaaagatccggcctctagagaagcagggcccgatggaatcgcggaacctgtggcgggaggttactagatacctgcggctcggcgacatagatgcagcaacagaacagaagaggcacctggaagagaagcagagggtcgaagaacgcaagagggagaacctgcggactccgtggaagccgaagtatttcatacaggaaggtgacggctgggtctattttaatccgctctggaaggcacattag

SEQ ID NO: 198358 - DNA, 2244 bp, Artificial Sequence
  Description of Artificial Sequence: Synthetic coding sequence
atgcagggcggcgagcccgtgagcaccatgaaggtgagcgagagcgagggcaaactcgagggacaggccaccgccgtgacaccaaataagaatagtagctgtggcggtggcatctctagctcctcatcctccaggggcgggagtgccaaaggctggcagtattccgaccacatggagaatgtgtatggctatctgatgaagtacacaaacctagtgacgggttggcagtatagattcttcgtgctgaataatgaagcaggcctgctggagtacttcgtcaatgagcagtcacggaatcagaagcctcgaggaaccctccaacttgccggggctgtgataagccccagtgatgaggactcccatacctttacagtgaacgccgcatcaggcgagcagtacaagctgagggccactgacgcgaaagaacggcagcactgggtgagtagactccaaatctgcacacagcaccatacagaagcaatcggtaaaaacaaccccccccttaagtcccggtcctttagcctagcttcgagtagtaactccccaatatctcagagaaggcccagccagaatgctattagttttttcaatgtaggtcattccaagttgcaatcgctcagcaaaagaaccaatttacctcctgaccacctggtggaggtaagagaaatgatgtcacatgccgaaggacagcagagagaccttatcagacgaatcgaatgcctgcctacgtcaggccatcttagctctttggaccaggacttgttgatgcttaaagctacctcaatggccactatgaattgcttgaatgactgcttccatatcttacagctccaacacgcctctcaccaaaaaggctccctgccatccggaaccacaattgagtggctggaaccgaaaatttcactgtccaaccactataagaacggagccgaccagccttttgcgactgatcaaagcaagccagttgctgtgccagaggaacagccagtggcagaatcaggattactcgccagggaaccagaggagataaatgccgacgatgagatcgaggatacctgcgaccacaaggaagacgatctgggcgcggtggaagaacagcggagcgtgattctgcaccttctgtcccagctaaaacttggaatggacctgaccagggtcgtgctgccaacatttatcctggaaaagcgctccctacttgagatgtacgcagacttcatgagccatccggacctcttcattgccattaccaacggcgccacagcagaagatcgaatgataaggtttgtcgagtattatctgacctccttccacgagggccgaaagggggccatcgccaaaaagccttacaaccccatcataggggagacgtttcattgttcttggaagatgcccaaatccgaagtcgccagctccgtcttctcatccagctctactcagggagttacaaaccacgcccccctcagcggtgagtctttgactcaggtaggttctgattgctacaccgtcagattcgtggcagagcaggtgtctcatcaccccccagtcagtggattttatgccgagtgcaccgagcgcaagatgtgcgtaaacgcccatgtctggacaaagtccaagttcttaggtatgagcataggggtcacaatggtaggcgaaggcatcctttcgcttctggagcacggtgaagaatacacattttcactgccttgcgcatacgctagatccattttgacagtaccttgggtcgagttggggggtaaagtatccgtgaactgcgccaagacgggatatagcgctagtattactttccataccaagcccttttacggcggcaagttgcatcgggtgactgcggaggtgaagcacaatattacaaataccgtggtgtgccgtgttcagggagagtggaattccgttttggagtttacctatagtaatggcgagacaaagtacgtggacttgaccaagctggccgtaactaagaaacgagtccgccccttggagaaacaggatcccttcgaaagcaggcggctgtggaagaacgtgaccgacagccttcgtgagtcagaaattgataaggccacagaacacaagcataccctggaggagcggcagaggacagaagaaaggcaccggaccgaaacagggacgccgtggaagaccaaatacttcattaaagagggcgacgggtgggtttaccataagccactgtggaagattattcctacgacccagcctgccgaatag

SEQ ID NO: 198359 - DNA, 2853 bp, Artificial Sequence
  Description of Artificial Sequence: Synthetic coding sequence
atgaacaccgaggccgagcagcagctgctgcaccacgcccggaacggcaatgcagaggaggtgagacaactcctcgagacaatggcccgaaacgaagtgatagcagatattaattgcaaaggccggagcaaaagcaacttggggtggaccccccttcatcttgcatgctacttcggccaccgtcaagtggtgcaggatctgttgaaggcaggcgcagaggtgaacgtcctaaacgacatgggcgatacccctttgcacagggccgccttcacaggccgcaaagagctggtaatgcttcttctggaatataacgcagacaccacgatcgttaatgggtcagggcagaccgctaaggaggtgactcatgcggaggagattcgctccatgctggaggccgtggagcgcacgcagcagcgtaaattggaagagcttctgcttgcggctgcaagggagggcaaaactacagagctcaccgcgctgctgaaccgaccgaatccaccagatgtgaattgctcggatcagttggggaacacccccttgcattgtgctgcctatcgcgcccataaacagtgcgcgctgaaactgcttcgtagcggtgcagatccgaatcttaagaacaaaaatgatcaaaaaccacttgatctggcccagggggcagaaatgaagcacatcctcgtcggcaataaagtcatttataaggcattgaagaggtatgagggccctctgtggaaatcaagtaggttctttgggtggaggctgttttgggttgttctggaacatggggttctttcctggtacaggaaacagcccgacgctgtgcacaacatttaccgccaggggtgtaaacatttgacacaggcagtttgtaccgtgaagtcaaccgatagctgcttattcttcatcaagtgttttgacgataccatccacggatttcgcgtgcccaagaattccctgcagcaaagccgcgaagactggttagaggcaatagaggaacactcagcctacagtacacactactgtagccaggaccagttaacagacgaagaagaagaggacacagtgagcgcggcggatctcaagaaatccttagagaaagctcagtcgtgtcaacagagactagatagagagatcagcaactttctaaaaatgattaaagaatgtgatatggccaaggaaatgctcccttcttttctgcagaaggtcgaagtggtgtctgaggcctctagggaaacctgtgttgccctgacagattgcctcaatctgttcacaaaacaggaaggcgtcaggaattttaagcttgagcaggaacaggaaaagaacaaaatcctgtccgaagccctggagactctggccaccgaacatcatgagctggaacagtctctggttaagggtagcccccctgcaagcattctgtccgaggacgaattctatgacgctctgagtgactcagaatctgagagatctctgtcgagactcgaggccgtcaccgctaggagcttcgaagaagagggcgagcatttaggctcccggaaacatcggatgagtgaggagaaggactgtggcggtggagatgcccttagtaacggaatcaaaaagcatcgaacctccttgccatctccgatgtttagccgtaacgatttctccatttggtcaattcttcggaagtgtattggcatggaactatctaaaatcactatgcctgtgattttcaacgagcccctgtctttcctgcaaagattgaccgagtacatggaacatacatatctcatccacaaggcctcctcactgtcagaccccgtcgaacggatgcagtgtgtcgcagctttcgccgtctctgccgttgcttctcagtgggaaaggactggaaagcctttcaaccccctgctaggtgaaacctacgagcttgtccgtgacgacctcggcttcagactgataagtgaacaggtgagtcatcacccccccatctcagcattccacgcggaaggactgaacaatgacttcatcttccatggtagtatatatcctaaactgaagttttggggaaagtcagttgaagcagaacctaaagggacaatcactctagaactattagaacataatgaggcatacacttggaccaatcccacttgttgcgtccacaatattatcgtggggaagctgtggattgaacagtacggcaacgttgagattatcaaccacaagaccggcgacaaatgtgtgctgaactttaagccctgtgggctattcgggaaggaactgcacaaagtggaaggctacatccaggacaagtccaagaagaagctgtgtgccctgtatggcaaatggacagagtgcctctattctgtggatcctgccacctttgacgcatacaagaaaaacgataaaaagaacaccgaggaaaaaaagaatagcaagcagatgtccacgagtgaagaactagatgaaatgccagtccccgacagcgagagcgtgtttataatcccaggctccgtgttactctggaggatcgcaccgcggccacctaacagtgcccaaatgtacaattttactagttttgcgatggtgctcaacgaggtggataaagatatggagagtgtaattcccaagactgattgtaggttaaggccagatattcgggccatggaaaatggagaaattgaccaagcttcggaggagaaaaaaagactagaggaaaagcagagggcggctaggaaaaacaggagtaaaagcgaggaggactggaagacccgctggtttcatcaaggacccaacccctataatggagcacaggattggatttattctggatcctactgggatcgcaactatttcaatttgcccgatatatattag

SEQ ID NO: 198360 - DNA, 1707 bp, Artificial Sequence
  Description of Artificial Sequence: Synthetic coding sequence
atgatcaaggagtgcgacatggccaaggagatgctgcccagcttcttgcaaaaggtcgaggtggttagcgaggcttcccgggaaacctgcgtggcattaaccgattgtcttaacctgttcacaaaacaggagggcgttcgaaattttaagctcgaacaagagcaagagaaaaacaaaatcctgagcgaggctttagagacccttgccacggagcaccacgagctcgagcagtctttggtgaaagggagcccgcctgcaagcattctgtccgaggatgagttctacgacgccctgagcgacagtgagtccgaacgatcactgtctaggctcgaagcagtcaccgctagatccttcgaggaagaaggtgagcacctgggtagcaggaagcatagaatgtctgaggaaaaggattgcggcggaggggatgccctgtccaatggaattaagaagcacagaacttcattaccgtcccctatgtttagcagaaatgacttttcgatctggtctattttgcgcaagtgcatcggcatggagctgtccaaaattaccatgccagtgatcttcaacgagcccctaagctttctgcagaggctcacggaatatatggaacacacctaccttatacacaaggcaagttccctgagtgatcccgttgaacggatgcagtgcgtggctgcatttgccgtgagcgcggtcgcctcgcagtgggagaggaccggcaaaccttttaatccactgctgggggaaacttacgagctggttagggacgacctaggcttccggctgatatcagagcaggtgtcccaccaccctcccatctccgcattccatgccgaaggtttgaacaatgactttattttccatggatccatataccccaagctcaaattctggggcaagtccgttgaagccgagcctaaagggacgataacattagagctcctcgagcacaacgaggcctatacttggactaacccaacctgctgtgtgcataacattatcgttgggaaactgtggatcgagcagtacggcaacgtggagataattaatcacaaaactggcgataagtgtgtgttaaattttaaaccatgcgggttattcggtaaggagctgcacaaggtggaaggttatatccaagataagtcaaagaagaaactgtgtgcattgtatggcaaatggaccgagtgtctgtattcggtggatccggccacgtttgacgcctataagaaaaatgacaagaaaaataccgaggagaaaaagaacagcaagcaaatgagtacctctgaggaattagatgagatgccggtgcctgattcagagagcgtctttattattccgggatcagtcctactgtggcgcatagctccaaggccaccgaattccgcccagatgtataattttacttcatttgccatggtccttaatgaagtcgacaaagacatggagagcgtcattcctaagactgactgtaggctccgaccagatatccgcgcgatggaaaatggcgagattgaccaagccagtgaggaaaagaagagacttgaggaaaagcaaagagcagctcggaagaatcgcagtaagagcgaggaagactggaaaacccggtggtttcaccaggggcccaatccatataatggcgcacaggattggatctactctggttcttattgggatcgcaattacttcaaccttcctgatatttattag

SEQ ID NO: 198361 - DNA, 303 bp, Artificial Sequence
  Description of Artificial Sequence: Synthetic coding sequence
atgaacaccgaggccgagcagcagctgctgcaccacgcccggaacggcaatgccgaagaggtgcgccagctcctcgagactatggcccgcaatgaggtgatcgccgacattaattgtaaaggacggagtaagagcaacctcggttggacccccttacacttggcctgctattttggccatcgacaggttgtccaagatctgctgaaagcaggggcagaggtcaatgttcttaatgacatgggggacacacccctgcaccgtgccgctttcactgggcgcaagatctgctcccaggggagctag

SEQ ID NO: 198362 - DNA, 1314 bp, Artificial Sequence
  Description of Artificial Sequence: Synthetic coding sequence
atgagcgaggagaaggactgcggcggcggcgacgccctgagcaacgggattaagaaacaccggacatctcttcccagcccaatgttttccaggaacgatttctctatatggtctattttgagaaagtgtatcggaatggagctgtccaagattaccatgccggtgatcttcaatgaacccctgagctttctgcaacggctgacggaatacatggaacatacctacctgatccacaaggcgtcgagtttgagcgatcctgttgaacggatgcagtgcgttgccgccttcgcggtctctgccgtcgctagccagtgggaacggaccgggaaaccctttaacccactgttgggcgaaacctatgagttggtgcgcgacgacctgggcttccgtctaattagcgagcaagtctcccaccaccctcccattagtgcattccatgcggagggcctgaacaacgattttatattccatggcagcatttacccaaaacttaagttctggggaaaaagcgtagaagccgaaccgaagggtaccattaccctagagctcctggagcataatgaggcttatacctggacaaaccctacatgttgcgtccataacatcatagtgggaaagttatggatagaacaatacggaaatgtcgagatcattaaccataagacaggggacaagtgtgttctgaatttcaagccctgcggattgttcggaaaggagctgcataaagttgagggctacatacaggataaatccaagaaaaagctgtgtgcactgtacggaaagtggacagagtgcctctattcagttgaccctgctaccttcgatgcatacaagaaaaatgacaagaaaaacactgaagagaaaaaaaactctaagcaaatgtccacgagcgaagagttggatgagatgccagttcctgactctgagagtgtattcattattcccggctcagtgctactgtggcggattgccccacgaccgcccaacagcgcccagatgtacaacttcaccagcttcgccatggttcttaatgaagtggacaaagacatggaaagcgtgatcccaaagaccgactgccgccttcgaccggacattcgggcaatggaaaacggtgaaattgaccaggccagtgaagagaagaagcgtctagaggagaagcagcgcgctgcaaggaagaataggagtaagagcgaagaagattggaaaactagatggttccaccagggtcccaatccctacaacggagcccaggattggatatacagcggatcctactgggaccgaaattactttaatctcccggatatctattag

SEQ ID NO: 198363 - DNA, 345 bp, Artificial Sequence
  Description of Artificial Sequence: Synthetic coding sequence
atgcagagcgtggccgccttcgccgtgagcgccgtggccagccagtgggaacgtacaggtaaacctttcaacccactgctgggtgagacgtacgaactcattagggaggacttgggtttccgttttattagtgaacaagtgtctcatcatcctcctatcagtgccttccacagcgaagggctaaatcacgattttctattccatggttctatatacccaaaactgaaattctggggaaaatccgtcgaggctgagcccagaggaaccatcaccctcgaattactgaacgtgaaccagcgtcatctaagagcaaagcacaaaagcccaacaaatgctgggcgatag

SEQ ID NO: 198364 - DNA, 1443 bp, Artificial Sequence
  Description of Artificial Sequence: Synthetic coding sequence
atgaacggcgaggaggagttcttcgacgccgtgaccggcttcgactccgataatagttcaggcgagttctccgaggcaaaccagaaggttacaggaatgatcgacctggatactagcaagaataaccggattgggaagaccggcgagcgcccaagtcaagagaatgggatacagaagcataggacatccctgcccgccccaatgttcagcaggtctgacttctcagtctggacaattctgaaaaaatgcgtggggctcgagctatcaaaaatcacgatgcccatcgccttcaatgagccactttcatttctgcagcggataactgaatacatggaacatgtatacttgattcaccgagccagctgtcaaccgcaaccactggaacgcatgcagtctgttgccgccttcgccgtcagcgctgtcgcaagccagtgggagcgcacaggtaagcccttcaatccccttttgggtgagacatacgaactaattcgagaggaccttggctttaggttcattagtgagcaggtaagccatcaccctcctatatccgcgtttcattctgagggcctgaatcatgacttcctcttccacggctcaatctacccaaaactgaagttttgggggaaaagtgtagaagccgagccaaggggaacgattacccttgagctgctgaaacataacgaagcttatacttggacaaaccctacctgctgtgtgcataacgtcattattggtaagctttggattgaacagtacggcacggtggagatcctcaaccacagaacaggtcataagtgcgtgcttcacttcaagccttgtggcttgttcgggaaagagttacataaggtggagggccacatacaagataaaaacaagaagaaattattcatgatctatggaaagtggactgagtgcctttggggaatcgacccggtatcatatgaatcgttcaaaaagcaggaaagacgaggcgaccatttacgtaaggccaaattagatgaggacagtggaaaagcagactcagatgtggcggatgatgtgcctgtcgcacaagaaactgtgcaggtgataccaggtagcaaactgctttggaggattaacacacgccccccaaattctgctcaaatgtataacttcacatccttcacagtcagcttgaacgaactcgaaaccgggatggaaaagacattgccccccacagactgtaggttaagaccagatattcggggtatggaaaacggtaacatggatcttgcatctcaggaaaaagagaggctggaggaaaaacagcgggaagcccggagagaaagagctaaggaagaggctgagtggcagaccaggtggttttatccggggaataacccttatactggcacgcctgactggctgtacgcaggcgactacttcgaacgcaactttagcgactgtccagacatttattag

SEQ ID NO: 198365 - DNA, 1407 bp, Artificial Sequence
  Description of Artificial Sequence: Synthetic coding sequence
atgaacggcgaggaggagttcttcgacgccgtgaccgaggccaaccagaaagtcactggtatgattgacctggacacaagcaaaaacaatcgtatcggaaaaactggtgagagaccctcccaggaaaatggaatccagaaacatcgcaccagcctccctgcccccatgtttagccgctccgacttctcagtatggacaatcttgaagaaatgtgtcggcctcgaactgtcaaagattaccatgcccattgcctttaatgaacccctttcttttctccagaggattacagagtacatggaacatgtgtacctcatccatcgtgcaagttgccagccccagcccctggagaggatgcagagtgtggcagctttcgccgtctcagcggtcgcgagccagtgggagagaactgggaaacctttcaaccccttactgggggagacatatgaactgatcagagaagacctgggctttcggttcatcagtgaacaagtttcgcatcacccaccgatctctgcctttcattcagaggggctcaatcacgattttctatttcatggctccatctatcccaaactcaaattctggggaaaaagtgttgaagccgagccccgcggaactataacactggaactgcttaagcacaatgaggcttacacatggaccaatcccacgtgctgtgtccacaatgttattataggcaagctctggatagagcagtacggaacagtagagatacttaatcatcgcaccggccacaagtgcgtgctgcactttaagccatgtgggctcttcggaaaggagctgcacaaagtagaaggacacatacaggataagaataaaaagaaactgtttatgatctacgggaagtggacagagtgcctttggggaatagacccagtgtcctacgagtctttcaagaaacaggaacgacggggtgaccacctgaggaaagcgaagctggacgaagactccggtaaagccgacagcgacgtagcggatgacgtgccagtcgcacaggagaccgtgcaggttatccccggctcaaagctgctttggcgaattaatactcgacctcccaattctgcccagatgtacaattttactagttttaccgtaagccttaatgagttagagaccggcatggagaagactctccccccaacggattgcaggctgcgccctgatattagaggaatggagaatggcaacatggacctcgccagtcaggaaaaggaaagattagaggaaaagcagcgggaggccaggcgagagagagctaaggaagaagctgaatggcaaaccagatggttttatccaggaaacaatccttatactggaacacctgattggttgtacgcgggcgactacttcgagaggaactttagcgattgtcctgatatctattag

SEQ ID NO: 198366 - DNA, 1113 bp, Artificial Sequence
  Description of Artificial Sequence: Synthetic coding sequence
atgcccatcgccttcaacgagcccctgagcttcctgcagcggatcaccgagtatatggaacatgtgtaccttatccacagggcttcatgccaacctcagcctctggaaaggatgcagtctgtggcagcctttgctgtgtctgccgtcgcctcccagtgggaaagaacaggaaagccttttaaccccctgctgggtgagacttatgaactaattcgtgaggacttaggctttcgctttatctcagaacaggttagccaccacccccccatctcagcctttcattctgagggcttgaatcacgactttctcttccacggctctatttaccccaaactcaaattctggggcaagtctgtcgaggctgagccccgaggtactatcacacttgaacttctgaagcacaacgaagcgtacacttggacgaaccccacctgctgcgtccacaacgtgattattggaaagctttggattgagcagtatggaaccgtggagatcctaaaccacagaaccggtcacaagtgcgttctgcattttaaaccatgcggtttattcggcaaagagctgcacaaggtggagggccatattcaagacaaaaacaagaaaaagttgtttatgatttatgggaagtggaccgagtgcctctggggcatcgaccccgtatcctatgaatctttcaagaagcaggagaggcgtggcgaccacttgcggaaagccaaacttgatgaagatagtggaaaggcagattccgatgtcgccgacgatgtaccagtggctcaggagacagtgcaggtcatccccggctccaagctgctgtggcgtattaacaccaggccccccaactccgcacagatctggcctgccaggcgcagatccgggtggaggagaagtcgagagaagcatgggggctccggacctcggcggagacaatcaggacgcaggggcggcagtactcaagcaatcacgcctaccttaggacccccaacaggctgtatgcagggcatcaccttgagtggtatctctccaaccgcccagattagcaccgaaggtctggaagggcccggagccagagaccggaggctaacacggctcgacttcttagagtggcctctgtag

SEQ ID NO: 198367 - DNA, 339 bp, Artificial Sequence
  Description of Artificial Sequence: Synthetic coding sequence
agcgtggccgccttcgccgtgagcgccgtggccagccagtgggagagaaccggtaagccttttaaccccctcctcggagaaacatatgaacttatcagagaagacctgggctttagatttattagtgaacaagtctctcaccatccaccaatttcagcattccacagcgaagggctgaatcacgatttccttttccacggttcaatctaccctaagctgaagttttggggaaagagtgtggaggcagagcctcgcggcactattacactggagttgctcaacgtgaaccagagacacctgcgggcaaaacacaagagcccgaccaacgccgggagatag

SEQ ID NO: 198368 - DNA, 2664 bp, Artificial Sequence
  Description of Artificial Sequence: Synthetic coding sequence
atgatgagcgacgagaagaacctgggcgtgagccagaagctggtgtctccttctaggtccacttccagttgtagctcaaagcagggatcacgccaggattcgtgggaagtggtcgaaggcctacgcggggaaatgaattacacccaggaaccccccgtgcagaaaggttttctgctcaaaaagagaaaatggcctttgaaaggctggcataagcgcttcttctacttggacaaaggtatcctgaaatacgctaagtcccagacggatatcgaaagggaaaagttgcacggctgcatcgacgtaggactgagcgtgatgtcagtcaagaaatcctccaaatgcatcgacctcgatacagaagaacacatttatcacctgaaagtaaagagtgaggaagtgtttgacgaatgggtgagtaaattaaggcaccataggatgtatagacagaacgaaattgcaatgttcccgcatgaggtgaaccactttttcagtggctctaccattactgattcctcctccggggtctttgatagcatttctagcagaaaacgatcttcaatatcgaagcaaaatttgtttcagaccggcagcaatgtatccttttcttgcgggggagaaacccgtgtccctctgtggctacagtcctcagaggacatggaaaaatgttctaaggatttggcacattgccatgcttatctggtagaaatgtcccaactcctgcagtccatggatgtactccaccggacctatagtgcacctgcaatcaacgccatccagggtggcagcttcgaaagtccaaaaaaagaaaagagatctcaccgtagatggcggagcagggcaataggtaaagacgcaaagggtacactgcaagtccccaagccatttagtgggccggtgcgcctgcattccagtaatccaaatctcagtacacttgatttcggagaagagaagaattacagtgacggcagcgaaacttccagtgaatttagcaagatgcaggaagatctgtgtcatattgcgcacaaagtctatttcaccctcagatccgcatttaacattatgtctgctgagagggagaaactgaagcagctcatggaacaggatgcttccagttcaccctcagcccaggtgatcggcctcaagaacgcactgagctccgcactcgcacagaacaccgaccttaaagagaggctcaggaggattcacgccgaatctttactcttggattcccctgcagttgcaaaaagcggtgataacctcgctgaggaaaattcccgggacgagaatcgtgccctggtgcatcagctgtccaatgagtccaggcttagtattacagactctctttccgagttctttgacgcgcaggaagtcttgctaagcccatcaagctcggagaatgagatatcagatgatgattcttacgtttctgacatttctgataacctgtctttagacaatttatcaaacgacttggacaacgaaaggcagactttgggccccgtactagacagcggcagagaagccaagagtagaagaaggacatgcttaccagccccctgtccgtcatcctcgaatattagcctctggaacatcctccgcaataatattggtaaggacctatccaaggtcgcgatgcctgtagaactaaacgagcccctgaatacactacagagactctgcgaagagctagaatatagtgagctgctcgacaaagcggcacagataccaagccccctggagcggatggtttacgtagctgcattcgcaatatctgcctatgcctcaagctattaccgggccggtagtaaaccctttaacccagtactcggcgaaacgtacgaatgcatccgtgaagataagggatttcagttctttagcgagcaggtgagccatcacccacctatttctgcctgccacgcggagagcagaaacttcgttttctggcaggatgttaggtggaaaaacaaattctggggaaagagtatggaaatcgttcccataggaaccactcacgtgaccctccctgtctttggggaccactttgagtggaacaaagtgaccagctgcattcataatattttgagcggccaaaggtggatcgaacattacggtgagattgtgatcaagaatcttcatgacgacagctgctattgcaaagtgaactttattaaggcgaaatattggtcgacaaatgcacacgaaatcgagggcactgttttcgaccgatcaggaaaagcggtacatcggcttttcggaaagtggcacgagtccatctattgcggcggaggctcctcttctgcttgtgtttggagagccaacccgatgcctaaaggatatgagcagtattattcttttactcagttcgcgctggagctgaacgagatggatccaagcagtaagtccttgttgccccccacggacacgagattccgcccagatcagaggtttcttgaagagggaaacctggaggaggccgaaatccagaagcaacgaattgaacaacttcaacgagagagacgcagggtgttggaggagaatcatgtcgagcatcaacctcggtttttccgaaaaagtgatgatgactcctgggtctcaaatggcacatacctggagctgcgtaaagacctcggcttttcgaagctcgatcaccccgtactgtggtag

SEQ ID NO: 198369 - DNA, 2571 bp, Artificial Sequence
  Description of Artificial Sequence: Synthetic coding sequence
atgatgagcgacgagaagaacctgggcgtgagccagaagctggtgagccccagtcgatctacatctagttgttcttctaagcagggctctcggcaggactcatgggaggtagtagaaggattacgaggagagatgaactacacccaggagccacctgtgcagaagggctttttgctgaaaaagcgtaaatggcctctgaaaggctggcacaagcgatttttctacctcgacaaaggcatccttaaatacgcaaagtcacagacggatatcgaaagggaaaaactccatggctgtatcgatgtgggactgtcagtcatgtccgtcaagaagtcgtccaagtgtatagacctggatacggaggaacacatctaccacctgaaggtgaaaagcgaggaagtcttcgacgaatgggttagcaaactcagacaccaccgaatgtaccgccaaaacgagattgcaatgttcccccatgaggtgaatcacttcttctccggttccacaatcacagactcttctagcggtgtgttcgatagcatcagctcacggaagcgctcatctataagtaagcagaacctgttccaaaccggctcgaacgtttcttttagctgcggaggagagactcgtgtgcctctatggttgcagtcttccgaggacatggaaaagtgcagcaaggacctagcccactgtcacgcctatctggtggagatgagccagttgttgcagagcatggatgtgctccaccgtacctacagcgcacccgccattaatgcaatccaggttcccaaaccgttctctggacctgtgcgacttcactccagcaatcccaacctttctacactggattttggagaggaaaaaaactatagtgatggctcggagacaagttcggagtttagcaagatgcaggaggacctgtgccacattgctcataaggtgtacttcacattaaggagtgcattcaatatcatgagcgccgagagggagaagctcaagcagctcatggagcaggacgcaagttctagcccctccgctcaggtgattggtctaaagaacgccctcagctccgctcttgctcagaataccgaccttaaagaacggttaagacggatccatgctgagagcctgcttctagattcgccagccgtggctaaatctggcgacaacctggccgaggagaatagccgggacgagaatagggccctggttcaccagctcagcaacgagagcaggctgtctattacagatagcctcagcgaattttttgacgcccaagaagtgctcttgtcaccttcatcctccgaaaatgagatttcagacgatgatagttacgtgagcgacatctccgacaacctgagtttggacaacttgagcaacgatctggataacgagcggcagacactcgggccagtgctcgactccggccgggaggccaagagtcgacgacgaacgtgcctcccagcaccgtgcccttccagctcaaatatctctctgtggaacattctgcgcaataatatcgggaaggatttatccaaggtggctatgcccgtcgaactgaacgagccgcttaacacccttcagagactgtgcgaagagttagaatactcagaactgctggataaagcagctcagattccctcccccctggagaggatggtttacgtggctgcctttgccatttcagcctacgcctctagctactacagggcgggctcaaaacctttcaatcccgtccttggagaaacatacgagtgtatccgtgaggacaagggattccagttcttttcagagcaggtcagtcaccatcctcctatttccgcatgccatgccgaatctagaaacttcgtcttctggcaggatgtccgatggaagaacaagttctggggtaaatccatggaaatcgtaccaataggcactacccacgtaaccttgcccgtgtttggcgaccattttgaatggaacaaagtaacatcctgtattcacaacatcctgagcggtcagcgctggatcgagcattatggagagatcgtaattaagaatttgcatgacgatagctgttactgcaaggtgaattttatcaaggccaaatactggtccactaatgcccacgagattgaaggcacggtattcgatcgtagtggtaaagctgtgcaccgcctctttggcaaatggcatgagtccatatactgcggcggaggctcgtcgagtgcctgtgtgtggagagcaaacccgatgcctaagggctacgagcaatactactccttcacacagtttgctttggagctgaatgagatggacccctcctcaaaatcactgctgcctccaacagacaccagattccggccagatcaacggtttctagaggaaggcaatctcgaggaggccgagatccagaaacaaaggattgagcagcttcaacgggaacgtaggcgagtgttggaagagaatcacgttgaacaccaaccaagattcttcaggaaatcggatgacgactcatgggtaagcaacgggacatacctcgaactcagaaaagacctgggttttagcaaacttgaccaccctgtgctgtggtag

SEQ ID NO: 198370 - DNA, 2556 bp, Artificial Sequence
  Description of Artificial Sequence: Synthetic coding sequence
atgatgagcgacgagaagaacctgggcgtgagccagaagctggtgtcaccctcgcgctctacctcatcgtgttcgtccaaacagggcagtaggcaggattcctgggaggtagtcgaaggtctgcgcggtgagatgaactacacacaggagcctcccgtccaaaaaggatttctgctgaaaaaacggaaatggcccctgaaagggtggcacaagagattcttttacttggataaagggatactgaagtacgcaaaaagccagaccgatatcgagcgggagaaactccatgggtgtattgacgtcggcttgtccgtcatgagtgtcaagaagagctctaaatgcattgatctggatacagaagaacacatttaccacctgaaggtcaagagtgaggaggtgttcgacgagtgggtgagtaaattgcgccatcaccggatgtacaggcaaaacgagatcgctatgttcccacatgaggtgaaccactttttcagcgggagtacgattacggattcttcctccggtgtgttcgatagcatttccagcaggaaacgatcctctatttctaaacagaatttattccagaccggctctaacgttagcttctcttgcgggggggaaacaagggtgccactgtggctgcagtccagtgaggatatggaaaagtgctccaaggacttggcgcactgtcatgcttacttggttgagatgtcccagctgttacagagcatggatgtgctccatagaacatacagcgccccggctatcaatgcaatccaaggagggtccttcgaatctcccaagaaagagaagcgctctcatcgccgttggaggtcgcgagccataggcaaggatgcaaagggcacactccaagtgcctaagcccttttccgggccagtgaggttacactcgagcaatcctaatctcagcactcttgactttggagaggagaagaactattcagatggaagcgagaccagctcggaattcagcaaaatgcaggaagatctctgccatattgcccacaaggtatattttacactgcgctctgccttcaatattatgtcagccgaacgagagaagttgaaacaactcatggaacaggacgcctcatcaagccctagtgcccaggtgatcggccttaagaacgctctgtcctcagagaatagcagagatgaaaaccgcgctttagtacaccagttgtccaacgaaagccgactctccattactgactcgctctccgaattctttgacgcccaggaggtgctgctttcaccaagctcttccgaaaacgaaatcagcgacgacgacagctacgtgtcagacatatctgataacctctcacttgataatctgagtaacgacttggataatgagcggcagacactaggtccagtgttagattctgggcgggaagcaaaatcacggcgccgcacctgcctgcccgccccgtgtccctcatcatcaaatatcagtctttggaacatcctgcgcaacaacattggtaaagacctgagtaaagttgccatgccagtggaactgaatgagcctctcaataccttgcagagactctgcgaagagcttgagtactcagaactgttagataaagcggcccagataccatcacccctggaacggatggtatatgtggctgcgtttgcaatatcagcttatgcctcctcctactaccgcgcgggtagcaagccattcaatccagtccttggggagacttacgagtgcatccgagaagacaaaggtttccagttcttttcggaacaagtgagtcaccacccaccgataagcgcctgccacgccgagagccgcaacttcgtcttctggcaggatgtccgatggaaaaacaagttctgggggaaaagcatggaaatagtgcccataggaaccacacatgtgacactgcctgtgttcggggatcacttcgagtggaataaggttacaagttgcatccacaatattctgagcggacagcgttggatcgaacactacggtgagattgtgatcaaaaatctccatgacgacagctgctattgcaaggtaaattttattaaagcaaaatattggagtactaacgcccacgaaatcgagggaactgtgttcgataggtcgggaaaagccgtccatcgattattcgggaaatggcacgagtccatttattgtgggggcggctcatcaagtgcgtgtgtatggcgcgccaaccctatgcctaagggatacgagcaatactacagttttacacagtttgccctcgaactgaatgaaatggacccatcttctaagagcctgctaccgccgacggatacgcgatttaggcccgatcaaagattcttggaggagggaaatctcgaggaagccgagatacagaagcaacggatcgagcaactgcagcgggaacggagaagagtccttgaagagaatcacgtggaacatcagcctcgtttctttcgcaaatccgacgacgactcttgggtgagcaacggtacctacctggagctccgaaaggaccttggcttctcaaagctggaccaccctgtgctgtggtag

SEQ ID NO: 198371 - DNA, 2556 bp, Artificial Sequence
  Description of Artificial Sequence: Synthetic coding sequence
atgatgagcgacgagaagaacctgggcgtgagccagaagctggtgagcccatctagaagcacaagttcttgcagcagcaagcagggctctaggcaggacagttgggaggtggttgaaggactccgtggcgaaatgaactatacccaggaacccccagtccagaagggattcctgctgaaaaaacggaaatggcctcttaagggatggcacaaacgctttttttatctggataaagggatcctgaaatatgctaagtctcagacagacatcgagcgggaaaagttgcacggctgcattgacgtaggactatctgtcatgagtgtcaaaaagagcagcaaatgtattgacttagacaccgaagaacacatttatcacttgaaggtcaagtcagaggaagttttcgatgagtgggtgtcaaaactgcgccatcataggatgtacaggcagaatgaaatcgctatgttcccccacgaggtcaaccacttcttctctggctccaccattactgacagctccagtggagtatttgatagcatctcctcacgcaaacgctcctcaatcagtaagcagaacttgttccagactggatcgaacgtgagtttttcctgtgggggagaaacacgcgtgccgctgtggctccagtcgagtgaggatatggaaaagtgcagcaaggatctggcccactgccacgcatatcttgttgaaatgtcccaactgctacaaagtatggacgtgctgcataggacatattccgctcccgccatcaacgctatacagggcggaagctttgaatcccctaaaaaagaaaagaggtcccacagacgttggcgctcaagagctatcgggaaggacgccaaaggcaccttgcaagttcccaagccattctcgggccctgtgaggctgcacagtagtaaccccaacttaagcacacttgactttggagaagagaagaactatagcgacggttcagaaacttcgtctgagttctctaagatgcaggaggacctgtgccacatagcgcataaggtctacttcacactcagatcagcctttaacatcatgagcgcagaaagggagaaactgaagcagttaatggaacaggacgcctcttctagtcccagcgcgcaggttataggcttgaagaacgccctgtcttctgaaaacagccgtgacgagaacagagccctggtgcaccagttatctaacgagtcgagactgtcaatcactgactctttgagtgaattctttgacgcccaggaggtgctgctgagtccttcgtcctctgagaatgagatttctgacgatgattcctacgtctcagatatctcagataatctgtctctggataacttgagcaatgacctggataacgaacggcagacattaggccccgtgcttgacagcggccgagaagccaagagcagacgtcgcacctgcctgccggccccctgtccctcatccagtaacattagtctctggaatattctgagaaataacatcgggaaggatctctccaaggtggccatgcccgtggagctaaatgagcctctgaatacactgcagaggctgtgcgaggaacttgaatattctgaactactggataaggccgcccagataccctcacctttggagcgtatggtgtatgtggccgctttcgcaatcagcgcctatgctagcagctattatagagcaggatctaaacctttcaatccggtgctgggagagacctatgagtgcatccgggaggataagggattccagtttttcagtgaacaggtgagtcatcatccccccattagcgcatgtcacgccgaatcacgtaacttcgtattctggcaagatgtcagatggaagaataagttttggggcaagtcaatggaaatagtgccaatcggtacaactcatgttaccttaccagtcttcggggatcactttgaatggaacaaagtcacctcctgcatccataatatcctctccggccagaggtggatcgagcactatggagaaattgtgattaaaaacctccatgacgactcttgttattgcaaggtgaacttcattaaggccaagtattggtcaactaacgcacatgaaattgaaggcacggtattcgatagatcagggaaggcagtgcatcggctgttcggaaagtggcatgaatcaatctattgtggcggcgggagttccagcgcttgcgtctggcgagccaaccccatgcccaagggatacgagcagtactactcatttacacagtttgcgcttgaactgaatgagatggatccaagctccaaatctctgctgccccctacagacacaagattcaggccagatcagcgctttctcgaagaaggcaacctcgaggaagctgaaatccagaaacagcgaatcgagcaattacagcgggaaaggagacgggtgctagaagagaatcacgtggaacatcagccacgattcttccggaagtctgacgatgactcttgggtgagcaacggcacctatttggaactgcgcaaggatctaggtttttcaaaactagatcatcctgtgctgtggtag

SEQ ID NO: 198372 - DNA, 2571 bp, Artificial Sequence
  Description of Artificial Sequence: Synthetic coding sequence
atgatgagcgacgagaagaacctgggcgtgagccagaagctggtgtccccatctcgttccacaagttcttgtagtagtaaacagggatctaggcaagatagctgggaagttgttgaagggcttaggggcgagatgaattatactcaagagcctccagtacagaaaggcttcttactgaagaagaggaagtggcctctaaagggatggcacaagaggttcttttacttggacaagggtatccttaaatacgcaaagtcccaaacagacatagaaagagagaagttgcacggttgtatcgatgtggggctaagcgtcatgtctgtcaagaagtcctcaaagtgtattgacttggatacagaagagcacatctatcacctgaaagtgaagtctgaggaggtgttcgacgagtgggtcagcaaattaaggcaccaccgaatgtacaggcagaacgaaatcgccatgttcccccatgaggtgaaccatttcttcagtgggtcaaccataacagattcatcatccggtgtcttcgatagcatcagttcacgcaagcgtagctcgatcagcaagcaaaatctctttcagactggatctaacgtgtcgttttcatgtggaggtgaaactagagtgccactgtggctgcagtcatctgaagatatggaaaaatgcagtaaagacctcgcgcattgtcacgcctatctggtcgagatgtctcagctcctccagagcatggatgtccttcaccgcacatatagcgcaccagccatcaacgcgatccaggttccaaaaccgttctctggacccgttcggctccactcatcaaatcctaaccttagtaccttggatttcggagaggaaaagaactatagcgatgggtccgagacttcctcggagttcagcaaaatgcaagaggacctttgtcatatcgcccacaaggtgtatttcacgcttaggtcagctttcaatatcatgagcgcagaaagagagaaactgaaacagctaatggagcaagacgcctcatcgagcccgagtgctcaggtgattggactcaagaatgccttgtcctccgctctggcacagaacacagatcttaaagagcgtctgaggagaatccatgccgagtccctcctccttgacagtcccgccgttgctaagagtggggataaccttgccgaggagaattcaagagatgagaacagggcgctcgtgcatcagctttctaacgagtcacgtctttccattaccgactccctctccgaattttttgacgcccaggaagtcttgctgtctccaagctcgtctgagaatgaaatttctgacgatgactcatacgtatccgacattagcgataacctgtctttggacaacctgtcaaacgacctcgacaatgagagacaaacacttggccctgtattagacagcggcagagaggctaaatcaaggcggcgtacctgcctgcctgccccatgcccctccagctctaacatatccctctggaacatcttgcggaataacatcggaaaggacttgtccaaagtcgctatgcccgtagagctgaacgagccacttaacactctccaacgcctgtgcgaggagctggaatactcggaacttttagataaggccgcccaaatacccagcccattggagcgtatggtatatgttgccgcgttcgcaatctccgcatatgctagttcctattaccgggctgggtcaaagccattcaatcccgtgcttggggaaacctacgaatgtattcgcgaggataaggggtttcaattcttttctgaacaggtttcgcatcatccgcctattagcgcatgtcacgcagaatctaggaatttcgtgttttggcaggacgtcagatggaagaacaagttttggggaaaatcaatggagattgtgcctattggaaccactcacgtcacactaccggtttttggcgatcacttcgaatggaataaggtcacgtcatgcattcacaacattctctcaggtcagagatggattgaacactacggagagattgtgatcaagaacctacatgacgattcgtgctactgcaaggttaactttataaaggcaaagtactggtctacaaacgcccatgaaatagagggcactgttttcgaccgctctggaaaggccgtgcacagactgtttggcaaatggcatgagtcaatctactgcggcggaggttcgtcttcagcttgtgtctggagagccaatcccatgcccaagggctatgaacaatattacagttttacacaattcgctctggaacttaacgagatggaccccagcagtaagtctctgctaccccccactgacaccaggtttagacctgatcagcgctttctggaagagggaaatctggaggaagccgagatccagaagcagaggatcgagcagttacagagagaacgcaggcgcgtgctggaggaaaatcacgtagaacatcagccgcggttctttaggaagtcggacgatgattcgtgggttagcaatggaacttacctggagctccgtaaagatctgggcttctctaaactcgatcaccccgttctgtggtag

SEQ ID NO: 198373 - DNA, 2463 bp, Artificial Sequence
  Description of Artificial Sequence: Synthetic coding sequence
atgatgagcgacgagaagaacctgggcgtgagccagaagctggtgagcccttcccgtagcaccagttcttgctcctctaagcaaggctctcgccaggacagctgggaagttgttgaagggctgaggggcgaaatgaattatacccaagagcctccagtgcagaaggggtttctgttaaaaaaaagaaaatggcccctcaagggctggcacaaacgatttttttatttggataagggcattctcaaatatgccaagtcacagactgatatcgagcgagagaagctgcacggctgcattgacgtcggcctttcagtgatgtccgtcaagaaatcttcaaaatgcatcgaccttgacaccgaagagcacatctatcatctcaaggtcaaaagtgaagaagtgttcgacgaatgggtgtctaaattgaggcaccaccgaatgtatcggcaaaatgaaattgcgatgttccctcacgaagtcaatcatttcttttctggctcaacaatcacagacagctcaagcggcgtcttcgatagcatcagcagtcgtaaacgaagttctattagtaagcagaatctgttccaaaccgggtcaaacgttagtttcagttgcggtggagagacccgggtgcctctctggctgcaatcaagcgaggatatggagaagtgcagtaaagaccttgcccattgccatgcatatctggtagagatgtctcagctcctccaatcaatggatgtgctgcatagaacatactccgctccggctatcaacgcaatacaagttccaaagcccttttctgggccggtgcggcttcactcttcaaacccaaacctttctactttggactttggcgaagaaaaaaactatagcgatggatctgaaacgagtagcgaattttccaagatgcaggaagatctctgccatatcgctcacaaagtttactttaccctcaggtccgctttcaatatcatgagtgctgagcgagaaaagctaaaacaactaatggagcaagacgcatcctcctcaccttcagcccaggtgataggattaaagaacgccctgtcaagtgagaattctcgggacgaaaaccgtgccctggtgcaccagctgtcgaatgagtcgcggctgagtattaccgattcacttagcgagttctttgatgctcaagaagtgctgctcagccctagcagctccgagaacgaaatttcagatgacgattcttacgtgtccgacatttccgataacctcagtttagataacctgtccaatgatctggataatgagcgccagactctcggccccgtgttggacagcggtagggaggccaaatcacgccggcgcacatgtctgcctgctccctgcccctcctcatcgaacatttctctgtggaatattctgcgaaacaatattggaaaagacctgtcaaaggtggctatgccagtggagcttaacgaaccgttgaacacactccagcgcctgtgtgaagagctagagtactctgagttgttggataaagccgcccagatcccctcgcccttagaacgcatggtttatgtggccgctttcgcaatctcagcctatgcctcaagctactatcgagcaggctcgaagccttttaatccagtgcttggcgagacatatgagtgtattcgagaagataaagggttccagtttttttcagagcaagtctcccaccaccccccgatttccgcatgccacgccgaatcaaggaactttgtgttttggcaggacgttcggtggaagaacaagttttgggggaaatccatggagatcgttcccatcgggacaactcatgtgactctgcccgtttttggcgatcatttcgagtggaataaggttacttcttgtattcacaacatcctgagtggtcaaagatggatcgagcactacggtgagatcgtgatcaaaaatttacacgacgatagctgctactgtaaagtgaatttcattaaggccaagtactggtccacgaacgctcacgagattgaaggaaccgtcttcgatcgaagcggcaaggcggttcacagactgtttgggaagtggcacgaatctatttactgcggcggggggagcagctcagcctgcgtctggagggcaaacccaatgcccaaaggttacgagcagtattactcttttacccagtttgctttagaactgaatgagatggacccttcatctaaaagtctccttccacccacagacaccagattccggcctgaccagcggttcctggaagagggaaaccttgaggaagctgaaatccagaagcagcgcatcgaacaattgcagagggaaagaaggagggtgcttgaagagaatcacgtcgagcaccagccacgcttttttagaaagtccgacgacgattcctgggtgtcaaacggaacatatttggagttgcgcaaagatttgggctttagcaaactcgatcatccggtactgtggtag

SEQ ID NO: 198374 - DNA, 339 bp, Artificial Sequence
  Description of Artificial Sequence: Synthetic coding sequence
atgatgagcgacgagaagaacctgggcgtgagccagaagctggtgtccccctccaggagcacctcatcctgcagcagcaagcagggctctagacaggatagttgggaggtcgtggaaggccttcggggagaaatgaattatactcaggaaccccctgttcagaaaggcttcctgctgaaaaaacgcaagtggcctttgaaaggctggcacaaacgatttttttatttggataagggaatcctgaagtacgccaaaagtcagacagatattgaaagggagaagctgcacggttgcatcgacgtgggcttaagtgtcatgagcgtgaagaagtcctcttag

SEQ ID NO: 198375 - DNA, 186 bp, Artificial Sequence
  Description of Artificial Sequence: Synthetic coding sequence
atgatgagcgacgagaagaacctgggcgtgagccagaagctggtgagtccttccaggagcactagttcatgcagtagcaaacaaggttcaaggcaggacagctgggaagtggtcgaggggctcaggggagagatgaactatactcaagagcctccggtacagaaaggcttcttattaaagaaatag

SEQ ID NO: 198376 - DNA, 2463 bp, Artificial Sequence
  Description of Artificial Sequence: Synthetic coding sequence
atgatgagcgacgagaagaacctgggcgtgagccagaagctggtgagcccttctcgaagtacttcaagttgttccagcaaacaaggcagcaggcaggactcctgggaggtagttgaaggtctaaggggggaaatgaactatacccaggaacctcctgtccagaaaggctttctgttgaagaagaggaagtggcctctgaaggggtggcataaacgttttttttatctcgacaaaggtatcctcaagtatgcgaagtcgcagaccgatatcgagcgggagaaacttcacggctgtatcgacgtgggactctctgtgatgtcagttaaaaaatccagtaagtgcatcgatctggacactgaggaacatatttaccatctcaaggtgaaatccgaggaagtgttcgatgagtgggtttctaagctgaggcatcatcgcatgtataggcagaacgagatcgcaatgtttcctcacgaggtgaatcattttttctcaggctctaccatcacagactctagttccggtgtctttgatagtatttcaagtagaaaaagaagctcaatctctaaacagaatttattccagaccggatccaacgtgtccttctcttgtggaggagagaccagggttcctctctggctccagtctagcgaagatatggagaaatgtagcaaggatctggcccattgccatgcctacctggtggaaatgagccagcttctacagtcaatggacgttttgcaccgcacatacagcgccccggcaatcaatgccatccaggtgccgaagcccttctccgggcctgtgcgattgcactctagtaacccgaatttatccaccctcgactttggagaagaaaagaattactccgatggtagcgaaacatcttcagagttttcgaagatgcaggaggacctgtgtcacatcgctcacaaagtatatttcacattacggtcggctttcaacattatgagcgcagagcgcgaaaaactaaaacagcttatggaacaggatgcatcctcctccccatctgcccaggtgataggcctgaaaaacgccctgtccagcgaaaactcccgagacgaaaatagggccttagttcatcagctgtcaaacgagagccggctttcaataactgactctctgtccgaattcttcgatgcgcaagaggtgctcctttccccttctagctccgaaaatgagatcagtgacgatgattcttacgtgtctgatatctctgataacctgtctctggacaatctttccaacgatctcgataacgaaagacagactcttgggcccgtgctggattctggtagggaggcgaaatcgcgccgacgcacttgtttacctgcaccatgcccctcaagctccaatatttctctgtggaacatcctgaggaacaacatcggcaaggacttgagcaaagtggccatgcctgtggagctgaatgagcctctaaatacactccagcggttatgcgaagagctggagtactctgagctgctagataaagcagcacaaataccctcacctctcgagagaatggtatacgtggctgcttttgctatatcggcttacgccagttcctactaccgcgccgggtccaaacctttcaatccagtgctgggagagacctatgagtgcattagggaggacaaaggctttcaattttttagcgaacaggtgtcacaccacccgcccatttctgcttgtcacgctgagtctcgcaatttcgtattttggcaagatgtgaggtggaaaaacaaattctgggggaagtccatggaaatagtaccaattggcacaacacatgtgaccttgcccgtgttcggtgaccattttgagtggaataaggtaacaagttgcatccataacatactgtccgggcagcgttggatcgagcattacggcgagatcgtgatcaagaatttgcacgacgattcttgttattgcaaggtaaacttcatcaaggccaagtattggagtaccaacgctcacgaaattgaaggtacggtgtttgaccggtcaggcaaagctgtgcaccgccttttcggcaagtggcacgaatccatctactgtggcggcgggtcctcgtccgcatgcgtgtggagagcaaatcccatgcccaaggggtatgaacagtattactcattcacacagtttgctctggaacttaacgaaatggatccctcgtccaagtcattgctccctccgacggacactagatttaggccagaccagagattcttggaagagggtaacttggaagaggcggagatacagaagcagagaattgagcagcttcaacgggagcggcgtcgcgtgctggaggagaatcacgtggagcaccagccaagattcttcagaaagagcgacgacgatagctgggtgtcgaacgggacctacttggaactgcgtaaggaccttggtttcagcaagctagaccatccagtgttgtggtag

SEQ ID NO: 198377 - DNA, 270 bp, Artificial Sequence
  Description of Artificial Sequence: Synthetic coding sequence
atgatgagcgacgagaagaacctgggcgtgagccagaagctggtgtctccgtctaggtcaacctcctcgtgttcaagcaagcagggcagtcggcaggatagttgggaagtcgtggaaggccttaggggcgaaatgaattatactcaagagccacccgtccagaagggctttctccttaaaaaacgaaagtggcctcttaaagggtggcacaagcgcttcttctacctggataagggtatccttaagtatgccaagtcgcagactgactag

SEQ ID NO: 198378 - DNA, 2640 bp, Artificial Sequence
  Description of Artificial Sequence: Synthetic coding sequence
atgaaggaggaggccttcctgcggcggcggttcagcctgtgccccccgagcagtactccgcaaaaggtcgatccccggaaattaacacggaacctactgctgagcggtgacaatgagctttaccctctgagccctggaaaggacatggaacctaatgggccctctctgccaagagatgaaggaccgccaaccccatctagcgctactaaggtgcccccagccgaatatcgcctgtgcaatggatccgataaggaatgcgtgtcgccaactgccagggtaacaaaaaaggagactctcaaggctcagaaagaaaattataggcaggaaaagaaacgcgccacaagacagctgctgtctgctctgacagacccctcagtagtgatcatggctgattcgctcaaaatccgaggaacactcaaatcctggacaaaattgtggtgcgtgctcaagcccggggttctcttaatctataagacacccaaggttggacagtgggttggcacagttctcctgcattgttgcgaactaatcgagcgaccgtcaaaaaaagacgggttttgttttaaacttttccaccccttagatcaatcggtgtgggcagtaaagggtccgaagggtgagagcgtgggcagcatcactcaaccactgccctcttcctacctcatttttagggcagccagcgagtctgatggccggtgctggctggatgccctggaactggcactcaggtgctcctccctcttgcggctgggaacttgtaagcccgggagggatggggagcccggaacgtctccagacgcttcaccatcttcactgtgcggcctaccagcttctgcgacggtgcatcccgaccaggatctgttcccactcaatggctcatctttggaaaatgacgctttctctgataagtccgaacgcgaaaatcccgaagagagtgatacagaaacacaggatcactcacgcaagaccgagagtggttcagaccagagcgaaactccaggggccccagtgcggcggggaaccacatacgtggaacaggtgcaggaggagcttggggaactgggggaggcctcccaggtcgaaacagtttcggaagagaataagagtctgatgtggactctgctgaaacagctgcggccagggatggatctctctagggtagtcctgcccacattcgtgctcgaacctcgcagcttcctgaataagctctctgattactattaccatgctgatctgctaagtagggccgccgtggaggaagacgcctactctaggatgaaactggtgctccgctggtacctgtccggattttacaaaaagcccaagggaataaaaaaaccatacaatcccatactcggcgaaacatttaggtgttgttggtttcatccacagacagattcccggacattttatatcgcagagcaggtgagccatcaccctccggtgtcggcatttcatgtgagtaaccggaaggatggattttgcattagcggaagcataacggctaagagtaggttctatggcaacagccttagcgccctgcttgacggaaaagcgacactaacttttttaaacagggcggaagactatactctcacaatgccttacgcccattgcaaaggaatattgtacggtaccatgacattggaactagggggcaaagtcacaatcgaatgcgccaaaaataatttccaggctcagctggagttcaagctgaagccgttctttggcggatcgacctcaattaatcagattagcggtaagataacttcaggcgaggaagtgctggcaagcctgtctgggcattgggatcgcgacgtgtttatcaaggaagagggttccggtagttcagcactgttctggactccaagtggggaagttcgccggcagcggctacgccagcacaccgtgccactggaggagcaaacagagctggaaagcgagagactctggcagcacgttaccagggctatttctaagggggaccaacatagggctacccaggaaaaattcgctctggaagaggcccagaggcagagggcacgggagcgtcaggagtcgctcatgccttggaaaccccaactgttccacctggatcccatcacgcaggaatggcattatcggtatgaggatcacagcccctgggaccctctgaaggacatagcacagttcgagcaagacggaatcttaagaacactacaacaggaagctgtggcccggcaaacaacgtttcttgggtctcccggcccacgccacgagcgtagcgggcctgatcaacggctcagaaaagcgagcgaccagcctagtggccacagccaggcaacagaaagctcaggctctacacctgaatcctgcccagagctctcagacgaggagcaagatggtgactttgtgccaggaggagagtccccgtgtcctcgttgtagaaaggaggcgcgccgcctgcaggcactgcacgaggccatcctgtccattcgagaggctcagcaggagctccatcggcatctgagcgctatgttaagtagcaccgccagagcggctcaagcgcccactccaggactgctccaaagcccaaggtcctggtttctcctctgtgttttcctggcgtgccagctttttatcaatcacatcttaaagtag

SEQ ID NO: 198379 - DNA, 2436 bp, Artificial Sequence
  Description of Artificial Sequence: Synthetic coding sequence
atgaaggaggaggccttcctgcggcggcggttcagcctgtgcccccctagcagcactccacagaaggtggatcctcgtaaactaacgagaaatcttctgctttcgggggacaacgagctgtatccgctgtctcccgggaaggacatggaacccaatggccctagcctgcccagagacgaaggacccccaactccatcttcagcgactaaggtgcctcccgctgagtataggctgtgcaatggatcagacaaggaatgcgtatcacctaccgcacgcgtcaccaaaaaggagaccctgaaagcccagaaggaaaactatcggcaagagaagaagagggccacccgacagctcctcagcgctctcactgacccaagcgtggtgatcatggcggactctctcaaagggcctaaaggcgaatcagtgggctccattacccaaccacttcccagttcttacctaatctttcgcgccgccagcgagtcagatggcagatgttggttggacgcactggaactggccttgcggtgttcctctctgctccgactgggtacctgtaagccgggccgggacggggaacccggaactagtccagatgcttctccttcctccctgtgcggattacccgccagcgcgaccgtgcaccctgaccaagatctgtttcctctgaacggctcctcattagaaaatgatgccttctctgacaaatcagagcgcgagaacccagaggaaagtgacacagagactcaggaccattctagaaaaactgaatcgggctctgatcagtccgaaactcccggtgcaccagtgcgacgcggaacgacctatgttgaacaagtccaggaggagctcggtgagcttggagaggcttcccaggtcgagaccgtgagtgaagagaataagtccctgatgtggacacttttgaagcagctgcgcccagggatggatctgagcagggtggtgctgcctacttttgtgttggaacctcgcagttttctgaataagctatccgattactattaccacgcggaccttctgagtcgggctgctgtcgaagaggatgcctacagcaggatgaagctcgttctccgttggtacctgtccggcttttataagaagccaaaggggatcaaaaagccttacaatccaatacttggcgagaccttcagatgctgctggtttcatccgcagacagacagtcgtacattttacatagcggagcaggtctctcaccatcctccagtgagcgcttttcatgtgagtaaccgaaaagacggattttgtatcagcgggtccatcacagcaaaatctcggttctacggcaactcattgtctgcccttctagacggcaaagcaactctaaccttcttgaatcgtgcggaggactacactctgacaatgccctatgcgcattgcaaagggattttatacggcacaatgacgttggagctcggtggcaaagtaaccatcgaatgcgctaaaaacaattttcaagcacagcttgaatttaagctcaaaccattcttcggcggtagcactagcatcaaccaaatttcgggcaaaataacaagtggagaggaagtgctcgccagcttgagcggacattgggatagagacgtgttcatcaaggaggagggctctgggtcgagtgctctcttctggaccccatctggggaggtgagacgccaaaggctgcgccaacacactgtgcctcttgaagagcagaccgaactggagtctgagcgcttgtggcagcacgtgacaagagccatcagcaaaggagatcagcatagggccactcaggaaaagttcgctttggaggaagcccaacgacagagagctcgggagcgacaggagagtctgatgccatggaaacctcagttgttccaccttgatccaatcactcaagagtggcattatcgctacgaagatcacagcccgtgggatccattaaaggatatcgcccagttcgagcaagatggtatccttcgcaccctacagcaggaggcggttgccaggcagactactttcttgggaagcccagggcctaggcatgagagaagtgggccggatcagcggctgaggaaagctagcgatcagccgagcggccactcccaggccactgagagctctgggtctacaccagagagctgccctgagctgagcgatgaagagcaggatggcgatttcgtgccaggaggggaatccccctgccccagatgtaggaaagaagcacgacggctccaggccttgcacgaagcaattttgagtatccgcgaggcccagcaggagctgcaccggcacctttcagctatgctctcctctactgcccgggccgctcaagcccccactcccggcctactgcagagcccgcgaagctggtttctgctgtgtgtcttcctggcctgccaattatttatcaatcacatcttaaagtag

SEQ ID NO: 198380 - DNA, 1320 bp, Artificial Sequence
  Description of Artificial Sequence: Synthetic coding sequence
atggacctgagccgggtggtgctgcccaccttcgtgctggagccccggagcttcctcaataagttatctgactactattaccatgccgacttattgtccagggccgccgttgaagaagatgcatattctaggatgaaactggtgcttagatggtatctgagtggcttctataaaaagccgaaaggcattaagaaaccttacaatcctatactgggcgagaccttccggtgttgctggttccatcctcagactgattccaggactttttacatagcggaacaggtgagccaccaccctccggtatccgcctttcatgtttcaaacagaaaagacggattctgtatatcgggttccataaccgcgaagtctagattctatggcaacagcctgtcagctctgctggacggcaaagccactctgacttttctgaatagagctgaggactatacactcaccatgccatatgcacactgtaaaggaatcctgtatggcacgatgactctggagctcggggggaaggtgaccatcgagtgtgctaagaataacttccaggcgcagctggagttcaagctaaagccgttctttggcggcagtacgtctatcaatcagattagtggcaagattacctccggcgaagaagttctggctagtttatctgggcattgggatagagatgttttcataaaggaagaagggtccggttccagcgcgctgttctggacacctagcggtgaggttaggaggcagaggctgcggcagcacacagtacctctagaggagcaaaccgaactcgaatctgaacgactgtggcagcatgtgacccgggccatatccaagggagatcaacatcgcgcaacgcaggagaagtttgctttggaagaggctcagcgacagagggcaagagaacgacaggaatctctgatgccgtggaaacctcagctctttcacttagatcctattactcaagaatggcactatcgatatgaggatcactccccatgggatccactaaaagacatagcccaatttgagcaggatggcatcctgcgcacccttcagcaggaggctgtggcccggcaaacgacttttcttggctcacccggcccgcgacacgaacgaagcggtccagatcaacgtctacgaaaggcctcagaccaaccttctggtcactctcaggccactgagtcaagtggttcaacccccgagtcctgcccggagctgcacggcaccgggtctacgggaactgaccccaggcctcccgccgaaccccctatacttgtgcctgccctgcgggtaccaggcgtgtctgctgtgcattag

SEQ ID NO: 198381 - DNA, 2436 bp, Artificial Sequence
  Description of Artificial Sequence: Synthetic coding sequence
atgaaggaggaggccttcctgcggcggcggttcagcctgtgccccccttcatccacaccccagaaagtggacccccgaaagctcacaaggaatttgctcctaagtggcgataatgagctgtacccgctgagccctggaaaggatatggagccaaacggaccttcactgccgcgcgatgagggcccacccacacccagctctgctaccaaagtgccaccagccgagtaccggctgtgtaacggctctgacaaggagtgtgtgtcacccaccgcccgagtgaccaagaaggagacgctgaaggcacagaaggagaattatagacaggaaaaaaaacgagctaccagacagcttctttctgctctcacagacccaagcgtggtcattatggccgattccctgaagggtccgaagggggaatccgtagggagtattacccagcctctcccatcgagctaccttatttttagggccgcctccgagtcagacggcagatgttggctcgatgctctcgaacttgcccttcgctgctctagtctcctgcgattaggcacatgtaagcccggacgggatggggagcctgggacatcgcctgacgcttcaccgagttctctatgtggactcccagctagcgctaccgtgcaccctgaccaagacctgttcccgcttaatggctcatccctagaaaacgacgccttctctgacaaatcagaacgagaaaaccctgaagagtcggacacagaaactcaagaccactcacgtaagactgaatccggttctgatcagagtgagacgcctggtgcgccagtccgcagaggaaccacttacgtggaacaggtacaggaggaactgggtgaacttggtgaggcctctcaagtggagacggtgtccgaggagaataaaagcctcatgtggactctgttaaagcagttgcggcctggaatggacctgtctcgcgttgtactgcccacatttgtcttggagcccagatcctttctgaacaaactttctgactactactatcacgcagaccttctgagcagagctgccgtggaagaagacgcgtattcccgaatgaagttggtactccgttggtatctgtcgggtttttacaaaaaacctaaggggattaagaaaccctacaatccaatcttaggagagactttccgctgctgctggttccatccccagaccgatagccggaccttctacatcgcggaacaagtgagccatcatccaccagtcagtgcttttcacgtgtccaatcggaaagatggcttctgcattagcgggtccataactgccaagtccaggttttatggaaattcactgagcgctcttttggatggcaaggctactctcacctttctcaacagggctgaagactataccctcaccatgccctacgcccactgcaagggaatcctctacggcacaatgactttagaactgggagggaaagttaccatcgagtgtgcgaagaataactttcaggctcaactggagttcaaactgaagccattcttcggtggctctacctcgattaatcaaatttccgggaagattactagcggcgaggaggtgctcgccagcctgagtgggcattgggatcgtgacgttttcattaaggaggaagggagtggctcttccgccctgttctggacgccatctggcgaggttcgtagacagagactgagacaacataccgtgccgctggaggagcagaccgaactggaaagcgagaggctttggcaacacgtgacccgggcaataagtaagggggatcagcaccgggccacccaggaaaaattcgcactggaagaggcgcaacggcagcgagcacgcgaacgccaggagtcactgatgccctggaaaccccagctgttccacctagatccaatcacccaggagtggcactatcggtacgaagaccacagcccctgggatccactgaaagacatcgcccagttcgaacaggacggtatcctgaggacattgcagcaggaggcagtggcccgacaaacaactttcctgggaagtcctggtccgagacatgaaagatccgggccagatcagaggctacgaaaggctagcgaccagccaagcgggcactcgcaggcaacggagagcagcggctccacacccgaatcctgcccagaacttagtgacgaagagcaggatggcgacttcgtaccgggaggtgaaagcccttgcccaaggtgccggaaggaggcccgccggcttcaagctttgcatgaggcgattttgtccataagagaagcacagcaggagctgcaccgccaccttagtgctatgttaagcagcaccgccagagccgctcaggcccctactccagggttattacagtcacctagaagctggtttttactgtgtgtgtttctggcctgccagcttttcatcaatcatatcttgaagtag

SEQ ID NO: 198382 - DNA, 375 bp, Artificial Sequence
  Description of Artificial Sequence: Synthetic coding sequence
atgaaggaggaggccttcctgcggcggcggttcagcctgtgccccccctcatccacaccacaaaaggtcgatccgagaaagctgactaggaacctgcttttgtccggagataatgaactatatccgctctcccccggtaaagacatggagccgaatggaccctcactcccgagagacgaaggcccgcccacgcctagctcagccactaaagtgcccccagcagagtatagactgtgcaatgggagcgacaaagaatgtgtgtcaccaaccgcacgggttacaaaaaaggaaacgttgaaggcgcaaaaggaaaattacaggcaggaaaaaaaaagggcaaccaggcaattgcttagtgcactgacagatccgtag

SEQ ID NO: 198383 - DNA, 297 bp, Artificial Sequence
  Description of Artificial Sequence: Synthetic coding sequence
atgaaggaggaggccttcctgcggcggcggttcagcctgtgcccccctagctccacccctcaaaaggttgaccctaggaagttaactagaaacctcctacttagtggtgacaatgagttataccctctctcccctggcaaagacatggaaccaaatgggcctagccttcctagagacgagggaccccctacaccatcctctgctacgaaagtgcctcctgcggaataccggctgtgtaatggtagcgataaggagtgcgtttcgcccactgcccgcgttacaaaaaaggagacatag

SEQ ID NO: 198384 - DNA, 420 bp, Artificial Sequence
  Description of Artificial Sequence: Synthetic coding sequence
atgaaggaggaggccttcctgcggcggcggttcagcctgtgccccccctcatccacaccacaaaaggtcgaccccagaaaacttaccagaaatctgcttctgtctggcgataacgagctctacccactaagccctggcaaagacatggaacccaacggcccatcactgcctcgggatgaggggcctcctactccctcatccgccaccaaggtgccgcccgccgaatatcgactttgcaatggctccgataaagagtgcgtgagccctaccgcccgcgtgacaaaaaaggaaaccctgaaagcccagaaagagaactacagacaggaaaagaagcgcgccacgcgtcagttgctgagcgccttgacggaccccagcgtggttatcatggcagatagtctgaagatccgaggtacgctctag

SEQ ID NO: 198385 - DNA, 273 bp, Artificial Sequence
  Description of Artificial Sequence: Synthetic coding sequence
atgaaggaggaggccttcctgcggcggcggttcagcctgtgccccccgtcctctaccccccagaaggtcgacccccgtaagctgactagaaacttgctgttgtctggggacaacgaactttatcctctgtcccctggcaaagatatggagccaaatggaccctccctccctcgcgatgagggtccacccacaccctccagtgccaccaaagtcccaccggccgaatataggctctgcaacggctcagacaaggagtgcgtttctccgacatag

SEQ ID NO: 198386 - DNA, 210 bp, Artificial Sequence
  Description of Artificial Sequence: Synthetic coding sequence
atgaaggaggaggccttcctgcggcggcggttcagcctgtgccccccttcatcaactccccagaaagtcgatcccaggaagttaactcgcaatcttctgctgtctggggacaatgaactctacccactgtctccaggcaaggatatggaaccaaacggcccatctctgccccgagacgaaggcccacccacgccttcctccgcgacgtag

SEQ ID NO: 198387 - DNA, 1299 bp, Artificial Sequence
  Description of Artificial Sequence: Synthetic coding sequence
tacaaccccatcctgggcgagaccttccggtgctgctggttccacccccagacagatagccggaccttttatatcgctgaacaggtctcccatcacccccctgtgagcgctttccacgtgtccaaccgcaaggatggcttctgtatttccggcagcatcactgccaaatcccggttttacggaaactccctgagcgccctgttagatgggaaggccacattgacttttctcaaccgagccgaggattacaccctgaccatgccctatgcccactgtaagggcatactatacggcacaatgaccctcgaactgggcgggaaagtaaccattgaatgtgccaagaacaacttccaagcacagttggagttcaaactgaagccattctttggtggatccacctccataaaccagatctctggtaaaatcacgtctggcgaagaggtgctggctagcctttctggtcattgggacagagatgtattcataaaggaagagggcagtggatctagcgctctgttttggaccccatctggggaggtgcgccgccaacgcctgcgtcagcacacggtcccattggaagagcagacagaattagaatccgagagactttggcagcacgtgacacgtgccatctctaaaggagatcagcacagagcaacacaggagaaatttgcgctcgaagaagcccagcggcagagggcaagagagagacaggaatcattaatgccctggaaaccacaactcttccacttagaccccattacccaggagtggcactaccgctacgaggaccatagtccctgggaccccctcaaggacatcgctcagttcgagcaagatggaatcctacggacccttcagcaggaagctgttgcaagacagactacctttctcggctcccccgggcccaggcacgaaaggagtgggccagatcagcgcttgcgtaaggcttctgaccaaccctccggtcatagtcaggccactgaatccagcggatcgacacccgaatcttgtcccgaactgagtgacgaggaacaagatggagactttgtgccgggaggggaatccccttgccccaggtgccggaaggaggcccgaagattacaagctttgcacgaggcaatcctctccatccgggaggcccagcaggaactgcaccggcatttgtctgcaatgttgagttctacagctcgagcagctcaggcaccgacccctggcttactccagtccccccgctcttggtttctgctgtgcgtgtttctagcctgtcaactgttcattaatcatatcttgaaatag

SEQ ID NO: 198388 - DNA, 1533 bp, Artificial Sequence
  Description of Artificial Sequence: Synthetic coding sequence
atgtgcgtgccccaccggcagggccaccaggagggcgacagccagggcgctgaaggcgagttgccagccggcgaggagccaagatctttcctgaataagctgagcgactactactaccacgcagatttgctgagccgcgcagccgttgaggaagacgcgtatagtcggatgaaactggtgcttcgctggtacctcagcgggttttacaagaaaccaaaggggattaaaaaaccatataatcccattctgggcgagacctttaggtgttgttggttccaccctcaaaccgacagccgaacgttttatatagccgagcaggtctctcatcacccgcctgtgtctgctttccacgtgtccaatagaaaggatggcttctgtatctctggatctatcactgcgaaatctcgtttttatggcaactccctgagcgccctgcttgacggaaaagccactctcacattcctgaaccgcgctgaggactacacattaactatgccgtatgctcactgtaaaggtatattgtacgggaccatgacactcgaactcggaggcaaggttacaatagagtgtgccaagaataactttcaagcgcaactggagttcaagctcaagccctttttcggcgggtctactagcatcaatcagatttcaggtaagattacgtcgggagaggaagtactggcctccctgtcaggacactgggacagagacgtgtttatcaaagaagaaggctcaggaagttctgctctgttctggacaccatctggagaggtccgtcggcaaaggctccgccagcacactgtcccattggaagaacagacagaattggagagcgaacgactgtggcagcacgtgacccgcgccataagcaagggcgaccagcacagggccactcaggagaaatttgcgttagaagaggcccagcgccaaagagcgagagagcgacaagaaagcctgatgccttggaagcctcaactgttccaccttgacccaattactcaggaatggcattaccgctacgaggaccatagcccatgggaccctctgaaggacatcgctcagttcgagcaagacggtatccttagaacgctgcagcaagaggctgtggcacgccaaactacattcctgggcagccccggccctagacacgaaaggtccgggcccgaccaacgtctgcgaaaagcaagcgaccagccttctggccactcacaggccactgagtcttccggcagtacaccagagagttgccctgagttaagcgatgaagaacaagatggagacttcgtccccggtggcgaatcaccctgtccccgctgccggaaggaagccagaaggcttcaggccctccacgaagctatcctgtcgataagggaggcccagcaggagctgcacaggcacttatctgcgatgctttcaagcactgctcgcgcggcacaagccccaactccgggcctgctgcagtcccctaggagctggtttctgttgtgtgtgttcctggcttgtcagttgttcatcaatcatatcctaaagtag

SEQ ID NO: 198389 - DNA, 2805 bp, Artificial Sequence
  Description of Artificial Sequence: Synthetic coding sequence
atgagcagcgacgagaagggcatcagccccgcccacaagaccagcactccaacgcacagaagtgctagtagttctacgtccagccagcgggattctcggcagtcaatccacatattggaaagaaccgcttcatcctcgactgagccttctgtctcccggcaactgctggagcccgagcctgtacccctgagtaaagaagcagactcttgggagataatagaaggcctcaagattggccagactaatgtacaaaagccggacaaacatgaaggatttatgttaaaaaagagaaaatggcctctgaaaggctggcacaaaaggttcttcgtgctcgacaacgggatgcttaaatactccaaagcaccactggatatccaaaaggggaaagtccatggctcaattgacgtcggcttgtccgtgatgtccattaagaaaaaggcaaggcgcatagatcttgataccgaagagcacatctaccatctgaaggtcaagtctcaggactggtttgacgcctgggtctccaagcttcgccaccaccgcctgtaccggcagaatgagatagtgcgctcccctagagacgcaagcttccacatctttccctccacttctactgccgaatcttcgcctgctgctaacgttagcgtgatggacgggaagatgcagcccaattcctttccttggcagagtcctttgccttgtagtaatagtttgccagcgacctgtacgacgggacagagtaaggtggccgcctggctgcaggatagcgaggagatggatcgctgcgcagaggatctggcccattgccagagtaatcttgttgagctctcaaagctgctgcagaatcttgagatcctacagagaacacagagcgctcccaacttcaccgacatgcaggccaactgtgtggacatcagcaaaaaagacaagcgcgtcacaagaagatggaggactaagagcgttagcaaggacaccaagatacagttgcaggtgcctttttctgctacaatgagccccgtccgccttcacagcagtaaccccaacctctgtgcagatatcgagttccagacacctccctctcatttaacggacccactcgaatcatccactgactacaccaagttgcaagaggagttttgtctcattgctcagaaggtgcacagtctgctgaaatccgcatttaattccatcgctattgagaaggagaaactaaaacagatggtttccgagcaggaccattcgaagggtcactctacgcagatggcccgcctacgacaaagcttaagccaggctttaaatcaaaacgcggaactccgctcccgcttgaaccgcatccactccgagagtataatctgcgaccaggttgtatccgtcaacatcatcccatcacctgacgaggcgggcgagcagatccacgtgtctctgcctttgtcacagcaggtcgctaacgaaagcagactctcaatgtcagaatctgtcagcgagttctttgacgcccaagaggttctcctgtccgcttcatcgagcgaaaacgaggcctcggacgatgaatcttatatttctgacgtgtctgataatatttctgaggacaacacctccgtggctgacaacatatcaaggcaaatcctgaatggggagctgacgggcggagctttccgtaacgggaggcgagcctgtctgccagcaccgtgtccggacacatccaacattaatttgtggaatatcctgaggaacaacattggtaaggatctcagcaaagtctcaatgccggtggaactgaacgaaccgctgaatacgctccagcacctttgtgaagaaatggaatactcagagctcttggacaaggcttctgagacggacgatccttacgaacgcatggttctggtggctgcgttcgccgtttccgggtactgctctacatattttagagcggggtccaaaccctttaacccggtgctgggtgaaacttacgaatgcattagggaggacaaaggattccgattctttagtgagcaggtcagtcatcaccctcccatttcggcatgccactgcgagtctaagaatttcgtgttctggcaagatataagatggaagaataaattttggggaaagtccatggaaattctccctgtgggaacactgaatgtaatgctgcctaaatatggagactattatgtgtggaataaagtaacaacttgtatccacaatatcctctccggccggcgctggatagagcactatggcgaggtgaccatcaggaatacaaaatcctctgtatgcatttgcaagctgacatttgttaaagtgaattactggaacagtaacatgaacgaagtgcagggcgttgtgattgatcaggagggaaaagcggtgtaccgtctttttgggaaatggcacgaggggctctactgtggggtggcaccttccgctaagtgtatttggaggcctggtagtatgcccaccaactacgaattatattatgggttcacacgattcgccatcgaactcaacgaactcgatccagtgctcaaggaccttttaccacccacagatgcaaggttccgacctgaccagagattcctcgaggaaggcaatctggaggcagccgccagcgagaaacagagggtcgaagagctccagaggagccgacgccgttacatggaagaaaataacttagaacacatacctaagtttttcaagaaagttattgacgcaaaccagcgtgaagcttgggtgtccaacgacacttattgggagctgcggaaggatccaggattttctaaggtagacagtccagtcctgtggtag

SEQ ID NO: 198390 - DNA, 2817 bp, Artificial Sequence
  Description of Artificial Sequence: Synthetic coding sequence
atgcaccagctgagcctgatccggggcaaccggggccggagcatccacatcctggaacgtacggccagtagctctacggaaccctcggtctctcgtcagttactagaaccggaacctgtgcccttgtccaaagaggcagatagctgggagatcattgagggtctgaagatcggccagaccaacgtgcagaaaccagataaacacgaagggttcatgctaaaaaagaggaagtggccccttaagggttggcacaagcgcttctttgtcttggataatggcatgctcaaatatagcaaggcccctcttgacatccagaaaggtaaagttcacggctcaatcgacgtcgggctgagtgtgatgagcatcaaaaaaaaagctcgcaggattgacttggacaccgaggagcacatataccacctcaaggtgaagagccaggactggtttgacgcgtgggtgtccaagctgcgccatcataggctctaccgccagaatgagatcgtgaggtcacctcgggacgctagttttcacatatttccctccacgagcacagctgagagcagccctgcagccaatgtgtccgtgatggatgggaagatgcagccgaactcatttccgtggcagagccctctaccctgcagcaactcactgcccgccacctgcacaacgggtcagtccaaggttgcagcttggctccaggacagcgaagagatggacagatgcgccgaggacctggcccactgtcagtcaaatctggtggagcttagtaaactacttcagaatttagagattttacaacgcacccaatcagcccctaatttcaccgatatgcaggccaattgcgtcgatattagcaagaaagacaaacgagtgacccgccgatggcgtactaaatccgtgagtaaagatacaaagatccagctgcaggaaggacctccggctaaaggacaattcagcaccacacgccgcagacaaaggctcgcagctgctgtggccactactgtgcctttttctgcaaccatgtcccccgtccgcctccattcctctaatccgaacctgtgtgcggacatcgaatttcagacaccgccctctcacctcactgacccactggagtcttccactgattacactaagctgcaggaagaattctgtctgattgcacaaaaggttcactctctattgaaaagcgcattcaatagcattgccatcgaaaaagaaaagctcaaacaaatggtgtctgagcaggatcactctaaaggccatagcacccagatggcaaggttgagacagagcttgagccaggcactcaatcaaaacgcggagttgcggagccgactcaatcggatccactctgagtccattatttgcgatcaagtcgtaagcgttaacatcattccttcacctgatgaggcgggggaacagatacacgtgtcccttcccttaagtcagcaggtcgccaatgagtctcggttaagcatgtcagaatccgtttcggaattctttgacgcccaggaggtactgctatcagcctcttcctcagagaatgaagcaagtgatgacgagtcttatatctcggacgtttccgataacatttccgaggataataccagtgtcgcagacaacatttcccgtcaaattcttaatggagaactgacaggaggggcttttaggaatgggcggcgggcgtgcctgcccgctccatgccctgatacttccaacattaacctctggaacatcctgcggaataacatcggtaaagacttgagtaaggtgagcatgcctgttgagctgaacgagcctcttaacaccctgcagcacctctgtgaagagatggagtatagcgagctgctggacaaggctagtgagaccgatgatccgtacgaacgaatggtgctggtggccgcgtttgcggtttccgggtactgctctacctatttccgtgcggggtcaaaaccgtttaacccagtcctgggggagacatacgagtgtattcgggaagataaaggctttaggtttttttcagagcaggtgtcccaccaccctcctatcagcgcctgccactgtgagtctaagaactttgtgttctggcaggacattaggtggaaaaacaagttttgggggaagagtatggaaatccttcccgtgggaactttgaatgtgatgctacctaaatacggagattactacgtctggaacaaagtcaccacatgtatccataatattctgtcaggcaggaggtggatagagcactacggcgaggtcacaatccggaataccaaatcgtcggtgtgcatatgtaagctgactttcgtcaaagtgaattattggaattccaatatgaacgaagtgcagggagtcgtcatcgaccaggagggcaaggcagtctatagactgttcggcaaatggcacgagggactctattgtggcgtggccccgagcgctaaatgcatttggagacctggatccatgccaacaaactacgagttatattatggctttacacgatttgccattgagttgaatgaactcgatccggtccttaaggacctcctcccaccaaccgacgcgcgctttagacccgatcagagattcctggaagagggcaatctggaggccgccgcctccgaaaaacagagagttgaggaacttcaaagaagcagacggaggtacatggaagaaaataatctggaacacatcccaaaattcttcaagaaggtgatcgacgcaaaccaaagagaggcctgggtgtcaaatgatacctactgggagcttcgcaaggaccccggattcagcaaagtcgattcgcctgttctctggtag

SEQ ID NO: 198391 - DNA, 2697 bp, Artificial Sequence
  Description of Artificial Sequence: Synthetic coding sequence
atgagcagcgacgagaagggcatcagccccgcccacaagaccagcactcctacccaccggtcagcttctagtagcacgtcctcacagagggattctcgccagtctattcacatcctggagcgtactgcatcaagcagcacggagccaagtgtatctagacagcttctggaaccggagcccgtgccactatcaaaagaggcagattcgtgggaaataattgaaggactgaaaatcgggcagacgaatgtccaaaagcccgataagcacgaagggttcatgctaaaaaagagaaaatggccattaaaagggtggcacaagaggtttttcgtacttgacaatgggatgctgaagtattccaaagctccccttgacatacaaaaggggaaggttcatgggtcgatcgatgtggggctcagcgttatgtccataaagaagaaagcccggagaatcgacttggacactgaggaacacatataccacttgaaagtgaagtcgcaggactggtttgacgcctgggtgtccaaactaagacatcaccggttgtatcggcagaatgagattgttagatcgcctcgggacgcctcttttcacatctttccctcaacatctacagccgagtccagccccgccgccaatgtctcggtgatggacggaaagatgcagcccaattcattcccctggcagagtcctctgccatgcagcaacagtctcccagcaacctgcacaaccggtcagagcaaggtagcggcctggttacaggactccgaagagatggatagatgcgcagaggaccttgctcactgtcagtctaatcttgttgagttgagcaaactcctgcagaatcttgagattcttcagcgcacacagtccgcaccgaacttcaccgacatgcaagctaactgtgtggatatctctaagaaggataagagagtgaccagaagatggagaaccaaatccgtgagtaaggacaccaagattcaactacaagtccctttcagcgctactatgtctccagtcaggttgcacagctccaatcctaacctatgcgcagacattgagtttcagactccaccgtctcacctgaccgaccccctggagtcctctaccgactataccaaactgcaggaggagttctgcctcattgcacagaaggtacacagtctgttaaagtctgcattcaatagtatcgccatcgaaaaggagaagttgaagcagatggtgagcgaacaggatcactctaaaggtcactctacccagatggccaggctcaggcagagcctctcccaagcaggggagcagatacacgtctcactgccattgtcacagcaggtggctaacgagtctagactttcaatgagtgagtcagtaagtgagttctttgatgctcaggaggttctgcttagcgcatccagctcagaaaacgaggcatccgatgatgaaagctatatctcggatgtgtcagacaatatctctgaggacaatacgagtgtggctgacaacatctcacgacaaattctgaatggtgagctcaccggtggagcattccgcaacgggagacgcgcatgcttacccgccccatgtcctgacaccagcaacatcaatctgtggaatatattacgcaacaatattggcaaggacctttcaaaagtgagtatgccagttgagctgaatgaaccgttgaacactctgcaacacttgtgtgaggaaatggagtatagcgagctcctggataaagcttcagagacggatgacccttatgagcggatggtgctggtggcggcgtttgctgtttcaggctattgtagcacatattttagagccggtagcaagcccttcaaccccgtactgggcgaaacttacgaatgtattcgcgaagataaggggtttcgattttttagcgaacaggtgtcccatcaccccccaatcagcgcttgtcactgcgagtctaagaactttgtgttctggcaggacatccggtggaagaacaagttttggggaaaatctatggaaatcctccctgtcgggactctcaacgtgatgctccccaagtatggcgattattatgtgtggaacaaggttacaacatgcatacataacatattaagcgggagaaggtggatcgaacattatggggaagttacaatcaggaacacaaagagtagtgtttgtatttgtaaactgacatttgtgaaggtcaactactggaacagtaatatgaacgaagtacaaggggtcgtaattgaccaggaggggaaggccgtgtatcgactcttcgggaaatggcatgaaggcctttactgcggcgtggccccatctgctaagtgtatttggcggccaggatctatgccgactaactacgaattatactatgggtttactcgttttgcaatagagcttaacgaactagacccagtccttaaggatttattgcccccaaccgatgcacgatttcggcccgaccagcgctttctcgaggaggggaacttggaggccgccgctagcgaaaagcaacgggtggaggagctgcagcggtccaggcggagatacatggaggagaacaatctggaacacatacccaaatttttcaaaaaggtcatagacgccaaccaacgtgaggcctgggtatcaaacgacacatactgggaactgcggaaggatccagggtttagcaaggtcgactcacctgtcctttggtag

SEQ ID NO: 198392 - DNA, 573 bp, Artificial Sequence
  Description of Artificial Sequence: Synthetic coding sequence
atggacggcaagatgcagcccaacagcttcccctggcagagccccctgccttgtagtaattccctacctgccacatgcactactggccagtcaaaggtcgccgcttggcttcaggacagcgaagaaatggaccggtgcgcggaggacctggctcactgccagtccaacctggtggagttatcaaaattactccagaatctcgagatcctgcaaagaactcagagtgcacctaatttcacagacatgcaagccaattgcgtggatatcagcaaaaaagacaagagggtgaccaggaggtggcgcaccaaaagtgtctccaaagataccaagatccaattacaggtcccctttagtgccacgatgagccctgtccggttgcactcgtctaatcctaatctctgcgcggacattgagttccagacaccaccccccaatcactttggcattctgtccgtgctgctgcaaccctattccctgaaaaagaagaagaaaaaaaagaagaaatctacccccagccttgaaagccgtatcaagggagccgaatacaagatccaatccctgacttcgctctag

SEQ ID NO: 198393 - DNA, 2880 bp, Artificial Sequence
  Description of Artificial Sequence: Synthetic coding sequence
atgagcagcgacgagaagggcatcagccccgcccacaagaccagcactccaactcataggtctgccagtagcagtacatccagccagagggacagccggcaatcaattcacatcttggaacgcacggccagtagttccaccgagcccagcgtcagccggcagctgttggagccagagccggttcccctttccaaagaggccgactcctgggagatcatcgagggtctaaaaataggacagacaaacgtccagaaacccgataagcacgagggttttatgctgaagaaacggaagtggcctctgaagggctggcacaaaagattcttcgtcctcgacaacgggatgctgaagtattcgaaagcccctctggacatacagaaaggcaaagtgcatggcagtattgatgtcggactctcggtaatgagtataaagaaaaaggctcggcgcattgacctggacaccgaggagcacatttaccacttgaaggtaaaaagtcaggactggttcgatgcctgggtatccaagctgcgtcatcatagactttacaggcaaaacgagatcgtgcgcagccctcgtgatgcttcttttcacattttcccgagcacaagcactgctgaaagctctcctgcagcgaacgtgtccgtcatggacggaaaaatgcagccaaacagtttcccctggcaaagcccactgccttgctctaatagcctaccagctacttgcaccacaggacaatcaaaagtggccgcctggctccaagactctgaggagatggatcggtgtgcagaagatctcgcccactgtcagagcaacctggtggagttgagcaagctgcttcagaacctggaaatactgcagcgcacccaatccgcgcctaactttacagatatgcaagcgaattgcgtagatatctctaaaaaggataaacgcgtcaccagacgctggagaaccaaatccgtttccaaggataccaagattcagcttcaggaggggccacccgccaagggccagttctccaccacccgcaggcgccagcgactcgcagcggcagtcgcaactaccgtcccattctcagccaccatgtctcctgtacgtttacatagctccaatcccaatctctgcgctgatatcgagtttcagacacctccctcacacctgacagatccacttgagtcatcaactgactacacgaagctccaggaagaattttgtctcatcgcgcagaaagtccattccctgctcaaatcagcatttaattctatcgccattgagaaggagaagctgaaacaaatggtatcggaacaggaccactccaaaggtcatagcacacagatggctcgactcaggcagtcactttcacaggctctgaatcagaacgccgagcttcgcagtcgactgaatagaatccactccgagtctatcatttgtgaccaagtggtgtccgtgaatattatcccgagccctgacgaggcaggggagcagattcatgtaagcctacccttgtcccagcaggttgcgaatgagtcacgtctttcaatgagtgagtctgtttcagagtttttcgatgctcaggaagtcctgctgagtgctagttcgtccgagaatgaagcaagcgacgacgaatcttacatcagtgacgtgagcgacaatatctcagaagataatacctctgtggccgacaacatctctagacagatcttgaatggcgagctgacgggtggagctttccggaacggtcgcagggcttgcttgcctgcgccttgtcccgatacctcgaatatcaacctgtggaacatactgcgcaataatattggtaaggacctgtccaaggtcagcatgcccgtcgagctcaacgaaccactcaacacgctacagcatctgtgtgaagagatggagtattcagagttgttagacaaggcaagcgaaacggatgacccatacgagcggatggtgctggtggccgccttcgctgtctcgggctactgttctacttacttccgggccggctccaagccattcaaccctgtgctaggggaaacatatgaatgtatccgagaggacaagggcttccgattttttagcgaacaggtgtctcaccatcctccaatatctgcgtgccactgcgaaagcaaaaattttgtcttttggcaagatatccgatggaaaaacaaattttgggggaagtccatggaaatactgcccgtgggaaccctaaacgtgatgctccccaaatacggagactattacgtctggaataaggtgaccacgtgtatccacaacatcctgtccgggcgtcgttggatcgaacattatggcgaggttacgatacgtaataccaagagcagtgtctgtatctgtaaactgaccttcgtgaaggttaattactggaactcaaacatgaacgaggtgcagggagttgtgattgatcaggaaggtaaggccgtgtaccgtctgttcggcaagtggcatgaggggttatattgcggagtggcaccttcagcaaagtgtatctggagacctggaagtatgcccactaactatgagttgtactacggttttactcggtttgccatcgagttgaatgaacttgatccagtgctgaaggaccttcttccccctacggacgcccgattccgcccagatcaacgatttctcgaagaggggaatctggaggcggcagcttctgagaagcagcgcgtcgaggaactccagaggtccagaaggcggtacatggaagagaataacctcgagcacataccaaagttctttaagaaggttatcgatgctaatcagagggaagcatgggtcagtaacgatacctactgggagctcagaaaagaccctgggtttagtaaagtggatagtccagtgctgtggtag

SEQ ID NO: 198394 - DNA, 2712 bp, Artificial Sequence
  Description of Artificial Sequence: Synthetic coding sequence
atgagcagcgacgagaagggcatcagccccgcccacaagaccagcacccctactcacaggtccgcgagtagctcaacaagctcacagagggattcccgacaatccattcacattctggagaggactgcgagtagctctacagagccaagcgtgagtcggcagttgttggaaccagaacccgttccccttagcaaagaagccgattcgtgggagatcattgaagggctgaagatcggccagactaatgtgcaaaagccagataagcacgaaggttttatgctaaaaaaacgcaaatggcctctgaagggatggcataagagattcttcgtgctcgataacggaatgcttaagtactctaaggcgcctttggacatacaaaaagggaaggtccacggttctatcgatgtgggcctttccgtaatgagcatcaagaaaaaggcacggcgcatcgacctggataccgaagaacatatttaccatttaaaagtgaagtcccaggactggtttgacgcatgggtatccaaactgagacaccaccgtctatatagacagaacgagatcgtgaggagtcctagagacgcttctttccacatcttcccgagcactagtacggccgaaagctccccggcagcgaatgtgagtgtgatggatggtaagatgcagcccaacagctttccttggcagtcacctctgccttgctcaaacagcctccccgccacttgtaccaccgggcagtccaaagtggcggcttggctgcaggacagcgaggagatggaccgctgcgccgaggacctggcccactgtcagtcaaatctggttgagctgtccaagttgctccagaacctggagattctgcaacgtacccaatctgcacctaattttacagacatgcaggtgcccttctcagctactatgtcgcccgttaggttacacagtagcaaccccaacctgtgcgcagacattgaattccagacgcctcccagccacctgaccgatcccctcgaaagcagtaccgactataccaaactgcaagaggagttctgcctcattgcacaaaaagtccatagccttttgaaatcagcattcaatagtatagccattgagaaagaaaaactgaagcagatggtatccgaacaagatcacagtaaaggtcatagcactcagatggctcgactgcgacagtccttgagccaagctttgaaccagaacgccgaactccggtcgcgcctgaatcgcattcactccgagtctatcatttgcgatcaggtggtgtctgtgaatattattccctcaccggatgaggcaggggaacaaatccatgtcagcctgccactttcccagcaagtcgcgaacgaaagcagactttctatgtcagagtccgtgtcagagttcttcgacgcgcaggaggtgctgttatccgcctccagctcagaaaatgaagcgtctgatgacgagtcttacatcagtgacgtttctgataacatctccgaggacaacaccagcgtggctgacaatatctctcgtcagattcttaacggggaactaactggaggagcctttagaaacgggagacgggcctgtctcccagcaccctgccctgatacctccaatatcaacctgtggaatattctgcgaaacaacatagggaaggaccttagcaaagtctccatgccggtggaactgaacgaaccacttaatactcttcaacatctgtgcgaagaaatggagtatagtgagcttctggataaagcatcggaaactgacgacccttatgaaaggatggtgctggtggccgcattcgccgtctcagggtactgtagtacctactttagagccggaagcaaaccattcaacccggtcctgggggaaacctatgagtgcatccgcgaggacaaagggttccgattcttttcggagcaggtatcgcaccatccaccgatatccgcctgccattgcgagagcaaaaatttcgtcttttggcaggacataagatggaagaataagttctggggaaagtcaatggaaattttgcccgtggggacactgaacgtcatgttacctaagtacggtgattactacgtctggaacaaggtgaccacctgtatccataatattctgagcggccgccgctggattgaacactatggagaggtgactatacgaaacactaagtcttctgtgtgcatatgtaagctgacgttcgtaaaagtgaattactggaattctaatatgaacgaggtccaaggagtcgttatcgaccaggaaggaaaagcagtctatcgactctttgggaaatggcatgaggggttatactgtggcgtggctcctagcgcaaaatgcatctggcgccctggaagtatgccaactaactacgagctgtactatggcttcacacgctttgcaatcgagctcaatgagctggaccctgtgctcaaggacttgctgccccccacagacgcgcgattccggccggatcaacgatttctggaggagggcaatcttgaagccgcagcatccgaaaagcaacgggtagaggagcttcagcgatcaagaagacgatatatggaagagaataatttggagcatatccctaagtttttcaagaaggtgattgacgctaatcagcgggaagcctgggtttcaaacgatacttattgggagcttcggaaagatccaggattttccaaggtcgactcccccgtcctttggtag

SEQ ID NO: 198395 - DNA, 2529 bp, Artificial Sequence
  Description of Artificial Sequence: Synthetic coding sequence
atggacttccaggagcgggacccccccttcctgcccgagagcgcccagtcctccaagccctcaagcgcccagcaggcttcggagttatgggaagtggtcgaggaacctcgcgtccgcctgggaaccgagggtgtaatgcccgagagacaggagggacacttgttgaagaagcggaagtggcccctgaagggctggcataagcggtattttgtactggaggatggaattctgcactatgctacaactcgccaggacataacaaagggtaagttacatgggagcatcgacgtgagactttcagtgatgagcattaataaaaaagctcagcgcatcgacctcgacaccgaggacaacatctaccacttgaagattaaaagtcaggatttgtttcagagctgggtcgcccaactgagagctcaccgactggcacaccggttggatatgcctcgagggtccttgccttcaacagcacaccgtaaggtgcccggggcacagctacctaccgcagctactgcgtcagctctaccaggtttaggcccacgggagaaggtgtcgtcgtggcttagggattcggatggcctggaccgttgctcgcatgaactgtccgagtgtcaggggaaactgcaagaactccacaggttgctccagtccctcgaaagcctgcacaggatcccttctgcccccgtgattcccacgcaccaggcctctgtaacaacagagcggcccaaaaaaggaaagagaacctcacgaatgtggtgtactcagtcttttgcgaaggatgacacaattggtagagtgggcagactgcacgggagtgtcccgaatctctcacgctacctggagagtcgtgattccagcgggacgcggggtctgcctcctactgactacgctcatctgcagcggtccttttgggccttggcccagaaggttcactcatcgcttagcagcgtgctggccgcactcaccatggagcgcgatcagctcagagatatgcaccaaggtagcgaactctcccgcatgggggtgagcgaagcttcaaccggacagcgacggttgcatagcctgtccacgtctagtgacactaccgccgactcgtttagctcccttaatcctgaagaacaagaggccctttatatgaagggccgggagctgaccccccagctgtcccagacttcaatcctgtctctggcagactcgcataccgagttcttcgacgcctgcgaggtgctgcttagcgcctcatccagcgagaatgaaggctctgaggaagaggagagttgcacttccgagattactaccagcctcagcgaggagatgctggacttaaggggtgcagaaaggtgtcaaaaaggagggtgtgtgccaggtcgacctatgggcccaccacggcgacgatgtctgcccgcagccagcgggccaggcgccgatgtatccttatggaatatcctcagaaacaatatcggaaaggacttgtcgaaagtctcaatgcctgtgcagctgaacgaaccgcttaataccctacagagattgtgtgaggaactagagtattcttctctgttagatcaggctagtcgcatcgccgatccatgcgaacggatggtgtatattgccgcgtttgctgtgagtgcctatagctcaacttaccacagggctgggtgcaagccgtttaatcctgtactgggagagacctatgagtgcgagcgccccgacaggggcttccggttcatatccgagcaagtaagtcatcatcctccaatctctgcctgccatgcagagtccgagaactttgccttttggcaggacatgaaatggaaaaacaaattttgggggaagagtcttgagatcgtgcccgtgggtactgttaatgtcagcctgccccgttttggagatcacttcgaatggaacaaggtaacaagctgtatccataacgtgttgagcgggcagaggtggatcgagcattacggggaggtgttaatccggaacactcaagacagcagctgtcattgtaaaattacattttgcaaagcaaagtactggagttccaatgtacacgaagtgcagggcgctgtcctctcccggagtgggagggttctacaccgactttttggaaagtggcacgagggactttaccggggaccaacccccggaggacaatgtatctggaagcctaactccatgccaccagatcacgaacgtaattttggattcacacagttcgccttggaactgaacgagttgaccgccgagttaaagcggagtttaccctctaccgacacacgactacgccctgatcagcggtacctggaggaaggaaacatccaagccgccgaagcacagaagcggcgtatcgagcagctacagagggacagacggaaggtaatggaggagaataacatcgtccatcaagcacgatttttcaggaggcagaccgattcatcaggaaaggagtggtgggttaccaataatacctattggagactacgcgccgaaccgggctacggcaatatggacggagccgtactttggtag

SEQ ID NO: 198396 - DNA, 2529 bp, Artificial Sequence
  Description of Artificial Sequence: Synthetic coding sequence
atggacttccaggagcgggacccccccttcctgcccgagagcgcccagtcctcgaagccctcctccgcccagcaggcctctgaattgtgggaggtagtggaggaaccacgggtgcggctcgggaccgagggcgttatgcccgagagacaggaaggccatctgctcaagaagagaaaatggcccctgaagggctggcacaaacggtatttcgtattagaggatgggattctacactatgccactactaggcaggacattactaagggaaaactacacggatctattgacgtccgtttatccgttatgagtattaataaaaaggcccagagaatcgaccttgacaccgaagataacatctaccatctcaagataaaaagtcaggacctcttccagtcctgggtcgcccagctgcgtgcccatcgtctggcacaccgattagacatgccgaggggttccctcccttcaacggcacaccgaaaagtacctggggctcagctgccaactgcggcaacagcctccgctctaccaggcctcggtccaagagagaaagtaagctcatggttgcgcgacagtgatggattggatcggtgttctcacgagctctctgagtgtcaaggtaaattgcaggagctccaccgtctgttgcaaagcctggagtcactgcaccgcatcccgtcggcgccagtaatccctacacatcaggcaagtgtgaccactgagcggcccaagaaaggaaaaagaacctctagaatgtggtgtacccagtcttttgcaaaagatgacacgataggaagggtgggacgccttcatgggtctgtcccaaatctctccagatatctggagagccgcgactcaagtgggactcgcggcttacccccaactgactacgcccatctgcagaggagtttctgggcactggcgcaaaaggtgcattctagcctgtctagcgtactggcggccttaaccatggagagggatcagcttagggatatgcatcaggggtcagagctgagcagaatgggagtttccgaagcatccacgggccaacgccgtctccatagcctgagcacttcttctgacacgactgctgactcctttagcagcttaaatcctgaggagcaagaagcattgtacatgaaaggacgggagctcactcctcagctgtcgcagacctccattctgtctctggcagattcccacactgagttcttcgatgcatgtgaggttctgctctcagcctctagctcagaaaacgagggaagtgaagaggaagagtcatgcaccagcgagatcacgacatccttgtctgaggagatgctggaccttagaggggctgaaagatgccagaagggcggttgcgtccccggaagaccgatgggccctcctcgccgccggtgtctccctgcagccagtgggcccggtgccgacgtgtccctatggaacattctgcggaacaatatagggaaggacctgtcaaaagtgtctatgcctgttcagttaaatgaaccgcttaacactctgcagcgtctgtgtgaggagcttgaatatagcagcttgctggaccaagcttccagaattgcggatccttgcgagcgtatggtgtatattgccgcctttgccgtgagtgcatacagttctacttatcacagggctggctgcaaacccttcaatccggtgctgggggagacatacgagtgcgagagacccgatcgaggcttccgctttatcagcgagcaggttagccatcatccccctatctccgcctgtcacgcagagagcgaaaacttcgctttttggcaagatatgaagtggaagaacaaattctggggaaagtcccttgagattgtcccagtaggaactgtcaatgtttctctcccacgtttcggcgatcattttgagtggaacaaggtcacctcttgcattcacaacgttctttcaggacagcgttggatcgagcactatggcgaagtgttaatacggaatactcaggatagcagttgtcactgcaagatcactttctgcaaggccaaatattggtccagcaacgtgcatgaggtgcagggcgccgtgctgtccagatcagggagggtcctgcaccggctgttcggcaagtggcatgagggattataccgaggcccaactcccggcggacagtgtatctggaagccgaacagtatgcctcctgaccatgaaagaaacttcggattcactcagttcgctctggagctgaacgaacttacggccgaactcaagcgcagtctccctagcacagatacaaggctccgtccagaccaacgatatcttgaagagggcaacatccaagcagctgaggcacagaagagaaggatcgaacaattgcagcgtgaccggcgcaaggtgatggaagaaaacaacatcgtacaccaggccaggtttttccgcagacaaaccgacagtagcggaaaagagtggtgggtcacaaacaatacgtactggcggctgcgtgcggaaccaggctacggcaatatggatggtgcagttctttggtag

SEQ ID NO: 198397 - DNA, 2670 bp, Artificial Sequence
  Description of Artificial Sequence: Synthetic coding sequence
atggagggcggcctggccgacggcgagcccgaccggaccagcctgttgggggactcaaaggacgtcctgggcccatcgaccgtggtcgccaactccgacgagagccaattgctgacccctggaaagatgtctcagaggcaaggcaaggaggcttatcccacacctaccaaggaccttcaccagccaagtctctccccggcaagcccacactcccagggcttcgagcgaggaaaggaggacatatcccagaataaggatgagtcaagtctcagcatgtccaaatcaaaatctgaatccaaactttacaatggcagtgagaaggatagtagcacatctagcaaactgactaagaaagagagtctgaaggtccaaaagaaaaattatagagaggaaaagaaacgcgctaccaaggaactgctttcgaccattacagacccgagtgtgatagtaatggcggattggctgaaaatccggggtacgctgaagtcgtggactaaattgtggtgtgtacttaagccgggggtactcctaatttacaaaacacagaagaacgggcaatgggtgggcacagtcctgctgaacgcttgcgagattattgagcggccaagcaaaaaggatggcttctgctttaagctcttccaccccctagagcagagcatttgggccgtgaagggcccgaagggggaagcagtggggtccatcacacagccactcccttcaagttatttgattataagagcaactagcgaatctgatggaaggtgctggatggatgccttggagttggctttgaagtgttcctccctgctgaagcggactatgatcagggagggtaaagagcacgacctgagcgtgtcgagcgactccacacatgtcaccttctacggactgctgagggccaacaacctccattcgggcgataactttcagctgaacgatagcgagatcgaacgccaacatttcaaagaccaggacatgtacagcgataagagcgacaaagagaatgatcaagagcacgacgaatcagataacgaagtcatgggcaagtccgaagagagcgacacagatactagtgagagacaggacgattcttacatagagcccgagccggtagagcccctgaaagagacgacctacacagaacagagtcatgaagaactgggcgaggcaggcgaagcctcccaaaccgagaccgtcagcgaagagaataaatccctcatttggacactattaaagcaggtgagaccaggaatggacctgagcaaggtggttctgccgacgttcattttggaacccaggtcttttttagacaaattgtcggactactactatcacgcagacttcttgagcgaagcggccctggaggagaacccatatttcagactgaaaaaggttgtgaagtggtatctgtcaggcttttacaagaaaccaaaaggactgaagaaaccatataacccaatcctgggagaaacattccgctgtctgtggatccacccacgaaccaattctaaaacattttatatcgccgagcaggtgtcacatcacccccccattagcgcattttatgtgtctaatcggaaggacggcttctgtttgtcagggtctattctagcgaagtccaagttctacggcaattctttgagtgcaatactggaaggcgaggcccggctgaccttcctcaacaggggagaggattacgtcatgaccatgccatacgcccattgcaaaggtatactgtacggtacgatgacactagagctgggtggaaccgtcaatatcacctgccaaaagacaggttactctgccattctggagtttaagctgaagccatttttaggctccagtgattgtgttaatcagatcagcggcaagctcaagttagggaaggaagtcctggccacactagaaggccactgggattcagaggtttttatcaccgataaaaagaccgacaactcagaggtgttctggaatccaacccctgacatcaagcagtggcgattgataagacatacagtgaagttcgaagaacaaggcgattttgagagcgaaaaactatggcagcgtgtgacccgtgctatcaatgccaaagaccagacagaggcaacacaggaaaaatatgttctggaggaagctcagcgtcaggcagcacgagatagaaagacaaaaaatgaggagtggagttgtaagctgttcgagctagatccactcaccggggaatggcactataagttcgccgatacccgtccctgggaccctctgaacgatatgatccaatttgaaaaggacggcgtcatccaaacaaaggttaaacacaggactccaatggtctccgtcccaaaaatgaaacacaagccaactagacagcagaagaaggtagctaagggctactcctcccccgagccagatattcaggactcttcaggatcagaagctcagtctgtcaagccgagcacacgccgcaaaaagggcattgagcttggggatattcagagcagcatcgagtcaatcaaacaaacgcaggaagaaatcaaacggaatatcatggccctgcgcaatcatctggtttccagtactccagctacagattatttcctccaacagaaagactattttatcatctttctcttgatcctgctccaagttatcatcaatttcatgttcaagtag

SEQ ID NO: 198398 - DNA, 2544 bp, Artificial Sequence
  Description of Artificial Sequence: Synthetic coding sequence
atgagccagcggcagggcaaggaggcctaccccacccccaccaaggacctgcaccagcctagcctatcaccagctagcccacactcccaggggttcgaacggggtaaagaggacatcagccagaacaaggatgagagctccctgagtatgtccaaaagtaaaagtgagtccaagctgtataatgggagcgagaaggatagtagcacctcttcgaagctcaccaagaaggagtccctaaaagtgcaaaagaagaattatcgcgaggagaaaaaacgcgccactaaagaactgttatcgacaattaccgatccctccgttattgtgatggcggactggctgaagattagggggactctgaaaagttggacgaaattatggtgcgtgctgaagccaggggtgctcttaatttacaagactcagaagaatggccagtgggtcggaacggtgcttctgaatgcatgcgagattatcgagaggccttctaagaaagacggcttttgctttaagctgtttcacccccttgagcagtctatctgggctgtgaagggccccaaaggcgaggctgttggttcaattacacagccactgccttctagttacttaatcatccgagccacgtccgagagtgacggaagatgttggatggatgccctggaactggctcttaagtgcagctccctcctcaagcgcaccatgatccgagagggtaaagagcatgatttaagcgtgtcctcagattcaactcacgtcactttctacggactgcttcgcgcaaacaacctgcattctggggacaatttccaattgaacgacagcgaaattgagcgtcaacactttaaagatcaggacatgtacagcgataaaagtgacaaggagaatgaccaagaacacgatgagtcggacaacgaggtgatgggaaaatccgaggagtctgacaccgacaccagcgagagacaggatgatagttatatcgagcctgaacctgtcgaacccttgaaggaaaccacatacacagaacagtctcatgaggagctcggggaggccggagaagcttctcagaccgaaacagtctctgaggaaaataaatccttaatttggaccctgctgaaacaagttagacctggtatggacttgtcgaaagtagtactcccgactttcatactggaaccaaggtcctttctggacaagctatcagattactactatcatgcagatttcctctctgaggctgcactggaagagaacccctactttagactcaagaaggtggttaagtggtatctcagtggtttttataagaaaccaaagggacttaaaaaaccttataaccctattctaggagaaacctttcgatgcctgtggattcatccccggacaaatagcaaaacattctacattgctgaacaggtgtcgcaccatccgcctataagtgctttttacgtgtctaaccgcaaagatggcttttgcctttccggatccatcctggccaagtcgaagttttacggcaattccctttcggccatactcgagggcgaagctcggcttaccttcttgaacaggggggaggactacgtgatgacaatgccctatgctcattgcaagggcattctgtatggtacgatgaccctcgagttaggtggtactgtgaatatcacctgccagaagactggctactccgccattctggaatttaagcttaagccattcctgggatcctcagattgcgtgaaccagatcagcggaaagctgaagctcggcaaggaggtcctggctactcttgaagggcactgggacagcgaagtattcattactgacaagaagacagacaatagtgaggtattttggaatcccaccccggacatcaagcagtggcgcctgatccggcacaccgtcaaattcgaggaacagggagacttcgagtctgaaaaactgtggcagcgcgtgacccgcgcaattaatgcgaaggaccaaacagaagccactcaagagaaatacgtcctcgaggaagcgcagcgccaagcagctcgcgacagaaaaacaaagaacgaagagtggagttgcaaactcttcgaattagaccctctcacaggggaatggcattacaaattcgctgacaccagaccgtgggaccccctaaatgacatgattcaattcgagaaggacggagtgatacagaccaaagtcaagcacaggactcctatggtcagcgtgcctaagatgaaacacaagcccacacgacagcagaaaaaggtagctaaggggtactctagtcccgaacccgatattcaggactcgtccggctcagaggcccagagcgtgaaaccctcaactaggaggaagaaagggattgaactcggcgacattcagtcttccatcgaaagcattaagcaaacccaggaggaaattaagaggaatattatggcactccggaaccatctcgtgtctagcacaccagccaccgattattttttgcagcaaaaagactactttatcattttcctactcatcctgctccaagtgatcatcaatttcatgttcaaatag

SEQ ID NO: 198399 - DNA, 2544 bp, Artificial Sequence
  Description of Artificial Sequence: Synthetic coding sequence
atgagccagcggcagggcaaggaggcctaccccacccccaccaaggacctccatcagccttccctttctcctgcctcccctcacagccaagggttcgaaaggggaaaagaggacatcagccagaataaggatgagtcaagcctttccatgagcaagtcaaagtctgagagcaagctatacaacggatccgaaaaagactcgtcgacgtcttcaaagttgacaaagaaggaaagtcttaaagtacagaaaaagaactacagagaggagaaaaagagagcaaccaaagagctgctttctacaatcacagatccatccgtgattgtgatggcagactggttgaagatacggggaacgcttaagtcttggaccaagctgtggtgtgttctgaagcccggagtgctgctgatttacaagactcagaaaaacggccagtgggttggcactgtgctcctgaatgcctgtgaaatcattgaaagaccatcaaagaaggatggcttttgcttcaagttgttccatcctctggaacaaagcatctgggccgtcaaaggccctaaaggtgaggccgtgggttcaatcacacagcctctccccagtagctacctgattatcagggccacatccgagagcgacgggaggtgctggatggatgctctggaactcgccctcaagtgctcttccctgctgaagagaactatgataagggagggcaaagaacatgatttatcggtatcctctgattccacccacgtgacattctacgggcttttaagagctaataacctgcatagcggtgacaatttccagctgaatgacagcgagatcgaacggcagcactttaaagatcaggacatgtactccgataaatcggataaggaaaatgaccaggaacacgatgaatccgataacgaagtaatgggcaaatccgaggagtccgatacggacactagcgagagacaggatgattcctacattgagcctgagccagtggagcctctgaaggagacaacctacactgagcagagccacgaggagctgggagaagctggcgaagccagccagaccgaaaccgtgagcgaggaaaacaaaagtctgatctggactctgctgaaacaagtcaggcccggcatggatctgtctaaggtggttctgcctacattcatcttagaaccgcggagcttcctggataagctgagcgattattattatcacgccgatttcctgtctgaggccgcacttgaagagaatccgtatttccgtcttaagaaagttgtcaaatggtatctgtccggcttttacaagaagcctaagggactgaagaagccgtacaatccgattcttggcgagacatttcggtgtttatggattcacccccggaccaactctaagaccttctacatagccgagcaggtctcacaccacccacccatctctgcattttacgtttctaaccggaaagatggattttgccttagcggttccatcctggccaagagcaagttctacggcaattccctttcggcaattctcgaaggggaggctcggcttacattcttaaacaggggggaggactacgtaatgactatgccctacgcacattgcaaaggaatattgtatggtacaatgaccctcgagttaggtggcacagtcaacattacatgccagaaaacaggttactccgcaatcctggaatttaagctaaaacccttccttgggagcagtgattgcgtcaatcaaatctccggtaagttaaaactcggaaaagaggtcctggccacactggaagggcactgggacagcgaagtgttcatcactgacaagaagactgacaatagtgaggtattctggaatccaacccctgatattaaacagtggcgtttgatccgccatacagtcaagtttgaagaacagggagacttcgagtcagagaagctgtggcagcgcgttacccgggcaattaatgctaaagatcaaacagaggctacacaggagaaatatgttcttgaggaggcccagcgtcaggcagctcgcgacaggaagactaagaacgaagagtggtcatgcaaactcttcgaactcgaccctctcaccggagagtggcactataagttcgccgatacacggccctgggacccactgaatgacatgatccagttcgaaaaggatggagtcatccaaaccaaagtcaagcacagaacccctatggtgtcagtaccgaagatgaagcacaagcctactcgtcaacagaagaaagttgctaagggatacagctccccggagcctgatatccaagattcatcgggcagtgaggctcagtctgtgaagccctctacacggcgcaaaaagggaatagaactgggtgatatccaatcatcaattgaatctattaagcagacacaggaggaaatcaagagaaacattatggccctgcgcaatcaccttgtgtccagcaccccagccacggactactttttgcagcagaaggattatttcatcatttttctccttatactgctgcaagttataattaacttcatgtttaaatag

SEQ ID NO: 198400 - DNA, 2187 bp, Artificial Sequence
  Description of Artificial Sequence: Synthetic coding sequence
atggagggcggcctggccgacggcgagcccgaccggaccagcctgttaggagacagtaaagatgttctggggccttccaccgtggtggcgaatagtgacgaaagccagctgctcacccctgggaaaatgtctcagcgccaaggcaaagaagcctatcccaccccaaccaaagacttgcatcaaccatctctaagtccagcgagtccccactctcagggctttgagagaggcaaagaagatatctcccagaataaagacgaatcttcgctctctatgtccaagagcaagagcgagtcaaagctttataatggctccgagaaggactctagcactagtagcaaactcaccaagaaagaatcccttaaggtgcagaaaaagaactacagagaagaaaagaagcgcgctactaaagaactcctgtcaactattaccgatccctcggtcattgtcatggctgactggttgaaaatcagagggacccttaaatcttggaccaaactttggtgtgtcttgaagcccggcgtcctgctgatatataagacacagaaaaacggccagtgggtgggaacagtgctgcttaacgcgtgtgaaatcattgaacgtccgtccaagaaggacggtttctgctttaagctttttcacccactggaacagtctatctgggcagtgaagggccccaagggtgaggctgtcggcagcatcactcaacctctcccctcctcatacttgattattcgcgcgacctcagaatctgatggtcggtgctggatggacgcactggaactggccctgaagtgctccagcctgctcaagcgcacaatgatcagggaggggaaagagcacgatcttagcgtgagttcagactctacccacgtgactttttacgggctcttacgcgccaataatctccactccggagacaactttcaactgaacgatagcgagattgagagacagcatttcaaagatcaagatatgtacagcgacaaatcagacaaagagaacgaccaggaacacgacgagtccgacaatgaggtgatgggcaagagcgaagagagcgatactgacacctctgagcgccaggacgactcttacatcgagcccgagcctgttgagcctttgaaggaaactacctacaccgagcagtcccacgaggagctgggtgaagctggagaggccagccaaactgagaccgtttccgaggaaaacaagtccttgatctggaccctgttgaagcaggtgagacctggaatggacctgagcaaagttgttttgcctacattcatactggagccccggtcttttcttgataagctctctgattactattatcatgctgacttcctctcagaagcagcacttgaagagaacccttactttagactcaagaaggttgttaaatggtatctaagtggcttctacaagaaacccaagggcctcaagaaaccgtataatcctatacttggtgagactttccggtgtctgtggatacatccaaggacgaatagtaaaactttttacattgctgagcaagttagtcaccacccacccatttctgcgttttacgtaagcaacagaaaggacggcttttgtttgtccggctccatccttgcaaagagcaaattttacggcaattcactctcagccattctggagggcgaggcacggctgacctttttaaaccggggggaggattacgtcatgaccatgccgtatgctcactgtaaaggtatactatatgggacaatgaccctggaacttggaggaactgtgaacatcacttgccagaaaaccggatatagtgcaatactcgaatttaaactgaaacccttcctaggatctagcgactgcgtcaatcagattagcggaaagctcaagctaggcaaggaagtgcttgccaccctcgagggccactgggatagcgaagtgtttatcacagacaaaaaaacagacaattctgaggtgttttggaatccgactcccgacataaaacagtggaggcttatcagacatactgtgaaatttgaggaacagggcgattttgaaagcgagaaactttggcagcgcgtgacaagagcaattaacgcaaaagaccagaccgaagcaacccaggagaagtacgtgctggaagaggcacagcgacaggccgctcgggataggaaaacaaaaaatgagaagaagaagtag

SEQ ID NO: 198401 - DNA, 2625 bp, Artificial Sequence
  Description of Artificial Sequence: Synthetic coding sequence
atggagggcggcctggccgacggcgagcccgaccggaccagcgccaatagcgacgagtctcagctgctgacacctggtaagatgtcgcagagacaagggaaagaagcttatcctacgccaacaaaagacctgcaccaaccaagtcttagccccgccagcccccactcccagggattcgaacggggtaaggaagatatatctcagaataaagatgagtctagcttgtccatgagcaagtccaaaagcgaatctaagttatataacgggtccgagaaggatagttcgaccagcagcaagttaaccaagaaagaatcgcttaaagttcagaagaagaattacagagaggaaaaaaagcgggccacgaaagaacttctgtctacaatcacggacccgtctgtaatcgtgatggccgactggctcaagatccgtgggactctgaagagctggacaaagctttggtgcgttctgaagccaggagtgctcctcatatacaaaacgcagaagaatgggcagtgggtcggaacagtgctcctcaacgcttgcgaaatcatagaacggccaagtaagaaagacgggttttgcttcaaattgtttcaccccctggagcaatccatatgggccgtgaagggccctaagggggaagcagtgggatccattacacagccactcccttcatcctaccttatcatccgcgccacttcagagagcgacgggcgctgttggatggatgctcttgagcttgcactgaaatgcagcagcttgttgaagcgcacgatgattagggagggcaaggaacatgacttaagtgtgagtagtgacagtacccacgtaaccttctatggactgttgcgagccaacaacctacacagtggagataactttcagcttaatgactctgaaattgagagacagcatttcaaggatcaggatatgtacagtgacaaatccgataaggagaacgaccaggaacatgacgagagcgacaatgaagtgatgggaaagagtgaggagtccgacactgacacaagtgagcggcaagatgactcctacatcgagcctgaaccggttgagcccttaaaggaaactacgtatacggagcagtcccacgaggagctgggggaagcgggtgaggcctcccagacagaaacagtgagtgaggaaaacaagagcttaatctggacattgctaaagcaggttaggcctggaatggatctgtcaaaagttgtcttgccgaccttcattcttgaaccacgatcattcctggataaactgtccgactactattaccatgccgatttcctgtctgaagctgcactggaggagaacccatatttccgtctgaagaaggtcgttaagtggtatttgtccggcttttataaaaagcctaagggcctgaaaaaaccctacaacccaattctgggggagaccttcaggtgcctatggatccacccccggacaaactccaaaactttttatatcgccgaacaggtctcacaccatcctcccatatctgctttttatgtgtccaacaggaaagatggattttgcctatccggaagcattctggccaagtctaagttctacgggaacagtctgagcgctattttagagggggaagcacggctcaccttcctgaatagaggggaggactatgtcatgacaatgccctacgcgcactgtaaaggtatcctctacgggacaatgacactcgagctcggcggtaccgttaatatcacttgccagaagactgggtactcagccatcctggagtttaaactgaagccgtttttgggctccagtgattgcgtgaaccagatctcaggtaaactgaaactcggcaaggaagtattagcaactcttgaaggccattgggattcggaggtcttcatcacagacaaaaagactgataactctgaagtgttctggaaccctacacctgacattaaacagtggaggcttatcaggcacacggtgaagtttgaagagcagggggacttcgagagcgagaagctgtggcagagggtcacgagggctataaatgctaaagaccaaacagaggctacccaggagaagtacgtactggaggaagcgcagcgccaggcagcaagagaccggaagacgaaaaacgaggagtggtcctgcaagctctttgaactcgatccactgactggcgagtggcactataagttcgcagacaccaggccgtgggaccccctgaatgacatgattcagtttgaaaaggatggtgtgatccagacaaaggtcaagcaccggaccccaatggtgtccgtacctaagatgaaacacaagcccactaggcagcagaaaaaggtggccaagggctactcctcaccagagcctgatatccaagactccagtggctccgaggcacagagcgtgaaacctagtacccgaagaaaaaaggggatcgagcttggagacatccagagctcaatcgaaagtatcaaacagacacaggaggagattaagcgcaacatcatggcattacgcaaccacctggttagcagcactcccgccaccgactactttctgcagcaaaaagattacttcattatatttcttcttatactgctacaggtcatcattaactttatgttcaagtag

SEQ ID NO: 198402 - DNA, 162 bp, Artificial Sequence
  Description of Artificial Sequence: Synthetic coding sequence
atggagggcggcctggccgacggcgagcccgaccggaccagcctgcttggagattccaaggacgtgctaggaccaagcacgaatagtgatgaatcccagctgctaacgccaggcaaaatgtctcagagacagggaaaagaagcctacccaacacccacatag

SEQ ID NO: 198403 - DNA, 231 bp, Artificial Sequence
  Description of Artificial Sequence: Synthetic coding sequence
atgagccagcggcagggcaaggaggcctaccccacccccaccaaggacctgcaccagccgagtttgtcacccgcctctccccatagccagggcttcgagcgtggaaaagaggacatctctcaaaacaaggatgagtcatcattatcaatgtccaaatccaaatctgaatctaaactatacaacggctccgagaaagattcctccacatcctctaagctaacgaagaagtag

SEQ ID NO: 198404 - DNA, 177 bp, Artificial Sequence
  Description of Artificial Sequence: Synthetic coding sequence
atggagggcggcctggccgacggcgagcccgaccggaccagcctgttgggagacagcaaagatgtgcttgggccgagcactgttgttgccaattctgacgaaagccaattgctgactccagggaagatgtcccagagacaggggaaggaagcttacccgactcctacaaaagattag

SEQ ID NO: 198405 - DNA, 336 bp, Artificial Sequence
  Description of Artificial Sequence: Synthetic coding sequence
atgagccagcggcagggcaaggaggcctaccccacccccaccaaggatcttcatcagcctagtctgtcccccgccagcccccactctcaagggtttgaaaggggcaaggaggatatttcccagaataaagatgagagctccttatcgatgtccaaatcaaaatccgagagtaaattgtacaacggcagtgagaaggactccagcaccagtagtaagcttacgaaaaaagaatctctgaaggttcagaaaaagaactatagggaagagaaaaagcgggcaaccaaggagctgctctccaccattacagatccatccgtcatcgtgatggctgactag

SEQ ID NO: 198406 - DNA, 2226 bp, Artificial Sequence
  Description of Artificial Sequence: Synthetic coding sequence
atgccctaccggcgggtgaccagcggccggctgctgagcctggccgcgcctaagatggcctctatcatggagggtccactctctaaatggacaaatgttatgaaagggtggcagtaccgttggttcgtgctggactataacgctgggttgctatcatactatacaagcaaggacaagatgatgcgcgggtcccggcggggctgcgtccggctgcggggggctgtgataggaatcgacgacgaggacgacagcaccttcacaattacggtggaccagaaaaccttccactttcaggctagggacgcggacgaaagagagaagtggatacatgccctggaggaaacgattcttcgtcacacactgcagttgcagggactggatagtgggtttgttccatcggtgcaggacttcgataaaaaattgacagaggctgacgcttatctgcaaatcttgattgagcagttgaagctcttcgatgacaagttgcaaaactgcaaagaagacgaacagcgcaaaaaaattgaaacgcttaaagagactacaaactcaatggttgagagtataaaacactgcatcgttctgctccagatagcaaaatctacgattaaccctgtcgacgctatttaccagccaagtccccttgagccagtcatctcaaccatgcccagccagaccgttttaccacccgaaccagtccagttatgcaagtcagaacagcgaccgagcagtctaccagtcgggcccgtcctggccacactgggtcatcatcagactcccactccgaatagcaccggttccgggcatagccccccaagcagttccctgacatcaccatctcatgtcaacctttcaccaaacactgtcccggagtttagttattctagctctgaggatgaattctatgacgctgatgaattccaccagagtggatctagtccaaagcggctgattgatagcagtggctccgcttccgtgcttacccattcatcgtccggaaattcactgaagcgccccgataccactgaatctctcaatagtagcttgtccaatggaacgtccgatgcagacctctttgacagccatgatgatagggatgatgatgcagaggctggatccgtggaggagcataaatcagtcataatgcacctgctctctcaggttcgcctggggatggatctgaccaaagttgttctgcctacctttattttagaaaggcgctctttattggaaatgtatgccgacttctttgcccacccagatctgttcgtctcaataagcgaccaaaaagaccctaaggatcgcatggtgcaggtcgttaagtggtacctgtcagcctttcatgccggccgcaaaggatcggtcgccaaaaagccatacaatcccatattgggcgagatttttcagtgccactggaccctgccaaatgacaccgaggaaaacacagaattggtgagtgaggggcctgtgccttgggtcagtaaaaacagcgtgactttcgttgctgagcaagtatcacaccaccctcccatatctgccttttacgccgagtgctttaacaaaaagatccagttcaacgcccacatttggacaaagtcaaagttcctggggatgtccatcggcgtccacaatattggccagggctgcgtgagctgcttggactatgatgaacactatattctcactttcccaaacgggtatggccgatctattctgactgtcccatgggtggagctcggcggggaatgcaatatcaattgtagtaaaaccggctattctgccaatatcattttccacactaaacctttctacggtggcaagaaacacaggatcaccgccgaaatcttctcacccaacgacaaaaagagcttctgttctattgagggcgagtggaatggcgtgatgtacgcgaagtacgctacaggagagaatactgtgttcgtcgatactaagaagctgccaataattaagaaaaaggtaagaaagctggaggatcagaacgagtatgaatcacgttccctatggaaggatgtcaccttcaatttgaaaattcgggatattgatgccgctactgaagcgaagcatcgattagaagaaagacaaagagccgaagcaagggaacggaaggagaaagagattcagtgggaaacccgcctcttccacgaagacggcgagtgctgggtgtacgatgaacccctcctgaagcgcctaggagcagccaagcattag

SEQ ID NO: 198407 - DNA, 1881 bp, Artificial Sequence
  Description of Artificial Sequence: Synthetic coding sequence
atggccttcctgctggccacctgcggcggcctggacagcggcttcgtcccatccgtccaggatttcgataagaaactaactgaagccgatgcttatctccaaatcctcatcgaacagttgaagcttttcgacgataagctacagaattgcaaggaggatgaacaaaggaaaaagatagagacccttaaagagacgaccaactccatggttgaatccataaaacactgtattgtattgttgcagattgcgaagtcgaccatcaacccagtggacgctatctatcagccgtcccccctggagccagtcatttccactatgccgtcccagactgtcttgccacccgaacctgtccaattgtgtaagtcagaacagcgcccaagttccctgcccgttggtccggttctggccacgctgggccatcaccagacccccacccctaattccacaggctctgggcattcccccccgagcagctctctcacgagcccctcccacgtaaatctgagccccaacacggtgccagagttctcttatagttccagtgaagacgaattttatgatgccgatgagtttcaccagtctggatcaagccctaaaagacttatcgactctagcggttcggcctcagtgttgactcactccagttccggaaactcgttgaagcgcccagacactaccgagagcctgaactcctcgctctctaatggcacttccgacgccgacctatttgatagtcacgatgaccgcgatgatgatgctgaggcaggaagtgtggaggagcataagagcgtgatcatgcatctcctctctcaggttagattgggtatggacttgactaaggtggttctgcctacgttcatactcgagagacgatctttattagagatgtatgcagattttttcgcccacccggacttgttcgtgagtatcagcgaccaaaaagatcctaaagaccggatggtccaagtggtaaagtggtacctttctgcatttcatgccggccgcaaaggttcagtggccaaaaaaccttataacccaattcttggagagatcttccagtgccattggaccttgccaaatgataccgaagaaaacacggaacttgtgtccgaggggcctgtgccatgggtgtcaaagaactctgttacctttgtggccgaacaggtaagccatcaccccccaatctccgccttttatgccgagtgcttcaacaagaagatccagtttaatgctcacatttggacaaagtcaaagttcctcggtatgtccatcggtgtccacaatatcggtcaaggatgtgtgagttgccttgattacgacgagcattacattctgacttttcctaatggctatggtagatccatcttgacagtgccttgggttgaattagggggcgagtgcaatattaattgctctaaaaccggatacagcgccaacattatcttccatacaaaaccattttacggcggaaaaaagcaccgtatcaccgccgagatttttagtcccaacgataagaagagcttctgcagcatcgaaggagagtggaatggcgtaatgtacgccaagtacgcgacaggggagaacacggtcttcgtggatactaaaaagctgcccatcattaagaagaaggtcagaaaactcgaggaccagaatgagtacgagagccgctctctgtggaaggacgtgacctttaatctcaagatacgggacatcgatgccgccactgaggcaaaacatcgcctcgaagagcggcagagagccgaggccagggagagaaaggaaaaagaaatccaatgggaaacccgtctgttccatgaagacggggagtgctgggtgtatgacgagcctttactgaaacgactgggggccgcaaaacattag

SEQ ID NO: 198408 - DNA, 2265 bp, Artificial Sequence
  Description of Artificial Sequence: Synthetic coding sequence
atgccctaccggcgggtgaccagcggccggctgctgagcctggccgcacccaagatggcgagcatcatggaaggacctctcagcaagtggaccaacgtgatgaaaggctggcaatacaggtggtttgtgctggactacaacgccggcctgctctcatattatacatccaaagacaaaatgatgcgcggatcccggcgtgggtgcgttcggcttcgaggtgctgtaatcgggatcgacgatgaggatgatagtacgttcactattacagtcgatcagaagacgttccactttcaagcgcgggacgccgacgagagggagaaatggatacacgccttagaggaaaccattcttcggcacaccctgcagctgcaggggctcgactctggctttgttccctccgtgcaggactttgacaaaaaactcacggaggcagacgcctatctacagatcctgattgaacagctcaaattatttgacgacaagttacagaactgtaaggaggacgaacagaggaaaaagatagaaaccctgaaagaaaccactaatagtatggtggaatcaattaagcactgtattgtcctgttacagattgcaaaagaccagtcaaatgctgaaaagcatgccgacggaatgatttccactatcaatccagttgacgccatttaccagccttcccccctggaacccgtgattagtactatgccatcacagaccgtgctacctccagaacctgtgcagttgtgcaagagtgaacaacggcctagtagtttacccgtgggacccgtgctagctactctgggacatcaccagactccgactccgaactcaacgggaagcgggcacagcccgcctagctctagcctcacaagccctagccatgtgaacctttctcccaacaccgtccccgaattttcatatagttcgagcgaggacgaattttacgacgctgatgaatttcaccagtcgggatcctccccgaaacgcctgattgattcttcggggagtgccagcgtgcttacccacagctcttcgggcaactctcttaaacgcccagacacgacagaatctctgaactcctcactaagcaatggaactagcgatgccgacttgtttgactctcacgatgatagagatgacgacgctgaggctgggagcgtggaggagcataagagcgtgattatgcacctcctgagccaggttcggctcggtatggatcttactaaggtggtgttgcccactttcattctggaaaggcgttcgctgctggaaatgtacgctgacttttttgctcatcctgatctatttgtcagcattagcgatcagaaggatcctaaggatcggatggtccaggtcgtgaaatggtatctctcagccttccacgctgggcggaagggtagtgtggctaagaagccatacaacccgatcctcggtgaaatattccagtgccactggacgctgcctaacgataccgaagagaatacagaactggtaagtgaaggacctgtcccatgggtgtcgaaaaattctgtgactttcgttgctgagcaggtttctcatcaccctccaatttcagcattttacgcggaatgctttaataagaaaattcagttcaacgctcacatctggactaaatctaagttcctgggaatgtcaatcggtgtccacaatatcggccagggctgcgtcagttgcttggactacgatgagcactacattttaacattcccaaacggctatggccgatccatcctaacggtgccatgggtggagttggggggggagtgtaacattaattgttcgaagactgggtacagcgcaaatattatctttcatacaaaaccattttacggtggaaagaagcatagaattaccgccgaaattttctctcccaacgataaaaagagtttctgcagcatcgagggtgaatggaatggagttatgtacgcaaagtatgccacaggagaaaacacagttttcgtcgataccaagaagctccccataatcaaaaagaaagtgagaaagttggaggaccagaatgaatacgagagtcgttccctgtggaaggacgttaccttcaacctcaaaataagagacattgacgccgccactgaagccaagcaccggctcgaggagcggcagagagccgaagctcgggagcggaaggagaaggagattcagtgggagacccgactcttccatgaggatggtgaatgctgggtgtacgatgagccgcttctgaaacgcctgggggcagctaaacattag

SEQ ID NO: 198409 - DNA, 2172 bp, Artificial Sequence
  Description of Artificial Sequence: Synthetic coding sequence
atggccagcatcatggagggccccctgagcaagtggaccaacgtgatgaagggttggcaataccgatggttcgtgctggattataacgcaggccttctgtcatattatacttcaaaagataaaatgatgcgcggttccagacgtggctgtgtgcgcttacggggtgctgtcattggcattgatgacgaagatgactcgactttcaccattacggtggatcagaagacttttcactttcaggctagggacgccgacgagcgcgagaaatggatccatgctttggaagaaactatcctgcgccatactttacaactgcagggacttgactcgggttttgtgccatctgtccaagattttgacaagaagctgacagaggcggatgcatacctgcaaatactgattgaacagctaaaattgttcgatgacaagctgcaaaattgtaaggaggacgagcagaggaaaaagatagaaacactcaaggagacaacaaacagtatggtggaaagtatcaagcattgtatcgtgctgctccagatcgctaagtcaactataaaccccgtagatgccatctatcaaccatcacctctcgagcccgttatatcaacaatgcccagtcagactgtactgcctccagagcctgtccagctgtgcaaatctgagcagcgccctagctccctacctgtaggcccagtgcttgccaccctcggacatcaccagacccccacacccaacagtacaggatcgggacatagccctccctcatcgtcgctgactagcccctcacatgtcaatctgtcccccaatacagtgcccgagttttcttattcctctagtgaggatgaattctacgacgccgatgagttccaccagtccggtagctcccctaaacggctgatcgacagcagcggatcagcttccgtactgacccattcgtcaagtggtaactccctcaagcggcccgacactacggagtctttaaattcctccttgagcaatggtacatctgacgccgacctattcgactcacacgacgatagggatgacgacgccgaggcggggagcgtcgaggaacacaaatctgtcatcatgcatctcttgtctcaggtgcgcttgggtatggatctcactaaagtcgtcctcccaacctttattctggaaaggaggagtctactcgagatgtatgcagacttttttgcacatccagacttattcgtgtccattagcgaccaaaaggacccaaaagatcgcatggtccaggtggttaaatggtacctttctgccttccacgctgggagaaaaggatcagtcgcaaaaaaaccttacaacccaatccttggtgagatcttccagtgccactggactctgccaaacgacaccgaggagaatacagagctggtctcagaggggccggtgccgtgggtctccaaaaactccgtgactttcgttgccgagcaggtgagccatcatcctcccatttccgccttttatgctgagtgcttcaacaaaaagattcagtttaacgctcacatctggactaagtctaaattcctgggcatgtcgatcggagtacacaatattggccagggctgcgtgtcgtgcctagactatgatgaacattacattttgacattcccaaatgggtacggaaggtcaatactgacagtgccatgggtcgagctcgggggggagtgcaatatcaactgtagtaaaaccgggtattctgcgaacatcatcttccatacaaagccattctacggaggcaaaaagcatcggatcaccgccgagatatttagtccgaatgacaagaagagtttctgcagtatcgagggggaatggaatggagttatgtatgctaagtatgcgactggcgagaacaccgtgttcgtagacactaaaaaattgccaatcataaaaaagaaagttcgcaagctggaagaccagaatgagtacgaatctagatctctctggaaagatgtgacctttaatctcaaaatacgcgatattgacgccgcaaccgaggccaagcacaggctggaggaaagacaacgggccgaagccagagagaggaaagagaaggaaatccagtgggagacacgcttatttcacgaagacggcgagtgctgggtttacgatgaacctctgctgaaaaggctcggcgccgccaaacattag

SEQ ID NO: 198410 - DNA, 2211 bp, Artificial Sequence
  Description of Artificial Sequence: Synthetic coding sequence
atggccagcatcatggagggccccctgagcaagtggaccaacgtgatgaagggctggcagtatcgctggtttgtgctagactacaacgccggattgttgtcttactacacttccaaagacaaaatgatgagaggaagccggaggggatgcgtgcggttacgaggcgctgttatcggtatcgatgacgaagacgacagtactttcacaattacagtagaccagaaaacctttcacttccaggctcgagatgccgatgagagggaaaaatggatccacgctctggaggagacaattcttcgacatacacttcagctgcagggattggactcagggttcgttcctagcgtgcaagacttcgacaagaagctaactgaagccgatgcctacctgcagattctgatcgaacagttgaagctgttcgatgacaagcttcagaactgcaaggaagacgaacaacgcaagaaaattgagacactgaaggagaccaccaacagtatggtggaatcaatcaaacactgcatagttcttctacagatcgccaaggaccaatctaatgccgaaaaacacgcagacggtatgatttccaccatcaatccggttgacgcaatctatcagcccagccccctggagcctgtgatctccacaatgccctcccagacggtgcttccacctgaacccgtgcagttatgtaagtcggagcagagaccttcgtccttgcctgtaggacccgtgttggctaccctcgggcaccaccaaactccgacccctaattccactggaagcggtcactctccccccagcagctctttgactagtccctcccacgtgaacctaagtcccaacaccgtgcccgaattcagctattccagctctgaggatgaattctatgacgctgacgagttccaccaatctggaagctcaccaaagaggctgatcgacagcagcggttccgcgagtgtgttaactcacagctctagcggaaactccctgaaaaggcccgacacaacagagagtttgaacagcagtttaagcaacggaacctccgacgcggacctgtttgacagccatgacgatcgggacgatgacgcagaggccggaagcgttgaagagcacaaaagtgtcattatgcaccttctttcacaggtgcgcctgggtatggatttgactaaagtcgtgctgcctacatttatcctcgagcggaggagcctgctggagatgtacgccgacttctttgcgcatcccgatctgtttgtctcaatcagcgatcagaaggatccaaaagatcggatggttcaagtggtgaaatggtacctgtccgctttccacgccggccgaaaagggagcgttgccaagaaaccctacaatcccatactaggcgagattttccaatgtcattggaccctacccaacgacactgaagaaaacactgagttggtgtctgaggggccagtcccatgggttagtaagaactccgttactttcgtcgccgaacaagtgtcgcaccaccccccaatttccgctttctacgctgagtgcttcaacaagaagatccagttcaatgcccatatctggacgaaatccaaattcctcggaatgtcaattggggtccacaacatagggcagggctgcgtctcctgcttggactacgatgaacattacatcctcacctttcctaacggatatggccggtctatcttgacagtgccctgggttgaattagggggcgagtgcaacattaactgctccaaaactggttacagtgccaacattatctttcataccaagccattctacggcgggaagaaacaccggatcactgcagagatcttctctcctaacgacaaaaagtctttctgtagcatcgaaggtgaatggaatggcgtgatgtacgcaaagtacgcgaccggcgaaaacactgtgtttgtggacacgaagaagcttcccatcattaagaaaaaagtgagaaaactggaggatcagaatgagtacgaatcaagaagcttgtggaaagatgtgacctttaatttaaaaattagagacatcgatgctgcgacggaagccaaacacaggctggaggaacgccagcgggcggaggcaagagagagaaaagaaaaggagatacagtgggagacccgcctctttcatgaggacggtgaatgttgggtatacgacgagcctttgctcaagcggctgggtgcagcaaagcactag

SEQ ID NO: 198411 - DNA, 1716 bp, Artificial Sequence
  Description of Artificial Sequence: Synthetic coding sequence
atggtggagagcatcaagcactgcatcgtgctgctgcagatcgccaaagatcagtccaatgccgagaagcacgcggacggtatgatctcaaccataaaccccgtggacgcaatttatcagccgtctccacttgaacccgtcatcagcacaatgccgtctcagacagtgctgcctcctgaacctgtccaactctgtaaaagtgaacagagaccgtcgtcattaccggtcgggcccgtgctggctacccttgggcaccatcaaacccctacgccgaactcaacgggcagtggccacagtcctcctagctcaagtctgacctctccctcccatgttaatcttagccctaatacagtgcctgagtttagctacagcagctcggaggatgaattttatgacgctgacgaattccaccagtctgggtcctcccccaagagactgatagattcttcaggatctgcttccgtgttgacacattctagcagtggaaattcactcaagagacccgacactaccgaatctctcaactcttccctcagcaacgggactagcgacgcagacctgttcgatagccatgacgatcgagacgacgacgccgaggcgggaagtgtagaggaacataaaagcgtcatcatgcatctacttagtcaagttcgcctgggaatggacctgacgaaagtggttttgccaacctttattctcgaaaggcggtcactgctcgagatgtatgccgatttctttgctcaccccgatctgtttgtcagtatctccgaccagaaggatccaaaggatcgcatggtgcaggtggttaagtggtacttgagcgctttccacgcaggcagaaagggaagcgtggccaaaaagccttacaacccaattctgggagagatcttccagtgccattggacattgcctaatgacaccgaagagaacacggaactggtgagcgaaggcccagttccctgggtgtcaaaaaactctgtcacatttgtggcggagcaggtgagtcaccaccccccgatcagtgccttttatgccgagtgttttaataaaaagatccagttcaacgcccacatctggacgaaaagtaagttccttgggatgtcgatcggcgtgcataatattggtcagggctgtgtcagttgtctagattacgatgagcactacatcctaactttcccaaacggatatggccggagcattctaaccgtgccatgggtcgaactggggggtgaatgcaatatcaattgttctaagactggttactccgcaaacattatatttcacacaaagcctttttacggcggaaagaaacaccgcatcacagccgaaatcttctcgccaaatgacaaaaagagcttctgttccattgaaggagaatggaacggcgtcatgtatgccaagtacgctaccggagagaatactgttttcgtggacacaaagaagctgcctattatcaagaagaaggtgcggaagttagaagatcagaacgagtatgagtctcgcagtctgtggaaggacgtgaccttcaaccttaagatacgtgatatagatgccgctactgaagcaaaacaccggcttgaggagaggcagcgcgcagaagcgcgggagagaaaagagaaggaaatccagtgggaaacaaggctgttccacgaagacggtgaatgctgggtatacgacgaaccactgctcaaacgcttgggcgccgccaaacattag

SEQ ID NO: 198412 - DNA, 2241 bp, Artificial Sequence
  Description of Artificial Sequence: Synthetic coding sequence
atggccagcatcatggagggccccctgagcaagtggaccaacgtgatgaaaggctggcagtataggtggtttgttttggattacaatgctggtctgttaagctattatacgtccaaggataaaatgatgcgaggcagtcgacgggggtgtgtgaggctaagaggagcagtcattggtatagacgacgaagatgatagtactttcaccatcacagtagatcagaagaccttccattttcaggccagggacgcagacgaacgtgaaaaatggatacatgccctggaggagactattctccgccacaccctccagctgcagatatctacaacactggccttcttccagtcatctggaattagccccgtgcttgaattttctaagattatcggactcgatagcggcttcgtgccctcagttcaggactttgataagaaactcaccgaggcagacgcctatctgcagatcctgatcgaacaactcaaactatttgacgataagttgcagaactgcaaggaggatgaacagagaaaaaaaatcgagactctcaaagaaaccaccaacagcatggttgaaagcattaagcattgcatagtactgttacagatagctaagtccacgattaatcctgtcgacgccatttatcagccctcaccacttgagccggtcataagtaccatgccgagccagacagtgctgccgcctgaaccagtacagctgtgcaaatccgaacagagaccctcctccctgcctgtgggccccgtgctggctacactgggccatcaccagacaccaacacccaatagcactggctccggccacagtccccccagctccagcctgacttccccgagtcacgttaaccttagccctaatactgttcccgagttctcctactcaagctcagaggatgagttctatgatgcagacgagtttcatcaatccggcagtagtccaaagcggttgatagattccagtggaagtgctagcgtcctgactcactcatcatctgggaacagtcttaaaaggccagacaccactgagagtctgaatagttcattgtcaaacggcacctcagatgctgatttatttgactcacacgatgacagggatgatgacgcagaggctggctctgtggaggagcacaagagtgtaattatgcacttactctctcaggtacgtttgggcatggatcttactaaggtggtcttgcccactttcatccttgaaagacgtagcctactcgaaatgtacgccgacttttttgcacaccccgacttgttcgtgtccatcagcgatcagaaggatccaaaggaccggatggtgcaggtggtgaagtggtacctcagcgcgtttcatgcaggaagaaagggatcagtcgcaaagaaaccctacaatcccatcctgggcgagattttccaatgccactggacgctgcccaatgacaccgaagagaacaccgaactggtgagtgaaggcccggtgccctgggtcagcaaaaatagcgtaaccttcgtagcagaacaggtcagccatcacccccccatctcagctttctatgctgagtgcttcaataagaagattcagttcaacgctcacatttggacaaagtcaaagtttttggggatgagcataggtgtgcataacatcggccaagggtgcgtgagttgtctcgactatgatgaacattacatacttacctttccaaacggctacggtcggagcatcctgaccgtgccttgggtggaattggggggggaatgcaacattaactgctcaaaaactggatattccgctaatattatctttcacaccaagcccttctacggagggaagaagcatagaatcactgcagagatattcagtcccaatgataaaaaaagcttctgctctattgaaggcgaatggaatggtgtgatgtacgccaaatatgccacaggcgaaaatacggtgttcgtggatacaaagaaactgcccattatcaaaaagaaagtgcgtaagcttgaagaccagaacgaatacgaatccagaagcctgtggaaggatgttacatttaatctgaagatcagagacattgacgcagctacagaggctaaacatcgcttggaggagaggcagcgggctgaggcccgggagaggaaggagaaggaaattcaatgggagacccggttgttccatgaggacggggagtgttgggtctatgatgagcccctgctgaagcgtctgggcgctgcaaagcattag

SEQ ID NO: 198413 - DNA, 2160 bp, Artificial Sequence
  Description of Artificial Sequence: Synthetic coding sequence
atggccagcatcatggagggccccctgagcaagtggaccaacgtgatgaaaggatggcaatacaggtggtttgtgctcgactacaatgctggactgctcagttactataccggggccgtgatcggaatcgatgacgaggacgactcgacctttactattacggtagaccagaagacatttcacttccaggccagggacgccgacgaaagagagaagtggattcatgctcttgaggagacgatcctgcgccacacactgcagcttcaggggctcgacagcgggttcgtcccatccgtacaggacttcgacaaaaaactgaccgaggctgacgcctatctccagatcctgatagaacagctcaagttattcgatgacaagcttcaaaattgtaaagaggacgagcaaagaaagaaaatagagaccttgaaggagaccaccaacagtatggttgaatcgatcaaacactgcatcgtactgttgcagattgcgaaagatcagtcaaacgccgaaaaacacgctgacggcatgatttctacaatcaatccagtcgacgctatctaccagccgagccccctggagcccgtcatcagcaccatgcctagtcagaccgtcctgccgcccgagcccgtgcagctgtgcaaatccgaacagagaccctcttccctgccagtcggcccagtcctggctactctggggcaccatcagaccccgacccctaattccaccggatcgggtcactcccctccttccagcagcctgacatccccgagtcacgtgaacctaagcccaaatacagtgccagaattcagttacagttcatccgaggacgagttttatgatgcggacgaatttcatcaaagtggaagctccccaaagcgcctcatcgacagttcgggaagtgccagtgtgctcactcatagctcatctggtaattctttgaagcgtcctgacactacagagagcctcaacagcagcctcagcaacggcacttctgacgccgaccttttcgactcacatgacgatagggacgatgacgcggaggcaggttccgtggaggaacataaatctgtgattatgcacttgctttcacaggtgcgactggggatggatttaaccaaggtcgtcctcccaacctttattttagagcgacgctctttactggagatgtacgccgacttttttgcacacccagatttgtttgtcagcatttccgaccaaaaggaccccaaggaccgcatggtgcaggtcgtcaagtggtatctaagtgcctttcacgcagggaggaagggatccgtggcgaagaagccttacaaccctatcctcggggagatctttcagtgccactggactcttcctaacgataccgaagaaaacactgaactggtgagtgaggggccggttccctgggtttctaagaattctgtgacgtttgttgccgagcaagttagccaccacccacccatttcagcattctatgcagaatgtttcaacaaaaaaattcagttcaatgcacacatatggaccaagtcaaagttcctcggtatgagcatcggtgttcataacattggacaagggtgcgttagctgcctcgactatgatgagcactatattctgactttcccaaacggatacggccggtctattctgacagtaccatgggtcgaactggggggcgagtgcaacattaactgcagcaagactggatactcagcaaacatcatattccataccaaacccttttacggcggtaagaaacacagaattactgcggagatattttccccaaatgacaagaaatccttctgcagtattgaaggagagtggaatggtgtcatgtacgcaaagtatgctacaggtgaaaacactgttttcgtcgacaccaagaagttgcccattatcaaaaagaaggtccggaagcttgaagatcaaaacgagtacgagtcgaggtctctgtggaaagacgttacatttaatctgaaaatacgggacatcgatgcagcgactgaagccaagcacaggttagaggagcgccagagggccgaggctcgcgagaggaaggaaaaggaaatacagtgggaaaccagactgttccacgaggatggcgagtgttgggtctatgatgaacctctgttaaaaagactgggagcggccaaacactag

SEQ ID NO: 198414 - DNA, 1677 bp, Artificial Sequence
  Description of Artificial Sequence: Synthetic coding sequence
atggtggagagcatcaagcactgcatcgtgctgctgcagatcgccaagagcactattaaccctgtcgacgccatctaccagccaagcccactggaacctgtgatctctacaatgccaagccagaccgtcctgcctcctgaaccagtccagctatgtaagagtgagcagcgccctagcagtctacccgtaggacccgtgctggccaccctgggtcaccatcagacacctactccgaactccacgggtagtggacacagtcctccatcatccagcctgacatcacctagtcatgtgaacctgagtcccaacaccgtgcctgagttctcatatagcagctctgaggatgagttctacgacgcagatgagtttcatcagagcggttccagtcctaagaggctgattgattcttccggaagtgcgagcgttcttacacattcttcgagtgggaacagcctaaaaaggcccgacaccaccgaaagcctaaattcttccctgtcaaacggtacctcggatgccgacctgtttgatagtcacgacgatagagacgatgatgccgaagccggaagtgtggaggagcataagtctgtgataatgcatttactttcccaagtgcggcttgggatggacctgactaaggtagtgctgcccacatttatattggagcggaggagcctgcttgagatgtatgcagacttcttcgcccacccagacctctttgtgtctataagcgaccaaaaggatcccaaggatcggatggttcaggttgtcaagtggtatctgtcagcttttcacgccggccgtaaaggatcagtggcgaagaagccctacaatcctatcttgggggagatttttcagtgccactggaccttaccaaatgacactgaggaaaacacggagctcgttagcgaaggaccagtcccttgggtgtccaaaaatagtgtgacgttcgtggcggaacaggtgtcccaccacccccccatctccgccttttatgccgaatgctttaataagaaaattcagttcaacgctcatatctggaccaaaagcaaattcctgggcatgtcaatcggcgtgcataacatcggacagggctgtgtctcttgtctggactatgacgagcactacatcttgacattccccaatggctatggtcgctccatccttaccgtgccctgggtggagctgggcggagagtgtaatattaactgcagcaaaacaggatatagtgctaatataatctttcacaccaaacctttctacggcgggaagaaacacagaattaccgccgaaatcttctcgcctaatgataagaagtccttttgcagtatagagggagaatggaatggtgtgatgtatgctaagtacgctacaggtgagaatactgtgttcgttgacacaaagaagctgccgataattaaaaaaaaagtgaggaaattggaagaccagaacgagtatgagtcgagaagtttgtggaaggacgtgacattcaacctgaaaatcagggatatagacgcagctaccgaggcaaagcataggttggaagagagacagcgggcagaggctagggaaagaaaggagaaggaaattcagtgggagacaaggctgttccacgaagacggcgagtgttgggtctatgacgaaccgttgctcaagagacttggggctgcaaaacattag

SEQ ID NO: 198415 - DNA, 99 bp, Artificial Sequence
  Description of Artificial Sequence: Synthetic coding sequence
atggtggagagcatcaagcactgcatcgtgctgctgcagatcgccaaagaccagagcaatgcggagaagcacgccgacggcatgattgtgagtctttag

SEQ ID NO: 198416 - DNA, 1677 bp, Artificial Sequence
  Description of Artificial Sequence: Synthetic coding sequence
atggtggagagcatcaagcactgcatcgtgctgctgcagatcgccaaaagtactataaaccccgtcgatgcaatctatcagcccagcccattagaacccgttatcagtactatgccgtcccagaccgtgctccccccggagccagtgcagctgtgcaaaagcgagcagaggccttcctctctaccagttggcccagtgctggccaccttgggccatcatcagacgcccacccccaattccaccggctccggacattcgccgccatcgagttcactgacctcgccctcacacgtaaacctatctccaaacacagtgcccgaattttcgtattcaagcagtgaagacgagttttacgatgctgatgagtttcatcaaagcggttcatctccgaagcgccttatcgactctagtggttccgccagtgtgctcactcatagttcttcaggtaacagcctgaagagacctgacacaaccgagtcattgaacagttctctttcaaatggcacctctgatgctgatctcttcgacagccatgacgaccgagacgatgatgctgaggcaggcagtgtcgaggagcacaaatcggtgataatgcacctcttatcccaggttagactggggatggacttaacaaaagtcgtcctccccacattcattctggaacggagatcactcttagaaatgtatgctgatttcttcgcccacccagacctctttgtcagcatctccgaccagaaggaccccaaagacaggatggtgcaggtggtaaaatggtatcttagcgcctttcacgccgggaggaaagggagtgtggccaaaaagccctacaatcccattcttggagaaatcttccagtgccattggactctgcccaatgataccgaggaaaacaccgagctagttagcgagggcccagtgccttgggtctctaagaattctgtgacctttgttgcggagcaggtttcacaccatcccccgatttccgccttctacgcggaatgctttaataagaaaattcagttcaatgctcacatctggactaagagcaagttcctggggatgtccataggagtacataacatcgggcagggttgcgttagctgcttggactatgatgagcattacatcctcacttttcccaacggctacggtcgttctatcctgaccgtgccttgggtggagctcggcggcgaatgtaatatcaactgttctaaaacaggctattctgccaatatcatatttcatactaagccgttctatggcggaaagaaacatcggataaccgctgagatcttctctcccaacgataagaagagcttctgtagcattgagggggaatggaacggcgttatgtacgctaaatatgcgactggagagaataccgtgttcgtggacacaaagaagctacctattatcaagaagaaggtgagaaaattggaagaccagaacgagtatgaaagtcggtccctgtggaaggacgtgacatttaatctaaagatccgggacattgatgccgctactgaggccaagcacagattggaagagcgacagcgggcagaggcccgagagcgaaaagagaaggagatacagtgggaaactcgcctgttccacgaggatggggagtgctgggtgtatgatgagccgctgttgaagcgcttgggcgctgccaagcactag

SEQ ID NO: 198417 - DNA, 1968 bp, Artificial Sequence
  Description of Artificial Sequence: Synthetic coding sequence
atgggctgctgctgctgctggctggtgttcaccgaggcccgggacgccgacgaacgcgaaaaatggatccacgcactggaggagacaattttaagacatacgctgcagctgcagggactcgattctggtttcgttccgagcgttcaagacttcgataaaaaacttacggaagccgatgcgtatttacaaatcttgatcgagcaactgaaactatttgacgacaagctgcagaattgcaaggaggacgaacaaaggaagaaaattgagaccctgaaggaaacgactaacagtatggtggaatctatcaaacactgcattgtactgctgcagattgcgaaatcgactatcaacccggtcgacgcgatctaccaaccttcacccctagaacccgtcataagtactatgccatcccaaacagtgctcccgcccgaaccggttcaactgtgcaaatcagaacaacggccaagttctcttcccgtgggccccgtgttagctactcttggacaccaccagacacctacacccaatagtaccggttcgggacattcacctccctcctcatctctcacctcgccttcgcatgtaaatctttccccgaatactgtgccagaattcagctactcttcgtccgaggacgaattctatgatgccgacgaatttcatcagagcggctcatctccgaagcgcctgattgacagctccggcagtgcctccgtcctgactcattctagctctggcaactcactgaagcgccccgatacaacagaatctttaaacagctccctgagtaacgggacaagcgacgctgatctatttgatagtcatgacgaccgtgatgacgacgccgaggctgggtctgttgaggagcacaagagtgtgatcatgcacttattatctcaggtgcgtctcgggatggacctaactaaggtggtgctgcctacattcattcttgagcgcagatcactgttggagatgtatgcagacttcttcgctcaccctgacctgttcgtgtccatcagcgatcagaaagatccaaaggaccgtatggtgcaggtagtcaagtggtatctgtcggcctttcacgccggacgcaagggatccgttgctaaaaagccctacaaccccattttaggcgagattttccagtgtcattggactctgcccaacgataccgaagagaatactgagctggtctccgagggccctgtgccttgggtgagcaagaacagtgtcacctttgttgccgaacaggtgagccaccatccgcccatatctgctttttacgccgagtgttttaataaaaaaatccagtttaacgcacacatctggaccaagtctaagtttttaggcatgtcaattggagtccacaacatcggacaggggtgcgtgtcatgcctggattacgacgagcattatattctcacttttcccaatggctatggtcggtctattctgacagtgccctgggtggagctcggtggagaatgtaatattaactgctctaaaacaggctacagcgccaatataatctttcatacaaaacctttctacggcggaaagaagcatcggatcaccgcagaaatctttagcccgaatgataaaaaatccttttgctctatagagggggagtggaatggagtcatgtatgccaagtatgccacgggagaaaataccgttttcgtagacacgaaaaagctcccgattataaaaaaaaaggtgcggaagctcgaggatcaaaacgagtacgaaagtaggtcattatggaaggacgtgacattcaacctcaaaatccgggacattgacgctgctaccgaagcaaagcacaggctcgaggagcgacagcgggctgaggctagagaaaggaaggaaaaggaaatacagtgggagacgaggctgtttcatgaggacggcgaatgctgggtgtatgacgagccattgctgaagcggctgggcgccgccaagcactag

SEQ ID NO: 198418 - DNA, 330 bp, Artificial Sequence
  Description of Artificial Sequence: Synthetic coding sequence
atggtggagagcatcaagcactgcatcgtgctgctgcagatcgccaagagcacaatcaacccagtcgatgctatctaccagccttctcccctggaacctgtgatcagcaccatgccgtctcagaccgttcttccgcctgagccggtccagctttgtaagagtgagcagagacctagtagtctccctgtcggcccggtccttgcaaccctgggacaccaccaaacccctacaccaaattcaaccggcagcgggcactcacctcccagctcttctttgacctccccaagtcacgtgaatctgtcaccgaacactgttcccgaattctcgtag

SEQ ID NO: 198419 - DNA, 1170 bp, Artificial Sequence
  Description of Artificial Sequence: Synthetic coding sequence
atggagggcgccctggccgccaactggagcgccgaggccgccaacgcatctgctgcaccgcctggcgccgagggaaacaggaccgctggcccaccccgtcgcaatgaagccctggctagggttgaagtcgccgtcctgtgcctgattttactcctggccttatccggcaatgcttgtgtgctcctggctcttaggacgacccgccaaaagcatagccggctttttttttttatgaagcatctgagcattgctgatctcgtggttgccgtgtttcaggtcctgccccagcttctgtgggatattacatttcgattttatggacccgatttattgtgtcgccttgttaagtacctgcaagtcgttggaatgttcgcctccacttatttgctgttattaatgtctcttgacaggtgcttggcaatttgtcagcctttgaggtcactgcggaggcgtactgaccgcctggccgtacttgcaacctggctgggctgcctggtcgcatcggctccccaggtacacattttctctttgagagaggtggccgacggggtgttcgactgctgggctgttttcattcagccgtggggtccgaaggcctatattacctggattacacttgcagtatacatcgtgcccgtcattgtgctcgctgcgtgctacgggttaatatcatttaagatctggcagaatcttaggttgaagaccgcagcggctgccgcggctgaggcccctgagggggccgcggcaggggacgggggcagggttgcattggcaagagttagtagtgttaagctgattagtaaagccaaaatcaggaccgttaagatgacgttcattatcgtgttggcattcatcgtgtgctggactcctttcttctttgtgcaaatgtggtccgtttgggacgcaaatgcaccaaaagaagcatcagcttttatcattgtgatgctgctcgcctccctgaactcatgctgtaatccttggatttacatgcttttcaccggtcatcttttccatgaattggtccagcggtttctttgttgctcagcatcctatttaaaaggacggcggcttggcgaaacctcagcgtctaaaaaaagtaactccagctcctttgtgttaagccacagaagctccagccagcgcagctgcagccagccctcaactgcctag

SEQ ID NO: 198420 - DNA, 132 bp, Artificial Sequence
  Description of Artificial Sequence: Synthetic coding sequence
atggagggcgccctggccgccaactggagcgccgaggccgccaacgcttcggccgcgccgcctggcgcagaagggaacaggacggctgggcctccccggcggaacgaggccctggccagggtcgaggtgtag

SEQ ID NO: 198421 - DNA, 279 bp, Artificial Sequence
  Description of Artificial Sequence: Synthetic coding sequence
atggagggcgccctggccgccaactggagcgccgaggccgccaacgcatctgcagcacccccgggcgctgagggaaacagaactgccggtccccccaggcgtaacgaggcgctggcgagagtcgaagtggctgttctgtgccttatactcttgttagccttaagtggcaacgcctgtgtgttattggccctgcggacgaccaggcagaagcacagtagattgtttttttttatgaaacacctgagcatagcagatctcgtagtagccgtcttccagtag

SEQ ID NO: 198422 - DNA, 1518 bp, Artificial Sequence
  Description of Artificial Sequence: Synthetic coding sequence
atggccagcggccggcgggccccccggaccggcctgctggagctgagagccggggccggctccggagccggcggagaaagatggcagagggtgttgctgtcactggccgaggatgtgctaacagtgtcccctgcagacggtgatcccggtccggaaccaggtgcacctagggaacaggagcctgcacagttgaatggggccgccgagcctggagctggcccccctcagctaccggaagccttgttactccagagacgaagggtcaccgtcaggaaggctgatgctggaggactggggattagtattaagggaggaagggaaaacaaaatgcccattctcatttccaagatattcaaaggactagcagccgaccaaactgaggccctattcgtgggcgacgctatcctgtctgttaatggcgaagatctatcctcagccacacacgacgaagcagttcaggtcttgaagaagaccggcaaagaggttgtgctggaggtgaagtacatgaaggacgtaagcccctattttaagaattcaacaggaggcaccagcgtaggatgggattcccccccagcctctcccctgcaacgacagcccagtagcccgggcccgacaccacggaatttcagtgaagccaagcatatgagtttgaagatggcttatgtgagcaaacggtgcacccccaacgaccccgaaccaagatacttggaaatctgttcagctgatggtcaggatactctgtttctgagggccaaggatgaggcctccgcacgaagctgggctacagccattcaagcccaggtcaacactctcactcccagagtaaaagacgagttacaggctctcctggcagctaccagtactgcaggctcccaagatatcaagcagatcggatggctgaccgagcaacttccgagcggtggcactgcaccaacactcgctctactgacggagaaagagctgttgttgtatctgagccttcctgagacacgcgaggcacttagccgaccggctaggactgccccgctgatagctaccaggttagtgcatagcggcccatctaagggaagcgtgccctatgacgcagagctttcttttgccttgaggaccgggactcgacatggcgtcgatacccatctcttcagcgttgagagcccccaggagctcgctgcctggacccgccagcttgtcgatggttgtcatagagcagccgagggtgtgcaggaggtttctaccgcttgtacgtggaacggtcgtccgtgtagtctcagtgtccacatcgataagggcttcacactgtgggctgccgagcccggcgctgctcgggccgttctcctgcggcagcctttcgagaagctacagatgagttctgatgatggagcttctttgctctttttggactttgggggtgctgagggtgagattcagttggatttgcactcgtgccccaagacgatcgtctttataattcactcatttttgtccgcgaaagtgacccgcctcgggctgcttgcttag

SEQ ID NO: 198423 - DNA, 441 bp, Artificial Sequence
  Description of Artificial Sequence: Synthetic coding sequence
atgggcttcctgcggcggctgatctaccggcggcggcccatgatctacgtcgagtctagcgaggagtcctcagacgaacagcctgacgaagttgaatctccaacccaaagccaggattctactcctgccgaggaacgcgaggatgagggcgcctcggcagcgcagggccaggagcctgaagctgactcgcaggaattggtgcagccaaaaacagggtgtgaactaggcgacggacccgacaccaagcgcgtttgtttacgcaatgaggagcagatgaaacttcccgcagagggacccgagcccgaagccgacagccaggagcaggtccatccaaaaaccggatgcgagcgtggcgacgggccagatgtccaggagttgggcctccccaacccggaggaagttaaaactcccgaagaagacgagggacagagccagccatag

SEQ ID NO: 198424 - DNA, 336 bp, Artificial Sequence
  Description of Artificial Sequence: Synthetic coding sequence
atgagcgagctgctgcgggcccggagccagagcagcgagcggggcaacgaccaagagtcatcccagcctgttggcagtgtcatcgtgcaggagcccactgaggaaaagcggcaggaagaggaacccccaacagacaaccagggtatcgccccctccggcgaaattgagaatcaggccgtgccagctttccagggaccagacatggaggcctttcagcaagagctcgccctcctgaaaattgaggacgaacccggggatggccctgacgtgagagagggtataatgcccaccttcgacctaacaaaggtcttggaggctggcgacgcccagccttag

SEQ ID NO: 198425 - DNA, 195 bp, Artificial Sequence
  Description of Artificial Sequence: Synthetic coding sequence
atgagcgagctgctgcgggcccggagccagagcagcgagcggggcaacgaccaggaaagttctcaacctgtcggcagcgtgatagtgcaggagcccacagaagagaaaagacaggaggaggagccacccactgacaaccagggcatcgccccatctggcgagatcgaaaatcaagctgtcccagctttccagtag

SEQ ID NO: 198426 - DNA, 342 bp, Artificial Sequence
  Description of Artificial Sequence: Synthetic coding sequence
atgagcggccaccagcggacccggagccggagccgggagcggcgggacgatcaggacagcaatcaccccgtgggcgcagtggtggcccaggagctgcccagcaatgatcagctgcagcaagaggagccacccattgagagccaggactatactccagggcaggaacgtgatgagggcgccttggactttcaagtgctcggcttggctgcttacctgtgggagcttaccaggagcaaaactgggggagaaagaggagacggcccaaatgtgaaaggggaattcctgcccaacctcgagcctgtgaagatcccagaagccggcgaggggcagcccagtgtctag

SEQ ID NO: 198427 - DNA, 342 bp, Artificial Sequence
  Description of Artificial Sequence: Synthetic coding sequence
atgagcggccaccagcggacccggagccggagccgggagcggcgggacgaccaggattccaaccatcctgtgggtgccgtggtggcacaagaacttccttcaaacgaccagcttcagcaagaagaacctcccattgagtcccaggattacacaccagggcaggaacgagacgagggcgctctggatttccaggttcttgggctagctgcctacctgtgggagttgacaaggagtaaaactggaggcgaaaggggtgatgggcccaatgtgaagggcgaatttctgccaaatttagaacccgtgaaaataccagaggccggcgagggccagccatcagtgtag

SEQ ID NO: 198428 - DNA, 1458 bp, Artificial Sequence
  Description of Artificial Sequence: Synthetic coding sequence
atggccgccgtgtggcagcaggtgctggccgtggacgcccggtacaatgcatacagaacacctacattcccacaattcagaacccagtacatccgcagacgttcccagttgctgcgggaaaacgcaaaggctggccatccccccgctctacgtcgacagtacctgaggctacggggccaattactgggacaaaggtatggccctctgagtgaacccggctccgcaagagcctacagcaattccatagtcaggagctcaagaactacattggatcggatggaagattttgaagatgatccccgggctcttggagcgcgcggacatcgcagaagcgtgtcacgaggttcctatcagctgcaggcacagatgaatcgggcagtctacgaagatcgaccacctggatcagtagtgccaacatccgcagcagaggcctcacgcgctatggccggggatacttccttatccgagaattacgccttcgccgggatgtaccacgtttttgaccaacacgtagacgaggcagtccctcgggtgaggtttgccaatgatgatagacaccgcctcgcgtgctgcagcctggacggttctatatccctctgccagcttgtgcccgccccccctacagtcctcagagtgctgagagggcacacccgaggcgtgtccgacttcgcgtggagcctgtcaaacgacatcctcgtgtctacttcgctcgacgctacaatgcggatctgggcctcagaagatggtcgctgtattcgggaaatccctgacccagattccgccgagttgttgtgctgcacgttccagcctgtgaataacaaccttaccgtagtcgggaacgccaagcacaatgttcacgtgatgaatattagtacaggtaagaaggtcaaaggcgggtcaagtaaattgacaggacgggttcttgcactatccttcgacgccccgggacggttactgtgggcaggagatgaccatggctctgtgttctcctttttgttcgatatggccaccggaaaactcactaaggccaagcgtctggttgtccacgagggatcccccgtcactagcatctccgcgcggagctgggtgtctcgagaagcccgggatcctagcctgctcattaatgcttgcctcaataagcttctgctgtaccgtgtggtcgacaacgagggtactctccaactgaagaggagttttcctatagagcagtccagtcacccggtgcgaagcatcttttgccccctgatgtcgttccgacagggggcctgtgtggtcaccgggtcggaggatatgtgtgtgcacttcttcgacgttgaacgagccgccaaggccgccgtgaataaattacagggacactcagccccagttctcgacgtgtcattcaactgtgatgaatcgctattggcgtcatcagacgcctccggcatggtgatcgtgtggcgacgtgaacaaaagtag

SEQ ID NO: 198429 - DNA, 309 bp, Artificial Sequence
  Description of Artificial Sequence: Synthetic coding sequence
atgagcgcccgggtgcggagccggagccggggccggggcgacggccaggaagctccagatgtcgtcgctttcgtggcgcctggtgaatcgcagcaggaagagcctccaacggataaccaggacattgagcccgggcaggaaagggaaggtacgccccccattgaagagcgtaaagtggagggcgattgccaggagatggatctggagaaaactcgcagcgagcggggagatggctccgacgtgaaggaaaaaactccgccgaatccaaaacacgccaagacaaaagaagctggggatgggcagccctag

SEQ ID NO: 198430 - DNA, 1575 bp, Artificial Sequence
  Description of Artificial Sequence: Synthetic coding sequence
atgagcgacaacggcgagctggaggacaagccccccgccccccccgtccgtatgtcttctactatcttcagtacaggtggtaaggatcctctgtcggccaatcattccttgaaacctcttccctctgtgcccgaggagaaaaaacccagacataagattattagcatttttagcggtactgaaaagggctccaaaaagaaggagaaagaacgccccgagatatcaccgccctcagatttcgaacatactattcacgttggtttcgacgcagtaacgggggagtttactggcatgccagagcagtgggcgcgcctcttgcagactagtaatatcacaaagttagagcagaagaagaacccccaagccgtgctggacgtgctgaaattctacgattctaataccgtgaagcaaaaatacttaagcttcactcccccagagaaggatgggttccccagtggcacccctgccctcaatgcaaagggcactgaggctccggccgtggtgaccgaggaggaagatgatgatgaggagaccgctccgccagtgatagccccaagaccagatcataccaagagcatctatacccgcagtgtaattgatcctgttccagcccccgtcggcgatagccacgtggacggcgctgctaagtccctcgataagcagaaaaagaaaacaaagatgactgacgaggagataatggaaaagctgcggacaatcgtgagtatcggagatccgaagaagaaatatacgagatacgaaaaaatcggccagggggcaagcggcacggtgttcacagccactgatgttgccctgggacaagaggtcgctattaagcagatcaacctgcagaagcagccaaaaaaggaacttattattaacgagattctcgtgatgaaggagctgaaaaaccctaatattgtgaactttttggatagctatctggtgggcgatgaactgttcgtagtgatggaatacctcgccggggggagtctgacagatgtggtaacagagacttgtatggatgaagctcagattgctgctgtgtgtagagaatgtttgcaggcactggagtttctgcacgctaaccaggtgatccacagagacattaaaagcgataacgttctgctgggtatggagggcagtgtgaaactgacagacttcggtttctgtgcccagatcaccccagagcagtcaaagagaagcactatggtgggtaccccgtactggatggctcctgaagtggtgaccaggaaggcttatggacccaaggtggacatttggtcacttgggatcatggctattgagatggtggagggagagcccccatacctgaacgagaatcccctgcgagcactgtacctcattgctacaaacgggacacccgaactgcaaaacccagagaagttgagtccaatctttcgggacttcctgaatcgatgccttgaaatggacgtggagaagcgtggtagcgccaaagagcttttgcagcaccctttcctgaagctggccaagcccctctcctccctgacccccttgataatggcggcgaaagaagctatgaagtcaaacagatag

SEQ ID NO: 198431 - DNA, 1680 bp, Artificial Sequence
  Description of Artificial Sequence: Synthetic coding sequence
atgagcgacggcctggacaacgaggagaagccccccgccccccccttgagaatgaatagtaacaatcgcgatagttccgccctgaatcattcttctaaacccctaccaatggcccctgaggagaaaaataagaaggcccgtctgaggtccatttttcctggaggtggggataagacaaataagaagaaagagaaagaacggccagaaatatctctgccctctgactttgaacacacaatccatgtgggctttgatgccgtgacaggagagtttacacctgacctctatggcagccagatgtgccccggcaagcttcccgaaggaatcccagagcagtgggcccgtctgctgcagacttccaacatcacaaagctggagcagaaaaagaacccgcaggccgtgttggacgtgctgaaattctacgatagcaaggagacagtgaataatcaaaagtacatgtctttcactagtggggataaatcggcgcacggttatattgctgcgcatcctagttccacgaagaccgcaagtgagcctccgctggcgccccccgtgagcgaagaagaggacgaggaggaagaggaggaggaagacgaaaatgaacctccccctgtcatcgctcctcgccctgagcatactaagagtatttacacacgcagtgtggtggaatctatcgcctcaccggccgtccccaataaagaagtaactcctccaagtgcagaaaatgcaaactcgtcaactctgtacagaaacacggacagacagaggaagaagagtaagatgaccgacgaggaaatactcgagaagcttagaagtatcgtcagtgtcggggacccaaaaaagaaatacacacgcttcgagaagattgggcagggggcctctggaacagtatataccgccttggacattgccacaggccaggaggttgccataaagcagatgaacctgcagcaacaaccgaagaaggagctgataattaatgagatcctcgtgatgcgtgagaacaaaaaccccaatatagtcaactacttagacagctaccttgtcggtgacgagctgtgggtagttatggagtatctggccggcggttctctcaccgacgtggtgaccgaaacctgtatggacgagggtcaaatcgccgccgtctgcagagagtgtctgcaagccctagactttctgcatagcaatcaggtcatccatagggacatcaaatcagacaacattttactgggtatggacggcagcgttaagctgacagatttcggcttttgtgcacagatcacacccgagcagtcgaaaaggtcaacaatggtcgggaccccgtactggatggctccggaggtcgtgactcgtaaagcatatggccccaaagttgatatatggtcgctgggcataatggctattgaaatggtggagggggaacccccttatctgaatgagaaccccctgcgggccttatatctcatcgcaactaatggcactccggaacttcagaacccagagaggctgagcgctgtcttcagggattttcttaatcggtgcctggagatggacgtcgatcgccgtggatctgctaaggagttgctccaacacccgttccttaaactcgccaaaccgttatcaagcctcactcctctcatcatcgccgccaaggaggccatcaaaaatagttccagatag

SEQ ID NO: 198432 - DNA, 1743 bp, Artificial Sequence
  Description of Artificial Sequence: Synthetic coding sequence
atgagcgacggcctggacaacgaggagaagccccccgccccccccttacgaatgaacagtaacaaccgcgactcatcagccctgaaccacagcagtaagccactgcccatggctccagaggaaaagaacaagaaagcccggctgcgctcaatctttcctggggggggcgacaagaccaacaagaagaaggagaaggagcggcctgagatctccctgcccagcgatttcgagcacaccatccacgtgggcttcgacgccgtaacaggtgaatttacaaattctccctttcaaaccagccgtccagtgaccgtggccagctcccagtctgaaggcaagatgcccgacctctacggctctcagatgtgtcctggcaagttgccggaaggcattccagagcagtgggcaagattgctccaaacctccaacatcacaaagcttgaacaaaaaaaaaatccccaggcagtgttagatgtgctcaagttctacgacagtaaggagaccgtaaacaaccaaaagtacatgtctttcacttcaggggataaatctgctcacggatacatcgccgcccatccgtcctccacaaaaactgcctcagaaccgcccctagcacccccggtttctgaagaggaagacgaagaagaagaagaggaggaggacgagaatgagcctcctccggttatagccccacgtcccgaacacacaaagagcatttatacaaggagcgtggttgagagtattgcctcacctgcagtcccaaataaagaagtgaccccacctagcgcagaaaacgctaatagctctactttgtacagaaatactgacagacagagaaagaagtcaaagatgacagacgaggaaatcctcgaaaagctgcgctccattgtttctgtgggggaccccaaaaaaaagtatacccgcttcgaaaaaatcggtcagggagcaagcgggactgtgtataccgctctcgatattgcgaccggacaagaggtggccatcaagcaaatgaatctccagcaacagcccaagaaggagctgatcatcaacgaaattctggtgatgagggagaacaaaaatcctaatatcgtaaattatttagactcctatctggtgggtgacgagctttgggtggtgatggaatatctggccggaggatcgcttacggacgtcgtcacagagacatgtatggatgagggacagatcgccgccgtttgtagagagtgtctccaagcgctggatttccttcattcaaatcaggttatccaccgcgacatcaaaagcgataacattcttcttgggatggatggatctgttaagctcacggattttgggttctgcgctcagatcacccctgagcaatctaaacgcagtaccatggtgggcacaccctattggatggcccccgaggtcgtgaccaggaaggcctacgggcctaaggttgatatctggagtctgggcattatggcaattgagatggtcgagggggagcctccctacttaaatgagaatcctctgagggcactgtaccttatcgcaacaaatggtactcccgaacttcagaacccggaacgcctgagcgctgtgtttagggatttcttgaaccgctgtttggagatggacgttgatcggaggggctctgccaaggagttgttgcagcacccctttcttaaactggcaaagccgctctcatctctcaccccactgattattgccgccaaagaggcaattaaaaactcttcacggtag

SEQ ID NO: 198433 - DNA, 1635 bp, Artificial Sequence
  Description of Artificial Sequence: Synthetic coding sequence
atgagcgacggcctggacaacgaggagaagccccccgccccccccttacggatgaatagtaataacagagattcatctgccctcaaccattcctccaaacccttgcctatggccccagaggagaagaacaaaaaggcgagactgcgctccatctttcctggaggaggtgataagaccaacaaaaaaaaagagaaagaacgtccagagatatcactcccaagcgactttgagcacactatccacgtgggttttgatgccgtcacaggagagttcactggaatccccgaacagtgggcgcgactcttgcagaccagtaatatcactaagcttgaacagaaaaaaaatccacaggctgttctggacgtgctgaaattctacgactcaaaggaaacggtgaataatcaaaagtacatgtcattcacctcaggagacaagtcagctcatggctatatcgctgcacaccccagctccacaaaaaccgcgtccgaaccgcctttggcccccccagtcagcgaagaagaggatgaggaagaggaggaggaggaggatgagaacgaaccaccacccgtcatcgcaccacgaccagagcacaccaagtccatatatacccgctctgttgtcgaaagcatcgcttcaccagccgtcccaaataaggaggtgactcccccttcagccgagaacgcaaactcatcaaccctttaccgtaataccgacaggcaaagaaagaagtccaagatgactgatgaagaaattctcgagaaactccgctccatcgtgtccgttggtgatcctaaaaaaaaatatacccgatttgagaagatcggtcagggagcctctggcactgtgtatactgcgctggacattgcaacaggccaggaggtggcgattaagcagatgaatcttcagcagcagcccaagaaagagctgatcattaacgagattctggtgatgcgggaaaacaaaaatcctaacattgtgaattatctggactcatatttggtcggggatgagttgtgggtggtgatggagtatctggctggcggttccctgaccgatgtggtaaccgagacatgtatggacgaggggcagatcgcagccgtgtgccgggaatgcctgcaggccctggatttcctgcacagcaatcaggtgattcacagagatattaaatccgacaacatcctactggggatggatggcagtgtcaaactgacagacttcggcttctgcgcccagataactcctgagcaaagcaagcgctcaacaatggtcggaacgccctactggatggcaccagaagtggtgacacgtaaggcctacggcccaaaggttgatatctggtctctagggatcatggctatcgagatggtggagggagaacccccttacttaaatgaaaatcccctgcgcgccttatatcttatcgccaccaacgggacaccagagctccaaaatcccgagcgacttagcgccgtgttccgggacttcctcaacaggtgtctggagatggacgtggaccgcagaggatcagctaaggaactactacaacaccctttcttgaaactggcgaagccactgtcaagcctaacacctttgatcatcgctgccaaggaagccatcaaaaatagttctagatag

SEQ ID NO: 198434 - DNA, 1680 bp, Artificial Sequence
  Description of Artificial Sequence: Synthetic coding sequence
atgagcgacggcctggacaacgaggagaagccccccgccccccccctgcgtatgaactccaacaatagggactcctccgcactgaaccatagtagcaaaccattgcctatggcaccagaggagaagaataagaaggcccggctccgatctatctttcccggcggtggcgacaaaacaaacaaaaagaaagagaaggagcgtcccgaaatcagcctgccaagcgacttcgagcacaccatccacgtcgggttcgatgctgtgactggggaattcacacctgacctttatggatcgcagatgtgtcccggcaagctgcctgagggaattcccgaacaatgggctcgattactccagacttctaacattacgaaactggagcagaagaaaaaccctcaggctgtgctggatgtcctgaagttttacgactctaaggaaaccgtgaacaaccagaaatacatgagcttcacatctggcgacaaaagcgctcatgggtacatcgctgcccacccttccagcaccaaaaccgcatcagaaccaccactcgcccctcctgtgagcgaagaggaggatgaggaagaggaggaggaagaggatgagaacgaacccccacctgtcatagcccccagaccggagcacacaaagagcatctatacgcgctctgtggtcgagtctattgccagtccggcagtgcctaataaagaggttaccccgcctagtgccgaaaacgccaactcatctaccctgtatagaaacaccgaccgccagcggaagaaaagcaagatgacagacgaagaaattctcgagaagctaagatctattgtgtcagtaggtgaccctaagaagaagtacaccaggttcgagaaaatcgggcagggcgcaagcgggaccgtgtataccgcgctcgatatcgctacaggccaggaagttgccattaaacagatgaacttacagcagcagccgaagaaagagctgattattaatgagattttagtcatgcgggagaacaaaaatccaaatatcgtgaactacttggacagttacttggtcggcgatgagctgtgggtggtgatggaatacctcgccgggggatcgctcacagacgtcgtcaccgaaacctgcatggacgagggtcagatcgctgccgtgtgccgcgagtgcctgcaggctctggacttcttgcattccaaccaggttatccatcgagacatcaagagcgacaatattctgctgggtatggacggttccgtaaagcttacagatttcgggttctgcgcccagataacaccggaacaaagcaagaggagcacaatggtggggacaccctactggatggcccctgaagtagtgactaggaaagcctacggtccgaaggtcgatatctggtcccttggaattatggccatcgaaatggtggaaggcgagcctccctatttgaatgagaacccacttcgcgccctgtatctaatagcaacgaatggcaccccagaacttcaaaaccccgagaggctcagtgccgtgttcagagattttctgaatagatgcctggaaatggatgtggatcgcagaggaagcgctaaggagctactgcagcatccctttctgaagttggccaagccactgtcatcccttacgccgctgatcattgctgctaaggaggcaattaaaaacagctctcgctag

SEQ ID NO: 198435 - DNA, 1698 bp, Artificial Sequence
  Description of Artificial Sequence: Synthetic coding sequence
atgagcgacggcctggacaacgaggagaagccccccgccccccccttgcgcatgaacagcaataaccgggattcctcagcactgaatcacagtagtaagccgcttcccatggcacccgaggagaagaacaagaaagctcgattacggtctatcttcccgggtgggggagataaaactaataagaaaaaagagaaagagcgacctgagatctcacttcctagcgactttgagcacactatacatgtgggattcgatgccgtcaccggcgaattcaccaatagcccattccaaacatctagacccgtcactgtggctagctctcagtcggagggaaagatgggcattccggagcagtgggcaaggctgctgcagacatccaacataactaaattagagcagaagaagaacccccaggcagtgctcgacgtcctcaaattctacgattcaaaggagactgttaataatcagaagtacatgtcttttacgagcggtgataagagcgcacatggttatattgctgcacacccaagcagcacaaaaacagcttcagaacccccattggctcctcctgtgagcgaggaagaggatgaggaggaggaagaggaagaggatgagaatgaacccccccctgtgatcgcccctcgtccggaacacactaagtccatctacacccgctccgttgtcgagtcaatcgcctcacctgcagtgccaaataaggaggtaacgccgccctccgccgagaatgcaaattccagcacattgtatagaaacaccgatcgccagcggaagaagagcaaaatgacagatgaagagattttagagaagctgcggtccattgtttcagtgggagacccaaagaagaagtatacccggtttgagaagattggccaaggcgcttcaggcaccgtgtataccgcccttgacatcgccaccggacaagaggttgcaataaagcagatgaacctgcagcagcagccgaaaaaggagctgatcataaatgaaatcctcgtgatgcgagaaaataaaaaccccaatatcgtgaactatcttgactcatacttggttggagatgagctctgggtggtcatggagtacctggctggtggaagcttgacggacgtggtcacagagacctgcatggatgagggccagatcgctgctgtctgtagggaatgcctacaagcccttgatttcctacactcgaatcaggtgatccatcgagacataaagtccgacaacatattactgggtatggatggatccgtgaagctgactgacttcggcttctgcgcccaaataacaccggaacaatctaagagaagcactatggtggggaccccttactggatggcccccgaggtagtgacaagaaaagcatacggacccaaagttgacatctggagcctaggaataatggctatcgagatggtggaaggcgagcccccttacctcaatgaaaatcccttgcgggcactctatctaatagccactaatggtactccagagctgcagaaccctgaaaggctcagtgccgtgtttcgggattttctgaatcgctgtctggaaatggatgtggaccggcggggtagtgcaaaggagctgctgcagcaccccttcctgaaattggcgaaaccactcagttcactcactcccctaatcattgccgcgaaagaagccataaaaaattcatcccggtag

SEQ ID NO: 198436 - DNA, 1635 bp, Artificial Sequence
  Description of Artificial Sequence: Synthetic coding sequence
atgagcgacggcctggacaacgaggagaagccccccgccccccccttgaggatgaattcaaataatcgtgacagcagcgcactgaatcattcctccaagcccctccccatggcccctgaggaaaaaaacaaaaaggcaagactgaggtcaatattccctggcggcggggacaagactaataaaaagaaggaaaaggagcgtccagagatatcattgccctcagattttgaacacacaatccacgtgggcttcgacgccgtcaccggcgaatttacgggaattcccgagcaatgggcgcgcttattacagacatcgaacattaccaaactcgagcaaaagaaaaacccacaggccgtgctcgacgttttgaaattctacgactccaaggagactgtgaataatcaaaaatatatgagctttacgagcggggataaaagtgcgcatgggtacattgctgcccatccatcttctaccaaaaccgctagtgagcctccactagctcccccagtctccgaagaggaggacgaggaggaagaagaagaggaggatgagaatgaacctccacccgttatagctcccaggccggaacacaccaaatcaatttatacccgttcagtcgtggagagtattgcctcccctgcagtgcccaataaggaagtgacacctcccagcgctgaaaacgcaaattcctccactctgtatcggaataccgatagacagagaaagaagagcaagatgaccgatgaagagattctggagaagctccgatctatagttagtgtgggagacccaaagaagaaatacacgcgttttgagaagattggccagggggcttccggtacggtctacaccgccttggatatagcaaccggtcaggaagtggctataaaacagatgaatcttcaacagcaacccaagaaggagctgatcataaacgaaatccttgttatgagagagaacaagaaccccaacatcgtaaattatcttgattcatatctcgtaggcgacgagctttgggtcgtcatggagtacctggcgggtggcagccttacagatgtggttaccgaaacctgcatggacgaggggcaaatcgcagcagtgtgcagagaatgcctgcaggccctggattttctgcattctaatcaggttattcatagggatattaaatcagacaatatcctcttgggaatggacggatccgtgaagctcactgacttcggtttttgcgcccaaataacaccagagcagagcaagcggagcaccatggtgggaactccttactggatggcccccgaggttgttacccgcaaagcctacggccccaaggtcgatatatggtcgctgggtatcatggctatcgaaatggtggagggagaacccccttaccttaacgagaatccgttgcgggccttgtacctgatagctactaatggcaccccggaacttcagaatcccgaacgtctgtccgccgtgtttagggattttctgaaccgctgccttgagatggatgtagaccggagaggttccgctaaagagcttttgcaacacccattcctgaagctagcaaagcctctctcctctcttaccccgctcattatagccgcaaaagaggccataaagaactcctccagatag

SEQ ID NO: 198437 - DNA, 546 bp, Artificial Sequence
  Description of Artificial Sequence: Synthetic coding sequence
atgagcgacggcctggacaacgaggagaagccccccgccccccccttgagaatgaactcaaacaaccgggactcctccgcattgaaccactcgagcaagccacttcctatggctcccgaggagaaaaacaagaaagccagacttaggagtatcttcccgggcggtggtgataaaacaaacaaaaaaaaagaaaaggaacggcccgagatcagcctgccctccgatttcgagcatacgattcacgttggtttcgatgctgtcactggcgaattcaccaactcgccatttcagacgtcacgcccagtaactgtagcatcaagtcaaagcgaaggaaagatgcccgacctctacgggagccagatgtgccccgggaaactgccagaggggattcccgagcagtgggccagactgctgcagaccagtaacattactaagttggagcagaagaaaaatccgcaggccgtcctagatgtcctcaagttctacgatagcaaagagactgtgaacaatcagaagtacatgtcattcacttctggtgataagtag

SEQ ID NO: 198438 - DNA, 1635 bp, Artificial Sequence
  Description of Artificial Sequence: Synthetic coding sequence
atgagcgacggcctggacaacgaggagaagccccccgccccccccctgcggatgaattccaataaccgagacagcagtgccctgaaccacagcagcaagcctttaccaatggcccctgaagagaagaataagaaggcacgcttgagatctatcttccctggaggtggggataaaaccaacaagaaaaaagaaaaggaacgccctgaaatcagtctgccctctgattttgagcacaccattcatgtggggtttgacgcagtgacaggagaatttacgggcatacccgaacagtgggcaaggttactccagacatcaaacatcacgaagctggaacagaaaaagaaccctcaggccgttctggatgtgctgaaattttatgattccaaagagacggttaataatcagaagtacatgagcttcacttctggggacaagagtgcgcacggatacatcgcggcccacccatcatccaccaagaccgcttctgaacccccactggcaccccccgtgagcgaagaagaggacgaggaggaagaggaggaagaagacgaaaatgaaccacctcctgtcatagcaccgaggccagagcataccaagtctatatatacaaggtcagtggtggagtctatcgccagccctgccgtgcctaataaagaggtgacgccaccaagcgcagagaacgcgaactcttcaacactctatcggaacaccgaccggcaaagaaagaagtccaagatgaccgatgaggaaatcctcgagaagttgcgctcaatagtctccgtaggggacccaaagaagaagtatacccggtttgaaaaaattggacagggcgcgagcggtacagtgtatacggctctagacatcgcgacaggtcaggaggtagctatcaagcaaatgaacctgcagcagcagcccaagaaagaattgattattaacgaaatcctggtaatgcgggaaaacaagaaccctaacattgttaattacctcgatagctatttggtcggtgatgagctgtgggtggtcatggagtacctcgcgggtggctctctgacagacgtagtaacagaaacctgtatggacgaaggacagatcgccgccgtgtgccgcgaatgtttgcaagcactagattttctccactctaatcaggtgattcacagggacatcaagagtgacaatatcttacttggaatggacgggtccgttaaactcaccgatttcggcttttgtgcccagatcactccagagcagtctaaacggtccaccatggtgggcaccccctattggatggctcccgaggtggtcactcgtaaagcctatgggcccaaggttgatatttggagtttggggattatggccattgagatggtcgaaggcgagccaccatatctgaatgaaaacccactgagggccctgtacttgattgcgacaaatggtacgcccgagctgcagaacccagagcgactaagtgcggtgttccgcgacttcctgaacaggtgcctggaaatggacgtggacaggaggggaagcgctaaggaactgttacagcacccgttcctgaagctcgcaaagcctctgtcaagccttactcctctgattatcgccgctaaagaggccattaaaaacagttcacgctag

SEQ ID NO: 198439 - DNA, 1743 bp, Artificial Sequence
  Description of Artificial Sequence: Synthetic coding sequence
atgagcgacggcctggacaacgaggagaagccccccgccccccccctcagaatgaattccaacaatcgggactcttccgctctgaatcatagttccaaaccactgccaatggcgcctgaagagaagaataagaaggcgcggctgcgctcgattttccccgggggaggggataagacaaacaagaagaaggaaaaagagcggccagagatcagtctccctagcgactttgaacatactatccatgtggggttcgacgctgtgacaggagaattcactaactccccatttcagacttctcgtccggtcacagtggcgagttctcagagtgaaggcaagatgcccgatctgtacggaagtcagatgtgtcccggtaagctgccagagggaataccagaacagtgggccaggctgctccagaccagtaatataaccaagctcgaacagaagaaaaaccctcaagcagtcctggatgtattgaaattttatgactcgaaagagaccgtcaataaccagaagtacatgtcattcacttctggagacaagagcgcccacggctacatcgcagcacatccctcatccaccaagacagccagcgagcccccactcgccccgccggtcagcgaggaagaagatgaagaggaggaagaggaggaggatgagaatgaaccaccaccagtcattgcgccccggcctgagcataccaagagcatttacactcgatcagtggtcgagtcgatcgctagccccgctgtacccaataaggaggtgacccccccttcagcggagaatgctaacagttctaccctctaccgaaacaccgaccgacaacgaaagaaatccaagatgacagacgaagagattctggaaaagctgcgcagcatcgtttctgtcggggatcctaagaaaaagtacacgcggttcgagaaaatcggtcagggcgccagcgggactgtatatactgccctggatattgccacaggacaggaggtggctatcaagcagatgaatctgcagcagcaacctaagaaagagctcatcataaatgagattctggtaatgcgggaaaataaaaatccgaatattgtgaactacctggattcgtatctcgttggggatgagctgtgggtcgtgatggaatacctcgcaggcggctccctgacagacgttgtgacagaaacctgcatggacgagggtcagattgccgctgtgtgccgagagtgcttgcaggccctggacttcctgcactcaaaccaggttatacaccgcgatataaagtctgacaatatcctcctgggcatggatgggagcgtgaagcttactgacttcggcttctgtgcgcaaatcacaccagagcagtccaagcgatccacaatggtgggcacaccgtattggatggctcctgaagttgtgacgaggaaagcttacggtcccaaggtcgatatttggagcctcggaatcatggctatcgaaatggttgagggtgaaccaccctacctgaacgaaaatccactacgcgctctttacctcattgctactaatggcactccagagctccagaaccctgagcgactatccgcagtgtttcgagacttccttaatcggtgtttggaaatggacgtcgaccggcggggctctgctaaagaactgctgcagcatccattcctgaagttggcgaaaccactgtcctcattgacgcctctgataatcgcagccaaggaggccatcaagaacagcagtaggtag

SEQ ID NO: 198440 - DNA, 1698 bp, Artificial Sequence
  Description of Artificial Sequence: Synthetic coding sequence
atgagcgacggcctggacaacgaggagaagccccccgccccccccctgaggatgaattcaaacaaccgcgactcgtccgccttaaaccattcttcgaagccccttccaatggctccagaggagaagaataaaaaggccaggctccgctcgatctttcctggggggggcgacaaaaccaataaaaaaaaagaaaaagagcgcccagaaatctctctgccctctgacttcgagcatactattcacgtcggctttgatgccgtcacaggagagtttacaaactctccattccagacaagtcgcccggtaaccgttgcctcctcccagagcgaagggaagatgggcatccccgagcaatgggccagattgttacagactagcaatattactaaactggaacaaaaaaagaatccccaggctgttctggacgtgctgaaattctatgatagcaaagaaactgtcaacaaccagaagtacatgtcattcactagtggtgacaaaagtgctcacgggtatatagctgcacacccctccagcacaaagactgcttccgaaccacctcttgcgccaccagtgtctgaagaagaagatgaggaggaggaagaggaggaggatgagaacgaaccacccccagtgatcgcgccacgccccgagcacaccaaatcgatttataccaggagcgtagttgaatctattgcctcccctgcagtgcccaataaggaggttacgccaccaagcgccgaaaacgcaaacagctcaacactgtaccggaataccgaccggcaacgaaaaaaatctaagatgacagatgaggagattctcgagaaactccggtcaatcgtgtccgtgggcgatccaaaaaagaaatatacccggttcgagaagatcggccagggtgccagcggtacggtctacactgcactggatatcgctaccggacaggaagtggctattaaacagatgaacctccaacagcaacctaaaaaggaattgatcatcaatgagattctggtcatgcgcgagaataaaaatcctaatattgtcaactatctggactcttacctggttggtgacgagctttgggtagtgatggaatacctagctggcggttcgcttacagatgtggtgaccgagacttgcatggacgagggtcagatcgcggctgtgtgcagagaatgtctccaggctctggactttctgcatagtaatcaggtgatacaccgggatataaagtcagacaacatactcctgggtatggatgggagcgtgaagctgaccgattttggcttctgtgcccagattacacctgaacaatctaagcgcagcacaatggtggggaccccatactggatggcccccgaggtcgtgactaggaaggcttacgggccaaaagtggatatctggagtctaggtattatggcaattgagatggtggagggcgaaccaccatacttgaatgaaaatccattaagggccctctatctgattgctaccaacggaacacccgagctccagaatccagagaggctgagcgcagtgttccgcgattttctgaatcgttgtctcgaaatggacgtggatcgcaggggcagcgctaaggagcttctgcagcatcccttcttaaagcttgccaagcccctcagctcactgacgccactcatcatagcggcgaaagaagccatcaagaatagtagtcggtag

SEQ ID NO: 198441 - DNA, 2046 bp, Artificial Sequence
  Description of Artificial Sequence: Synthetic coding sequence
atgttccggaagaagaagaagaagcggcccgagatcagcgccccccagaactttcagcatagagttcacacaagtttcgatcccaaggagggcaagttcgtcggccttcctccacagtggcaaaacatactcgatacactgcggcgccctaagcctgttgtggaccccagcagaatcaccagggtccaactccagcctatgaaaactgtggtccgcggctccgcaatgcctgtggacgggtatatcagcgggttgctgaatgacattcagaaactgtccgtaatttcgtctaataccttaagaggtcggagccctacttcccggaggcgcgcacaaagcctgggactgctaggagacgagcattgggccacggaccctgatatgtacttgcagtcaccccagagtgagagaaccgaccctcatggcctctacctcagttgcaatggaggcacccccgccggtcataaacagatgccctggcccgaaccacagtcacccagagtcctaccgaatggactggccgctaaagcccagtcactcgggcccgccgaattccagggagcatcacagaggtgcctccagctaggcgcatgccttcaaagcagtccacccggcgcttctccacctaccgggaccaataggcatggtatgaaagccgcgaaacacggaagcgaggaggcccgaccacagagctgcttagtcggttctgccaccggtagaccaggaggagaagggtcaccaagccctaaaactcgcgagtcatctctgaagcgcagactttttcggtctatgttcctttctactgcggctactgccccccccagcagctcgaagcccggaccgccgcctcaatccaagcctaatagtagcttcaggcctccacagaaggataatccaccctccctcgtcgccaaggcccagagcctgccttccgaccagccggtcggcactttttctccacttaccacaagcgacaccagctctccacagaagagtctgaggaccgcgccagctacaggccagttacccggcagatcttcacccgctggaagtccaagaacatggcatgcccagatcagcacatctaacctgtatctgccccaggatcctacagtcgccaagggggcgctagccggggaagataccggggtagtgacccatgaacagttcaaggcggctctgcgaatggtggtggatcagggcgacccacgcctgcttctagattcttacgtcaagataggagagggctcgacaggcattgtgtgtctggctagggaaaaacattctggaaggcaggttgcagtgaagatgatggatctccgcaaacaacaacggagagagttgttattcaacgaagtggtcatcatgagggattatcaacacttcaacgtcgtggaaatgtataaaagctatctggttggggaggaactttgggtcctcatggaattcctgcaagggggagcacttacggacatcgtgagtcaagtgcggctgaacgaagaacagatcgctacggtgtgtgaggccgttctgcaggcccttgcttacttacatgcccaaggcgtgattcatagagacatcaagagtgactctattctcctcacactcgacggtagggtcaaactgtctgactttggcttctgtgcccagatatccaaggatgtacccaaacgcaagtcactcgttgggacgccttactggatggcccccgaagtaatttcacgtagtctttacgccaccgaggtggatatatggagcttaggcatcatggtgatcgagatggtggacggggaaccgccttacttctctgacagtcccgtccaggctatgaaaagactaagagactctcctccacccaagttgaaaaatagtcataaagtatctcctgtcctgagggactttctggagaggatgcttgtcagagatcctcaagagcgagccaccgctcaagagcttttggatcacccgtttctgctacagacagggcttccagaatgccttgtgcctctaattcagctgtatagaaagcagactagtacttgctag

SEQ ID NO: 198442 - DNA, 2046 bp, Artificial Sequence
  Description of Artificial Sequence: Synthetic coding sequence
atgttccggaagaagaagaagaagcggcccgagatcagcgccccccaaaatttccaacaccgggtccatacaagcttcgaccctaaagaggggaaattcgtgggactcccccctcagtggcagaatatcctggacactctgcggcgccccaaacctgtggtcgaccctagcaggataacacgcgttcagctgcagcccatgaaaaccgttgtgcggggctccgcaatgccagtggacggttatataagtggtctgctcaacgacattcagaaacttagtgtaatatctagcaataccctgcggggtcggtccccgacctctagacggagagcccagtctttgggcttgctcggcgatgagcactgggccactgacccagacatgtacctacagtccccacaatccgagagaacagaccctcacggcctttacttgtcttgcaatgggggtactccagctggtcataagcagatgccgtggcccgagcctcaatccccgcgggtcctccccaacggactggcagctaaagcacagtcactgggacctgcagaattccagggcgcatcccagcggtgcttgcaacttggcgcctgcttacagagtagcccaccaggcgcatcaccaccgaccggcaccaaccgacacggaatgaaagctgccaagcatggcagcgaggaagcccggccacagtcttgcctagtcggttccgctaccggccggcccgggggcgaagggtccccttcccccaagactagggaaagcagccttaaacgcagactctttcggtcgatgttcctgtcaacagctgctacagccccccccagctcttcgaagcccggtccaccacctcagtcaaagcccaacagttcattccgaccccctcaaaaagataacccaccaagtcttgttgcgaaagcgcagtccctaccgagtgaccagcccgtgggaacattttccccattaacaacttccgacacctcgagcccccagaaatcgttaaggactgctcctgccaccggtcagctccccggcagaagttcacctgcaggaagcccccgtacctggcacgcccagatcagcacatctaatctgtatcttccacaggaccctaccgtcgcaaagggcgccttggctggcgaggacactggagtggtgactcatgaacagttcaaagctgccttacgcatggttgttgaccaaggagatccccggctccttctcgactcctatgtgaagataggggaaggctcaacgggtattgtatgtctggcacgcgagaagcattcaggtcgccaggtcgcagtcaaaatgatggacctgcgtaagcagcaacgccgggagctgctcttcaacgaagtggtgataatgcgcgattaccagcattttaatgtggtggaaatgtacaagtcatacttagtaggagaagaactgtgggtcctgatggagttccttcaaggtggcgcactcaccgatatcgtctcacaggtgcggctgaacgaggaacagattgccactgtctgtgaagccgtgctgcaggctctggcatacctccacgcacagggcgtcatccatcgcgacatcaagagcgattccattctgctgacgttggatggcagagtcaagctttcggactttgggttctgcgctcagatttctaaagacgtgcctaagcgaaaatcactggttggaaccccttattggatggctcctgaagtcatcagtcggagcttgtacgcaaccgaggttgacatctggagtttgggaatcatggtgatcgaaatggttgacggcgagcctccatatttttctgattctccagtgcaagccatgaagcgtctgcgggattccccacctcccaaactaaagaactctcataaagtctctcctgtactgcgcgattttctggaacggatgcttgtgcgcgatccacaggagcgagcaaccgctcaggaactgctggaccatccttttctcctacaaacggggcttcccgagtgtctggttccactgattcagctctatagaaagcagacctccacctgctag

SEQ ID NO: 198443 - DNA, 2046 bp, Artificial Sequence
  Description of Artificial Sequence: Synthetic coding sequence
atgttccggaagaagaagaagaagcggcccgagatcagcgccccccagaatttccagcatcgagtacacacgagttttgacccaaaagaaggaaaattcgtcggacttcccccccagtggcaaaatatcctggataccctgagacggccaaagcccgtggtagatccgtctcggatcaccagagttcaacttcagcccatgaagactgtggtgcgaggcagtgcgatgccagtggacggctatatctctgggcttctcaatgacatccagaagctatccgttatatcgagtaataccctaagagggaggtcacctaccagtcggcgaagggctcagagcctgggcttgcttggcgacgaacattgggctaccgatcctgacatgtacttgcaatctccacagtccgagagaacagatccccacggactatatttgtcgtgcaatggaggaacccctgctggtcataagcagatgccgtggccagagccgcagtcccccagggttcttcctaatgggttagctgcaaaggcacaatcactcggacccgcggaatttcagggcgcttctcagcgctgtctgcaacttggcgcttgtttgcagagctcaccccctggggccagcccaccaacagggactaatcgccacggcatgaaagccgcaaaacatggctccgaggaagccaggccacagtcttgtctggttggttctgcaacaggcaggcccggtggagaaggttcacccagtccaaagacccgcgagtcttctctcaaaaggaggctatttcgaagcatgttcttgtccaccgccgcaacagcgcccccatcatctagtaagcctggcccccccccacagagcaagccaaactcctcttttcgaccaccccaaaaggacaaccctccatcactcgttgctaaggcacaatctcttccgagcgaccaaccagtggggacattcagcccgttgactacctctgatacctcttctccacagaagtccctccgaacggcccccgccaccggacaactacccggtcgcagctccccggctggttcccccagaacctggcatgcccaaatctccactagcaacctttatcttccccaggatcccactgtggcgaagggcgcattagcgggcgaggacaccggcgttgtgacacacgagcagttcaaagcagccttgaggatggtggtcgaccaaggcgatccccgcctactcttggactcttacgttaaaattggagaagggtctaccggcatcgtctgcctggcccgcgaaaaacactccgggcgccaagtggccgtgaagatgatggacctacggaaacagcagagaagagaactgctcttcaacgaggtggtcatcatgagagactatcagcacttcaacgtggtcgagatgtacaaaagttatttggtcggagaagaactgtgggtgttaatggagtttttgcagggtggagcgctgaccgacatcgtatcccaggttcgcctgaatgaggaacagatagctactgtgtgtgaggctgttttgcaggctctagcatacctccacgcacagggcgttatccacagagatattaagtcagacagcatcctcctgacccttgatgggcgcgtcaagttgtccgacttcggcttctgtgcccagatctcaaaggatgtacccaaaagaaagtccctggtggggactccatactggatggccccagaagtcatctcaagatccctgtacgccactgaagtcgacatctggtctctgggcatcatggtcatagagatggtcgacggtgagcctccctacttcagcgacagccctgtacaagcaatgaagcggttacgcgactcgcccccaccgaaattgaagaactcccacaaggtttctcctgtgctccgagatttcctggagcgcatgctggttcgcgacccccaggaaagggctaccgcccaagagttgctcgaccatcccttcctcctgcagacgggactcccagagtgcctagttcccctcatccagttgtatcgtaagcaaacctcaacttgctag

SEQ ID NO: 198444 - DNA, 369 bp, Artificial Sequence
  Description of Artificial Sequence: Synthetic coding sequence
atgttccggaagaagaagaagaagcggcccgagatcagcgccccccagaatttccagcatcgcgttcacacaagctttgatcccaaagaagggaaattcgtcggattgccaccccaatggcagaacattctggacacgcttaggcgccctaaacctgtcgtggaccctagccgaatcactagggtgcagctgcagccaatgaagaccgtggtgcgcggctccgcgatgcctgtggacggctatatctcaggacttctgaatgacatacagaagttgtccgtcatctcttccaacaccttaagaggacgatctcccacatctcgtcggagagcccaaagtttgggattactgggggacgagcactggtag

SEQ ID NO: 198445 - DNA, 372 bp, Artificial Sequence
  Description of Artificial Sequence: Synthetic coding sequence
atgttccggaagaagaagaagaagcggcccgagatcagcgccccccagaatttccagcatcgcgtgcacacctcattcgacccgaaagagggcaaattcgtaggacttccgccacaatggcaaaacatcctcgatacgcttcggagaccgaaacctgtggtggatcctagtaggataaccagagtacaactgcagccaatgaagacagttgtccggggttccgctatgccagtcgatggctatatcagcgggcttctgaacgatatacagaagctgtctgttatttcttcaaacaccctgcgaggaagatctccaaccagtcgtcgtcgcgcccagtctctgggactcttaggagacgaacactgggcttag

SEQ ID NO: 198446 - DNA, 330 bp, Artificial Sequence
  Description of Artificial Sequence: Synthetic coding sequence
atgttccggaagaagaagaagaagcggcccgagatcagcgccccccagaacttccagcatcgcgtgcacaccagctttgaccccaaggaggggaagttcgtcggtctgcccccccaatggcaaaacattctggatacactgcggaggcctaaacctgtcgtggacccatctcggataaccagggtgcagctacaaccaatgaagaccgtggtgagaggctccgcaatgccggtcgatggctatatttcaggacttttgaatgatatccagaagctctcagtcatctcctcaaataccttgagaggacgatctcccactagcagaaggtag

SEQ ID NO: 198447 - DNA, 339 bp, Artificial Sequence
  Description of Artificial Sequence: Synthetic coding sequence
atgttccggaagaagaagaagaagcggcccgagatcagcgccccccagaacttccagcatcgggtgcacacctctttcgatcctaaggaaggtaagttcgtgggtcttcctccacagtggcagaatatcttggataccttgcgacggccaaagcctgtcgtcgacccctcccgaattacacgcgttcagctgcagcccatgaaaaccgtggtgaggggctcagctatgccagtagatgggtacatcagcggacttctgaatgatattcagaagctgtcagtgatttcttctaacacactgagagggagatcacccactagtagaagaagggctcagtag

SEQ ID NO: 198448 - DNA, 2046 bp, Artificial Sequence
  Description of Artificial Sequence: Synthetic coding sequence
atgttccggaagaagaagaagaagcggcccgagatcagcgccccccagaactttcagcatcgagtacatactagcttcgaccccaaggaaggcaaatttgttggattgccccctcagtggcagaacatccttgatacgctgaggagaccgaagccagtcgtggacccatcaaggattacccgagtgcagttacagcctatgaagactgtagtccgcggtagtgcaatgccagtcgacgggtacatctcaggcctcctaaacgacatccagaagctgtctgtcatttcaagtaataccctgcgcggccgttcacccacctctcgccggcgggcccaatctctcggattgcttggggacgagcattgggcgactgaccccgacatgtatcttcagagccctcagagtgaaagaacagatccacatgggctgtatctcagttgcaacgggggcacacctgccggccataaacagatgccttggcccgaaccccagagccctagggtgctccccaacgggctcgccgcaaaggcccagagcctgggacccgccgagtttcaaggagcctcccagaggtgcctgcagctgggagcctgtctccagagctcccccccaggggcgtcacctcctaccggcacaaatcgccacggcatgaaggccgcaaagcacggctctgaggaagcccgcccccagtcctgtctggttggcagcgctaccggtcggccgggcggagagggttccccttcacccaagacacgcgaaagctctctgaaacgcaggctgtttagaagcatgttcctttccactgccgcaacagctcccccctcttcttctaagcccgggccgcccccgcagtcgaaacctaacagctcctttaggcccccccagaaggataacccaccctcccttgttgcgaaggcccagtcattaccctctgatcaacctgtggggaccttttccccgcttactacctccgacacctcctcacctcagaaatccctgcgaaccgctccagcgactgggcaattgccaggccggtcatcccccgccggatctccccggacctggcacgcccagatcagtacaagcaacctttacctcccacaggaccccaccgttgccaaaggcgcgctcgcaggagaagatacgggggtagttacccatgagcagttcaaagctgctcttcgcatggtcgtggatcaaggcgatccacgtttgcttttggactcttatgtgaagattggagaaggctccaccgggatcgtttgtttagcaagggagaaacacagtggtcgccaggtggcggtcaaaatgatggacctacggaagcagcagcgtagagagctactgttcaacgaagtcgtgattatgagagactaccagcatttcaatgtggtggaaatgtataagtcttacttggtgggcgaagagctctgggtgttgatggagttcttacaggggggcgctctgacagacatcgtctcacaggtgcggctgaatgaagaacaaatcgctacagtttgtgaagctgtattacaggccctagcttacctgcacgcccagggcgtgatccacagggacatcaagtccgatagcattcttctgaccctggatggtcgcgtaaaactaagtgacttcggcttctgtgcacagatcagcaaggatgttcctaagagaaaaagcctggtggggacaccatactggatggcaccggaggtgattagccggtccctgtacgccaccgaggtcgatatttggtcactgggaatcatggttatagagatggttgatggggaacctccctatttcagtgacagcccagttcaagcaatgaagcggctgagagatagccccccgcctaaactgaaaaatagtcataaggtcagccccgtcctccgggacttcctagaaagaatgctggtcagagatccccaggagagagccacagcacaggaactcttggaccacccgttcctgctgcagactggcctaccagaatgtttggttccgctgatccaactttaccgcaagcaaacctctacctgctag

SEQ ID NO: 198449 - DNA, 855 bp, Artificial Sequence
  Description of Artificial Sequence: Synthetic coding sequence
atgttccggaagaagaagaagaagcggcccgagatcagcgccccccagaactttcagcatagagtacacacaagcttcgatccaaaagagggcaagttcgtgggcctgccacctcaatggcagaatatccttgatacactcagacggcctaagccagtcgtagacccttctcggattacacgagtccaactccagcctatgaagacagtggtgaggggctcggctatgcctgtggacgggtacatcagtggcctgctaaatgacattcagaagctcagcgtcatttcaagcaatacactccgggggaggtctcccactagccgaaggcgagcgcagtctctcgggctcctgggagatgagcattgggcaaccgatcccgatatgtacttgcagagcccacagagcgaacggaccgacccccacggcctatatctctcctgtaacggggggacacctgctggacacaagcagatgccttggccagaaccacagtccccaagagtgctgccgaatgggttagcagctaaggcccagtctttaggtcccgctgaattccagggagcatctcagaggtgcctgcagcttggtgcatgtctccagtcgtccccaccgggtgccagcccaccaaccggaacaaacagacacggaatgaaggcagccaaacatggctcagaagaggctcgtcctcagtcctgtctcgttggatctgccacaggtcgccccggcggggaggggtctcctagccccaagacgcgcgaaagttcgctgaagcgacgtctctttcgcagcatgttcctgtccaccgcagccactgccccaccaagctctagcaagccgggacccccacctcagtag

SEQ ID NO: 198450 - DNA, 318 bp, Artificial Sequence
  Description of Artificial Sequence: Synthetic coding sequence
atgttccggaagaagaagaagaagcggcccgagatcagcgccccccagaatttccagcatcgtgttcatacgtcttttgatcccaaagaaggaaagttcgtaggactgccccctcagtggcagaacatacttgatactcttcggcgtccgaagcctgtggtggatccctcacgaattacacgcgttcagttacaacccatgaagaccgtggtccgaggcagcgccatgcctgttgacggatacatttcaggtcttctcaacgacatccagaaactgtccgtgatttcctccaatactcttagaggccgtagcccttag

SEQ ID NO: 198451 - DNA, 441 bp, Artificial Sequence
  Description of Artificial Sequence: Synthetic coding sequence
atgatcaacatgggcgacagccacgtggacaccagcagcaccgtgtctgaggctgtggccgaggaagtgagcctttttagtatgacggacatgatcctgttttctctgattgtgggactcctgacatattggttcctatttcgcaaaaaaaaagaggaggttccagagtttacaaagattcagacccttacttcgagtgttagagagtcctcctttgtggagaagatgaaaaagactgggcggaacatcatcgtgttctacggatcccagaccggaactgcagaggagttcgcgaatcgactgagtaaagatgcccaccgatatggaatgcgcggtatgagcgccgatccggaggagtacgatttggctgacctgtctagcctccctgaaattgataatgcactggtggtgttttgtatggccacatacggtgagggatag

SEQ ID NO: 198452 - DNA, 519 bp, Artificial Sequence
  Description of Artificial Sequence: Synthetic coding sequence
atgatcaacatgggcgacagccacgtggacaccagcagcaccgtgtccgaggccgtagccgaagaggtgtctcttttctctatgacagacatgattttgttttctcttatagtcggtctgctgacatactggttcctttttcgcaagaagaaagaggaagtacccgaatttacaaagattcaaaccctgacatcaagcgtccgggagagttcgtttgtggagaaaatgaagaagaccggaaggaacatcatcgttttctatggttcacagacggggacagctgaggagttcgcaaatcgcctctctaaagacgctcatcggtacggcatgcggggaatgagtgccgatccagaggagtacgatctggcggatcttagttctctccccgaaatcgacaatgcgctagtggtattttgtatggcaacctacggggagggcgatcccactgataatgctcaggacttctacgattggctccaggaaaccgatgtggacctgtccggggtaaaattcgcatag

SEQ ID NO: 198453 - DNA, 189 bp, Artificial Sequence
  Description of Artificial Sequence: Synthetic coding sequence
atgatcaacatgggcgacagccacgtggacaccagcagcaccgtgagtgaggccgtggccgaagaagtgtcgctgttctcgatgaccgatatgatcctatttagtctcattgtgggactgcttacctattggtttctgttccgcaagaagaaggaagaagtcccagagtttaccaagatccagacctag

SEQ ID NO: 198454 - DNA, 1107 bp, Artificial Sequence
  Description of Artificial Sequence: Synthetic coding sequence
atgggcaagtacgtggacaagcggctggagcagctgggcgcccagagaatcttcgagctcgggctcggcgacgatgatggtaacctggaagaggactttatcacctggcgggagcagttctggcccgctgtgtgcgaacattttggggttgaggctaccggagaggaatcatcaatccgccaatacgagctggttgtgcataccgatatcgatgccgcaaaagtgtacatgggagaaatggggcgcttaaagagctacgagaatcagaaaccccctttcgacgccaaaaatccatttttagcggcggttacgaccaataggaagttgaaccagggtactgaacggcatctcatgcatctcgagctggacattagtgacagcaagatacggtatgagtcaggtgatcatgtggccgtctatcccgctaacgatagcgccctagtcaaccagctgggcaagattctgggcgccgatctggacgtcgtcatgtcactcaacaacctggatgaagagtcgaataagaagcacccttttccctgccccacctcttaccggacagctttaacttattacctggatataaccaatccaccaaggactaatgtcctttacgaattggctcagtacgcttcggagccatccgagcaggaattgctcaggaagatggcttcctcttccggtgaggggaaagagttgtacctcagctgggtagtggaagccaggcggcacatcttggcaatactgcaagactgtccaagtttgaggccacccatagatcatctttgcgagctactccctaggctccaggcacggtattatagcatagcctcaagttccaaggtgcaccctaactctgtccatatatgcgcggtggtggtagagtacgagacaaaagcagggagaatcaataagggggtcgcaactaattggctgagggccaaggagcctgccggcgagaacggaggccgtgctctcgctgtgcctaccagcacctccgtggggatgcatggcacctggccaggcatgtgcagaacacccagtaccacaagctggctgagctcaggtccttggagcactaggagaagatggaccacttccagaaattag

SEQ ID NO: 198455 - DNA, 120 bp, Artificial Sequence
  Description of Artificial Sequence: Synthetic coding sequence
atgatcaacatgggcgacagccacgtggacaccagcagcaccgtgagtgaagccgtggccgaggaggtgtcgctcttttctatgaccgatatgatcctattctctctgattgtcggatag

SEQ ID NO: 198456 - DNA, 501 bp, Artificial Sequence
  Description of Artificial Sequence: Synthetic coding sequence
atgatcaacatgggcgacagccacgtggacaccagcagcaccgtgtccgaggccgtggctgaggaggtatccttgttcagcatgacagacatgattctgttcagcttaattgttgggctgctcacatactggtttctgtttaggaagaaaaaggaggaggtacccgagtttactaaaatccagaccctgactagttcggtcagggagagctccttcgtagagaagatgaagaagactggtagaaatattatcgtcttttacggatctcagactggtacagctgaagagtttgccaaccggctgagcaaagacgctcacaggtacggcatgagaggcatgtccgctgacccagaggaatatgacctagccgatcttagcagtctgcctgagatagacaatgccctggttgtattctgtatggcgacctatggcgagggggatccaacggacaacgcacaggacttttacgactggttgcaggagacagacgtcgacctgtag

SEQ ID NO: 198457 - DNA, 567 bp, Artificial Sequence
  Description of Artificial Sequence: Synthetic coding sequence
atgatcaacatgggcgacagccacgtggacaccagcagcaccgtgagtgaggcagtggctgaggaagtcagtctgttcagcatgaccgatatgattctcttttctttgattgtgggccttctaacttactggttcctattcagaaaaaaaaaggaggaagtgcccgaattcactaagatccagaccctgacatcatcggtccgggagtccagttttgtcgagaaaatgaagaaaaccggacggaacatcatagtattttatggcagtcagactgggacagctgaagaattcgccaatagactaagcaaggacgctcaccggtatggaatgaggggaatgagcgcggatcccgaggaatacgacctggccgacctgtccagcctgcccgaaatcgataacgctctggtcgtcttctgcatggccacatacggggaaggcgatccaaccgacaacgcccaggatttctatgactggctgcaggaaacagatgtggacctatctggcgtgaaatttgcagtattcgggctcggcaacaaaacttatgagcatttcaacgccatgggctag

SEQ ID NO: 198458 - DNA, 189 bp, Artificial Sequence
  Description of Artificial Sequence: Synthetic coding sequence
atgatcaacatgggcgacagccacgtggacaccagcagcaccgtgagcgaagcagtggcggaagaggtttcactgttcagcatgaccgacatgatcctgttcagtcttatcgttggcttgctcacctattggttcttattccgcaaaaagaaagaagaggtcccagaatttacaaaaattcagacatag

SEQ ID NO: 198459 - DNA, 1722 bp, Artificial Sequence
  Description of Artificial Sequence: Synthetic coding sequence
atgggcagccggtggcccgccgtgcccccctggggcctgcagatccatgtttctgagcgtcagccgtcccggccccctccctgcccacagcagccaggtcaggccacttgcgagaccttgagcagcgcacccgaccctagtacgacgaggatgtcgcccccttgtccgcagccccagagtgcccctggcggtatcggttgttggaggctgaaggtgttcggcctgggcaacaaaacttacgaacacttcaatgccatgggaaagtatgtggataagaggctggagcagctgggagcccaacggatttttgaactaggattgggggatgacgatggcaatctggaagaagacttcatcacttggagagagcaattctggcctgctgtttgtgaacactttggcgtggaggctactggcgaagagtcttcaatcaggcaatatgaactcgtcgtgcatactgacatcgacgccgcgaaggtgtatatgggagagatgggacgcctgaagtcttatgaaaatcagaaaccaccattcgatgctaaaaacccttttctcgcggccgtaacaacaaatcggaaattaaaccaggggactgaacgccacctcatgcacctcgagttagatataagcgactctaaaatccgttatgaatctggcgatcacgtggctgtctaccccgctaatgattcggcactggtaaatcagttaggaaaaattctcggcgccgaccttgacgtggtgatgtccttaaacaatctggacgaggaatcaaacaaaaagcacccgttcccttgtcctacttcttatagaaccgccttaacctattatctggacattacaaacccccctagaactaatgtattgtatgagctagcccaatacgcatcagagccatcggaacaggagctactcaggaaaatggccagcagcagcggcgaagggaaggagctttacctcagctgggtcgtggaggcaaggagacatattctcgccatcttgcaagattgcccaagcctccggccacctatcgaccatctctgcgagttacttccacggctgcaggccagatactactccattgcatcctcctctaaggttcacccaaacagcgttcatatatgcgccgtagtagtggagtacgagactaaagcaggcagaattaataagggcgtagccacaaactggttgcgcgccaaagaacccgccggagagaatggcggacgtgccctagtgccaatgttcgtgcgaaagtctcagttcaggctgccctttaaggccacaacacccgtgattatggtcgggcccggcacaggggtcgccccttttatagggtttattcaggaaagggcatggctgcggcagcaggggaaagaggtcggtgaaaccctgctgtactatggatgtagacgatcggatgaagactacctataccgggaagagttagcccagtttcatagagatggggcgcttacgcagttgaacgtcgccttctccagggaacagtcccacaaggtgtacgtgcaacaccttctcaaacaagatagagagcacctctggaaattgatagaaggaggggctcatatctatgtatgcggcactccttccagctgccccggaatgcacggaacatggcccggtatgtgtcgcacaccatctaccacgtcttggctgagctctggaccctggtccactcggcgcagatggacaactagtaggaattag

SEQ ID NO: 198460 - DNA, 423 bp, Artificial Sequence
  Description of Artificial Sequence: Synthetic coding sequence
atgatcaacatgggcgacagccacgtggacaccagcagcaccgtgagtgaagccgtcgccgaggaggtctccctgttttcaatgactgacatgattttgtttagcctaattgtcggcctgctgacttactggtttttgtttaggaagaagaaggaagaggtgccagagtttaccaagattcaaactctcacttcttcggtccgcgagtcctcctttgtcgagaagatgaaaaagactgggagaaatatcatcgtattttatggaagtcagaccgggaccgctgaggaatttgccaacagattatccaaagatgctcatcgctatggaatgcgtgggatgtcagctgatcccgaggaatacgacctggccgatctatcttctcttccggagattgataatgctctagtggttttctgtatgtag

SEQ ID NO: 198461 - DNA, 2043 bp, Artificial Sequence
  Description of Artificial Sequence: Synthetic coding sequence
atgatcaacatgggcgacagccacgtggacaccagcagcaccgtgagcgaagccgttgccgaggaggttagcctgttttctatgactgacatgatactcttcagccttatcgtgggacttctaacgtactggtttttgttcagaaagaagaaagaagaggtccctgagtttaccaagattcagaccctgaccagttctgtaagagagagcagcttcgtggaaaagatgaagaaaaccgggagaaatatcatcgtgttttatggttcccagaccggaactgctgaagaattcgcaaatagactcagtaaagacgcgcataggtatggtatgcgaggaatgagcgcagatccggaagagtatgatctggctgacctgtccagcctgcctgagatcgataatgccctggtggtcttttgtatggcaacatacggcgagggtgatcccaccgacaacgcccaggacttttacgactggctccaggaaacagacgtggacctgagtggtgtcaagtttgcggtattcggactcggcaataaaacgtatgaacattttaacgccatggggaaatacgttgataagcggctggaacagcttggggctcagcggatctttgagttaggcctgggtgacgacgacgggaatctggaggaggacttcataacctggagggagcaattttggcctgctgtgtgcgagcacttcggagttgaagctacaggtgaagaatctagcatacgtcagtacgagctagtcgttcatactgatattgacgccgccaaagtttacatgggcgagatgggccggctcaaatcctacgaaaatcagaagccaccattcgacgctaagaaccctttcctggccgctgtgactaccaaccggaagctcaatcaaggcacggaaagacacttaatgcacttggaactcgacatctccgactcaaagattaggtacgaaagcggggaccacgtggctgtgtaccccgcgaatgatagcgcattggtcaaccagctcggtaaaatcctgggcgcggacctggacgtcgttatgtctttgaacaatttggacgaggagtccaataagaaacatccttttccctgtcccacaagctaccgtaccgccttaacatactatcttgacatcactaatccaccccgcacaaatgtgctgtatgagctagctcagtacgcctcagaaccctccgaacaagaattgctccgaaaaatggcttccagttccggggagggcaaggaactctatctgtcatgggtggtggaggctcgccgacacatcctcgctatcctgcaagactgtccttctctcagaccacccattgaccacttatgtgagctgttgccacgactccaggcccgatattattctatagcctctagttcaaaagtgcaccccaacagcgtccatatatgcgctgtggtagttgaatatgagactaaggcaggacgcattaacaaaggtgtcgccactaactggctgcgcgctaaagagcccgctggtgaaaacgggggccgtgctttggtgcctatgttcgtccgcaagtcgcagttcaggctgccctttaaggcaaccacacctgtaattatggtcggtcctggcaccggagtcgcgccttttatcggcttcatccaggagcgggcctggcttaggcaacaagggaaggaggtgggcgagactctcctttattatgggtgccgccgctccgatgaggactacctttacagggaagaattggctcagtttcaccgtgatggtgcactcactcagttgaacgtcgctttctcgcgtgagcagtcacacaaagtgtatgttcaacacttgttaaagcaggatcgggagcacttgtggaagctgatcgagggtggggctcacatatacgtatgtggtgacgcaaggaacatggctagggacgtacagaatacattctatgatatcgtggccgaacttggagccatggaacacgcccaggcggtcgactatattaaaaagttaatgactaaagggagatactcactcgatgtttggagttag

SEQ ID NO: 198462 - DNA, 1467 bp, Artificial Sequence
  Description of Artificial Sequence: Synthetic coding sequence
atgccccggaccagcaccaccggctgccggcggcagacctggatctccctgggatcctccagccgcctcgaggaggactttataacatggcgcgagcaattttggcccgctgtctgtgagcattttggagtggaggcaacaggggaggagagctccataagacagtacgagctcgtggtccacactgatatcgacgccgcgaaagtgtacatgggcgaaatgggccgccttaaaagctacgagaaccagaaacctccctttgatgccaagaatccattcttagccgctgtgacaaccaacaggaaactaaatcagggaaccgagaggcaccttatgcatctcgaacttgacatctctgactctaagatcagatatgaaagcggagaccacgttgccgtatatcccgccaacgattccgctctcgtgaaccagctgggcaagattttgggggccgatctcgatgtggtgatgagtcttaataacctggacgaggagtcaaataaaaaacatccatttccgtgcccgactagttataggacagcgttaacctactatttggatatcacgaacccccctcgtaccaacgtgctttatgagctcgctcagtacgcttctgagccctccgaacaggaactactgaggaagatggcttcttcatcaggcgaagggaaggagctatacctgtcatgggtcgtcgaagctcggaggcacattctggccattctgcaggactgtccttctctgcggccccccatcgatcatctctgtgagctgctgcccagattacaggcccggtattactccatagcgtcaagttcaaaggtccatcctaattcggtacatatctgcgcagttgtggtcgagtacgagactaaagcagggagaattaacaaaggagtggctactaattggctccgggccaaagaaccagccggggagaacggaggtagagctctggtgcctatgttcgtccgtaagtctcagttccgattaccctttaaagcgaccacccccgttatcatggtgggcccaggaactggcgtagctccctttatcgggttcatccaagagcgcgcttggttgaggcagcaaggcaaggaagtgggggaaacgctgctatattacggatgccgacgctcagacgaggattacctgtatagggaagagctggcccagttccatagggacggagcactgacacagctcaacgttgcattctctcgcgagcaatctcacaaggtttacgtgcagcacctactcaaacaggatagggaacacctgtggaagctcattgaggggggcgcccacatctacgtctgtggagacgcacggaatatggctcgagacgtgcagaatactttctacgacatagtggcagaactgggtgcaatggagcacgcccaggccgttgactacatcaagaagctgatgaccaagggaagatactcactcgacgtgtggtcttag

SEQ ID NO: 198463 - DNA, 402 bp, Artificial Sequence
  Description of Artificial Sequence: Synthetic coding sequence
atgctgagccccgaggccgagcgggtgctgcggtacctggtggaggtcgaagagctggccgaggaggtcctggcagataagagacagatagtagatctcgataccaagaggaaccagaatagggaaggcctccgcgctctgcagaaagatctctccttgtccgaggatgttatggtatgcttcgggaatatgttcatcaagatgcctcaccccgaaacaaaggaaatgattgaaaaagatcaggaccaccttgataaggagattgagaaattacggaaacagctcaaggttaaagtcaacaggctgtttgaagcccaaggtaaaccagagctaaaaggcttcaacctcaatcccctcaaccaggatgaactcaaagctctgaaggtaattctgaagggttag

SEQ ID NO: 198464 - DNA, 1605 bp, Artificial Sequence
  Description of Artificial Sequence: Synthetic coding sequence
atgaagttcaccctgggcctgggcagccgggcctggcgggtgagctgggagggagcggctgccgcggctgcgggacccggtgcaggaggcagcgccctgagatgccgcgcacagcgggtgtctagcccgcgcctgggaaggcgtgggtcccgactgagtggcgcattgcccctttgcctaagcaggggcggagggggcgcacaggcattgcctgattgcgcaggtccctcccccggacatcctggccacccaggcgcacggcagctggccgggcctctggccatggaacaaacgtacggggaggtcaatcagttgggcggtgtgttcgtcaacggccgtcccttgcctaatgcaattcggctgcggatcgtggagttggcccagttgggaatccggccatgcgacatctctcggcagttaagggtgagccacgggtgtgtgtcaaaaatactggcacgctataacgagactgggtccatcctgccgggcgcgattggcggctctaaaccccgcgtcaccactccgaatgtcgtgaagcatataagggattataagcaaggcgaccctggcatatttgcttgggaaatccgagaccggttgttggcggacggcgtctgcgataagtacaacgtcccttccgtgtcctccatatccaggattctccgaaacaaaattgggtcccttgctcagccaggaccttatgaggcaagcaaacaaccgccaagccagccgaccctcccatataaccacatctaccagtacccctatccaagcccggtctcaccaaccggggcaaaaatggggagccatcctggcgttcccggcaccgctggtcatgttagcattcctaggtcttggccaagcgcccattctgtatcaaatatcttagggatacgaacatttatggagcagacaggtgccttggctggtagtgaaggtaccgcttactctccaaaaatggaggactgggccggggtgaacaggactgcgtttcctgccacacctgctgtcaacgggcttgagaagcctgctctggaggcagacatcaagtatacgcaaagcgcctcaaccctctccgcagtgggggggtttctgccggcctgcgcctaccccgcttctaaccaacatggtgtgtactctgctcctggggggggctacctcgcgccgggccctccatggcctcccgcccaaggcccaccgctcgccccacctggcgctggcgtggccgtgcatggcggagagcttgccgcagcaatgacctttaagcatcctagtcgagagggttccttaccagcaccggcggcaagacctaggactccgagcgtagcttacaccgactgcccaagcagacctaggccgcctcgggggagcagcccacgcacccgcgccagaagagaacgccaggctgatccgggggctcaggtgtgtgctgcagcgcccgccataggcaccggcagaattggcggactggccgaggaggaagctagcgcaggacccaggggggcccgtcctgccagccctcaggctcaaccttgcttgtggcctgatcctccccatttcctctactggtccggcttcctaggctttagtgagcttggtttttag

SEQ ID NO: 198465 - DNA, 1185 bp, Artificial Sequence
  Description of Artificial Sequence: Synthetic coding sequence
atggacatgcactgcaaggccgaccccttcagcgccatgcaccccggccacggcggcgtaaatcagttaggcggcgtgttcgtaaacggccgcccactgccagacgtagtccgtcaaagaattgtggagttggcacatcagggggtgagaccctgtgacatctccaggcagctgcgcgtttcccatggctgcgtctcgaagatccttgggagatactacgaaaccgggagtataaaacccggagtgattggcggtagcaaacctaaagtggctactcccaaggttgttgacaagattgctgaatataagcgccagaatcccactatgttcgcatgggaaattcgggatcgcctcctggccgagggtatttgcgacaacgataccgtccccagtgtgtccagcatcaaccgcatcatcaggactaaggtccagcaacctttccaccccactccagacggtgctggcaccggagtgaccgcccctggccataccattgtaccctcaactgcgagcccaccagtatccagtgcgtcaaacgaccccgtgggcagctacagtataaatggcatactagggattccacgttccaacggcgagaagaggaaaagggatgaagacgtgtcggagggatcagtgccaaacggcgattctcagtcgggtgttgatagcctgaggaaacacctccgagcggacaccttcactcagcaacagttggaggcccttgatcgcgtgttcgagagacctagttatcccgacgtgttccaggcctcagaacacatcaaaagtgagcagggcaatgagtattccctgcccgccctaaccccaggccttgatgaagtgaagagtagtctgagcgcctccactaatccagaacttggaagtaacgtttcgggcacacagacctatccagtggttacggggagagatatggctagtactacactccctggatatcctcctcacgtcccgcccaccggccaaggctcctaccccacgtctacgctagctggcatggtgcccggcagcgagttttctggcaatccttacagccacccccaatacaccgcgtacaatgaggcttggcggttcagcaacccagccctgctgtcttctccttattactactcggctgcaccacgaggatctgcacccgccgccgccgcagccgcatacgacaggcattag

SEQ ID NO: 198466 - DNA, 1191 bp, Artificial Sequence
  Description of Artificial Sequence: Synthetic coding sequence
atggacatgcactgcaaggccgaccccttcagcgccatgcaccccggccacggaggcgtgaaccagctgggcggggtatttgtcaacgggcggccactccctgatgtggtccgacagcgtattgtggagcttgcccaccagggcgtaagaccatgcgacatatccaggcaacttcgtgtctcacacggctgcgtgagcaagatcctgggtagatactacgagactgggagcatcaagccgggagtaatcggcggatccaagcccaaggtcgctactcctaaagtggtcgacaagattgcagagtataagaggcaaaatcccactatgttcgcctgggaaatcagagatagactgcttgctgaaggcatctgcgacaatgataccgtgccctcggtaagcagcataaacaggattatacgaaccaaggttcagcagccatttcaccccacacctgacggggctgggacaggtgtaacagcgcctggacacaccattgtaccatcgaccgcctcaccacccgtctcatctgctagcaacgatcctgtgggcagttactctatcaacggcatactcggaatacccaggtcaaacggtgagaaaaggaaacgggatgaagacgtgtctgagggatccgtaccaaacggggactcccagtcaggtgtggacagtttgagaaagcatttgcgcgccgatacttttactcaacagcagctcgaggctctcgaccgagtgttcgaacgaccatcatatccggacgtgttccaggcctctgagcacataaaaagtgaacagggcaatgagtactcattacctgcccttactccgggcttggatgaagtgaaatcatctctgtcagcgtccacgaatccggagctcgggtctaatgtcagcggcacacagacatatcctgtggttacgggccgcgacatggcttccacaacattgcccggctatcccccacatgtgccacccacaggtcagggctcctaccctacttctaccctcgcaggtatggttccggaagccgccgtaggccccagtagcagtttgatgtccaaaccgggtagaaaactggctgaggtaccaccctgcgtccagcctaccggcgcttccagccctgccactcgcaccgctaccccctctacacgccccaccactcgtctcggagactccgcaacaccaccctattag

SEQ ID NO: 198467 - DNA, 990 bp, Artificial Sequence
  Description of Artificial Sequence: Synthetic coding sequence
atgttcgcctgggagatccgggaccggctgctggccgagggcatctgcgataatgacacagtcccctccgtctcctcaattaatcgcatcatcagaactaaagtgcaacagccatttcacccaacgcccgacggcgccgggactggcgtaaccgcccccggtcatactatcgtaccatcgacagccagccctcctgtgtcatcagcatccaatgaccccgtggggtcatatagcattaatgggatcctggggatccccaggtccaacggagaaaaacgtaagcgagatgaggtcgaagtttacacggaccccgcccacatcaggggcggcggcgggcttcacctggtgtggacccttcgggacgtgtctgagggctccgtaccaaacggtgattcgcagtcaggtgtcgactccctccgtaaacatctacgcgcagacacctttacacagcaacaactggaggccttggatagggtgttcgaaaggccctcctatccggatgtgtttcaggcgtctgagcacattaagagcgagcagggaaatgagtactccctgccagctttgacacccgggctcgacgaagtgaaatcatctctgtctgccagtactaatccagagctgggttccaacgtgtccggtacacagacctatcccgtggtaacagggcgggacatggcttcgaccactttgcccgggtatcctcctcatgtgcctcccaccggccaggggagttatcccacatctacacttgctggcatggttcccgggagtgaattcagcgggaacccttatagtcacccgcaatatactgcctataacgaagcatggcgtttttctaatccagcactgctgtcctctccttactattattcagcagcacctagaggatcacttcccctcctcccacttcctatgaccgcaaccagctaccgtggagaccatatcaaacttcaagccgactcatttgggctccatattgtgcccgtctag

SEQ ID NO: 198468 - DNA, 1260 bp, Artificial Sequence
  Description of Artificial Sequence: Synthetic coding sequence
atggacatgcactgcaaggccgaccccttcagcgccatgcaccccggccacgggggggtgaaccagctgggtggtgtgttcgtgaacgggagaccactaccagatgttgttagacagaggatcgtagagttagctcatcaaggcgttcggccatgtgatattagccggcaactccgagtgtcgcacggatgcgtgtccaagattctgggcaggtactatgagactggatccattaagcctggtgtcattgggggtagcaaacccaaggttgcaaccccgaaggtggtggacaaaattgctgaatataaaaggcagaatcctacaatgttcgcttgggaaatccgggatcggctgttagcagagggcatctgcgacaacgacacggtgccttccgtgtcctccattaatcggatcatacgcacaaaggtgcagcaaccctttcatcctacaccagatggcgccggcactggagtgaccgcacccgggcacactatagtcccttccacagcttcaccccccgtcagttcagcttcaaatgatcctgttggatcatactcgatcaacggaattctgggcatccccaggtctaacggagagaagaggaagcgtgatgaagttgaagtgtacacagaccctgcccatatacgaggcggaggaggcttgcatctggtctggacactgcgtgacgtgagcgagggctccgtgcctaacggtgactcgcaatccggcgtggacagcttacgaaaacaccttagggccgatacattcacccagcaacagctggaggccctggaccgcgtcttcgaacggccttcgtatccagatgtcttccaggccagcgaacatatcaagagcgagcaaggcaacgagtattcgctgcctgccctgactcctggtttggatgaagtcaagtcctcacttagcgcttccacaaaccctgagctgggctccaatgtgtccggaacacagacgtatcccgtggttacaggaagggacatggcttctaccaccttgcccggttatccgccacatgttcccccgacgggtcaaggctcttatcccacaagcaccctagcaggtatggtgcctgaggctgccgtgggaccatcctcttcactgatgagcaaacctgggagaaagctggccgaggtgcctccttgcgtgcagcccaccggggccagctcacccgctacacggaccgcaaccccctcaaccagacccacaacaaggctcggagactctgctacccctccctactag

SEQ ID NO: 198469 - DNA, 645 bp, Artificial Sequence
  Description of Artificial Sequence: Synthetic coding sequence
atggacatgcactgcaaggccgaccccttcagcgccatgcaccccggacatggcggcgtaaatcagctcggcggggttttcgtgaacggcaggcctctgccagatgttgtacggcagagaattgtagagcttgcccaccagggtgtcagaccctgcgatataagtcggcagctgcgagtgtcccatggctgtgtgtcaaagatacttgggcggtactacgagacgggttctatcaagcctggagtcattggcggcagtaagcccaaggtggcaactcctaaggtggtagacaagattgcagaatataaacgccaaaatcctactatgttcgcgtgggagatccgcgatagattgctcgccgagggtatctgcgataacgacaccgtgccatcagtctcttccataaatcggattatcaggaccaaagttcagcagccctttcacccaacgccggacggcgctggcacaggggtgacggcaccgggccacactattgtgccctcaacggcgtctcccccagtgtcttctgcaagcaatgatcccgtggggtcttacagtattaacggcattctgggcatcccccggtccaatggcgaaaaacggaagcgggatgaagtggaagtgtacacggatcccgctcactag

SEQ ID NO: 198470 - DNA, 1254 bp, Artificial Sequence
  Description of Artificial Sequence: Synthetic coding sequence
atggacatgcactgcaaggccgaccccttcagcgccatgcaccccgggcatggaggagtaaatcagttaggaggcgtgttcgtaaacggtcgccctctaccggatgttgtaagacagcgaatagtggagctggctcatcagggcgtgcggccctgcgacatctctaggcagctgcgcgtgagccacggctgtgtgagcaaaatcctgggccggtactatgagaccgggtctatcaagcctggagtcatcggtgggtccaagccgaaggtagccacaccaaaggtggtggacaaaatcgccgagtataagagacagaacccaacaatgttcgcttgggagattcgtgacagactgctggccgaaggaatttgcgacaatgatacagtgccgagtgtgtcttccattaatcgtatcattaggacaaaagtccagcagccttttcacccaactccagatggggctgggaccggcgtcacagcacctggccacaccatcgtcccttcaacggcgtcccctccagtgagttcggctagtaacgatcccgtcggctcttactctatcaacggaatcctcgggattccacggagtaatggcgagaaacgaaaaagagacgaggtggaggtttacacagatcctgcccacatccgcggagggggaggcctgcatctggtgtggaccttgagggatgtgtccgaaggcagtgtgccaaatggtgacagccagtctggagtagactccctgcggaagcacctgagggctgatacctttacgcagcaacaattagaggccttggatcgagtgtttgagcgcccgtcttacccggacgtgttccaggcctcagagcacataaaaagtgagcaagggaacgaatattcgctgcccgctcttaccccgggcctggatgaggtgaagagcagtctttcagcctccactaatcctgagttaggctcgaatgtgtccggcacccagacttaccccgttgtaacaggccgcgacatggcctctaccaccctgcccggctatcccccacacgtaccaccaaccgggcagggatcttacccgactagtactttagcggggatggtgccgggctctgagttctcaggaaacccttacagccatccacagtacaccgcttacaacgaagcgtggcgtttctccaaccctgcgctgctgtcatccccatattattacagcgctgcccccaggggatccgcaccagcagccgccgccgcagcttacgatagacactag

SEQ ID NO: 198471 - DNA, 621 bp, Artificial Sequence
  Description of Artificial Sequence: Synthetic coding sequence
atgaccaccctggccggcgccgtgccccggatgatgcggcccggccctggccaaaattacccccggtctggcttccctctcgaggtcagcacaccactgggccagggacgcgtgaatcagttaggcggagtgtttatcaacggccggccccttcccaaccatatacgccacaagatcgtggagatggcccatcacggtatcagaccatgtgtcatttcacggcaacttagggtgtcccatgggtgtgtgagtaaaatcttatgtcggtatcaggagaccgggtccattagacccggcgccatcgggggctcaaaacccaaacaagtgaccacaccggatgtggagaaaaagatcgaagagtataagagagagaaccccggtatgttttcttgggagatccgagataagctattgaaggacgctgtgtgcgataggaataccgtccccagcgtgtcctcgatttcacgtatcctgagatccaaatttggaaagggggaggaagaggaagccgatctcgagaggaaggaagcagaagagagtgaaaagaaggccaaacactccatcgacggcattctgtccgaacgcggaaaagcgcttgtcagcggtgtgagctctcactag

SEQ ID NO: 198472 - DNA, 1224 bp, Artificial Sequence
  Description of Artificial Sequence: Synthetic coding sequence
atgaccaccctggccggcgccgtgccccggatgatgcggcccggccccggacaaaattacccacggtctggcttcccactggaggtctccactcctttgggccagggaagggtgaatcagctcggaggagtgtttattaacgggcgccccctcccaaaccatattcgacacaaaatcgtagagatggcacaccacggaatcagaccttgcgtcatttcccggcagctgcgggtgagtcacgggtgtgtgtcaaagatcctgtgccggtatcaggagactgggtccattcgccccggcgccattggaggatccaagcctaagcaggtgactaccccggatgtggaaaagaaaattgaggagtataagcgtgaaaatcctggaatgtttagctgggagatccgtgacaaactcttgaaagacgctgtctgtgacagaaatactgtaccctcagtgtcatccatttcaagaatactgaggtcgaagttcggaaaaggcgaggaggaggaagcagacttggagcgcaaggaagcagaagaaagtgaaaaaaaggccaaacattccattgacggcattctgtctgagagagcctccgcgccccaaagtgatgaagggtcagacattgacagtgagcctgatctccctctgaagagaaagcaacggcgctctaggaccaccttcacagccgaacagcttgaggagctggaaagagcattcgaaagaacccattatcctgatatctataccagggaggagctggcccagagagccaaactgactgaggcccgagtacaggtctggtttagcaacaggcgcgcccggtggcgcaaacaagcaggcgccaaccagctaatggcatttaaccaccttattccaggtggttttcctcccacagcaatgccaactttgcccacctaccaactctcggagacaagttaccaacctaccagcattccgcaggccgtatcagacccttcgtcaaccgtgcaccggcctcagcctttaccaccatccaccgtgcatcaatccacaatacctagtaatcccgactcaagcagtgcttattgcctacccagtactagacatggctttagttcatacaccgactctttcgtgcctccttctggcccgagcaaccctatgaacccaactatcgggaatggactatcaccccaagttccattcattatctcaagccaaatcagcctcggtttcaaatccttctag

SEQ ID NO: 198473 - DNA, 1212 bp, Artificial Sequence
  Description of Artificial Sequence: Synthetic coding sequence
atgaccaccctggccggcgccgtgccccggatgatgcggcccggccccggccaaaactacccccgaagtggattccccttggaagtaagcacacccttgggccaggggcgcgtcaatcagctcgggggggtcttcatcaatggaaggccacttcccaaccacatccgtcacaaaatcgtggagatggcgcaccacggaattcggccttgcgtcatatcacggcagctccgcgtttcccacggctgcgtcagtaagatactgtgccggtaccaggagaccggcagtattaggcctggggccattggcggcagcaaacctaagcaggtgacgacaccggatgtggagaaaaagatcgaggagtacaagagagagaatcctggtatgtttagctgggagattagagacaaactcctgaaagatgctgtgtgtgataggaacacggtgccctccgtaagcagcatctcacggattttgcggagcaaattcggcaagggtgaggaggaggaggccgacttggagcgtaaggaggctgaggaatctgagaagaaggccaaacattctattgacggcattctgagcgaacgcgcctcagctccccagtcagacgaagggtcggatatcgattcggaacctgacctgcccctgaagcgcaagcagcggcgtagccggaccacgttcacggccgagcagcttgaggagctggaacgtgctttcgaaaggacccattatcccgatatctacaccagggaagaacttgcccagcgggccaaattgaccgaggccagagtgcaggtctggtttagtaaccgacgggccaggtggagaaagcaggccggtgccaaccagctgatggctttcaatcatctcatccccgggggcttcccgcccaccgcaatgccaactttgccaacgtatcagctgtccgaaacctcttaccagcctacttccattccccaggcagtaagtgatcctagcagcacagtgcacaggccacagcccctgccgccaagcaccgtgcaccagagtaccatcccttccaaccccgattcctccagcgcatactgtcttcccagcacgcgccatggcttttctagctacacagactcctttgtgcccccttccggcccatctaaccccatgaatcccacgatcggaaacggcctttcccctcaagtgcctttcatcattagctctcagatcagccgaaaatag

SEQ ID NO: 198474 - DNA, 1440 bp, Artificial Sequence
  Description of Artificial Sequence: Synthetic coding sequence
atgaccaccctggccggcgccgtgccccggatgatgcggcccggccccggccagaattacccccggtctgggttccccctagaagttagcactccgctgggtcaggggagggtgaaccaactggggggtgtgtttataaatggcagaccgttacctaatcacatccgacataaaattgttgaaatggcccaccacggaattcgtccatgcgtaattagtcgccagctgcgtgtaagccatggctgcgtatccaagatcctctgccggtatcaggaaacaggatctatccgccccggagccatcggcggctcaaaaccaaagcaggtgacaacacccgacgtggagaaaaagatcgaggaatataagcgggagaacccaggcatgtttagctgggagatcagagacaaacttctgaaggacgctgtatgcgacaggaataccgttcctagtgtgagctccatttcgcgcatcctgcgttccaaattcggcaaaggcgaggaagaggaagctgaccttgagaggaaggaggccgaggaaagtgagaaaaaagctaagcactcaattgacgggatcctgagcgagagggcatctgccccccaatcagacgaaggcagcgacatagactccgagcccgatctcccgctgaagcgcaaacagcggcgatcaaggaccacgtttactgccgaacagctggaagaactggaacgggcgtttgagcgcacccactaccccgacatttacacccgggaggaacttgcccagagggccaaattgacagaggctcgggtccaggtgtggtttagcaaccgacgcgcccgttggcgcaagcaagcaggagccaaccaacttatggccttcaaccaccttattccaggcgggttccctccaactgccatgcccacgttgccaacgtaccagctaagtgagacttcttatcagccgacttcaatccctcaggcggtaagcgatcctagttctactgttcatagaccccagcctttaccaccctctaccgtgcaccagtccaccattccgtccaaccctgatagctccagtgcttactgtctcccctctactcgccacggcttcagctcgtacacagactcttttgtccccccaagcggcccctccaaccccatgaatccgactatagggaatggactatctcctcaggtgatgggtctcctgacaaatcacggtggcgtgccgcatcaacctcagactgactacgcactgagtccattaaccggcgggctcgagccgacgactaccgttagtgcatcctgctcccagcgtctcgaccacatgaagtccctcgatagtctccctacctcacagtcctactgcccacctacctattccaccacaggatatagcatggatccggtgactggctatcagtacggacagtacggacaatctaagccatggaccttttag

SEQ ID NO: 198475 - DNA, 1518 bp, Artificial Sequence
  Description of Artificial Sequence: Synthetic coding sequence
atgaccaccctggccggcgccgtgccccggatgatgcggcccggccctgggcagaactatccccgtagtgggtttccactggaagtgtccaccccactcggccagggacgcgttaaccagctgggcggggtttttattaacggcagaccactgcctaaccatatccggcacaagattgtcgagatggcccaccacgggatcaggccatgcgtcattagccggcagcttagggtgtcacacggctgcgtctcaaagattctgtgcaggtaccaggagactggcagcatacggccaggtgccatcggtggttcaaaacctaagcaagtgacaacccctgatgttgaaaaaaagattgaagagtacaagagagagaaccccggtatgttctcctgggaaattagagataaactcctgaaggacgctgtctgcgataggaatacagtcccctctgtgagctcgatcagccggatcttacgaagcaagttcggcaagggcgaagaggaagaggctgacctcgaacgcaaagaagcagaagagagtgagaagaaagcgaaacatagtattgacggtatactatcagaaagagcctccgctccccagtcagatgaagggagcgacatagattccgagccagacttaccgctcaaacggaaacaacggcgttcacgtacaaccttcaccgcagagcaattagaggaactggagcgcgctttcgaacgaactcattatcccgatatttataccagagaggaactggcccagagggccaagctgaccgaggcccgagtgcaagtatggttttccaaccgacgagcccgctggaggaaacaagctggcgctaaccaactaatggcctttaaccacctcattcctggcggcttccccccaactgccatgcccaccctaccaacctaccagctcagcgagacgtcctatcagcctacctcaatcccccaggcagtttccgatccatccagtacagtgcatcgaccacagcctctcccaccctcaacagtgcaccagtctaccattccatccaaccctgatagttcatcagcctactgcttgccttctacacgccacggattctccagttacacagacagctttgtcccccccagcggaccttccaacccaatgaaccctacgattggaaacgggttgtctcctcaagtgatgggactcctcaccaaccatgggggggtgcctcatcagcctcaaaccgattatgctctgtctcctttaacgggaggtttagaaccaaccacaaccgtcagcgccagctgtagccagaggttagatcacatgaagtcgctcgactctcttcccacttctcaaagttactgccccccaacatactccacaaccggctacagtatggatcccgtgacgggttatcaatatggacagtatggccagagcgcgtttcactatctaaaaccagatattgcgtggtttcagattctgctgaacacttttgataaatcaagcggcgaggaagaagatcttgaacagtag

SEQ ID NO: 198476 - DNA, 1455 bp, Artificial Sequence
  Description of Artificial Sequence: Synthetic coding sequence
atgaccaccctggccggcgccgtgccccggatgatgcggcccggcccggggcagaattatcctagatccggcttcccgttggaagttagtacgccgctgggtcagggcagagttaatcaactcgggggtgtcttcatcaacggtcggccactcccgaaccacataagacacaagatcgttgaaatggcccatcacggaattagaccctgtgtgatctccaggcagttgagggtatctcatggctgtgtctctaagattctgtgccgataccaggaaacgggttccatcagaccgggggctattggcggatcaaaacccaagcaagtgaccacccctgacgttgaaaagaaaatcgaagaatacaagcgcgaaaatcccggtatgttttcctgggaaatccgagacaaactgttgaaggatgctgtctgtgaccggaacacggtaccatctgttagtagtattagtcgcattctcagatcaaaatttggcaaaggtgaggaagaagaagctgacctggagagaaaagaagccgaagagagcgaaaagaaagccaaacactctatcgacgggattctgtccgaaagggccagtgcccctcagtccgacgaggggagtgacatagatagcgaacctgatttgcctttaaagagaaagcagagacgcagccgtacgaccttcacagccgagcaactggaagaactggaacgcgcttttgaacggacacactatccggatatttacaccagagaggaactggcacaacgcgccaagctgacagaggcccgtgtgcaagtctggttctcaaacagacgcgcgagatggcgcaagcaggccggtgcaaatcaattgatggcattcaatcatcttatccctgggggattcccacccactgcaatgcctacgctccccacataccagctatctgagactagctatcagccgacctccatcccccaggctgtatctgatccatccagcaccgtccatcgccctcagccacttcccccttccactgtgcaccaatcgacaatcccgtcaaatcccgacagcagttcagcgtattgcttaccttccacacggcacggcttctccagttacactgatagcttcgtacctccctcaggaccttcaaacccaatgaaccctaccattggaaatgggcttagcccgcaagtaatggggttgctcaccaatcacggtggagtcccacaccagccacagacagattacgctctatctcccctaacgggcggactcgagcccaccacaacagtgtcagcttcctgtagtcagaggctggaccacatgaaaagccttgacagcctccctacatcccagagctactgccctcccacttacagcaccacgggatactctatggatccggttaccgggtaccagtatggacagtacggccagtccgccttccactacctgaaaccagatatcgcttag

SEQ ID NO: 198477 - DNA, 1452 bp, Artificial Sequence
  Description of Artificial Sequence: Synthetic coding sequence
atgaccaccctggccggcgccgtgccccggatgatgcggcccggccccggacaaaattatccacgctccggcttccccttggaagtgtccacccccctgggtcagggacgggtgaaccagttggggggagtcttcattaacggccgccccctacccaaccacatcagacataagattgtcgagatggctcaccatgggatcagaccatgtgttatttcccggcaacttagagtcagtcatggttgcgtgtcaaaaatactgtgcagataccaggagacaggatcaataaggccaggcgctatcggcgggtcgaaacctaaagtcactacccctgatgtcgaaaaaaaaatcgaggagtacaaacgggagaaccccggcatgttctcttgggagatcagagacaaattgctgaaagacgccgtgtgcgatcgcaacaccgtgccctccgtctctagtatcagtcggatacttaggtctaagtttggaaagggcgaggaggaggaggccgacctggaaaggaaagaagctgaggaaagcgaaaagaaagcgaagcattcaattgacggtatattgagtgagcgggcatccgcccctcagagcgatgagggttccgatattgattcagagcccgatctcccccttaagcggaagcagcggagaagtagaactacgttcactgcagagcaattggaggagctggaacgtgcgtttgagagaactcattaccctgacatatatacaagagaagaactggcccaaagggccaagttgacagaagccagggtccaggtgtggttcagtaaccgacgggcccggtggcgcaaacaagccggcgctaaccagcttatggcttttaatcacttgatcccaggcggatttccacccacggctatgcctacactgcctacttaccagctcagtgagacatcctatcagcctacctccatacctcaggccgtctccgatccctcttctaccgttcatagacctcagccactcccaccctccaccgtccaccaaagcaccattccatccaaccccgacagctcttcagcttactgtttgcccagcactaggcacggattctcctcatacactgattctttcgtgcctcctagcgggcctagcaatccaatgaacccaacaataggaaacggccttagtccacaggtcatgggactcctgacaaaccacggcggtgtgcctcaccaaccccagacagactacgcactgtctcctctgaccggaggtctggaacctaccactaccgtgtccgcatcttgttcacaacgcctggatcatatgaaatccctcgactccctcccaacatcccagtcttactgccccccaacatattctaccacagggtatagtatggaccccgtgaccgggtatcaatatggtcagtatgggcaatctgcgtttcattacctcaagcccgatattgcatag

SEQ ID NO: 198478 - DNA, 648 bp, Artificial Sequence
  Description of Artificial Sequence: Synthetic coding sequence
atgaccaccctggccggcgccgtgccccggatgatgcggcccggccctggccaaaattaccctcgatctgggtttccactggaagtgtccacacctctgggccaggggcgcgtgaaccaactggggggtgtcttcataaacggaagaccactgccgaatcacatccgtcacaagattgtcgagatggcccatcacggcatccggccttgcgtcatttcgagacagctaagggttagccatggatgcgtgtccaagatactgtgcaggtatcaagaaaccggctcaatccgtcccggcgccatcggaggatctaagcctaaacaggttacaacacccgacgtggagaaaaaaatcgaggagtataagcgagaaaatcccggcatgttctcttgggagattagagacaaactcctgaaagacgcagtctgcgaccggaacactgtcccgtcggtgagcagcatctctcgcattctgaggtcgaaatttggcaaaggtgaagaggaagaagctgacctggaacggaaggaagctgaggaatccgagaaaaaagccaaacattccattgacgggatcctgtcagaacggggtaagcggtggcgcctgggcagacggacgtgctgggttacctggcgagcctctgcgtcttag

SEQ ID NO: 198479 - DNA, 822 bp, Artificial Sequence
  Description of Artificial Sequence: Synthetic coding sequence
atgcaccaggacggcatcagcagcatgaaccagctgggcggcctgttcgttaatggacgacccctccccctcgacacccggcagcagatcgtgagactggccgtgtcagggatgagaccatgcgacatctctcggattctgaaagtgagcaatggttgtgtctcaaaaattttgggacgctactatcgcacgggtgttctggagccgaagggcataggggggtctaaacccagactcgctactccacctgtggtcgcaagaattgctcaactcaaaggggagtgtccagccttgtttgcctgggagatccagcgccagctgtgcgctgagggcctgtgtacccaggacaagacaccatccgtttcctcaatcaacagagtgctcagagctctgcaggaagaccaaggtctgccatgcacacgcctgagatcccccgctgtgcttgccccagcagtgcttacacctcacagcgggagtgagacaccccgggggacccacccaggcactggccatcgcaaccggactatcttctccccctcgcaggccgaggcgctggaaaaggaatttcaaagagggcagtaccccgactctgttgctagaggcaagctggctacggccactagcttgccagaagatacagtgagagtgtggtttagtaaccggagagctaagtggaggagacaggagaagctcaaatgggagatgcaattgcctgccgttccatggcagtgcgctcactcttcccctgcctgcccaggaaccaccggatcactccttctgtccgctgtgctcggcaactcgaccagaaaggtgtccgagtag

SEQ ID NO: 198480 - DNA, 1032 bp, Artificial Sequence
  Description of Artificial Sequence: Synthetic coding sequence
atgaaccagctgggcggcctgttcgtgaacggccggcccctgccccttgatacaagacagcagatcgtcagacttgccgtgtctggcatgcggccatgtgacattagtcgtattcttaaagtgtctaatggatgcgtctctaagattttgggccgctactatcgcactggagttctggagcccaaagggataggcggatctaagccaagactggccactccacccgtggtggcgcggattgcgcaactgaagggagagtgcccagccctattcgcctgggagatacagcgacaactctgcgccgaaggcctgtgtacccaggacaaaaccccttctgtgtccagtatcaacagggttctgcgcgccttacaggaggatcaaggcttgccctgcacccggctacgcagccccgctgttcttgcaccagcagtcctgactccccatagcggaagtgagactcctaggggaacccatccggggacaggtcacaggaatcgaaccatttttagtccatctcaagcagaagccctcgaaaaagagttccagcgggggcagtaccctgacagcgtggctcggggcaaactggctacagccactagtctgcccgaggataccgtaagggtgtggttttcaaacagacgggctaaatggaggcgacaggagaagctgaaatgggaaatgcagcttcccggagcatctcaaggactgacggtgccgagggtcgcaccgggaattatttccgcacagcagagtcctgggtcagtgcctacagcggcattgcccgcactcgagcctctcggacccagttgctaccaactgtgttgggctaccgcccctgagaggtgtctatctgacacacctcctaaagcatgtctcaagccctgctggggccacctgcctccgcagcccaactcactggacagcggcttgttgtgcttgccatgcccttcctcccactgtcacctcgccagtctgagcggcagtcaagcattgttgtggcccggctgcccactcctgtatggcctcgaatag

SEQ ID NO: 198481 - DNA, 1047 bp, Artificial Sequence
  Description of Artificial Sequence: Synthetic coding sequence
atgcaccaggacggcatcagcagcatgaaccagctgggcggcctgtttgtcaatggtagacccttgcctctcgatactaggcaacagatcgtccgtttagcagtgtccggtatgcgaccttgcgatatctctcgcatcctaaaagtctcgaatggatgtgtttcgaaaatcctaggtcggtactaccggacaggcgtgctggagcctaaaggaattggcggaagtaaacctaggctcgccaccccccccgtggttgcacggattgctcagctcaaaggtgagtgtcccgcactgttcgcttgggagatccagcggcagctgtgcgccgaaggcctttgtactcaggacaaaactccttcggtgagctctatcaaccgcgtgctccgtgcattgcaggaggatcagggattaccatgcactcgcctgcgaagtcctgccgtactggcgccagcagtgttgacccctcactccggcagtgaaactccccgcggaacacatcccggtaccggtcatagaaaccgaaccatattctcaccctcccaggctgaagcacttgagaaagagtttcagagaggacagtatcccgattcagtggcaaggggcaagctggccactgctacctctcttccggaggatacagtccgggtgtggttctctaataggcgggcaaaatggagaagacaggagaaacttaaatgggagatgcagttgccaggtgcaagccagggactgactgtacctcgcgtagcacctggcatcatcagcgcgcagcagtctcctgggtctgtccctactgctgccttgcccgcattggaaccacttggtccttcatgttaccagctgtgttgggccacagctccagagcgctgcttgtcagacacaccacccaaggcttgcctgaagccgtgctgggattgcggcagctttctactgccagtcatcgctcctagctgtgttgacgtggcatggccgtgcttggacgcctcccttgcacatcacctgattgggggagcaggcaaggctactcccacccacttcagccattag

SEQ ID NO: 198482 - DNA, 1563 bp, Artificial Sequence
  Description of Artificial Sequence: Synthetic coding sequence
atggccgccctgcccggcaccgtgccccggatgatgcggcccgccccaggccagaactatcctcgcactggcttcccgctggaggtgagcacacctctcggccaggggcgtgttaaccagttgggaggggtttttatcaacgggcgtccactgccaaatcacatccgccataaaattgtggagatggcccaccacggaatccggccgtgcgtgatatcaaggcagctccgcgtcagccatggctgtgtaagcaaaattctttgtcggtaccaagagacgggctctatccggccgggagcgatcggcggttctaaacctcgacaggtcgctacacctgatgttgagaagaaaatagaggagtacaaacgcgaaaaccctggtatgtttagctgggagatccgcgatagactgctcaaagatggacattgcgacagatctaccgtgccttccggcttagtctcctcaatttcacgcgtgctgcgaatcaagttcggcaagaaggaagaggaagatgaagctgataaaaaggaagacgacggcgagaaaaaagctaagcactctatagatggtatattaggcgataagggaaaccgcctggatgaggggagcgatgtggagagtgaacctgacctgcccctgaaacgcaaacaaaggcggtcgcggaccacatttactgccgagcagctggaggagttggagaaggcctttgagcgtacccattaccccgacatttatacccgcgaggagttggcacagcgaaccaaactcacagaagccagagtgcaagtctggttcagtaaccgaagggcgcggtggagaaagcaagccggcgccaatcagctagcagcctttaatcatcttctgccaggaggtttcccccctaccgggatgcctacattacccccttatcagctcccggatagtacttaccccacaacgaccatctcacaggatggcggaagcacagtgcataggccccagccactgcctccatctaccatgcatcagggagggttggccgcagctgcagccgcggccgacacgtcttccgcatatggcgcacgacacagcttctcatcgtattccgatagttttatgaacccggcggccccaagtaaccatatgaatcccgtgagcaacgggctcagtccccaggtgatgagtatactaggaaatcctagcgcagtgcccccccagccccaagccgattttagcattagccctctgcacggcggcttggacagtgctaccagtattagcgcgagctgcagccagcgggccgactccataaaacctggtgattcattgcccacaagccaagcttactgcccacccacctattctacaacagggtactccgttgatcctgtcgccgggtaccagtatggccagtacggccaaagcgagtgtctcgtgccgtgggctagccccgtgcccataccgtcacccactccacgagcctcttgcctttttatggaatcctataaggtggtcagtggctggggtatgtccatctctcagatggagaagctcaaatcctctcagatggaacagttcacatag

SEQ ID NO: 198483 - DNA, 1557 bp, Artificial Sequence
  Description of Artificial Sequence: Synthetic coding sequence
atggccgccctgcccggcaccgtgccccggatgatgcggcccgcccccgggcagaattaccccaggaccggcttcccactcgaggtttctacccccctgggacagggcagggtgaatcagctgggtggcgttttcatcaatggcaggccactgccaaatcatattagacacaaaatcgttgaaatggctcatcatggaatccgaccttgtgtaatctctcgacagctgagagttagccacggctgtgttagcaagattctttgtcggtaccaagagaccgggtctatccggcctggggcgattggaggctcgaaaccgaggcaggttgcgacccctgacgtcgaaaaaaaaattgaagagtataagcgcgaaaaccccggcatgttctcttgggaaattcgcgatcgcctgttgaaagacggccattgtgataggagcacggtgcctagcgtgtcaagcataagcagagtccttcgcattaaatttggcaaaaaagaggaggaagacgaggctgacaaaaaggaggacgacggcgaaaagaaggcaaaacactcaatcgatggtatcctgggcgataaaggcaatcggctggacgagggatcagacgtcgaatcagaaccggacctgcctctgaagcggaaacagaggcgcagcagaacaacgttcaccgctgaacagctggaagaactcgagaaggcatttgagcgaacccactacccagacatttataccagagaggagctagcacaaaggactaaacttactgaggcacgagtgcaagtgtggttcagtaacaggcgcgcccgatggcggaagcaggctggcgcaaaccagttggcagcctttaatcatctactacccgggggtttcccgccaactgggatgcctacactgcctccataccagctgcccgactcaacatacccaacaactacaatcagtcaggacgggggctcaacagtgcatcgcccgcagcctctgcccccgagcacaatgcaccagggcggattggcggccgcagccgcagctgctgatacctcttcggcatatggtgcacggcatagcttcagttcttactctgactccttcatgaaccccgctgcaccatcaaaccacatgaatcccgtaagcaatggcctttctcctcaggtgatgagcatcctggggaacccaagcgcggttcccccgcagccacaggcagatttctctatttctcctctgcacggaggtctggatagcgcaacatctatcagtgcatcgtgctcgcagcgggcagattcgatcaagcccggggactccctgccaaccagccaagcctactgtcctccgacatattccacgacggggtattcagtggaccccgtggccggctatcagtatggacaatatggccaaagcgagtgcctggtgccatgggcatcccctgtgccaattcctagcccgacacctcgcgcgagctgtctctttatggaatcatacaaggtggtgagtggctgggggatgagcatcagtcagatggagaagctcaagtcatcacagatggagcagtttacatag

SEQ ID NO: 198484 - DNA, 1518 bp, Artificial Sequence
  Description of Artificial Sequence: Synthetic coding sequence
atggccgccctgcccggcaccgtgccccggatgatgcggcccgcccctggacagaactaccccagaaccggctttcctttggaggtctctacacccctgggacagggccgtgtgaatcagctaggtggtgtctttattaatggacgccccctccctaatcacataaggcacaagattgtcgaaatggctcaccacggaatacgcccttgtgttatctcaaggcagctaagagtgtcccatggctgtgtctccaagatcctgtgtcggtatcaggagaccgggtcgattagacccggagccattggagggagtaagccgcggcaggtggccacccccgacgtggaaaagaaaatcgaggagtacaagcgcgagaatcccgggatgttttcctgggagatccgagaccgacttctaaaagatggacactgcgacaggtccaccgttccctctggattagttagttccatctcacgcgttctgcgcatcaagttcggcaaaaaggaggaagaagacgaagctgataagaaggaagacgacggcgaaaaaaaagcgaagcactcaattgacggtattctcggcgataaggggaacagactcgacgagggctcagatgtggagtctgaaccagatctacccctgaagcggaagcagcgcagatcccgcactacttttaccgcggagcagcttgaagagctcgaaaaagccttcgagcgaacacactatcccgacatttacacacgggaggagcttgcccagagaactaagctgacagaggctcgggtgcaagtctggttttcgaatcgaagggctcgttggaggaaacaagccggggccaaccagttagcagcgtttaaccatcttctccctggcgggttcccacctactggaatgccaacactgcccccataccagctgcctgacagcacttaccctacgactaccatttcgcaggatgggggctctaccgtgcataggccgcaaccattgcctccaagtaccatgcaccagggaggcttagcggcggcagcagctgcagcagacacatcatctgcctacggtgccagacattccttctctagctacagtgactcattcatgaatcctgccgcccccagcaaccatatgaacccggtcagcaatggattaagcccccaggtcatgagtattctgggcaatcccagcgccgtaccgcctcagccacaagcagatttctccatatctccactgcacggaggcctggactctgctacctcaatctccgcgtcctgcagccagcgggcggacagcattaagccaggagatagcctgcctacatcacaggcatactgtcctcccacatacagtaccaccgggtattccgtggaccccgtggccggctaccaatacgggcagtacggccagaccgcagtggactacctagccaagaacgtgtccctgagtacccagaggcgaatgaagcttggagaacacagcgcagtactcggcctgctaccggtggagaccggacaggcatattag

SEQ ID NO: 198485 - DNA, 1026 bp, Artificial Sequence
  Description of Artificial Sequence: Synthetic coding sequence
atggagcccgccttcggcgaggtgaaccagctgggcggcgtgttcgtaaatggccgccctcttcccaacgctattcgccttagaatcgttgagctggctcaactgggcattcgcccctgtgatattagtcgccaactgagagtgtcacacggatgtgtaagtaaaatcctcgcccggtacaatgagactggatccatccttcctggggctatcggcgggtccaagcctcgagtgaccaccccaactgtcgtaaagcacatccggacatacaaacagcgggacccaggaattttcgcctgggaaattagggatagacttctcgctgacggcgtgtgcgacaaatacaatgtgccttccgttagtagtatttccaggattctgcgcaacaagatcggcaacctggcacaacaaggccattacgattcctacaaacaacaccagcccaccccgcagccagccttgccttataatcacatttacagctacccatcgcccatcaccgccgctgcagcaaaagtacccacacctcctggggtgcctgcaattccagggtccgtcgccatgccacgaacttggccatcgagtcacagcgtgacggacatcctggggattcgctctatcactgatcaagtaagcgacagctccccttaccactcgccaaaagtggaggaatggagcagcctgggacgcaacaactttcccgcggcagctccacatgcggtgaatggcctcgagaagggagccctagaacaagaggccaaatacggccaggcccccaacggcctccccgcggtgggctcctttgtatctgctagttccatggctccatacccaacccctgcccaggtttcgccttacatgacctattccgctgcaccttctggttatgtcgctgggcacggatggcagcatgcaggcggcacaagtctctcaccgcacaattgtgatataccagcttccctggcctttaagggaatgcaagcagcccgcgaaggtagtcacagtgtgaccgcatctgctctttag

SEQ ID NO: 198486 - DNA, 1026 bp, Artificial Sequence
  Description of Artificial Sequence: Synthetic coding sequence
atggagcccgccttcggcgaggtgaaccagctgggcggcgtgttcgtgaacggcagacctttgccaaacgccatccggctccgaatagtcgagctagctcagctgggcatccggccatgcgatatcagcagacaactaagggtatcgcacggttgcgtgtccaaaatccttgctcggtacaatgaaaccggctcaattttgcccggcgcgattggaggtagcaaaccccgcgtgactacgccaaccgtggttaaacatatccgcacctacaagcagcgagatcccggcatctttgcctgggaaataagagacagattactcgccgacggagtgtgcgataagtataatgttccaagcgtgtcttctatatccagaattttgcgcaataagattggcaacctggctcagcaggggcactacgattcttacaagcagcaccaaccgacaccccaaccggctttgccatataatcacatctactcttacccttcccccattacggccgccgcagcgaaggtccccacccctcctggcgtgcccgcaatccctggaagtgttgcaatgcccagaacctggcctagttcccactctgtgactgacattctgggcatcagaagcataaccgaccaagtttcagacagctctccgtatcactctcccaaggtggaggagtggtcatctcttggccgcaataactttcctgcagctgcaccacacgctgtgaatggcctcgagaagggcgcgctcgagcaagaggctaaatatggccaagccccgaatggcctgcctgcagttggcagtttcgtctcggcgagctccatggctccgtatcccacgcctgctcaagtgtccccctacatgacctatagtgcggccccatctgggtatgttgcagggcacggctggcagcacgcaggaggaacgagtctctccccgcataactgcgacatacccgcctcgctggccttcaagggaatgcaggccgctcgggaagggagccactccgtgaccgcatctgcattgtag

SEQ ID NO: 198487 - DNA, 183 bp, Artificial Sequence
  Description of Artificial Sequence: Synthetic coding sequence
agcgacagcagcccctaccacagccccaaggtggaggagtggagctctctgggcagaaataacttccccgccgcggcaccccacgccgtgaatggacttgaaaagggcgcacttgagcaagaagccaaatatggacagatccaaaacttcttcctgctcatgatcagccggctgaagttctag

SEQ ID NO: 198488 - DNA, 912 bp, Artificial Sequence
  Description of Artificial Sequence: Synthetic coding sequence
atgggccggcccctgctgctgcccctgctgcccctgctgctgccccctgctttcttgcaaccaagtggatccacggggtcaggacctagctatctctacggagtgacccaacctaagcacctgagtgccagtatggggggctctgtggaaattccatttagcttttattacccatgggaactggctaccgcaccagatgtaagaatttcttggcgccggggacacttccaccgccagtctttctactccaccaggccgccctctattcacaaagactatgtgaaccggctttttttgaactggaccgaaggacagaaaagcggctttctacggatctccaatctgcagaagcaggatcaatccgtttacttttgccgcgtggaactggatacgagaagctcaggacgccagcagtggcagtccatagaaggaaccaaactgagcattacccaagcggtcaccaccacaactcaaagaccctcttccatgactaccacttggcggctgtcttcgacgacaacaacaaccggtctgagggtgacccagggcaaaaggaggtccgatagctggcacatttctttagaaacggctgtgggagtcgccgtggccgtcactgtcctgggtattatgatactcgggcttatctgcctgctcagatggcgcagaaggaagggtcaacaacgtactaaggcaaccactcccgcaagggagccatttcagaacactgaagagccctacgaaaacatcaggaacgaaggccagaatactgatcccaagttaaatccgaaggatgacggcatcgtctatgcctcactggccctgagtagttcgacttccccccgagccccaccctcacaccggcctttgaagtccccgcagaacgaaaccctctactccgttttaaaagcctag

SEQ ID NO: 198489 - DNA, 693 bp, Artificial Sequence
  Description of Artificial Sequence: Synthetic coding sequence
atgggccggcccctgctgctgcccctgctgcccctgctgctgccccccgcctttctccagccatcgggctccactggctctggcccaagctatttatacggcgttacacaaccaaaacacttgtctgccagcatgggtgggtctgtcgaaatacccttttccttttattacccttgggaacttgcgacagcccccgacgtgcgaattagctggcgacggggtcactttcatcggcagagtttctacagcacacgcccaccaagcatccataaggattacgttaaccgcctgtttcttaattggaccgagggtcaaaagtctggtttcctacgcatctcaaacctccaaaagcaggatcaatccgtatacttctgccgcgtcgagctcgacacgagatcctcagggcgacagcagtggcagagcattgaagggaccaaactgtcgattacccagggacagcagagaacaaaggctacaacccctgcacgggagcctttccagaatactgaagaaccatatgagaatatccgaaacgaggggcagaacactgaccccaaactcaaccctaaagatgacggaatcgtatatgcctctctggctttgtccagtagcacctcccccagagcacctccgtcccatagacccctgaagagtcctcaaaatgagacactgtactccgtcttgaaggcctag

SEQ ID NO: 198490 - DNA, 528 bp, Artificial Sequence
  Description of Artificial Sequence: Synthetic coding sequence
atgggccggcccctgctgctgcccctgctgcccctgctgctgccccccgcctttctgcagccgagcgggagcaccgggtccggcccgtcatacctttacggtgtgacccagcccaaacacctgtcagcttccatggggggcagtgtggaaattccttttagcttctattacccctgggaactggccaccgctcccgatgtgcggatctcctggagacggggccatttccacagacagagcttctactctactagacctcccagtatccataaggattatgtaaaccgcttgttcctgaattggaccgaggggcagaaaagtggatttctgcgaatctctaatctgcaaaagcaggatcaatctgtatatttctgcagggtcgagctcgacacccgctcttccggtaggcagcaatggcagagcattgaaggaactaaactctctatcacccaggggaatccatcaaaaacccagcggtcacacatgcggatttcagggatgaaggataagatccagataccatcttag

SEQ ID NO: 198491 - DNA, 492 bp, Artificial Sequence
  Description of Artificial Sequence: Synthetic coding sequence
atgggccggcccctgctgctgcccctgctgcccctgctgctgccccccgcctttctgcaaccatcaggatccacggggagcggcccgtcttatctctatggcgtgactcagcccaagcatcttagcgctagcatgggagggtctgtggagattccattctccttctattatccatgggagcttgccacagctcccgacgtacgtatttcatggcgaagggggcattttcacaggcagtctttctatagtacacgacccccctctattcataaggattacgttaaccggttgtttctcaactggactgaagggcagaagtcagggttcttacgaatcagcaatctccagaagcaagatcagagcgtttacttttgtagagtggagctggatacacggtccagcgggcgccagcaatggcagagcatcgagggaacaaagttatccattactcaggggcaacagcggaccaaggcaactacgccagccaggtag

SEQ ID NO: 198492 - DNA, 684 bp, Artificial Sequence
  Description of Artificial Sequence: Synthetic coding sequence
atgggccggcccctgctgctgcccctgctgctgctgctgcagcccccagcttttttacagcccggcggctcaacgggaagcggcccatcatacttatatggcgtcactcaaccaaaacacctgagcgcctcaatgggaggcagtgtagagattcccttttccttttactacccatgggagctggccatagtgcctaacgtccgcatcagttggagacgtggacactttcacggacagagcttttactcgacgcggccacctagtatacacaaggattacgtgaatagactcttcctcaactggactgaagggcaggagtctggattcctaagaataagcaatctccgaaaagaagatcagagtgtttatttttgccgggttgagctcgatactagacgctcaggccggcaacaattgcagagcataaaggggaccaagctgacgatcacacaagcagtgaccacgaccacgacttggcgccctagctcaactacaaccatcgcaggccttcgtgtgacagagagcaaaggtcactctgagtcatggcacctgtcacttgacactgccatccgagtggccctcgctgtagccgtcctgaagacagtgattctgggacttctctgtctgttgcttctgtggtggcgaagacggaaaggtagccgggcgcctagcagcgatttttag

SEQ ID NO: 198493 - DNA, 999 bp, Artificial Sequence
  Description of Artificial Sequence: Synthetic coding sequence
atgggccgggccagctacggcggcagccccgtgggccaccagagctcatctgatcaccccagagcaaaaacttgtcgtagccctgtgcgcgacggaccacgcactctgtgtggagtccctactgtggctctgagtcttcacttccttcgcgaggcttctagcggatccagaacatgcgggcgtcggacaagtctgtgcacttctgcgaagtccagttggacttatcggtctgctctgagacagcctttacacagggccccgctgctaccagggcagctgtgttggagtccccgtcctcttgagaagaacaaggccatgggtcggcccctgctactgccactgctgctgctcctacagccacctgcattccttcagcctggtggatccacaggaagtgggccctcttacctctacggagtgacgcagcccaaacacttgtccgcttcaatgggtggaagcgtggagatccctttttcgttttactacccatgggagctagccatagtccccaacgtccgcatcagttggagaaggggccattttcatggccaatcattttattccacacgaccgccttcgattcataaggattacgtaaatcgcttgttcctgaactggaccgaggggcaagagtccggattcctgcgtatttccaacttaagaaaggaagaccaatccgtgtatttctgccgcgtggagctcgacacacggcgctccgggcgtcagcagttgcagagcatcaaaggtacaaaactgacaatcactcaagctgtcactacgactactacctggaggccttcttcaactaccactatagctgggttaagggtgactgaatccaagggccactccgaaagctggcacctgagtctggatacagccattagagtggctctggccgtcgcggtccttaagacggtcatactgggattgctttgcttactgttgctctggtggcgccggaggaagggctcacgtgcccctagttccgatttttag

SEQ ID NO: 198494 - DNA, 384 bp, Artificial Sequence
  Description of Artificial Sequence: Synthetic coding sequence
atgggccggcccctgctgctgcccctgctgctgctgctgcagcccccagcctttctgcaacccggtgggtctacaggcagtggccccagctacctatacggtgtgacccagccaaagcacctgagtgccagtatgggcgggtccgttgaaatcccctttagcttttactacccgtgggaactggcaattgtacctaacgtcaggatctcctggagaaggggtcatttccacggccagtctttttactccacccggccacccagcatccataaagattatgtgaatcggctgttcctgaactggactgaaggccaagagagcggttttctacgcatctccaacttaaggaaagaggatcagtcagtgtatttttgccgggtttag

SEQ ID NO: 198495 - DNA, 684 bp, Artificial Sequence
  Description of Artificial Sequence: Synthetic coding sequence
atgggccggcccctgctgctgcccctgctgctgctgctgcagccccctgcattcctgcaacctggcggtagtaccggaagcggccccagttatctctatggtgtgacgcaaccaaagcacctgagcgcttccatgggggggtctgtcgagattcctttttctttttactacccctgggaactcgccatcgttcctaatgtccgcatcagttggcggaggggacatttccatggccagagcttctatagcacccgccctccatccatacacaaagactatgtgaatcggttgtttctgaattggacggaggggcaggagagtgggttcctaagaatctctaatctccggaaggaagaccagagcgtctacttctgcagggttgagcttgatacccgccgctctgggcggcagcaactgcaatctatcaaaggcactaagctgaccattacacaagccgtcacgaccacaaccacctggagacctagtagtacgacaactatcgccggactgagggtcactgagagcaaaggccatagtgagagctggcatctttcactagacacagctattcgcgtcgccttggccgtggctgtgctgaaaaccgtcatcctgggcttgctttgcctgttgttactgtggtggaggcgccggaagggatcccgcgcccccagttcagatttctag

SEQ ID NO: 198496 - DNA, 384 bp, Artificial Sequence
  Description of Artificial Sequence: Synthetic coding sequence
atgggccggcccctgctgctgcccctgctgctgctgctgcagccccccgcttttctgcagccgggggggtccactgggtccggccctagttacctctacggggtcacacagcccaagcacttgagcgcatctatgggagggagcgtcgagatccccttcagcttttattacccatgggagctggcaattgtgcctaacgttcgcatctcctggaggagagggcattttcacgggcagagtttctactctaccaggccgccctcaatccacaaggactacgttaaccgacttttcttaaactggaccgagggtcaagagtcaggctttctgcgcatctcgaacttacgaaaagaggaccaatccgtgtatttttgtagagtttag

SEQ ID NO: 198497 - DNA, 183 bp, Artificial Sequence
  Description of Artificial Sequence: Synthetic coding sequence
atgggccggcccctgctgctgcccctgctgctgctgctgcagcccccagcctttcttcagccaggtctgtgcgagcctgctttgagcgaacttgacagagggagcggcgagagactccctcaggatctgaagcctgctgaaggaggtcctgtgtgcgtcttccttccctcaagggccggctag

SEQ ID NO: 198498 - DNA, 366 bp, Artificial Sequence
  Description of Artificial Sequence: Synthetic coding sequence
atgggccggcccctgctgctgcccctgctgctgctgctgcagccccctgcattcttgcagcctgggggctctacaggctcaggcccgtcatatctctacggcgtcacccaaccgaagcatctaagcgccagcatgggcggctctgtggaaattccttttagcttttactacccatgggaactggcaatcgttcccaacgttagaatttcatggcggcggggtcatttccatggtcaatcattttattctacaaggccgcctagcatccataaggactatgtaaatagactgtttcttaattggactgagggacaggagtccgggtttctgagaatttccaacttacgcaaggaagaccagagctag

SEQ ID NO: 198499 - DNA, 384 bp, Artificial Sequence
  Description of Artificial Sequence: Synthetic coding sequence
atgggccggcccctgctgctgcccctgctgctgctgctgcagccccccgctttcctccagccaggggggagcacgggttccggcccttcatatctgtatggagtgacgcagccaaaacacctgtctgcttctatgggcggctcagtggaaatccctttctctttctattacccatgggaacttgccatcgtgcccaacgtacgcatctcctggaggcgcggccactttcatggtcagtcattttatagtactcggcccccctccatacataaggattacgtcaatcgattgttcctgaattggacagaggggcaagagtcaggcttcctgcggatatccaatctccggaaagaggatcagagtgtctacttttgcagggtatag

SEQ ID NO: 198500 - DNA, 684 bp, Artificial Sequence
  Description of Artificial Sequence: Synthetic coding sequence
atgggccggcccctgctgctgcccctgctgctgctgctgcagccccctgccttcctgcagcccggagggtctacaggctccggtccaagctacctgtacggcgtaacacagcccaaacacctgagcgcaagtatgggtggctcagtggagatccctttctccttctattacccgtgggaactcgctatcgttcctaacgttcgaattagctggcgccgcggccacttccacggccaaagcttttattccacccgtccccctagtattcataaggattatgtgaatcgtctcttccttaactggacagagggtcaggagtcgggttttttacggatttccaatttgcgcaaagaggaccagagcgtatatttctgtcgggttgaattagacacccggcgctccgggcgccagcaactgcaaagtataaaaggaactaaactgacgataacccaggccgtgacaactaccactacctggaggcccagttccaccacaaccatagcgggtcttcgtgttactgagtcaaagggccattctgaatcatggcacctatctttggacacagcaattagggtagcgctggccgtggccgtgctgaagaccgtaatcctgggactactctgcctgctgcttctgtggtggcggaggcgcaaggggtctagggccccttcgagtgatttttag

SEQ ID NO: 198501 - DNA, 450 bp, Artificial Sequence
  Description of Artificial Sequence: Synthetic coding sequence
atgggccggcccctgctgctgcccctgctgctgctgctgcagccccccgctttcctgcagcccggactttgcgaaccagctctcagtgagctggacagaggatccggcgagaggttgccccaagacttaaagcccgccgaaggtgggcctgtttgcgtatttctccccagtagagccggtcaccccgagatccgggaggccgctgtggcggtgcaccagggcgaccagacacatcaccaccccgggtgccataaccatcaccacctggaggcccagcagcacaaccaccactctcggcctcagggacacaggaagcaaagagccctacggattatggcccctaaatctggacattgccaccagggatgcataggatgtcgctgtgcgcagaattgtcatttcggcacggccgtgccccccccccccgtagtcgaggagaaggaaagatag

SEQ ID NO: 198502 - DNA, 816 bp, Artificial Sequence
  Description of Artificial Sequence: Synthetic coding sequence
atgggccgggccagctacggcggcagccccgtgggccaccagagctcgtccgaccacccaagggctaagacctgccgctctcccgttagggacggtccacggaccctgtgcggcgtgccaactgtggctttgtccctgcatttccttcgcgaagcgtctagtggatccagaacttgtggacgtagaactagtctttgcacatccgctaaatcttcctggacatacagatcaggccgactcagttggcagagtattaaggggacccacctcaccattacccaggctctcaggcagccactccaccgcgctcccctactccctggtcagctatgttggagtccccgccctctggaaaagaataaggcaatgggccggccgctcttgcttcctttgctgctgttgctgcagcctcccgctttcctgcaacccgggctgtgtgagccggctttgtcagaactagacaggggcagtggggagaggctgccccaggatctgaaaccagcagaaggggggcctgtttgcgtatttctgcctagtcgagctggtcatccagagatccgcgaggccgcggtcgccgttcaccagggagaccagactcatcatcatcctggctgtcacaatcatcatcatctagaggcacaacagcataatcatcacagtagaccacaaggtcatcgaaaacaacgagctctgcggattatggcaccgaagtctgggcactgtcatcaggggtgtatcggctgccgttgcgcccagaattgtcactttggtaccgctgtacccccaccccccgttgtagaagagaaggaacggtag

SEQ ID NO: 198503 - DNA, 684 bp, Artificial Sequence
  Description of Artificial Sequence: Synthetic coding sequence
atgggccggcccctgctgctgcccctgctgctgctgctgcagccccccgcattcctgcagccaggaggaagcactgggtcagggccttcatatttgtatggagtcactcagcctaaacatctgtccgccagtatgggcggctccgtcgagatcccttttagcttttactatccatgggagctggcaatcgtgcctaacgttcgcatctcttggcggcgcgggcacttccatggccaatctttctattccacaagacccccttcaatccacaaggattacgtcaaccggctgtttctgaactggacagaaggccaggaatctggattcttgcgcatcagtaatctgaggaaagaagaccaatctgtctacttttgcagagtggagttggatacccggcggtctggccggcagcagctacagagtattaagggaacaaaacttaccattacccaagctgtgaccaccacaaccacttggcgcccttcctccacgactacaatagctggcttgcgtgtaaccgaaagtaaaggccattccgagagctggcatctgagtctggacacagcaatacgggtggccttggcggtggcagtcttgaaaactgtcattctgggcctgctctgcctcctgcttctatggtggagacgccgcaaagggagtcgcgcccctagttccgatttctag

SEQ ID NO: 198504 - DNA, 327 bp, Artificial Sequence
  Description of Artificial Sequence: Synthetic coding sequence
atgggccgggccagctacggcggcagccccgtgggccaccagagctctagcgatcacccgcgcgccaaaacctgtagatctcctgtgcgcgatgggcctcgcaccttgtgtggggtgcctaccgtggccctctcattacacttcctgagggaagctagttcaggcagtcggacatgcggaagaagaacttcactgtgcacgtcggcaaaaagctcttggacctataggtcgggcaggctgagctggcagtccatcaaagggacccacttaaccatcacacaggccctccgccagccgctccacagggcccccttactaccagggtag

SEQ ID NO: 198505 - DNA, 384 bp, Artificial Sequence
  Description of Artificial Sequence: Synthetic coding sequence
atgggccggcccctgctgctgcccctgctgctgctgctgcagccccccgcctttctgcagccgggcgggtccaccggcagcggaccaagttatctttacggagtgacccaaccaaaacacctgagcgcaagtatgggagggtctgtagaaatccccttctccttttactatccatgggaactggcgatcgtccccaacgtgagaatctcctggcgccgaggtcactttcacggtcaatctttctactctacccggcccccgtctattcacaaagactacgtgaacagactctttctgaattggaccgagggacaggagagtggtttcctcagaattagcaaccttcgaaaagaggatcagtctgtgtatttttgccgcgtctag

SEQ ID NO: 198506 - DNA, 738 bp, Artificial Sequence
  Description of Artificial Sequence: Synthetic coding sequence
atgaccagcagctacggccacgtgctggagcggcagcccgccctgggcggccgactggattccccaggaaacctggataccctgcaggcaaagaagaatttcagcgtgtctcatcttctcgacttggaagaggccggcgacatggttgccgctcaggcagatgaaaatgtcggggaagctggccgaagccttctggaatcaccaggtctgacatctgggtccgacacccctcagcaagacaacgatcagctgaattcggaagagaagaagaagaggaagcagcggaggaaccgaactacctttaattcaagccaactacaagccttagagcgggtcttcgagaggacccattatcccgacgcatttgtccgggaagacctggctcgtcgggtgaatttgaccgaagctcgcgtgcaggtgtggtttcaaaatcgccgcgccaagttcagacggaacgaacgcgccatgctggctaacaaaaatgcttcgcttttgaagagttatagcggggatgtgactgctgtggaacaacccattgttccaaggccagctccaagaccaacagactatctcagttggggcacagcctccccgtactcagcaatggccacatattctgcaacttgcgccaataatagccctgcccagggcataaacatggcgaattcaatagccaatttgcgactcaaagcgaaagaatactccctgcagcgtaatcaggtgcctactgtcaattag

SEQ ID NO: 198507 - DNA, 654 bp, Artificial Sequence
  Description of Artificial Sequence: Synthetic coding sequence
atgaccagcagctacggccacgtgctggagcggcagcccgccctgggcgggaggctcgacagtccaggaaatctcgacacgctgcaagcaaagaagaactttagcgtgtcacaccttctggatttggaagaggccggtgacatggtggctgcgcaagccgatgagaacgtgggagaggccggcaggagtctgctggaaagccctgggctgacatccggaagcgatacaccacagcaggataacgatcagctcaattcagaagagaagaagaagcgcaaacagaggaggaatagaacgacttttaactcgtctcagttgcaggccctggagcgagtttttgagagaacacactacccggacgccttcgtgagagaggacttggcacgacgggtgaacctcaccgaagcccgcgtccaggtctggtttcagaatcggagggctaaattccgtaggaacgaaagagccatgttagccaacaaaaacgcaagtctgttgaaaagctattcaggtgacgtgactgctgtcgaacagccgattgtacctagacctgccccccgcccgaccgattacctgtcttggggaacggcgagcccttaccgctctagtagcctgcctcgctgttgccttcacgagggcctgcacaatggattttag

SEQ ID NO: 198508 - DNA, 762 bp, Artificial Sequence
  Description of Artificial Sequence: Synthetic coding sequence
atggacagcgccgccgccgccttcgccctggacaagcccgccctgggacctggaccaccccccccaccacctgccctagggcctggggactgcgcccaggcacggaaaaacttttctgtgtctcacctgctggatctcgaagaagttgcagccgctgggaggctggctgcacggcccggcgccagggccgaggcccgggaaggagccgctagagagcccagcgggggatcaagcggcagcgaagctgccccacaagacggagagtgcccctcccccgggcgcggatccgccgctaaaaggaaaaaaaagcaacggagaaacaggaccacctttaactcatcccagctccaggctctggagagggttttcgaaaggacccactaccctgacgctttcgtgagggaagaactggcccgcagggttaatctgagtgaggcgcgggtgcaagtttggtttcagaaccggagggccaaatttcgccgaaacgagcgggccatgctcgctagccggtctgcctcactgctcaaaagctattcccaagaagcggccattgagcaaccagtggccccccggcccacagcactgtcgcctgattacctctcctggaccgcctcttcaccctacagcaccgtccccccttattcgcccggcagtagcggaccagctactcctggtgtaaatatggcaaattccatcgcgagtctgcgattaaaagccaaggagttctcactgcaccattctcaggtgccgacagtgaattag

SEQ ID NO: 198509 - DNA, 855 bp, Artificial Sequence
  Description of Artificial Sequence: Synthetic coding sequence
atggactacagctacctgaacagctacgacagctgcgtggccgccatggaagcatccgcctacggtgattttggcgcctgctctcaaccaggaggcttccagtacagtcctctgagaccagcttttcccgcagccggccccccttgccccgcactgggctctagcaactgcgccctgggcgcgctccgagatcaccagcctgccccctacagtgccgtgccatataaatttttccccgaaccctccgggttgcacgagaaaagaaaacagaggagaatcagaaccacctttaccagtgcacagcttaaggaactcgagcgagtttttgctgagacccactatcccgacatttataccagggaagaacttgctctgaagatcgatttaacagaggcacgtgttcaggtctggttccagaatagacgagccaagttccggaaacaggaacgggccgccagcgctaaaggagcagctggtgctgcaggggcaaagaagggagaggctcgatgcagcagtgaagacgatgattccaaggagagcacttgcagtcccacccccgacagcacagctagtttgcctccacccccagctccgggcttggccagtcctcggctgagtccaagtcccttgcctgtcgctctaggatccggcccaggccctggccctggaccgcaacctctgaagggggccctgtgggcgggcgtggctggtggaggcggcggggggccaggggccggcgctgcagagctactgaaggcttggcagccggctgagagcgggccagggccgttcagcggagttctgagcagcttccatcgcaaacccggccctgctctgaaaaccaatctgttttag

SEQ ID NO: 198510 - DNA, 1800 bp, Artificial Sequence
  Description of Artificial Sequence: Synthetic coding sequence
atgaagctgctgaagctgaccggcttcatcttcttcctgttcttcctgaccgagagtctgaccctgccaacccagcccagagacattgaaaatttcaactcgacacagaaattcatagaagataacatcgaatacattactatcattgcctttgcacagtacgtgcaagaagcaactttcgaagagatggaaaagctggtcaaggatatggtggagtataaggaccgttgtatggccgataaaaccttgcctgaatgctccaagttacccaataatgtgcttcaggagaagatctgcgccatggagggattgccccaaaagcataacttcagtcactgttgcagtaaagtagatgcccagagacgcctatgttttttctacaataagaagtctgacgtcgggtttctccctcccttccccactctggatcctgaagagaaatgccaagcgtacgagtcgaaccgggaaagtctcctaaatcacttcctgtacgaagtcgctcgacgcaatcctttcgtgttcgctccaacacttttgacagtagccgttcacttcgaagaggtggccaaaagttgttgcgaggagcagaataaggtgaattgcctacagactagggccattccagtcacccaatatcttaaagccttctccagctatcagaaacacgtgtgtggggctctcctgaagttcgggaccaaggtggttcacttcatctatatagccatcttgtcacaaaaatttccaaagatcgagttcaaagaattaatcagtttggtggaggacgtgagcagcaactatgacggatgctgtgaaggagatgttgttcagtgtatccgcgacacgtcaaaagttatgaaccacatatgttctaaacaggactctatcagtagcaaaatcaaggagtgctgcgaaaaaaaaatcccagagagaggacagtgcataatcaattccaacaaggacgatcggcccaaggacctgtctctccgcgaagggaagttcacagatagcgagaatgtgtgccaagagcgcgacgccgaccctgatactttcttcgcaaagttcacatttgagtattctcggagacaccccgacctttccattcctgagctgcttaggatcgtccagatctataaggacctcctgcggaactgttgtaacactgagaacccgcccggctgttacagatatgccgaggacaaattcaacgagaccaccgaaaaatcgctcaagatggtacagcaggaatgcaaacacttccagaacctggggaaggacggactcaaataccactatttaatccggttaacaaagatcgcacctcagctttccactgaggagctcgtgagcctcggcgagaagatggtcacagctttcaccacatgctgtaccttgagtgaggaatttgcctgtgtggacaatttggccgatctcgtatttggcgaactgtgtggagtgaatgagaatcgcactataaacccggcagtggatcactgttgcaagaccaacttcgcctttcggcggccttgctttgagtccctcaaagccgacaagacctacgtgccaccacctttttcccaagatctgtttacctttcatgctgacatgtgccaatctcagaacgaagaattgcagaggaagaccgaccggtttctggtcaatctggtaaagctgaagcacgaactcacagacgaagagttgcaaagcctcttcactaacttcgctaacgtggtggataagtgctgcaaagcagaatctccagaagtgtgtttcaacgaggagtcccctaaaattggcaattag

SEQ ID NO: 198511 - DNA, 945 bp, Artificial Sequence
  Description of Artificial Sequence: Synthetic coding sequence
atggacgccttcaagggcggcatgagcctggagcggctgcccgagggtctgcggccccctccccccccaccacatgacatggggcccgccttccacctggctcgacccgcggacccccgcgaaccactggagaatagtgccagcgagtccagcgacacggaactgcctgaaaaggaaagaggcggagagccgaagggacccgaagactccggcgccggcggtacagggtgcggcggcgctgacgacccggcaaaaaagaagaagcaaagaagacagaggacccactttactagtcagcaactgcaggagctggaggcgactttccagcgaaatcggtacccagatatgagcatgagagaggaaattgccgtttggactaatttgacggaaccccgagtgagagtctggtttaaaaacagacgtgccaagtggagaaaacgagagaggaatcaacagctcgatctctgcaagggcggctacgtgccacaattctccgggttggttcaaccatatgaagacgtatacgctgcaggctactcctataacaattgggcagcgaaaagtctggctcctgcacccctttcaacaaaaagttttactttctttaattcgatgagccccttatccagccaaagtatgttctccgcgccatcaagcatctcaagtatgacgatgccttccagcatgggaccgggagcagtacccgggatgcctaatagtggactcaacaacatcaataatctgactggctccagcctcaattctgccatgagtccaggtgcctgtccttatggaacccccgcctcaccctactccgtgtaccgagacacttgcaatagctccttggcgtccctacggttgaagtccaagcagcactcaagcttcggctacggagggctgcagggacccgcctccggactgaatgcctgccagtataattcatag

SEQ ID NO: 198512 - DNA, 345 bp, Artificial Sequence
  Description of Artificial Sequence: Synthetic coding sequence
atggacgccttcaagggcggcatgagcctggagcggctgcccgagggtttaaggcctcccccgccgcctccacatgatatggggccagcgttccacttggccaggcctgctgaccctcgcgagccactagaaaacagtgcgtcagaaagctcagacaccgagttgccggaaaaagagcgtggcggggaacctaaagggccagaagactccggtgctggtgggacggggtgtggcggagctgacgacccagccaaaaagaaaaaacagaggcgacagagaacccactttacaagccagcagctgcaggagttggaggccactttccaaaggaatagatatccatag

SEQ ID NO: 198513 - DNA, 945 bp, Artificial Sequence
  Description of Artificial Sequence: Synthetic coding sequence
atggacgccttcaagggcggcatgagcctggagcggctgcccgagggtttgcggccgccacctcctccgcctcatgatatgggcccggctttccatctggcgcggcccgctgacccgagggaacccctggagaatagtgcctccgaatcttctgataccgagcttcctgagaaagagcgcggaggcgagccaaaggggccagaggactctggtgcaggagggaccggctgcgggggcgccgacgaccctgctaaaaagaaaaaacaacggcggcaacgcactcactttactagccaacagttacaggagcttgaggctactttccaacggaacagataccccgatatgtcgatgcgcgaggagattgcagtctggaccaacctcaccgagccgagggttcgagtgtggtttaaaaaccgccgcgcgaaatggcggaagcgagaacgtaaccagcagcttgacctctgcaaaggtgggtacgtacctcagttttcaggcctggttcagccgtatgaggacgtatacgccgccggttactcctacaacaactgggccgcgaagagcttggcgcccgccccgctgtctaccaaatccttcacgttcttcaattctatgtctcccttatcttcccagagcatgttcagcgctccctcttctatcagctctatgacaatgccgtccagcatgggtccgggtgccgtgcctggcatgccaaacagtggtcttaataatattaataacctcaccggatcgtcactgaactctgccatgtcccccggcgcttgtccatatgggactcctgcctccccttacagcgtttatcgcgacacctgcaatagttccctcgcatcactgaggctgaagtcaaagcagcattcatcatttgggtacggggggctgcaagggcccgcatcgggactgaacgcgtgccagtataattcatag

SEQ ID NO: 198514 - DNA, 396 bp, Artificial Sequence
  Description of Artificial Sequence: Synthetic coding sequence
atggacgccttcaagggcggcatgagcctggagcggctgcccgaggggttacggcctcctcccccacctccccacgacatggggccagccttccacttagctcgtccggctgatcctagggagccactggaaaactcagcctccgagagtagcgacactgagctgcccgagaaagagcgcggcggggaacctaaaggtccagaggactccggtgccggtggaacgggttgtgggggagccgatgaccccgcaaagaagaagaaacagagacgtcagcggactcactttacatctcagcagctgcaggagctggaggctaccttccagcgcaaccgataccctgatatgagcatgagggaggaaattgccgtttggacaaatctcacggaaccctag

SEQ ID NO: 198515 - DNA, 975 bp, Artificial Sequence
  Description of Artificial Sequence: Synthetic coding sequence
atgaactgcatgaagggccccctgcacctggagcaccgggccgccgggaccaaactgtcggccgtgtcctcttcctcttgtcaccacccccagccactggcgatggcgtctgtgttagctccaggccagccaaggtcactagactcaagcaaacacagactggaggtgcatactataagtgatacatcctcaccagaagccgcagaaaaagacaaaagtcagcaagggaagaacgaggacgtgggcgccgaggacccatctaagaaaaagagacagaggaggcagcggacccacttcacctctcaacaattgcaagaactcgaagcaacgtttcaaagaaacaggtatccagacatgagtacacgggaagaaatcgctgtgtggaccaatctgaccgaggcgagggtacgggtctggtttaaaaacaggcgggcaaaatggagaaaacgggaacggaaccagcaggccgaactatgtaaaaacggctttggcccccagtttaatggactgatgcaaccatacgacgacatgtatccgggatacagctacaacaactgggctgcgaaggggctgacatcagcaagcctgtctaccaaatccttcccattctttaattctatgaacgtcaatccgcttagctcccagtccatgttcagtcctcctaattccatcagttccatgagcatgagttcctcaatggtccctagtgccgtgactggtgtgccggggtccagtctgaattcgctgaataatctcaataacctctcatccccgagcctgaactctgccgtgccaacaccagcatgtccctatgcccctccaactccaccatacgtgtatagagacacatgcaatagcagtctcgcatccctgcgcctcaaagccaaacagcacagctctttcggctatgctagcgtgcagaacccggctagtaacctgtccgcttgccaatatgcagtggacaggccagtttag

SEQ ID NO: 198516 - DNA, 954 bp, Artificial Sequence
  Description of Artificial Sequence: Synthetic coding sequence
atggagaccaactgccggaagctggtgagcgcctgcgtgcagctgggagtccagccggctgccgtcgaatgtctattttcgaaagatagcgaaatcaaaaaggtcgagttcacagatagccccgagagcaggaaagaggcagcctctagtaaattttttccgagacagcaccccggggcaaacgaaaaggataaatcccagcagggtaaaaacgaggacgttggcgccgaagatcctagtaagaagaaaaggcagaggaggcagaggacccattttactagccagcagctgcaggaactggaggccacgtttcagaggaatcggtatccagatatgagcactagggaagaaatcgcagtctggaccaatttgactgaagctagagtgagggtttggtttaagaatcgaagggccaaatggcggaagagagagaggaatcagcaagctgaattgtgcaagaatggttttggcccgcagttcaatgggctgatgcagccttacgatgatatgtaccctggatactcttacaataactgggcagctaagggactgacgagcgccagcttgtccacaaaatcctttcctttctttaactctatgaatgtgaacccgctgtcgtcacagtcaatgtttagcccgcctaatagtatctccagcatgtcgatgagttcatcaatggtgccctcggcagtcaccggcgttcccggatccagcctcaattcactcaataatctgaataaccttagtagcccaagccttaactccgccgtaccaacccctgcttgcccttatgcgccgcctacaccaccctatgtataccgtgatacctgtaattccagtctcgcttccctgcgattgaaagctaaacagcattccagtttcggctacgcctctgtccagaatcccgcaagcaatctttccgcctgtcagtacgccgtggatagaccagtgtag

SEQ ID NO: 198517 - DNA, 816 bp, Artificial Sequence
  Description of Artificial Sequence: Synthetic coding sequence
atggagaccaactgccggaagctggtgagcgcctgcgtgcagctggaaaaggacaagtcccagcagggtaagaacgaagatgttggtgccgaggatccgtcaaagaagaagcgccaacggcggcaacgcacacattttacctctcagcaacttcaggagctggaggctacatttcagcgcaaccgatacccagacatgtcaactcgcgaagaaattgccgtctggactaatctgactgaagctagggtgagggtgtggtttaagaacagacgcgcgaaatggagaaaaagagagaggaatcagcaggctgagctatgcaagaacggattcggcccccagttcaacgggctaatgcaaccctacgacgacatgtaccctggctacagttacaataattgggctgctaagggcctcacctccgcttctcttagtactaaaagttttccattttttaactctatgaatgttaatccactgtccagccagagcatgtttagcccaccaaattccattagtagcatgtctatgtccagcagtatggtgcccagcgcggtaacaggcgttccaggaagtagccttaactcactgaacaatctcaacaacctctcttccccgtcacttaactcagctgtgcctaccccagcttgtccgtatgcaccacccaccccaccatatgtttaccgtgacacttgcaattcatcgcttgcgtcgctgcgactgaaggctaagcaacactcatcttttggatacgccagcgtccagaacccagcatctaacctgtccgcctgtcagtatgccgtagaccgccccgtatag

SEQ ID NO: 198518 - DNA, 954 bp, Artificial Sequence
  Description of Artificial Sequence: Synthetic coding sequence
atggagaccaactgccggaagctggtgagcgcctgcgtgcagctgggagtgcagcctgctgcagtggagtgtcttttttctaaggactctgagataaagaaggtggagtttaccgacagtcccgagagccgaaaagaggccgcgagtagtaaatttttcccccggcagcatccaggggcaaacgagaaggataaatcgcaacagggcaaaaacgaggacgtcggtgcagaggacccctccaaaaagaagaggcaacgacggcaacggacccacttcactagtcaacaactccaggagttggaagccaccttccagcggaatcgctaccctgatatgtccaccagggaagagatcgccgtctggacaaatctgactgaggccagggtccgagtctggttcaagaaccgccgagccaaatggagaaaaagagaacggaatcaacaggcagaactgtgtaagaatggttttgggccccagtttaatggacttatgcagccctatgacgatatgtaccctgggtatagctacaataactgggccgccaaggggctcacttcagccagcctttctaccaagtcattcccctttttcaactccatgaatgtaaaccctctctcctcccaaagcatgttttccccccctaacagcattagctctatgtctatgtccagtagcatggtgccaagcgcagtgacaggtgtccctgggtccagccttaacagcttgaacaacttgaacaatctatccagccccagcctgaacagtgctgtgccaacacctgcttgtccgtatgcccctcctactcccccgtacgtgtatagggacacatgtaattcttcgcttgcaagcctgcgcctgaaagctaagcagcactccagtttcggctatgcatcggtacagaacccggcctccaatttgtctgcctgccagtacgccgttgaccgccctgtatag

SEQ ID NO: 198519 - DNA, 873 bp, Artificial Sequence
  Description of Artificial Sequence: Synthetic coding sequence
atggagaccaactgccggaagctggtgagcgcctgcgtgcagctgggtgtccagcctgcagccgtggagtgcctttttagcaaggactccgagatcaagaaggtggagtttacagacagcccagagagtagaaaagaagcagcctcttctaagttcttccctcgccagcatccgggcgccaacgagaaggacaagagccagcagggcaaaaatgaggatgtaggcgccgaagacccttccaaaaagaaaaggcagcggcggcagagaacccacttcaccagtcagcaacttcaggagctggaggctacttttcaacgcaatcgataccctgacatgtccactagagaggagatcgcagtttggacaaacctaaccgaggccagggtgagggtttggtttaagaatcgacgcgctaagtggcggaaacgggaacgtaaccagcaggcagagctgtgcaagaatgggttcgggccccaatttaacggcctgatgcagccttacgatgacatgtaccccggatattcctacaacaattgggcagctaagggattaaccagcgcatctctcagcactaaaagcttcccgttttttaatagtatgaatgtaaatcccctgtcctcccagagcatgttttcgccacccaattcaatcagtagtatgagcatgtcctcctccatggttcccagtgcagtgaccggagtgcccgggtcgtcactgaactcactcaataatttgaacaatttgtcatctccatccctgaactcagccgtgcccactccagcatgtccttatgcccctcctaccccaccttatgtgtacagggatacttgtaattccagcttggcttctctcagactcaaagctaagcaatag

SEQ ID NO: 198520 - DNA, 357 bp, Artificial Sequence
  Description of Artificial Sequence: Synthetic coding sequence
atggagaccaactgccggaagctggtgagcgcctgcgtgcagctggaaaaggacaagtcccagcaaggtaagaacgaggatgtgggggccgaggatcccagtaaaaaaaaaagacagaggcgccagcgcacccattttacatcacagcaactgcaagaactggaggccactttccagcggaatagataccccgacatgtccacaagagaggaaatcgccgtttggacaaacctcacagaggcccgtgtccgggtgtggttcaaaaaccgaagggccaagtggcgaaagagggaacgaaaccagcaggctgagctgtgtaaaaatgggttcgggccacagttcaacggcctgatgtag

SEQ ID NO: 198521 - DNA, 909 bp, Artificial Sequence
  Description of Artificial Sequence: Synthetic coding sequence
atggagttcggcctgctgagcgaggccgaggcccggagccccgccctgtccttgagcgacgccggcacaccacatccacagcttccagagcatgggtgcaagggtcaggagcacagcgactccgagaaggccagcgcatcattacccgggggttctcccgaggacgggagtttgaaaaaaaaacagcgtagacagagaacacatttcacaagtcagcaactccaggagttggaagccacttttcagagaaataggtaccccgatatgagcacgcgggaggagatcgcagtgtggactaatctgacggaggccagggtgcgggtgtggttcaaaaaccggagagccaaatggagaaaacgtgagcggtcacaacaggctgagttgtgcaagggaagttttgccgcacctttaggaggtctcgtccccccttacgaggaggtatatccaggttattcatacggtaactggccgccgaaggcccttgcccctccactggctgctaaaacgttcccattcgcctttaattccgtgaatgtcgggcctctggcctcacaaccggtgttttctcctccatcgtcgattgccgctagtatggtgcccagtgcggcggccgcccctggaaccgtaccaggtcccggcgcccttcagggcttaggcggcggcccaccggggctggctccagcggcagtgagctcaggtgctgtgagctgtccctacgcctcagctgccgccgctgccgctgcggccgcaagttccccttatgtttaccgcgatccctgcaattctagtctggcctctttgcgcctgaaggcgaagcagcatgccagttttagctatccagccgtccacggccccccccccgccgcgaatctatctccatgtcagtatgcagttgagcggcctgtgtag

SEQ ID NO: 198522 - DNA, 909 bp, Artificial Sequence
  Description of Artificial Sequence: Synthetic coding sequence
atggagttcggcctgctgagcgaggccgaggcccggagccccgccctaagcctttctgacgctggaaccccccatccacagcttcctgaacacggctgcaaagggcaggaacactctgattctgaaaaggccagtgcatctttgcctggcgggagcccagaagatggtagtctgaagaaaaagcaacgccgacagcgcacgcattttacatcacagcaactgcaggagctggaggcaacttttcaacgcaaccgctacccagacatgtcgactagggaggaaatagctgtgtggaccaacctcaccgaagccagggtcagggtgtggttcaagaatcgcagagcaaagtggcgtaagcgggagcgatctcagcaagcagaactgtgcaaggggagttttgcagcccccttaggaggactggtgcctccatacgaggaggtgtacccaggctattcctatggtaactggcctccaaaagcactcgctccccccctggccgccaaaacattcccgttcgccttcaacagtgtgaatgtgggccccctagctagccagccagtgttctcacccccctcatctatcgcagcttccatggttccatcagcggccgcggccccaggcactgttccgggcccaggagcactgcagggtcttggcggggggccaccaggcctagcccctgcagcggtcagttctggggcggtgtcttgtccatacgcatctgcggcagctgccgctgccgccgctgcctcctcaccgtacgtgtacagagacccctgcaatagcagcctcgccagtctccgtctgaaagccaagcagcatgcttctttctcctaccccgccgtgcacggcccacctcctgctgctaacctttcaccatgccaatatgctgttgaacgacctgtctag

SEQ ID NO: 198523 - DNA, 1179 bp, Artificial Sequence
  Description of Artificial Sequence: Synthetic coding sequence
atggagctggtggccggctgctacgagcaggtgctgttcggcttcgccgtgcatccagagccagaggcttgtggtgatcatgagcagtggacattagtggcagattttacccaccatgctcacacagcgtcattaagtgccgttgcggtgaacagccgttttgtggtgactgggtccaaggacgaaaccatacatatatatgatatgaagaaaaagatcgaacacggcgcgctcgtgcatcactcagggaccattacctgtctcaaattttacggtaatcgccaccttataagtggggctgaggatggcctaatctgcatctgggacgccaagaagtgggagtgtttgaagtcaatcaaggcccacaagggtcaagtcacttttctctcaatacacccctccgggaagcttgccctcagcgtggggactgacaaaactctgcgcacgtggaatctggtggagggacgttccgcttttataaagaacatcaaacagaacgctcacattgtcgaatggtctccaagaggcgaacaatatgtcgtaattatccagaacaagattgatatataccagcttgacaccgctagcatctctggaaccatcacaaacgagaaacgcattagctctgtgaagttcctctcggagtccgtgctggccgtggctggcgacgaggaagtaattcgattttttgactgtgacagtctggtttgtctatgcgaatttaaagctcatgaaaaccgagttaaagatatgtttagtttcgagatccccgagcatcacgttattgtgtcagcatcctctgacgggttcattaaaatgtggaaactgaaacaagacaagaaggtgcctccttcactgctttgtgagattaatacaaatgctcggctaacctgtctgggcgtatggcttgataaggtggccgacatgaaagaatccttaccgcccgccgcagagccatccccggtgagtaaggagcagagcaaaataggtaagaaggaaccgggagacacggttcacaaggaagaaaagcggtccaaacctaacacaaagaagcgaggcttaaccggggactccaagaaggcaaccaaagagtccggccttatcagtactaagaaacggaagatggtggagatgctcgaaaaaaagagaaaaaagaagaaaattaagacaatgcagtag

SEQ ID NO: 198524 - DNA, 3372 bp, Artificial Sequence
  Description of Artificial Sequence: Synthetic coding sequence
atgagcggcaccagcagccacgagagcttctacgacagcctgagcgacatgcaggaagaatctaagaataccgacttttttccagggctgtctgccttcctaagccaggaggagatcaataagtctttggacctggcccgcagagcaatcgccgactcagaaacagaagatttcgattcagaaaaggaaatttcccagatattttcgacaagtcctgcctctctttgtgagcacccctcacataaggaaactaagctgggagaacatgccagcaggaggccacaggacaacaggtctacccccgtgcagccactggcagaaaaacagacaaaaagcatcagctctcctgtctctaagcgaaaaccagctatgagcccactgctcacaaggccttcgtacatcaggtctttacgaaaagccgaaaagcgcggagcaaagacaccttccaccaacgtgaagccaaaaaccccccaccagcgcaaaggaggacctcagtctcagctgtgtgacaaggccgcgaacctcatcgaggagctgacctcgatatttaaggccgccaaacccagaaacagaagtcccaacggtgagtcctcttcccctgattccggatatctgagtcctaaaaatcagccttccgctctgctgagcgcatctgcttcacagtcaccaatggaggaccagggcgagatggagagggaagtcaaatctccgggtgcacggcattgttatcaagacaaccaggatctggcagttcctcacaatcggaaaagccacccacagcctcatagcgcattgcactttcccgccgcccctcgctttatacaaaagttaagaagccaagaggtggctgaaggtagccgggtttatctagagtgtagggtgacaggcaatccaaccccgcgtgtgcgctggttttgcgaggggaaggaacttcacaacacacccgatattcagatccactgcgagggaggagatttgcacaccctcattatcgccgaggctttcgaagacgacacgggtaggtacacgtgtttggctaccaatcccagcgggtctgacaccacgtctgccgaagtatttatcgaaggagctagttctactgacagcgattccgaaagcctggccttcaaaagcagagccggagccatgccacaggctcagaaaaaaactaccagtgtgagtctcaccataggctcctcttctcccaagactggcgtgacaaccgccgtgatccagcctctgagcgttcccgttcagcaggttcactcacctacatcctatctgtgtcgaccagatggaactacaactgcatacttccctccagtgttcacaaaggagttacaaaacaccgccgttgcggagggccaagtggtggtgctagaatgccgggttagaggggccccgccgctccaagtgcagtggttcaggcagggttcagagatccaggatagccccgactttcgcattctacaaaagaagcctcgatccactgctgaacccgaagaaatctgcactctggtcattgcagagacttttccggaagacgccggcatctttacatgttctgccaggaacgactatggatctgccacaagcacagcacagttagtcgtcacctccgccaacactgaaaactgtagctacgagtcaatgggggagtctaacaatgaccacttccagcatttccccccaccccccccaatcctggagacttcatcactggagctggcctcgaagaagccgagtgagattcagcaggtcaataacccagagctcgggctctctagggctgctctgcagatgcagttcaatgcagccgagagagagactaatggggttcatccctccaggggcgtgaacggcctaattaacgggaaggctaactctaataagtccctgcctactcctgctgtgttactttcccccaccaaggagcctcctcctctgctcgctaaacctaagctgggcttccctaaaaaggctagccggaccgccagaatcgcttccgacgaggaaattcagggcactaaggatgctgtgatccaggacctcgaacgcaagcttaggtttaaagaggaccttctgaacaatgggcagcctcggctaacctacgaggaacgaatggcacgccggttactcggtgcagatagcgccactgtctttaacatccaagaacctgaggaggagacagccaaccaagatattgggtcaccccatgccagcgtgggcagccccctagatggacagaaggagtacaaagtctctagctgcgagcagaggctcatctctgagatcgaataccggttggagagatccccggtagatgagtcaggcgacgaggtgcagtatggagatgtccccgtcgagaacgggatggcgccgttctttgaaatgaagctcaaacactacaagatttttgaaggtatgccagtgacatttacatgtcgcgtggcagggaaccctaagcctaaaatctattggttcaaagatggcaagcagatttcaccaaaatccgaccactatacgattcagcgcgatctagacggcacttgcagcctacatacaaccgcgtccaccctggacgacgatggcaattacaccatcatggccgctaatccccagggaaggataagttgcacaggccgtctgatggtgcaggctgtgaaccaaaggggcaggagccccaggtcaccgagcgggcaccctcacgtgaggagaccaaggtcccgatcccgagactcgggcgacgaaaatgaacctatccaggaacgctttttcagaccgcacttcctccaggccccgggcgatctgactgttcaggagggaaagctgtgccgcatggactgtaaagttagcggcctacctactcctgatctctcgtggcagctggatggtaaacccgtgcgacctgattctgctcacaaaatgcttgtcagagaaaatggcgtccactccctcatcattgaacctgtgactagcagggacgctgggatatatacatgtattgctaccaaccgcgctggccaaaactccttttcgttggaacttgtagtggccgccaaggaggcccacaaaccacccgtcttcatagaaaagcttcagaataccggggtggccgatggatatccggtacgcttggaatgtagagtgctgggcgtgcctccccctcagattttctggaaaaaagaaaacgagtctttgacacacagtacagacagagtatctatgcaccaggacaaccatgggtacatttgcctgctaatccagggtgctaccaaagaagacgccggatggtatacggtttccgccaagaatgaagcaggcattgtgtcctgtaccgctagactggacgtctacattagccgacactag

SEQ ID NO: 198525 - DNA, 2019 bp, Artificial Sequence
  Description of Artificial Sequence: Synthetic coding sequence
atgagcgccctggccagccggagcgcccccgccatgcagagcagcgggagcttcaactacgcccggcccaaacagtttattgccgcacaaaacctaggacctgccagcggccatggcacccccgcttcctctccctctagcagtagcctgcccagtcccatgagcccaaccccacgccagttcggacgggcccccgtacccccttttgctcagcctttcggagctgagcctgaagcgccctggggaagcagttctccctccccaccgccgcccccgcctccagtcttttcgcctactgcagcgttccctgtgccagacgtgttccccctgcccccacctccacccccactccctagcccaggacaggcatcccactgtagttctccagctacccgttttggtcattctcagaccccagctgcattcctgagcgctctcctgccctcgcagccacctccagctgccgtgaatgcgctggggctcccgaaaggtgtgacaccggcagggttcccaaagaaagcaagccgcacggcccgcatcgcatctgatgaggagatccaaggcaccaaagatgctgtgattcaggatctggagcggaaactgcggtttaaggaagatctcctcaataatggacagccaaggttaacgtacgaagaaagaatggctcgtagactgctcggggctgacagtgcaacagtgtttaacattcaggaaccagaggaggagactgccaaccaggaatacaaagtttcttcctgtgagcagcgtcttattagcgagatcgagtatcgcttggagcgaagcccggtggacgaatcaggggacgaggtgcaatatggtgacgtgcctgtagaaaacggcatggccccctttttcgaaatgaaactcaaacattacaaaatcttcgaggggatgcccgtcaccttcacctgtagggtcgcgggtaatcccaaaccaaagatttactggttcaaggatggcaagcaaatttctcccaagagcgaccactacacaatacaaagagatctggatggcacctgttcactccacactaccgcctcaactcttgatgacgacggcaactacaccatcatggctgcgaacccacagggccggatttcatgtacaggcaggctcatggtgcaggccgtaaatcagcgtggccgctctcccaggagtccaagcgggcatccccacgtccgccggcccagatcccgctcaagggatagcggcgatgaaaatgaaccaatacaggaaagattcttccgacctcattttctccaggcccccggtgatcttacagtgcaagaggggaaactgtgcaggatggactgcaaagtttccggcttaccaacccctgatcttagttggcagctcgacggaaagccagtgagacctgattcagcccacaagatgctcgtccgcgaaaacggcgtccacagtctcataatcgaacctgttacttccagggacgctggcatttatacttgcattgcgaccaacagagcggggcagaacagtttctcactggagttagtcgtggcggcaaaagaagcacacaagcctcccgtgtttatcgaaaagctgcagaacacaggggtggctgatgggtatcctgtaaggcttgagtgccgagtgttgggggtgccccccccccagatcttttggaaaaaggagaatgagtctctcacacatagtaccgatcgggtttctatgcatcaggataaccacggatacatctgtctgctcattcagggcgcaactaaggaagacgctgggtggtacaccgtgtcagctaagaatgaggccggcatcgtcagctgcactgctaggcttgatgtatatacccaatggcatcaacagagccagagcacaaagccaaagaaagttcgcccaagtgcctctcggtacgccgccctcagtgatcaagggctggatattaaggccgccttccagcccgaggcgaatccctcgcaccttaccctgaacaccgccctcgtcgagtcagaagatttatag

SEQ ID NO: 198526 - DNA, 2334 bp, Artificial Sequence
  Description of Artificial Sequence: Synthetic coding sequence
atgccccaggcccagaagaagaccaccagcgtgagcctgaccatcggttcgtcatccccaaagactggagttaccacagcagtcatccagcccctcagcgttcctgtccagcaggtgcacagtcctacatcttatctctgtaggccagacggtactacaaccgcttatttccctccagtgttcaccaaggagcttcagaacaccgctgtggcagagggacaggttgtggtcttggagtgtagagtgcgcggcgcccctcctctccaagtacaatggttccggcagggatcagaaattcaggactctccagactttcgcattctacagaagaagcctaggtcgactgcggagcctgaggaaatctgcacattggtcattgccgagacgttccctgaggacgccgggatcttcacttgctcggcgagaaatgattacgggtcagcaacctccaccgctcagctggtggtaaccagcgccaacactgaaaattgttcttacgagtcaatgggagagtctaacaatgaccatttccagcactttcctccacctcccccaattctagagacaagcagtcttgagcttgcctccaagaagccatccgaaatccagcaagttaacaaccccgagctgggtctcagcagagccgctctgcagatgcagtttaatgccgccgaacgagaaacaaacggagtgcatccaagcagaggggtgaatggcctgataaatgggaaagcgaacagtaataaatcattacctacacccgccgttctcctcagtcctaccaaagaacctcctccccttctggccaagcccaagttgggcttccctaagaaagcctcccgaaccgcaagaattgcctctgatgaagaaatccagggcaccaaagatgccgtcatccaggacctagagagaaaactgcgctttaaagaagacttgctcaacaacggtcaaccacggctgacttacgaggaacgcatggctcgcaggctgctgggtgccgattcagcaactgtgtttaatatccaggagccagaggaggaaaccgccaaccaggaatataaggtgtccagttgcgaacaacgccttatcagcgaaattgaataccgccttgaacggtcacctgtggatgaaagtggggacgaagtacaatatggagatgtccccgttgagaatggcatggctccattctttgaaatgaagctgaagcattacaaaatttttgaggggatgcctgtaacttttacatgccgggtggccggaaacccaaagccaaagatttattggtttaaagatggcaagcagatcagccctaaaagcgaccattataccatccagcgcgatcttgatggtacatgctcactacatacaacggcctccaccctagatgacgatgggaactatactatcatggccgctaatccccagggaaggatttcttgtaccggacgccttatggtgcaggccgtgaatcagcgcggaagaagcccgcgatccccatctggccacccacacgtgaggcgaccgagatcccggtcccgcgattctggcgatgagaatgaaccgattcaggagaggttctttcgtccccacttcctgcaggcccctggcgatctgactgtccaagagggaaaattgtgtaggatggactgtaaggtgtcaggcctcccaacacctgatctcagttggcagcttgatgggaaaccagttcgacctgactcagcacacaaaatgctcgtccgtgagaatggagtgcactctctcatcatcgagccggtgacctcccgcgacgccgggatctatacatgcattgccaccaatcgcgcaggacaaaattcgttcagtctcgagcttgtggtcgcagctaaagaagcccacaaaccccctgtgttcatcgaaaagctgcagaataccggtgttgctgacggataccctgttagactggagtgtcgggtgctaggggttccacctccccagatcttttggaaaaaagagaatgagtctctcacgcacagcaccgatcgcgtgtctatgcaccaagataaccatggctatatttgcctactgattcaaggggctactaaagaggatgccgggtggtacacagtgtctgccaaaaacgaggccggaatcgtcagctgcacagcccgcctagatgtgtacacccagtggcatcagcaatctcagtcaacaaagccgaagaaggtgaggccatctgcatcacggtacgcagctcttagcgaccagggacttgacatcaaagccgcctttcagccggaggcgaacccaagtcatctgactcttaatacagcattagttgagagtgaagatctgtag

SEQ ID NO: 198527 - DNA, 3321 bp, Artificial Sequence
  Description of Artificial Sequence: Synthetic coding sequence
atgagcggcaccagcagccacgagagcttctacgacagcctgagcgacatgcaggaagaatccaaaaatactgacttttttccgggattaagcgcctttctgtctcaagaagaaatcaataaatccttggacctggccagacgggcgatcgctgactccgagacagaagacttcgactcagagaaagaaatctcccagattttctcaacgtccccagcaagtctgtgcgaacatccaagccataaggaaaccaaattaggtgaacatgctagtcgccggccacaggacaatagatccactcccgtgcagccacttgccgagaagcaaacaaaaagcatctctagcccagtaagcaagcggaaacccgcaatgtctccactacttacgaggccctcatacatcagatccctgcggaaggccgaaaagcgaggggccaaaacccccagtacaaacgttaaacccaaaaccccacaccagaggaagggcggaccccagagtcaactgtgcgacaaggcagcaaatctgattgaggaattgactagtatctttaaagctgctaaaccacgaaatcgatcccctaatggagagagttctagtcctgactcaggctacttgtcccccaaaaaccagcctagcgccctcctgtccgcctctgcaagtcaatcccccatggaagatcagggcgaaatggagcgcgaggttaagtctcccggggctcgccattgctatcaagataatcaagacctggctgtgccccacaatcggaaaagccatccccagccccatagcgctcttcacttccctgcagctccgcgctttatacagaagctgcgcagtcaggaggttgccgaaggatcccgtgtgtacctggagtgccgtgtgactggaaatccaacaccccgagttcgctggttctgtgagggcaaggaattgcataacacccccgacattcagattcactgtgaggggggagacctgcataccctcatcattgccgaggcttttgaggacgacaccggacgctacacttgcctcgcaaccaacccctctgggtccgataccacatcggcagaggtatttatagagggggcttcttccacagacagtgactccgagtccctcgcatttaagagtagggcaggggctatgccccaagcacaaaagaagacgacaagtgtgtctctgacaatcgggtccagttctcctaagactggtgtgacaacagcagtcatccagcctctgtcggttccggtgcaacaggtgcatagccccacatcatatctgtgtaggccagacggcaccacgaccgcctattttccacccgtatttactaaagagctccagaataccgccgtggccgaaggacaggtagttgtgctcgagtgcagggtgaggggagccccacccctgcaggtacagtggttccggcagggctcggagattcaagactcacctgactttcgcatcctgcagaaaaagccacgaagcactgctgagcccgaggaaatctgcactctagtaattgccgagacttttcccgaagacgcaggaatcttcacttgttccgcccggaatgattatggtagcgcaacaagcaccgcccaactggtggtaacatccgctaacactgaaaactgcagctacgagtctatgggagagtcaaacaatgaccacttccagcatttcccacctcccccccccatcctggagacttcctctctggagcttgcgtctaaaaagccgtctgagatccagcaggtgaacaaccccgagttaggactgtcccgagctgctctgcagatgcagttcaacgcggcggagcgtgagaccaacggagtgcacccttcgcgcggtgtgaacggcctgattaatggcaaagcgaattccaataagtcgcttcccacccctgccgtcctactcagtcctacaaaagaacctcctcccttactggccaagccaaaactcggctttccaaaaaaggccagccggactgctagaattgcgtccgatgaagagatccagggcacaaaggacgcagtgatacaggatctggagcggaagctcagatttaaagaggacctgctgaataacggtcagccacgtctgacttacgaagaacgtatggcacggaggttactcggggctgattccgcaaccgtgtttaacatccaagagcccgaggaagaaaccgccaaccaggaatataaagtctcttcgtgtgaacagcggctgatcagcgaaatcgagtaccgcctagaacgctctcccgtcgatgaatcaggagatgaggttcagtacggggatgtcccggtggagaacggtatggctccgttctttgagatgaaattaaagcactataagatatttgaaggcatgccggtaacattcacctgcagagtggcaggcaaccctaaacctaaaatttattggttcaaggacggaaaacagatctcacctaagtctgatcattacacaattcagcgagatctggacggtacctgttccctgcatactaccgcctcaacgctggacgatgacgggaactacaccatcatggcagctaatccgcagggtagaatctcttgtaccggaagattgatggtgcaggcggtcaatcaaagaggacggagccctcggtcaccctcggggcacccccacgtgcggaggccacgtagtcggtctagagactcaggggacgagaacgaacctattcaggaacggttcttccggccgcacttcctacaggctcctggtgatttgaccgtgcaggagggcaagctgtgcagaatggactgtaaagtttccggcctcccaacccccgacctgtcgtggcagcttgatggaaagcctgtccgaccagactccgcccacaaaatgctagtccgggaaaatggcgtgcactcgctcatcatcgagcctgtgactagtcgtgatgcaggtatctatacctgcatcgccactaaccgcgccggccaaaattccttctccctcgagctcgtggtagcagccaaagaagctcacaaacctcctgtattcattgaaaagcttcagaatacgggcgttgctgatggctaccctgtgcgcttggaatgtagggtgctgggagtccctcctcctcagattttttggaagaaggaaaacgaatccctgactcattcgacggatagagtctctatgcaccaggacaatcatggatacatttgtctgctaatccagggcgcgactaaggaagatgcaggttggtacacggtgtcggccaagaacgaggctggcatcgtttcctgcacggctcgcctggacgtctatattagtagacattag

SEQ ID NO: 198528 - DNA, 1233 bp, Artificial Sequence
  Description of Artificial Sequence: Synthetic coding sequence
atgagccccctgctgacccggcccagctacatccggagcctgcggaaggcagaaaaaagaggagccaagaccccttccactaatgttaagccaaaaactcctcaccagcgaaaaggtgggccacaatctcagctgtgcgataaagccgcaaacttgatagaagaacttaccagcatttttaaagcagccaagcctcgcaataggtcccccaatggcgaatcatcatctcccgattctggctatctttccccaaaaaaccaaccatccgctctgctgtccgcctcagcctctcaatccccaatggaagaccagggggaaatggagagagaagtgaagagtccaggtgctagacactgctaccaggacaaccaggacctcgcagttcctcataatagaaagagccacccacagccccactccgcactgcattttcccgccgcaccgagattcatacagaaactccgctctcaagaggtggctgaaggaagccgggtctaccttgaatgcagggtcaccggaaacccgacccctagagtccgctggttttgtgaaggaaaggaactacataacacacctgacattcagatacattgtgagggaggtgacctgcacacactgatcattgccgaagctttcgaggacgacaccgggcggtacacctgtctcgccaccaatccatctggctccgacaccacttctgctgaggttttcatcgagggcgcctcatcgactgacagcgactcagagagcctggcatttaaaagcagggctggagctatgcctcaggcccagaagaagactacgagcgtctcattgacaatcggctccagctcacccaagacgggcgtgaccacagccgtgattcagcctctttcagtgcccgtgcaacaggtgcactcacccaccagctacctgtgccgtccagatgggactacaaccgcctattttccacctgtgttcacaaaagagcttcagaataccgcagtagccgagggccaggttgtggttctcgagtgtcgggttcgaggcgcccccccactgcaggtccagtggtttcgtcagggttctgagatccaggactctccggactttaggattctgcagaagaaacctcgatccacggccgaaccagacgttctgtacgtattcgtccgcgtgcggtgtcaccagatgaaaattcagtactacaatctggcacacctgatatcgtcttggctgtcatctttcctatag

SEQ ID NO: 198529 - DNA, 3006 bp, Artificial Sequence
  Description of Artificial Sequence: Synthetic coding sequence
atgccccaggcccagaagaagaccaccagcgtgagcctgaccatcggttcatctagtccaaaaaccggcgtgacaaccgcagtgattcaaccacttagcgtgcctgttcagcaggttcattcccctaccagctacctctgccgtccagacgggacgactacagcctattttccacctgtctttaccaaagaattgcagaatacagctgtcgctgaaggacaagtcgtcgtcttggagtgccgggtgcgaggggcccctcctctgcaggtgcagtggtttcggcaaggctctgagatccaggattcccctgatttccgcatcctgcagaagaagcccaggtccactgcagagcccgaggagatttgcacccttgttatcgctgagacctttcctgaggatgcaggcatttttacttgttcagccaggaatgactatggcagtgcgaccagcaccgcccagttagtagtgacctccgctaatactgaaaattgtagttacgaatctatgggggagtctaacaacgaccatttccagcacttcccccccccgcctcctattctggagacctcctcgctggagctggcctctaagaagccttccgagattcagcaggtcaacaaccctgaactggggctgtccagggctgcccttcagatgcagttcaacgccgcagagcgagaaaccaatggggtccacccaagtcgtggagtaaatggacttatcaacggaaaagcaaactctaataagtccctgccaacacccgctgtcctactgtcccccaccaaggagcctcctcctctgctggcaaagcctaagcttgacccgctaaagttacagcaactccagaaccagatccggctggaacaagaagctggggcaagacagccccctccagcacctcgctccgccccgcctagccctccttttccaccccctcccgcctttcccgagttggctgcctgtacgccaccagcgtctccagagccaatgagcgcgttggccagccgtagtgcccccgccatgcaaagctctggtagttttaattatgccagaccgaaacagtttatcgcagctcaaaatctcggccctgccagcggccatgggacgcctgcaagtagccctagtagctccagcctgcccagtccaatgtctcccacgcctcgccagttcggcagagctcctgttcctccctttgcacagccatttggcgccgaacctgaagccccgtggggatcttctagtcccagccctccaccaccacctcctccagtcttttcccctaccgcagcatttcccgtgccggatgtatttccgctgccccccccaccacctcctctgcctagtcctggtcaggcatcacattgttcatctcccgccaccaggtttggccactcgcagactccagcggcatttctcagcgctctgttacctagccagccgcctccggctgcggtcaatgcactggggttgcccaagggtgtgacaccagctgggttcccgaagaaagcatctcgtaccgcgagaatcgcttctgatgaggaaattcagggaaccaaggacgctgtcattcaagatctagagcggaagttgaggtttaaagaagacctgctaaacaacggccagcccaggctgacatatgaggagcgcatggcacggaggctgttgggggcagactctgctactgtgttcaacatccaggagcccgaggaggagaccgccaaccaggagtataaagtctcaagctgcgagcaacggctgatcagcgagatagagtatcgactggaacgctcacctgttgacgaaagtggggatgaagtgcaatacggggatgttcccgtggagaacgggatggccccatttttcgaaatgaagctgaaacactataagatcttcgaaggtatgccagtgactttcacttgtcgcgtcgcaggaaaccccaagccaaagatttactggtttaaggacggcaagcaaatctcgccgaaatcagaccattacaccatccagcgagacctagatggtacttgttctctgcacaccactgcctccacattagacgatgacggcaattacaccatcatggccgctaacccacagggcaggatcagttgtaccggcaggctgatggtgcaggctgtcaatcagcggggaaggtctcccagatcaccaagcggtcatcctcacgtccgacggcccaggtcaaggagccgagattcaggagacgagaatgaacccatccaggagcgtttttttagaccccacttcctgcaggccccaggcgaccttactgtccaagaaggcaagctgtgcaggatggactgcaaggtctctggcctcccaaccccagacctgtcctggcagctggatggcaagccagtgagaccagactcggcgcacaagatgctagtccgagaaaacggtgtacattcccttataatagagcccgtcacaagccgcgatgccggcatttatacctgtatcgcaaccaatagggccggacaaaactcctttagcttagagctggtcgtcgcagcaaaagaagctcacaaacctcctgtcttcattgagaaactgcagaacacaggagtggccgatggatatccagtgagattagaatgccgggtgttaggggtcccacccccccaaatcttttggaagaaggaaaacgaatccttgacacacagcacggatcgcgtgagcatgcaccaggacaaccatggttacatttgcctcctgattcagggcgctactaaggaggatgccgggtggtacaccgtaagcgccaaaaacgaggcaggaatcgtgtcctgtacagccagattggatgtatacacccagtggcatcagcagtcacagagcacaaagcccaaaaaggtacgcccctccgcaagtagatatgctgcccttagtgaccagggattagacattaaggctgcttttcagccggaggccaaccccagccacctcaccctgaatacggcccttgtggaaagcgaggacctgtag

SEQ ID NO: 198530 - DNA, 483 bp, Artificial Sequence
  Description of Artificial Sequence: Synthetic coding sequence
tgaggcaagcccgtgcggcccgacagcgcccacaagatgctggtgcgggaaaacggggtgcactcgctgatcattgaacccgtgacatcacgtgatgccggcatttatacttgtatcgccacgaatcgcgccggccaaaatagcttctccctggaactggtcgtcgcggcgaaggaggcacataagccacccgttttcatcgaaaagctgcagaacacaggagtggcggacgggtatcccgtacggcttgagtgccgggtactgggtgtgcccccaccccagatcttctggaagaaggaaaacgaatctctcactcacagcaccgatagagtgtcaatgcaccaggacaaccatggatatatctgtcttctgatccagggcgcaactaaggaggacgcaggatggtatacagtgtcagccaagaacgaggcgggaatagtgagctgcactgcacgtctggacgtgtacattagcaggcattag

SEQ ID NO: 198531 - DNA, 1539 bp, Artificial Sequence
  Description of Artificial Sequence: Synthetic coding sequence
aagaacaccgacttcttccccggcctgagcgccttcctgagccaggaagagattaacaaaagcctggacctggcaagacgggctatcgctgactccgaaaccgaagactttgattccgaaaaggagatatcccagatattctctacatcacctgccagcctttgcgaacatccgtcccacaaggaaactaaactgggcgaacacgcgtcaagacggccccaagataacaggtcaaccccagttcagcctcttgccgagaagcagaccaagagtatctcgtctccagtgagcaaaagaaagcctgccatgagtccactgctgactcgccctagctatatccgctccctccgaaaggccgagaaaaggggcgctaagactccctcaactaatgtcaagccaaagacaccccatcaacgaaagggagggcctcagtcacaactgtgtgataaggcagctaatctcatcgaggagctgaccagtattttcaaggcggctaagcctcgaaaccgcagtccgaacggcgaatccagcagccctgactcaggttatctgtcaccaaagaaccagcctagcgccctgctgtcagcttcagccagtcagagccctatggaggaccaaggggagatggaacgtgaagtgaagagccccggggcccggcactgctatcaggataaccaggacttggccgtgccacataacaggaagtcccatcctcagcctcactctgccctgcactttccagccgcccctcggttcattcagaagctccggtcccaggaagttgccgagggctctcgcgtctatctggaatgccgcgtcacaggaaaccccaccccacgggtgcgttggttttgcgagggaaaagagctgcacaacacccccgacatccaaattcactgcgagggcggtgacttacacacgctgatcatagccgaagcattcgaagatgataccggacgttatacatgcctcgcgactaatccctctgggtcggacactactagcgcagaggtatttatcgaaggggcgtccagcacggatagcgatagcgagtccttggctttcaagtcccgcgctggagcaatgccacaggcccagaagaagaccaccagtgtttctttgacaatagggagttctagtcccaaaacaggagtgacaacggcggtgatccaacccctgagcgtccccgtgcagcaggtgcactctccaacttcttatttgtgtcgccctgatggcacgacaaccgcatacttccctccagtgtttactaaagagctgcagaatacagccgtagctgaaggacaggttgtcgtgttagagtgtcgggtccggggcgccccgccattgcaagtacagtggtttcgccaagggtctgaaatccaggactccccggacttccgaattctgcagaagaagccccgcagtaccgcagagcctgacgttttatacgtcttcgttagagtcaggtgtcaccagatgaagatacaatattataacctggctcatttgatttcctcatggctatcctcttttctctag

SEQ ID NO: 198532 - DNA, 87 bp, Artificial Sequence
  Description of Artificial Sequence: Synthetic coding sequence
atgagcggcaccagcagccacgagagcttctacgacagcctgagcgacatgcaggaggagtctaagaatacggatttctttccctag

SEQ ID NO: 198533 - DNA, 690 bp, Artificial Sequence
  Description of Artificial Sequence: Synthetic coding sequence
atggccgcccagcccctgcggcaccggagccggtgcgccacccccccaaggggagacttctgcggcggcaccgaaagagccatcgaccaggcgtcattcactaccagcatggaatgggacacccaagttgtcaagggcagctcccccctgggccctgcgggacttggagctgaggagccagctgcaggaccccaattaccgtcctggctccagccagaaagatgtgccgtgttccaatgcgctcaatgtcatgccgtgttagctgacagtgtgcatttggcctgggatctgtcccggagcctcggagctgtcgtatttagccgcgtgaccaacaatgtggtgcttgaggcccctttcctagtagggattgagggtagtctaaaagggtctacttataatctgctattttgtggttcatgtggcatcccagtgggattccatctttacagcacacacgcagccctcgccgccctcagagggcacttttgtctctcatctgacaaaatggtatgttatctattaaaaaccaaagccatagtaaacgccagcgagatggacattcagaatgtccccctgtccgagaagattgcagagttgaaagaaaagatcgtcctgactcacaatcgcctgaagtcacttatgaagatcttatcagaggtgacgcccgatcagagcaaacctgaaaattag

SEQ ID NO: 198534 - DNA, 816 bp, Artificial Sequence
  Description of Artificial Sequence: Synthetic coding sequence
atggccagccccggctgcctgtggctgctggccgtggccctgctgccctggacgtgtgcgtcaagagccttacagcatctggatcctcccgctcctctgccactggttatatggcacggaatgggcagtcgctacgttgcccagactggtctggagttgctcgcctcctctaaccccccagctagctcttaccagagcgctggtatgattggcgatagttgctgcaaccctctgagtatgggcgctatcaaaaaaatggtggaaaagaaaatccccggaatttatgtgctttccctggagatcggaaaaaccctgatggaagatgttgaaaactcattctttttgaacgtgaactcacaggttactactgtttgccaggccctcgccaaagatccaaagttgcagcagggttacaatgcaatgggttttagccaggggggacagtttcttagggctgttgcgcaacgctgccccagcccgcctatgattaatctcatcagcgtcgggggacagcaccagggcgtgttcgggctaccaaggtgtcctggggagtcatcccacatttgcgatttcatccggaagactcttaatgctggagcatattccaaggtggtccaggagcgcctggtgcaggccgagtactggcacgaccctattaaagaagatgtataccgcaaccactccattttcctcgctgacataaaccaagaacgcgggattaacgagagctataaaaagaatctcatggcccttaaaaagttcgtaatggtgaagttccttaacgactcaatcgtcgacccagtagactcagagtag

SEQ ID NO: 198535 - DNA, 921 bp, Artificial Sequence
  Description of Artificial Sequence: Synthetic coding sequence
atggccagccccggctgcctgtggctgctggccgtggccctgctgccgtggacatgcgcatcacgcgctctacaacacctcgatccaccggcccctctgccgctggtgatctggcatggtatgggcgattcatgttgtaacccactgagtatgggggctatcaaaaagatggtcgaaaagaagatccccggaatatacgtattgagcttggagattggtaagactctgatggaagacgtcgagaacagtttctttttgaacgttaattcccaggtgactaccgtctgtcaggcgctggctaaggatcctaaactccaacaggggtacaatgcaatgggattcagccagggaggccaatttctgagggcggtagctcagcggtgcccatcacctcccatgattaatctgattagtgttggcgggcagcaccagggagtgtttgggttaccccggtgcccaggcgagtcatcacacatctgtgatttcattcggaagactttaaacgccggcgcatactctaaggtggtgcaggagaggttagtgcaggccgagtattggcatgaccctataaaagaagacgtttacagaaatcatagcatctttctggctgacattaatcaggagaggggcatcaacgagtcctacaagaagaacctgatggccctgaagaagtttgtcatggtcaagtttctgaacgacagtattgtggatcccgtcgacagcgagtggtttgggttttatcggtctgggcaggccaaagagactatcccacttcaggagacttctctgtatacgcaggaccgactagggttaaaagagatggataatgccggacagcttgtctttcttgccacggaaggagaccacctgcagctgtcagaagaatggttttacgctcatattatccctttcttgggctag

SEQ ID NO: 198536 - DNA, 612 bp, Artificial Sequence
  Description of Artificial Sequence: Synthetic coding sequence
atggccagccccggctgcctgtggctgctggccgtggccctgctgccctggacctgcgcctcaagagccctccaacatctcgatcctcctgccccactacctctcgtgatctggcacggcatgggggttttcggcctgcctagatgcccgggcgagtcctcgcatatctgtgattttatcaggaaaaccctgaatgccggcgcgtattcaaaggtcgtgcaggagcgactggtacaggcagagtactggcatgaccccattaaggaggacgtgtatcggaaccactctatctttctcgcagacatcaaccaggagagaggcatcaatgaaagttataagaagaacctgatggcactcaagaagttcgttatggtgaagttcttaaatgactccattgtggatccggttgacagtgaatggtttggattctaccggagcgggcaggccaaagaaacaatccctctgcaggagacttctctgtacacacaagatagactgggcctcaaagagatggacaatgccgggcaactggtgttcctggctacagagggagatcatttacagctctcagaagagtggttctacgcccatatcatccccttcctggggtag

SEQ ID NO: 198537 - DNA, 921 bp, Artificial Sequence
  Description of Artificial Sequence: Synthetic coding sequence
atggccagccccggctgcctgtggctgctggccgtggccctgctgccatggacctgtgctagcagagctctccaacatctcgacccacctgcacccctgcctctggtaatctggcacggcatgggggacagctgctgcaacccgctgtcaatgggagcgatcaaaaaaatggtggagaaaaaaattcccggaatatatgtactgtcgctggagattggaaagaccctgatggaagacgtagaaaactccttcttcctgaacgtgaattctcaggtgactacagtttgccaggccctcgctaaagatccgaaactgcagcaggggtataacgccatgggtttctctcaaggcggccagttcttgagggccgtggcacagcgatgtccctccccacccatgatcaacctgatctccgtgggcggacagcatcagggcgtgtttggtctgccgaggtgccctggggagtctagccacatctgcgactttatcaggaagactttgaacgctggagcttatagcaaggtggttcaggagaggctggtgcaggccgagtattggcacgaccctattaaagaagacgtttacaggaaccatagcatttttttggccgatatcaatcaggaaagaggcatcaacgagagctataagaaaaatttaatggctctgaagaaattcgttatggtcaagttcttgaacgattcaatagtcgatcctgtggatagtgaatggttcggcttttatcggtctggtcaggccaaagagacaatcccattacaggagacatcgttatatactcaggatcggctgggcttgaaggagatggacaacgcaggccagttggtgttcctggcaaccgaaggcgaccaccttcagctatcggaagaatggttttatgctcacatcatccccttcctggggtag

SEQ ID NO: 198538 - DNA, 909 bp, Artificial Sequence
  Description of Artificial Sequence: Synthetic coding sequence
atgctgggcctgtgcggccagcggctgcccgccgcctgggtgctgctactgctaccattcctgccactgctgctgctcgccgcccccgccccgcacagagctagttataagcccgtgattgtagttcatggtctgtttgactcaagctactcctttcggcacctcttagagtatatcaatgagacacatcctggcacagtggtgactgtcctcgacctgttcgacggtcgggaaagtctcagacccctctgggaacaagtacagggcttcagagaagccgtcgtccccattatggctaaggccccacagggggtgcatctaatttgctatagccagggaggacttgtctgccgggccctgctgtccgtgatggatgatcataacgtggactcttttattagcctctcctcaccacagatgggccaatatggggatacggactatctcaaatggttgtttcctacgtccatgcgttccaacttatatcgcatatgctatagcccttggggtcaggagttctcgatctgtaactactggcacgatccacaccacgacgatctctatttgaatgcaagctccttcttggcccttatcaacggcgagagagaccaccccaatgctactgtctggaggaaaaattttctgcgggtgggccacctggtactcattgggggaccagacgatggggtgataaccccttggcaatcttcctttttcggattctacgatgctaatgaaactgtcctcgagatggaggaacaactggtttatctgcgcgattcgttcggcttaaaaacgctgctggcccggggtgccatcgtgcggtgcccgatggctggcatctcccacactgcctggcatagtaaccgcactctttacgaaacttgtatagagccctggctctcttag

SEQ ID NO: 198539 - DNA, 927 bp, Artificial Sequence
  Description of Artificial Sequence: Synthetic coding sequence
atgaagagctgcggcagcatgctgggcctgtgcggccagcggctgcctgctgcgtgggtgctcctgctgctgccatttcttccactgctgctccttgctgcccctgctccccacagggccagttacaagcctgtaattgtagtgcatggactatttgacagttcttacagctttagacacctgctcgagtacattaacgagacacacccggggaccgtagtcacggtcctggacctgttcgatggccgagagagtctcagaccactgtgggagcaggtccaaggtttccgggaagccgtagtccctatcatggcaaaagcaccacagggagtgcacctgatctgctatagccagggcggtctggtctgccgcgccctcctcagcgtaatggatgaccataatgttgactcttttatctccctctccagccctcagatgggccaatatggggacacggactatcttaagtggctgtttcccacaagcatgcgcagtaacttataccgcatttgctacagtccgtggggtcaggaattttctatctgtaattactggcacgatccacatcacgacgacctgtacctcaatgctagctcctttctcgcactgatcaacggcgaacgagaccacccgaatgctactgtttggagaaagaattttctgagagtaggacatttggttcttataggggggcctgatgacggggtgatcacgccttggcagtcctctttcttcggattttacgatgccaacgaaactgtgcttgaaatggaagagcaacttgtgtacctgcgagactcttttgggctgaagacgctgttagcaaggggtgcgattgtcaggtgcccaatggccgggatctctcacacagcttggcattctaacagaaccctgtacgaaacatgcatagaaccatggctgtcttag

SEQ ID NO: 198540 - DNA, 909 bp, Artificial Sequence
  Description of Artificial Sequence: Synthetic coding sequence
atgctgggcctgtgcggccagcggctgcccgccgcctgggtgctgctcctcttgcccttcctgcctctgctcttactggctgcccccgctccgcatagagcctcctacaagcccgtaattgtagtacacggcctgttcgacagctcttattcctttagacacctgctggaatacataaatgagactcaccccggtaccgtggtcactgtgcttgacttatttgacgggagagagtcactgcgccccttatgggagcaagtgcagggatttcgcgaggccgtggtgcccatcatggctaaggctcctcagggggtgcatttaatctgttattctcagggcgggctagtctgcagggcacttctttcggtgatggatgatcacaatgtcgattctttcattagtttatcttcaccacagatgggacagtatggtgacactgattatctgaagtggctcttccccacgtccatgaggtccaacctgtacaggatttgctacagtccctggggccaggagttcagtatctgcaattattggcatgatccacatcacgatgatttatatctgaacgccagctcgttcctcgcactaattaacggagagagagaccaccctaatgcgacagtctggcgcaagaatttcctgagagttggccacctggtcctgattggcggaccggacgacggcgtaatcaccccatggcagtcttcgttttttggcttctacgatgcaaatgaaaccgtgctagaaatggaggagcagttggtctacctcagagactcgtttggattgaaaaccctcctggcacgtggagccatcgtcagatgtccgatggctggcattagccataccgcctggcacagtaatcgaactttgtacgagacttgcatcgagccatggttgtcatag

SEQ ID NO: 198541 - DNA, 909 bp, Artificial Sequence
  Description of Artificial Sequence: Synthetic coding sequence
atgctgggcctgtgcggccagcggctgcccgccgcctgggtgctgttactcctgccctttctaccattgctcctgttggctgctcctgctccccaccgggcatcgtataaacccgtcatcgtggtccatggactattcgacagtagttatagctttcgccaccttctagaatatattaatgagacacacccagggaccgtcgttactgtgctggatctcttcgacggtagggaaagcctgcggcccctttgggagcaggtgcagggctttagagaagccgtcgtccctattatggccaaagccccgcagggtgttcacctcatttgttattcccagggtggcctcgtgtgccgagcccttctcagcgttatggatgaccacaatgtcgactcctttattagtctatcctcccctcagatgggacagtacggagacacagactacctcaagtggctgtttcctacatcaatgcgttcaaatctgtatcggatctgctatagcccatggggccaggaattctccatctgtaattactggcacgatcctcaccatgatgacctttatctgaacgcgtcatccttccttgctctgatcaatggagaacgggatcaccccaacgccacggtgtggcgaaagaactttcttagggtaggtcatctggtccttatcggtggacccgacgacggggtgatcacaccctggcagtcatcattttttggcttttatgacgcaaatgagactgtacttgaaatggaagaacaactggtgtacctcagagattcctttggcctaaaaaccctgctggcgaggggtgccattgtgcgctgtcctatggccggaatctcacacaccgcatggcactcaaacagaacactttacgagacctgtattgagccttggctttcgtag

SEQ ID NO: 198542 - DNA, 927 bp, Artificial Sequence
  Description of Artificial Sequence: Synthetic coding sequence
atgaagagctgcggcagcatgctgggcctgtggggccagcggctgcccgcagcgtgggtcctactcctgctaccattcctgccattgttactgttggctgccccagcccctcacagggagtcatataagccagtgattgtggtgcacggattatttgattcatcttattctttcaggcatcttctcgagtacatcaacgaaactcatcctggcacagttgtgaccgtgctggatctgttcgacgggcgagaatctctgcggccattgtgggaacaggtgcagggtttccgggaggccgtggttccaattatggcaaaggctccccagggagtccatctgatttgttactcacaagggggactggtgtgtagagcactcctctctgttatggacgaccataatgtcgacagctttatcagtctatcttccccacagatgggccagtacggcgataccgattatcttaagtggctattcccaactagtatgcgaagcaatctctatagaatttgctactctccatggggacaggaattctctatctgcaactattggcatgacccacaccacgacgatctgtacctgaacgcgagctcctttctggccctcatcaacggagagagggatcatccaaacgctacagtctggaggaagaatttcctgagagtgggtcatctagtgttgatcggaggccccgacgatggcgtgataacaccctggcaaagtagtttcttcgggttttacgacgcgaatgaaaccgtgctggaaatggaggagcaactcgtctacctgagagactcatttggcctgaagactttgttagctagaggggccattgtcaggtgcccaatggcagggataagtcatacggcatggcactccaatagaactctctatgagacatgtattgaaccctggctgtcttag

SEQ ID NO: 198543 - DNA, 927 bp, Artificial Sequence
  Description of Artificial Sequence: Synthetic coding sequence
atgaagagctgcggcagcatgctgggcctgtggggccagcggctgcccgctgcttgggtccttctcctgctaccgtttctgccgctcttgctgctggcagcgcccgctcctcatcgagcaagctacaaacccgttattgttgttcatggtctatttgattcttcctattcgtttcgccatctgttagagtatatcaacgaaacacacccgggcacagtggtcactgtcctcgatctcttcgacggtagggagtccctccggcccctgtgggaacaggtgcaggggttcagggaggccgtcgtacccatcatggcgaaagcaccacagggagttcatttgatatgctattcccaaggtggtctggtttgccgcgctctgctgtctgtcatggacgaccacaatgttgactctttcatctcccttagtagcccccagatggggcagtatggcgatacagactatctcaagtggctctttcccacctcaatgaggagtaacctgtatcgaatctgctattccccatggggccaagaattttcaatatgcaactactggcacgatccacaccatgacgacctgtatttaaatgcctcttctttcctcgccctcattaacggcgagagggatcaccctaatgctacggtgtggaggaagaactttttgagggttgggcacctcgtgctgattggcggccccgacgacggcgtcatcactccatggcagagtagcttttttgggttctacgacgccaacgaaactgtcctcgaaatggaagaacagctcgtgtacttgagagacagtttcgggttgaagacacttctggctcgtggagcaatcgtgagatgccctatggcggggatctctcataccgcgtggcattcaaacagaacactgtacgagacgtgtatagaaccttggctttcttag

SEQ ID NO: 198544 - DNA, 909 bp, Artificial Sequence
  Description of Artificial Sequence: Synthetic coding sequence
atgctgggcctgtgcggccagcggctgcccgccgcctgggtgctgctgctgctcccctttctgcccctgctactgttagcagctccagcccctcatagagcaagctataagccggtcatcgtcgtgcatggtcttttcgactctagctatagcttccgccacctgttagaatatatcaatgaaactcaccccgggaccgtagtgactgttttggacctgtttgatgggcgcgaatccctgagaccactctgggaacaagttcaaggctttagggaggccgtggtgcccatcatggctaaggcccctcagggcgtgcatcttatctgttatagccaaggaggcctggtgtgccgcgctctcttaagcgtgatggatgaccacaacgttgattctttcatttccctgtcatccccacaaatggggcagtacggagacaccgattatttgaagtggctattccccacgtctatgcggagtaacctctaccgcatttgctatagcccttggggccaggaattcagtatttgtaactattggcatgatccacatcacgatgacctctacctgaatgcctcaagctttttggctctcatcaatggagagcgcgaccaccccaacgccacggtgtggcggaaaaattttctccgggtgggacatttggtgttgataggcggtcccgatgatggagtgattaccccatggcagtcctccttttttgggttttacgatgccaacgaaactgtgctcgagatggaggagcagctggtatacctcagagactccttcgggttgaagacgctgctcgctagaggcgctatcgttagatgcccgatggcagggatttctcataccgcctggcatagcaaccgaacactctacgagacctgtattgagccctggctgtcttag

SEQ ID NO: 198545 - DNA, 909 bp, Artificial Sequence
  Description of Artificial Sequence: Synthetic coding sequence
atgctgggcctgtggggccagcggctgcccgccgcctgggtgctgctgctgctgcctttcctgcctttgctcttgctggctgcccccgctccccatcgagagtcttacaagccggtgatcgtagtccacggcctgtttgatagctcatacagcttcaggcacctactggagtacatcaatgagacacatcccgggacagttgtcacggtgctggacctgttcgacggccgcgagtctttgcggcctctgtgggagcaggtgcagggattccgtgaagccgtggtgccgatcatggcgaaagcccctcaaggcgtccatctaatctgttatagtcaaggaggactcgtatgccgcgccctgctgtctgtaatggacgatcacaatgtggatagtttcatctccctgtccagtccacagatgggccagtatggcgataccgattacctcaagtggctcttccctactagcatgcgctctaacctgtacagaatctgttattcaccctggggtcaggagttttctatctgcaactattggcatgatccccaccacgatgatctgtatcttaacgcttcttcttttttagccctgattaatggggagagagatcaccctaacgccacagtctggaggaagaactttctgcgggtcggccacctggtcctcattggcggacccgacgacggcgtgatcactccatggcagagctcattctttgggttctatgatgccaacgaaactgtgctggaaatggaggaacaactggtgtacctgagagactcgtttggcctcaaaacactcctggcgagaggcgccatcgtcaggtgccctatggcaggcatcagccacaccgcatggcactcaaaccgtactctgtatgagacctgtatcgagccttggctgtcttag

SEQ ID NO: 198546 - DNA, 909 bp, Artificial Sequence
  Description of Artificial Sequence: Synthetic coding sequence
atgctgggcctgtggggccagcggctgcccgccgcctgggtgctgttattgctccccttcttgcccctgctgcttctggccgctcctgcccctcatagggagtcttataaacccgtaatcgttgtacacggacttttcgactcttcctattccttcagacatttgttggagtatatcaacgagacccaccctggcaccgttgtgacggtgctggacctgtttgatggacgggagtctctcaggccattatgggagcaggttcagggctttcgcgaggccgtggtgccaattatggcgaaggcaccccaaggtgttcatctgatttgttatagtcaggggggattggtgtgtagagcactgcttagtgtgatggacgaccacaatgtcgacagctttatcagtttatcgtccccgcagatggggcaatacggtgacactgattatttgaaatggctcttcccaacatccatgcggtccaatctgtaccgtatctgctacagtccctggggacaggagttttctatctgtaattactggcatgacccccatcacgatgacctgtaccttaatgcctcctccttcctcgccttgatcaatggcgagagggatcaccctaatgcaaccgtgtggcgcaagaattttctcagggttggacacctcgtgctgatagggggccccgatgacggagtgattactccgtggcagtcatcttttttcggtttctacgatgctaacgagacagtgttggaaatggaagagcagctggtgtacctgagggactcgtttggtcttaaaaccttactagctagaggcgctatagtccggtgtcctatggctggcatcagtcacaccgcgtggcactcaaacaggaccttgtatgagacttgcattgagccatggctcagttag

SEQ ID NO: 198547 - DNA, 909 bp, Artificial Sequence
  Description of Artificial Sequence: Synthetic coding sequence
atgctgggcctgtggggccagcggctgcccgccgcctgggtgctgctgctgttgccctttctgccactgctccttttggcagcgcctgccccccaccgggagagctataaaccagtcatcgttgtgcatggactgttcgactcatcctattccttcagacatctcctcgagtacattaacgaaacacatcctggtaccgtggtgaccgtgctggatctcttcgacggccgagaaagccttcgtcctctgtgggaacaggtgcagggtttccgggaagccgtagtaccgataatggctaaagccccacagggagtccacctaatttgttactcccaaggaggcctggtttgtagggccctcctcagcgtgatggatgaccacaatgtggacagttttatatcactcagcagtccacaaatggggcagtatggcgacacagactaccttaaatggttgtttcccacctctatgaggagcaatctgtacaggatctgttacagtccctgggggcaagagttcagtatttgtaattactggcacgacccccatcacgatgacctctatctcaatgccagcagcttcctggcgttgattaacggcgaaagagatcaccccaacgctactgtatggcggaagaactttttgagagtgggacacctagtgctgattgggggacccgacgatggagtgatcaccccctggcaatcaagctttttcggcttctacgatgcgaacgagactgtgttggaaatggaggagcagttggtttaccttcgggatagctttgggttgaaaacgctcttagcacgcggggcaattgtgcgttgtccaatggcgggcatcagccataccgcttggcactccaacagaaccctttacgagacatgtatagagccgtggctgtcatag

SEQ ID NO: 198548 - DNA, 909 bp, Artificial Sequence
  Description of Artificial Sequence: Synthetic coding sequence
atgctgggcctgtggggccagcggctgcccgccgcctgggtgctgttactactgccctttctcccacttctgctgctcgccgcccctgcgccacatagggcctcttacaagcctgttattgtggtgcacggcctgtttgacagtagttattctttccggcatctgctggagtacatcaacgagacccatcccggtaccgtggtcaccgtactagatctgttcgatggcagagagagtctccggcccctctgggagcaggttcagggttttcgcgaagccgtggtaccaatcatggccaaggcaccccagggcgtgcatctaatctgttacagccagggcgggcttgtgtgcagggccctgctgtcggtaatggatgaccacaatgtcgactcttttattagcctctctagcccccagatgggtcagtatggggatacagactatttaaagtggctctttcctacctccatgcgcagtaacctgtataggatctgctattccccatggggccaggagttcagtatctgtaactattggcacgacccccaccacgacgacctctatttgaacgcttccagcttcctcgctctgataaacggggaaagagatcacccaaacgccacagtttggcgaaagaatttcctgcgggtcggccacctcgttctcatcggtggcccggatgacggcgtcatcaccccatggcagagttccttctttggattttacgatgctaatgagacagtgctcgaaatggaagaacagctggtctacctgagagactcttttggattaaagacactgctagccaggggcgccatcgttcggtgccctatggcaggcatcagccatactgcttggcatagcaaccgcacgttatatgagacttgtatcgagccttggctctcctag

SEQ ID NO: 198549 - DNA, 909 bp, Artificial Sequence
  Description of Artificial Sequence: Synthetic coding sequence
atgctgggcctgtggggccagcggctgcccgccgcctgggtgctgttgctgctcccattcctacctctcctactgctggccgcccccgcgccacaccgggcatcctataagccggtgattgtggttcacggcctgtttgattcctcatatagcttccgccatctactggaatatattaatgagacacaccccggcacggtggttacagtcttggatctgttcgatggacgcgagagtttgagacctctttgggaacaggttcaaggattccgcgaggccgttgtccctatcatggcaaaagcaccgcaaggcgtacacctgatctgctattctcaaggtggcttggtgtgtagggcgctgctaagcgtgatggacgatcataacgtagattcattcatcagcctgagtagcccccagatggggcagtacggggatactgactatctgaagtggctgttcccaacctcgatgcgcagcaacctctacaggatttgttactccccgtggggacaggagttctctatctgtaattactggcatgatccacatcacgatgatttgtacctgaacgcttcatcttttctcgctctcatcaatggagagagggatcatcccaacgcaactgtctggcgtaagaacttcttgcgcgtgggtcatctggtgctcattggtgggcccgatgacggggttatcaccccctggcagtcttctttcttcggtttttacgacgctaacgaaacagtgttggaaatggaggagcagctggtgtaccttcgggactcctttggcctgaaaacgctgctggcgcggggggccatcgtcaggtgtcccatggctggtatctcacatacagcttggcacagcaatcggacgctctatgagacctgcatcgagccgtggctctcatag

SEQ ID NO: 198550 - DNA, 909 bp, Artificial Sequence
  Description of Artificial Sequence: Synthetic coding sequence
atgctgggcctgtggggccagcggctgcccgccgcctgggtgctgcttctcctgccattcctgcccctcttactcctggccgctcctgccccacatcgagctagttataaacccgtgatcgtcgtgcacggactcttcgacagctcctacagttttcgtcacttgctcgagtacattaacgagacccacccagggacagtggtcacagtgcttgatctctttgatggccgcgagtccctaagacccctgtgggaacaggttcagggttttcgggaggccgtggtgccaatcatggcaaaagctccccagggggtgcacctgatctgttatagccaaggcggcctggtctgccgggcactactttccgtaatggatgaccacaatgttgactcttttatatcattgagtagtccacaaatggggcagtacggggacactgactatctaaaatggctctttcctaccagcatgaggtccaacttatatcgcatttgctacagcccttgggggcaggagttttcaatttgtaattattggcatgacccccatcatgacgacctatatctaaacgcatcttcctttttggcattgatcaacggagagcgtgaccacccgaacgccaccgtctggagaaagaactttttgcgagttggacatctcgtgcttatcggcggacctgatgacggtgtcatcacgccctggcaaagcagctttttcgggttttacgatgcaaatgagaccgtgttagaaatggaagagcagctggtgtacttaagggactccttcggacttaagaccctgttagcccgcggagccatagtgagatgtccaatggccggcatttcacacacagcctggcactccaatcggaccctgtacgagacttgcatcgaaccatggctgagctag

SEQ ID NO: 198551 - DNA, 927 bp, Artificial Sequence
  Description of Artificial Sequence: Synthetic coding sequence
atgaagagctgcggcagcatgctgggcctgtggggccagcggctgcccgccgcttgggtgctgcttctgttgccctttctgcctctgttgttactggcggcccccgctccacacagggccagttataagcctgtgatcgttgtccacggactcttcgattcttcatacagttttaggcacctgctggaatatatcaatgaaactcatcccggaaccgttgttactgtgctggacctgttcgacggccgggaaagccttcggccactgtgggagcaagtgcaggggttccgggaggccgtggtgcccattatggctaaggcaccgcagggcgtgcatctgatctgctactctcagggaggactcgtgtgcagggcactgctgagcgtcatggacgaccacaatgttgatagtttcatatcactgtcaagtccacagatgggccagtatggcgacacggactatttaaagtggctgtttcctaccagcatgcgtagcaatctgtaccggatttgttactccccatgggggcaggagttctctatttgcaactactggcacgatccacatcatgacgacctttacttgaatgcgagctctttcctggccctgatcaacggtgaacgagatcaccccaacgcaaccgtgtggcgaaaaaactttctcagagtcggacatcttgtgctgatcggcgggccggatgacggcgtcatcaccccatggcagagcagctttttcggcttttatgatgcaaatgaaaccgtcctcgaaatggaagaacaactagtgtatctccgggatagttttggcctgaaaaccctcctggcccggggagctattgtgcgatgccccatggctggaatctctcatacggcttggcattctaaccggacgttgtacgagacttgtatcgaaccttggcttagctag

SEQ ID NO: 198552 - DNA, 282 bp, Artificial Sequence
  Description of Artificial Sequence: Synthetic coding sequence
atgctgggcctgtggggccagcggctgcccgccgcctgggtgctgcttctgctgcccttcctgcctctgctcctcctggccgccccagcccctcaccgggcgagttataagcctgtcattgtggttcatgggctgttcgattcctcttacagtttcaggcacctgctggagtacatcaacgagggagccctgtgtgctggtctttgcttcctgagctggatgattaccacttggatcctctcgagcccctcacccctgcatcgttgggattcaatggaatag

SEQ ID NO: 198553 - DNA, 543 bp, Artificial Sequence
  Description of Artificial Sequence: Synthetic coding sequence
atgctgggcctgtgcggccagcggctgcccgccgcctgggtgctgctgctccttcctttcctccccctgctgctgctggctgcgcctgccccgcacagagcttcgtacaagcctgttatcgtggtgcatggtctattcgacagttcctatagttttcggcacctgctggagtacataaatgaaacccaccctggcactgtggtgacagtcctcgatctgttcgacggtcgcgagtctctgcggcctctctgggaacaggtgcagggatttcgggaagctgttgtgcctattatggcaaaggcaccacagggcgtgcacctgatctgctattctcaggggggcctcgtatgccgcgccctgctgtcagtgatggatgatcacaacgtcgattctttcatatccctgtctagtccccagatgggccagtatggagacactgattatctgaaatggctattcccaacaagtatgcgctccaacctgtaccgaatatgctactctccctgggggcaggaattcagtatttgcaactattggcactag

SEQ ID NO: 198554 - DNA, 927 bp, Artificial Sequence
  Description of Artificial Sequence: Synthetic coding sequence
atgaagagctgcggcagcatgctgggcctgtggggccagcggctgcccgccgcctgggtgctcctgcttttgccctttctcccactgctgttgttggccgcaccagccccccatcgggctagctataagcctgtgattgtagtgcacggtctcttcgatagctcctattccttccgccatctgctggaatacatcaacgagacccatcctggaacagtggtgactgtcctggacttatttgatgggcgagaaagtctgcgcccactatgggaacaggttcagggatttcgagaggctgtggtgcccattatggctaaagccccccagggcgtccatctgatctgctattctcaggggggtctcgtatgtcgagccctactatccgttatggatgaccacaacgtggatagtttcatttccctcagctcccctcaaatgggccagtatggagacacagattatctcaagtggctttttccgaccagcatgaggtcaaacctgtatagaatctgctatagcccctggggccaggagttctccatctgtaattactggcatgatccacaccatgatgatctatacctaaatgccagctcttttctggccttaatcaatggtgaacgggaccaccctaacgcaactgtatggagaaagaactttctgagagtgggccatctggtgttgatcgggggtcctgacgacggcgtgataactccctggcaaagttcattcttcggcttttatgacgccaatgaaacagtgttggagatggaagagcagctcgtttatttaagggattcattcggactgaagacattgttagcacgcggcgcaattgtaagatgcccgatggccggcatctctcacaccgcctggcattcaaatcgcacattgtacgaaacctgcatcgaaccatggctgtcctag

SEQ ID NO: 198555 - DNA, 603 bp, Artificial Sequence
  Description of Artificial Sequence: Synthetic coding sequence
atgctgggcctgtggggccagcggctgcccgccgcctgggtgctgctattactgcccttcctgccactgctgcttttggccgcccctgccccacacagagagtcatacaagcccgtgattgtggtgcatgggttgtttgactcgtcttactcatttcgacatctcctggaatacataaatgaaacgcatcctgggaccgtcgtaacggtgcttgatctgttcgacggccgcgaaagcttgagaccattgtgggagcaggtccaaggattccgtgaagcggttgtgcctattatggccaaagcaccacagggggtgcatctgatctgttatagccagggggggctcgtttgccgggccttgttgagcgtgatggacgatcataatgttgactcctttatatccttaagttctccccaaatgggacagtatggcgacaccgactatttgaagtggttgtttcccacgtctatgcggtccaatctctaccgcatctgctatagtccgtgggggcaggaattctccatttgcaactactggcacgatccacaccatgatgatctgtatctgaacgcctcctcatttttggcccttatcaacggctag

SEQ ID NO: 198556 - DNA, 477 bp, Artificial Sequence
  Description of Artificial Sequence: Synthetic coding sequence
atgctgggcctgtggggccagcggctgcccgccgcctgggtgctgctgctccttcctttcctcccacttttacttctcgccgctccagctcctcaccgagaatcttataagcctgtcatcgtggttcacgggctatttgactcttcttactctttcagacacttattagaatatatcaatgaaatgggacaatatggagataccgattatctcaagtggctgttccccacaagtatgaggagtaatctgtaccgcatatgttattcaccatggggacaagagttctccatctgcaactactggcatgatccccaccacgacgatttatatctgaatgccagtagttttcttgcactgattaatggtgagagggaccatccaaacgcaaccgtgtggcgtaaaaatttcctccgagtcggccatttagtgctcatagggggtccagacgacggcgtgatcaccccatggcagtcatag

SEQ ID NO: 198557 - DNA, 543 bp, Artificial Sequence
  Description of Artificial Sequence: Synthetic coding sequence
atgctgggcctgtggggccagcggctgcccgccgcctgggtgctgctgctgctcccatttctgccgttactcctcctggccgcacccgccccccaccgggccagctataaacccgttatcgtggtccatggcctctttgattcttcatatagtttcaggcatctcctggagtacatcaatgaaactcaccccggaacggtggttacagtgttggaccttttcgatggtagagagtctctccggccactgtgggagcaggtgcagggctttcgcgaggccgtggtcccaatcatggctaaggccccacagggagtgcatttaatctgctatagccagggaggattagtgtgtcgcgcccttctctccgtaatggatgaccataacgtagacagctttatcagtctatcctcccctcagatgggccagtacggagatactgattatttaaagtggctcttcccaacttcaatgcggtctaacctatacagaatttgctactccccatgggggcaggaattttccatctgcaattactggcactag

SEQ ID NO: 198558 - DNA, 477 bp, Artificial Sequence
  Description of Artificial Sequence: Synthetic coding sequence
atgctgggcctgtggggccagcggctgcccgccgcctgggtgctgctactcctgccctttttgcctctgctcctgctggctgcccccgccccgcatcgggcctcatacaagcctgtgatcgtggtgcacggattgttcgacagcagctactccttcagacaccttctggagtacattaatgagatggggcagtatggggatacagattacctgaaatggctatttcctacatccatgcggagcaacctgtataggatctgctattcaccttggggacaggaatttagtatatgtaattattggcatgaccctcatcacgatgacctgtacctgaacgccagctcttttctggctcttattaatggcgaacgtgaccacccaaacgccactgtctggagaaagaacttccttagagtcgggcatctggtattgataggaggccccgacgatggagtcataactccctggcagtcttag

SEQ ID NO: 198559 - DNA, 543 bp, Artificial Sequence
  Description of Artificial Sequence: Synthetic coding sequence
atgctgggcctgtggggccagcggctgcccgccgcctgggtgctgctgctgctgccatttctgccacttctgctgctcgcagcgccggccccgcatagggcctcatacaaacccgtcatagtggtccatggcctttttgactccagctattctttccggcatcttctggagtacatcaatgagacccatcctggaacagtcgtgactgtgctcgacttattcgacggcagggaatccctcagacccctatgggagcaagtgcagggttttcgggaggccgtcgtaccgatcatggccaaagccccgcaaggagttcatctcatctgttattcccagggcggattggtgtgcagagctctgctttcagtgatggacgatcataatgtcgatagtttcatctctctttcttcaccacaaatgggccagtatggcgatacagactacctgaaatggctcttccctacaagcatgcggtctaacctttaccgcatctgttattccccttggggacaggagttcagcatctgtaattattggcattag

SEQ ID NO: 198560 - DNA, 909 bp, Artificial Sequence
  Description of Artificial Sequence: Synthetic coding sequence
atgctgggcctgtggggccagcggctgcccgccgcctgggtgctgcttctgctgccgtttctgcccctgctgttgctggcagctcccgccccccatcgagcaagctataagcctgtgatagtggtgcacggcctgttcgacagctcttattcttttagacatctgctggagtacatcaatgagacgcaccctggaaccgtagttaccgtactggacctgttcgacggccgggaaagcctgaggcccctctgggagcaggtgcaaggcttccgtgaagccgtggtccccataatggccaaagcccctcagggggtccacttaatttgttacagccagggggggcttgtttgcagggctctcctgagcgtaatggacgatcataacgtggattctttcatttccctctcatccccccaaatgggtcaatacggagacacagactacctcaagtggctgtttccgacctcaatgcgctccaatctatataggatttgttactccccttggggacaggagtttagtatttgcaattactggcacgacccacatcatgatgatctttatctcaatgcctcctctttcttggccctcattaacggcgagcgggaccaccctaatgcaaccgtgtggcgtaaaaacttcctgcgggtgggacacctggtgctgattggcggcccagatgatggtgtgatcacgccctggcagagctctttctttggcttctatgatgccaatgaaacagttcttgagatggaggagcagctcgtttatttaagggactcctttggactaaagactttactcgcacggggcgccatcgtccggtgtcctatggcaggaatatctcacactgcgtggcacagcaacaggactctgtacgagacatgtatcgagccatggctttcatag

SEQ ID NO: 198561 - DNA, 909 bp, Artificial Sequence
  Description of Artificial Sequence: Synthetic coding sequence
atgctgggcctgtggggccagcggctgcccgccgcctgggtgctgcttctactcccatttctgccactactcctgctcgctgccccagcaccacacagagccagctataagcccgtgattgttgtgcatggactatttgactccagctattccttccgccacctcctggaatatattaacgagacccaccccggcactgtggtgactgtactggatctttttgacggcagagagagcctgaggccattgtgggaacaagtgcagggcttccgcgaggccgtcgtaccaatcatggcgaaggctccacaaggcgtgcatctgatttgttactcacagggagggttagtatgtcgcgccttgctttcagttatggatgaccacaacgtggactcgttcataagcttgtcttctccccagatgggccagtacggagacacggattatctcaagtggctgttccccacctcaatgagatccaatctttaccggatttgctactccccctggggccaggaattctcaatctgcaactactggcacgatccacaccacgacgatctgtatctgaacgctagttcttttctagcccttatcaacggggagagggaccacccgaatgcaaccgtctggagaaaaaattttctgagggtggggcacttggttctgatcgggggtcctgacgatggcgtcattacaccctggcagtcctcttttttcgggttttacgacgccaacgagaccgtcctggaaatggaagagcagctcgtgtaccttagagacagcttcgggttgaaaaccctgttggcccgtggggcaatcgtccgttgccccatggctggaatcagccatacagcatggcactcaaatagaaccctgtacgaaacctgcattgagccatggctttcctag

SEQ ID NO: 198562 - DNA, 927 bp, Artificial Sequence
  Description of Artificial Sequence: Synthetic coding sequence
atgaagagctgcggcagcatgctgggcctgtggggccagcggctgcccgcagcatgggtactcctgctgctgcccttcctccccctgctcttactcgcggcccctgcccctcatcgagcctcctacaaacctgtgatagtcgtccatggattgtttgatagttcctactctttccggcatctgctggaatatatcaatgagacacatccagggacagtcgtcaccgtactcgacctctttgatggcagggagagcttacggcctctatgggagcaagttcaggggttcagagaggccgttgttcctataatggccaaggcaccacagggagtgcatctgatctgttactcgcagggcggcttagtctgccgtgctctcttaagcgtcatggatgatcacaatgtggactcttttatcagtctttccagtcctcagatgggccaatacggtgacaccgactacctgaagtggctgtttccaacaagcatgaggtccaatctgtaccggatatgttacagcccctgggggcaggagttcagcatctgcaattattggcatgatccccatcacgacgatttgtacctgaatgcgtcatcttttctcgccctaattaacggcgagcgtgaccatcccaacgcaaccgtttggcggaagaacttccttcgcgtggggcacttggtcctgatcggtggtccagacgacggggttattacaccatggcagtcatcgttcttcgggttctacgacgcgaacgagaccgtgttagaaatggaggagcagctggtctatttacgcgattcctttggactgaaaaccctgctggctcggggggctatagtgcgctgcccgatggcagggatctcccatactgcatggcactctaaccggaccctatatgaaacctgtatcgaaccctggctgtcctag

SEQ ID NO: 198563 - DNA, 282 bp, Artificial Sequence
  Description of Artificial Sequence: Synthetic coding sequence
atgctgggcctgtggggccagcggctgcccgccgcctgggtgctgctcctcctcccctttcttcctctgttgctgcttgctgctcccgcgccgcacagagcctcgtataaacccgttatcgtggtccacggccttttcgacagctcttattcctttcgccatctgctggagtacatcaatgaaggggccctgtgcgccgggctctgttttttgtcgtggatgatcacaacatggatcctgtcgtctcctagtccacttcaccgatgggactctatggagtag

SEQ ID NO: 198564 - DNA, 909 bp, Artificial Sequence
  Description of Artificial Sequence: Synthetic coding sequence
atgctgggcctgtggggccagcggctgcccgccgcctgggtgctgttgctcctgcctttcctgcctttactcttactagccgctcccgcaccacacagagccagctacaaaccagtgattgtagtccacggactgttcgattctagttacagtttcagacacctcctagaatacattaatgagactcaccctggcaccgtcgttactgtcctggacctatttgatgggagggagagcctcaggccactgtgggaacaggtccaggggtttcgcgaagccgttgtgccaataatggccaaagctcctcaaggcgttcacctgatctgttactcccagggaggcctcgtttgccgagccctcttaagtgtcatggatgaccataatgtggactccttcattagtttgtcatctccacaaatgggacagtatggcgatactgattacctgaagtggctgtttccgacttccatgcggtccaacctctaccggatctgctattccccatgggggcaggaattctccatttgtaactattggcatgacccacatcatgacgatctctaccttaacgccagcagtttcctggcgctgatcaatggcgaaagggatcacccaaatgccactgtgtggcgaaagaactttctgcgggtgggacacttggttttgatcggagggcccgacgatggtgttattacaccctggcagagttctttcttcggcttctacgacgccaacgagacagtgttagagatggaggaacagttggtgtacctgcgtgactccttcggactgaagaccctgctggcacggggagcaattgtccgctgccccatggctggcatctcccatactgcctggcatagtaataggacgttgtacgaaacctgcattgagccctggctaagttag

SEQ ID NO: 198565 - DNA, 477 bp, Artificial Sequence
  Description of Artificial Sequence: Synthetic coding sequence
atgctgggcctgtgcggccagcggctgcccgccgcctgggtgctgctgctgctgcccttcttgcctcttcttctgctcgcggcaccagcccctcaccgcgcgtcctacaaaccagtaatcgtcgtgcatggtctctttgattcttcatactcttttcgacacctcctggaatacatcaacgagatgggacaatatggagacacagattatctgaaatggctgtttcccactagcatgcgttccaacctgtatcgcatatgttactctccgtggggtcaggaattctctatttgcaactactggcatgatccccaccatgatgatctgtacctaaatgctagttccttccttgcactgatcaatggagagagggaccaccccaacgccacagtgtggagaaaaaattttctgcgcgtcggacatctggttctcatcggcggcccagatgatggggtgataaccccctggcaaagttag

SEQ ID NO: 198566 - DNA, 711 bp, Artificial Sequence
  Description of Artificial Sequence: Synthetic coding sequence
atgctgggcctgtggggccagcggctgcccgccgcctgggtgctgctacttctaccattccttcctctgctgctgttggccgcacccgcgcctcaccgggagagctataaaccggtcattgtggttcacggcctgtttgatagctcatacagctttaggcacctgctggaatacatcaatgaaactcaccctggaacagtggtaacagtgctggatttgttcgatggccgtgaaagcttgaggcctctgtgggagcaagtgcagggctttcgtgaggccgtggtgccaataatggctaaagcccctcaaggagtgcacttgatttgttattcacaaggcggcctcgtgtgcagagccctcctgtccgtcatggacgatcataatgtggactcgtttatctcattatccagtccacagatgggacagtacggggacacggattatttgaagtggctcttccctacatccatgaggtccaatctatatcgcatatgctacagtccatgggggcaggagtttagcatatgcaactactggcatgatcctcatcacgacgacctataccttaacgcctcttcttttttggctctaattaatggggagcgtgaccatcctaacgcgaccgtttggaggaagaattttttacgcgtgggccacctcgtgcttattgggggcccagacgacggcgtgatcacgccttggcagtcttag

SEQ ID NO: 198567 - DNA, 543 bp, Artificial Sequence
  Description of Artificial Sequence: Synthetic coding sequence
atgctgggcctgtggggccagcggctgcccgccgcctgggtgctgttactcctccccttcttacctctcctactgctcgccgccccagccccccacagggcatcttacaaacctgtaatagttgtccatggtcttttcgattcctcttacagttttcgtcatttgctggaatatattaatgaaacccaccccggaaccgttgtgactgtgcttgacctgtttgacggtagagagagtcttcgaccactgtgggaacaagtgcaggggtttagggaggcagtggtgcccattatggcgaaagcaccccagggggttcacctgatttgttattcgcagggcggactcgtgtgcagagctttgctgtctgtcatggatgatcataatgtggatagtttcatctccctcagctccccccaaatgggacagtatggggacacggattacctcaagtggctcttccccacctccatgcggagtaacctttaccgtatttgctactccccttggggccaggagttcagcatctgtaattactggcactag

SEQ ID NO: 198568 - DNA, 711 bp, Artificial Sequence
  Description of Artificial Sequence: Synthetic coding sequence
atgctgggcctgtggggccagcggctgcccgccgcctgggtgctgttactattgccctttcttccactactgctgttggctgcgcccgctccacatcgggagagttacaaacccgtcatcgtcgtacacgggctgttcgattcgagctactccttcaggcaccttttggagtacatcaacgagacccatcccggaacagttgtgaccgtgcttgatctcttcgacggaagggaaagtttaagaccactctgggagcaagtccagggattcagggaagctgttgttcctataatggcaaaggctcctcagggcgtgcatctgatttgttattcacagggtgggctcgtctgcagggcattgctctccgtgatggatgaccataatgtggattccttcatcagcctgtccagtccccagatgggacaatacggtgatacagattatctgaagtggctttttcccaccagtatgaggtctaacctataccgtatctgttacagcccctggggacaggagttctcaatttgcaattactggcacgatcctcaccacgatgacctttacttgaacgcatcttcctttttggccctgataaacggtgaaagggaccaccccaatgctacagtgtggagaaaaaacttcctgcgcgttggccacctagtcctcatcggagggcctgatgacggcgtgatcactccctggcagtcgtag

SEQ ID NO: 198569 - DNA, 603 bp, Artificial Sequence
  Description of Artificial Sequence: Synthetic coding sequence
atgctgggcctgtggggccagcggctgcccgccgcctgggtgctgctgctgcttcccttcctgcccctgcttctactggcagcccctgcccctcatcgtgcttcttataagcctgtcatcgtggttcatggattgttcgactctagctacagctttcgtcatctactggagtacatcaacgagactcacccaggcactgttgtgacagtgctggacctgttcgatgggagggagtccttgagacccctatgggaacaggtccaggggttcagggaggccgtcgtgcctattatggctaaggctcctcagggagttcacctgatttgttactctcaaggcgggctcgtatgtcgagccttactttcagtgatggatgaccataacgtggattccttcatctctctgtcctcccctcaaatggggcagtatggagacaccgactacctcaaatggctgttcccaacatctatgcggtccaacctgtatcgcatctgctacagcccatgggggcaggaattcagtatttgcaactactggcacgacccacatcatgacgatttatacctgaatgcctccagcttcctggcgctgataaacggctag

SEQ ID NO: 198570 - DNA, 909 bp, Artificial Sequence
  Description of Artificial Sequence: Synthetic coding sequence
atgctgggcctgtggggccagcggctgcccgccgcctgggtgctgctactcctgccatttctgcccctcttactcttggcagctcctgctccgcacagagcgagctataagcctgttatcgtggtgcacgggctctttgatagttcctatagtttccgtcatctgctggagtatataaacgagacccaccccgggacagtggtcactgtcctcgatctgttcgatggaagggaatcattgagacctctctgggagcaagtgcaggggttccgggaggctgttgtgccgatcatggccaaagctccccagggagtgcacctgatctgctactctcagggtggtctggtgtgtagagcacttctgtccgtcatggatgaccataatgttgatagctttatttctctttcatctcctcagatggggcagtacggcgacacagattatctgaagtggctgttcccgaccagcatgcgctccaacctctaccggatttgctatagcccatggggccaggagttctcaatatgtaattattggcacgatccacatcacgacgatttgtatttaaacgcatccagctttcttgcgctgattaacggcgaacgcgaccaccccaatgctacggtgtggcggaaaaactttttgcgggtggggcatctggtattaattggcggtcctgatgatggtgtcatcacaccctggcagtcaagtttttttggtttctacgatgcgaatgaaaccgtgcttgaaatggaagagcagctcgtgtatctgagagattccttcggcctgaagactctcttggcaaggggggctatagttcgttgcccgatggccggaatatctcacacggcctggcactcgaacaggactctgtatgagacttgtattgaaccatggctcagctag

SEQ ID NO: 198571 - DNA, 603 bp, Artificial Sequence
  Description of Artificial Sequence: Synthetic coding sequence
atgctgggcctgtggggccagcggctgcccgccgcctgggtgctgctgctcctgccttttctcccactgctgctgctggcggcacccgcacctcatcgtgcctcatacaagcccgtgatcgtggtgcacggactgtttgattcttcttatagttttaggcatcttctggagtatatcaacgaaacacaccctggaacggtcgtaaccgttctagatctcttcgacggaagagagtctctccgaccgctgtgggagcaggtgcaggggtttcgggaagcagtggtccccatcatggctaaggctccgcagggggttcatttgatatgctattctcagggaggcctcgtgtgccgcgccctgctgtccgtcatggacgaccacaacgtcgatagctttatttctcttagctcaccccagatgggtcagtatggtgataccgattacttaaagtggttgttcccgacttccatgaggtcaaatttgtataggatttgttattctccctggggacaggagttttcaatttgtaactactggcatgacccacaccacgatgacctgtacttaaacgcttcatcatttctagcacttataaatggctag

SEQ ID NO: 198572 - DNA, 729 bp, Artificial Sequence
  Description of Artificial Sequence: Synthetic coding sequence
atgaagagctgcggcagcatgctgggcctgtggggccagcggctgccagccgcctgggtcctcttgctcctgcctttcctccccctcctcctgttggcagcaccagcgccccatcgggaaagttacaagcccgttattgtggtccacggtctgttcgatagctcatatagctttcgacacctgctcgaatatatcaacgaaactcatccaggaacggtggtcaccgtcctggatttgtttgatggacgcgagtccctgcggccactttgggaacaggttcagggattcagggaagctgtcgtaccaattatggcaaaggcacctcaaggggtacatcttatctgctactcacagggagggctcgtatgtcgagctctgctgtccgttatggatgatcataacgtagacagctttatttcgctgtccagcccccagatgggccaatatggcgacaccgactatcttaaatggctgtttccgactagtatgaggagcaacttgtaccgtatatgctattccccatggggtcaggagtttagcatatgtaactactggcacgatccgcaccacgatgatctttacctgaacgccagctccttccttgctttaattaatggtgagagagaccaccccaatgcaaccgtctggaggaagaacttcctgcgtgttgggcatctcgttcttataggaggccctgatgacggcgttataactccgtggcagtcctag

SEQ ID NO: 198573 - DNA, 711 bp, Artificial Sequence
  Description of Artificial Sequence: Synthetic coding sequence
atgctgggcctgtggggccagcggctgcccgccgcctgggtgctgctccttcttccatttcttcctttactgcttcttgctgcgccagcaccacatcgtgagtcctataaacccgtcatcgtcgttcacgggctgttcgacagcagctactcttttcggcacttgcttgagtacatcaacgaaacgcaccccggaacagtggtgaccgtcttagacctctttgacgggagggaaagtttgagacccctgtgggaacaggtgcaaggttttagggaagcagtggtcccgattatggcaaaggcccctcaaggcgtgcacctgatatgttattcacaaggcggcctagtctgtcgagcattactcagcgtgatggacgatcacaatgttgatagctttattagcttgtccagccctcaaatggggcagtatggagataccgattacctaaaatggctttttccaacatctatgagatccaacctgtataggatttgttactcaccttggggccaggagttcagcatctgcaattactggcacgaccctcatcacgatgacctctacctcaatgcgtctagcttcttggccctgatcaatggtgaaagagaccatccaaacgctacagtctggcgaaagaacttcctccgcgtcggtcatctggttcttattggaggacccgacgacggcgtcattactccatggcaatcttag

SEQ ID NO: 198574 - DNA, 543 bp, Artificial Sequence
  Description of Artificial Sequence: Synthetic coding sequence
atgctgggcctgtggggccagcggctgcccgccgcctgggtgctgcttctgctgccttttctgcccctgctgctgctggccgccccggccccacacagggccagttataagccagtaatagttgtgcacggtctgtttgacagctcatacagctttagacatctgctcgagtacattaacgaaacccacccgggtaccgtggtcaccgtgttagatctgttcgacggacgcgagtctctgcgacccctgtgggagcaggtccagggttttagggaggccgttgtgcccataatggcaaaagcgccccagggagtccacctcatatgttatagtcaggggggtctggtgtgtcgagcgcttttgtcagtgatggatgatcacaacgttgacagcttcatatctctgagcagtccccagatgggccagtacggcgacactgactatctgaagtggctgttccctacctcaatgcggtctaatctgtaccgcatatgttacagcccctggggtcaagagttctcgatttgcaactattggcactag

SEQ ID NO: 198575 - DNA, 477 bp, Artificial Sequence
  Description of Artificial Sequence: Synthetic coding sequence
atgctgggcctgtggggccagcggctgcccgccgcctgggtgctgctcttgttacccttcctcccgcttttactcttggccgctccagcaccccaccgggcctcctacaagccagtcatcgtcgtgcatggactgtttgactcctcctattcttttcgccatctgttggagtacatcaacgagatgggacaatacggagacactgactacctcaaatggttgttccctaccagcatgagatcaaatttataccggatctgctattcgccatggggccaggagttcagtatctgtaactattggcacgacccacaccacgatgacctctacctgaatgctagcagctttctagccctcatcaacggtgagcgggatcaccccaacgccactgtgtggaggaagaactttctgcgcgtgggacacctcgtgctgatcggtgggcctgacgatggcgtcattaccccttggcagagttag

SEQ ID NO: 198576 - DNA, 603 bp, Artificial Sequence
  Description of Artificial Sequence: Synthetic coding sequence
atgctgggcctgtggggccagcggctgcccgccgcctgggtgctgcttctgctcccgttcctgcctctgctgctactggctgccccagccccacaccgggagagttataaaccagtcatagtagtgcacgggttattcgattccagctacagcttcaggcacttgctggagtacataaatgagacgcatccaggcactgttgtgaccgttctggatttgtttgacggaagagaatctctgaggccgctctgggagcaggttcagggcttccgggaggctgtggtccctattatggctaaggcaccccagggagtgcacctgatctgttactcccaggggggcctggtgtgcagggccttattgagcgtaatggatgaccacaatgtggatagcttcatatctctgagttctccccaaatgggacaatacggggacactgattatttaaagtggctgtttccgacttccatgcggagcaatttgtaccggatctgctactctccctggggtcaggagttttcaatttgcaactactggcacgacccccaccatgacgacctgtacttgaatgctagctcatttctcgcgttgatcaatgggtag

SEQ ID NO: 198577 - DNA, 603 bp, Artificial Sequence
  Description of Artificial Sequence: Synthetic coding sequence
atgctgggcctgtgcggccagcggctgcccgccgcctgggtgctgctgctgctgcctttcctgcccctcctgctgctggcagcaccagctccccatagagcaagctacaaacctgtgattgtggtgcatggcctgttcgactcctcctacagcttccgccatcttctcgagtatataaacgagacacacccaggaacagttgtgaccgtccttgacctgtttgacggccgtgagtctttacgccccctttgggagcaggtgcagggttttcgtgaggccgtggtccctatcatggccaaagctccgcagggcgtacacctcatttgctattctcagggggggttggtctgccgagctctgctctcggtgatggatgatcacaacgtagactcattcatttccctctcaagtccccaaatgggacagtacggagatacagattacttgaaatggctcttcccgacctccatgaggtccaatctttatagaatatgctactcgccgtggggacaggagttctctatttgtaattattggcatgaccctcatcatgatgacctctacctgaacgcgagcagctttttggctctcataaatggctag

SEQ ID NO: 198578 - DNA, 441 bp, Artificial Sequence
  Description of Artificial Sequence: Synthetic coding sequence
atggacgaccacaacgtggacagcttcatcagcctgagcagcccccagatgggccagtatggagatacagattacctgaaatggctttttcctacctccatgaggagtaacttgtacaggatctgctatagcccgtggggccaagagttttcaatttgcaactattggcacgacccacaccatgacgatttgtacctcaatgcgagctcgttcctagctctaatcaacggcgagcgagaccatcctaacgcaactgtctggagaaaaaacttcctgcgggtggggcacctggtgcttattggagggccagatgatggggtcatcaccccctggcagtccagcttctttggcttctatgatgcaaatgaaaccgtcctcgagatggaagaacagctacctgttggctcttcggtgaaggctaaccatggagtgcaggggtag

SEQ ID NO: 198579 - DNA, 477 bp, Artificial Sequence
  Description of Artificial Sequence: Synthetic coding sequence
atgctgggcctgtggggccagcggctgcccgccgcctgggtgctgctgttgctcccttttcttcctttgctgcttcttgctgcccccgcgccccaccgggctagttacaagcccgtgattgtggtccacggtctgttcgactcatcatatagcttcagacatcttctagagtacatcaatgagatgggtcagtacggggacactgactatttgaagtggctgttcccaacatcgatgcgctccaacctctaccgcatctgctactccccctggggccaggaattttctatatgcaattattggcacgacccgcatcacgacgacctttacctgaatgcctctagctttctggctctcataaacggtgaacgtgatcatccaaacgcaaccgtgtggcgcaagaacttcctccgggtgggtcatctagtcttaataggagggccagatgatggggttatcaccccttggcagagttag

SEQ ID NO: 198580 - DNA, 909 bp, Artificial Sequence
  Description of Artificial Sequence: Synthetic coding sequence
atgctgggcctgtggggccagcggctgcccgccgcctgggtgctgctcttattacccttcctccctcttctgttactggctgcacctgcgccccatagagcatcttacaagccagtgattgtcgtgcacggactgtttgatagttcttactccttccgccacctcctggagtatatcaacgaaacccatccagggacagtggtcacagtgttggatctgttcgacgggagagagtctctgagacctctgtgggaacaggtccagggattccgtgaggctgtcgtacccatcatggccaaagcccctcaaggcgttcatcttatatgttactctcagggagggttggtttgccgagcactgctcagcgtcatggacgaccataacgtagattcttttattagcctctccagcccacagatgggccagtacggagacacagactaccttaaatggttgttcccgacttccatgcgcagcaatctgtaccggatttgttatagtccatggggccaagagtttagcatctgcaattactggcacgacccccaccacgacgacctgtacttaaacgcttcctcctttctagcgctaattaatggcgaaagggatcaccctaacgccactgtttggcgcaaaaatttcctccgagtcggacatctggtcctgataggcggacctgatgacggagttatcaccccatggcagagtagcttttttggcttctatgacgctaacgagaccgtactagagatggaggagcagcttgtttacctcagggattccttcggactaaaaacacttcttgctcgcggcgctatcgtgcggtgccctatggctgggatttcccacaccgcctggcactcgaacagaacactctacgaaacttgtatagagccctggcttagctag

SEQ ID NO: 198581 - DNA, 909 bp, Artificial Sequence
  Description of Artificial Sequence: Synthetic coding sequence
atgctgggcctgtggggccagcggctgcccgccgcctgggtgctgcttttgctcccctttctcccactgctgctgctcgcggcccccgctccccacagagcttcttataagcctgtcattgtggttcacgggctctttgattcctcttactctttccgccacttactggagtacattaacgaaacgcacccaggcacagtcgttactgtgctggacctcttcgatggccgtgaatcgctccggcctctgtgggagcaggtgcagggcttcagggaggccgttgtgccgataatggctaaagccccccagggagtccatttgatctgttatagtcagggggggctcgtctgcagggctctcctgtcagttatggacgaccacaacgtggatagctttattagcctcagctcaccccagatgggccaatacggagacaccgattacctcaagtggctgtttcccacatccatgcgcagcaacctctatcgcatctgttactcaccatggggccaagaattcagtatatgcaattattggcatgacccccatcatgacgatctgtacctgaacgcctcctcctttctcgctctgattaacggggagcgggaccaccccaatgctacggtttggcgcaaaaatttcctaagggtggggcacttggtcctcatcgggggtccagacgacggtgttatcactccctggcagtctagcttcttcgggttctatgacgccaatgaaactgtgcttgagatggaagaacagctggtgtatctgagagattcgtttgggctcaaaacgctgctggctcggggcgcaatcgtgagatgcccaatggccggaatcagtcatacggcttggcacagtaacaggaccctgtacgagacttgcattgaaccgtggctctcctag

SEQ ID NO: 198582 - DNA, 909 bp, Artificial Sequence
  Description of Artificial Sequence: Synthetic coding sequence
atgctgggcctgtggggccagcggctgcccgccgcctgggtgctgcttcttctgcctttcctgcctctcttgttgctggcagcccccgctccacaccgcgcgagctataaacccgtcattgttgtccatggtctcttcgactcttcatactccttccggcatctacttgagtacatcaatgaaacacaccccgggacagtagtgaccgtattggacctctttgacggacgagagtcccttcgcccattatgggaacaggttcaggggttccgcgaagccgtcgtgcctatcatggccaaagccccacagggtgtacaccttatctgttacagtcaaggaggcctcgtgtgtagagcattactcagcgtgatggacgatcacaacgttgattcgttcattagcttgagctccccacaaatgggccagtacggggacaccgattacctcaaatggctgtttccaacatccatgcgttccaatttatacagaatatgttattctccctggggccaagagttcagcatatgcaactactggcatgatccccaccacgatgacctgtatctcaacgcatcgtcatttctggcattaatcaacggcgaacgggatcatcccaatgctaccgtttggcgaaaaaactttcttagagtaggacatctggttctgattggagggccggacgatggagtgattacaccatggcagagcagtttttttggcttctatgatgccaacgagacagttctcgagatggaagagcaactggtgtatttgcgcgactccttcggattaaaaactctgctagcacggggcgcgatcgtgcgctgtccaatggctggcataagtcacaccgcctggcactccaatcggaccttgtatgagacctgtatagagccttggttgtcctag

SEQ ID NO: 198583 - DNA, 282 bp, Artificial Sequence
  Description of Artificial Sequence: Synthetic coding sequence
atgctgggcctgtggggccagcggctgcccgccgcctgggtgctgctactgctcccgtttcttcctctgttgcttttagccgcaccggcacctcaccgggaatcttacaaaccggttatagtggtgcacgggctctttgatagctcttactcatttagacacttgttggagtatataaatgaaggcgcattatgcgctggactttgttttctatcctggatgatcacaacctggattctctcatccccaagtccactgcaccgttgggactcgatggaatag

SEQ ID NO: 198584 - DNA, 603 bp, Artificial Sequence
  Description of Artificial Sequence: Synthetic coding sequence
atgctgggcctgtggggccagcggctgcccgccgcctgggtgctgctgctccttccattcctcccactcctcctattggctgctcctgctccccacagagcaagctacaagccagtgatcgtcgtgcacggcctcttcgatagcagctattcttttcggcatctccttgaatacatcaacgaaactcaccctggcactgtggtaacagtgctggaccttttcgacgggcgagaaagtttacgcccactctgggagcaggtgcagggattcagagaggcggtggtccccatcatggccaaggcaccacagggagtgcacttgatatgttacagtcaaggcggtcttgtctgtagggccttattgtctgtcatggatgaccataacgttgacagttttatctctctttccagcccgcagatggggcagtatggggacacagactatctgaaatggctctttcccacctctatgaggtccaacctctaccggatttgttatagtccctggggacaggagtttagcatctgcaactactggcatgatcctcatcacgacgatctctacctcaatgcatctagtttcctggccctaatcaatggctag

SEQ ID NO: 198585 - DNA, 603 bp, Artificial Sequence
  Description of Artificial Sequence: Synthetic coding sequence
atgctgggcctgtggggccagcggctgcccgccgcctgggtgctgcttttgctcccattcttgccgctgctacttctggccgctccggccccgcacagggctagctacaagcccgtgatcgtcgtccatggtctgttcgacagtagttatagctttcggcatcttctcgagtatataaacgagacacatcccggaaccgtggtgacagttcttgacttgtttgacggaagagagagtctgcgcccactctgggaacaggtgcagggctttcgggaggccgtggttccaatcatggcaaaagctccgcaaggagtgcatctcatatgctattcccagggagggctggtctgtcgcgccctccttagtgtcatggacgatcacaacgttgacagttttatatccctcagttctccccagatgggccagtacggcgacacagattatctcaaatggctttttccaacaagtatgaggagcaacttgtataggatctgttactctccatggggccaggaattctctatctgcaactactggcatgacccccatcatgacgatctctatttaaacgcctcctcatttctggctttgataaacgggtag

SEQ ID NO: 198586 - DNA, 909 bp, Artificial Sequence
  Description of Artificial Sequence: Synthetic coding sequence
atgctgggcctgtggggccagcggctgcccgccgcctgggtgctgctgttgctgccattcctgccactgctgctcctggcagctcccgcaccgcacagagcttcctacaaacctgtcattgtggtgcatggactgtttgattccagttatagtttcaggcatttgttggaatatatcaacgagacacaccctgggacagttgtgacggttctcgatctcttcgacggaagggaaagcctgcggcccttatgggagcaggtccaggggttccgtgaagctgttgtgcctatcatggccaaagctccccagggtgtgcacctgatttgctatagccaaggcggcttagtctgtagagcccttctgtccgtgatggacgaccataacgtcgattcattcattagtctgtcgtctccgcagatgggacagtatggcgacaccgactaccttaaatggctcttccccacttccatgagatccaacctttacagaatttgttactcaccctggggacaggaattttccatctgtaactattggcatgacccgcatcatgatgatctgtacttgaacgctagcagctttttggccctgattaacggagaaagagatcacccaaatgccaccgtatggcgcaagaactttctacgcgtcggacacctcgtcctcataggtgggcctgacgatggagtcattacaccttggcagtcctccttctttggtttttacgacgccaacgaaacagtgctggagatggaggaacagctggtttatctgagagattccttcggtctcaagacactcctggcaaggggagccattgtgcgctgtcccatggctgggattagtcacaccgcctggcactcaaatcgcacactctacgagacttgcatcgaaccatggttatcgtag

SEQ ID NO: 198587 - DNA, 906 bp, Artificial Sequence
  Description of Artificial Sequence: Synthetic coding sequence
atgctgggcctgtgcggccagcggctgcccgccgcctgggtgctgctgctcctcccctttctacccctcctgttactcgcggctccagctcctcaccgtgctagctataaacccgttatcgtggtgcacggcctctttgactcaagttactccttccgacacctcttagagtacattaacgagacccaccctgggactgttgttaccgtcctagatttgtttgatggccgggagtcactgaggcccctatgggaacaagttcagggattccgcgaagcagtggtgccaatcatggctaaagcgccacagggggtacatctcatctgctattctcagggaggactggtgtgtcgagcccttttgtccgtcatggatgatcacaatgtggacagcttcattagcttgtcatctccacagatgggccagtatggggacaccgattacctcaaatggcttttccccacaagtatgcgctccaacctatatcggatttgctattccccatggggacaggaattctccatctgtaactattggcacgatcctcaccatgacgatctatatctgaatgccagttcctttctggcactcataaacggcgagcgcgaccatcccaacgccacagtctggcggaagaacttcttgcgcgttgggcacctggtgctgatcggtggacctgatgacggagtgattacaccttggcaatctagcttttttgggttctatgacgccaatgagacagtgctggagatggaagagcagctcccagcacgccctacccatcagtccgagctgctattactcaggctagtgtgtctgaagccaccacgaaggaaaaagccagcctgccgtgttcaacgacagtccgagtcctggggtccggggctcagttgcgccctgtcttag

SEQ ID NO: 198588 - DNA, 477 bp, Artificial Sequence
  Description of Artificial Sequence: Synthetic coding sequence
atgctgggcctgtggggccagcggctgcccgccgcctgggtgctgcttctactcccctttctccctctgttactcctggcagctcctgccccccaccgggaaagctacaaacccgtcattgtggtgcatggcctcttcgattcgagctactccttccggcacctcctggaatacatcaatgagatgggacaatatggtgataccgactatcttaagtggctgttccccacttccatgcggagcaatctctatcgcatttgttactccccttgggggcaggaattctcaatctgtaattattggcatgatccccatcatgatgatctctaccttaacgcatcttcttttctggctcttattaacggagaacgtgatcaccccaatgcgacagtctggcgcaagaatttcttgcgggtgggtcatttagttctgataggggggcccgacgacggggttataacaccgtggcagagctag

SEQ ID NO: 198589 - DNA, 543 bp, Artificial Sequence
  Description of Artificial Sequence: Synthetic coding sequence
atgctgggcctgtggggccagcggctgcccgccgcctgggtgctgcttttactgcccttccttcctctgctgctactcgctgctcctgccccccaccgcgccagttataaacctgttattgtggtccacggcttgttcgacagtagttattcattcaggcaccttctggaatatattaacgagactcaccccgggaccgtcgtgactgtcctcgacctgtttgacgggcgcgagtcactaaggccactctgggaacaagtgcagggctttcgggaggccgtcgtacccattatggccaaagccccgcagggggtgcaccttatatgttacagccaaggtggtctggtgtgccgtgcgctgctctcggtgatggatgaccacaacgtcgactcatttatctcattatcatcccctcagatgggccagtatggcgacaccgattacctcaagtggctcttcccaacctctatgcggtctaacttgtacagaatctgctactcaccgtggggccaggagtttagcatttgtaattactggcattag

SEQ ID NO: 198590 - DNA, 603 bp, Artificial Sequence
  Description of Artificial Sequence: Synthetic coding sequence
atgctgggcctgtggggccagcggctgcccgccgcctgggtgctgcttctgttaccctttctgcctcttcttctccttgccgctcctgcaccacacagagccagctacaagcctgtgatcgttgtgcacggcttgtttgattcatcatacagcttccgccacctgctcgaatatattaacgagacacacccaggtaccgtcgtcacggtccttgacctttttgacggaagagaatccctcagacctttatgggaacaggtccaggggtttcgcgaagcagttgtgcccataatggcgaaggctccgcagggagttcacctgatatgttattcccagggtggtctcgtttgccgcgccctgctgtcagtcatggatgaccacaatgtggactcgttcatcagcctgtctagtccccagatgggccagtacggagacacggactacttaaagtggctcttcccgacatcaatgcgatccaatctgtacaggatctgctatagtccctggggccaggaattcagtatctgtaactactggcacgaccctcatcacgatgatctctacctgaatgcaagtagctttctggccctaatcaacggctag

SEQ ID NO: 198591 - DNA, 909 bp, Artificial Sequence
  Description of Artificial Sequence: Synthetic coding sequence
atgctgggcctgtggggccagcggctgcccgccgcctgggtgctgctgttactgccttttctgccattgttgctactcgccgcccctgcgccccacagagccagctataagccagttatcgttgtgcatggcctcttcgactcgtcttattcattccggcatctgctcgagtacattaatgagacacatcccgggaccgtggtaaccgtcctggacctgtttgatggtagggagagcttgcgcccactgtgggagcaggtacagggatttcgagaagctgtcgtgccaataatggcgaaggcccctcaaggggtgcacctaatttgctactcacagggcggcctggtgtgtcgcgccctcttaagcgtgatggacgaccataatgtggatagctttatttcgcttagctctcctcaaatgggacaatacggagatacagactacctgaaatggctgttccccactagtatgcgcagcaatttatatagaatttgctatagcccatgggggcaggagttttccatttgcaactactggcatgatccccaccacgatgacctctacttgaatgcctcatcatttttggctttgataaatggagaaagggaccatcctaacgccacagtgtggcggaagaacttcctgagggtcggccacctagtgctcataggagggcccgatgacggggtgatcacaccttggcagtcctcattctttggattttacgatgctaacgagactgtgctcgagatggaagaacagttggtttaccttagagactcctttggcctgaagactctcctcgctcggggagccatcgtgaggtgtcccatggccggcatttcgcacactgcctggcattctaatagaacactctacgagacttgtattgaaccttggttgtcttag

SEQ ID NO: 198592 - DNA, 909 bp, Artificial Sequence
  Description of Artificial Sequence: Synthetic coding sequence
atgctgggcctgtggggccagcggctgcccgccgcctgggtgctgcttctgcttccattcctgcccttgctgctgctggctgcgcccgctcctcacagagcctcttacaaaccagtcattgtcgtccacgggctgtttgatagctcatactctttcaggcacctgctggaatatatcaatgaaacccaccccggaacagttgttaccgtccttgatctttttgatggacgtgaaagtctccggcccctgtgggagcaggtgcagggcttcagagaggctgttgtgccaattatggcgaaagctccccagggtgtgcaccttatttgctattctcagggaggactggtctgtcgggctctcctcagtgtgatggacgaccacaatgtcgattcgtttatttctctgtcttcccctcagatgggacagtacggagataccgactaccttaaatggctttttcccaccagtatgcggagcaatctgtatagaatttgttattctccctggggccaggagttctcgatctgtaactattggcacgaccctcaccacgatgatctctacctgaacgctagtagctttctggcactcattaacggcgagagagaccacccaaatgctactgtatggcggaaaaatttcctccgggtgggccatctcgtactgatcggcggccccgatgacggcgtgattacgccttggcaaagctcatttttcggtttctatgacgccaatgagaccgtcctggagatggaagagcagcttgtgtatctcagggactccttcggactgaagaccctgcttgctaggggcgccatcgtgcggtgtcctatggctggtatctcgcacacggcttggcactctaaccgaacactctacgagacatgcatcgaaccctggctgtcttag

SEQ ID NO: 198593 - DNA, 282 bp, Artificial Sequence
  Description of Artificial Sequence: Synthetic coding sequence
atgctgggcctgtggggccagcggctgcccgccgcctgggtgctgttgctgctgcctttcttgccccttctgctgctcgctgcgcccgcccctcacagagccagctataaacctgtaattgtggtgcatggcttatttgatagcagctattctttccgacacttactggaatatattaacgaaggcgctctctgcgcagggctgtgttttttgtcttggatgatcacaacctggatcctcagttctcctagcccactgcatagatgggactctatggaatag

SEQ ID NO: 198594 - DNA, 282 bp, Artificial Sequence
  Description of Artificial Sequence: Synthetic coding sequence
atgctgggcctgtgcggccagcggctgcccgccgcctgggtgctgctgctccttccctttcttccattgcttctgttggccgcgccggcacctcaccgcgcaagttataagcctgttattgtggtgcatggcctgtttgattcttcatactcattcaggcacttgctggagtatatcaacgagggcgctctttgtgccgggttgtgtttcctatcttggatgatcaccacatggattctgtcaagcccttcacccttgcacagatgggatagcatggaatag

SEQ ID NO: 198595 - DNA, 909 bp, Artificial Sequence
  Description of Artificial Sequence: Synthetic coding sequence
atgctgggcctgtggggccagcggctgcccgccgcctgggtgctgttactcctgccttttctgcctctgcttctgcttgcagcaccagccccacaccgcgcctcatacaaacctgttatagtggtccatgggcttttcgactcctcttactcatttagacacttgcttgagtacatcaacgagacacaccctggcactgtggtcacagtactcgatctgttcgatggcagagaatccctgagaccactgtgggagcaggtccagggttttcgggaggccgtagtgcctattatggctaaagccccacagggcgtgcacctcatctgctacagtcagggtggtttggtgtgtcgggctcttttatccgtcatggatgaccacaatgtggatagcttcatctcactgtcgtctccacaaatgggacagtatggtgataccgactacctgaagtggttgtttcctacctccatgcgcagcaatctatacaggatctgctactcaccttggggacaggaattcagtatctgtaattactggcatgatcctcaccacgatgacctttatctgaacgccagcagctttctcgctcttatcaacggagaacgcgaccatccaaacgccactgtctggcgcaagaacttcctgcgcgtcgggcacctggtcctcattggcgggcctgacgatggtgttatcaccccctggcagtcatcctttttcggcttttatgacgctaatgaaacggtgttggagatggaggaacagttggtatacctccgggactcttttggcctgaagacactgctggctaggggagccatcgtgcgctgtcccatggcggggatttctcataccgcctggcattctaaccggacgctctatgaaacctgtattgaaccatggctgtcctag

SEQ ID NO: 198596 - DNA, 909 bp, Artificial Sequence
  Description of Artificial Sequence: Synthetic coding sequence
atgctgggcctgtggggccagcggctgcccgccgcctgggtgctgctgttactgcccttcttgcctctgcttttactcgcggcacccgccccccacagggcctcctacaaaccagtgattgtggtgcacggtctttttgatagcagctactccttcaggcatctactggaatatattaatgaaacccacccaggaactgtggttaccgtcctcgacttatttgatggccgggagtctctgcgaccgctgtgggaacaggtgcaggggtttagggaagcagtcgtgccaatcatggccaaggctccacaaggagttcacctcatatgctatagccagggcggtctcgtgtgtcgcgcgctcctgagcgtgatggatgatcacaatgtcgatagcttcatatcactgtcatcccctcagatgggtcagtacggagatacagactacttgaagtggctctttcctacgtcaatgaggagcaacctgtataggatctgttacagcccatggggccaagagttttccatatgtaattactggcatgacccacaccatgatgacctgtatttgaatgcctcgtccttccttgctcttattaatggagagagggaccatccgaatgccaccgtttggcgcaagaatttccttagagttggccacctggtgctgatcggaggcccagatgacggagtaatcaccccttggcagtccagctttttcgggttttacgacgccaatgaaactgtactggaaatggaagaacagttggtttacctgcgggactcatttgggctgaaaacgctactcgcacgaggtgccatcgtcagatgcccgatggcaggcatttctcatacagcttggcactcgaatcgcaccctttatgagacttgtattgaaccatggctgtcatag

SEQ ID NO: 198597 - DNA, 543 bp, Artificial Sequence
  Description of Artificial Sequence: Synthetic coding sequence
atgctgggcctgtggggccagcggctgcccgccgcctgggtgctgttgctgctgcctttcctgcctctgctgcttctggccgccccggccccgcaccgggaaagctacaagcctgtgatagtcgtgcatgggctcttcgacagcagctactctttccgccaccttcttgaatacattaatgaaacgcatcctggtactgtcgtgactgttcttgatctctttgatggacgggaaagcctgagaccactgtgggagcaggtgcaggggtttagggaggccgttgtgccaatcatggctaaagcgccccagggcgtccacctaatatgctactcacagggcggactggtgtgcagagccctcctgagtgtaatggatgatcacaacgtggactcctttataagcctgtcctctccacaaatgggccaatatggcgatactgattatcttaagtggctcttccccacttcaatgagaagcaatctgtaccggatttgctactctccctggggacaggagttctcaatttgtaactactggcattag

SEQ ID NO: 198598 - DNA, 543 bp, Artificial Sequence
  Description of Artificial Sequence: Synthetic coding sequence
atgctgggcctgtggggccagcggctgcccgccgcctgggtgctgctgctccttccttttctgccactgcttctactggccgcacccgctccacatcgtgagtcttataaacccgtgatcgttgttcacggtctcttcgactcctcctactcctttcgccatttgctggaatacatcaatgagacgcacccaggaactgtcgtgacagtactggacctgttcgatggtcgcgagagtctgaggcctctttgggagcaggtccagggcttccgtgaggccgttgtgcccattatggcaaaagctccgcaaggagtgcatcttatctgctatagccaagggggattagtctgtagggctttgctcagcgtaatggatgaccataacgtggattcctttatcagtctgagcagtccccagatgggacagtacggggataccgactatttaaagtggctctttccaactagcatgcgcagcaatttgtaccgtatctgttattctccttggggacaggaattctccatttgtaactactggcactag

SEQ ID NO: 198599 - DNA, 282 bp, Artificial Sequence
  Description of Artificial Sequence: Synthetic coding sequence
atgctgggcctgtggggccagcggctgcccgccgcctgggtgctgctcctgctgcccttcctgccgctgctactgttggcggctcctgcacctcacagggaatcttataaacctgtgatcgtagttcacggcttattcgatagctcctattcattccgccatctcttggaatacataaacgagggtgccttatgtgcaggcctgtgctttctgagttggatgattacaacttggatcctgagctctcccagcccactccatagatgggacagcatggagtag

SEQ ID NO: 198600 - DNA, 711 bp, Artificial Sequence
  Description of Artificial Sequence: Synthetic coding sequence
atgctgggcctgtggggccagcggctgcccgccgcctgggtgctgcttctcctgcccttcttacccttgctcctcctcgctgcaccagccccacaccgtgagagttacaagcctgtgattgtcgtacatggtctctttgattccagctacagcttccggcatctgttggaatacattaatgagacacatccagggacggtagttacggtgctggacctgttcgacggtcgcgagagcctgagacctttatgggaacaggtccagggatttcgtgaggccgtagtcccaattatggccaaagcaccacagggagttcaccttatctgctacagccaggggggattggtttgtagagctctgctatctgtgatggacgaccataacgtagatagctttatctcattatctagccctcagatgggacagtatggagataccgactaccttaagtggctgttccctacctccatgcgatcgaatctgtataggatctgttacagtccttggggacaagaattctcaatttgcaattactggcacgatccacaccatgacgacctctatttgaacgcgtccagcttcctggcgctgatcaatggtgagagggaccaccccaacgccacagtgtggaggaagaactttctcagagtgggacatctggtgttaattggagggcctgacgatggggttataaccccttggcagtcctag

SEQ ID NO: 198601 - DNA, 165 bp, Artificial Sequence
  Description of Artificial Sequence: Synthetic coding sequence
tgacacgacgacctgtacctgaacgccagcagcttcctggccctgatcaatggagagagggaccacccaaatgctacggtatggcgtaagaatttcctgcgggtgggccatcttgtgctgatcggtggccctgacgacggggtgattacgccatggcaaagttag

SEQ ID NO: 198602 - DNA, 711 bp, Artificial Sequence
  Description of Artificial Sequence: Synthetic coding sequence
atgctgggcctgtggggccagcggctgcccgccgcctgggtgctgctgctgctgcccttcctgcccctgctcctgttggccgccccggccccccaccgcgagtcctacaaaccagtaattgtcgtgcacggactgttcgattctagctattccttcagacatttgttggaatatattaatgagacccacccaggcactgtggtgactgtcctggacttgtttgacgggagggagtccttgcggccactgtgggagcaagtccaggggtttcgcgaggccgtcgtgcctataatggctaaagctccacagggtgtccacttaatttgctactctcagggcgggctggtgtgccgcgctctcctgtccgttatggatgaccacaacgtggattcatttataagcttgagttcaccacagatgggacagtatggagataccgattacttgaagtggctcttcccgaccagcatgagatcaaacctttatcgcatctgttactctccctggggccaagaattctccatttgcaattattggcatgacccacaccacgatgatttatacctgaacgcgagctcctttctggccctaataaacggagagcgcgatcaccctaatgcgaccgtctggaggaaaaattttctcagagtagggcacctggttctgattggcggacccgacgatggtgtcatcacaccatggcagagttag

SEQ ID NO: 198603 - DNA, 909 bp, Artificial Sequence
  Description of Artificial Sequence: Synthetic coding sequence
atgctgggcctgtggggccagcggctgcccgccgcctgggtgctgttactgctcccgtttcttccactgctgctgctggctgcgccagcaccccatagagccagttacaagcctgtaatcgttgtgcatgggttgttcgacagtagttactccttccgccacctgttggagtatatcaacgagacccacccaggtacagttgtaacggtgctggacctcttcgatggtcgtgagagtctaaggccactctgggagcaggtgcaaggattcagggaagctgttgtgccaatcatggctaaagcccctcagggtgttcacctgatttgttactcccaaggggggttagtgtgtagagctctgttgagtgtgatggatgaccacaatgtcgacagcttcatctccctttcaagcccacaaatggggcagtatggagataccgactacttgaaatggttattccctacctcaatgaggtctaatctttaccggatctgttatagtccgtgggggcaggaatttagcatatgcaattactggcatgatccacaccacgacgatctctatctgaacgccagttctttcctcgccctgatcaacggtgagagagatcatccaaacgccacagtgtggcgcaagaactttctacgcgtgggccacctggtgctcatcggtggaccggacgacggagttatcaccccttggcagtcatcttttttcggcttctatgatgccaacgagacggttctcgagatggaagagcagcttgtttacctgcgtgacagtttcggactgaagacactcttggcgagaggggcaattgtgcgctgtcctatggctggcatctcacacactgcatggcattcaaaccgaacgttgtacgagacgtgcattgaaccttggctgagctag

SEQ ID NO: 198604 - DNA, 909 bp, Artificial Sequence
  Description of Artificial Sequence: Synthetic coding sequence
atgctgggcctgtggggccagcggctgcccgccgcctgggtgctgttgcttctgcccttcctgcctcttttgcttctggctgctcctgccccacatcgagcctcctacaaacctgtgatcgtggtgcatggcctgtttgactctagctactcatttaggcatctgctggaatacataaacgaaacacaccccgggaccgtggtgactgtgctcgatctcttcgacggccgggaatctctccggcccttgtgggagcaggtacagggattcagggaagctgtggtccctatcatggccaaagcacctcagggcgtgcatctaatctgctactcccagggaggcctcgtctgtcgcgctctcctcagtgttatggatgatcataatgtcgacagcttcataagcctgtctagcccacaaatgggtcagtacggggataccgactatttaaagtggctgtttcctacaagcatgcgatcaaatctctacaggatctgctatagtccatgggggcaggaatttagcatttgcaactattggcatgacccgcaccacgacgacctttacctgaacgccagcagtttccttgctctcattaacggagagagggaccaccctaacgccacggtctggagaaagaactttctgagagtcgggcacttagtactgataggaggccctgacgatggagtaatcacaccatggcagtcttcatttttcggcttttacgacgccaatgagaccgtgctggagatggaggaacagctggtgtacctgcgcgattccttcggactcaaaacacttctggcccggggtgctatagtccggtgtccaatggccgggattagccacactgcatggcattcgaaccggacactttacgagacgtgtatcgaaccttggttgagttag

SEQ ID NO: 198605 - DNA, 909 bp, Artificial Sequence
  Description of Artificial Sequence: Synthetic coding sequence
atgctgggcctgtggggccagcggctgcccgccgcctgggtgctgctgctgcttcctttcttgcccctgctgctattggcagctcccgccccacacagggcgagctacaaacctgtgatagtggtgcacggtttgtttgatagcagctacagcttccgtcatttgttagagtacatcaacgagacacacccaggaacggtcgtcacggttctagacctcttcgacgggagagagagtctgagacccttgtgggaacaggtacagggatttcgtgaggctgtggtaccaattatggcaaaagctccccaaggcgtccatttgatttgttactcgcaggggggcctcgtttgtcgcgcactcctttcagttatggatgaccataacgtcgacagcttcatttcactgtcttctccccaaatgggtcagtacggagacacggattacctaaagtggctgttccctacttcgatgaggagtaacctctataggatttgttactctccttggggacaggaattttctatttgcaactactggcatgacccacatcacgacgatttgtatctgaatgcctccagctttcttgcactcatcaacggagagcgcgaccaccccaatgcaactgtgtggcgtaagaacttcctgcgagtcggacatttagtgttaatcggcggtcctgacgatggcgtgatcactccgtggcagtcctcctttttcggattctatgacgcaaatgaaactgtgctagaaatggaggagcaactggtctatctccgtgatagcttcgggctgaagacccttctcgcacggggcgcaattgtgagatgccctatggctggcatttctcataccgcatggcacagcaaccgcaccttgtacgaaacctgtatcgaaccgtggctctcttag

SEQ ID NO: 198606 - DNA, 441 bp, Artificial Sequence
  Description of Artificial Sequence: Synthetic coding sequence
atggacgaccacaacgtggacagcttcatcagcctgagcagcccccagatggggcagtatggagatactgactacctgaagtggttgtttccaacctcaatgcggagcaatttgtatcggatctgttatagtccctggggccaagaattcagcatctgtaattattggcatgaccctcaccacgatgacctgtacctgaacgcctccagtttcctcgcactaatcaatggcgaaagagaccaccctaacgctacggtgtggaggaagaacttcttgcgtgtcggtcacctcgtgctcattggaggaccagatgacggtgtgatcacaccgtggcagagtagtttctttggattctacgacgcaaacgaaaccgtgctggagatggaagagcagcttccggtgggcagctctgtgaaggctaatcatggcgtgcaggggtag

SEQ ID NO: 198607 - DNA, 927 bp, Artificial Sequence
  Description of Artificial Sequence: Synthetic coding sequence
atgaagagctgcggcagcatgctgggcctgtggggccagcggctgcccgccgcctgggtgctgctgctactacctttcctgccattgctcctgctggcagcccctgcgccccacagggccagctataagccagtgattgtggtacacggcttgttcgatagctcttactcattccgccatttattagaatatattaacgagacccatcctgggactgtggtgactgtgctggacttattcgacggcagggagagcttacgaccgctctgggagcaggtgcagggcttccgggaagcggtggtaccaatcatggccaaggcgccacagggtgtgcacctgatctgctactcacagggcgggctcgtgtgtcgagcgctgctgagcgtcatggacgaccacaatgtggattcattcatcagcttgtcttctccacagatgggacagtacggtgatactgactacctgaaatggctgttccccactagcatgagaagcaacctgtataggatttgttactccccatggggccaagagttttctatctgtaactactggcatgatccgcaccacgacgacctctacctgaacgcctctagttttctggctctgatcaacggggagcgggaccatccgaacgcgacagtatggcgaaaaaacttcttgcgggtgggacatcttgtgctgattggtgggcctgacgatggcgtgatcacgccctggcagagcagtttcttcggcttttacgacgccaatgagacagtgttggagatggaggaacagctggtttaccttagggacagttttggcctcaagacccttcttgcaagaggcgccatcgttagatgtcccatggccggtattagccatacagcatggcatagtaataggaccctttacgaaacctgtattgagccatggctttcctag

SEQ ID NO: 198608 - DNA, 882 bp, Artificial Sequence
  Description of Artificial Sequence: Synthetic coding sequence
atgggcagccgggccgagctgtgcaccctgctgggcggcttcagcttcctactgttattgataccgggagaaggtgctaaagggggttctttgcgggagtcccaaggggtgtgtagcaagcagacattggttgtccccctccactacaatgagagttacagtcagcctgtctacaaaccttacctcaccctgtgcgctgggcggcgtatatgttcaacgtatagaacaatgtatcgcgtgatgtggagagaagttcgcagagaagtccagcaaacccatgctgtgtgctgtcaggggtggaagaaacggcatccaggtgctttgacatgtgaagccatatgtgctaagccgtgcctcaacggcggagtgtgcgttcggccagaccagtgcgagtgtgcccccgggtgggggggcaagcactgccacgtggatgtcgacgagtgtagaacctcaattactttgtgcagtcaccattgtttcaacacagctggctccttcacgtgcggttgtccgcacgacctggttctgggtgtcgacggtcgcacttgcatggaaggaagtcccgagcccccgacctctgcgagtattttgagcgtggcggtcagggaagcagagaaggatgaaagagcccttaagcaagagattcacgagttacgtgggaggcttgagagactggaacagtgggccgggcaggcgggtgcctgggtgcgggctgtgttaccggtgccacctgaggagctccagcccgagcaggtcgccgagttgtggggcaggggcgaccgaatcgagtctctttccgatcaggtgctcctcctcgaagagagattaggggcatgtagttgcgaggacaactcgctcggattaggggtgaatcataggtag

SEQ ID NO: 198609 - DNA, 906 bp, Artificial Sequence
  Description of Artificial Sequence: Synthetic coding sequence
atgctgggcctgtggggccagcggctgcccgccgcctgggtgctgctgctgctccccttccttcccctgctgttgctcgccgcccccgctccacacagagcatcttataaacctgttatcgtggtccatgggctcttcgacagtagttattcattcaggcatctcctggaatacattaacgagactcaccccggtacagtagtgacggtgttagatttatttgacggcagggagagcctgaggcccctgtgggaacaggtgcaaggcttcagagaggccgtggttcctataatggctaaggcaccccagggggtgcatctcatctgctatagccaagggggactcgtctgcagggcccttctgagtgtgatggacgaccataatgtcgactcattcatttctctctcttctccacagatgggtcagtatggtgacacagactaccttaagtggttatttccaacgagtatgcgaagcaacctttatcgaatctgttacagtccctggggccaggaattttcgatttgcaactattggcacgacccccaccacgatgacctatacctgaatgcctcctcctttttagctcttattaacggtgagagagatcaccctaatgccaccgtatggcggaagaacttcctccgggtgggccacctcgtattaatcggcgggccagacgacggcgtgattacaccttggcagagcagttttttcggtttctatgacgctaatgaaaccgtgctggaaatggaagaacagctgcccgcccgacctacacaccaaagcgagctgctgctgttaaggctggtctgtctgaagccgccacgccgcaaaaagccagcttgccgagttcagcgtcagtccgagtcatggggcccaggactgtcttgtgccctcagttag

SEQ ID NO: 198610 - DNA, 909 bp, Artificial Sequence
  Description of Artificial Sequence: Synthetic coding sequence
atgctgggcctgtggggccagcggctgcccgccgcctgggtgctgttactcctgccttttctgcctctccttttattagcggctccagctcctcatagagaatcttataaaccagtgatagttgtgcacggcctgtttgattcctcttacagcttccgacatctgctcgagtatattaacgaaactcatccaggcacggtggtaacagtccttgatctcttcgatgggcgcgaatcccttcggcctctgtgggagcaagtccaagggtttagagaggccgtcgttccaatcatggcaaaggctcctcaaggtgtccacctgatctgctattctcaaggcgggctcgtttgcagagccctgctgtctgtcatggatgatcataatgttgactcctttatatcactgagttcacctcagatgggccaatacggggataccgattacctgaaatggctgtttccgacaagtatgcgctctaatctgtaccgtatttgctattcaccctggggacaagagtttagcatatgcaactactggcatgacccgcaccacgacgacctctacctgaacgcgagctcctttcttgctctaattaatggcgaaagggaccatcctaatgccaccgtgtggcggaagaattttttgcgggtgggccatctggtactaataggcggccctgacgacggagtcatcaccccctggcagagtagcttttttggtttttacgatgccaacgagaccgtgttggagatggaggagcagctcgtgtacctgcgcgatagtttcggcctgaagacattgctggctcggggggccatcgtgcgttgtcctatggccggcattagccacacagcatggcactctaataggaccctgtacgagacctgcatcgagccgtggctcagctag

SEQ ID NO: 198611 - DNA, 441 bp, Artificial Sequence
  Description of Artificial Sequence: Synthetic coding sequence
atggacgaccacaacgtggacagcttcatcagcctgagcagcccccagatgggtcagtacggagacactgactacctcaaatggttattccccacatccatgaggtccaatttgtaccggatctgttattcaccctggggacaggaatttagcatatgtaactactggcacgatcctcatcacgatgatctctatttgaacgcaagtagtttcttggccttaatcaatggcgagcgggaccatcctaacgctacagtctggaggaagaattttctgagggtggggcatctggtcctcattggagggccggatgacggcgtcatcaccccctggcagagctcatttttcggtttttacgacgccaatgagaccgtgttggaaatggaagagcagctgccggtgggctcatctgtgaaggccaatcatggcgtgcagggatag

SEQ ID NO: 198612 - DNA, 882 bp, Artificial Sequence
  Description of Artificial Sequence: Synthetic coding sequence
atgggcagccgggccgagctgtgcaccctgctgggcggcttcagcttcttacttttgttgattccgggggaaggtgcaaagggtggaagcctacgggagtcgcagggggtttgtagtaagcaaacattagtggtcccactccactataatgaatcttattctcagccagtctacaagccttacctcactctgtgtgccggtagacggatctgcagtacataccggactatgtaccgagtcatgtggagagaagtccgccgggaggtccagcagactcacgcagtgtgttgccaaggctggaagaagcgccaccccggagcactgacttgtgaagccatctgcgccaaaccgtgccttaatggtggggtatgcgtgaggcccgaccaatgtgagtgtgcaccaggatggggagggaagcactgccacgtggatgtggatgaatgtcggacgtcaattacgctctgttcacatcattgtttcaacacagccggatcattcacctgcggctgccctcatgacctggttctcggtgtggatggtcgcacctgcatggagggaagcccagagcctccaacctcagctagcatcttaagcgtggcagtgcgggaagccgagaaggacgagagagccctcaagcaggaaatccatgaattgcgcggccgattggagcgcctcgagcagtgggccggccaagctggtgcttgggtgcgcgccgtactgccagtgccccccgaggagttacaacccgaacaagttgccgagttgtgggggagaggcgaccgtattgagagcctgtctgatcaggtactgcttctggaagaacgactcggcgcatgttcttgcgaagacaattccctggggctgggagtcaaccatcggtag

SEQ ID NO: 198613 - DNA, 906 bp, Artificial Sequence
  Description of Artificial Sequence: Synthetic coding sequence
atgctgggcctgtggggccagcggctgcccgccgcctgggtgctgttgcttctgccctttcttccattactattactagctgcgcctgccccacatcgagcaagctataagcctgttattgtcgtgcatggtctctttgattctagttactcctttaggcacttattagagtacattaacgaaacacaccctggcacagtcgtaacagtcttggatttatttgacgggagagaatctctgagaccactgtgggaacaagtgcaggggttccgcgaggcagtcgtccctatcatggccaaagcccctcaaggggtgcaccttatatgctactcgcaggggggactcgtttgtcgggctctcctgagcgtaatggatgatcacaatgtggatagctttatcagcttgagcagccctcagatgggccagtacggagataccgactatcttaaatggctgtttcctacttccatgagaagcaacctgtataggatttgttactctccgtggggacaggaattctccatctgtaactattggcacgacccccatcacgatgatctgtatctgaatgcttcttcctttctggcactgattaacggggagagagatcaccctaacgcaacggtatggagaaagaactttttgcgcgtaggccatctcgtgctgatcgggggccctgacgacggagtgattaccccgtggcaaagctctttctttggcttctacgacgcgaacgaaactgtcctcgaaatggaagaacaactcccggcaaggccaacacatcagagcgaactgctacttctgcgactggtgtgcctgaagcctcccaggagaaagaaacccgcttgtcgcgtgcagagacagagtgagagctggggacccggcttaagctgtgcattaagttag

SEQ ID NO: 198614 - DNA, 441 bp, Artificial Sequence
  Description of Artificial Sequence: Synthetic coding sequence
atggacgaccacaacgtggacagcttcatcagcctgagcagcccccagatgggacagtatggcgacaccgattatctcaagtggctgtttcccactagcatgaggtcgaatctttatcgcatctgctacagcccatggggacaggaattctccatttgtaactactggcatgatccacaccacgacgatctttatttgaatgcatcctctttcctggctctgattaatggcgaacgggatcaccctaatgctaccgtgtggcgtaagaatttcctgagagtggggcatcttgtactgataggtggtcccgatgatggcgttattaccccttggcaatcaagttttttcggcttttacgatgctaacgaaactgtgctggagatggaagaacaactgccagtaggatcatccgtgaaggccaatcacggcgtgcagggctag

SEQ ID NO: 198615 - DNA, 906 bp, Artificial Sequence
  Description of Artificial Sequence: Synthetic coding sequence
atgctgggcctgtggggccagcggctgcccgccgcctgggtgctgctgttgctcccgttcttaccactgctcctgctcgcagcaccagcaccccatagagcctcttacaaaccagtaattgtggtgcatggcctctttgatagctcctatagctttagacatttactggagtacatcaatgagacccacccaggaactgttgttaccgttctggatctgttcgatggtcgggagagcctgaggcctctgtgggagcaggtgcaggggtttcgggaggccgtggtaccaatcatggccaaagcccctcagggtgtgcacctgatttgttacagccagggggggctggtttgtagggcgctcctgtcggtaatggacgatcataatgtggacagcttcatcagcctctcaagtccgcagatggggcagtacggtgataccgactatctgaaatggcttttccccaccagcatgcgctccaacctttatcgtatctgctattctccatggggacaggaatttagcatttgtaattactggcatgacccccaccatgacgatttatatctgaacgccagttcatttcttgctctgattaacggggagagggatcatcccaacgccacagtttggagaaagaatttccttagggtggggcatctcgtgcttatagggggtcccgatgacggcgtaattacaccctggcagtcctcgttctttgggttttacgacgccaatgagacagtacttgaaatggaagaacaactgccagccagacccacacaccagtctgagctgctcctgcttagactggtttgtttgaagccacctcgccggaaaaagcccgcctgcagagtccaacggcagtctgagagctgggggcccggactgagctgcgcattatcctag

SEQ ID NO: 198616 - DNA, 441 bp, Artificial Sequence
  Description of Artificial Sequence: Synthetic coding sequence
atggacgaccacaacgtggacagcttcatcagcctgagcagcccccaaatgggtcaatatggtgacacggactatttaaaatggctgttccccacaagtatgcgatctaacctttataggatctgttacagtccctggggacaggagttctcaatttgcaactactggcacgatccccaccatgatgatctctatctgaacgcaagttcctttctggcactgatcaacggcgaaagggatcatccgaatgcaaccgtgtggcggaagaacttcctgagagtgggtcatctcgtcctcataggcggacctgatgatggggtgatcaccccttggcaaagtagcttctttggcttctacgacgccaatgagaccgttctcgagatggaagagcagctgccagtggggtcgagcgtgaaggcaaaccacggggtgcagggctag

SEQ ID NO: 198617 - DNA, 882 bp, Artificial Sequence
  Description of Artificial Sequence: Synthetic coding sequence
atgggcagccgggccgagctgtgcaccctgctgggcggcttcagcttcttactgcttctaatccctggagaaggagcaaaaggggggagcctgagagaatcacagggcgtgtgctccaagcaaacactggtggtgcctttgcactacaatgagagctatagccagcccgtgtataaaccctatctcacgctgtgcgcgggccggcgcatttgctctacctaccgcaccatgtatagagtgatgtggagagaagttcgccgggaggttcaacagacccatgccgtgtgctgccagggatggaaaaagagacacccaggagccttaacctgtgaggccatttgtgctaagccttgtctgaacgggggtgtctgcgttcggcccgaccagtgtgagtgcgccccaggatggggaggtaaacactgccacgtggatgtagatgagtgtagaacatctattacactctgttcccaccactgctttaatacggctggctctttcacctgtgggtgtccacatgatctggtattgggggtggatgggcgcacctgtatggaggggtcccctgagccccccacctctgcatcaatcctaagtgtggcggttcgcgaggccgagaaggacgagcgggccctcaaacaagagatacatgagctgcgcggtcggctggaacgcctggaacagtgggccggacaggccggagcatgggtgcgagcagttttgcccgtccctcccgaggagctccagccagagcaggtggctgaactgtggggccgaggagatcggatcgagtccctcagtgaccaggttctgctgctcgaggaaaggctgggagcatgcagctgcgaagacaactcgctagggctgggggtgaatcatagatag

SEQ ID NO: 198618 - DNA, 882 bp, Artificial Sequence
  Description of Artificial Sequence: Synthetic coding sequence
atgggcagccgggccgagctgtgcaccctgctgggcggcttcagctttctgctattgttgatccccggcgagggcgcaaagggcggctccctcagggagagccagggggtgtgttccaagcagaccctcgtggtccccctgcattataatgagtcctattcccagccagtctacaagccctacctgaccttgtgcgctggcaggcgtatctgctcgacatacaggaccatgtacagagtaatgtggcgagaggtgaggcgggaagtgcagcagacacatgccgtgtgttgccagggatggaaaaaacggcaccctggggcactgacttgtgaagccatctgcgcaaagccttgccttaacggcggcgtttgtgtaaggcctgatcagtgtgagtgcgcgcccggttggggagggaaacattgtcacgtggatgtcgacgaatgccgtaccagtatcactctttgcagccaccattgttttaataccgccggcagcttcacatgtggctgtccacacgacctggtgttgggggttgatggcaggacctgcatggaggggagccccgaaccacctacctcagcgtccatcctgagcgtggccgtgcgggaagccgagaaagatgagagggcactgaagcaggagattcacgaactacgaggtcgcctggaaaggctcgagcagtgggcgggccaggctggggcttgggttagagcggttctgcctgtaccaccagaggagctgcagcccgagcaggtagccgagctttgggggaggggcgatagaatcgagtcgttgtccgatcaggtgctccttttggaggagcgcctgggggcctgctcctgcgaagataattccctcggcctcggcgtcaaccacaggtag

SEQ ID NO: 198619 - DNA, 909 bp, Artificial Sequence
  Description of Artificial Sequence: Synthetic coding sequence
atgctgggcctgtggggccagcggctgcccgccgcctgggtgctgctactactaccctttctgcccctcttgctactggccgccccggcaccacaccgcgcctcatacaaaccggtgatcgtggtacacgggttgtttgatagtagttatagttttcgacacctgttggagtatatcaacgagacccatcccggcaccgtggtgaccgtgctggatctgtttgacggccgggaatcacttagacccctgtgggagcaggtgcaggggtttcgggaggcggtggtacccatcatggctaaggccccacagggggtacacctcatctgctatagccagggtgggctggtctgtcgggccttgctttccgtcatggacgatcataatgttgacagctttatctccctgtctagcccgcaaatggggcagtatggggacactgactacctcaaatggttgttccctacctccatgagatcgaatttatatcgcatctgttactctccctggggccaggaattctctatttgcaactattggcacgacccccaccacgatgatctctacctgaatgctagttcctttctcgccctcatcaatggagaacgcgatcatccgaatgctaccgtatggcgcaagaacttcctgagggtaggacaccttgtgctaattggcgggcccgacgatggagtgatcaccccgtggcaatcaagctttttcgggttttacgacgctaatgaaaccgtcctggagatggaagagcagctggtgtatttgagggattcattcggcctcaaaacgcttttggctaggggcgctattgtgcgatgtccgatggcaggaataagtcatactgcctggcattccaatagaaccctgtacgaaacctgcattgagccttggttgagttag

SEQ ID NO: 198620 - DNA, 441 bp, Artificial Sequence
  Description of Artificial Sequence: Synthetic coding sequence
atggacgaccacaacgtggacagcttcatcagcctgagcagcccccagatggggcaatacggtgacaccgactacctgaagtggcttttccccacatctatgcgttctaacctgtatagaatttgctactcgccgtggggtcaagagttctccatatgcaattattggcacgatccccaccacgacgacctgtatctcaacgcaagttctttcctggctctgattaatggcgaaagggatcaccccaacgctaccgtttggcgcaagaactttctccgggtcggacatctagtgctcatcggcggccccgacgacggagtaatcacaccttggcagtccagtttcttcggattttatgacgcgaacgaaacagtcctggagatggaggagcagctcccagttggctctagtgtgaaggccaaccatggcgttcagggatag

SEQ ID NO: 198621 - DNA, 909 bp, Artificial Sequence
  Description of Artificial Sequence: Synthetic coding sequence
atgctgggcctgtggggccagcggctgcccgccgcctgggtgctgttgctcctccctttcctgcccctcctcctgcttgctgccccagctccgcacagggcctcctataagccagtaatcgtggtgcacggactatttgactcctcttatagctttagacatttgctggaatatatcaatgaaacccacccaggcaccgtggtcacagttctggatctatttgatggtcgcgagagcctgcggcccctctgggagcaagtgcagggcttccgggaagccgtggtgcccatcatggccaaggccccacagggggttcatctgatctgctatagccagggtgggctggtgtgtagagcgctgttaagcgtgatggacgatcacaacgtggacagtttcattagcttatcttccccacagatggggcaatatggcgataccgattaccttaaatggctgttccccacgtctatgcggtccaatctatacagaatttgttattcaccctggggccaagagtttagcatctgtaattattggcatgacccccatcacgatgatctgtacttgaacgccagctctttcctggcactgatcaacggagaaagggaccaccccaatgccactgtatggcgcaagaacttcctgcgcgtggggcaccttgtgttgattggggggcccgatgatggagtgataaccccgtggcagagctcctttttcggattctacgacgccaacgagactgttcttgaaatggaggaacaactagtatatcttcgcgactcttttgggcttaaaaccttgttggctcgaggtgcgattgtaagatgccctatggctgggatcagccacacagcctggcatagtaatagaaccttgtacgagacatgcatcgaaccatggttatcttag

SEQ ID NO: 198622 - DNA, 441 bp, Artificial Sequence
  Description of Artificial Sequence: Synthetic coding sequence
atggacgaccacaacgtggacagcttcatcagcctgagcagcccccagatgggccagtatggggacaccgattatcttaaatggttgtttccaacttcaatgcgtagcaacttataccgtatctgttattcaccttgggggcaggaattttccatatgcaactattggcacgacccccatcatgacgatctgtatctcaatgcctcgtcatttcttgctctgattaacggcgagagggaccatcccaacgctacagtctggcgaaaaaatttccttcgtgtgggtcacttagtgctcattggtggccccgacgacggcgtaattactccctggcagtcctccttttttggattttatgacgctaacgagactgtgctggagatggaagagcagttgccggttggcagctccgttaaggccaatcatggcgttcagggctag

SEQ ID NO: 198623 - DNA, 906 bp, Artificial Sequence
  Description of Artificial Sequence: Synthetic coding sequence
atgctgggcctgtggggccagcggctgcccgccgcctgggtgctgttgctcttaccattcttgccactgttgctcctcgctgcacccgccccccatagggccagctataaacccgtaattgtagtgcatgggctgtttgattctagctactccttccgccacctgttagaatacatcaacgagactcacccagggaccgtagtgactgttttagatctctttgacggtagggaatcactgcggcctctctgggaacaagtgcaaggattccgcgaagccgtcgttcccattatggcgaaggctcctcagggcgtccacctgatctgctatagtcaaggcggcctggtatgtcgggctttgctctccgtcatggatgaccacaatgtggactctttcatttccctttccagcccccaaatggggcagtacggtgataccgactacctcaagtggctctttccgacttccatgcgctccaacttgtaccgcatctgttacagcccctggggtcaagaattcagcatctgtaattactggcacgatccccaccatgacgacttgtatttaaatgcatcttcgtttttggctcttataaacggagagagagaccaccctaatgctactgtgtggaggaagaacttcctccgcgtagggcatttagtactgattggcggaccagatgacggcgttataaccccgtggcaaagcagttttttcggattctatgatgccaatgagaccgttctcgaaatggaagagcaattaccagctagacccacccatcagtcagagctgctactactcaggctggtctgtcttaaacccccgagacgaaagaagcctgcctgtagagtacagcggcagagcgagagctggggcccaggactgtcctgcgccttgtcctag

SEQ ID NO: 198624 - DNA, 906 bp, Artificial Sequence
  Description of Artificial Sequence: Synthetic coding sequence
atgctgggcctgtggggccagcggctgcccgccgcctgggtgctgctgctgctacccttcctgcccctcctgttgcttgcagcccctgccccacacagagaaagctacaaacccgttatagtggtgcatggactgttcgactcatcttattcctttaggcacctgctggagtacattaacgagacacacccgggaacggtggtcaccgtgcttgatctgtttgacgggcgggagtcacttagaccactgtgggagcaggtgcaaggcttcagggaggctgtggtgcctattatggctaaagcccctcagggtgtgcatctgatttgctacagccaaggtgggttggtctgtcgggctctcctgtctgttatggatgaccacaacgttgattctttcatctctttgtcatccccacaaatgggccagtatggcgacaccgactacctgaagtggctgttcccaacctccatgcgcagtaatctgtacaggatctgttatagtccctggggccaggagttcagcatctgtaattactggcatgacccccatcacgatgacctgtatctaaacgcttcctcttttctggcactgataaatggcgagcgcgatcaccctaacgccacggtctggcggaagaattttctgagggtcggccatctcgttctcatcggaggtcccgatgacggggtaattactccctggcagtcctcttttttcggattctacgacgccaatgagacagttctcgagatggaagaacagctgcctgctagaccaacacaccaaagcgaactactgctcctgcggttagtgtgtctgaagcctcccagacgaaagaaacctgcgtgtcgcgtccagaggcaatcagagagttggggccctggactgtcctgtgccctgagctag

SEQ ID NO: 198625 - DNA, 906 bp, Artificial Sequence
  Description of Artificial Sequence: Synthetic coding sequence
atgctgggcctgtggggccagcggctgcccgccgcctgggtgctgctgcttcttccatttttgcctctgcttctgctggctgcaccagcccctcaccgggcctcttataagcctgtcatcgtcgtgcacggactcttcgactcatcttatagctttaggcatctcttagaatacatcaacgagacccaccccggaaccgtggtcacggtattggacctctttgacggcagagaaagcctgaggcccctctgggagcaggtccagggctttagggaggccgtggtccctatcatggccaaagcaccacaaggcgtacatctcatttgttatagtcaagggggcctcgtgtgccgggctttgctgagtgtaatggatgatcataacgtggactccttcatctctctgtcatctccccagatgggacagtacggggatacagactacttgaaatggctcttccccacttctatgaggtctaacctgtatcggatctgttattctccttggggccaggaattcagcatttgcaactactggcacgatccccaccacgacgacctgtacttgaatgcatccagttttctggccctgattaatggagagcgggaccaccctaatgcaacagtgtggagaaaaaatttcctgagagttggccaccttgtgctaattggcgggccagatgatggcgttataacaccttggcagtcctccttttttggattttatgacgccaacgagacagtgctggagatggaagagcagctgccagcacggccgacacaccaatcagaactcctcctgctgagacttgtctgcttgaagccaccaagacgtaagaagccagcgtgcagggtgcaacgccaatctgaatcgtgggggcctgggttgtcatgcgccctctcctag

SEQ ID NO: 198626 - DNA, 909 bp, Artificial Sequence
  Description of Artificial Sequence: Synthetic coding sequence
atgctgggcctgtggggccagcggctgcccgccgcctgggtgctgctgctcctccccttcctgccgctcctgcttctggcggcaccggcaccccatagagcctcttacaagcctgtcatcgtggtccacggtctcttcgatagcagctattcttttagacaccttctggagtacattaacgaaacccatcccggcactgttgtaaccgtacttgacttgttcgatggccgcgagtccctcagaccactatgggagcaggtgcaaggatttagagaggcagtggttcctatcatggccaaggcacctcaaggtgttcatctgatctgctattcacagggcgggctcgtgtgtagggcattactgtcagtgatggacgatcacaacgtcgatagcttcattagtctttcgtcaccacagatgggccagtacggcgataccgactacctcaagtggctctttcctacctctatgcggtccaatctataccgcatctgttactccccttggggacaggagtttagcatttgtaactattggcatgatccccatcacgacgacctgtatttgaatgcttccagctttctcgcgctaatcaacggcgaaagggaccatcctaacgccaccgtttggcgcaaaaatttcctccgcgtgggacacctagtcctcattggcgggcctgacgacggggttattactccgtggcagtcttcattcttcggcttttatgacgctaacgagacagtcctggaaatggaggaacaactggtctatcttagagattcatttgggctgaaaacactgcttgcacgaggagccattgtacggtgcccaatggcaggcatcagtcataccgcttggcattcaaacagaactctctatgagacctgcatcgagccatggctttcttag

SEQ ID NO: 198627 - DNA, 3606 bp, Artificial Sequence
  Description of Artificial Sequence: Synthetic coding sequence
atgaacttcgagggcctggaccccggcctggccgagtacgcccccgcaatgcacagcgcactggacccggtgctggacgctcatctcaacccttcattgctgcagaacgtcgaacttgatccagaaggagtagcccttgaagcacttccagtgcaggagagtgtccatatcatggagggtgtgtattctgaacttcatagcgtggttgccgaggtaggagtgcctgtcagcgtgagccatttcgatctgcacgaggagatgctctgggttggatctcacggggggcatgccacaagcttctttggccctgctctggagaggtactcatcctttcaggtcaacgggtctgacgatatccgtcagatccagtccttggagaacggcatactcttcttaactaaaaataatctcaaatacatggcccgcggcggcctcattatctttgactatctgttggacgaaaatgaggatatgcactctttgctcttgaccgattcatctaccttgttggtgggaggactccagaaccatatcattgaaatcgatctcaacacggttcaggagacccaaaagtatgccgtcgagacccccggtgttacaatcatgaggcagaccaatagattcttcttttgtgggcacacctccggcaaggttagcttgcgtgacctgagaacattcaaggttgagcacgaatttgatgctttttccgggtcgctcagtgacttcgatgtacacggaaatctccttgctgcctgcggctttagttcccgactgactggactagcctgtgacaggtttctcaaagtatacgatctgagaatgatgcgcgccatcacccctcttcaggtacacgtggacccagcatttctgcgattcatcccaacctacacctcaagactggcgatcatcagtcaatctgggcaatgccaattttgtgagccgactgggctagctaacccagctgacatatttcacgtcaacccagtgggccctctcctgatgaccttcgatgtaagcgccagcaaacaggctctcgcctttggggactctgaggggtgcgtccacctgtggaccgatagccccgaaccctcttttaacccgtattcccgcgaaaccgaatttgccctgccgtgcctagtggactctttgcctcccctcgactggagtcaagatctactcccactctcattgattccagtaccattgacaaccgatactctgctttccgactggcctgcagctaattccgcccctgccccccggcgggcaccgccagtagacgccgagatcctgcggaccatgaaaaaagttggcttcattggatatgctccaaatccacgcacacggctgcggaaccagattccctaccggctaaaggagtctgactccgaattcgacagcttctcccaggtgacagagtctcctgtgggaagggaggaagagccacatctacatatggtaagtaagaaatacagaaaggtcaccattaagtatagtaaactgggactggaagacttcgacttcaaacattacaacaaaaccttatttgctgggcttgagccacatatcccaaacgcctattgcaattgcatgatccaggttctgtacttcctggagcctgttcgctgcctcatccagaaccacctctgccaaaaagagttctgtctggcatgcgaactggggttcctgttccatatgctggatctctcacgaggcgatccgtgtcagggaaacaattttctcagagccttcagaacaatccctgaagcttcagcccttggactcattctggcagactccgatgaggctagtggcaaagggaacttggcaaggcttatccaacgctggaacaggttcatcctgacacagctccaccaagatatgcaagaactggagattccgcaggcctacagaggcgccggaggcagcttttgctcttctggcgacagcgtcattggacaacttttttcctgcgagatggagaattgctcattgtgtcggtgtgggtcggagaccgtccgcgccagttctacgctactgttcaccctctcatacccggatgggagcaaatcagacaagacaggcaagaactacgacttcgctcaagttctgaaacggtcaatttgcctagaccagaatactcaagcctggtgtgacacatgcgagaaatatcagcccacaatccagacccggaatatccgacatctccctgatatcctggtcatcaattgcgaggtaaatagctcgaaagaggctgatttttggcgcatgcaggctgaggtggcctttaagatggccgtcaagaagcatggcggggagatatctaagaataaggagttcgcgctagccgactggaaggagcttggcagccccgagggagtgttggtgtgccctagcatagaagaattgaaaaatgtatggctacctttcagtatccggatgaaaatgacgaaaaacaagggcctcgacgtttgcaattggactgatggtgacgagatgcagtggggcccagctagggctgaagaagaacatggagtgtatgtctacgatttaatggccaccgtggtgcacatcctggactctagaaccggtgggtcactagtggcgcacatcaaagtgggtgagacataccatcagcggaaggagggtgtcacacaccagcaatggtatctctttaacgactttctcatcgagccgatcgacaagcacgaggctgtacaattcgacatgaactggaaagtccctgctatcctgtactacgtgaagcgcaatctcaactccaggtataacctaaatataaagaatcccatcgaggcctctgtgctactggccgaggccagcctggcgcgaaaacagagaaagactcataccaccttcatccccctcatgctaaatgagatgccccagatcggcgatttggtgggacttgatgccgaatttgttactcttaatgaggaggaagctgagctccggtcagatgggactaaatctacgatcaaacctagccagatgtctgtagcccgcattacatgtgtgcgggggcaaggacccaacgagggaatcccattcattgacgattatatttccacccaagaacaggtagtggactacctcactcagtactctggtattaagcccggagaccttgatgctaagatcagttcaaaacatctcacaaccctgaagtcaacatacttgaaactcagattccttatcgacatcggagtgaaatttgtggggcatgggctgcaaaaagattttcgcgttattaatctgatggtccctaaggatcaagtacttgacacggtgtacttattccacatgccaaggaaacgtatgatcagcttgagattcctggcctggtacttcctcgacctgaagatccagggcgagacgcacgatagtatcgaggacgcccggactgccctgcagttgtaccgaaagtatctcgagttgagcaaaaatggcactgagcccgaatcatttcataaggtcctgaagggactttacgagaagggcagaaaaatggattggaaagtcccagagccagagggacaaaccagtcccaagaatgcagccgttttctcttcagtcttggccttgtag

SEQ ID NO: 198628 - DNA, 3609 bp, Artificial Sequence
  Description of Artificial Sequence: Synthetic coding sequence
atgaacttcgagggcctggaccccggcctggccgagtacgcccccgcgatgcacagtgccttagatcctgttctggacgctcatttaaacccctctctgctccagaacgtggagcttgatccggagggcgtggccctggaagctctccccgtccaagagtccgtgcatatcatggaaggcgtctacagtgagctccactctgttgtcgctgaggtgggggtgcccgtttccgtatcacattttgatctacacgaagagatgctgtgggttggcagccacggcggccacgcaaccagcttctttgggcctgccttggaacgttatagctccttccaggtgaacggctcagatgacatccgacaaatacagagtctcgaaaatggcatcctatttttgacgaagaataatctcaaatatatggcacggggcgggctgataattttcgactacctgctggacgagaatgaggatatgcatagcctcttgctcaccgattctagcacacttctcgtgggtggcctgcagaaccatatcattgagatcgatctgaacaccgttcaggaaacccaaaagtacgccgtggaaacccccggcgtgactattatgaggcagacaaaccgattcttcttctgtggacacacatctggcaaagtttccctccgggatctgagaacattcaaggtagagcacgaattcgatgcattcagtggtagcttgagtgactttgacgtgcacggcaacctgctggctgcttgtggcttctcttccagacttacaggcttagcttgcgacaggttccttaaagtgtatgacctcagaatgatgcgagcaataacacctttgcaggtgcacgttgaccctgcgtttctgaggttcattcccacatataccagccgcctagcaatcatctcccagtctggacagtgccagttttgcgaaccaactggtcttgccaatcctgccgatattttccacgtgaacccagtagggcctttgctgatgacatttgacgtgagcgcatctaagcaggcgctggcatttggtgactctgaaggatgcgtccatctttggacagatagccccgagccatccttcaatccttacagcagagagactgagtttgcactcccctgtttggtggactcattgcccccactagactggtcccaggacctgcttccgctgtccctgattcctgtcccacttacaaccgacacgctgttgtccgactggcctgccgccaactcagcgccggcaccacgcagagctccacctgtagacgccgagattctgcggactatgaagaaagttggctttatcgggtatgcgccaaaccctcggactcgtcttagaaaccagataccgtacaggcttaaagaatctgactcggaattcgactccttctcccaggtcaccgaatctcccgtcgggcgcgaagaggaaccacacctgcatatggtgagtaagaaatacaggaaggttaccattaagtacagtaagctgggactcgaggactttgatttcaaacactacaacaagacactgtttgcaggtttagagcctcacatcccgaacgcatattgcaattgtatgattcaagttctctattttctggaaccagtacggtgtctcatccaaaatcacctttgtcaaaaggaattctgtctcgcttgcgagctgggtttcctgttccatatgctggatttatcacgcggggacccctgtcaggggaacaatttcctacgcgccttcagaacgatacctgaggcaagcgcccttggtcttattttggccgactcagacgaagcgtccggcaagggcaacctggctaggctgatccagcggtggaatcggtttattctgacacagttacatcaggatatgcaggagttagaaattccacaggcctaccgaggagctggcgggtcctctttctgtagctcaggtgacagtgtcatcgggcagctttttagttgtgagatggagaactgctctctgtgcagatgcggatctgaaaccgtgagagcttcaagcacgctgctgttcactctgagctatcctgacggttcgaagagtgacaaaacaggtaagaactacgatttcgcccaggtgctgaaaagatctatttgtctcgaccagaacacccaagcatggtgtgatacatgcgagaaatatcagccaactatccagacaaggaacatccgccatctccccgatattcttgtgattaactgcgaggttaacagctctaaggaggccgacttctggaggatgcaggcggaggtggcttttaagatggccgtcaagaagcatggaggggaaatcagcaagaacaaagaattcgcccttgccgactggaaagaactcggcagccctgagggagtgctggtctgcccctctatcgaagagttgaagaacgtgtggctgccattttctatcagaatgaagatgaccaaaaacaagggattggatgtgtgtaattggactgacggagatgagatgcagtggggccctgcaagggctgaggaagaacacggcgtctacgtatatgatcttatggctactgtggtgcatatccttgattcccgcactggcggatctcttgtggcccacatcaaagtgggggaaacctaccaccagagaaaagagggcgtgacccaccagcaatggtacctgttcaacgattttttaattgaacccatagataagcatgaggccgtgcagttcgacatgaactggaaagtgccagcgatcctctattacgtgaagcgcaatctcaactccaggtataatctcaacatcaagaaccctattgaagcctcagttcttctggccgaggcttccctcgcccgtaaacaacgcaaaacccataccacttttatacccctgatgcttaacgagatgcctcagatcggagatctggtgggcctggacgcagaattcgtcacacttaacgaggaagaagcggagcttcgctctgatgggaccaagagcacaataaagccctcacagatgtctgtagccaggattacttgcgtgcgaggccagggacccaacgagggtattccatttatcgatgactacatttctacccaggagcaagtagtggactatttgacccagtattctggaattaaacccggcgatcttgatgctaaaatcagttcaaaacaccttactacactgaaatctacctacctgaaactgagatttctgattgatatcggcgttaagttcgtggggcacgggctccagaaagactttagagtcatcaatttaatggtgccaaaggatcaagtactggacactgtatatctattccacatgccacgtaaacggatgatctctcttcgcttcctcgcatggtattttctggatctgaaaatccagggagagactcacgattcaatagaggatgcacgcaccgccttgcagctgtaccggaaatatctagaacttagtaaaaacgggacagagccggagagcttccataaggtgttgaaaggcttatatgagaagggccggaaaatggactggaaggtgcccgagccggagggccagacttcccccaagaatgcagccgtattcagttccgtgctggccttatag

SEQ ID NO: 198629 - DNA, 3597 bp, Artificial Sequence
  Description of Artificial Sequence: Synthetic coding sequence
atgaacttcgagggcctggaccccggcctggccgagtacgcccccgccatgcattccgctttagaccctgtactcgatgcccatctgaatccctctctcttacagaatgtggaattggaccccgaaggtgtagctctggaggctctcccagtgcaggagtctgttcacattatggaaggagtttactccgagttacactcagtcgtggcggaggtgggggtgcctgtttccgtaagtcacttcgacctgcacgaagagatgctatgggtgggtagccatgggggccacgccacatctttctttggtccagctctagaacggtactcgtcgtttcaggtcaacggaagtgacgacatccggcagatacagtccctagaaaacggcatcctgttcttgactaaaaataacctgaagtacatggctcggggcggtctgatcatctttgactatctcttggatgagaacgaagacatgcattcattgctgctgaccgacagtagtacacttcttgtgggagggctacagaatcacatcattgagattgatctgaacactgtccaggagacacagaagtatgcggtagaaacgcccggggtaaccattatgcggcagacaaataggttctttttctgtggccacacttcaggcaaggtgtccctgagggacttacgaacgtttaaagtcgaacatgaatttgatgctttcagcggctcgctgtccgatttcgatgtgcatggaaatctcttagccgcgtgtggttttagttcacggctaaccggtctggcctgcgataggtttctgaaggtctacgatcttcgtatgatgcgcgccataacgcccctgcaagttcacgtggatcctgcctttctccgctttattccgacatacacgtctcgactggctattatctcacagtccgggcagtgccaattctgtgaaccaactggcctggcgaatcccgccgatatcttccatgtcaatccagtaggcccactgctgatgacttttgacgtgagcgcctccaagcaggctctcgctttcggagattccgagggctgcgtgcatctctggaccgacagccctgagccatcatttaatccctatagccgcgagaccgagttcgcccttccctgtttagtggactctttgccgccactggattggagccaggatctactcccgctgtcactgatccccgtgcccctgaccacagacacgttactgtccgactggcctgccgcaaatagtgctcctgcacctagaagagcacctcccgtggacgccgagatcctgaggacaatgaagaaggtgggcttcatcggctacgcacccaatccgcgcacacgactgcggaaccagataccatacagactgaaagaatccgactccgaattcgactcattctcccaagtgaccgaatcccccgtcggcagagaggaggagccacacctgcacatggtgtccaagaaatatagaaaggtaacaatcaagtattctaagctgggcctggaagatttcgatttcaagcactacaataagacattatttgcaggcctggaaccccatatcccaaacgcctactgcaattgtatgatacaagtcctgtattttctcgaacctgtgagatgcctcatacaaaatcatttgtgccagaaggagttttgcctggcttgcgaactcggcttcctctttcatatgcttgacctgagcagaggcgacccctgtcagggaaacaacttcctgcgcgcctttagaactatacccgaagcaagtgcactgggtctgattcttgctgactccgatgaggcatccgggaaaggcaatctggcgagactaattcagaggtggaaccgctttattttgacacagttgcaccaagatatgcaagaacttgaaattccccaggcctaccgcggagctgggggatcttctttctgcagctctggcgactcagttattggacagctgttctcctgcgagatggagaactgcagtctgtgtaggtgtgggagtgaaacggtgcgagcctcttcaaccctgctgttcactctgtcttatcccgacgataaaacgggcaagaattatgacttcgctcaggttctgaaacgaagcatttgcctcgatcagaacacacaggcttggtgtgacacatgtgaaaagtaccagcccacaatccagacccggaatattagacacctccctgatattctcgtcattaattgcgaggtaaattcatccaaagaggcagacttttggaggatgcaggctgaggtcgcctttaagatggctgtgaaaaaacacgggggcgagatctcaaagaacaaagagttcgccctggcagattggaaggagttgggatctccagagggggtactggtgtgccccagcatcgaagagctcaagaacgtctggttacctttctctattcggatgaagatgacaaagaacaaaggtcttgatgtttgcaattggaccgacggggacgagatgcaatgggggcctgctcgggcagaggaggagcatggcgtttacgtgtatgatctgatggcaactgtagtccacatattggacagtcggactggcgggtcacttgtcgcacatatcaaagttggtgagacctaccaccagcggaaggaaggagtgacccaccagcagtggtacctatttaacgattttctgattgaacccattgacaaacacgaagctgtccagtttgacatgaactggaaggtacccgccattctctattatgtgaagcgtaacctcaacagcaggtataacctgaatatcaagaaccccatcgaggcttccgtcttactggccgaggccagcctggctcgtaaacagcgcaagacacacactacattcattccactgatgctcaacgaaatgccccagataggcgatctggtggggctggacgccgaatttgttacactcaacgaagaagaggctgaactgaggtcggacggcacaaagtccactatcaagccaagccagatgagcgtagctaggataacctgcgtgcgggggcagggcccaaacgaaggcatcccattcatagacgattatatctccacacaggagcaggttgtcgactatcttacccagtatagcggcattaaaccgggagatctggatgccaagatcagctccaaacatttgacaactctcaaatcaacttacctgaagctgcgcttcctcatcgatatcggcgtcaagtttgtaggacacggactacaaaaggactttagggtcattaatctgatggtaccaaaggaccaggtccttgacactgtgtacctgtttcacatgccgagaaagaggatgattagcctccgatttcttgcttggtacttcctcgatctgaagattcagggcgagacgcacgacagcatcgaggacgctaggactgcactacagctctacaggaaatacctcgagctgagcaaaaatggcactgagcctgagagttttcacaaagtcctgaagggattgtatgaaaaaggtcggaagatggactggaaggtgcccgaacctgagggacagacttcacctaaaaacgccgctgtgttttctagcgtgctggccctgtag

SEQ ID NO: 198630 - DNA, 3609 bp, Artificial Sequence
  Description of Artificial Sequence: Synthetic coding sequence
atgaacttcgagggcctggaccccggcctggccgagtacgcccccgcgatgcactcagctctggatcccgttctggatgcacacctaaaccccagcctcctgcagaatgtagagcttgacccggaaggggtggccctcgaagctttgccggtgcaggagtccgtccacattatggagggtgtatactccgagttacactccgtggtagcggaggtgggagtacctgtgagtgtgtcacacttcgatcttcatgaggagatgctgtgggtagggtctcatggaggtcacgctacgtccttctttggtccagctctggaacgttactcctcgttccaggtgaacggcagtgatgatatccgacaaatccagtctctggaaaatgggatcctcttcctgacaaaaaataaccttaagtatatggcccgcggtgggttgattatttttgattatctactggatgagaatgaggatatgcattctctgcttctgaccgacagctccacgcttcttgtaggcggactgcaaaatcacatcatcgagatcgacctcaacaccgtgcaagaaacacagaaatacgctgtcgaaaccccaggtgtgactattatgaggcaaactaacagattcttcttctgtggccatactagcggaaaagtaagtttgcgcgacctgaggaccttcaaggttgaacacgagtttgacgcattttccggctctctgagtgatttcgatgtgcacggtaacttattggcggcatgcggattttcctcccgtttaactggcttggcctgcgacaggtttctgaaagtctacgacctccggatgatgcgcgccattacgcctttgcaggtacacgtggacccagctttcctgcggttcattcccacttacactagtagactggccatcatctcacagagcgggcaatgtcagttctgtgagccaactggactcgcgaacccagcagacatctttcacgtgaatcctgttggcccgttgctgatgacctttgatgtgtctgcgtcgaaacaggcccttgcattcggagacagcgagggctgtgtgcatctgtggaccgacagcccagagccgtcttttaacccttactcgagggagacagagttcgcacttccatgcttggtggacagcctcccccctctggactggagccaggatctgctgccactgagcctgattccagtaccgctgaccaccgacacccttctgtctgactggccagccgccaactctgctccagctcccaggcgggctccaccagtggacgcggaaatattgaggactatgaaaaaggtggggttcatcggctatgcgcccaacccccggacgaggctgcgaaatcagatcccgtatcggctcaaagagtccgactctgagttcgactcattttctcaggttactgagagcccagtcggacgtgaagaagagccccacctgcacatggttagcaaaaagtaccggaaggtcaccatcaagtattcgaaactcggcctcgaggatttcgattttaagcactacaacaaaaccctgttcgcaggactggagccacacataccgaacgcctattgcaattgcatgattcaggtgctgtattttcttgagcctgtgcgatgtctcatccagaaccacctgtgtcaaaaagaattttgtcttgcatgtgaactagggtttctgttccatatgttagatttgagccgcggcgatccctgccaagggaataacttcctcagagcttttcgcacaatccccgaggcaagcgctttgggtctgattcttgccgactcagacgaagcttctgggaagggcaacttagcccggttgatccaacgctggaataggttcatcttaacccaactccatcaggacatgcaggagctggaaattccccaggcataccgcggagccggcgggtcttccttctgctccagtggcgacagcgttatcggacagctgttctcctgtgaaatggaaaactgctctctctgtcgctgtggatccgaaaccgtacgcgccagctcaacgctcctcttcacactttcatatccggacggctcaaagtcagacaaaactggcaaaaactacgactttgcccaggtcttgaagagaagcatttgtctggaccagaacacccaggcgtggtgcgatacctgtgagaagtaccagcctaccatacagacgaggaacattcgacaccttcctgatatcctggtcattaactgcgaggttaatagttctaaggaggccgacttttggcgcatgcaggccgaagtcgcttttaaaatggccgtgaaaaaacatggcggcgagatttcaaagaacaaggagttcgctctcgcagactggaaggagctgggcagtcctgagggggtacttgtgtgtccttcaattgaggagttgaaaaacgtttggctgcctttttccattcgcatgaaaatgactaaaaataaagggctggacgtgtgtaattggacagatggcgacgagatgcagtgggggccggcccgagccgaagaagagcacggcgtgtatgtgtacgacttaatggctactgttgtacacatcttggactcaagaactggtggatcgctggttgctcatatcaaggtgggagaaacatatcaccagaggaaagagggggtcactcatcaacagtggtatttgttcaacgattttctgatagaacccattgacaagcacgaggccgtccaattcgatatgaattggaaggtccctgccatcttatattatgtgaagcgcaatttaaattcgaggtataatctgaatattaagaaccccatcgaagccagcgtgctcttggctgaggcaagtctagcgaggaagcagcggaaaacccatactactttcattcctctaatgcttaacgagatgccacaaatcggtgacctcgtcggcctagatgctgagtttgtgacactgaacgaggaggaagcagagcttcgctcagacggcaccaagtcaaccatcaagccgtcacaaatgtctgttgctaggattacatgcgtgcgtggccaggggccaaatgaaggaattccgttcatagacgattatatctcaacgcaagaacaggtggttgactacctgactcagtattctggaattaaaccaggagacttggatgccaaaatctccagtaaacacctcacaaccctgaaatctacatacttgaagctccgctttctcatcgatattggggtgaagttcgtgggacacggcctccagaaggacttcagagtcataaatttaatggtgccaaaggatcaggtccttgatacagtgtatcttttccacatgccccggaagcgcatgatttcattacggtttctcgcttggtatttcctggatctgaaaattcagggtgaaactcatgattctatcgaagacgctcgtacagccctacaactgtaccgcaaatacctggagctgagcaagaatggaaccgagccagagagttttcataaggttcttaagggtctctacgagaaggggagaaagatggactggaaggtcccggagcccgagggacaaacttcaccaaagaacgccgcagtcttctcctctgtattagccttatag

SEQ ID NO: 198631 - DNA, 987 bp, Artificial Sequence
  Description of Artificial Sequence: Synthetic coding sequence
atggacgccgtgctgctggagcacttccccggcggcctggacgcctttccatcaagctattttgatgaggacgatttcttcaccgatcagtcaagtcgagaccccttggaggacggggatgagctcttggctgatgagcaagccgaagtggaattcctgtctcaccaactccatgagtattgttaccgagacggcgcctgtctgctcttacagccagctccgccagccgcccccctcgcccttgcaccaccatccagcggggggctgggagaacccgatgacggaggcggaggggggtactgctgcgagacaggggctccccccggtggtttcccttactctcctggcagccctcctagctgcctcgcgtatccatgtgctggagctgccgttctatctcccggcgctaggctgcgagggttgtccggcgccgccgcagccgctgcacggaggaggcgacgcgtcagatcagaggccgagctacaacaactcaggcaggcagcaaatgttcgtgagcgcagacgtatgcaatcaattaatgatgcgttcgagggtctccgcagccatattcctacactgccctacgagaagaggttatccaaggttgatacactcaggctcgctataggatatattaattttttatcagagctcgtgcaggctgaccttccactccgtggcggcggagcgggcggctgtggcggacccggaggtggaggcaggctcggtggtgattctccggggtcccaggctcagaaggttattatctgccaccgcggaactcgaagccctagcccctccgatcccgactacggcttgcccccattagccgggcatagccttagttggaccgacgagaaacagctcaaagaacaaaatataatacgcaccgcaaaggtgtggacacctgaggaccctagaaaactgaacagcaaatcgtcctttaataatatcgaaaacgagcccccatttgagttcgtgagctag

SEQ ID NO: 198632 - DNA, 852 bp, Artificial Sequence
  Description of Artificial Sequence: Synthetic coding sequence
atgaacggcgaggagcagtactacgccgccacccagctgtacaaggacccctgcgctttccagaggggccctgcacccgaattctccgccagcccccccgcctgtctgtacatgggcagacagccgccgccccccccccctcacccctttcccggcgcattgggggctcttgagcagggctccccacccgacatctctccatacgaagtgccacctttggccgacgatcccgctgttgctcatctgcatcaccacttgccagcacaacttgcgctgcctcacccgcctgctggtccgttccccgagggtgctgaacctggggttctggaagagcccaaccgagtccagttaccgtttccctggatgaagtcaaccaaggcgcacgcttggaaaggtcagtgggcagggggcgcctatgctgccgagcccgaggagaacaagagaacccgcaccgcttatacccgggcgcaacttcttgaactggagaaagagtttctcttcaacaagtacatatcacgtccccggagggtggagttggctgtcatgttgaacctgactgagcgtcacatcaagatctggttccagaacaggagaatgaaatggaaaaaggaagaggataaaaagcggggaggaggtactgccgtgggaggaggaggcgtggccgagcctgagcaggattgtgctgttacatcaggagaggagctgctagccctccccccaccgccaccaccagggggcgctgtccccccagctgctcccgttgccgctcgtgagggaagattacccccaggtctatcagcttcaccgcagcccagctcagtagctcctcgccgccctcaggagcccagatag

SEQ ID NO: 198633 - DNA, 1398 bp, Artificial Sequence
  Description of Artificial Sequence: Synthetic coding sequence
atgctgcccctgtggaccctgagcctgctgctgggcgccgtggccggtaaagaagtatgttatgagagactcgggtgttttagcgacgacagcccttggtctggaattaccgaacggcctctccacatcctcccgtggtcccccaaggacgttaatactagattcttgctttataccaatgaaaatccaaacaattttcaggaggtagctgcggactcttcgagtatctcaggttcaaattttaaaaccaataggaaaactaggtttattatacatggcttcatcgataagggtgaggagaattggctggcaaacgtctgcaagaacctgtttaaggtcgagtccgtgaattgcatctgtgtagattggaagggaggttctagaactggctatacgcaggcctctcagaacattaggatagtgggggctgaggtcgcttattttgtcgagttcttgcagtcagctttcggttattccccgagcaatgtccacgtgattgggcatagcctgggcgcacatgctgccggggaggcaggccgaagaaccaatggtacaattggcagaatcacaggtctggacccagccgagccctgttttcagggcacacccgagcttgtgcgcctggatccatccgatgccaaatttgtcgacgtcatccataccgatggggcgccaattgtacccaatctcggattcggcatgagccaggtagtgggtcacctcgatttctttccaaacggcggagtggaaatgccaggctgcaaaaagaatatcttgagccagatagtggatatcgacggtatctgggagggtacaagagactttgccgcctgcaaccacctgcgctcttacaagtattacaccgactccatagtgaatcccgatggtttcgcaggtttcccctgcgcgtcctataacgttttcacagcaaataagtgtttcccctgtccatctggggggtgtccccagatgggacactatgctgataggtacccgggtaagaccaacgacgtgggacagaagttttatctggacactggcgatgcgtcaaattttgctagatggcgctacaaagtctccgtgacgctctctggcaaaaaagtgaccgggcatattctggtgtctttgtttggcaacaagggaaacagcaaacagtatgagattttcaaaggcacccttaagcccgattccacacatagtaacgaattcgattccgatgtcgacgtgggggacctgcagatggtcaaattcatctggtataacaacgtaatcaaccctacactgccaagagtcggagcaagcaaaatcatagtcgagaccaacgtagggaaacagtttaacttctgctcaccagagacagttcgcgaagaggtgcttctcacactgactccttgttag

SEQ ID NO: 198634 - DNA, 3372 bp, Artificial Sequence
  Description of Artificial Sequence: Synthetic coding sequence
atgaacagccccaacgagagcgccgacggcatgagcggccgggagccaagcctggaaatcctgccccggacgtcacttcactccatccctgtgaccgtcgaggtcaagccggtccttccccgcgcgatgcctagctccatgggaggtggtgggggcgggtcaccctctcctgtcgagcttcggggtgccttggtaggcagcgtggaccctaccttgcgcgaacaacaattgcaacaggaactgctagcactgaaacagcagcagcagttgcagaagcagctgttatttgccgaatttcagaaacagcacgaccacctgacccgccagcacgaggtacagctgcagaagcacctgaagcagcagcaggagatgctggcagcaaagcagcaacaagaaatgttggcagccaagcgccagcaagaattggagcagcagcggcagcgggaacagcagcgacaggaggagttagaaaaacagagactggagcagcagttgctgatcctgcgcaacaaggagaagtccaaagaatccgcaattgctagcacagaagtgaagctcagactgcaagagttcttgctttctaagagtaaggagcccacccccgggggcttaaatcactctttaccacagcatcctaagtgttggggggcccatcacgcgtctcttgatcagtcctcaccacctcaatccggaccacccggcaccccaccgtcgtacaagctgccccttccaggcccatacgactctagggatgacttccccctcaggaaaacggccagcgagccgaacctgaaggtgcggagccgcctcaagcagaaggtcgccgagcgccggtcctcacctctacttagaagaaaagacgggactgtcatctccacatttaagaagagagccgttgagattaccggagccgggcccggtgccagcagtgtttgcaattccgcaccaggtagtggcccttcttctcccaatagctctcacagcacaattgctgagaatggttttacggggagtgtgccaaatattccaactgaaatgttgccccagcaccgcgccctgccccttgactcttcccctaatcaattcagtctctacacaagtccctcccttcctaacatttctctggggctacaggctacggtcacagtgacaaatagtcatctcaccgcttctcccaagctctctacacagcaggaggccgaacggcaagccttgcaatcgctaaggcagggaggaaccctgactggtaaatttatgagtacatcatcaatacccggctgtctgctcggggtcgccctggagggcgacggatcacctcacggtcacgcttccctgttacagcatgtgcttctcctcgagcaggcccggcagcagtctacactaatcgccgtcccgcttcacggacaatccccacttgtgacaggtgaacgcgtcgctacaagtatgcgcaccgtgggaaaactgccccgccaccgcccactcagtcggacgcagagttcccctctaccccagtcccctcaggcattgcagcagctagtgatgcagcaacagcatcaacagttcctcgagaagcagaaacagcagcaactccagttaggaaaaatcctgaccaagacgggggaactgccacgacagcccacaacacatccggaggagacggaggaggaacttacagagcagcaagaagttctcttgggcgagggggcgctcactatgccccgcgaggggtccactgaatccgaaagcacacaggaagatctggaagaagaggacgaggaagacgacggagaagaggaagaagattgcattcaggtcaaagacgaggagggggagtcgggagcagaggaaggacctgacctggaggagccgggagctggatacaagaagctcttctccgatgcccagcctctgcagcccttgcaagtctaccaggccccactatctttggcaactgtgccgcaccaggcactaggacgaacccagagctcgcctgccgcacctggtggcatgaaatccccgcccgaccagcctgttaaacacctgtttaccacaggcgtggtttatgacacctttatgcttaagcaccagtgtatgtgcggaaacacacacgtccaccctgaacacgctggacgaatccaatccatctggagccgtctccaagagaccggcctcctaagcaaatgtgagcgaattcgaggccgaaaggctacacttgatgagatccagaccgtccactccgagtaccatactctgctgtatggcacctctccccttaaccgccaaaagttggactcaaagaagcttctcggtcctatctctcagaagatgtatgctgtgctgccttgcggaggaataggagtggacagcgatactgtgtggaacgaaatgcattcgtcctccgctgtgcgcatggctgttgggtgtctgctcgagctcgcatttaaggtggcagcaggggaattgaaaaacggcttcgccatcatcaggccacctggccaccatgctgaagagtccactgcgatgggcttttgcttttttaatagcgtagcaattactgcaaagcttctacagcagaaattgaacgtgggcaaggtactgattgttgattgggatatccaccacggcaatggcacacagcaggcattttacaacgacccttcagtgctgtacatatcccttcaccgctatgacaacggtaacttcttccccggctccggcgcacccgaggaagtcgggggcggaccgggtgtcggctacaatgtgaatgtcgcatggaccggcggtgtggatcctccgatcggggatgtggagtaccttactgcctttaggactgtggtgatgcccattgcccacgagttcagcccagacgtcgttcttgtgtcagcagggtttgatgccgtcgaaggccatctgtctcccctggggggatactctgttacggcccgttgcttcggacatttaaccagacagctgatgacgttggccggaggccgcgtcgtgctggcactggagggaggccatgacctcacagcaatttgtgatgccagcgaagcttgtgtgagcgcccttctgtctgttgaattgcagcctctagatgaggcggtgttgcagcagaagcccaacattaacgctgttgctacgctagaaaaggtgatcgaaatccaatctaaacattggtcgtgtgtgcagaagtttgccgctggcctgggccgctccctacgggaggctcaggctggcgagacggaggaagccgagacggtctcagccatggccctattaagcgtaggcgcagagcaagcgcaggctgcggccgcccgggagcattcccctaggcccgcagaagagcctatggagcaggagccagccctctag

SEQ ID NO: 198635 - DNA, 1128 bp, Artificial Sequence
  Description of Artificial Sequence: Synthetic coding sequence
atgaacaccagccacctgctggccctgctgctgcccaagagcccccagggtgagaatagatctaaacccctggggacaccgtacaacttttccgagcactgccaggactctgtcgacgtgatggtgttcattgttacttcctattcgattgagaccgtggttggggtcttaggaaatctctgcctcatgtgcgtcactgtccggcagaaagaaaaggccaacgtgaccaatttgttaatagcaaacctcgccttctccgacttcctcatgtgtctgttatgccagccattaacagctgtgtacacaattatggactactggatttttggagagacgttatgcaagatgagtgcatttatccagtgtatgtctgtgaccgtgtccatccttagcctggtgctcgtggcgctggaacgacatcagctaattataaatcccaccggatggaagccatctattagtcaagcgtatctgggcatcgtgctgatatgggttattgcttgcgtcctgagcctgcccttcctggctaattcaatccttgagaacgtgtttcataaaaaccattctaaagccctggagtttctggctgacaaagtagtgtgcactgagagttggcccctggcccatcacagaaccatttataccacatttctactgctgtttcagtactgtctgccacttggctttatcctagtgtgctatgcccgcatttaccgcaggctccagcggcagggccgggttttccacaagggcacttactccttgcgagctggacacatgaagcaagttaatgttgtgctcgtcgtgatggtggtggcctttgctgtcctttggcttccactccatgtgttcaattcactggaagattggcaccacgaagcgattcccatttgccacggtaatttaattttcctagtctgccatcttcttgccatggcaagtacgtgtgttaacccatttatctacgggttccttaacacaaacttcaagaaggagatcaaggccctggttctcacctgccagcaaagcgcaccccttgaggagagcgaacacctgcccctgtccactgttcatacagaggtgtccaagggctctctgcggcttagcgggaggagcaaccccatttag

SEQ ID NO: 198636 - DNA, 1128 bp, Artificial Sequence
  Description of Artificial Sequence: Synthetic coding sequence
atgaacaccagccacctgctggccctgctgctgcccaagagcccccagggcgagaataggagcaagcctttgggcaccccctacaatttctctgagcactgccaggatagcgttgacgttatggtgtttatagttacgagttacagcatcgagactgtggtaggggtgttggggaatctctgtttgatgtgcgttacggtcaggcaaaaggagaaggccaatgttaccaatctgctgatagctaatctagctttcagtgacttcctgatgtgcctgctatgtcagcccttgactgccgtctacactatcatggattactggatctttggagagaccctctgtaaaatgagtgcttttatccagtgtatgtccgttaccgtgtccattctctccctggtgctcgtggcacttgaacggcaccagttgatcatcaacccaacaggttggaaacccagcatcagccaggcctatctgggcattgtcctgatatgggtgatcgcatgcgtgctttccttaccctttctggcaaacagcatcctggaaaacgtcttccacaaaaatcacagtaaggctttagagtttcttgccgacaaggtggtctgcacagaatcctggcccctagcccaccacagaacgatctataccacctttctcctgctcttccagtactgtcttcctcttggcttcatcctcgtctgctacgccaggatctatagaagactgcaaagacagggaagggtgttccacaaagggacttattccctgcgtgctggccacatgaagcaggttaacgtggttctcgtggtgatggtggttgctttcgccgtactgtggctgcctttgcatgtctttaattctttggaagactggcaccatgaggctattcccatctgtcacgggaacctgatttttttggtgtgccatctacttgctatggctagcacttgcgttaacccgtttatttacgggttcctcaatacaaactttaagaaggagatcaaagccttggttctcacctgccaacagtcagcccctctggaggaatctgagcacctgccgctaagtacagttcataccgaagtttccaaaggctcccttcggctgtcaggccgctctaacccaatctag

SEQ ID NO: 198637 - DNA, 1797 bp, Artificial Sequence
  Description of Artificial Sequence: Synthetic coding sequence
atgctgaagctggtgggcggcggcggcggccaggactgggcctgctcggtggccggtacttcactcggaggggaggaagctgcttttgaggtggcgcgcccaggggatcaaggcaaagccggagggggatctccgggatggggatgtgccggcattcctgactctgcacccggcgccggcgtgctgcaggccggggctgtcggccctgcccgaggcggccagggggccgaggaggtgggagagagcgctgggggcggagaggaaagacgggttcgccacccacaggccccggccctaaggttgttgaatcgtaagccacagggtgggagcggggagatcaaaacccctgaaaacgatttacagcggggacgactgagtcgtggtcccagaacagccccccccgcaccgggaatgggggatcggtcaggccagcaggagagatcggttccccactcgccgggcgcccctgttggcacctccgccgctgcagtcaacggcctcctgcacaacgggttccacccgccaccggtccagccaccacatgtgtgcagcaggggaccagtcggaggctccgacgccgcccctcaacggcttcctctgttgcccgagctacaaccgcagcctctgctgccccaacacgactccccagcaaaaaaatgtcgacttcgaaggcgcatggactccggcaggaaaaaccgccccccctttccatggtttggtatggacattggagggacactggtcaaattggtgtactttgagcccaaggatattactgccgaggaagagcaggaagaggtggaaaacttaaagagtattagaaaatatctgactagcaatacagcttacggaaagactggtattagggatgttcacctcgagctcaagaacctcaccatgtgcggacgcaaggggaatttacattttattaggttcccaagctgcgctatgcatcgatttattcaaatgggatctgaaaagaacttctcttccctgcataccacactatgcgcaactggcggtggtgccttcaaatttgaagaggattttcggatgatcgccgacttgcagctacataagctagacgagctggactgcctaatccaagggctgctgtacgtggactccgttgggtttaatggtaagccagaatgctattacttcgagaatcccactaatcccgagctctgccagaaaaagccatactgtctggacaatccctatcccatgcttctggtgaatatgggatccggggtttcaattctggccgtctatagtaaagataactataagcgggtcactggtacttctctcggcggtgggacttttctgggtctctgctgtcttctgacgggctgtgagactttcgaggaagcgcttgaaatggcagcaaaaggcgactccactaacgtggataaactggttaaggatatctacggcggagactacgagcgctttgggctccagggctcggccgttgcatcttcctttgggaatatgatgagcaaggagaaaagagatagtatctccaaggaggaccttgcacgcgccacactggtgacgataaccaacaatattggctcaattgctagaatgtgtgctctgaacgagaacatcgatcgggttgtttttgttggcaattttctaagaatcaacatggtgtctatgaaattactcgcctacgccatggatttttggagtaaaggccagctgaaagcattatttctagagcatgagggatattttggagctgtgggtgctttgttagagctgtttaagatgactgacgataagtag

SEQ ID NO: 198638 - DNA, 945 bp, Artificial Sequence
  Description of Artificial Sequence: Synthetic coding sequence
atgaagctgatcaacggcaagaagcagaccttcccctggttcggcatggacatcggcggcaccctcgtgaaattggtgtacttcgagcctaaagacataactgccgaggaagagcaggaagaggtcgaaaatcttaagagcattcggaagtatctgacgagcaacacagcctatggcaagactggcattagggatgtgcacctcgagctgaagaatctgacaatgtgcggacggaagggcaacctacatttcattcggttcccgagctgtgcaatgcaccgctttatccagatgggatcggagaagaatttttctagtctccacaccacactatgtgccaccggtggcggcgccttcaagttcgaagaagatttccgcatgatagctgacctgcaactgcacaaactcgatgaactggattgtctgattcagggcctcttatatgtggattctgtggggtttaacggcaagccagagtgttactatttcgaaaacccaacaaatcccgagctttgtcaaaagaagccatactgcctagacaacccttaccccatgttgttggtcaatatgggctcgggtgtgagtattctggccgtgtatagtaaggataattataagcgggtaaccggcactagcttcgggaatatgatgagcaaagagaaaagagattccataagcaaggaggatctggcgagagcaacactggtgactattacgaacaacatcggctccatcgccagaatgtgtgcgttaaatgaaaatatagaccgcgtggtttttgtaggcaattttctgaggattaatatggtgtccatgaagctcttagcttatgccatggatttttggtccaaaggccagctcaaagcgctgtttctcgaacacgagggctacttcggagctgtcggggctctcctcgaactttttaaaatgacggacgataagtag

SEQ ID NO: 198639 - DNA, 1122 bp, Artificial Sequence
  Description of Artificial Sequence: Synthetic coding sequence
atgaagctgatcaacggcaagaagcagaccttcccctggttcggcatggatataggaggcacattagtgaaattggtctatttcgaacccaaagatatcacggcggaggaagagcaggaggaggttgaaaacctcaagagcatacgaaagtacctgacatctaacaccgcttacggtaagacaggtatacgtgatgtccacctcgaactcaaaaatctgaccatgtgtggtcggaaaggaaacctccatttcattaggttcccctcctgcgctatgcataggtttatccagatgggaagcgagaagaacttcagcagtctccacactacattatgcgccactggcggcggggcctttaagtttgaggaagatttccgaatgatcgcagacctccagctccacaaacttgatgagttggactgcctgatccaggggctcctgtatgtagattcagtggggtttaatggaaaaccagagtgctattacttcgagaaccccactaatcccgaattgtgccagaagaaaccgtattgtctggataacccctacccaatgctccttgtgaacatgggttccggagtcagcatattagccgtatactccaaggataattataaacgtgtgaccggcaccagcctaggcggaggtacatttttgggcctgtgttgtctcttgacgggctgtgagaccttcgaagaagccctcgaaatggcggctaaaggtgactccacaaatgtggataaactcgtgaaagacatatatgggggggactatgagaggttcggcctgcagggaagtgccgttgcctccagctttggaaacatgatgagtaaggagaaacgggattccattagcaaggaagatcttgccagagctacccttgtgaccatcacaaataacataggctctattgctcggatgtgcgccttaaatgagaatatcgaccgcgttgtatttgtaggaaattttctgcggatcaatatggtttctatgaagctgctggcctacgccatggatttttggagcaaaggtcagctgaaagccctgtttttggagcatgagggatatttcggcgccgtaggggcactcctcgagctgtttaaaatgaccgacgataaatag

SEQ ID NO: 198640 - DNA, 1203 bp, Artificial Sequence
  Description of Artificial Sequence: Synthetic coding sequence
atggccaagagcaagcacgccctgctgcccttctgccacggcatgatgcagcaggagggcctgcatcagatgcagtcccttgacctcggtttactctcgctgcagaattcattcccatggtttggcatggatattggcggcacgctggtcaaactggtctattttgagcccaaggacatcacagccgaagaagagcaagaagaggtggagaatttgaaatctatcaggaaatatcttacgtcgaacacggcttatggcaagaccggaattagagacgtgcatctcgagctgaagaacctcaccatgtgtggccggaaaggaaatttgcatttcattcgcttccccagctgcgctatgcacagatttatacagatgggatcagagaagaatttctcgtcacttcacacaacgttgtgcgctaccggggggggcgccttcaagttcgaagaagatttccgaatgattgcagacctgcaactgcacaagctggatgagttggactgcctgattcagggtttgctgtacgtggactccgtggggtttaacgggaaaccagaatgttattacttcgagaatcccaccaaccccgagctctgtcagaaaaaaccttattgtctcgacaacccttatccaatgcttctggtgaatatgggttcgggcgtctccattctggccgtgtactctaaagataattataagagggtgactgggacgagtttgggaggagggaccttcctgggtttgtgttgtctgcttaccggctgcgagacctttgaggaagcgctggaaatggccgctaagggcgactcaaccaatgtggacaaactggtgaaagacatctacggcggagactatgagagatttgggcttcagggttctgctgtggcaagtagtttcggtaatatgatgtcaaaggaaaagcgggactctatatctaaggaggacttggccagggcaaccttggtgaccattacaaataacattggctctattgcccgcatgtgcgctttgaatgaaaacatcgacagggttgtgtttgtggggaatttcttgcgcatcaacatggtttcgatgaagctgctggcatacgcaatggacttctggtcaaaaggccagctcaaagccctcttcctcgagcatgaggggtatttcggagctgtgggcgcactccttgaattgttcaaaatgaccgatgataaatag

SEQ ID NO: 198641 - DNA, 1386 bp, Artificial Sequence
  Description of Artificial Sequence: Synthetic coding sequence
atgggcgaccggagcggccagcaggagcggagcgtgccccacagccccggggcgccagtgggtacatcagcagcagccgtgaacggattgcttcacaacggatttcacccaccacccgtgcagccaccccatgtgtgctcacgcggcccagttgggggaagcgatgcagctccgcagagactgcctcttctgccagaattgcagccacagcctctgttgccacagcatgatagcccggccaagaagtgcagattgcgacgccgtatggattcaggcagaaagaataggcctcccttcccttggttcggaatggacatcggtggcactctggtgaaactggtctacttcgaaccaaaagatatcaccgctgaagaggaacaggaagaggtagaaaacctgaagtccattcgcaagtacctgacctccaacaccgcttacgggaaaaccgggatccgcgacgtgcacctcgaacttaaaaatttaactatgtgtgggagaaaaggaaacctgcatttcattagattcccctcctgcgcaatgcatagattcatccagatgggctccgagaagaattttagctctcttcataccactttgtgcgctaccggtggaggagcattcaaattcgaggaggactttcgtatgatagccgacctgcagctgcacaagctcgacgagctcgactgtctgattcagggcttactgtacgtggatagcgtgggtttcaatggtaaacccgagtgctattacttcgaaaatccaaccaaccccgaactctgtcagaaaaagccttattgcctggataatccatacccaatgctactggtgaatatgggttccggggtttccattctggctgtctacagcaaggataattacaaacgggtgaccgggacaagcctggggggaggtacattcctgggcttgtgttgccttctgaccggatgcgaaacatttgaggaggccttggagatggctgccaaaggtgacagcaccaacgtcgacaaactcgtgaaggatatttatggcggcgattacgagagattcggtctgcaaggtagcgctgtggcaagcagttttggaaacatgatgagtaaggagaaaagagactcaattagcaaggaggacctggcaagggccacattggtgacaattaccaataatatcggaagcatcgctaggatgtgtgcgctgaacgaaaatatcgatcgcgtcgtcttcgttgggaacttccttagaattaacatggtatctatgaagttgctggcctatgccatggatttttggtccaaggggcagctaaaggccttgtttttggagcatgagggttactttggagcggtcggcgccttgcttgagctgttcaaaatgaccgatgataagtag

SEQ ID NO: 198642 - DNA, 1713 bp, Artificial Sequence
  Description of Artificial Sequence: Synthetic coding sequence
atgcggcggctgggccccttccacccccgggtgcactgggccgcccctcccagcctgtcgtcaggactgcatcgtctgctgttcctcagaggtacacggatcccatctagtacaacactcagtcctccccggcatgattcactgagcctggatggtggcacagtgaatccaccacgggttcgggagcccactggtcgggaggccttcggaccctctcctgccagtagtgactggttgcctgcccgatggagaaacgggcggggcggtcgccccagggcccggctttgttccggctggactgccgccgaggaagcaagaagaaatcctacattgggagggcttctgggccggcagagactactccttagaatgggcggtggccgcttgggggccccaatggaaagacatggccgggccagtgcgacctccgtttctagtgccggggagcaggcagccggcgaccccgaaggaaggcgccaagaacccttaaggcgccgtgcttccagcgcctcagtgcctgccgttggcgctagcgccgaagggacacgccgcgaccgacttggctcttactcgggtcccacaagcgtcagtcgtcagcgtgttgaatctctgcggaaaaaacgtccactgttcccttggttcggtctcgatattggcggcacactggtgaagctggtctactttgaaccaaaggatatcacagctgaagaggaagaggaggaggtggaatcattgaagtctatcagaaagtatctgacttcaaatgtcgcctatggttcaactgggattagagacgtgcatcttgaattaaaggatctcaccctatgcggtagaaagggcaaccttcacttcattcgcttcccaacacacgatatgcccgcattcattcaaatgggccgggataagaacttcagctcattacacactgttttctgcgctactggggggggggcatacaaatttgaacaagattttttgactattggcgacctacaactttgcaaactggacgagcttgattgcttgattaagggtatactctacattgactccgtgggctttaatggtagaagtcaatgttattattttgaaaaccccgctgacagtgagaagtgtcagaagctgccatttgacctgaaaaacccctacccccttctgcttgtcaacataggctcaggcgtgtcaatactggctgtatatagcaaagataactacaagcgcgtgactggaacttcccttggcgggggcacttttttcggtctttgttgtctgttgaccggctgcactaccttcgaagaggctttggagatggcctcccggggcgactctaccaaggtagacaagctggtgcgcgatatttacggaggcgattacgagcgtttcggtctccctggatgggccgtcgcctcatcatttgggaacatgatgagtaaagagaagagagaagcggtttcaaaagaagatttggccagagctaccctgatcacaatcaccaataacatcgggagtattgctcggatgtgtgctctcaatgaaaatattaatcaagtcgtcttcgtggggaactttctccgaattaacacgatcgctatgcgtctgctggcatacgctctcgattactggtcaaaggggcaattgaaggccctgttttctgagcatgagggctacttcggggctgtcggggctctgctcgaactgctgaagattccttag

SEQ ID NO: 198643 - DNA, 1161 bp, Artificial Sequence
  Description of Artificial Sequence: Synthetic coding sequence
agcggccgggtgaaccccgccggcggcctgggctgcagcgagagcgggacttttggcggacctcccgctccaattgtcttcccctggttcggcctggatatcggaggcacccttgtcaagctggtgtatttcgaaccgaaagatataaccgcagaggaagaagaggaggaggtcgaatccctcaagagtatccggaaatacctcacctcgaatgtagcctatggctcaacaggcattagggacgttcatctcgagctcaaagacttaacactctgtggacgcaaaggcaatctgcactttattcgcttcccaacgcatgatatgcctgcattcatccagatggggcgggacaagaacttttctagcctgcataccgtgttttgtgcaaccggcgggggagcctataagtttgagcaagactttctgacgattggggatctacagttgtgcaaactagatgaattggattgcctgatcaagggaattctctatattgactctgtcgggttcaatggccgctcacagtgttactactttgagaaccccgccgattcagagaagtgccagaagctcccgtttgacctgaaaaatccttacccactcctgctggtcaacattggtagcggtgtgagcatcctcgccgtctactccaaggataattataaaagagtgacgggcacttcattaggaggagggacctttttcggtctgtgttgccttctgaccgggtgcacgacatttgaagaggctctagagatggcaagcaggggagattctacaaaggtagacaagcttgtgcgcgacatatatgggggcgattacgagcgcttcggactcccaggctgggccgtggcttcttcattcggtaacatgatgagcaaagaaaagcgggaggctgtttcgaaggaggacttggcgagagctaccctgattactataactaacaatatcggatccattgcgcgaatgtgtgcactaaacgaaaacattaaccaagtggtgtttgtgggtaactttctacggattaatacaattgctatgcgcctgctggcgtacgccctggactattggagcaagggacagctcaaagcattgttctccgagcatgaggggtattttggcgccgtgggggctcttcttgaattgttgaagatcccatag

SEQ ID NO: 198644 - DNA, 840 bp, Artificial Sequence
  Description of Artificial Sequence: Synthetic coding sequence
atgcccgccttcatccagatgggccgggacaagaacttcagcagcctccatacagtcttctgtgcaacggggggaggggcctataagtttgagcaggattttctgaccattggagatttgcagctgtgcaaactggacgagctggactgtctgatcaagggtatcctgtacatcgattcggtgggcttcaatggacggagccagtgttactatttcgaaaatccggccgatagcgagaaatgtcaaaagctacccttcgatctgaaaaacccataccctctgctcctggttaacatcggctctggagtgtccatcttggctgtttacagcaaggataattacaagagagtaactggcactagccttggagggggtacgttttttggactgtgttgtctgctgaccggctgtaccacttttgaggaggctctcgagatggccagccgaggggactctactaaggtcgacaagctagtgcgtgatatttatggcggtgactacgagcgctttgggcttccgggatgggccgtcgcaagctcatttggaaatatgatgtccaaggagaagagagaagcggtgagtaaggaggacttagcacgagctaccctgataacaataaccaataatattggtagcattgcacggatgtgcgctctaaacgagaacattaaccaggtggttttcgtgggcaattttctgcgcataaacactatcgccatgcgactgctcgcatacgctcttgactactggagtaaaggccaactcaaggcgctattttcagagcacgaggggtatttcggcgcggtcggagccctgctggagttgctcaaaatcccatag

SEQ ID NO: 198645 - DNA, 1113 bp, Artificial Sequence
  Description of Artificial Sequence: Synthetic coding sequence
atgaagatcaaggacgccaagaagcccagcttcccctggttcggcatggatataggagggacgctagtcaagctgtcatatttcgagccaatagacatcacagctgaggaggagcaggaagaggtggagagtttgaaatccatacgtaagtacctgaccagtaatgtggcctatggatccaccggaatcagagacgtgcatctggagctgaaagacctcaccctgttcggccgcagggggaatctgcatttcattaggtttccaacccaggatctgcctacttttatccagatggggcgcgacaaaaatttcagtactctacagacagttctctgtgccactggcggaggagcctacaagtttgaaaaggattttagaaccatagggaacctacatctgcataaactcgatgagcttgactgtcttgtgaaaggcttgctatatatcgactccgtcagcttcaacggacaggccgaatgttattatttcgccaacgcttccgagcccgagcggtgtcagaagatgcctttcaacctggatgatccctaccccttactggttgtcaatatcggttcaggcgtttctatcctggcggtccatagcaaggacaactacaaacgagtgactggaacttcattaggggggggaactttccttggactgtgctcgcttctaactggctgtgaatcgtttgaagaagctctggagatggcatcaaagggcgactccacacaggccgataagctcgtgcgagacatttatggaggcgattatgaaaggtttggcctgccagggtgggccgtggccagctcctttggcaacatgatctacaaagaaaaaagagaatcagtaagcaaggaggacttagcaagagcaaccctcgtgaccattacgaataacattgggtctgtcgcaagaatgtgtgcagtgaacgaaaagattaacagagtggtgtttgttggaaatttcctcagagtgaataccttgagtatgaaactgttagcttacgccctggattactggagcaaaggccaactgaaggcactcttcctcgaacacgaaggttactttggcgccgtgggcgcactcctgggactcccaaatttcagttag

SEQ ID NO: 198646 - DNA, 2322 bp, Artificial Sequence
  Description of Artificial Sequence: Synthetic coding sequence
atggccgagtgcggcgccagcggcagcggcagcagcggcgacagccttgacaagagcatcacattacctccagacgagatctttagaaacctcgaaaatgctaaacgttttgccatcgacataggcggatcccttacgaaactggcttactacagcaccgtgcagcacaaagtggcaaaggtcaggagcttcgatcacagcggcaaagataccgaacgggagcacgagcctccgtatgaaatttcagtgcaggaggagattaccgcccgcctccattttatcaaattcgagaacacctacatagaagcctgtttggactttataaaagaccacttggtgaacaccgaaacaaaagtcatacaagccaccggaggcggtgcctataagtttaaggatctgattgaggaaaaactgaggctcaaagtggataaagaggacgtcatgacttgtttgattaaagggtgtaattttgtgctgaaaaacatccctcatgaggccttcgtttaccagaaggattccgatccggagtttcgcttccaaacaaatcatccacatatatttccgtaccttcttgtgaatataggcagcggggtgagcatcgtgaaagtggaaaccgaggatcggttcgaatgggttggggggagcagcatcggaggagggacattctggggacttggggcactactcacaaaaaccaagaaattcgacgaactgcttcatcttgcctccagaggccagcactctaatgttgatatgttagtccgagatgtgtacggcggcgcacatcagactttgggtctgagcggtaacttaattgctagctcttttggaaaatcagccaccgctgaccaagagttctctaaagaggacatggcaaagtccctgttgcacatgatttctaatgatatcggacagctggcttgcctgcatgctaggctgcacagtctcgatagagtgtatttcggcggctttttcatccgtggccaccctgtcacaatgagaactatcacttacagcatcaactttttctctaaaggcgaagtgcaggccctctttcttcggcatgaagggtatttgggcgcaatcggtgcctttctcaaaggcgccgaacaagataacccaaatcagtactcatggggagagaactacgcaggctcatcagggctgatgagcgcatctccggagcttggcccagctcagagggctcgttccgggacttttgatctgctggagatggatagactagaaaggcccctcgtggatctccctttgctgctggaccccccttcatacgtgcccgatactgtggacctgaccgatgacgctttggcacgaaagtactggctgacatgttttgaagaagctctggatggagtggtcaagcgtgccgtggcctctcagcctgattctgtagacgccgccgagcgggcagaaaagtttcgacaaaaatattggaacaagctccaaaccttacgccagcaacccttcgcttacgggacactgaccgtccggagcctgctggacactagggagcattgccttaacgaatttaacttccccgatccatactcaaaggtcaaacagcgagagaatggcgtggcacttaggtgtttccccggagtggtgagaagtctggacgccctcgggtgggaggagcgtcagcttgccctggtcaagggattactggccggtaacgtcttcgactggggcgctaaagccgtgtctgcagttttggaaagcgacccgtattttggcttcgaagaagccaagagaaaactccaggaaagaccatggctggtggattcctactccgaatggcttcagagactgaagggtcctccccacaaatgtgctttaatcttcgctgacaactctggaatagacataatactcggcgtctttccttttgttcgagaactgctcctgaggggtactgaggtgatcctggcctgcaatagtggccctgccctcaatgatgtcacccacagcgaatcactgattgtggctgaaaggatcgccggcatggatcccgtggtacattctgctcttcaagaagaaagacttctgctggtacagacagggagtagctccccttgcctcgacttgtcacgcctggataaagggctcgcagcattggtacgcgagagaggtgcagacctggtcgtcatcgaagggatggggcgcgctgttcatacgaactaccacgcagctttgcgctgcgaaagcttgaagctagctgttatcaaaaacgcatggctcgccgaacggctgggagggcgcctgttctccgtcatttttaagtacgaggtccccgctgaatag

SEQ ID NO: 198647 - DNA, 1455 bp, Artificial Sequence
  Description of Artificial Sequence: Synthetic coding sequence
atgttccccaacagcatcctgggccggccccccttcacccccaaccaccagcaacacaacaatttctttaccctatcaccaactgtttactcgcatcagcagctgattgatgcccagttcaacttccaaaacgccgatctcagtagagcagtgagcttacagcagcttacttatgggaatgtatcccccatacagacaagtgcaagcccactattccgggggcggaaacgtctgtccgacgagaagaatctaccgctggatggaaaaagacagcggttccactctcctcatcaggaacctacagtggttaaccagattgtacccctctctggggaaaggagatactctatgccgcccctcttccacacccactacgtccctgacatagtcaggtgcgtacccccttttcgcgagatcgcctttcttgaaccccgagaaatcactcttccagaggccaaggataaattgagtcagcagatacttgaactgtttgaaacatgccaacaacagatcagcgacctcaagaaaaaagaattgtgcagaacacagctgcaacgggagatccagctgctcttcccccagtctcgcctcttcctggtcggcagtagtctcaacgggtttgggacccgttcctccgatggggacctatgtctggtggtgaaagaagagccttgcttttttcaggtcaaccagaaaacagaagctcggcatatcctgactcttgtgcacaagcatttttgtacccgcctttcaggctacattgagaggccgcagctgatccgcgccaaagtcccaattgtcaagtttagagataaggtttcatgcgtggaattcgatctcaacgtgaacaatattgttggaattcgtaacacatttctgctgagaacctacgcctacctagagaatagggtacggcctttggtgcttgtcatcaaaaagtgggcctcacaccaccagattaacgacgcatcccggggcactttatcttcttattctctagtgctaatggtgctgcattacttgcagaccctgccagaaccaatactcccaagtcttcagaaaatctatcccgagagcttcagtcctgccatccagctccacttagtgcaccaagctccgtgtaatgttcccccttatctcagcaagaatgagtccaacttgggagacctccttcttgggttcctgaaatattatgcaactgagtttgattggaactcacagatgataagcgtacgcgaagcgaaggcaatacctcgtccggacgggatcgagtggcgaaataaatatatctgcgtggaggagccattcgacggcactaatactgcaagagctgtgcacgagaagcagaagttcgatatgatcaaagatcaattcctcaagtcctggcaccgcctgaaaaataagagggatctcaattccatcctgcccgtgcgggccgccgtactgaagcgttag

SEQ ID NO: 198648 - DNA, 1443 bp, Artificial Sequence
  Description of Artificial Sequence: Synthetic coding sequence
atgttccccaacagcatcctgggccggccccccttcacccccaaccatcaacagcacaataattttttcaccttgagcccgacagtgtactcacatcagcagctgatagatgctcagtttaactttcagaacgccgatctgagcagggctgtgagtctgcaacaactgacctacggtaatgtatcccccattcaaactagtgctagtccgctctttagaggacgcaagcggctttctgacgaaaagaacctgcccctggacggaaagcgccaacggttccattcacctcaccaggagccaacagtcgtcaatcagattgtccccttatcaggtgaacgccgctacagtatgccccccctgttccatacccattacgtgcctgacattgtgcgatgcgtgcccccctttcgcgagatcgcgttcctcgagccccgggagatcactctgcccgaagccaaagataagctgagccaacaaatcctggagctcttcgagacctgccaacagcagatttccgatttgaagaagaaagaactctgcaggacccaattgcagagggagatccagctccttttccctcagtctagactctttttggttggcagctctctgaatgggtttggtactagatcttctgatggggacctatgtctggtagtgaaagaagagcccgtgaaccagaagactgaagcccgacacatactgacattagtgcacaaacacttctgtacccgcctgtctgggtacattgagagaccgcagttgatccgagccaaagtgccaattgtgaaatttagggacaaagtgtcttgcgtggagtttgacttaaacgtgaacaatattgtcggaatccgcaatacgttcctgctacgcacctatgcctacctggaaaacagggttaggcccctggtgctggtgattaagaagtgggctagccatcatcagataaacgatgcttcccggggcacactgagctcctactcattggttctgatggttttgcactacctgcagaccttgccagaaccaatcctgccttctttacagaagatttatcctgaaagcttcagccccgcgatacagctccacctggtgcatcaggcgccctgcaatgtgcccccatatttgtcaaagaatgagagtaacctcggtgatctgctgttgggattcctgaaatactacgctaccgagttcgattggaatagccaaatgattagcgttcgggaggcaaaagccatcccgcgcccagatggcattgaatggcgtaacaaatacatttgcgtggaggagccgttcgacgggactaacacggcaagagccgtacacgaaaagcagaagtttgatatgattaaagaccaattcctgaaaagctggcaccgactgaaaaacaaaagagacctcaacagtatcttaccagttagggccgccgttttgaagcggtag

SEQ ID NO: 198649 - DNA, 1455 bp, Artificial Sequence
  Description of Artificial Sequence: Synthetic coding sequence
atgttccccaacagcatcctgggccggccccccttcacccccaaccatcagcagcacaataacttcttcaccctctcccccactgtgtactcacatcagcagttgattgatgcccagttcaatttccagaacgccgatctcagtcgcgctgtgtctttgcagcagttgacctatgggaacgtcagcccaattcagaccagcgcctcccctctattccggggacgaaaacgcttaagcgacgaaaagaatttgcctcttgacggaaagcgacagcggttccattcaccgcatcaggagccaacagtcgtgaaccagattgtccccctgtctggggagagacgctattcaatgcccccacttttccatacccactatgtcccggacatcgtacgctgtgtccctccctttcgtgaaatcgcgtttcttgagcctcgcgagatcactttaccagaggcgaaagacaagctgagccagcagattctggagcttttcgagacatgtcagcagcagatttctgacctgaaaaagaaggagctctgtcgtacacagctacaacgggaaatccagctgctttttcctcagagtcgcttattcttagtaggatccagcctcaatgggttcggtacacgctcatcagatggggatctctgtctggttgtgaaggaagaaccttgcttcttccaggtgaaccaaaagactgaagccagacatatcctaacactggtgcataaacatttttgtacccgactgtccgggtatatcgaaagaccgcagctgatacgcgcaaaggtcccaattgtcaaattccgagataaggtgtcctgcgtggagtttgatctcaatgtgaataatattgtaggtatccgtaacactttcttgcttcgaacctacgcgtacctggagaatcgcgtaagaccccttgtacttgtaatcaaaaaatgggcaagtcaccatcagatcaacgacgcctcccgtggcaccctgtcatcctattccctggttctgatggtgctgcactacctgcagactctgcccgagccaattctgccaagcctgcagaagatctacccagaaagtttttcacccgccatccagctgcatctggtgcaccaggcaccttgcaacgtacccccgtatttgagcaagaatgaatccaatctgggcgaccttttgctaggcttcctgaaatattatgccacagagttcgattggaactctcagatgattagcgtcagagaggctaaggccatccccagacccgacggaattgagtggagaaacaaatatatttgcgttgaggaacctttcgatggcaccaacaccgcccgcgccgttcacgagaagcagaagtttgacatgatcaaagatcagttcctgaaatcctggcaccgcctgaaaaacaaaagagaccttaattctattttaccagtccgcgctgcagttctgaagagatag

SEQ ID NO: 198650 - DNA, 1455 bp, Artificial Sequence
  Description of Artificial Sequence: Synthetic coding sequence
atgttccccaacagcatcctgggccggccccccttcacccccaaccaccagcagcataacaatttcttcacactatccccaacagtgtactcccatcagcagttgatcgacgcacagtttaatttccagaacgcagacctcagccgcgccgtgtccctgcagcagttgacctacggtaacgtaagtcctatccaaacatcagcttctcccctctttagagggaggaagcggctgtcagatgagaaaaacctgccgttagacgggaagagacagaggttccactccccacaccaagagccaactgtggttaaccaaatagtcccgctcagcggcgagcgaaggtactccatgcccccactatttcatacacattatgtacccgatattgtaagatgcgttcccccattcagagagatagccttcctagagccacgtgagataactctgccggaggccaaggataaactttcacagcagatcttggaacttttcgaaacctgtcagcagcagatttcagatctaaaaaagaaggaactgtgccgcacccagctgcagcgcgaaatccagctcctgttcccgcaatccaggctattcctcgtcgggagctcactgaacggatttggaacacggtcgagcgacggcgacctgtgtctcgttgttaaagaggagccgtgtttctttcaggtgaaccaaaagactgaggctcgccatatcctcacgctggtgcacaaacatttctgtacacgcctgtccgggtacatcgaaagaccacagcttattagggcaaaggtgccgatcgtaaaatttcgtgacaaggtcagttgtgtggaatttgacctgaacgtgaataacattgtgggcatccgtaatacattcctcctgagaacctacgcctatcttgagaatagggtgcgaccacttgttttggtgataaaaaagtgggcatctcatcaccagattaacgacgcctcacgcgggaccctgtcgagctacagtttggtactgatggttctccactacttacagaccttaccagaacctatcctgccatctctgcagaaaatctatcctgaaagctttagtcccgcaatccaactccatcttgtgcatcaggcaccatgtaacgtgcccccatatcttagcaagaacgagtcaaacctcggagatctgctccttggttttttgaagtactacgccaccgaattcgattggaattctcagatgatctccgtgcgagaggctaaggcaatcccccgcccagatggcattgagtggaggaacaaatatatatgtgtagaggaacccttcgacggcaccaacactgctcgagccgtgcacgagaagcaaaaatttgatatgatcaaggatcagttcctgaagtcttggcatcgactgaagaataagagggatctgaacagcatactcccagttagggccgcggtcctgaaaagatag

SEQ ID NO: 198651 - DNA, 1476 bp, Artificial Sequence
  Description of Artificial Sequence: Synthetic coding sequence
atgagcctggtggcctacgccagcagcgacgagagcgagcccgacgaagctgagcccgagccagaggaggaagaggcagtcgcacctacttccgggccagcgctcggaggcctgttcgcctccctccctgctccaaaagggccagctctgctgccccctcctccacaaatgctcgctcccgcctttcccccccctcttctactgccccctccaacaggcgatcccaggctgcagcctccgcctcctctgccattcggcttgggcggttttcctccccctcccggagtgagccccgcggaggcggccggagtgggtgagggcctcggtttaggcctgcccagtccccggggtcccggcttgaatctccccccgcccatcggtggtgctggcccccctctggggcttcccaaaccaaagaaacggaaggagccagtgaaaattgccgcgccggagctgcacaaaggcgactccgactccgaggaagacgagccaactaagaagaagacgatactgcaggggagtagtgagggcactggtctctctgccctcttgccacagccaaagaatctgacagttaaagagacaaatcgactgctcctgcctcatgcattcagtcgcaagccctccgatgggagcccagacacaaagcctagtcgactggcttctaagaccaagacaagctcgctggcccctgtggtcgggaccaccaccaccactccttccccatccgcgataaaagccgccgccaagtcagccgctctgcaggttaccaagcaaattacacaggaggaagacgattcagacgaagaggtcgcccccgaaaacttcttttctctgcccgagaaggctgaaccgcccggagtggagccatacccatacccaataccaacagtgcccgaggagctacccccagggaccgagcctgagcctgcatttcaagacgacgcagccaatgctccactggagttcaagatggccgctggctcgtccggagcgccttggatgccaaagccaggcgacgattatagctacaaccaattcagcacctatggggatgctaatgccgccggcgcctactaccaggactactatagcgggggctattatccagcacaagatccagcccttgttcccccccaggagatcgctccagatgcctcatttatagatgatgaggcattcaaacgtctccagggcaaacgaaataggggaagagaggaaattaattttgttgaaatcaaaggggatgatcagttgagtggtgcccaacagtggatgaccaaaagccttacggaagagaagacaatgaaaagcttttctaaaaaaaagggcgaacagcctaccggccagcagaggcggaaacatcagatcacttatttgatccatcaagccaaggaaagggagctggagcttaaaaacacctggtcagagaacaaattgagtcgccggcagacccaagctaagtacgggttctag

SEQ ID NO: 198652 - DNA, 1380 bp, Artificial Sequence
  Description of Artificial Sequence: Synthetic coding sequence
atgagcctggtggcctacgccagcagcgacgagagcgagcccgacgaggccgagccagaaccggaggaggaagaagctgtagcgccaaccagtggacctgcactagggggactgtttgcctcactgcccgcccccaaaggccccgctctgctcccccccccaccacagatgctcgcgcccgcctttccccccccactcctgctaccccctcctaccggtgacccacggctccaacctcccccaccacttcccttcgggctaggcggctttcccccccctccgggtgtaagccccgccgaagccgcaggcgtgggcgagggtctcgggcttgggctgcccagcccccgtggacctgggctgaatctgccaccaccaattgggggcgctggtccacctctcggattgcccaagccgaagaagagaaaggagccagtaaagatcgcggctccggaactacacaaaggcgactcagattctgaggaagatgaacccacgaaaaaaaaaacaatcctccagggttcctctgagggaaccggattatctgccctgcttccccaacccaagaatctgacagtgaaagagactaatcgcctgctgctcccacacgcgttcagccgcaagccttccgatggttctcccgatacaaagcccagcagactcgcttccaagactaagactagttccctggctcctgtcgttgggaccacgaccaccacccctagcccctcagccataaaagccgccgctaaaagtgcagccctgcaggtaactaagcaaatcactcaggaggaagacgattctgacgaagaggtggctcctgagaactttttcagtctgccagagaaggctgaacctcctggtgttgaaccctacccctaccccatacccactgtgccggaggagctgcctcctgggacagagccagagccagctttccaggacgatgctgccaacgcgcccctggagtttaaaatggcggctggctcctcaggcgccccatggatgcctaagcccggagacgactactcttataaccaatttagcacgtatggagatgccaatgctgccggggcttactaccaatttaagcgcctccagggcaagcggaatcgtggccgagaagagattaactttgtggaaatcaaaggcgacgaccaactgtccggcgcccagcagtggatgacaaagtcgttaactgaagaaaagacgatgaagagcttctctaagaaaaagggagagcagcctaccggtcagcagagacggaagcaccagatcacatatttgatacaccaggctaaagagcgagaactggaactgaagaacacctggtccgagaataagctgtcacgtaggcagacccaggctaaatacgggttttag

SEQ ID NO: 198653 - DNA, 1404 bp, Artificial Sequence
  Description of Artificial Sequence: Synthetic coding sequence
atgctggcccccgccttccccccccccctgctgctgcccccccccaccggcgatccgaggctgcaacctccacctcctctgccttttgggctcggggggtttccgcctcctccgggcgtgtcacctgccgaggccgcaggggtaggggagggcttaggccttggacttcccagtcccagaggcccaggcttgaatctgcctccacctatcgggggtgccgggccgcctctgggtctcccaaagccaaaaaagagaaaggagcccgtgaaaatcgccgccccagaactccataagggcgattctgattccgaggaagatgaaccgacaaagaagaaaaccatccttcagggtagtagcgaagggacaggattgtccgcgctcttaccccagcccaagaatcttacggtaaaggagaccaatcggctactgctgccccatgcgttctcacggaaaccatcagacggttccccagacaccaaaccttccaggctggctagcaagaccaagacctctagtctagcccctgtagtagggaccacaaccactacacctagtccctctgccatcaaagccgccgctaagagcgctgcccttcaggttaccaagcaaataacacaggaggaggacgatagcgacgaggaagtcgcccctgagaatttcttttccctgccagaaaaagccgaacctcctggcgtcgagccttacccatacccgataccaactgtccctgaagaactgccgcccggcactgaaccggagccagctttccaggatgatgcggctaatgctcctcttgaatttaaaatggcagccggttcatctggtgccccctggatgcccaagcctggggatgattatagttataatcaattctcaacttacggcgacgccaacgccgctggggcctactatcaaggcctgcagcagcacctaggccatagcccactgaggggtatcatgcgatttctgaacagcaagagtgggaaaaggacctgctttgtgccatccttcgactactacagcggaggttactacccagcacaagatcctgctctcgtcccgcctcaggagatagcccctgacgccagtttcatcgatgacgaggcctttaagcgactccagggcaagaggaacagggggagagaggagataaatttcgtcgagattaaaggtgacgatcaactcagcggggcacagcagtggatgacaaaaagcctcacggaggaaaagacgatgaagagtttttcaaagaaaaagggggaacagccaaccggtcaacagcggcgcaaacatcagatcacctatctgatccaccaggccaaagaacgggagctcgaactgaagaatacctggtccgagaacaaactcagtcgcaggcaaacccaggccaagtatggcttctag

SEQ ID NO: 198654 - DNA, 3096 bp, Artificial Sequence
  Description of Artificial Sequence: Synthetic coding sequence
atgaaggtgaccgtgtgcttcggccggacccgggtggtggtgccctgcggagatgggcatatgaaggtcttttccctcattcaacaagccgttacgaggtacaggaaggcaattgctaaagatccaaattactggatccaggtgcatcgcctggaacacggtgacggcgggatcctggatctggatgacatcctctgcgacgtcgctgacgacaaggaccgtctggttgccgtttttgatgaacaggacccccaccatggtggggacgggacctctgcgtcatcaacagggactcaatcacctgagatcttcggctcagagttaggcaccaacaatgtgagcgctttccaaccctatcaagccacatccgaaattgaggtcacaccaagcgtattgagagcgaacatgcccctgcatgtgaggcgaagtagcgatccggccctcataggactctctacatctgtttcggactcaaacttcagtagcgaggaaccatcccgcaagaatcccaccaggtggtccacaactgctgggttcctaaaacagaatacagccgggtctccgaaaacctgcgatagaaagaaggatgagaattacagatcactccccagggacactagcaattggtccaatcagttccagagagataatgcaaggtcttcgctgagcgccagccaccctatggttgggaagtggcttgaaaagcaggaacaggacgaggacgggacagaggaggataattctagggtcgagcccgtcggccacgccgacacaggactggaacacattccaaatttttcgcttgatgacatggtgaagttggtcgaggtgccgaacgacgggggcccccttggaatccatgttgttccgttcagtgccaggggaggccgcaccctgggcttactggttaagaggctcgaaaaaggcgggaaggctgagcatgagaatctttttcgcgagaacgattgtatagtgaggattaacgacggcgacctgcgtaatcgtcggttcgaacaggctcagcacatgttccggcaagctatgcggacacccattatatggttccacgtcgtgcccgcagccaataaggaacagtacgagcaattgagtcagtcggagaaaaacaactactattcaagccgtttctccccggattcccagtatattgataatcggagcgtcaacagcgctgggctccataccgtccaacgggcacccaggctgaaccacccaccagaacagatcgacagtcatagccgcctgcctcacagcgcccacccaagcggaaagccgcccagcgcacccgcctcagctccacagaatgtgttctctaccacggtcagctctgggtataataccaaaaaaatcggaaagagactgaatattcagctgaagaaggggaccgagggcctgggctttagcataacctcacgggatgtgacgatcggtggctccgccccaatctacgtgaaaaacatcttacctcgtggggccgccattcaggatggccggctgaaagccggagaccgattgatagaggtgaacggggtcgatttggtgggcaagtctcaggaggaggtggtgtcgctcctcaggtcgaccaaaatggagggcaccgtctcactgctggtgtttcggcaggaagatgcattccatccacgggagctcaacgcagaaccgtcccagatgcagatcccaaaggaaacgaaagccgaggatgaagatattgtcctgactcctgatggaactcgggaattcctgacctttgaggtgccgctgaatgacagtggttccgcgggcctaggcgtcagcgtgaagggcaaccgcagcaaggaaaaccacgccgatctgggcatctttgtgaagtcgatcataaatggaggcgctgcaagtaaggacggacggttgcgggttaatgaccagttgatcgccgtcaacggcgaatccttgctgggaaagaccaaccaggatgctatggagacacttcggcgttcaatgtccaccgaggggaataagcgaggcatgatccagttgatagttgctaggcgcatatctaaatgcaacgagcttaaatcacctggctctccgccaggacccgaactgcccatagagacagcactggatgaccgggaacgccgcatttctcatagtctgtacagcgggattgaagggctggacgagtcgcctagcaggaacgcggccctgtccagaataatggggaagtatcaactgagtcctacagtcaacatgccccaggatgataccgttataattgaggatgatagattgcccgttcttccaccccacctgtctgatcagagctcctcctcctctcatgacgatgtgggatttgttaccgctgacgccggtacctgggccaaggccgccatcagcgactcagccgactgttctttgtccccagacgtagatccggtgttggccttccagagggagggattcggccgccagagtatgtctgagaaacgaaccaagcagttctctgacgcatcccagctagatttcgtcaagactagaaaatcaaaatccatggacttggggatagctgacgaaacgaaactaaacaccgttgatgatcagaaagcgggaagtccatctagagacgtcgggccttccctgggtctgaagaagtcatcaagtttagaatccctgcagaccgctgtggcagaggtaacactgaatggtgacatcccatttcacaggccacgaccaaggataatccgaggccgggggtgtaacgagtcttttcgggccgcaatagataaatcttacgataagcccgcagtcgatgacgatgatgaagggatggagactttggaggaagacacggaagagtcctctcggtcgggtagggagagcgtctctacagccagtgaccaacctagccactccctagaaaggcaaatgaatggcaatcaggagaagggtgataaaaccgaccgcaagaaggacaagacaggcaaagagaaaaaaaaagacagagacaaggaaaaagataagatgaaggccaagaaaggaatgctgaaagggctcggtgatatgtttagtctagctaagttaaagcccgaaaagcgctag

SEQ ID NO: 198655 - DNA, 3960 bp, Artificial Sequence
  Description of Artificial Sequence: Synthetic coding sequence
atgaaggtgaccgtgtgcttcggccggacccgggtggtggtgccctgcggggacggacacatgaaggtcttttctctgatacagcaagcggttacacggtacaggaaggccatagccaaggatccaaactactggatccaagttcatcgtctggagcacggcgacggtggaatcctcgatctggacgacattctttgtgatgttgccgatgacaaagatcggctagtggccgtgttcgatgagcaggatcctcatcatggaggggatggcactagcgcttcttccacaggcactcagtctcccgagatcttcggaagcgagctgggaacaaacaatgtctctgcgtttcaaccctatcaggcaactagtgagattgaggtgacaccctccgtgttgagggctaacatgcctctgcacgtccggagaagcagtgacccagccttgatcggactgagcacctccgtgtctgactccaatttctccagtgaggagccctcgagaaagaatccgacaagatggtccaccacggctggctttctgaaacagaatacagcaggcagccctaagacttgcgatcggaaaaaggacgagaactatcggagtctccctagggatacctctaattggagcaaccagtttcagcgagacaatgcaaggtccagtttaagcgcatctcacccgatggtaggcaaatggctggagaagcaggaacaggatgaagatgggacagaggaagataattctagggtagagccagtgggacacgccgacactggactggagcatatccctaacttttctttggacgatatggttaaactggttgaggtccctaacgatggcgggcctctcggcatccatgttgtccccttctcggcgaggggtggaaggacgctcggactcctggtcaaaaggctggaaaagggtgggaaggccgaacatgagaatctgttcagagagaatgactgtattgtccgcatcaatgacggggatctgcggaaccgccggttcgaacaggcccaacacatgtttcggcaggctatgcggactcctattatttggtttcatgtggtccctgccgccaacaaagagcagtatgagcagctcagtcagagcgaaaagaacaattattactcctctaggttcagtcccgatagccagtacatcgacaatcgcagtgtcaatagtgccggtctgcatactgttcaaagagccccgcggctgaatcacccacctgagcagatagacagtcactcccgcctgccacactccgcacatccgtcaggcaaaccaccctccgcccctgccagtgcacctcaaaatgtattttccaccacagtcagtagcggttataataccaaaaaaatcgggaagagactgaacattcagctgaagaagggtaccgaagggctgggattctcaattactagccgagatgtcaccatcggtgggagcgcgcctatctatgtgaaaaacatactgccaagaggtgcagctatccaggatgggcgcctcaaggccggcgatagactcatagaggtgaacggcgtcgatctcgtcggtaagagccaggaggaggtggtctctttgctgaggtctacaaaaatggagggaactgtgagtttattagtattcaggcaggaggatgcatttcatccaagagaattgaatgctgagccctcgcaaatgcagattcccaaagaaactaaagcggaggatgaagatattgtgcttacccccgatgggacccgagagtttctcacttttgaagtccccttgaatgatagtggctccgcaggactaggcgtgtccgtgaaaggcaaccgctctaaggagaatcacgccgatctaggaattttcgtcaagagcatcataaatggaggagccgcctctaaagacggaagactgcgagtgaacgaccagctcatagctgttaatggggagagcctgctcggcaagaccaaccaggacgcaatggaaaccctgcggcggtctatgtctactgagggcaacaaaaggggcatgattcaactgattgtggcaaggagaatctccaaatgtaacgaactaaagtcacctgggagtccacccgggcccgaactgcctattgagactgctttagacgaccgagagcggcggatttcgcacagtctgtattctgggattgagggtctggacgaatccccttcccgaaacgctgccctgtccagaatcatgggagagtccgggaagtaccaactgtctccaaccgttaacatgccacaagacgataccgtgattatcgaagacgataggctgccggtcctccccccacacttgtctgatcagtccagctcctccagtcatgacgatgtaggcttcgtcacagctgacgccggcacatgggccaaggccgcaatatccgactcagccgattgctctctgagccctgatgtcgaccccgtcttggcctttcagcgggaagggttcggacgccaatctatgtccgagaaaaggacaaagcagtttagcgatgcgagccagctcgactttgtcaagacccggaaatctaagtctatggacctgggcatagcagatgagaccaagttgaacactgtagacgaccagaaagctggttccccatcccgggatgttggaccatcgcttggtctcaagaaatcatcaagcttagaatctctccagacagcagtcgccgaggttaccctgaacggagacatcccctttcaccgaccgcggccaagaatcataaggggccggggttgtaacgagagctttcgtgcagcaatcgacaagtcttatgacaagcctgccgtggacgacgatgatgagggtatggagacactcgaggaggataccgaagagagcagcagatcagggcgcgagtcggtctcaactgcctctgatcagccatcccatagtttggaaaggcagatgaatgggaaccaggagaagggagacaaaacagatcggaagaaagataaaacaggaaaggaaaaaaaaaaagatcgggataaggaaaaagacaagatgaaggccaaaaaaggaatgctgaagggtctcggcgacatgtttaggatacaggccaagactcgcgaattcagggagcgccaggccagggaaagggattatgcagagattcaggacttccatcggacctttggctgtgatgacgaactaatgtatggaggggttagctcttacgagggttctatggcccttaatgcccgccctcagagcccacgcgaaggccacatgatggatgccctgtacgctcaagtaaagaaaccaagaaactccaaaccctcaccggtagatagtaaccgctcaacaccatccaatcacgacagaatacaacgattgaggcaggagtttcaacaggccaagcaagatgaggacgtggaggatcgcagacgaacctattcattcgagcagccctggcctaatgccagacccgccacccagtccggtagacacagtgtgagcgttgaagtgcagatgcagaggcagcggcaggaagaacgcgagagcagccagcaggctcagaggcagtattcttccctccctcgccaaagtagaaaaaacgccagctccgtgtctcaggattcttgggagcagaactattcccccggcgaaggctttcagtccgccaaggaaaacccccgctattcaagctatcaaggcagtaggaacgggtacctcgggggtcatggctttaatgcgagagtgatgctcgaaacccaggagctcctcagacaagagcagcgacgaaaggaacagcagatgaaaaaacagccaccctctgagggtccttctaattacgacagttataaaaaagtacaagaccctagctatgcgccacctaaagggcccttccgccaagatgtgccaccttccccttcccaagtcgcccggctgaaccggcttcagactccagaaaaggggagaccattctattcatag

SEQ ID NO: 198656 - DNA, 3933 bp, Artificial Sequence
  Description of Artificial Sequence: Synthetic coding sequence
atgaaggtgaccgtgtgcttcggccggacccgggtggtggtgccctgcggggacggacacatgaaggtgttcagtttaatccaacaggctgtgaccagataccgcaaggccatcgctaaggatcctaattactggatacaggtgcacaggctcgaacacggagatggcgggatactcgacctggacgacatcctatgtgacgtggctgacgacaaggatcggctggtggcggtgttcgacgaacaggaccctcatcacgggggcgatggcaccagcgcctcctccaccggtactcagagcccggagattttcggatcggagctgggaaccaataacgtttctgcgttccagccttatcaagcaaccagtgagattgaagtgaccccctctgtgttgagagctaacatgccattgcacgtaagacggagttctgacccagccctgattggcctcagtacctccgtttcagattcaaatttctcgtcagaggaaccctcaaggaagaacccaactcgctggagcaccacggccggattccttaaacagaataccgccggctccccaaagacttgtgatcggaagaaggatgaaaactaccgttccctccccagagacacatccaattggtctaaccaattccagagggacaacgcccgcagtagcttatccgccagccaccctatggtcggcaagtggttggaaaagcaagagcaggacgaggacggaactgaggaagacaattcgcgggtcgaaccggtgggccacgctgataccggactggagcatatcccaaatttctcactcgacgatatggtcaagctcgttgaagtgccgaatgacgggggtccattggggattcacgttgtaccattctcagctaggggcggacgtaccctcggacttctcgtgaaacgcctggagaagggcggcaaggctgaacatgaaaacctgtttcgagagaacgactgtatcgtgaggatcaatgatggcgacttacgtaaccggcgctttgaacaggcccaacacatgttcaggcaggccatgagaaccccaattatctggtttcatgtcgtgccagccgccaataaagagcagtacgaacaactgtcgcagagcgagaagaacaattactacagtagccgcttttcaccagacagccagtacattgataacagatctgttaattccgccggcctgcatacagtgcagcgcgcgcctcgactcaatcacccaccggaacaaatagactcccatagtagattaccacacagtgcccacccctctgggaaacctccctccgctcccgcatctgcacctcaaaatgtcttctccacaactgtgtcgtctgggtacaacacgaaaaagatagggaagagactgaacatccagctgaagaaaggcaccgagggccttgggttctcaataacaagtagggatgtgacaataggcggaagcgcacccatttatgtcaagaatatattgccccgaggcgccgccatccaagatgggcgtctgaaggccggggataggctgatcgaagtgaatggtgtggacctagtcggaaaaagccaggaagaggtagtgagcctactgaggagcacaaaaatggaaggcactgtcagtctcctggtgtttcgccaggaggatgcttttcaccccagagaacttaaagccgaggacgaagatatcgttcttaccccagacgggacccgggaattcctgaccttcgaggttccccttaacgatagtgggtccgccgggctgggtgtctctgttaaaggcaatcgttccaaagagaatcacgcggatctcggcattttcgttaaaagtatcattaacgggggggccgcttccaaggacgggcgattaagggtgaatgaccagttgatcgcagtgaacggcgagtctcttctcggaaagactaaccaggacgctatggaaacgctgcgacgttccatgtcgaccgagggtaacaaacgagggatgattcagctaatagtggctcgcagaatttccaaatgcaatgaactgaaatccccaggctcacccccaggacctgaactgccaattgagaccgctttggatgaccgcgagcgccgcatcagccattctctctatagtggaatcgaggggttggatgagagcccttcaagaaacgcagcactctctcgtatcatggggaagtatcagctctctcccactgtgaacatgccacaggatgataccgtaattattgaggatgatcggctgcccgttctgcccccacacctgtccgatcagtcctcttcctcaagccacgatgacgtaggcttcgtaacagctgacgccgggacatgggctaaggcagctatatcagacagtgcagactgcagcctttcgccagatgtagaccccgtgctagcttttcagcgtgagggattcggccgccagattgccgacgaaactaaattaaacactgtggacgaccagaaggctggatcaccttctagagatgttggtccgagccttggcttgaagaagagctctagtttggaatccctgcagaccgcggtagctgaggtgactctcaacggagatattccatttcaccgaccccgcccgagaatcatcagaggtcggggctgtaatgagtcctttagagccgctattgataaatcttatgacaagccagccgtagacgatgatgacgaaggcatggaaactctggaagaagatacggaagaatcgtcaagatcaggcagggagagcgtgtctacagcctcggaccaaccctcccacagtctggaaaggcaaatgaacgggaaccaggagaaaggtgataaaaccgaccgaaagaaggacaagaccggaaaagagaagaaaaaagatcgtgacaaggagaaagataaaatgaaagctaagaaggggatgttgaaggggctcggagacatgttccgcttcggcaaacatcgaaaggatgataaaatcgagaagaccggaaagatcaaaatccaggaaagttttacttccgaggaagaaaggattcgcatgaagcaagaacaagaaagaatccaggcgaagacacgagaattccgggagaggcaggcccgggaaagagactatgccgagatccaggatttccataggacattcggatgcgacgatgaactgatgtatggcggcgtatctagctacgaaggaagcatggccctgaatgcacgcccacaatcaccccgagaagggcatatgatggatgcgctttacgcgcaggtgaagaagccccggaactccaaacctagtccggtggatagtaatcggtccaccccaagtaaccatgatcggattcaacggctgagacaggaatttcagcaggcaaagcaggacgaagacgttgaagacagaaggagaacctactcatttgaacagccctggccaaacgcacgacccgctacacaatctggacgacactccgttagcgtagaagtacagatgcagaggcaacgacaggaggagcgagagtcaagtcagcaggctcagcgacagtacagcagtctcccacggcagagccggaagaacgcctcctctgtatcacaggactcttgggaacagaattactcccctggggagggctttcagtccgcgaaagaaaatcctaggtactcttcgtatcaaggttccaggaacggctatctcggcgggcatggatttaacgctagagtcatgctggaaactcaggaactacttagacaggagcaacgccgaaaggaacaacagatgaaaaagcagccgccctcagagggaccaagcaattacgactcctacaagaaagttcaggaccctagctatgctccccctaagggcccctttcgccaggacgtgcctccatctccctcacaggtcgcccgactgaatcgattgcagactccggaaaaagggagacccttctatagctag

SEQ ID NO: 198657 - DNA, 540 bp, Artificial Sequence
  Description of Artificial Sequence: Synthetic coding sequence
atgcagatccccaaggagaccaaggccgaggacgaggacatcgtgctcactccagatggcactcgggagttcttgaccttcgaagttccactcaacgactccggcagcgcaggcctgggagtctctgtcaaaggcaacaggtctaaggagaatcacgcagatctgggaatctttgtaaagagtatcattaacggcggggcagccagcaaggatggccgcctccgggtgaatgatcagctcattgctgttaacggcgaatcgctactagggaaaactaatcaggatgctatggaaacgctccggcgctcaatgagtactgaaggaaataaacgaggaatgattcagctaattgtggcccggagaatttctaagtgtaatgagctgaaatcaccaggatcccccccaggccccgagctgccgatcgaaacagccctggatgacagggaacgaagaatctcacacagtctctacagcggaatcgaagggctggatgagagtccaagtaggaatgctgccctgtctcgtataatggggacttag

SEQ ID NO: 198658 - DNA, 3006 bp, Artificial Sequence
  Description of Artificial Sequence: Synthetic coding sequence
atgaaggtgaccgtgtgcttcggccggacccgggtggtggtgccctgtggcgacggtcacatgaaggtcttcagcctcatccagcaggccgtgacccggtaccggaaggcaatagccaaggatccaaattattggatacaagtgcaccggctggagcatggggatggaggtatcctggatcttgatgacattctctgtgacgtagcagatgacaaggaccgcctggtggcggtctttgacgaacaggaccctcatcacggcggcgacggcaccagcgccagctcaactggaacccagtcccctgaaatatttgggtcagaactcggcacaaataatgtctccgcatttcaaccctaccaggcaacaagcgaaattgaagtgactccatctgtcctgcgggccaacatgcctctgcatgtccgccgaagctctgacccagccctgattgggttgagtaccagcgtatccgacagtaatttttcatccgaagaaccttccagaaaaaatcctacaagatggtcgaccaccgctggcttcctgaagcagaacaccgccgggtcacccaaaacttgtgatcgaaagaaagatgagaactatcggtccctgccccgtgacacctctaattggtccaatcagtttcagcgggacaacgctcgctccagtctgtcagcttcccatcccatggtagggaaatggttggaaaagcaggagcaggatgaggatgggacagaggaagataattcacgggttgagccagtgggccacgcagataccggactggaacacataccaaacttttctctggatgatatggtcaaactggttgaagtgccgaatgacggcggtcctctcggcatccatgtagtgcctttcagtgcccgagggggccgcaccctcggacttctggtgaaaagactcgaaaagggaggcaaagctgaacacgaaaacttatttagggagaacgattgtattgtccgaattaacgacggggacttgcggaaccggcgttttgaacaagcccaacatatgtttaggcaggctatgagaacacctatcatttggttccatgtggtccccgctgcgaacaaggagcagtacgaacagttgtcccaatctgagaagaataattattacagctctagattttctcctgactcccagtacatcgataatcgatcagtaaactctgcaggactgcataccgtccaacgcgcacccagactaaatcacccccccgaacaaatcgactctcacagcaggctcccccattcagctcacccaagcggaaagcccccaagcgcaccagctagcgccccacaaaatgtcttttcgaccaccgtgtcctctgggtacaacacgaagaaaatcggtaagcgactcaacatacagcttaagaagggtacagagggcctcggattctctattactagtcgagatgtaaccattggtgggagtgctccaatttatgtgaagaatatattacctagaggagcagcaatacaggacggaagactaaaggctggcgatagactgatcgaggtcaatggagttgatctggtagggaaatcacaggaagaagtagtctccctattgcgcagcacgaaaatggaagggacagtttctctgctcgttttccggcaggaagatgcattccatcccagggaattgaatgctgaaccttcccaaatgcaaattccgaaagagacaaaggctgaagatgaagacatagtgctcacccctgatggtacacgggagtttctgacctttgaagtgcccctgaatgattctgggtcagccggcctgggcgtgtcagtaaaggggaatcggtcaaaagaaaaccacgccgacttgggtatctttgttaaatccatcatcaacggcggcgctgcctcaaaagacggccgactgcgcgtgaatgaccagttaatagcggtaaacggagagtcccttctcggcaaaactaaccaggatgcaatggagaccctgaggcggagtatgagcacagagggaaacaaacgcggcatgattcagctcattgttgcaaggcgcattagcaagtgcaatgaactaaaaagccccggctcaccccccggacctgagctgcctatcgaaacagccctcgacgacagagagcgccggatttcacattcgctctattccgggatagaaggcctggacgaatcaccatctcggaatgccgcactcagccgaatcatggggaagtaccaactaagtccaactgtcaatatgccccaagacgacaccgtaattatcgaggacgaccggctgcccgttttacctccacatctttcggaccagtccagtagttcatcacatgatgacgtaggctttgtcactgccgatgcggggacctgggcaaaggcagcaatatctgactctgcagactgctctctctccccagatgtggatccggtgctggccttccagcgggagggtttcgggagacagattgccgacgagaccaaactaaacactgtggatgatcaaaaggctggatccccatccagagatgttgggccgtccctaggactgaagaagagttcttctctcgaatcactacagacagccgtggcagaggttaccctcaatggagatatccctttccacaggccccggcccaggatcatacgtgggagaggatgtaatgaatccttccgcgcagcaattgacaagtcatatgacaaacctgctgtcgatgacgatgatgagggcatggagaccttggaggaggacacagaagagtcttctagatcgggtcgcgagagtgtgtctacagcctccgaccagccctctcacagcttggagagacagatgaacgggaaccaggagaaaggcgataaaaccgatcggaaaaaagataagaccggaaaagagaagaagaaagaccgggacaaggagaaggataaaatgaaggccaagaaaggcatgctgaaaggtctaggggatatgttctctctcgctaagctgaagcctgaaaaacggtag

SEQ ID NO: 198659 - DNA, 2967 bp, Artificial Sequence
  Description of Artificial Sequence: Synthetic coding sequence
atgaaggtgaccgtgtgcttcggccggacccgggtggtggtgccctgtggagacgggcacatgaaggtgttcagcctgatccagcaggcggtcacgaggtacagaaaggcaattgccaaggaccctaactactggattcaggtccaccgcctcgagcacggcgacggtggaatccttgatctggacgacattctctgcgacgttgccgacgataaagaccgtctggtggctgtgttcgacgagcaggatcctcatcatggtggagacggcacttcagcaagcagtaccggtacccagtcccctgagatcttcggatctgaactgggcaccaataacgtttcagcgttccaaccttaccaggccacttccgagatagaagtcaccccatcggtcctgagggctaatatgcctctgcatgtgcgcaggtcgagcgaccctgcacttatcggcttgtcaacctcagtgagcgacagcaatttcagttccgaagagccctcccggaagaaccccacgaggtggtccacgacagccggcttcctgaagcaaaacaccgctggttctccgaagacttgcgacagaaaaaaggacgagaattaccgttcccttccacgcgatacttctaattggagcaaccagtttcaacgcgataatgctcgctcttcactctctgcttcccacccgatggtgggcaaatggctggaaaaacaggagcaggacgaagacgggacggaagaggataacagccgggttgaacccgtgggccatgctgataccggactggagcatataccgaatttcagcctcgacgacatggtgaaactcgtggaggttccaaatgacggcggccccctcggaatccatgtggttccatttagcgcccggggtggcagaactcttggcctccttgtgaagaggctcgagaaaggggggaaagccgagcatgagaatctgtttcgcgagaacgattgcatagtgcggatcaatgatggcgacctgcggaacaggcgtttcgagcaggcccagcacatgtttcggcaggccatgcgcaccccaattatatggttccacgtggtgccagccgccaataaggaacaatatgagcagctttcacagagcgagaagaataattattatagtagtcggttctcccccgactcgcaatacattgacaacaggtccgtcaacagtgccggcctgcacacagtgcagagagccccccgattaaatcatccccccgaacagatcgactcccactctaggctgcctcactccgcccatcccagcggaaagccgccaagcgcacctgcctccgctccacagaacgtcttctcgactactgtgtcaagtggctataataccaaaaagattggcaaacgtctaaacatccagttgaagaagggcacagagggtctggggttcagcattacgtcacgggacgtcacaatcggcggaagcgcgccaatctatgtgaagaacattttgccccggggggccgctatccaggatgggaggctgaaggcaggggatcgactgatcgaagtgaatggggtggatctcgtcggcaaatctcaggaggaggtggtttccctgcttagatctacaaaaatggaggggactgtgtcactgttagtgtttaggcaggaagatgccttccacccccgagaactgaaggccgaagatgaggacattgtcctcacacctgacggcacccgggagttcctcactttcgaagtgccactaaacgatagcggcagcgcggggctgggtgtgtccgtgaaaggaaatagaagcaaagagaaccacgcagacttgggaatcttcgtaaagtcgattatcaacggcggggccgcctccaaggatggaaggctccgggttaatgatcagcttatcgcggttaatggagagtcactgttaggtaaaacgaatcaggacgccatggaaacactgagaagaagcatgtcaaccgaaggcaacaaaaggggaatgatccagctcattgtcgcccggcggatttcaaagtgtaacgagcttaagtctcctggcagccctcctggtcccgaactgcccattgagaccgctttagacgaccgggaacgtaggatctcacacagcctgtacagtggaatagaaggtctcgatgaatcaccctcccgaaatgctgcactgtccagaattatgggtaagtaccagctcagtccaaccgttaacatgccccaagacgacactgtaatcattgaggacgataggttacccgtgctgcctcctcatctgtcagatcagtctagcagtagctctcatgatgacgtcggcttcgtcaccgccgacgccggtacatgggccaaagccgcaatctcagacagtgctgactgctcactttctccagacgtggatccagttctggcgtttcagagagaaggatttggcagacagatagccgacgaaaccaaacttaatacagtggatgatcagaaggccgggtcgccatcccgagacgtagggccatccttggggctaaaaaagtccagctctctggagtccctacagaccgccgtggcagaggtgaccctaaatggcgacattcctttccaccgcccacgccccagaattatcaggggcaggggctgcaacgagtcttttagggccgccatcgacaagagttatgacaagcctgccgtagatgacgatgatgaggggatggaaacactagaggaggacactgaggagtcgtctaggagcgggcgggagtcagtttccaccgcaagcgatcagcctagccatagcttggagcgacagatgaatggcaaccaggaaaaaggagataagaccgatcgcaaaaaagataagactggtaaagaaaaaaagaaggacagggataaggagaaagacaagatgaaggccaagaagggcatgctcaaagggctgggtgacatgttttcattggccaagctgaagccagagaagagatag

SEQ ID NO: 198660 - DNA, 4062 bp, Artificial Sequence
  Description of Artificial Sequence: Synthetic coding sequence
atgaaggtgaccgtgtgcttcggccggacccgggtggtggtgccctgtggcgacggtcatatgaaggttttctccttgatacaacaggctgtgacaaggtaccggaaagccatagctaaggacccaaattattggatccaggtgcatcgcctcgaacatggagacgggggtattctggaccttgatgacatcctttgtgatgtcgctgacgataaggatcgccttgtggcagtgttcgacgaacaggatcctcatcatggaggtgacgggacctctgcctcttcgacaggcacacagtcacccgagatcttcggctccgagctagggacgaacaatgttagcgcctttcaaccttatcaggccacctcagaaatcgaggttaccccctcagtgctacgcgcaaatatgccacttcacgtgaggcgcagctctgaccccgcactgattggcttaagcacctccgtgtctgactccaatttcagtagtgaagagcctagccggaagaacccgactagatggtccaccaccgctggctttcttaaacagaatacagccggctccccaaagacatgtgaccgaaagaaggatgaaaactataggtcattaccccgggatacatcaaattggagcaatcagtttcagcgagacaacgcgcgctcgagcttaagcgccagccaccccatggttggaaaatggctggagaaacaagagcaggacgaagacggcaccgaagaagataactctagggtcgaaccggtcggccatgcagatacgggccttgagcacatccctaattttagcctggacgacatggtcaagctggtggaggtccccaacgatggcggtccgctgggtattcacgtcgtgcctttctcagcacgcggtggacgcacattaggtctattagtaaaaagactagagaaggggggtaaagcggagcatgagaacctttttcgggaaaacgattgcatcgttagaattaatgatggtgatttacggaaccggaggtttgagcaggcgcagcacatgttcagacaggcgatgcgtactcccattatctggttccatgtcgtgcctgcagcaaataaggaacagtacgagcagctctctcaatcagaaaagaacaattactactccagtcgattcagtcccgattcacagtatatcgataacagatccgttaattccgccggtcttcataccgttcaacgtgcacctaggttgaaccacccccccgaacagatcgactcccactcccgacttcctcattcagcccaccctagcggtaaacctccctctgccccagccagtgcccctcagaacgtgttcagtacaactgtctcatcaggctataacacaaagaagatagggaagcggttaaacatccaactaaagaagggtaccgagggcctagggttttccatcacatcccgggacgtaactatcggaggctcagctcctatttacgttaagaatattttgcccagaggcgccgcaattcaggacggccgactgaaggcaggggacagactgatagaagtaaacggtgtggacctggtcggcaaaagtcaggaagaggtggtgagccttctcagaagcactaagatggaaggaaccgtatctcttctcgtctttagacaagaagacgcattccaccctagggaactgaatgctgaacctagccagatgcagatccctaaggaaacgaaggcagaggacgaggacatagtgctgacccccgatggcacccgcgagttcctgactttcgaagtaccactaaatgactctggatcagcggggctgggcgtctccgttaaaggtaatcgctcgaaagagaatcacgcggaccttggcatctttgtcaagtctatcatcaacggtggggccgccagcaaggacggcagattgagagttaatgaccagctgatcgccgtcaacggagaatcactgctgggcaagacaaaccaggacgcaatggagaccctgcgaagatctatgtctaccgaagggaataagcgcggcatgattcagctcatagtggcaaggaggatatcaaagtgtaatgagctgaaatcccctggcagtccaccagggccagaactgcccatcgaaactgctctcgacgacagagagaggaggatcagccacagtctctactccggcatcgagggattggacgaatccccttctcgaaacgcggctttgagccgcatcatgggcaagtatcaactgagccccacagtcaacatgcctcaagatgatacagtcatcatagaagacgatcggttacctgttctgcctcctcatctttccgatcaaagtagttcaagttctcatgatgatgtcggcttcgtgaccgccgatgccggcacctgggccaaagctgccatcagtgatagtgcagactgctctctcagccctgacgtggaccccgtcctagctttccagcgggaagggtttggccgccagagcatgtcagagaagcgaactaaacagttcagtgacgccagccagctagacttcgtgaaaactcggaagtcaaagagcatggatctagggatagctgatgaaactaaactgaacactgtcgacgatcagaaggctgggagcccctcaagagacgtgggaccgtccctgggtctaaaaaaatcttcctcccttgagtcgcttcagaccgccgtcgcagaagtgactcttaatggtgatattccttttcatcgccctagaccacgcatcatccgagggaggggatgcaacgaaagttttcgtgcagcaattgacaagtcctacgacaaacccgccgtagatgatgacgatgaggggatggagacattggaagaggatacagaggaatctagtagaagcgggcgcgaatcagtatcgaccgcaagtgaccagccttctcactcactcgaacgccagatgaacggcaaccaggaaaaaggggacaagacagacaggaaaaaggacaaaacgggcaaggagaagaagaaggacagagacaaagagaaggataagatgaaggccaagaagggcatgctgaaaggactgggggacatgtttcggtttgggaagcacaggaaagacgataaaattgagaagactggaaagatcaagatccaggaaagcttcacaagtgaggaagagcgaatcaggatgaagcaggagcaggagaggatccaagccaaaacgagagagttccgagagaggcaggcacgagaaagggattacgcagagattcaggacttccatcggaccttcggctgcgacgacgagttaatgtacggaggagtctcttcctatgagggctcaatggccctgaatgcaaggccccagtctccccgcgagggacacatgatggatgccctgtacgcccaggttaagaagccacgtaacagcaagccatcccccgttgacagtaatcggtctacacctagtaaccacgaccggatacagcgcttgcggcaggaattccagcaggccaagcaagacgaggacgtcgaggaccggcggagaacttactctttcgagcaaccttggcccaatgctaggcctgcgacccaatctggcaggcacagcgtgagcgtggaggtgcagatgcaaaggcagaggcaggaagagcgggaaagcagccaacaggcccagagacagtatagctcactgccaagacagtcccggaagaacgccagctctgtctctcaagatagttgggagcagaactattcacctggggagggttttcagagtgccaaagaaaatcccagatactcatcctaccagggctctcggaatggttatctgggagggcatgggtttaacgctcgggtcatgctggagacccaggaattattgaggcaagagcaacgaagaaaagagcagcagatgaagaaacagcccccttctgagggcccgtccaactacgacagctacaagaaagtgcaagatccttcatatgccccccctaaaggccccttccggcaggatgtaccgcccagcccatcccaagtagccagactgaatagactgcaaacgccagaaaaagggagacctttctactcttag

SEQ ID NO: 198661 - DNA, 4071 bp, Artificial Sequence
  Description of Artificial Sequence: Synthetic coding sequence
atgaaggtgaccgtgtgcttcggccggacccgggtggtggtgccctgcggggatggccatatgaaagtgttttcacttatccagcaggctgttacaaggtatcggaaagccatcgcaaaggaccctaactattggattcaggtgcacaggctggagcacggcgatggcggcatcctcgatctcgacgatattctctgtgacgtcgccgacgataaagatcgcctcgtcgccgtcttcgatgaacaggacccccaccacgggggagatggaacctccgcaagttccacaggaacccagagccccgagatctttggaagtgaacttggaacaaacaacgtgtccgcttttcagccgtatcaggctacaagcgaaattgaggttaccccttctgtattgagggcaaatatgcctctacatgtccgccgctcatctgatccggctttaatcggtctgtcaaccagtgtgagcgattctaacttttcttcagaggagccatcacggaaaaacccaacgagatggagtactacagcagggtttcttaagcagaatacagccggaagcccgaagacgtgtgataggaagaaggatgaaaattaccggtcgctgccaagagatacttctaattggtcgaaccagtttcaacgcgacaacgctcgctcaagcctgtccgcttctcatcctatggtgggcaagtggctggagaagcaagagcaggacgaggatggaaccgaggaagataactcccgagtagagcccgtgggccacgcggacaccggtctggaacacatccctaacttcagcttggacgacatggtgaagttggtggaggttcccaatgacgggggcccgctgggaatccatgttgtgcctttttcggctaggggtggaaggacattaggcctgctggtcaagaggctggagaagggtggcaaagccgaacacgaaaatttattccgggagaatgactgcatcgtgagaataaacgatggggaccttagaaatcggcgattcgagcaggcccagcacatgtttcggcaggccatgcgcacccctatcatttggttccacgttgttcccgccgcaaataaggaacagtacgaacagctgtctcagtctgaaaaaaacaattactactctagtaggttttcgcctgattctcagtacatcgacaacaggagtgtgaacagtgcgggcctgcatacagtgcaacgagccccaaggcttaaccaccctccagagcagatagatagccattcacgcttgccccattctgcccacccatcaggtaaaccaccatctgctcctgcttccgccccacagaatgtcttctcaacaaccgttagttctggatataacactaaaaaaatcggcaagagacttaatattcagctgaagaagggaaccgagggcctgggtttcagtattacttcgcgtgacgtgaccatcgggggctccgcacccatctacgtgaaaaatattctgccgcgcggcgctgccattcaagatggtaggctgaaagcgggggatcggttgatcgaggtgaacggagttgacctggtaggtaagagccaggaagaagtagtgtccctcctccggtctacgaagatggaaggcactgtcagcctcctggtgtttaggcaggaagatgccttccaccctcgagagcttaacgcagagccgtcccagatgcagatccccaaagaaaccaaagctgaagatgaggatattgtgttgacaccagatggaacgagggaattcttaacattcgaggtgccccttaatgactccggctcagcaggccttggggtgtcagtgaagggaaataggtctaaagaaaatcacgctgatctgggaattttcgttaagagtatcatcaacggcggagctgcctcaaaagacggcaggctccgcgtgaatgaccagctgatagctgttaacggcgagagtttactcggaaagacgaatcaggatgcaatggagacgctgcgtagatctatgtcaacagaaggcaataagcggggaatgattcagctcatagttgctcgacggatcagcaagtgcaacgaattaaaatctccaggctcaccacctggaccagaattacctattgaaacggctttggatgaccgagaacggcgcatcagtcactctctgtacagcggaattgagggccttgacgaaagccccagcagaaatgctgccctgtcacggatcatgggggagtctgggaagtaccagctgagccctacagtgaacatgcctcaggacgacactgttataattgaggacgacagactaccagtactccccccccacctcagcgatcagagtagcagcagttcgcatgatgatgtaggcttcgtcactgccgatgcagggacttgggcaaaggcagcgatcagtgactccgccgactgcagcctcagccctgatgttgatcctgtacttgcgtttcagcgagaaggctttggccgccagtccatgtccgagaagcgcacaaagcagtttagcgatgcgagtcagttggatttcgtcaaaacgcgtaagtccaaaagtatggatttgggaattgctgatgaaaccaaactaaacaccgtggatgaccagaaggctggatccccttctcgcgacgttggtccttctctcggactaaaaaaatcctcatccctagaatctctgcagacagctgtcgccgaggttactctcaacggtgacatccccttccatcgcccccgaccacggatcatacggggaagaggttgcaacgagtctttccgagcagccatcgacaaatcttacgataagcccgctgtcgatgatgatgacgagggaatggaaaccttagaggaagatacagaggagagctcccgttccggccgcgagagtgtaagtaccgccagtgatcaaccctcccacagtttggagcgccaaatgaatggaaatcaggagaagggtgacaaaaccgatcgaaaaaaagataagactggcaaggaaaaaaagaaggatagagacaaggagaaagacaagatgaaagcaaagaaagggatgttaaaaggccttggtgacatgttcaggttcggaaaacataggaaggatgataaaatcgagaaaacaggcaagataaagattcaggagagcttcacaagtgaagaggaaagaatccgcatgaaacaggagcaggagcggattcaggccaagacaagagaatttagagagcggcaggctagggagcgagattacgctgagatacaggattttcaccgcacttttggctgcgatgacgagctgatgtatggaggtgtgagcagctatgagggcagtatggccttgaacgctagaccccaatcccctcgggagggacacatgatggatgccctgtatgctcaggtaaagaagccacggaacagcaaaccgagcccagtggactctaacaggtccaccccatctaaccacgaccgaatacagcgacttcggcaagagttccagcaggcaaagcaagatgaggacgtcgaagatagacgcagaacatactcttttgagcagccatggccgaatgcccggcctgctacccagtccggccggcatagtgtatctgtggaggtgcagatgcagcgccagagacaagaggaacgcgagagctcacaacaggcccaacgccaatactctagcctgccccggcagtcacggaaaaacgcgtcttcagtgagccaggacagttgggagcagaactacagccccggcgaggggttccagtctgccaaggaaaaccctcgctacagctcttaccagggctctagaaacggctaccttggaggtcacgggtttaatgcacgcgtgatgctggaaacccaggagcttttgcggcaggaacaaagacggaaggagcagcagatgaaaaagcagccacctagcgagggccctagcaactacgatagctataaaaaagtccaggacccatcatatgcccccccaaaaggtcccttccgccaagatgtcccgccgtccccgagtcaggtggcccgtctaaacaggttgcagacacctgaaaaaggcagacccttctattcttag

SEQ ID NO: 198662 - DNA, 3891 bp, Artificial Sequence
  Description of Artificial Sequence: Synthetic coding sequence
atgaaggtgaccgtgtgcttcggccggacccgggtggtggtgccctgcggagatggacatatgaaggtgttctcactcatccagcaggccgtgactcggtaccgtaaggctatagcaaaggatcctaactattggatccaggtgcacagactcgaacacggggatgggggcatcttggacctggacgatatcctttgcgacgtggccgacgataaggaccgccttgtggcagtcttcgacgaacaggacccacaccatggaggcgatggaacctccgctagctcgactggtacacagagtccggagatattcggttcagagctggggacaaacaacgtgagtgcgtttcaaccctatcaggcgacctccgagatcgaggtgactccttcggtgctgcgggccaatatgcccttacacgtccggagaagtagtgatcctgcgttgataggcttgtccactagcgtgagtgacagcaattttagctccgaggaaccttctcggaagaaccctacaagatggagcaccacagctggtttcctgaagcagaacacggcgggctcaccaaagacatgcgacagaaaggacgaagacggaacggaggaagacaattcccgcgttgagccagttgggcacgccgacactggactggagcacattcctaattttagtcttgatgatatggtgaagctcgtggaagtgccaaacgatggcgggcctttaggaatccatgtggtgccttttagtgctcgcgggggccggaccttaggcctgttggtgaagaggcttgagaaaggcggaaaggccgagcacgagaatctctttcgagaaaacgactgcatagtccgcatcaacgacggtgatctccgcaaccgacggtttgagcaggcccagcacatgttcaggcaagctatgcgaacacccataatatggttccatgtcgtgccagcagccaataaagagcagtatgagcagttgtcgcaaagtgaaaaaaacaactactattcctcccgtttttctccagactcccaatatatcgacaatcggtctgtgaatagtgcaggattacacaccgtgcagagagcccccaggctcaaccacccaccagagcagatcgatagccattctaggctcccccactcagcccatcccagcggcaaaccccccagcgcccccgcatcagctccccagaatgtgttctcaactacggtttcttccggctacaataccaagaagattggaaagcgattaaacattcagcttaaaaaggggactgaagggcttggtttttctatcacttctcgggacgtaaccattggaggctcagctccgatctatgtgaagaatatcttaccacgtggggcagcgatccaggatggcagactgaaggccggggatcggctcattgaagtcaatggggtagatttggttggaaaaagccaagaggaggtggtctcactgctccgctccacgaagatggagggaactgtaagtcttctggtgttccgacaagaggatgccttccaccctcgtgaactgaaagctgaagacgaagacattgttctgactccggacggcacccgcgagtttttgacatttgaggtgcccttaaatgattctggcagtgctgggctgggagtgagcgtgaaaggaaaccggtctaaggaaaaccacgctgatctggggatctttgttaagagcatcattaacggaggagccgctagcaaagatggcagactccgggtaaatgaccagttgatcgctgtgaatggggagtccctccttgggaagacaaaccaggatgccatggagactctccgaagaagcatgagcactgagggcaacaagcgggggatgattcagctgatagtcgcccgtaggattagtaagtgtaatgagctaaagagcccagggtcccctcccgggcccgaactccctatcgaaacagctcttgacgatcgggaacgtagaatctcccacagcctctactccgggatagagggtctggatgaatctccaagcagaaatgctgctctatctagaattatgggcaaatatcagctctctccgacagtgaacatgcctcaggatgatacagtaatcatagaggacgacaggttgccagtgttgcccccacacctttcagaccaatcctccagctcttcccacgacgacgtcggatttgtgaccgccgatgccggtacctgggccaaagccgcaatctcagacagcgccgactgttctctgtcgccagatgtggatcccgtcctggcctttcaacgggagggctttgggaggcagtcaatgagtgaaaaaaggacaaaacagtttagtgatgccagccaattagacttcgtgaagactagaaaaagcaaaagcatggacctgggcatcgccgatgaaacaaaactaaataccgtcgacgaccaaaaagccggctcacccagccgggatgttggcccgagcctgggattgaagaagagttccagtcttgagagcttgcagacagcagtggctgaggtcaccctgaacggtgacattccatttcataggcctcgtccccggattatccgaggcaggggttgcaatgaaagcttccgagcagccattgacaaatcatacgacaagcccgctgtcgacgatgatgacgaaggcatggagactcttgaggaggacactgaggaaagtagcagatccggacgagagtctgtgtcaaccgcatcagaccagccgtcgcacagcctcgagcgccaaatgaacggcaatcaggagaagggtgacaagaccgatagaaaaaaggataaaaccggaaaggagaaaaagaaagatagggacaaagagaaggacaagatgaaggctaagaaggggatgcttaaaggactgggtgacatgttccgattcgggaagcaccggaaggatgataaaatcgagaaaactggcaaaattaagattcaggaaagttttacatccgaggaggagcggataaggatgaagcaggaacaggaaaggattcaggccaagacacgtgagtttcgcgaacggcaggcgagggagcgagattatgcagagatacaagactttcacaggacctttgggtgtgatgatgaactcatgtacggaggagtgagctcctacgaagggtcaatggctcttaacgccaggccacaaagccccagagagggacatatgatggatgcattgtatgctcaggttaaaaaacctagaaactcaaagccgtcgccagtggattcaaatcgctcaactcccagcaaccatgacaggatccagcggcttcgccaggaatttcaacaggctaagcaggacgaggacgttgaggatcgccggaggacatactctttcgagcagccatggcctaatgcacggccggcgactcagtcaggacgacactctgtcagtgtggaggttcagatgcagaggcagcgccaagaggaacgcgagtccagtcaacaggctcagcggcagtattcatccctgcctcgtcagagccgcaaaaacgcatcctctgtgagtcaggactcctgggaacagaattactctccaggagagggtttccagtctgctaaagagaacccacgctactccagctaccaggggagtcgcaacggttatctggggggacacggctttaatgcccgcgttatgctggagacccaggaacttctcaggcaggagcagcgccggaaggaacaacagatgaagaagcaaccaccatctgaaggcccaagcaactatgacagttataaaaaggtacaggacccctcctacgctccacctaagggcccattccgccaggatgtgcctcctagtccgtcccaagtggctcggctgaataggctgcaaacacctgagaagggtaggcctttttactcgtag

SEQ ID NO: 198663 - DNA, 3735 bp, Artificial Sequence
  Description of Artificial Sequence: Synthetic coding sequence
atgaaggtgaccgtgtgcttcggccggacccgggtggtggtgccctgtggcgatggacatatgaaggtttttagtttgatccagcaggccgtcactagatatcgaaaagcaatcgcgaaagatccaaactactggatccaggtacaccggctggaacacggagatggaggtattctcgacctcgacgacattctctgcgacgtggctgacgataaggaccgtttggtcgccgtttttgatgaacaggacccgcatcacggaggagacggtacctctgcaagcagcacaggtacacagagcccagagatcttcggctccgaactgggcacaaacaatgtgagcgctttccagccatatcaggcaacatcagagattgaggtgaccccctctgtgctgagagcaaacatgccgctccatgtcagacggtcgtcagaccctgccctgataggtttatccactagtgtgagcgactcaaatttctctagcgaggaaccatcgagaaaaaatccaacgcgatggtctaccacggctgggttcctcaagcagaacacggcaggctcaccaaagacatgtgaccggaaagatgaggacggaactgaggaggacaatagtcgggtcgaaccagttggacatgccgacactggactcgaacatatacccaacttttctctggatgatatggtaaagttagtggaagtgccgaacgacggaggacccctcggtattcacgtcgtccctttctccgctcgaggaggtcgcactctgggcctcctggtcaaacggctcgaaaagggcggaaaggcagagcacgagaatctgtttagagagaatgactgtattgtcaggattaatgacggtgatctccgtaacaggcgctttgaacaggcccagcacatgtttaggcaggccatgaggacgcccattatttggtttcacgtggttcctgccgccaacaaagaacagtacgaacaactgtcccagagtgaaaaaaacaattactactcctctcgattcagccctgatagtcagtacattgacaatcgctcggtcaattccgccgggctgcatactgtgcagcgcgcgcccagactgaatcatccccctgagcaaattgattcccactctagactgcctcactcagctcacccctcaggcaaacccccaagcgcgcccgcgtccgcaccccagaacgtcttttcgaccactgtttcatcaggctacaacactaagaagatcggaaagaggctcaatattcagctgaaaaagggcacagaaggcctgggtttctccattacctctagggacgtgaccatcggaggttcagctccaatctacgtcaagaacattctcccacggggggctgctattcaggatgggagactgaaggcgggtgaccgacttatcgaggtaaatggtgtggacctcgtgggcaagtctcaggaagaggttgtctctctgctccgctcaaccaagatggaagggaccgtgtccctgttagtctttaggcaggaggatgcttttcacccaagggagctgaaagcggaggatgaagacatcgttctcacacccgacggtactcgggagttccttacattcgaagtgcccttaaatgattcgggctcagccggactgggggtatcagtcaagggaaatcggtccaaagaaaaccacgctgatttggggatcttcgttaaaagtattataaatggcggagcggcttccaaggatggcagactgcgagtgaacgatcaactgattgcagtgaacggtgaatccctcctgggcaaaactaatcaggatgctatggaaaccctccgcaggtccatgtctaccgagggcaacaagcgaggaatgatccagcttattgtcgctcggaggatttctaagtgcaacgagctcaaatcccctggttcaccacccggccctgagctaccgatcgagaccgccttggacgacagggagagaaggatttcacacagcctctactctggcatcgaaggcttggacgagtcgcctagtagaaatgctgctctttcccggatcatgggcaaataccagctttctcccaccgttaacatgccccaagatgatacggtcatcatcgaggatgacaggctcccggtcctgcccccgcacttaagtgaccagagtagttcttccagccacgacgacgttgggttcgtcaccgccgatgcaggaacctgggccaaggccgccatttcggattcagctgattgcagtcttagccccgatgtcgacccagtccttgccttccagagggagggctttggcaggcagtccatgagtgagaaacggaccaaacagttctctgacgcctcccagctggacttcgttaagacccgcaagtcaaagtctatggacctcggatcttctccatccagggacgtgggaccatcactgggattaaagaaaagcagttctctagagtctctgcagaccgccgtggcggaggtcaccctgaatggggatattccattccatcgcccccgtccccgcattattcgcggcagagggtgtaacgagagctttcgggctgccatcgacaaaagctatgacaaacctgccgtggatgacgatgacgaaggcatggagacgctcgaggaggatacagaggaatcctccaggagcgggcgtgaaagtgtcagcaccgcctctgaccagccctctcacagtctggagcgacaaatgaatggtaaccaagaaaaaggcgataaaactgataggaagaaagacaagaccggaaaggagaagaaaaaggatcgggataaagagaaggataaaatgaaagccaagaaggggatgttgaaaggattgggtgacatgtttcgtatacaggcaaagactcgagagtttcgggagagacaggcacgagaaagggattacgccgagattcaagacttccaccggacattcgggtgtgacgatgagctgatgtacggcggtgtatccagttatgaagggtccatggcactgaacgccaggccccaatccccacgcgaaggccacatgatggatgcactgtacgcacaagtcaagaaacctcgtaattccaagccgtcaccggttgattctaatcgtagcacgccctccaatcatgataggatacagcgcctcaggcaagaatttcagcaagcgaagcaggatgaagatgtagaggacagacgtcggacgtactcctttgaacagccttggcccaacgctcgaccagccacgcagtccggacgacatagtgtgtcagtggaggtgcagatgcagaggcagcgacaagaagaacgcgagtcatcacaacaggcacagagacagtacagctccctccctcggcagtctcggaagaacgcaagttcagttagccaggacagttgggaacaaaattactctccaggggagggttttcaatctgcgaaagagaatcctcgatacagtagttatcaaggcagcaggaacgggtacctgggaggacacggattcaacgcccgggtgatgttagaaacccaggaacttcttcgacaggagcagaggaggaaggaacagcaaatgaaaaagcaaccaccaagtgaaggcccgagcaactacgactcatacaagaaagtccaagacccctcatatgctcctccaaagggccccttcagacaggacgtgccaccctctccatcccaggtagcacggcttaatcgactccaaacccccgagaaaggacgaccgttttatagctag

SEQ ID NO: 198664 - DNA, 2244 bp, Artificial Sequence
  Description of Artificial Sequence: Synthetic coding sequence
atggtgaagctggtggaggtgcccaacgacggcggccccctgggcatacacgtggtacccttctccgctcgcgggggacggacacttggcctgctcgtgaaaaggctcgaaaagggcggaaaagccgaacatgaaaatctctttagggaaaacgattgtattgtcaggatcaatgacggcgacctccgcaaccgccgcttcgagcaggcccagcacatgtttagacaagctatgcggacgcctataatttggtttcacgtggtgcccgccgcaaacaaggagcagtatgagcagctctctcaatccgagaaaaacaattattactccagtcgcttctccccagacagtcagtatatcgataataggagcgtgaatagcgccgggctacacacagtccagagggcacctagattgaaccaccccccagaacagattgattcgcactctcgtttaccacattcagcccaccctagcggaaaacctccctctgccccagcatcggcaccccagaacgtctttagtacaaccgtgagcagtggctacaataccaaaaagatcggaaagagactgaatatccagttgaaaaaaggaacagaaggcctcgggttcagtataacttcccgggacgtaactattggcggaagcgcacctatatatgtgaaaaacatactgccacggggggcagctatccaggacggacggcttaaggccggcgaccgactcattgaagtgaatggggtcgatctcgtcggtaagtctcaggaggaggtcgtgtcgttgctgagatctacgaagatggagggcacagtttctcttctggtgtttcgccaggaggacgccttccatcctcgggagctgaaggccgaggatgaagacatcgtgctgacaccggatggaacgagagaatttctgacatttgaagtgcccctcaatgactcgggctctgccggtctgggagtcagcgtgaaagggaaccggagcaaggaaaatcatgcagatctggggattttcgtgaaaagtatcattaatgggggggctgcctctaaagacgggaggctccgcgttaatgatcagctcatcgccgtgaatggagaatcccttctcggcaagactaaccaagatgctatggaaaccttaaggcgctcaatgagtacggaagggaacaagagggggatgatacagctgatagtcgcacgcaggatttctaaatgcaatgagctaaagagcccaggcagcccacccgggccagagctgcccattgaaacagccctagatgaccgcgaacgaagaatcagtcattctctctactctggtatcgaagggctggatgagtctccgtctcgcaatgccgcactcagcagaatcatgggcaagtatcagctatcgcccaccgttaacatgcctcaggacgacaccgtcatcatcgaagacgatagactgccagtactgccaccgcacctcagcgatcagagcagctctagtagccacgacgacgtaggctttgtgaccgcagatgctggcacttgggcgaaagctgcaatttctgacagcgcagattgctctttgagccccgatgtggatcccgtcctggcatttcagagggaaggcttcggccggcaatctatgagtgaaaagcggacaaagcagttcagcgatgcgtcacagctggactttgtcaaaacccgcaagtcaaagagtatggacctcgttgcggatgaaacaaaactgaataccgttgatgatcagaaggcaggttccccgtcacgcgacgtcggcccttcgctggggctgaagaaaagtagctctcttgaatccctgcaaactgctgttgccgaagtgaccttgaacggggacatacccttccaccggcctaggcctaggattattcggggcaggggatgcaacgaatctttccgagctgcgattgacaaatcttacgacaagccagcggttgatgacgacgacgagggtatggaaactttagaggaggacacagaagaatcttcccgctccggcagagagagtgtgtccacagcctccgatcagccctcccacagcctcgaaaggcagatgaatgggaaccaggaaaagggggataaaactgatcgaaagaaggataaaacgggtaaggagaaaaagaaggacagagataaagagaaagataaaatgaaagctaagaaagggatgctcaagggactcggagatatgttctcccttgccaaactgaaaccagagaaacgctag

SEQ ID NO: 198665 - DNA, 3801 bp, Artificial Sequence
  Description of Artificial Sequence: Synthetic coding sequence
atgaaggtgaccgtgtgcttcggccggacccgggtggtggtgccctgtggcgacggtcatatgaaagtgttctccctcatacagcaggctgtcacccgttaccgaaaagctatagccaaagatcctaattactggatccaggtacaccgtctggaacatggagatgggggtatcctcgacctggatgacattctatgcgatgtggctgacgataaagacagactcgttgcagtgtttgacgagcaggacccccaccatggaggcgacggtaccagtgcttctagcaccgggacccagtctcctgagatctttggcagcgaactggggacaaataatgtcagtgccttccagccataccaggcaacatccgagatcgaggtgacacccagtgtgctgagagctaatatgcccttgcatgtacggagaagttctgaccctgcgctgatcgggctctctacctccgtgtccgattcgaacttcagtagcgaggaaccctctcgcaaaaacccaactagatggtccacaacagcaggattcctgaagcaaaatactgccggaagcccaaagacctgcgatcggaaagacgaagacgggactgaagaggacaacagcagagtggagcccgtgggtcacgcagacaccggcctggagcatatccccaacttcagtctcgacgacatggtgaagctggtcgaagtgcctaacgatggcggtcctctcggcatccatgtagtgcccttcagcgcccgcgggggtcgcaccttaggcctcctcgttaagcgtcttgaaaaagggggtaaggcggaacatgagaaccttttcagagagaatgactgtattgtgaggattaacgacggcgatctgcgcaatcggcgcttcgaacaggctcagcatatgttcaggcaggccatgagaactcccattatttggtttcatgtggtcccggccgccaataaagagcagtatgagcagctgtctcaaagcgaaaaaaataattattacagcagccgcttctcacctgattcacagtacatagataataggagcgttaactcggctgggcttcatacggtgcaaagagcgccccgccttaatcaccctcccgagcaaattgattcccactcccggcttcctcattccgcacatccttctggcaaacctccatctgctccagcgtctgcaccccagaacgtcttctccaccaccgtctctagcggctataacacaaaaaaaattgggaaaagactcaatattcagttgaagaaaggcacggagggcctcggattctccattacttcccgtgatgtgacaatagggggctccgcacccatctacgtcaaaaatattctccctcgcggcgcagcaattcaggacgggcgattgaaagctggagaccggctgattgaggttaatggcgtcgacctggttggcaagtcccaagaagaggtcgtgtctctgctaagaagcacaaaaatggaggggacagtctctctgctggtcttccgccaggaggatgccttccacccacgcgagctcaaagccgaggatgaagatattgtcctcaccccagacggcactagggaatttttaacattcgaagttccactgaacgattccggctctgccgggctaggcgtatctgttaagggtaatcgctcgaaggagaaccacgctgacctggggatctttgtgaagagcattatcaatggaggcgcagccagtaaggatggccgcctgagagtaaacgaccagctgatcgcagtaaacggtgaatcattgctggggaagacaaatcaggatgctatggaaactctgaggagaagtatgtccaccgaaggcaacaagcgaggcatgattcaactgattgtggcccgacgcatctcaaaatgcaatgagcttaaatcgcccggatctccaccgggccccgagctgcccattgagaccgccctggatgaccgggaaagacggatctcacattccctttatagtggtattgagggcttagatgaaagtccatctaggaacgccgcccttagtcgaatcatgggaaagtatcaactatcccctacagtcaatatgccccaggacgatacagtcattattgaggacgaccgtctgcccgtgctgcccccacacttgtcagatcagagctcgtcaagtagtcacgatgatgtcggcttcgtaaccgcagatgccggcacctgggctaaggctgctatttcggacagtgctgattgctcactgagtcctgatgtcgatcctgtgctcgctttccagagagaggggtttggaaggcagattgcagatgaaaccaaactcaataccgtggacgatcagaaggcagggtctccaagtagggatgtcggaccgtccttggggctgaaaaaatcgtcttccctggagagtctccagactgctgtggctgaagtaacactcaatggggatatcccttttcaccggccgcgtcctcggatcattcgagggagagggtgcaatgaaagcttcagagcagctatcgataagtcatacgataaaccagccgtggacgacgatgatgaaggaatggagacattagaggaggatacagaagagagcagccgttcggggcgagagtctgtttccacagcttccgatcaaccctcccactccctcgagcgtcaaatgaacggaaaccaggagaagggggataaaactgatagaaaaaaggacaaaaccggaaaggagaagaagaaggaccgagataaggaaaaggacaaaatgaaagctaagaagggcatgctgaaaggcctcggcgacatgttcagatttggaaaacaccgaaaggatgataaaatcgagaaaacaggaaaaatcaagattcaagagagtttcacttctgaagaagagagaatcagaatgaaacaggagcaggagagaatacaagccaaaacacgtgagtttcgggagcgccaagcaagagagagagactacgccgaaatccaggattttcataggacgttcggttgcgacgatgagcttatgtatggtggggtttcctcctatgaagggagcatggcactcaacgcgcgaccacagtctcctagagagggtcacatgatggatgctttgtatgcccaggtcaagaagccgcgtaattcgaagccctcacccgtggactcaaacaggagcacaccatctaaccacgacaggattcagcgcctacggcaggaatttcagcaagctaagcaggacgaagacgttgaggataggcgaagaacttacagttttgaacagccatggcctaatgcccggcctgccacccagagcggccggcactctgtcagtgtcgaagtccagatgcaacgacagcgccaggaagagcgagaatctagccagcaggcccaaagacagtattcatccctgccgcggcaaagccgtaaaaatgctagtagcgtttcccaggacagttgggaacaaaactacagcccaggcgagggttttcagagcgcaaaggagaaccctagatacagctcatatcagggctcccgtaacggatacctaggaggccatggctttaatgcccgggtgatgctggagacacaggagctgctgagacaggaacagcggcgtaaagaacagcaaatgaaaaagcaacctccctctgaggggccctcaaattacgattcctacaagaaagttcaagatccttcctatgccccccctaagggcccattcagacaagacgtgccaccttcacctagccaagtggcacggcttaacagactgcaaacacccgaaaaagggagacccttctacagctag

SEQ ID NO: 198666 - DNA, 4023 bp, Artificial Sequence
  Description of Artificial Sequence: Synthetic coding sequence
atgaaggtgaccgtgtgcttcggccggacccgggtggtggtgccctgcggcgacggtcatatgaaggttttttccctcatccagcaagcagttacgcggtatcgtaaggctatcgctaaggatcccaactattggatacaggtgcaccgacttgaacatggggatggcgggatcctcgacctggatgacatcttgtgtgatgtggctgatgacaaggaccggctcgttgcagtcttcgatgaacaagacccacaccatgggggggatggcacatccgcgtccagtactggtacacagtcaccagagatatttggttctgaactgggcactaacaacgtctccgctttccagccataccaagccacaagtgaaattgaagtgacaccctccgtgctgagggccaacatgcctctccatgtgcgtcggtcatccgacccagccctcatcggtctgtcaacttctgtctccgacagcaacttctcaagcgaggaaccctcgagaaagaatccaacaagatggagcacaaccgccggtttcctcaaacagaacactgctggttctcctaaaacctgtgatcgaaaaaaagatgagaactaccggtctctgccaagagatacctctaattggtctaaccagtttcagcgggataacgcacgttcctcgctctctgcatcacatccgatggtcggtaagtggttggaaaagcaagaacaagatgaagacggaaccgaagaggataatagccgcgtcgagcccgtggggcacgctgacaccggcctggaacatataccaaatttcagccttgacgacatggtcaaactagtcgaggtcccaaacgacggtgggcctctcggcatccacgtggtccctttcagtgcccgtggaggtcggaccctggggctgctggtaaagagacttgaaaaagggggtaaggcagagcacgagaatctcttcagagaaaacgattgcatagttcggatcaatgatggggaccttcgcaatagacggtttgagcaagctcagcacatgttcagacaagccatgagaactccaattatctggttccacgttgtcccagctgcgaataaagagcaatacgaacagctctcacagagcgagaaaaacaactattatagttcccggttttcccccgactcacagtacatagacaatagatctgttaatagcgccgggttgcatactgtccagagggcaccccgcctcaaccacccccctgaacagattgatagtcactctagactgccccatagtgcccacccttctgggaagcccccaagcgctccagcatccgcgccccaaaacgtattcagcactaccgtttcttctggctacaacacaaagaagatcggaaagcgactgaacatacaactgaagaaaggcacagaaggcctcgggttcagtattacttctcgtgatgtgacaatcggtggctccgctccaatttacgtcaagaatattctgccgcggggagccgccatacaagatgggagactgaaggcgggcgatagattaatcgaggtcaacggcgtggaccttgtggggaaatcccaagaggaggtagtgagcctcctccgttccaccaagatggaaggtacggtgagcctcttggtgttccggcaggaggacgcattccatccaagagaactcaaagccgaagacgaagacattgttcttacccctgatggcaccagggagtttctcaccttcgaagtccctctgaatgacagtggatccgccggtttaggggtatctgtaaagggtaatcggagcaaagaaaatcacgcagatttggggattttcgtaaagtctatcattaacggtggggccgcctctaaggacggccgactgcgggtcaacgaccagctcatcgccgttaacggcgagtctctgctggggaaaaccaaccaggacgccatggaaaccctccgtagatctatgtcaaccgaagggaacaaaaggggtatgattcagctgatagtggccaggaggattagtaaatgtaatgagctgaaaagtcccgggtctccaccagggccagaactgcccattgaaaccgctctagacgaccgcgagaggagaatttctcactcactgtacagcggcatcgaggggcttgatgagtcaccaagtagaaatgccgcgctgagtcgaatcatggggaagtaccagttgtctccaactgtgaatatgccccaagatgataccgttattatcgaggatgaccgcttacccgtcctgccaccccatctctccgaccagtctagttccagttctcacgatgatgttggctttgtaaccgctgacgctggaacatgggcgaaggccgcaatttccgattccgctgactgtagcttgagtcccgacgtagaccctgtgttggcctttcagcgtgagggtttcggccggcagagtatgtccgagaagcgcactaagcagttctccgatgctagccaactggatttcgtgaagacccgcaaatctaagagtatggatctggggatagcagacgaaactaagctgaatactgtggatgaccagaaggctggttccccatcccgcgatgtgggcccatccctgggtctgaagaaaagtagcagcctggaatcattgcaaacagccgtcgctgaagtgacccttaacggcgatatcccctttcaccggcccagacctcgcattatcagaggccgcggttgcaatgaatcctttcgggctgctatcgataaatcctacgacaagccagcagtagacgatgacgacgaaggcatggagacactggaagaggacaccgaggagagcagcaggtcagggagagaaagtgtttcgacagcttctgaccagccaagccactctttggaaaggcagatgaacggtaatcaagaaaagggagacaaaacagaccggaagaaggacaagaccggaaaggagaaaaaaaaggatcgcgacaaggaaaaggacaaaatgaaggcaaagaaggggatgttgaagggacttggcgatatgtttcggttcggcaagcaccgcaaggacgataagatcgagaagacaggtaaaattaaaatacaagagagcttcacttccgaggaagagcgcattagaatgaagcaggagcaagagcgcattcaggctaaaaccagagaattccgggaacggcaggctcgggagagggactacgctgagatacaggatttccataggacgttcggatgcgacgatgaacttatgtatggcggagttagcagctacgagggatctatggccctgaatgcccggccccagtcgcccagagagggccacatgatggatgccttatacgctcaggtgaagaagcctagaaatagcaaaccctcccctgtggacagcaacagaagtactccgtcgaatcatgaccgaattcagagactgagacaggaattccaacaggccaagcaagatgaggatgtggaagatcggcgccgcacgtacagctttgaacagccctggccaaacgcaagacccgccacacagtcaggacggcactctgtgtctgtggaggtacagatgcagagacagcggcaggaggagcgcgaatcttcacaacaggcccagcgtcagtactccagtcttcctcgacagagtagaaaaaacgcttctagcgtgtcacaggacagctgggagcagaattatagtcccggagaggggtttcagtccgccaaggagaatccacggtactccagctatcaaggtagccgcaatggatacctgggtggccacgggtttaatgcgcgcgtgatgttggagacccaagaacttctacggcaggagcagcggcgaaaggagcagcagatgaaaaaacaaccacccagcgaaggtccctctaactacgatagttacaagaaggtgcaggacccctcctacgcacctccgaaaggcccctttcggcaggatgtccccccgagcccctcacaggtggcgcggctaaacaggctccagacccccgagaagggccgacctttctactcctag

SEQ ID NO: 198667 - DNA, 1119 bp, Artificial Sequence
  Description of Artificial Sequence: Synthetic coding sequence
atgaaccggagccaccggcacggcgccggcagcggctgcctgggcacaatggaagtgaagtccaaatttggcgcagaatttagacgcttctctttggaacggagcaaaccaggaaagttcgaagaattttacggtctgctgcagcacgtgcacaagatccccaacgtggacgtgctagtgggctatgctgacattcatggagacctgctccctatcaataacgatgacaactaccacaaggccgttagcacagccaacccactgctgaggattttcatccaaaaaaaagaagaagctgactactctgcttttgggactgacacgctcatcaagaaaaagaatgtcttgactaacgtgctccgcccggataaccacagaaaaaagccccatattgtgatcagtatgccccaggatttccggccagtctcatccatcattgacgtggatatactacccgaaactcatagacgcgtacgactgtataaatacgggacggaaaaaccactgggattctacatccgggacggctcgagcgtgcgggtgacaccccatgggctggagaaggtgccgggaatcttcatttcccgcctggtgcccggtggactggcccaatccactggcctgctagctgtcaatgatgaggttctggaggtgaatggaatcgaggtgtcaggcaaatctcttgaccaggtgacagacatgatgatcgccaactccaggaatctgatcatcactgttagacccgctaaccagcggaacaacgtagtgcgtaattcacgcacctcgggatcgtctggccagagcaccgataattctctcttagggtacccacagcaaattgagccatcttttgaacccgaggacgaggatagcgaggaggatgacatcattatcgaagataatggggtcccacagcagatccctaaagcagttccaaacactgaatctctcgaaagcctgacacagatcgagctgagcttcgaatccgggcagaacggatttatcccttctaacgaagtgagcctggctgccatagctagttcctcgaataccgaatttgagacacatgcgccagaccagaagctcttagaagaggatggcaccattatcacattgtag

SEQ ID NO: 198668 - DNA, 1131 bp, Artificial Sequence
  Description of Artificial Sequence: Synthetic coding sequence
atgaaccggagcttccacaagagccagaccctgcggttctacgactgcagcgccgtggaggttaaatcaaaatttggagccgaatttcgaagattctccctcgaccgacacaagcccggaaagttcgaagatttctacaagctagtggtgcatacacaccatatctccaacagtgacgtgaccataggttatgccgacgtgcatggcgacctcctgcctatcaacaacgacgacaacttttgcaaggccgtgagcagcgccaatcccctgctccgggtctttatccagaagcgcgaggaggctgagaggggcagccttggcgccggtagcctttgccgccgtaggagagctctgggcgccctacgcgatgaaggtccgagaaggcgcgcccacctcgacatcggccttcccagagattttcggccagtaagttccattattgacgtggaccttgtgcctgaaacgcatcggcgggtgcggttacatagacacggatgtgagaaaccactcgggttctacatccgtgacggcgcctcagttagagtgaccccccacggcctggaaaaggtgcccggaattttcattagccggatggtgcctggagggctagccgaaagtacagggcttctagctgtaaacgacgaggtactggaagttaacgggatcgaagtggccggtaagactttggaccaggtgacggatatgatgatcgccaacagtcataatctgatagtgacagtaaagcctgccaatcaacgtaacaatgtagtgagggggggccgggctctgggttctagtggacctccaagtgatgggacagccggattcgtaggaccacccgccccccgagtactgcagaactttcaccctgacgaagcagaatccgacgaggacaacgatgttgtcatagaggggacactagaaccggctcgtccaccccagaccccaggggctcctgctggctcattgtctcgggttaacggggctgggctcgcccagagactgcagcgggatctggctctagatggcggactgcagagattacttagcagccttagggctgacccacggcacagtttggcactccctcccgggggggtcgaggagcacgggcccgctgtgacactatag

SEQ ID NO: 198669 - DNA, 1236 bp, Artificial Sequence
  Description of Artificial Sequence: Synthetic coding sequence
atggccgaggccgagctgcacaaggagcggctgcaggccatcgccgaaaagagaaagcggcagactgagatcgaaggtaagcgtcagcagctggacgaacagatcctgctgctccagcattccaagtcaaaagtcttgagggaaaaatggctgcttcagggtattccagcgggtacggctgaggaagaggaggctaggagaaggcaatccgaggaagacgagtttagagtcaagcagctggaggacaacatccaaagactggaacaagaaattcaaactcttgaatccgaggagtcacagatttccgcgaaagagcagattattctcgagaaactgaaggagaccgagaagagttttaaagattttcagaaggggttctcttccactgatggagacgccgtaaactacatttcaagccaattaccagatctgcctattctgtgttctagaaccgccgagcccagtcctggccaggacggcacatcccgcgccgcagctgtgtatgctatggaaattaatgtagaaaaggataagcagaccggcgagacaaagattcttagcactagcaccatcgggccagaaggcgtccaccagaagggtgtcaaggtgtatgatgatggcacgaaagttgtgtatgaggtaagatccggcggcaccgtggtggagaatggcgttcacaaactatccacaaaggacgtggaagagttgattcagaaagccggacagtccagtttggggggagggcacgtgagtgagcggactgtgatcgccgacggcagcctgtctcacccgaaggaacatatgctgtgcaaggaagcgaagctggaaatggtgcacaagtcaagaaaagaccactcatcaggcaatccgggtcagcaggcacaggctccatcagccgctgggccagaagcaaacctcgatcaaccagtcacaatgatattcatggggtaccagaacatcgaagacgaggaggaaacaaaaaaagtccttggctacgatgagactataaaggcggagctggtcttgatagacgaggacgacgagaagtctctgagagaaaagacagtgaccgacgtgagcacaatcgacgggaacgcagcagaactggttagcggcagaccagtatctgataccaccgagccatcgtctcccgaagggaaggaggagtcactggccacagaaccagcccccggtacccaaaaaaaaaaacgatgccagtgctgcgttgtgatgtag

SEQ ID NO: 198670 - DNA, 1140 bp, Artificial Sequence
  Description of Artificial Sequence: Synthetic coding sequence
atggagatggccgaggccgagctgcacaaggagcggctgcaggccattgctgagaagcggaaacggcaaacagagatagaaggaaagaggcaacagctggatgagcagatactcttgctgcaacattcaaaatccaaggtcctgagggaaaaatggctgctgcagggcattccagccggaactgcggaagaggaggaggccaggcgaagacaaagcgaagaggacgaatttagggtaaaacaactggaggacaatattcaaagacttgagcaggagattcagactttagagtctgaggagtctcagatctccgctaaggagcagatcattctagagaaactaaaggagactgagaagtcattcaaggattttcagaaaggcttttcctccaccgacggagctgtatatgccatggagatcaacgttgaaaaggacaagcagacaggagagactaagattctgagcacgtccaccattggtccagaaggcgttcaccagaaaggcgttaaagtctatgatgacggcaccaaggttgtctacgaagtaagaagcggaggcactgtggttgaaaatggggtccataaactttcaacaaaggacgttgaagagctgattcagaaggcgggccagtcttctctcggcggaggccatgtttctgaacgcaccgtgatagccgatggaagtttgtctcaccccaaggaacacatgctctgtaaggaagcaaagctggaaatggtacataaatctcggaaagatcattccagcgggaaccctgggcaacaggcgcaggctccttcagctgccggtccggaagccaaccttgatcaacctgtcacaatgatctttatggggtatcagaatattgaagacgaggaggaaacaaagaaggtactcggctacgatgagaccattaaagctgagctggtgttgatagacgaagatgatgaaaagtccctgcgcgagaagacggtgacggatgttagcaccatcgatgggaacgcagcagagctcgtgagtggccgacccgtgtctgatacaaccgaaccatcttcccccgaaggaaaggaagaatcactggccaccgagcccgcccccggaacacagaagaagaagagatgccaatgttgcgtggtaatgtag

SEQ ID NO: 198671 - DNA, 1242 bp, Artificial Sequence
  Description of Artificial Sequence: Synthetic coding sequence
atggagatggccgaggccgagctgcacaaggagcggctgcaggccattgccgaaaagaggaagcggcagacagaaatcgagggcaaaaggcaacagcttgacgagcaaattcttctgctgcagcactcgaaatctaaggtcctgagagagaaatggttattgcagggtattccggccgggaccgccgaggaggaggaagcgcgacggcggcagtctgaggaggatgagttccgggtcaaacagcttgaggacaatatccagagactggagcaggaaatccagacactggaaagcgaggaaagccagattagcgccaaggagcagattatcctcgagaaactcaaggagaccgaaaagagcttcaaggatttccagaaggggttcagcagcactgatggcgacgccgtcaactacatctcctctcagctaccagatctgccaattctgtgctccagaactgctgagcccagtccaggtcaagacggcaccagtcgggctgcagccgtgtatgctatggagattaatgtggaaaaagataagcagacaggcgagactaagatcctgtcaacctctaccatcggccccgaaggagtccaccagaagggcgtgaaggtgtatgacgacgggacgaaagttgtctacgaggtgcggagtggtggaaccgtggtggaaaacggggtacacaagctgtccacgaaggatgtggaagaactgatacagaaggctggtcagagctcactgggcgggggccatgtttccgagcggactgtgatcgctgacggttctttgtcgcatccaaaagagcacatgctgtgcaaagaagctaagcttgaaatggttcataagtcaagaaaagaccactcttctggcaaccccggacaacaggcccaggcaccctcggccgccgggccagaggccaacctggaccagcctgtgactatgatttttatggggtatcagaatattgaggatgaggaagaaactaagaaggtcttgggttatgacgagaccataaaggctgagctcgtgttaatcgatgaggacgacgagaagagccttagggaaaagacagtgaccgacgtgtccaccattgatgggaacgccgccgagttggtgtcagggcgtcctgtgtctgacacgacagaacctagctcaccagagggcaaagaggagtctctggctacagagccggctcctggcacccaaaaaaagaagcggtgccagtgctgcgtggtgatgtag

SEQ ID NO: 198672 - DNA, 1167 bp, Artificial Sequence
  Description of Artificial Sequence: Synthetic coding sequence
atgggccgggcccggcggttccagtggcccctgctgctgctgtgggccgcagcagccggacccggtgcagggcaggaggttcagacagagaatgtgactgtggcggagggaggggttgctgagatcacctgtaggctgcatcaatacgacggttctattgttgtaatccagaatcctgcccggcagaccctctttttcaacgggactcgggcccttaaagacgagaggttccaattagaagagttttctcctcgcagagtccggatcagactttctgatgctcggttggaggatgagggaggctatttctgtcagctttataccgaagatacccatcaccagatcgctaccttgaccgtgttagtggcaccagagaaccctgtggtggaagtacgggagcaggcggtggaaggaggggaggtggaactatcatgcctcgtccctagaagccgccccgctgcaacactgcgatggtatagggatagaaaggaactcaaaggcgtgtcttcttcgcaggaaaacggcaaggtgtggtcggtggctagtactgtgagatttagggtggatcggaaagatgacggcggaatcatcatttgcgaggctcaaaaccaagccctgccgagtggacactcaaaacaaactcagtacgtgttagatgtgcagtactctcctactgccaggatccatgcctcccaagcagtagtcagagagggcgacaccctggtgctgacttgcgccgtcacaggcaacccgcggcccaaccaaatccgttggaatcgaggcaacgaaagtctgccggaaagagccgaggcagtgggagagacactgaccctgcctggcctcgtttctgctgataacggaacttacacgtgtgaggccagcaataagcatggccacgctagagctctgtacgttctggtggtctacgatcccggcgctgtcgtggaggctcaaacctccgtaccttacgcgatcgttgggggcattctcgcgctcctggtttttttgattatttgtgtgcttgtggggatggtttggtgctctgttagacagaagggctcctacctgactcacgaagcttcaggcctcgacgagcagggagaagcccgagaggcctttctaaacggctctgacggccacaagagaaaagaggaatttttcatctag

SEQ ID NO: 198673 - DNA, 1068 bp, Artificial Sequence
  Description of Artificial Sequence: Synthetic coding sequence
atgggcaagctggtggccctggtgctgctgggcgtgggcctgagcctagttggggaaatgtttctggccttcagggagcgtgtgaacgcgtccagagaagtagaaccggttgagcctgaaaactgccatcttatcgaggagctggaaacaggtagtgaagatttggagatcctgcccaatggcttggcgttcatttcttcagggttgaagtaccccggcattaaatcatttaatcccaacagcccgggaaagattcttctaatggatctcaacgaggaggatcccacggtgctggagctaggaataacaggcagcaagttcgatgtcagttcctttaatcctcacggcatcagtacattcacagacgaggacaatgccatgtacctgctggtggtcaaccacccagacgccaaatctacagtggaactatttaagttccaagaggaagagaaatcattgctgcaccttaaaacaatccggcataagctgttgcccaatctcaacgacattgtggcagtgggacctgagcatttctatggaaccaacgatcactactttcttgacccctaccttcagtcttgggagatgtatctggggctggcgtggagctacgtagtgtactacagtccctctgaggtccgagtcgtggccgaaggattcgattttgcaaacgggatcaatatcagcccggacggtaagtacgtttacattgcagaacttttagctcacaaaatccatgtctatgaaaaacatgccaattggaccctaacacccttgaagtctctggacttcaacacactggtggacaatataagcgttgacccagaaacaggagatttatgggtcgggtgccaccccaacggcatgaagatctttttctatgattccgagaaccccccagctagcgaggtcttgcgaatccaaaacatactgactgaagaacctaaagtgacgcaggtctacgcagaaaacggaaccgtgctgcagggtagtacagtggcctctgtgtataaaggtaaattgctgattgggacagtgttccacaaggccctctactgtgaactctag

SEQ ID NO: 198674 - DNA, 1017 bp, Artificial Sequence
  Description of Artificial Sequence: Synthetic coding sequence
atggccgccggctgcagcgaggccccccggcccgccgccgccagcgatggcagcttggtgggacaggctggtgtactcccttgcctcgagctaccaacttatgccgctgcatgcgcactggtgaactcccgatattcatgcctggtcgcgggacctcatcagcggcatattgccctcagtcctcgctatctgaacaggaaacgcaccggaatacgagaacagctggacgcagagctgctgaggtactctgaatccctgctgggtgtcccgatcgcctatgataacattaaggtggtcggagagttgggcgatatatatgacgaccagggccatatccatctgaatatagaagcggactttgtcatattttgtcccgaacctggccagaagctcatgggaatagtcaacaaggtgtcatcgagccatatcggttgtttagtacatgggtgctttaacgcctctattccgaagccagagcagctgtccgcagaacagtggcagacgatggaaattaacatgggcgacgagctggagttcgaagttttcagactggatagcgatgcagccggggttttctgtattcgcggtaaattgaatattacaagtctccagtttaagcgttctgaagtgtctgaagaagtgaccgagaacggaactgaagaagccgctaaaaaaccaaagaaaaagaaaaagaagaaggatcctgaaacttacgaagttgacagcggcacaaccaaactggctgatgatgccgatgatacccccatggaggagagtgcactccagaacactaataacgcaaacggcatttgggaggaggaacccaagaaaaaaaagaagaagaagaaacaccaggaggttcaggatcaagaccccgtttttcagggttccgattcctctggttaccagtccgaccataaaaaaaagaagaagaagcgaaagcatagtgaggaagccgagtttactccgcccttgaagtgctcccccaaacggaagggcaagagcaacttcctctag

SEQ ID NO: 198675 - DNA, 1059 bp, Artificial Sequence
  Description of Artificial Sequence: Synthetic coding sequence
ggcgccgccggcggctgcggcctggccggcgaccgggccggcctgggagaaaggttactcgcactccgcaatagactgaaagcatctcgggaagtggaaagcgtagatctgcctcattgtcacttgattaagggaatagaggctggaagcgaagacattgacatactacccaacggtcttgccttcttcagcgtagggctgaaattccccggcttgcatagttttgctccggataaaccagggggtattctcatgatggatttgaaggaagaaaaacccagagcaagggagctgcgtattagccgtggtttcgacttagcctctttcaaccctcatggaattagtacatttatcgataacgacgacacagtatacctcttcgtcgtcaaccatcctgagttcaagaataccgtggagattttcaaattcgaggaagccgaaaattctttgctccacctcaaaactgtgaaacacgaacttctcccttccgtaaacgacatcaccgcggttgggcctgcccacttctatgccacaaacgatcactactttagtgatccttttctcaaatatctcgagacctacctaaatctccattgggccaacgtggtgtactactctcccaacgaggtgaaggttgtggcagagggatttgacagcgccaacggaatcaacatttcaccggatgacaaatacatatacgtagcggatattcttgcacacgaaatccacgtattagagaagcacactaacatgaatctaacacagctgaaggtgctggagctggatactttggttgacaacctgtccattgacccctcgtcaggcgatatttgggtcggctgccatccaaatggtcaaaaactctttgtctacgatccaaacaacccgccctcttcagaagtactacggatccaaaacatcttgtccgagaaaccgacggtcactactgtctacgctaataatgggagcgtcttgcaaggcagtagcgtggctagtgtttacgacggtaagctgctgatcggcactctttatcatcgagccctgtactgcgagctttag

SEQ ID NO: 198676 - DNA, 1128 bp, Artificial Sequence
  Description of Artificial Sequence: Synthetic coding sequence
atggccccccccaccgagctgctggcccggcccgagcggggcagcgccccaggatccagggccatggggcgcctggtggctgtggggctgctgggcatcgccctggccctactcggcgagcgcctgcttgcactgaggaatcggctcaaggcgagtagagaagtagaatccgtcgacctcccgcattgccacctgataaaaggaatcgaggccggttcagaggatatagatatcctgcctaatggcctcgcattcttctccgtgggactgaaattccctggtttacacagctttgcacctgataaacctggggggattttgatgatggacttaaaggaagaaaaaccccgggctagggagctcagaattagccggggcttcgacctcgcctcgttcaatccgcacggcatcagcacattcattgacaatgatgacaccgtgtatctatttgttgttaaccacccggagtttaagaatacagtggaaatctttaaatttgaagaggctgagaattcccttctgcatcttaagacggtgaagcacgagcttttaccgagcgttaacgacattacagccgtggggcccgcccatttctacgcgaccaatgatcactactttagtgatccctttttgaagtatctagaaacttaccttaatttgcactgggctaacgtcgtgtattactctcctaacgaagtcaaggtggttgccgaggggttcgacagcgccaacggaatcaacatatcacccgacgataaatatatatatgtagcagatatcctggcccatgaaatccacgtgttggagaagcacacaaatatgaacttgacccagttgaaagtcctggagttggacactttagtggacaacctgagcattgaccctagtagtggagatatctgggttggatgccaccctaacggtcagaagctgtttgtctacgatcccaataatccgccaagttctgaagtgctgagaattcagaatattttgagtgaaaagcctactgttaccacggtttacgccaacaacggctctgtgctccagggtagcagcgtcgcctccgtgtacgatggcaagctgcttattggaacactgtaccatcgtgcactttactgtgagctatag

SEQ ID NO: 198677 - DNA, 1029 bp, Artificial Sequence
  Description of Artificial Sequence: Synthetic coding sequence
atgggccggctggtggccgtgggcctgctgggcatcgccctggccctgttgggcgaacggctattggcccttcgtaaccgactgaaggcaagcagggaggtggaaagtgtggaccttccacattgccaccttatcaagggcattgaggccggctctgaggacatcgacatcctgcctaacggcctggcctttttttcggttggattaaagtttccaggattgcactcatttgccccagacaaacctggcgggatccttatgatggaccttaaggaggaaaaacctagggcccgggagcttagaatcagtagggggttcgatctggcttctttcaacccccacggcatatcgacatttatcgataacgaatttaagaacaccgtcgaaatctttaagttcgaagaagccgaaaactcgttactgcatctcaaaacggttaagcacgaactgcttccatccgttaacgacatcactgctgtgggccccgcgcacttctacgctaccaacgatcattacttttccgacccgtttcttaagtacctcgaaacttacctgaacctccactgggccaatgtggtgtattacagtccaaatgaggtaaaagtagtggcagaaggattcgattcagccaacggcataaacatctctcctgacgataagtatatatacgtggccgacattcttgcccatgagatccacgttttagagaaacacaccaacatgaatttgacgcagctgaaggttctggagcttgacactttggtggacaatctgtcaatcgatcctagtagtggcgacatttgggtgggttgtcacccaaatggccaaaaattgttcgtgtacgatcccaacaaccccccttcaagtgaggtgttgagaatccagaacatcctctcagaaaagccgacagtgaccacagtgtacgccaataatggaagcgttttgcagggttcatcggtggcatcggtgtacgacggcaaactgctcatcgggacactgtatcatcgggctttgtattgcgaattatag

SEQ ID NO: 198678 - DNA, 1065 bp, Artificial Sequence
  Description of Artificial Sequence: Synthetic coding sequence
atgggcaagctggtggccctggtgctgctgggcgtgggcctgagcctggttggagagatgttcctcgccttcagagagcgggtgaatgcctcccgtgaggtcgagcccgttgagcctgagaactgccacctgatcgaagaattggaatccgggagcgaagatatcgacatcctcccatcagggctggccttcataagcagcgggctgaagtatccaggaatgcctaatttcgcccccgacgaaccgggaaaaatctttctaatggacctgaacgagcaaaatcccagagcccaagctctggagatcagtggcggcttcgataaagagctttttaatccccacgggatctccatctttatcgataaggataacactgtgtacctgtatgtcgtgaaccaccctcacatgaaaagtaccgtagaaatcttcaagttcgaggaacagcagcgcagcctcgtctacttaaaaaccattaaacatgaactcctgaaatcggtgaacgatatcgtggtcctgggacctgaacagttttatgctaccagagatcattacttcacaaactcattactatcatttttcgagatgatcttagatttacgctggacgtacgttttgttctactctccccgggaagtgaaggttgtggcaaagggattctgcagtgctaacggaattactgttagtgccgatcaaaaatatgtctatgtggccgatgtggcagcaaagaatattcacattatggaaaagcatgacaactgggatctaacacagcttaaggtaatccagttaggaacgcttgttgacaatttaacagttgatcccgctactggggacattctggcaggctgtcaccctaaccctatgaagctccttaactacaaccccgaggatccacccggatccgaggtgcttcgcatccagaatgtactgtccgagaaaccacgggtttcaaccgtgtacgccaacaacggcagcgtactccaggggacatcagtcgcctccgtttatcacgggaagattctgataggaacggtatttcacaaaaccctctactgcgagctatag

SEQ ID NO: 198679 - DNA, 1572 bp, Artificial Sequence
  Description of Artificial Sequence: Synthetic coding sequence
atgatgctgcggggcaacctgaagcaggtgcggatcgagaagaaccccgccaggctgcgcgccctggaatcagcagtcggagaaagtgagcccgccgcggcagctgctatggcactggcattggccggagaacccgcaccgcccgcccctgccccaccagaggaccatcctgatgaagagatgggcttcacaattgacatcaagagttttcttaaaccaggcgaaaaaacatatacccaaaggtgcagactgtttgtcggcaatctacctactgacattaccgaagaagatttcaagaggctctttgaacgatacggggaaccctcggaagtttttattaatcgcgacagaggttttggctttatccggcttgaaagccgcacactggccgagattgccaaggcagagcttgacgggaccatcctgaagtcccggcctttaagaattaggttcgccacacacggtgccgcactgaccgtgaaaaacctaagtcccgttgtctctaatgaacttctggaacaagcctttagccagttcgggcctgtggagaaagccgtagtggtggtcgatgaccggggccgagcgacaggtaagggatttgtggaattcgctgctaaaccacccgctagaaaagctctggagaggtgtggtgatggtgcttttctactgaccaccactccccgcccggtgatagtggagcctatggagcagtttgatgacgaggatgggcttccagagaagctaatgcaaaagactcagcagtatcataaggagcgagaacagcctccacggtttgcccaaccaggtactttcgagtttgagtacgcatcccgatggaaagctcttgatgagatggagaaacaacagagggaacaggtagacaggaatataagggaggccaaagagaaattagaggctgagatggaggccgcgcgacatgagcatcagctcatgcttatgagacaagatctgatgaggagacaggaagaactgcgacgtcttgaggaactgcgtaatcaggaattacaaaagcgcaagcagatccaactccgacacgaggaggagcacagaagacgtgaagaggagatgatccgccatcgggagcaagaggaactgcggagacagcaggagggctttaaacctaattatatggagaatagagagcaggaaatgaggatgggcgacatgggccctaggggcgccatcaacatgggagatgccttctccccagcccctgcagggaatcagggaccgccccctatgatgggtatgaatatgaacaatcgcgctacaattccaggacctcccatgggcccaggcccagcgatgggccccgagggagctgccaatatgggtacccccatgatgcccgacaatggtgccgtgcataacgaccgttttccccaggggccacccagccagatgggttcaccaatgggaagccgtacaggatccgaaaccccccaagcaccaatgagcggcgtcgggcctgtcagcggcggacctggcggattcggcagaggatcacagggtggcaactttgagggtcccaacaaacggaggcggtattag

SEQ ID NO: 198680 - DNA, 1392 bp, Artificial Sequence
  Description of Artificial Sequence: Synthetic coding sequence
atgggcttcaccatcgacatcaagagcttcctgaagcccggcgagaagacctatacacagagatgtagactgttcgtcggcaatctgcccaccgacataaccgaggaggattttaaacggttgttcgagcgatatggagagcccagcgaagtattcatcaaccgggacagggggttcggtttcattcggctcgagagccggaccttagcggagatcgccaaggccgagctcgacggaactattttaaagagccgacccctacgaattaggttcgctacacacggagcggccttaactgtcaaaaatctctcgccggtggtttccaacgagctgctggagcaggccttttcacagttcggacctgtggagaaggccgtagtggtggtggacgaccgcggcagggccacaggaaagggttttgtggaattcgcagccaagccacctgcaaggaaggctctcgaacgctgtggcgacggggctttcctcctcaccacaacaccgcgccccgtgatcgtggaacctatggaacagtttgacgatgaggacggcctacccgaaaaacttatgcagaagacacagcaataccacaaggagagggagcagcccccgcgtttcgcgcaacctggtactttcgagttcgagtacgccagccgctggaaagcattggatgagatggaaaagcaacagagagagcaggtagataggaatataagagaagctaaggaaaaattggaagcggaaatggaagcggcgcggcatgagcaccaactaatgcttatgcgtcaggatctcatgcggcggcaggaggagctacgcagactcgaggagctgaggaatcaggaattgcagaagcggaagcaaatccagctgagacacgaagaagagcaccgacgaagggaagaggaaatgatacgtcatagggaacaggaagaattgagaaggcagcaggaagggttcaagcccaactacatggagaacagagaacaagaaatgcgcatgggagacatggggcctagaggtgccatcaacatgggcgacgccttctccccagctccagctggtaaccagggtccgccgcccatgatggggatgaatatgaacaatagggctactataccagggccacctatgggacccggtcctgctatgggacctgaaggggccgctaatatgggcacccccatgatgcctgacaatggcgcagtccacaacgaccggtttccgcagggacctccaagccagatgggctccccaatgggatccaggaccggttcggagactccacaggcccctatgtcaggcgtggggccagtgagcggggggccgggcggctttgggcgcggaagccaaggtggcaactttgaaggtcccaacaaacgccgccgctactag

SEQ ID NO: 198681 - DNA, 747 bp, Artificial Sequence
  Description of Artificial Sequence: Synthetic coding sequence
atgatgctgcggggcaacctgaagcaggtgcggatcgagaagaacccagcgcggctgcgagcattggagtctgcagtgggcgagagcgagcccgccgcagccgcagccatggcactcgcactggccggtgagccagcaccacccgcccctgctccccccgaagaccatcctgacgaggaaatgggattcaccattgacattaaaagcttcctgaagccaggggaaaaaacctacactcaaaggtgcaggcttttcgtcggtaacctgcccaccgacattaccgaggaggatttcaaacgattatttgaaaggtatggggagccaagtgaggttttcattaatagagaccggggattcggttttattcggcttgagagcaggacactggctgagatcgccaaagctgaactggacggtacaattcttaagtctcgccccctgaggatcaggttcgccactcatggagccgctctgaccgttaagaacctttctccagtagtgtctaatgagcttcttgaacaggcattttcacaattcgggcccgttgaaaaggccgtcgtggtagtcgacgaccggggacgggctaccgggaaggggtttgttgaattcgctgccaagccacccgcaaggaaggccttggagcggtgcggcgatggggctttcctccttaccactacccctcgccctgtgatcgtggaacctatggagcagttcgatgatgaagacggactgccggagaaactatag

SEQ ID NO: 198682 - DNA, 309 bp, Artificial Sequence
  Description of Artificial Sequence: Synthetic coding sequence
atgagcgagaagagcgtggaggccgccgccgagctgagcgccaaggatttgaaggaaaagaaggaaaaagtcgaagagaaggcctccaggaaggagcggaaaaaggaggtcgtggaggaggaggagaatggagcagaagaagaggaggaagagactgctgaagacggggaagaggaggatgagggcgaggaagaagatgaagaagaggaggaagaggacgatgaaggtccagcccttaagcgggctgccgaagaggaagatgaggcagatcctaaacggcagaagacagagaatggagctagtgcctag

SEQ ID NO: 198683 - DNA, 315 bp, Artificial Sequence
  Description of Artificial Sequence: Synthetic coding sequence
atgagcgagaagagcgtggaggccgccgccgagctgagcgccaaggacttgaaagagaagaaagaaaaagtagaggagaaagcgagccgaaaggagcgtaaaaaagaggtggtcgaggccccggtgcccttggtggttatggtaggcaaagcctgttctcagcctgaggccactcctagccccggaccccataggcgaagacggacaggcctacgaaggaaaaagaagaagctgccacgcatggaaagaagaaagatgaaaggcaaaaagaaaatgcgtaagaagaaaaaacggatgatgaaaggtcctaggtag

SEQ ID NO: 198684 - DNA, 306 bp, Artificial Sequence
  Description of Artificial Sequence: Synthetic coding sequence
agccgggaccccgcctgccgggccgccgagctgagcgccaaggacttaaaggagaagaaggaaaaggtggaggaaaaggctagtaggaaggagcgcaagaaggaggttgtcgaggaagaggagaatggcgccgaagaagaagaggaggagacagccgaggatggtgaagaagaagatgaaggcgaggaagaagacgaggaagaggaggaggaggacgacgaggggccagccctgaagagggcggctgaggaggaggatgaggcagatcctaagagacagaaaacagaaaatggtgcgtcagcctag

SEQ ID NO: 198685 - DNA, 528 bp, Artificial Sequence
  Description of Artificial Sequence: Synthetic coding sequence
atgcagcggcggctggtgcagcagtggagcgtggccgtgttcctgttaagctacgcggtgcccagttgcgggcggagtgtggaggggctgtctaggcgccttaagagggctgttagcgaacaccagttgttacatgataagggtaagtcgatccaggatttgcggcgcaggttctttctgcatcacttgatcgctgaaatccatacagctgagatccgagccacaagcgaagtgagcccaaactccaagccttctcctaacacgaagaaccatccggtgcgtttcgggagcgacgatgaaggcagatatttaacacaagagactaacaaggtggagacctataaagagcagccacttaaaacccccggaaagaagaagaaaggaaagcctgggaaaaggaaggagcaggagaaaaagaagcggaggacaaggagtgcttggttagattctggtgtgacaggctctggcctggaaggggaccatctttccgacacatccactactagtctggagttagactcccgctag

SEQ ID NO: 198686 - DNA, 630 bp, Artificial Sequence
  Description of Artificial Sequence: Synthetic coding sequence
atgcagcggcggctggtgcagcagtggagcgtggccgtgttcctgctatcgtacgccgtaccctcctgcggcagatctgtggagggattgagccggagactcaagagagctgtgtccgaacatcaactcctgcatgacaaagggaagtccattcaggatctgcggagaaggttttttctgcaccacctaatagccgaaattcataccgctgaaatccgcgctacgtcagaggtctcccctaattccaagccgtcacctaacactaagaatcaccctgtgagattcgggagcgatgatgaggggcggtatttaacccaggaaaccaacaaggtggagacctacaaagagcagcctctgaaaacaccagggaagaagaagaagggcaagccaggcaaaaggaaggaacaggaaaagaaaaaacggagaacgcggtctgcctggctggactctggggttactggatccggcctggaaggggaccacctttctgacaccagcacaactagcctggaactggactctagaaccgccttgctgtggggactcaaaaagaagaaagagaataatcgccgtacccaccacatgcaactgatgatctcgttgtttaagagcccacttcttctgctatag

SEQ ID NO: 198687 - DNA, 528 bp, Artificial Sequence
  Description of Artificial Sequence: Synthetic coding sequence
atgcagcggcggctggtgcagcagtggagcgtggccgtgttcctgctatcatacgccgtcccatcttgtggaaggagtgtcgaggggctgtctaggcgactcaagcgcgccgtcagcgaacaccagttactgcatgacaaaggcaagtccattcaggatttgaggcgacgcttttttttacatcacttaattgcagaaatccataccgcagaaatacgcgcgacttccgaggttagtcctaacagtaaacctagtcctaacactaagaaccaccctgtgcgatttggcagcgacgacgagggaagatacttaacccaggagaccaataaagtcgagacttacaaagaacaacctctgaagactcccggtaaaaaaaaaaaggggaaacccggtaaacggaaagaacaggaaaaaaagaagcgcagaactaggagcgcctggctagattcaggagtcaccgggagcgggttagagggagatcatctgagtgacaccagcacaacttccctagagttagattcgcggtag

SEQ ID NO: 198688 - DNA, 534 bp, Artificial Sequence
  Description of Artificial Sequence: Synthetic coding sequence
atgcagcggcggctggtgcagcagtggagcgtggccgtgttcctgttgtcctacgcagtcccgtcttgcggacgctccgtggaaggcctgagtcgccgcttgaaacgggccgtgagcgaacaccagctgctgcacgacaaagggaaatccatccaggatctccgccggcgttttttcttgcaccatttgatcgctgagatccacaccgctgagattcgggcaaccagcgaggtgtcgccgaattcaaaaccctccccaaataccaagaaccacccagtgaggttcggctccgatgacgaaggaagataccttacacaggagacgaacaaagtggagacatacaaagagcaacccttgaaaacacccggaaaaaagaaaaaggggaaacccggaaagcgaaaggaacaggagaaaaagaagcgccggacaagatcagcttggctagattccggagttactggctccgggctggaaggcgaccacttaagtgatacgtctactacaagcctcgagctcgattcccgccgccattag

SEQ ID NO: 198689 - DNA, 528 bp, Artificial Sequence
  Description of Artificial Sequence: Synthetic coding sequence
atgcagcggcggctggtgcagcagtggagcgtggccgtgttcctgttgtcctatgccgtgcccagctgtgggagaagcgttgagggcctttcgaggcgcttgaagcgagcggtatcagaacaccagctcctccatgacaagggtaagagcatccaagatctgcggaggcggttttttctgcaccacctgattgctgaaattcataccgctgagatcagggctaccagcgaagttagtccaaactctaaacctagcccgaacaccaagaaccaccctgtgaggttcggatctgacgatgagggacgctatctgacccaggagaccaataaggtggaaacctacaaggagcagccactgaaaactccgggcaaaaagaagaaggggaaacctggcaagcgaaaggaacaggaaaagaagaaacgtcggacccgcagcgcctggttagacagcggagttaccggaagtgggctggagggcgaccatcttagtgacaccagcactacgagcctggaactggacagccgttag

SEQ ID NO: 198690 - DNA, 81 bp, Artificial Sequence
  Description of Artificial Sequence: Synthetic coding sequence
accgccctgctgtggggcctgaagaagaagggcaagcagcagaagaacacttcctatgccaccaacgacctcataatctag

SEQ ID NO: 198691 - DNA, 630 bp, Artificial Sequence
  Description of Artificial Sequence: Synthetic coding sequence
atgcagcggcggctggtgcagcagtggagcgtggccgtgttcctgctaagctacgccgtcccaagctgcggacgcagcgtggaggggctttcaagacgactcaaaagagccgtgtccgagcaccagctgctgcatgataaaggtaagtcaattcaagacctgagacgaaggttctttttacaccaccttatcgccgagattcacacggcggagatccgcgcaacttctgaggtctctcctaattccaagccctctcccaacactaagaatcatcccgttaggtttgggtcagacgatgaaggaaggtatctaacacaggagaccaacaaagtggagacttacaaggaacagccccttaagactcctgggaagaagaagaaaggaaagcctggcaaacgcaaggaacaagaaaaaaagaagagacggacacggtctgcatggctggactcaggcgtgactgggagcggtttggagggcgatcacctcagcgacacgagtaccacgtctctggagctcgattctcgtacagcgctactgtgggggctgaaaaaaaagaaggagaataacaggcggacccaccacatgcagctgatgattagcctgttcaagtcccctctcctactgctgtag

SEQ ID NO: 198692 - DNA, 534 bp, Artificial Sequence
  Description of Artificial Sequence: Synthetic coding sequence
atgcagcggcggctggtgcagcagtggagcgtggccgtgttcctgttgtcttatgcagtaccaagctgtggccgctccgtggagggcctgtcccggcggttgaagcgtgccgtgtccgaacaccagctactgcacgataaggggaagtcaatacaggacctacgccgcaggttctttctccaccatctcattgccgaaatccatacagccgagatcagggctaccagcgaggtctcccccaattccaagccaagtcccaacaccaaaaaccacccagttcggttcggctctgatgatgaggggcgttacctgactcaagagaccaataaggtggagacttacaaggaacagcccttgaaaactccgggcaagaaaaaaaaaggcaagcctggcaaacgcaaagaacaggaaaaaaaaaaacgccgcacccgtagtgcctggctggacagtggcgtcacaggttctggactggaaggggatcacctctccgacacatcgacaacaagcttagagctggactcgaggagacactag

SEQ ID NO: 198693 - DNA, 519 bp, Artificial Sequence
  Description of Artificial Sequence: Synthetic coding sequence
atgcagcggcggctggtgcagcagtggagcgtggccgtgttcctgctttcctacgccgtgccctcatgcggaagatccgttgaaggtctgtccagacgccttaagagagcagtttcggagcaccaactgctgcacgacaaaggaaagtccattcaagatctgcgaagaagatttttcttgcaccacctgattgctgaaatccacacagcagagattcgtgccacgagtgaggtgtcaccaaattcaaagccgtctcccaacacaaaaaatcacccggtccgctttggcagtgatgatgaaggcagatatttaactcaggagacaaacaaggtagagacctacaaggaacagccgctcaaaactcctgggaaaaaaaaaaagggcaaacctggcaagcggaaagaacaggagaaaaagaagaggagaactcgatccgcatggctagattctggcgtaactggaagcggacttgaaggcgaccatctttccgacacctccaccacctccttggagctctag

SEQ ID NO: 198694 - DNA, 534 bp, Artificial Sequence
  Description of Artificial Sequence: Synthetic coding sequence
atgcagcggcggctggtgcagcagtggagcgtggccgtgttcctgttgtcttacgctgtacctagttgcggccgctctgtggaaggcttatccaggagactaaaaagggccgtgtccgaacatcagctgctgcacgacaaggggaagtccatccaggacctgaggaggagattcttcttgcaccaccttatcgctgaaatccacaccgcagagatccgcgctacctcagaggtctcccccaactccaagccgagtccaaatacaaagaatcaccccgtcaggttcggatccgatgacgaggggcggtatctgactcaggagactaataaggtggagacttacaaagaacagccattaaagacacccggaaaaaaaaagaagggaaaaccaggaaaacggaaagaacaggagaaaaagaaacgacgaactcgttcggcctggttggattcaggcgtgactggatctggactagagggagaccacctgagtgacacatctacaacatctctggaactagactctcgacgccactag

SEQ ID NO: 198695 - DNA, 891 bp, Artificial Sequence
  Description of Artificial Sequence: Synthetic coding sequence
atggtggccgagaaggagaccctgagcctgaacaagtgccccgacaagatgccaaaaaggactaaactccttgcccagcaaccgctgcccgtgcaccaaccacattcactggtgtccgaaggatttactgtgaaagccatgatgaaaaatagcgtcgttcgcggaccacctgcagcaggcgcattcaaagaaagacccaccaaaccaaccgcttttcggaaattttacgagaggggtgactttcctatagcccttgaacatgacagcaaagggaataagattgcctggaaagtggagatagagaagctcgactatcaccattatctgcctctgttcttcgatgggctttgtgagatgacttttccctatgagttcttcgcacgtcagggtatccacgacatgttggaacacggaggcaataaaatcctccccgtgctgccccagctcattattcctattaagaacgccttaaatctgcgtaaccgccaggtcatatgcgtgactctgaaggtgctgcaacacctcgtggtgagcgccgaaatggtcgggaaagcgctcgtgccctattataggcagattctccccgtactgaacatattcaaaaacatgaatggaagttactcgctgccaagattagaatgtagcggcgccatcatggcacgctgcaatctcgatcacctcgggtcgtcggaccctccaacatcggcctctcaggtggccgaaatcatcgtgaatagtggggatggtatcgactactctcaacagaagagagagaatatcggagacctgatccaggagaccttggaagccttcgaaaggtacggaggcgagaatgcctttattaacatcaagtatgttgtcccaacatatgagtcctgcctcctaaactag

SEQ ID NO: 198696 - DNA, 774 bp, Artificial Sequence
  Description of Artificial Sequence: Synthetic coding sequence
atggtggccgagaaggagaccctgagcctgaacaagtgccccgacaagatgcccaagcggacgaaattgctggcccagcagccgctcccggttcaccagccgcattcacttgtatccgagggtttcacggtgaaagccatgatgaagaactcagtggtgcggggcccacccgccgccggcgccttcaaggaacgaccaactaagcccacggcttttcggaagttctacgaaaggggcgactttccgatcgccctggagcacgactctaaggggaataaaatcgcttggaaggtggagattgaaaagctggactaccatcattacctgccactatttttcgatggactgtgtgagatgacattcccttacgagtttttcgccaggcagggtatacacgatatgctggagcatggcggtaataagatcctcccggtccttccacagctcattatccccatcaagaacgccctcaatcttagaaatcgccaggtaatttgtgtgaccctgaaggtgctacagcatttggtcgtttccgcggaaatggtgggtaaggcgctcgtgccctattaccggcagattcttcccgtcctgaacatattcaagaatatgaacgtgaactcaggtgacggcatcgactacagccagcaaaagagagagaacattggggacctcatccaggaaacgctggaggcttttgaacgctacgggggagaaaatgccttcataaatatcaaatatgttgtccccacttacgaatcctgtctgctcaattag

SEQ ID NO: 198697 - DNA, 774 bp, Artificial Sequence
  Description of Artificial Sequence: Synthetic coding sequence
atggtggccgagaaggagaccctgagcctgaacaagtgccccgacaaaatgccaaagcgtacaaagctgctggcccagcagcctctgcccgtgcatcagccacatagcctggtttcagaggggtttactgtcaaggctatgatgaagaattcagtggttcgagggccaccggctgccggagctttcaaggagcggcccacaaaacccacagcctttcgcaagttctatgaaagaggtgactttcctattgccctcgagcacgacagcaaaggcaataaaatcgcttggaaggttgagatcgaaaaactggactaccaccattacctcccccttttttttgatgggctgtgcgagatgacgttcccctatgagttcttcgctaggcaaggaattcatgatatgctggaacacggcggaaacaagattctcccagtgctgccacagctcataattcctatcaaaaatgcccttaatctgcgaaacagacaggtgatctgcgtaaccctcaaggttctgcaacatttagtagtttcagctgaaatggtcggcaaagctcttgtgccttattatcgacagatactgcctgtgttaaatatatttaaaaacatgaacgtcaattctggcgacggcatcgattactctcagcagaagcgggagaatataggcgaccttatccaagaaactcttgaggcatttgagagatacggtggagagaacgccttcattaacatcaagtacgtggtacccacatacgaatcctgtttactaaattag

SEQ ID NO: 198698 - DNA, 825 bp, Artificial Sequence
  Description of Artificial Sequence: Synthetic coding sequence
atgagcggcgagtgccagagcccccactgccccggcaccagcgccgaatttttcttcaagtgtggggctcatccgacgagcgataaggagacaagtgtagctctgcatttaatcgccacgaacagccgcaatatcacctgcatcacctgtacagatgttcgctcaccagtgcttgtgtttcagtgcaattcacggcacgtaatttgcctcgattgttttcatctgtattgtgtgactaggctgaatgaccgccagtttgtgcacgatccacagctggggtattccctgccttgcgtggctggatgccctaacagtctgattaaggagcttcatcatttcaggattctcggagaggaacaatataaccggtatcagcagtatggagccgaagaatgcgtgctccagatgggtggtgtgttgtgcccacgccccggctgcggtgcgggacttctgccagaacccgaccagcgaaaagtgacctgcgagggaggaaacggcctcggatgcggatttgctttctgccgggagtgcaaggaagcataccatgaaggcgagtgttcagctgtttttgaggcctctgggaccaccacccaggcctacagagtggatgaacgggccgcagagcaggctaggtgggaagccgccagcaaggagaccattaagaagacaacaaaaccatgccccaggtgtcacgtaccagttgaaaagaacggaggctgtatgcacatgaagtgcccccaacctcagtgtaggctggaatggtgttggaactgtggatgtgagtggaacagggtgtgtatgggcgatcactggttcgatgtgtag

SEQ ID NO: 198699 - DNA, 1107 bp, Artificial Sequence
  Description of Artificial Sequence: Synthetic coding sequence
atgatcgtgttcgtgcggttcaacagcagccacggcttccccgtggaagtcgacagcgatacaagcatattccagctgaaggaggtcgtcgccaaacgtcaaggagtgccagcggaccaattgcgcgtgatatttgctggcaaagagctgagaaacgactggacagtgcagaattgtgatctggatcagcagtctattgtgcacatcgtccagaggccttggcgcaagggccaagagatgaacgcaacgggaggcgatgatcccaggaatgcagcagggggatgtgaacgcgagcctcaatccttgacccgggtcgacctgtcttctagcgtgctgcccggggactccgtcggactggccgtgatactgcacactgactcccggaaggactcccctccggcaggctcccctgccggcagaagcatctacaattctttctacgtgtactgcaaaggtccctgtcagcgggtgcagccgggaaaactgagagtacagtgctccacctgcagacaggccacacttacactgactcaggggcctagctgctgggatgatgttctgatcccaaaccgtatgtcgggtgagtgccagtccccgcactgcccgggcacctccgctgaattctttttcaagtgcggggctcatccaacatctgataaggagacctcggtggctctgcaccttatcgccacaaactcacgaaacattacatgtatcacttgtaccgacgtgaggtctcccgtcctcgtctttcaatgcaatagtcgccatgtgatttgtctggattgttttcatctgtattgtgtgacaaggctgaatgatcgacagtttgtgcacgatccccagctcgggtattcacttccatgcgttgcaggatgtcctaacagccttatcaaagagttgcaccattttcgcattctgggggaggagcagtacaaccggtaccagcagtacggggctgaggagtgcgtgctgcagatgggaggtgtgctgtgccctcgacctggatgtggcgctgggttattgcctgagccagaccagcggaaggtcacctgcgaaggcggaaacgggctcgggtgcggatacggtcagcggagaacaaagtag

SEQ ID NO: 198700 - DNA, 825 bp, Artificial Sequence
  Description of Artificial Sequence: Synthetic coding sequence
atgagcggcgagtgccagagcccccactgccccggcaccagcgccgaattttttttcaagtgtggcgctcatccaaccagcgacaaagaaacttcagttgcattacatcttatagcaaccaattctcggaacataacgtgtatcacttgtaccgatgtgagatctccggttctcgtgttccagtgcaattcacggcatgtcatctgcctggactgcttccacctctattgtgtcactaggctgaacgatcgacagttcgtgcacgacccacagttgggatattctcttccttgtgtggcaggttgccccaattcactaataaaggagctccatcactttcggatactgggtgaagaacagtataatcgttaccagcagtacggcgccgaggaatgcgtattacagatggggggagttttatgcccgcgccctggctgtggggccggccttctcccagagcccgaccagagaaaggtgacatgcgaaggcggcaacggactgggctgtgggttcgctttttgtagggagtgtaaggaggcataccacgagggggagtgctcagctgtctttgaggccagcggcaccacgacgcaggcctatagagtggacgaacgcgcagcggagcaggcgcggtgggaagcagcgagcaaagaaaccattaagaaaactacaaagccttgtcctagatgccacgtgcccgtggaaaagaatgggggatgtatgcacatgaaatgtcctcagccccagtgtaggttagagtggtgttggaactgtggctgtgaatggaatagagtgtgtatgggggaccattggtttgacgtatag

SEQ ID NO: 198701 - DNA, 657 bp, Artificial Sequence
  Description of Artificial Sequence: Synthetic coding sequence
atgaacgccaccggcggcgacgacccccggaacgccgccggcggctgcgaaagggaaccgcagagcctgacaagagtggatctcagcagttccgtactgcccggggattccgtggggctggctgtaatcctgcataccgattcgcggaaagactcccccccagcgggtagtcctgccggcagaagtatttataatagcttttatgtgtattgcaaggggccatgccagcgtgtccaaccggggaagctgagggttcaatgtagcacttgcaggcaggctacattgacactgacacaaggacctagttgctgggacgacgtgttgattcccaataggatgtcaggtgaatgtcagagtccacactgccccggaaccagcgctgaattcttttttaagtgcggcgcccaccctaccagcgacaaggagacctccgtggccctgcacctgattgctaccaatagtagaaatattacatgcatcacctgtaccgatgtgaggagtcccgtcttagtgttccaatgtaattcacgtcatgtcatatgtcttgactgtttccatctgtactgcgtgactcgcctgaatgacagacagttcgtgcacgacccgcaattaggctatagtctcccttgcgttgtgagcctcctgcctagccagtag

SEQ ID NO: 198702 - DNA, 951 bp, Artificial Sequence
  Description of Artificial Sequence: Synthetic coding sequence
atgatcgtgttcgtgcggttcaacagcagccacggcttccccgtggaggttgactcagacacttcgatttttcaattaaaagaagtggtagccaaacgacagggcgtgcccgctgaccaattgagagttatctttgctggcaaagaacttcggaatgattggactgtccaagagttcttctttaaatgtggtgcccatccaacatccgacaaagagacttccgtggccctgcaccttatcgctaccaactccagaaatattacgtgcatcacatgcaccgacgtgcgcagtcctgtccttgtttttcagtgcaatagcagacacgtgatctgtctggattgttttcacctgtactgcgtcacaaggctgaacgaccgccagtttgtgcacgacccacagctcgggtattctttgccatgtgtggccggctgcccaaactccctcatcaaggagctacatcacttcaggatcctgggtgaggagcaatataaccgttaccagcagtatggggcagaggaatgtgtgctccagatgggaggcgttctgtgtccccgcccggggtgcggagctggattactgccggagcctgatcaacggaaagtgacctgcgaagggggtaatgggctggggtgcgggttcgccttctgcagagaatgtaaagaggcctaccacgagggagaatgcagtgcggtcttcgaggccagtgggacaacaacgcaggcttaccgggtcgacgagcgggcggccgagcaagctcgctgggaggctgctagcaaagaaacaatcaagaagaccactaagccctgtcccaggtgtcatgtgcctgtggagaaaaacggggggtgcatgcacatgaaatgccctcagccgcagtgtaggctcgaatggtgctggaactgtggctgcgagtggaatcgggtttgcatgggggaccattggttcgacgtttag

SEQ ID NO: 198703 - DNA, 1314 bp, Artificial Sequence
  Description of Artificial Sequence: Synthetic coding sequence
atgatcgtgttcgtgcggttcaacagcagccacggcttccccgtggaggtggatagcgacaccagtattttccagctgaaagaagtggtcgctaagcgccagggcgttccagctgatcaactgagagttatctttgccgggaaggagcttcgcaatgactggactgtacaaaattgtgacctagatcaacaatcaatcgtgcatattgtgcagaggccgtggcgtaaagggcaagagatgaacgccactggcggagacgacccaaggaacgccgcgggcggctgcgagcgggagcctcagagtctcactcgcgtggacctgagttcttccgtcttgcctggggattcagtggggctggcagtgatcctgcacaccgacagccgaaaggattcaccacccgccgggtcccccgccggacgctcaatctacaactccttctacgtgtactgcaaagggccatgccagcgggtgcaacccggcaaactcagggttcagtgctctacatgtcgccaggcaactcttaccctcactcaggaattcttctttaagtgtggggctcaccctacctctgacaaagagacctccgtcgctctgcatctcatcgcaaccaatagccgaaacataacgtgtattacctgcaccgatgtccgatcccctgtgctcgttttccagtgtaattcccgacacgttatctgccttgactgcttccacctttactgcgtgacaagactgaacgatcgacaatttgtgcacgatccccagctggggtactcgctcccgtgcgtcgccggttgccccaactctctgattaaagaacttcatcacttcagaattcttggggaagagcagtacaatagataccagcagtacggagctgaagagtgcgtgctgcagatgggcggggtgctctgccccagacctggttgtggggccggtttgctgccagagcctgatcagcggaaagtcacatgtgaaggaggcaatggattgggttgtggatttgcattctgtcgggaatgtaaggaggcctaccacgaaggagagtgctccgccgtattcgaagcatcagggactacaacacaggcatatcgagtggacgaacgggcggccgagcaggcccgctgggaagccgcatcaaaggagacaatcaagaagactactaaaccgtgtcccaggtgccatgtccctgtcgagaagaacggagggtgcatgcatatgaagtgtcctcagcctcagtgtaggttggaatggtgctggaattgtggatgtgagtggaatcgcgtttgcatgggcgaccactggttcgacgtatag

SEQ ID NO: 198704 - DNA, 1398 bp, Artificial Sequence
  Description of Artificial Sequence: Synthetic coding sequence
atgatcgtgttcgtgcggttcaacagcagccacggcttccccgtggaggtggacagcgatactagcatcttccagctgaaagaggtggtggccaaaagacaaggagtgcctgccgaccagctgagggtgatcttcgccggcaaagaactgcgaaatgactggacggtgcagaactgcgacctggaccagcaaagtattgtccacatcgtccagcggccttggaggaagggccaggagatgaacgcaactggcggggacgatcccaggaatgccgctggaggctgtgagcgggaaccacagtctttaactcgcgtggacctgagcagctcggtcctgccaggtgatagcgtgggcttagctgtcatcctgcacacggactcccggaaagattctccaccggccggctcgcctgctggtaggtcaatctacaatagcttctatgtgtactgcaagggcccttgtcagagagtccaaccagggaagttgcgagtgcaatgttctacatgtcgtcaagccacactcaccctgacccagggaccttcctgctgggatgatgtcctcattcccaaccgcatgtctggagaatgtcagagtccccattgccctggcacgagtgctgagttctttttcaagtgcggcgctcaccccacaagcgacaaggagacatcagttgccctgcatctgatcgcgactaattctaggaatattacatgcatcacttgcactgacgtgcgctcccccgttctggtgttccaatgtaattctaggcatgtgatctgcctggactgtttccatctgtactgcgtcacgcgtctgaatgatcgccaatttgtccatgacccccagctggggtactcactgccatgcgttgccgggtgtcccaacagcctcattaaagaactgcaccatttccgtatcctcggggaggagcagtacaatcggtaccaacaatacggggctgaagagtgtgtactgcagatgggaggagttttatgcccgcggccaggctgtggagccggcctgctccctgagccagatcagcgtaaggttacttgcgaaggcgggaacgggctaggatgtggcttcgccttctgtagggagtgcaaggaagcctaccacgagggggaatgctccgctgtcttcgaggcaagtggtaccaccacacaggcttaccgcgttgacgagagagcagcagaacaggctaggtgggaggcagccagcaaagagactatcaagaagactacaaagccttgtcctcgctgtcacgtccctgtggaaaagaacggaggatgtatgcacatgaagtgtcctcagccccagtgccgcttggagtggtgttggaactgcgggtgtgagtggaatcgggtgtgcatgggagaccattggttcgacgtgtag

SEQ ID NO: 198705 - DNA, 612 bp, Artificial Sequence
  Description of Artificial Sequence: Synthetic coding sequence
atgagcggcgagtgccagagcccccactgccccggcaccagcgccgagttcttcttcaagtgcggggcccacccaacctctgacaaagaaacatccgtcgctttgcatttaattgccacaaacagcagaaatattacctgtatcacttgcacagacgttaggagtcctgtgctggtctttcagtgcaacagcaggcacgttatctgcctagactgttttcacctctactgcgttacaaggctgaatgataggcagtttgttcacgatccacagcttggttattcacttccatgtgtggcaggttgtcctaactccctcataaaggaactgcaccacttccgcatcctgggcgaagagcaatataacaggtaccaacagtatggggcggaagagtgtgtactacagatggggggagtgctttgccccagacccggttgtggggctgggttgctgcctgagccggatcagaggaaggtcacttgtgagggcggaaatgggttaggctgtggttttgccttctgccgtgagtgcaaggaagcctaccacgaaggcgagtgcagcgccgtcttcgaggccagtggcactaccacccaacactctggttgcacttag

SEQ ID NO: 198706 - DNA, 429 bp, Artificial Sequence
  Description of Artificial Sequence: Synthetic coding sequence
agcgtgttcgtgcggttcaacagcagccacggcttccccgtggaggtggacagcgatacgtcaattttccaactgaaggaggtggtggccaaacgtcaaggggtgcctgcggatcagttacgcgtaattttcgcgggcaaagaattgaggaacgattggacagtacaaaattgcgacttggatcaacagagcatagtgcatatcgtccagaggccctggcgcaaaggacaggagatgaacgcaaccggcggagacgaccctaggaacgcagcaggcggctgcgaaagagagccacaaagcctgacacgggttgatttgtccagctcagtgttgcccggtgactctgtcgggttggcagtgattctccacaccgactctaggaaggattctccccccgctggaagccctggaaactgtctgcacggctag

SEQ ID NO: 198707 - DNA, 429 bp, Artificial Sequence
  Description of Artificial Sequence: Synthetic coding sequence
atggccgccgtggtggccgccaccgccctgaagggccggggcgccagaaatgccagggtgctacgtggcattctggccggagccactgccaataaggcgagccataatcggacgagagcccttcagagccacagctcacccgaggggaaagaagaacctgagccactgtcccccgaattagagtacatcccacgaaagcgtggaaaaaacccgatgaaagccgtgggattagcctgggctattggctttccttgtggcatcctgcttttcattctgacaaagcgagaggtcgacaaagacagagtgaagcagatgaaagccagacaaaacatgcgactgtcaaacaccggtgaatacgagagccagagattcagagccagcagtcaatctgcccccagtcctgacgtggggtctggggtgcagacctag

SEQ ID NO: 198708 - DNA, 1086 bp, Artificial Sequence
  Description of Artificial Sequence: Synthetic coding sequence
atggcctggcagggctggcccgccgcctggcagtgggtggccggctgttggctgctgttagtgctcgtgctggtcctgctggtcagtccccgaggctgcagggcaaggcgaggactcagagggctcctgatggcacacagccaacgcctgctgttccgtatcggatattctctgtacacacgaacatggcttggctatctattttacagacaacagcttagacgggctcgcaacagatacccaaaggggcacagcaagacccagcccaggctgttcaatggcgtgaaagtgctgccgataccagtgctgagtgataattactcttacctgattatcgacacgcaggcccagctggctgttgccgtggacccatctgacccgcgggctgtgcaggcctcaattgagaaggaaggggtgactctcgtagcaatcctctgtacccataagcactgggaccattctgggggcaatcgggacctgagtaggagacatcgagactgccgggtgtatggttctcctcaggatggcattccatatctcacgcatccactctgtcaccaggacgttgtgtctgttggtcgacttcaaatacgggccttggctactcccgggcatacccagggacatctggtctatcttttggacggcgagccctacaaggggccaagttgtctattctctggcgaccttctcttcctgtctggctgcgggaggacattcgaaggaaatgcagaaacaatgctttctagcctggataccgtgttgggacttggggacgatacactcctctggccgggacatgagtatgcagaggaaaatctggggttcgcgggagtggtggagccggagaacttagcccgagagcgaaaaatgcaatgggtccagagacagcggctggaacgaaagggaacctgtcccagcaccctcggtgaagagcgttcatacaatccgttcttacgaacccattgccttgctcttcaggaagctctaggccccggccccggccccactggtgacgacgattactctagagcacagctgctggaggaactgcggcggttgaaggatatgcacaaatctaagtag

SEQ ID NO: 198709 - DNA, 1158 bp, Artificial Sequence
  Description of Artificial Sequence: Synthetic coding sequence
atggccgccgtggtggccgccaccgccctgaagggccggggcgcccgtaacgcccgggttcttcgggggatcctggcaggtgcaactgcaaataaggcctctcacaacagaacccgcgcactgcaatcacacagctcgccagagggcaaggaagagcccgaaccactgagtcccgagctggagtatattccgaggaagcggggcaaaaatcccatgaaagctgtgggtctggcctggtattccctctacacaaggacttggttgggatatctgttctacagacagcagcttagacgggccagaaacaggtatccgaaggggcacagtaagacacagccccggctatttaacggcgttaaagtcctgcctataccagtgctgtcagacaactactcatacttgatcattgacactcaggcccagctggcagtggctgtagatccctccgacccaagagccgtccaggcgtctatcgagaaggaaggtgtcacactggtcgcgatcctctgcacccacaaacattgggaccactccggcggtaacagagatctctctagacgccacagagattgcagagtgtacggcagcccccaggacggcattccatacctgacccatccactgtgtcatcaagatgtcgttagcgtcggacggttacagattagggcgcttgcgacgccagggcatacacagggccacctcgtatatcttctcgatggagagccgtataagggtccctcctgtttgttttcaggcgatctcctattcctgtccggttgcggcagaacattcgaagggaatgctgagaccatgctttcttccctcgacactgtgctggggttaggagatgacacactgctctggccaggccatgagtacgcagaagaaaatttgggcttcgccggcgtggtcgaacctgaaaacctcgccagagaacgcaaaatgcaatgggtccagcggcagcgcctggaaagaaagggaacctgtccatccaccctgggggaggaacgatcttataacccattcctgaggacccattgcctggctcttcaagaagccctaggcccaggacccgggcccacaggggacgacgattatagccgtgctcagctgctcgaggagctgaggcgattaaaagacatgcataagagtaagtag

SEQ ID NO: 198710 - DNA, 1455 bp, Artificial Sequence
  Description of Artificial Sequence: Synthetic coding sequence
atggccgccggcggcgaccacggcagccccgacagctaccggagccccctggcaagcaggtatgcgtcacccgagatgtgtttcgtgttttctgatcgttataaatttcggacttggaggcagctctggttatggttggccgaggcagagcagactctcggactccctatcactgacgaacagatacaggaaatgaaaagtaacttggaaaatatcgactttaaaatggctgctgaggaagagaaacgtctaagacacgatgtcatggcccacgtccacactttcggtcattgctgcccaaaagccgctggcatcattcatctcggcgctacttcttgttatgtcggggacaatactgacctcatcatcctgaggaatgccttggacttactgttgccgaaactggctcgagttatttctcgcctggcagattttgccaaggaaagagccagcctgccaacattaggctttactcacttccagcctgcccagctgaccacagtgggcaagcgctgctgtctctggatccaggacctttgcatggacttgcaaaacttgaagagggttcgggacgacctgagatttaggggagtgaaaggcacaaccggtacgcaggcatcctttctgcagttattcgaaggggatgatcataaggtcgagcagctcgataaaatggtgaccgagaaggccgggttcaagcgggccttcattattacggggcagacatacacccggaaagtggatatagaggttctgtccgtgctggcttcgcttggagcatctgtgcataaaatatgcaccgatatcagattgctcgccaatctgaaagaaatggaggagccatttgaaaagcagcagatcggatccagcgcaatgccatacaagagaaaccctatgaggtcggagcgctgctgctccttggcccggcacctcatgaccttggtcatggatccactgcaaacggcttcagtgcagtggtttgaacgaactttagacgatagtgctaacagacggatctgcctggccgaggcctttctgacggctgacactatcctgaacacactgcaaaacatcagcgaagggctggtggtataccctaaagtcattgaacgacggattagacaggagctgccttttatggccacagagaatatcattatggccatggtaaaagcagggggctcaagacaggactgccacgaaaaaatccgggtgttgagccagcaggctgcgtctgtggtaaagcaggaggggggtgacaacgacctcatcgaacgtatccaagtggacgcttatttctcccccattcattcccaactggaccacctgctggacccatctagcttcaccggtcgtgcttctcagcaggtgcagcggttcctcgaggaggaagtgtaccctctgctcaagccgtatgaaagtgtgatgaaagtgaaggccgagctgtgcctgtag

SEQ ID NO: 198711 - DNA, 237 bp, Artificial Sequence
  Description of Artificial Sequence: Synthetic coding sequence
atggtgggcctgaagaagaagagcgccgacgacgtgaagaaggtgtttcacatgttagataaagacaaatccggctttatcgaggaagatgaactggggttcattctgaaggggttcagcccagatgcacgggacctgtcggcaaaggaaactaagatgctgatggcggctggtgataaggatggcgatggcaagattggcgtcgatgagttttcgactttggtggcggagtcctag

SEQ ID NO: 198712 - DNA, 333 bp, Artificial Sequence
  Description of Artificial Sequence: Synthetic coding sequence
atgagcatgaccgacctgctgaacgccgaggacatcaagaaggccgtgggcgccttctctgctactgacagctttgatcataagaaatttttccagatggtggggctgaagaaaaagagtgctgacgatgtgaagaaggtctttcacatgctggataaggacaaatccggctttatcgaggaagatgagctgggcttcattttgaaaggattttctccagatgcccgcgatctgtctgccaaggaaacaaaaatgctgatggccgctggagataaagatggtgatggaaaaattggggtggatgagttctcaaccttagttgctgagtcctag

SEQ ID NO: 198713 - DNA, 306 bp, Artificial Sequence
  Description of Artificial Sequence: Synthetic coding sequence
atgagcatgaccgacctgctgaacgccgaggacatcaagaaggccgtcggagccttttcagccactgacagtttcgatcacaaaaaattctttcagatggtcgggctgaagaaaaagtctgccgacgacgtgaaaaaggtttttcatatgctagataaagacaaaagcggctttattgaagaggacgagttgggcttcatcctcaagggcttctcacccgacgcacgcgatctatcggctaaggaaacaaaaatgttgatggccgccggagacaaagatggcgacggaaagatcggggtggattag

SEQ ID NO: 198714 - DNA, 984 bp, Artificial Sequence
  Description of Artificial Sequence: Synthetic coding sequence
atgagcgacctgcaggaggagggcaagaacgccatcaacagccccatgtccccagctctggtcgatgtgcatcccgaagacactcagctggaggagaatgaggagcgtaccatgatcgaccctacttcaaaggaggaccctaagttcaaggagttggtgaaagttctgctggactggattaatgatgtgctagtggaagaacgaatcatagtgaagcaattggaagaagacttgtatgatggtcaggtgttacagaaactcctggagaagttggctgggtgtaaattgaacgttgctgaggtgacccagtctgaaatcggtcagaagcaaaaactgcagactgtgcttgaggctgtgcacgatctgctgcgcccccgcggctgggcgcttcggtggtccgtcgacagtatccacggaaagaacctggtcgcaatcctccaccttcttgtctcattggcaatgcactttcgtgcccctatccggcttcctgagcatgtgacagtgcaggtggtggtagtcagaaagcgtgaagggttgctccactcatcccatatatcggaagagctgactacaaccaccgaaatgatgatgggtcgcttcgaacgcgacgcgttcgataccctgtttgaccatgcgcctgacaagttgtcagtggtcaagaaaagcttaattacttttgtgaataaacatcttaataagctgaacctcgaagtcaccgagctggagacccagttcgcggatggagtttatctggttttactgatgggcctcctggaagattactttgtccctttgcaccatttctatctcactccagagagtttcgatcagaaggtgcacaacgtgtctttcgctttcgagcttatgctcgacgggggtctcaagaagccaaaagcccggcctgaggatgtagtaaacctcgacctcaagtcaaccctcagagtgctatacaacctatttacaaagtataagaacgtggaatag

SEQ ID NO: 198715 - DNA, 1239 bp, Artificial Sequence
  Description of Artificial Sequence: Synthetic coding sequence
atgctgggcatcatccccctgcccttcggcaagccccagccccagtcacgcaggcgacccttgcggcctcctagcgcatcatccgcgtctcgtcctgctcggggcagcctgcggcgagctatggcgacctccccccaaaaatcaccgtctgttcctaaaagtcccactcccaagagccccccaagccggaaaaaggacgactcatttctgggtaaactcgggggcaccctcgctcgccgcaaaaaggcaaaggaggtctctgaactccaagaagagggcatgaacgccatcaacctacctttaagtcccattccgttcgagctggaccccgaggacactatgttagaggagaacgaagtccgcacaatggtggaccctaactctaggagcgatccaaaactgcaggaactcatgaaggtcctcatcgactggatcaatgacgtgttggtgggggaacggattatagtgaaggatttggccgaagacctgtacgatgggcaagtcctgcaaaagctgttcgagaaactggaaagcgaaaagctgaatgtggccgaggtcacacagagcgagatagctcagaagcagaaactccaaactgtgctcgaaaaaataaacgagacgctgaaactgcctcccaggtcgataaaatggaatgtggattctgtacacgcgaagagcctggttgccatcttacatctgctggtggcactatctcaatactttcgcgcccctattcgtttgcctgaccacgtgtctatacaggtcgtggtcgtgcaaaaacgggaggggatattgcaaagccgtcagatccaggaagaaattacgggaaataccgaagctctgagtggtcgccatgagcgcgatgcattcgacacattgttcgatcacgctccagacaaactgaacgtggtcaaaaagacccttatcactttcgtaaacaaacacctcaataaactgaacctggaagtgacagagctggaaactcaatttgccgatggcgtgtatctagttcttctaatgggtctacttgagggctattttgtgccactgcactcattctttctaactccagactcctttgagcagaaagtcttgaacgtctctttcgcgtttgaactcatgcaggacgggggtctggaaaagcccaagccccggccagaggacattgtcaactgcgacttaaaaagtacattacgggtactctacaatctgttcactaagtatcggaatgtcgagtag

SEQ ID NO: 198716 - DNA, 873 bp, Artificial Sequence
  Description of Artificial Sequence: Synthetic coding sequence
atgaacgccatcaacctgcccctgagccccatccccttcgagctggatcccgaggatactatgctggaagaaaatgaggtgaggacaatggtcgaccccaactccagaagcgaccctaaactccaggaactgatgaaagtgcttattgactggattaatgacgtgctggtgggcgagcggattatcgtcaaagaccttgcagaggacctgtatgatggtcaggtgttgcagaagttgttcgagaaactggagtccgagaagctgaatgtcgccgaagtcacccagtccgagattgcccagaagcagaagctgcaaacggtgctggaaaaaatcaacgagacactcaagctgccacctcgttccatcaaatggaacgtggattctgtccacgcgaaatctctggtcgccatattacacttgctggtggctctgagtcagtatttccgggcccccatcagactacccgatcacgtgagcatccaggtggtggtggtgcagaagcgtgaagggattctgcagagtaggcagattcaggaggaaataaccggcaacacagaagcgctgtccggacgacacgagcgggatgcctttgacaccctctttgatcacgccccagataaacttaacgtggtgaagaaagttggaaagggatgtctcgggtggacagagggaagcgaaatgcaacagaatattgggaaaactcacccgtgcagtctgcgcgcatcttgccagaactggtggcaccacctgacctccgcccacaccggattatctcccctcccctctatgtatctctctgtcccgcactggatgctgcacctgggtctcttccctagcatttctatgaattcacttagttcgcaccccggttag

SEQ ID NO: 198717 - DNA, 1119 bp, Artificial Sequence
  Description of Artificial Sequence: Synthetic coding sequence
atggccaccagcccccagaagagccccagcgtgcccaagagccccaccccaaagtctccaccaagcagaaaaaaagacgatagtttcttggggaagctggggggaaccttggcacgccggaagaaggctaaagaggtctcagagttgcaggaagagggcatgaatgcgattaacttgcccctgtcaccaattccgttcgaactggatcccgaggataccatgctggaggagaatgaagtacggaccatggtggatcctaactccaggagcgatcccaaactgcaggagctgatgaaagtactgatcgattggataaacgacgtgctggttggtgagcgaattatcgtgaaggatctcgccgaagatctctatgatggacaggttctccaaaaactcttcgaaaagctcgagtcagagaagctgaatgttgcagaagtgacacaaagtgagatcgcccaaaaacagaagctgcagactgtgttagagaaaattaatgagacactgaagctgccacctcgctccatcaagtggaacgtggattcagtacacgccaagtctctggtcgcaattctccaccttcttgtggccctgagtcagtacttccgcgctcctatacggcttccagaccacgtctcaattcaggtggtggtcgttcagaagagggaaggcatcctacaatctcgacaaattcaggaggagatcactggtaatacagaatatgtctctagcaggcacaagcgcgatgcttttgataccctgttcgatcacgctcctgacaaattaaatgtagtgaagaaaacactgatcaccttcgtgaataagcacctaaataagttgaaccttgaggtgacagagctggagacgcaattcgccgacggcgtgtaccttgttctgctgatgggattactggaagggtactttgttcccctccattctttctttctcacaccagacagtttcgagcaaaaggttctgaatgtctcgttcgcctttgagcttatgcaggacggcggcttagagaaacccaaaccccgcccggaggatattgtgaattgtgacttaaaatcaactctccgggtcctatacaatttgttcaccaagtatagaaacgttgaatag

SEQ ID NO: 198718 - DNA, 1119 bp, Artificial Sequence
  Description of Artificial Sequence: Synthetic coding sequence
atggccaccagcccccagaagagccccagcgtgcccaagagccccacgccaaagtcaccaccttcaagaaagaaggacgattctttcctgggaaagctaggtggaaccttagctcgccggaagaaagcgaaagaggttagcgagctccaggaagaaggcatgaatgcgatcaatctccctctgtcaccgatcccatttgaactggacccagaagacacaatgctggaagagaacgaggtgcgaaccatggtcgatccaaactccagatccgatcccaagttacaagagcttatgaaagttctcatcgactggatcaatgacgtgcttgtgggcgagaggatcatcgtcaaggatctggccgaggatctgtatgatggccaggttctgcagaagttgtttgagaagctggagtctgaaaagctcaatgttgccgaagtaacacagtctgaaatagcgcagaaacagaaactgcagactgttctggaaaagatcaatgagactctaaaactcccacccagatcgattaaatggaatgtggatagcgtgcatgctaaaagcctggtcgcaatcctgcatctgctcgtggccctctctcaatattttagggcacccattaggctacccgaccacgttagtattcaagtggtggtggtgcaaaagagagaaggtatacttcagtcaagacagattcaggaggaaataacgggtaacactgaagcattgtctggccgacatgagcgcgatgctttcgacacactttttgaccacgccccggacaagcttaacgtggttaaaaaaaccttaataacattcgttaacaagcatctcaataaactcaatttagaggtgaccgagctcgaaacccaattcgctgacggggtctacctagtgcttttaatggggctcctggagggttacttcgttccattgcatagtttttttctgactccagattcctttgagcagaaagtgcttaacgtgtcttttgctttcgaactaatgcaagatggtgggttggaaaaacccaaacccagaccggaggacatcgtcaactgcgatcttaagtccactctgagagtgctctataacctttttactaaatatcgtaatgttgagtag

SEQ ID NO: 198719 - DNA, 1095 bp, Artificial Sequence
  Description of Artificial Sequence: Synthetic coding sequence
atgagcagcgccccccggagccccaccccccggccccggcggatgaagaaggatgaaagctttctgggcaaactgggtggcactttggcacggaaacgccgagcaagagaggtctccgacttacaggaagagggcaagaatgccattaatagccctatgagccctgctctggtggacgttcacccggaagatacccagcttgaagagaacgaagagcgcacaatgattgacccaacctcaaaggaggaccccaagttcaaagagttggtgaaagtgctgctggactggatcaacgacgttctggtggaagagaggatcatagtgaagcagttggaggaggacctgtacgatgggcaggttctgcaaaaattattggagaagctggcaggctgcaagctgaacgtggcagaagtgacccagtcagagatagggcagaagcagaaactgcagaccgtgctcgaagccgtccacgaccttctccgtcctaggggctgggctttacgctggtcagtcgacagcatccatggaaaaaacctagtggccatacttcacctcctggtgtcactggccatgcatttcagagcacctattcggctgcctgagcacgtgaccgtgcaggtcgtcgtcgtacgaaagcgggagggcctgctgcactccagccatataagtgaggagctaacaacgacaaccgagatgatgatgggacgtttcgagcgagatgcttttgacactctgttcgatcacgctcccgacaaactctccgtggttaagaagagcttgattaccttcgtgaacaagcatttgaacaaactaaaccttgaggttacagagctggaaactcaattcgcagatggagtctatctggtgttacttatggggctgcttgaagattattttgtaccactgcatcacttttacctaacaccggagtccttcgatcaaaaggtgcacaatgtgtctttcgcttttgaactgatgttagatggcggccttaagaagcctaaggccagaccggaggacgtagtgaacctcgacctgaagtcaacactccgggttctttataacctatttacgaagtacaaaaacgtcgagtag

SEQ ID NO: 198720 - DNA, 1194 bp, Artificial Sequence
  Description of Artificial Sequence: Synthetic coding sequence
atgcaccacgtgttcaaggaccaccagcggggcgagaagcggggctttctgtccccggaaaacaaaaactgccggcggctcgaactgaggcgtggctgctcctgcagctggggcctgtgctcccaggctctcatggcgagtctggccggatcacttctcccgggctccgacagatccggcgtggagacatccgagtacgcccagggaggtgtatccgatctgcaagaggaaggcaaaaacgctatcaatagtcccatgtctccagcactcgtcgacgtccaccccgaggacacacagctggaagaaaacgaagagaggacgatgattgaccctaccagcaaggaggaccctaaattcaaggaactcgtaaaggtgctgttggactggatcaatgacgtcctggtcgaagagcgcattatagttaaacagttggaggaggatctctatgacgggcaggtcctccagaagctcctggaaaagctagctgggtgcaaactcaacgtcgctgaagtgacacagtcggaaatcggccaaaagcagaagctgcaaactgtcttagaggctgtgcacgatctcttgcgcccacggggatgggccctgcgctggagcgttgattctatacacggcaagaacctcgtggctatcctacacttgcttgtctccctagcaatgcatttccgggccccaattcggttgccagagcatgtgaccgtccaggtggtggtcgtccggaagagagagggcctccttcactcttcacacatcagtgaagagctgacgacaacgactgagatgatgatgggtcgattcgagcgggacgccttcgacacgttattcgatcatgcgcctgataaactgtccgtagtgaagaaaagcctcatcaccttcgtgaataagcacctcaataagcttaaccttgaagtgacggagcttgagacgcagttcgcagacggagtctatctcgtcctactcatggggctcctggaagattacttcgtacccctgcatcacttttacctcaccccagaaagctttgaccaaaaggtgcacaatgtatcctttgccttcgaactgatgctcgatggtggattgaagaagcccaaggctagacccgaggatgtagttaatcttgacctaaagagtactctgagagtcctgtataatctctttactaagtacaagaacgtcgagtag

SEQ ID NO: 198721 - DNA, 996 bp, Artificial Sequence
  Description of Artificial Sequence: Synthetic coding sequence
atggagcccgagttcctgtacgacctgctgcagctgcccaagggcgttgagccccctgcagaggaagaactcagtaaagggggaaaaaaaaagtacctaccaccaacctctcggaaagaccccaaattcgaggagctgcagaaggtgctgatggaatggatcaatgcgacactactgcctgagcacatcgtcgtgcggtcgttagaggaagacatgtttgacggacttatacttcaccacctgtttcagcggctggcggccctgaagctggaagcagaagatatcgcgctgactgccaccagccagaagcataaattgaccgtggtcctagaagccgtgaatcgtagtctgcaactggaagaatggcaagctaaatggagcgtggaatctatctttaataaagacctcctaagtactctgcacctcctcgtagcactcgcgaagaggtttcagccagatctctcacttcctactaacgttcaagtagaggtgatcacaatcgaatccactaagagcggcttaaaaagcgaaaagctggtggagcagcttaccgagtactctaccgataaggacgaaccgccaaaggacgtgttcgatgaactttttaaactggcgcctgaaaaggtgaacgccgtcaaagaggccattgtgaacttcgtaaaccagaagcttgataggctggggctctctgtacaaaaccttgatacccagttcgccgacggcgtgatcctgctcctccttattgggcagctggagggcttctttctgcatctcaaggagttctacctaactcctaactcccccgccgagatgctgcacaacgtcaccctggctcttgaactgctgaaagatgaggggctactctcttgccccgtctcacccgaggatatcgtgaacaaggacgcaaagagtactctcagggtgttatacgggctgttttgcaagcacacccagaaggctcatagggaccgcactccccacggcgcccccaactag

SEQ ID NO: 198722 - DNA, 81 bp, Artificial Sequence
  Description of Artificial Sequence: Synthetic coding sequence
atggagcccgagttcctgtacgacctgctgcagctgcccaagggcgtcgagccccccgctgaggaagaattgtctaagtag

SEQ ID NO: 198723 - DNA, 93 bp, Artificial Sequence
  Description of Artificial Sequence: Synthetic coding sequence
atggagcccgagttcctgtacgacctgctgcagctgcccaagggcgtggagccgcctgccgaggaggaactgtccaaaggagtctgcccctag

SEQ ID NO: 198724 - DNA, 996 bp, Artificial Sequence
  Description of Artificial Sequence: Synthetic coding sequence
atggagcccgagttcctgtacgacctgctgcagctgcccaagggcgtggagccgcccgcagaggaggaactgagtaaagggggaaagaaaaagtatcttccccctaccagtaggaaagaccccaagtttgaggagctgcaaaaagtgctgatggaatggatcaatgccaccctgctgccggaacacatcgttgtgaggagcctggaggaggacatgttcgacgggctgatactccatcatctgtttcaacgcctagccgcactcaagctggaagccgaggatatcgccctcacagccacctctcagaagcacaaactgactgtcgtcctggaagctgtgaatagaagccttcagcttgaggagtggcaggccaagtggagtgttgaatctatctttaacaaggatcttctgagcaccctgcacctcctggtggcgctggccaagaggttccagcctgacctctcgttacctacaaatgtgcaagtggaagtgatcaccattgagtcaacaaaatcaggccttaagtctgagaagctggtggagcaattgacagaatattcaaccgacaaggacgaacctcccaaggacgtgttcgacgagctatttaaactcgcccccgagaaggtgaacgccgtgaaggaggcaatcgtcaatttcgtcaaccagaaacttgacagacttgggctcagtgtccagaacctcgatacccagtttgccgatggcgtgattttgctgctgctgattggacaactagagggtttcttcctgcacttgaaagagttttatcttacccccaacagcccagccgagatgctgcataatgtaactttggctctcgagctcttgaaggatgagggactgttgagctgtcccgtttctcccgaggatatcgtcaacaaggacgcaaaatccactctccgggtgctgtatggtttgttttgtaagcacacgcagaaagcccacagggaccggaccccacacggggcccctaactag

SEQ ID NO: 198725 - DNA, 996 bp, Artificial Sequence
  Description of Artificial Sequence: Synthetic coding sequence
atggagcccgagttcctgtacgacctgctgcagctgcccaagggcgttgaacccccagccgaagaggagctttcgaaaggcggaaaaaagaaatacctgccaccaaccagcagaaaggaccctaaatttgaggaattgcagaaggtgctgatggagtggataaatgccacactgttgcccgagcatattgtggtaagatcactagaggaggatatgttcgatggcttaattctgcaccacctgtttcaacgacttgccgccctaaaacttgaagccgaagacatcgcattaacagctactagccagaaacataagttgactgtggttctggaagccgtgaaccggtccctgcagttagaggaatggcaggctaaatggtcagtagagagtatcttcaataaggacttgctgagcacactgcacctgctagttgccttggccaaacggtttcaacccgacctgagcttgcctactaacgtgcaggttgaggtgataactattgagtcaacaaagagcggccttaaatcagaaaaacttgtggagcagctgaccgagtactccactgataaagacgagcctcccaaagatgtgtttgacgaactttttaagctcgccccggaaaaggtcaatgccgtaaaggaggcaatagtgaacttcgtgaaccagaagttagaccgcttggggctcagcgttcagaacctggacactcagtttgccgacggcgtcatattactgctcctaattggacagctcgagggattcttcctgcatttgaaagagttttatctgacccccaatagtcccgctgaaatgctgcataatgtcacacttgccttggagctgctcaaggatgaaggcttactgtcatgccccgtgtctccggaagacattgtgaacaaagacgccaaatccacgctccgagttctgtatgggttattttgtaaacatacccaaaaagcccaccgggacaggaccccgcacggggcgcccaattag

SEQ ID NO: 198726 - DNA, 414 bp, Artificial Sequence
  Description of Artificial Sequence: Synthetic coding sequence
atggtgcccgccaaggagcaggtgcccggccggtgcgacagcacccagagatgcttccccggcccttccaactggaccggggcaggaggacgcgccgggagtcagccgttcgtgggggatgggacactaggaactccaaacttctgttgggaccacaaagagaaacgagccgctgaaagccaattacaggcttgggaggcgatggaacctgagttcctctacgatctgttgcaactccccaagggggtggaaccccccgccgaagaagaattgtcgaagggtggaaagaaaaaatatctcccccctacatctcgaaaggacccaaagtttgaagagctgcagaagcatacttggccttcccccgtcaccggcaccggggacacaatctgcgggctggcccgcaagacatggtag

SEQ ID NO: 198727 - DNA, 1083 bp, Artificial Sequence
  Description of Artificial Sequence: Synthetic coding sequence
atggccgccgagcggggcgccggccagcagcagagccaggagatgatggaagttgacaggagagtggaatccgaagagtctggtgatgaggagggaaaaaagcatagctcgggcattgtggccgatctttctgagcaaagtctgaaggatggcgaggagcgaggggaggaggatccggaagaggaacatgaactccctgtcgacatggagactattaatctggaccgggatgccgaagatgtggacctgaatcactaccgcatcggaaagattgagggctttgaggttctgaagaaggttaagactctctgtcttcgccagaatctcatcaaatgcattgagaacctggaagagctgcaatctctgcgcgagctcgacttgtatgataaccagattaaaaaaattgagaacttggaggctctgaccgaactcgagattcttgacatctctttcaatctgctgcgcaatattgagggtgtcgacaaactgacgagactcaagaagctctttctggttaacaataagatctcgaaaattgaaaatttgtccaacttacaccagctccagatgcttgaacttggatctaaccggatcagggcgatagaaaatattgataccttgacaaacctggagtcgctgtttttggggaaaaacaaaattacaaagctgcagaatctcgacgcactgacaaaccttacagtgttatccatgcagtctaatcgcttgaccaagatagaagggttgcaaaacctggttaaccttcgcgaattgtacctcagccataacggcatcgaggtcattgaggggctggagaataataacaaactgaccatgctcgatatcgccagcaacaggatcaagaaaattgagaacatcagccacctgacagagctccaggagttctggatgaacgataatctgctggagagctggtctgatctggacgagctgaaaggagccagatccctggagaccgtctacttagaaagaaacccgctgcaaaaggatccccaatatcgccgtaaggtcatgcttgccctcccgtcagtcagacaaatagacgcaacattcgtgcggttttag

SEQ ID NO: 198728 - DNA, 3993 bp, Artificial Sequence
  Description of Artificial Sequence: Synthetic coding sequence
atggaggacggcggcctgaccgccttcgaggaggaccagcggtgcttgtcccagtccctgcccctcccagtgtctgccgagggacctgctgctcagaccactgccgaaccttcccgttcgttctccagtgcacaccgacacctttccagaaggaacggactgtcccgtttatgccaaagcagaaccgcactgtcagaggaccgctggtcctcatattgcttatccagtctggcggctcagaacatttgcacaagcaagctgcattgtccggccgcacctgagcacaccgaccctagcgaacctcgcggatccgtcagttgctgttcactcctcagaggactctcttcaggatggtccagtcccctactgcctgcgcctgtctgcaatccaaataaggctatcttcacagtcgacgccaaaactaccgagatcctcgtggcaaacgataaggcttgcgggttgctgggctattcaagccaagatctgatcgggcagaaactgacccagttcttccttcggagcgactcagatgtagtggaagctctatctgaagaacacatggaagccgatggtcacgccgctgtggttttcggaacagtggttgatatcatcagtcgcagtggagaaaagatccctgtgagtgtttggatgaagcgaatgcgccaggagcgcagattgtgctgcgtggtcgtactggaacctgttgaaagagttagcacatgggtcgccttccaatctgatgggaccgtgacatcctgtgacagcctttttgcacacctccatgggtacgtgtctggcgaagacgtcgccggccaacatatcaccgatctcatccccagcgttcagctgcccccttccgggcaacacattccgaagaacctgaagatacagcgctcagtcggacgcgcacgggatgggacaacctttccattgagtttgaagctgaaatcacaaccatcttctgaagaggctaccacaggggaagcggccccagtatccggctaccgggcgagcgtgtgggtgttttgtaccataagcggactgatcacgcttctacccgacggcacgattcatggtatcaaccattcattcgcactcacgctgtttggttacggcaaaaccgaactactgggcaaaaatatcaccttcctgatcccaggattctactcatacatggaccttgcctacaactcctcgttacagctccccgacctggctagctgcttggacgttgggaacgagagcgggtgtggtgagaggaccctggatccctggcaaggacaggatcctgccgaaggggggcaggaccctcgaattaatgtggtcttggcaggcggacacgtggtgcctagggatgagatcagaaaactaatggagtcacaggatatattcacagggacacagaccgagctcatagcaggcgggcagctgttaagttgcctgtcacctcagcctgccccaggcgtggacaatgtcccagagggctctttgcctgtccatggcgagcaggcactgcctaaggatcagcaaatcacagccctgggccgtgaggagcccgtggctatcgagtctccggggcaggatctgctaggagagagtcgctctgaacccgttgatgttaaacctttcgcctcctgcgaagattccgaagcaccagttccagcagaggacggcggcagtgatgcaggaatgtgcggcttatgtcagaaggcacaattggaaagaatgggggtctctggaccatcaggatccgatctgtgggcaggagccgccgtggcaaagccccaggcaaagggacaactggccgggggaagtttgctcatgcattgtccttgttacggttccgaatggggactgtggtggagatctcaggatctcgcaccaagcccatcgggtatggccgggctctcgttcgggacaccgacactcgatgagccttggctgggagtagaaaatgatcgagaggagctgcagacatgtcttatcaaagaacagctgtcccaactatcacttgccggggccctggacgtgcctcatgcggagttagtacctacagagtgtcaggccgtgaccgccccggtgtcatcctgcgatttgggcggcagagacttgtgcggtggctgcactggttcctcctctgcctgttatgctctagcaaccgatctgcccggcggcctggaagctgtggaggcgcaagaagttgacgtcaattccttcagctggaatctgaaagaactgttcttcagcgaccagacagaccagacgagctcaaactgcagttgcgccacctctgagttacgcgagacaccatccagcttggctgtgggatctgatccagatgtgggcagcctgcaggagcaggggagttgtgtgctggatgatcgagaattgcttctgctaacgggcacgtgcgtggatctcggccagggtcgacgctttcgcgagtcctgcgttgggcacgacccaacagagcctctggaggtgtgcctggtgtcttcagagcactatgctgcgtccgatcgtgaatctcctggacacgttccctccactttagatgccggtcccgaagacacttgcccctccgccgaggagccaagactcaatgtgcaggtgacctccacccctgtcatagtgatgcggggcgccgccggcttacagcgcgagattcaggagggggcatacagcgggtcctgttaccatcgcgatggccttaggctgtccatccagttcgaggtgagaagggtcgaacttcagggaccaactcccttgttttgttgctggctggttaaggacctgttgcattcccagcgggattcagccgcgaggacacgtctgtttttggcatcactcccgggctccacgcattcaacggccgccgagctgacagggcctagcctcgtagaagttctgagggccagaccttggtttgaggagccccccaaggccgtggaattggagggcctcgctgcatgtgagggagagtattctcaaaaatactcaactatgagccctctgggatccggcgcgttcggatttgtctggaccgcagttgacaaagagaaaaataaagaggtagttgtgaagtttattaaaaaagaaaaagttctggaagactgttggatcgaggacccaaaactgggtaaagtgactcttgagattgctattctttcgcgcgtcgagcacgctaatatcattaaagtactggacatttttgaaaaccaaggatttttccagctggtcatggaaaagcacgggagcggacttgatttatttgcgttcatcgataggcatcccagactggacgaacctctagccagctatatatttcgccaagtgagagctggacagtcccgacttgtgagtgccgttggctatctcaggctgaaggatatcatacaccgcgacatcaaggacgaaaacatcgtcatagcagaagactttactatcaaactgatagatttcggaagcgccgcttatctggagagaggcaaattgttctataccttttgcggaactattgaatactgtgcccccgaggttctgatggggaatccctacagaggccccgaactcgaaatgtggtctctcggggtgaccctctacactctggtgtttgaggagaaccccttttgcgaactggaggaaactgtcgaggccgcaatccatcccccttacctcgtctcaaaggaactgatgtccctggtgagtggtctgctgcagcccgtacctgaaaggagaacaaccttagagaaactggtgaccgatccctgggtgacgcagcctgtaaacctggcggattacacttgggaagaggtctttcgcgtgaataagcccgaatctggcgtcctgtctgccgcatccttggagatgggaaacaggtctctttctgacgtggctcaagctcaggagctgtgcggaggaccagtgccaggagaagcacccaacggacagggctgcctgcaccccggcgacccacgactcttgactagttag

SEQ ID NO: 198729 - DNA, 3972 bp, Artificial Sequence
  Description of Artificial Sequence: Synthetic coding sequence
atggaggacggcggcctgaccgccttcgaggaggaccagcggtgcctgagccagtccctgcccctgcctgtgagtgccgagggtcccgctgcacagactacagccgagccatcccggtcattttctagcgcacatagacatctgagccggaggaacggcctgtcaagactgtgtcagtctagaaccgcccttagcgaagaccgatggagctcttattgcctcagttcattagccgctcagaacatctgcacgtctaaactccactgccccgcagcccccgaacacacagatcctagcgaacctcggggctcagtcagttgctgttccctgctccgaggattgtcaagcgggtggtcctccccgctattgccagcccctgtttgcaatccgaacaaggcaatcttcactgtcgatgcaaagacaaccgaaatcttggtagcaaacgataaagcttgcggcttgctgggctatagttctcaggaccttattggccaaaagttaacccagttcttcctgcgatcagactcagatgtagtggaggcccttagtgaggagcatatggaggcagatgggcatgccgcggtggtgtttggaactgtcgtcgatattatctcacgtagcggcgagaagattccagtcagtgtttggatgaagaggatgcgtcaggagaggcgactgtgctgtgtggttgtgttggagcccgtcgaacgtgtctccacatgggtggcgtttcaatctgatggcacagtgaccagctgtgactctctgtttgcacacctgcatggttatgtgtctggtgaagacgttgcaggccagcatatcacagacctcatccctagtgtccaactgccaccttctgggcagcacatacccaaaaatctgaaaatacaacggagcgtcggacgggctcgagacggtaccacttttccattgtctctcaagcttaagagccagccgtccagcgaggaggctactacgggcgaggcagcccctgtgtccggatacagagcttccgtatgggtcttttgtactatatccggacttatcactctcttacccgacgggactattcacggcattaaccattcttttgctctgactttgttcggctatggtaagacggagttgctagggaagaacataaccttcctgattccggggttttattcatacatggaccttgcctacaacagcagcctccaactacctgatctagccagctgtctcgacgtagggaatgaaagcggctgtggcgagcgcaccctcgatccatggcagggccaggatcccgccgaggggggccaagaccccagaattaatgtggtactggctgggggtcacgtggttccaagagatgagatacgcaaactcatggagtcgcaggatatcttcacaggtacacagactgagctgattgctgggggacagctgctgagctgtcttagcccacagcctgcccctggtgtagacaatgtgcccgagggctctctccctgtccatggcgagcaggctctcccaaaggatcagcaaattacagccctcggacgtgaggaacccgttgccatcgagtcgcccgggcaagatctgctcggcgaatcaaggagtgagccagtggacgttaagccattcgcctcatgcgaggacagtgaggctccagtcccggcagaagacggggggtcggatgcaggcatgtgcggactgtgtcagaaggctcagttagagagaatgggcgtatccgggccatccggctccgatttgtgggccggggccgcggttgccaagcctcaagcaaaaggtcagctagccggcggctctcttttgatgcattgtccttgctacggctccgaatggggcctttggtggcgcagccaagacctagctccttcgccaagtgggatggctggactgagcttcggcacaccgaccctggacgagccctggctgggcgttgaaaatgatcgggaagagttacagacctgtctgattaaggaacaattgtctcaattgtccctggctggtgccctcgacgtccctcacgcagagctggtgccgaccgagtgtcaggctgtcacagccccagttagtagttgcgatcttgggggacgagatctgtgtggcgggtgtacaggatcatcctccgcttgctatgccctggccacagatctgcccggaggcctggaggccgtagaggctcaagaggtggacgttaactctttttcctggaatttgaaggagctctttttttcggaccagacggatcaaacttctagtaattgcagctgtgcaacctccgagctcagggagaccccctcaagcctggctgttgggagtgacccagatgtgggcagcctgcaggagcagggttcctgcgttctggacgacagggaactgttactgttgaccggcacttgtgtggatctgggccagggaagacggtttcgggagtcttgcgtgggccacgaccctacagaacccctggaggtttgcttggtctcctctgaacactatgcggcaagtgacagggagtctcccggtcatgtccccagcaccctggatgccggccctgaggacacatgtcctagcgcagaggaaccccggctcaacgtccaggtcacttccaccccagtcatcgtgatgagaggagccgcgggtttgcagagagaaattcaggaaggcgcatactccggatcatgttaccatagagatggcttgagactctccattcaattcgaggttcgacgagtggaactccaaggcccaacgccacttttctgttgctggttggtgaaggacctcctgcactctcagagggattcagcggctcgcacaaggctgtttttagccagtctgcctggctctacgcatagcacagctgccgagcttactggcccgtcactggtggaagtcttgcgggccagaccttggtttgaagaaccccccaaagcggtagaactcgaaggcctggccgcttgtgagggagagtactcacagaagtatagtacaatgtcccccctcggctcgggcgctttcggtttcgtctggacagctgtggacaaggaaaaaaacaaggaagttgtggtgaaattcatcaagaaggaaaaggtactggaagactgctggatagaagaccccaaactggggaaggtcaccctcgaaattgcaattctgtccagagtagaacatgccaacatcattaaggttttagatatctttgagaatcagggatttttccagctcgtgatggaaaagcatggatccggcctggacttgttcgctttcattgatcgccacccacgcctcgacgagccccttgcgtcttacatatttaggcagttagtgagcgccgtgggctatcttagattgaaggatatcattcaccgcgacataaaggacgagaatatagttattgcagaggactttacaataaagctcattgattttggctctgctgcgtacctggagcgggggaagcttttctacactttctgcggtacgatcgagtactgcgcaccggaggtgctgatgggaaacccttaccgaggcccagagctggagatgtggtctctgggagtcaccctgtacacactcgtttttgaggagaacccattttgtgagctggaggagactgtagaggcagccattcaccccccttatctggtgagtaaggaattgatgagcctagtatctgggttgctgcaaccagtgcccgaacggcgcaccaccctggaaaagttagtgacagatccttgggtgacacagcccgtgaaccttgcagactacacatgggaagaggtgtttcgagttaataaaccggagagcggcgtgctatcagcagccagcctggaaatgggcaatcggagtctttcagacgttgctcaggctcaggaactttgtggaggaccagttccaggagaagctcctaacggacaggggtgtctgcaccccggggatcctagactcctgaccagctag

SEQ ID NO: 198730 - DNA, 378 bp, Artificial Sequence
  Description of Artificial Sequence: Synthetic coding sequence
atggaggacggcggcctgaccgccttcgaggaggaccagcggtgcctgtcccagagtctgcccctgcccgtgtccgcagagggtccggccgcccaaactacagccgagccttcccgaagcttcagctcagctcacagacacctttcgaggaggaacggtctgtctagactgtgccaaagtaggaccgctttgtctgaggatcgctggagcagctattgcctgtcatctcttgcagcccagaatatttgtacatccaagctgcattgccccgctgcgccggaacatactgacccctccgagccacggggtagcgtgtcatgttgctcacttctgcgtggactgtccagcggctggagttccccccttttacctgcatag

SEQ ID NO: 198731 - DNA, 3324 bp, Artificial Sequence
  Description of Artificial Sequence: Synthetic coding sequence
atgaagcggatgcggcaggagcggcggctgtgctgcgtggtggtgctggagcctgtggaacgagtctctacttgggttgcattccagagtgacggaacagttacctcctgcgatagcttatttgcccacctgcacggttacgtaagtggagaggatgttgccggacagcacatcaccgatttgatcccgagcgtacagctccctccgagtggacaacacattccaaaaaatctgaagattcagcggtcagtcggtcgggctagggatggcactaccttccccctgagtctgaagctcaaatcccaaccctcttctgaagaggctactacgggcgaggctgcccctgtgtccggatatagagcatccgtctgggtgttctgcacaataagtggactgattacgctgttgcccgatggcaccatccacggcatcaaccatagtttcgcgctcaccttgttcggttatgggaagactgagctgctagggaagaatattaccttcctgataccgggattctactcatatatggacctggcctataattcaagcttgcaactacctgacctggcttcctgtctggatgtgggtaatgagagcggttgcggtgagaggaccctggacccctggcagggtcaggacccagccgagggagggcaagacccaagaatcaacgtcgtacttgctggcggccacgtggtgcccagagatgaaatcagaaagttgatggagtcacaagatattttcactggaactcagaccgagctgatcgccggaggacaacttctctcctgtctctcccctcagccagcccccggtgttgataatgtacccgaggggtcattacccgtacacggagagcaagcgcttcctaaagatcagcagatcacagcccttggtagggaggagccagtcgctatcgagtcacctggacaggatctgctaggggaatctaggagtgaacccgtggatgtgaagccctttgcttcttgcgaggattccgaggccccagtgccagcagaagatggaggctccgatgcaggcatgtgcggcctctgtcaaaaggctcagctggaaaggatgggtgtgagcggcccctcaggctccgacctgtgggccggagcagctgttgccaaaccacaggcaaaaggtcaactggccggcggctccctcctgatgcattgtccgtgttatgggtctgagtggggcctttggtggcgaagccaggaccttgcaccctcgcccagtggtatggcaggactttcttttggtactcccactctggatgaaccatggctgggcgtggaaaatgacagagaggagttgcagacttgtctcatcaaggagcaactttcacaattatctctcgctggggcgctggacgtccctcatgccgaactggtgccgaccgagtgtcaggctgtgacagcgcccgtaagttcttgcgatttaggtgggagggacttgtgcggcgggtgcacaggcagcagctcggcctgctacgcattggccacagacttgcccggggggctggaagcagtggaagctcaggaggtcgatgtgaactcttttagttggaatctcaaggagctgtttttctctgaccagacagatcagacttccagtaattgctcctgtgcaacatcggagctgcgggagacgcccagttctttggccgtgggtagcgacccagatgtgggaagccttcaggagcagggatcgtgtgtgctggatgacagagaactgctcctgcttacaggaacttgcgtggatttgggccaaggaaggagattcagagagtcctgcgtgggtcacgaccctaccgaacccttggaagtgtgtctagtgtcctctgaacattacgccgcctcggacagagaaagccccgggcacgtgccctccactctggacgccggacccgaggacacatgtccctccgcggaagagccgagacttaatgtgcaagtcacttccacaccagttattgtgatgcggggagctgcagggctgcaaagggaaattcaggagggagcatatagcggttcgtgttatcacagagacggcctcagattgagtatccagttcgaggtgaggcgggtggagttgcaaggcccaactcccctattctgctgctggcttgtgaaggacctccttcattctcagagggacagcgccgccaggacgcgcttgtttttggcttcattgccaggctctactcactctaccgccgcggaactgacaggccccagcctggtggaggttttgcgcgcccgcccttggttcgaggaaccccctaaagctgtcgagctggagggcctggccgcttgtgagggggaatactcccagaagtacagtaccatgtctcccctgggcagtggagcattcggattcgtgtggactgccgttgataaggaaaaaaacaaggaggtcgtggtaaagtttatcaaaaaggaaaaggtgcttgaagattgctggatcgaggaccctaaattgggcaaggtcacgctcgaaattgccattctctcaagagtggaacatgcaaacatcatcaaggtcctggacatttttgagaaccaggggttcttccagctggttatggagaagcatggttcaggactagacctgttcgcatttatcgatagacatccacggctcgatgaacctctagccagctacatctttcgtcagctggtgtcagcggttggttatctccgcctgaaggacataatccatcgcgacattaaagatgaaaacatcgtcattgcggaggacttcactattaaattgatagactttggatcagctgcctatctggagcggggtaagctcttttacactttctgcggaaccattgagtactgtgcccccgaagttcttatgggaaatccttacagaggaccggagctcgaaatgtggtctctgggcgtgaccctctatacattggtgttcgaggaaaaccctttttgcgagctggaagagacagtcgaggccgcgatccaccctccatatctagtctcaaaagaacttatgtccctggtgagtgggttgttacagccggtgcctgaacggaggaccaccctggaaaagttagtaaccgacccgtgggtgacccagcctgtcaaccttgcagattacacctgggaggaggtgttccgggtcaataagccagagtctggagtcctgtccgctgcttctctggagatggggaaccgctcactgagcgacgtcgcacaggcccaagaattgtgcggaggacctgtgcccggcgaggctccgaacggccagggctgcctgcatccaggagacccccggcttctcacatcttag

SEQ ID NO: 198732 - DNA, 3414 bp, Artificial Sequence
  Description of Artificial Sequence: Synthetic coding sequence
atgggcttccccgacagcgcccgggccggccagcggagcctggtggatattatctctcgcagtggcgaaaaaatcccggtctctgtgtggatgaaacggatgcgtcaggagaggcgactttgctgtgtggtcgtgctggaaccagtcgaacgcgtcagcacctgggtggcgttccagtccgacgggactgtgaccagctgtgattcactttttgcgcacctccacggctatgtgtcaggggaggatgtggctggccagcacatcactgatctgataccatctgtacagcttccacccagcggtcagcatattccaaagaatctgaagattcaaaggtccgtaggccgcgctagggatggcaccacattccctctgtcacttaaattgaaatcccaacctagttctgaggaagccaccactggcgaggctgccccagtgagcggctaccgggctagcgtgtgggtgttctgcactataagcggtcttatcaccttgctgcctgatggaacaatccacggaataaatcattcttttgctcttacactattcggatacggcaagaccgagctccttgggaagaatatcaccttcctgataccaggcttttactcttacatggatctggcttacaatagctcgctccagcttcctgatcttgccagctgtcttgatgtggggaatgaaagcggatgcggcgaaagaacactggatccatggcaaggccaagatcctgctgaaggcggccaggatccaaggattaacgtcgtgctggctggcggacatgttgtgcctcgggacgagatccgcaaattaatggaatcacaggacatctttacggggacacaaactgaacttattgcggggggccagcttctgtcatgtcttagtccgcagccagctcctggagtggataacgttccggaaggctccctgcctgtgcatggtgaacaggcactgcccaaagaccaacagatcactgctctcggccgggaagaaccggtcgctatcgagtctcccggccaagatctgctgggagagagccgtagcgagcccgtcgacgtaaagccattcgccagctgcgaggatagcgaagcccccgtgcctgccgaggacgggggctcggatgctggtatgtgcggcctgtgtcagaaagcacagctggagcggatgggtgtgagcggaccctctggatctgacctatgggcgggcgcagcagtggctaagcctcaggcaaaaggccagctggcggggggttccctgctgatgcattgtccatgttacgggagcgaatggggtctgtggtggagatcgcaggacctcgcaccaagcccaagcggtatggcggggttgtcgttcggtaccccaacactcgatgaaccctggctaggcgttgaaaatgatagagaggagctacaaacctgtttgattaaagagcagctctcccagcttagcctggccggagctctcgatgtgccccacgccgaactcgttccgactgaatgccaggccgtgactgcacccgtttcctcgtgtgatctagggggtcgtgatctgtgcggcggttgtactggaagcagttcagcctgctatgccctggctacagatctacctggcggacttgaggctgtcgaagcccaagaagtggacgtaaattcgttcagctggaatctaaaagaactgttctttagtgaccaaacagaccaaacgtcaagtaattgctcatgcgcaacaagtgaactccgcgaaaccccgtcctcgctcgccgtggggagcgacccagatgtggggagcctccaggagcaaggttcctgcgtgctcgacgatagagaattattgctgctgacgggaacctgtgtagatttaggccaaggccgacggttcagagaatcctgtgtcggccatgaccccacagaaccacttgaggtgtgcctggtgtcttctgaacattatgccgcctcggatcgcgaatcccctgggcatgtgcctagtacactggatgccggccccgaggatacttgtccgagtgccgaggagcctcgccttaacgtgcaagtgacctccaccccagtgattgttatgagaggagctgccggcctccagcgtgagatccaagagggtgcctattccgggtcatgctaccatagggatggactgaggttgtcaatccagtttgaagtgaggagggtggagctccagggcccgacccctctgttctgctgttggctcgtaaaggatctgctccatagccagcgggattctgcagcgagaaccagactgtttctcgcttctctgccaggcagcacacattccacagctgctgagctcactggaccatccctggtagaagttcttcgagccaggccgtggtttgaagagccccctaaagccgtagagcttgagggcttagcagcatgtgagggagaatactcccaaaaatactcaactatgagccccctgggttctggcgcctttggttttgtctggaccgctgtggataaagagaaaaacaaagaggtggtggtcaagtttataaagaaggagaaagtcctggaagattgttggattgaggatcccaaactgggcaaagtcacattggagatcgctatcctgtctcgcgtggaacacgctaatatcatcaaggtgctggacatctttgaaaatcagggctttttccagctagtgatggagaaacacgggtccggactggacctgttcgcctttatagatcgccatccacggctcgatgaacccctggcatcctatatcttccgccaactggtgagtgccgtcgggtatttgcggcttaaagatattatccatcgagatattaaagatgagaatatcgtcattgctgaagatttcaccattaaactaatagacttcggatccgcagcctatctcgaaagagggaagctcttctacactttttgtggaaccatcgagtattgcgccccagaagtgctaatgggaaatccctaccgagggccagaactggaaatgtggtcgcttggcgtgacactgtatactcttgtatttgaggagaaccccttctgcgagctggaagagacggttgaagcagccatacacccgccatatctcgttagtaaggagctgatgtcactcgtgtccggactgcttcagcccgtgcccgaacgtagaaccacccttgagaaattagtcacagacccttgggtgacgcagcccgtcaacctagccgattacacttgggaagaggtctttagggtcaataaacctgagagcggcgtgctgtcagcagcctctctggagatggggaatcggtcattaagcgacgtggcccaggctcaggagctttgcggcggccctgtgcccggggaggccccaaacgggcaggggtgccttcatccaggtgacccacggctgctaacctcttag

SEQ ID NO: 198733 - DNA, 3432 bp, Artificial Sequence
  Description of Artificial Sequence: Synthetic coding sequence
atggaggacggcggcctgaccgccttcgaggaggaccagcggtgccttagtcagagcttgcctctgcctgtgtctgccgaaggaccagctgcccagacgacggccgagccttccaggagttttagtagcgcacataggcacttgtctagaaggaacggtttatctcgactgtgtcagagccggaccgcactttctgaggaccgctggtcatcatactgcctctcctcactggctgcacagaacatttgtaccagtaagctgcattgccctgccgcccctgagcacacagatccctccgagccaaggggctctgtttcatgctgtagtctgctgcgcggcctatcctcgggatggtcttcccccctgctgcctgcaccagtgtgtaatcccaataaggccatctttacagtagacgcgaaaacgaccgagatcctcgtggcaaatgacaaggcctgcggattgcttggatactcttcccaggatctcataggtcaaaagctcactcagttcttcctgaggtcagattccgatgtagtcgaggctctgtcagaagaacatatggaagccgacggtcacgcagccgttgttttcggcacggtcgtcgacattatttcccggagtggagaaaagatacctgttagcgtatggatgaagcgtatgaggcaggagcgtcgactgtgttgtgttgtggtgctggaaccagtggagcgtgtaagcacctgggtggcctttcagtcagacggcaccgtgacctcgtgcgattccctcttcgcacatctgcatggatacgtatccggcgaggatgtcgctggacaacacatcactgaccttattccttccgttcagctgccaccgtcaggtcaacatatccctaaaaatctgaaaatccagcggtccgtcggcagggctagagatggtacaacctttccactgtctctgaaactgaaatcgcagccatcctctgaggaagcgacaacgggggaagccgcacccgtgtccggatacagggccagcgtgtgggttttctgcacaatttccggccttattaccttgttacccgacggcacgattcacgggatcaaccattcatttgccctgacccttttcggctatggcaaaactgaattattggggaagaacattacattcctcatcccagggttctatagctatatggacctcgcctacaactctagcctgcagcttccagacctggccagttgtctcgatgtaggaaatgagtctggttgtggcgagaggacactcgatccttggcaggggcaggatccagccgaaggaggacaagatccaaggatcaacgtcgttctagctggcggacatgtcgtgcccagagacgagattagaaagctgatggaatcacaggatatctttactggaacacagacagaattgattgctgggggtcagttattgagctgcttaagcccacaacctgcgcctggagtagacaatgtacctgagggtagcctgcccgtccacggagaacaagccctcccaaaagaccagcagataactgctctcggacgcgaggagccagtcgccatcgaaagcccaggacaggacttgctgggcgaatcccggtcagaacctgtggatgtgaagcccttcgcaagttgcgaagacagcgaagcacccgttcccgccgaggacggcgggtccgacgcagggatgtgcgggctctgtcagaaagcacagctagagcgaatgggggtttctgggccttccgggtcggatttatgggcaggcgccgcagtagccaaaccacaggctaaaggccagctggctggaggatctcttctgatgcactgcccttgttacggctcggaatggggactgtggtggaggtcacaggatctggcaccttcaccaagtgggatggcgggcctttccttcggtacccccaccctcgatgaaccttggttaggggttgagaatgaccgggaagaactgcaaacttgcctgataaaggagcaattgtcgcagctgtcattggccggcgcactagacgtgccccacgccgaactggtaccaaccgaatgtcaagctgtaaccgcgccagtgtctagctgcgatctgggaggccgggatctttgtggcggatgcacaggaagtagcagtgcatgttacgctctggccacagacttgcccggcggactggaggcggtggaggcccaggaagttgacgtgaattcgttctcctggaacctgaaagagctcttcttcagtgaccaaaccgatcagacatcttccaattgcagctgcgccacctccgagcttagagagactccaagctcattggccgttggatctgatcctgacgttggaagccttcaagagcagggttcatgcgttctggatgatcgggagctgttgttgctgacaggtacatgcgtcgacctcgggcagggacgtcgctttagagaatcgtgcgtggggcacgaccccaccgaacctttagaagtgtgcctcgtgagctccgagcactacgccgcgagtgacagggaatcgcccggacatgtgccttcaactctggacgctggtcccgaggatacctgtccgtccgccgaggagcccaggctgaatgttcaggtgacatctacaccagtgatcgtgatgagaggagccgcaggccttcaaagagagatacaggaaggggcgtactctggctcttgctatcatagagacggcttgaggctgtcaatacagtttgaagtccgccgcgtggagctccagggccccactcctctgttctgctgttggcttgtgaaggatcttttgcactcgcagagagactctgcggccaggactagactcttcttggcttctttacctggatcaacccactctaccgcagctgagctcacaggcccaagcctcgtagaggtgctgagggcccgaccctggtttgaagaacctccaaaggccgtcgagcttgaaggccttgccgcctgtgagggcgaatactcacaaaaatactccaccatgagccccctggggagcggagcattcggtttcgtttggaccgctgtcgataaagagaagaacaaagaagtcgtggtcaaatttatcaaaaaggaaaaggtgctggaagactgttggatagaggaccccaaactcggcaaagtcactttagaaatcgccatcctctctcgggtggagcatgctaacattattaaggtcctcgatatttttgaaaatcaaggcttctttcaactggtaatggaaaaacacggctctggcctggacttgttcgcgtttattgacaggcacccacgactcgatgagccccttgccagttacatattcagacaggtgcgcgcaggccaatctagggtcagcgtgaacgccggcctgggagcctgggtgagatggctccagaggtctgtcattcacacaagattctctctctag

SEQ ID NO: 198734 - DNA, 1314 bp, Artificial Sequence
  Description of Artificial Sequence: Synthetic coding sequence
atggtgcagatgatgcggcagttcctgtaccgggtgctgcccgaggattcatacaaagtgaccactgggaaattacacgtgagcctcaccaggctcactgatggggaaaatgtcgtcgtctccgagtttaccagcaaagaagagctcatcgaggccctgtactgcagttgttttgtgcccgtttattgcggcctgataccgcccacttacagaggtgtgaggtatattgacggtgggttcacagggatgcaaccctgtgcgttctggacagacgccattacaatctccacttttagcggccaacaagatatctgcccccgagactgcccagcaatctttcatgacttcagaatgttcaactgtagcttccagttcagcctggagaacatagccaggatgacacatgcgcttttccctcccgatctggttatcctgcatgattattactacagggggtacgaggacgctgttctgtacctccgtagacttaacgcagtatacctgaactctagttctaagagggtgatctttcccagagtcgaagtgtattgccagattgagcttgcgctgggaaatgagtgccctgaaaggagccagcccagtcttcgggccagacaggccagcctggagggcgccacacagcctcataaggagtgggtccctaagggagatggtagagggtctcacggcccacccgtatcacagccagtgcagacactcgaatttacttgcgaatcgcccgtgagtgctccggtgtcgcccctcgaacagccgcccgcacaacctttagcttcatccacacccttaagtctgtctggaatgccccctgtgtcctttccagcagtccacaagcctcccagtagcactccagggtccagcctacccacgccaccaccgggactgtctccgctgagccctcagcagcaggttcaaccctctggatcccccgcccggagcctgcatagtcaagcccctacttccccccgcccttcgctgggcccatccaccgtcggtgctcctcagaccctcccgcggagctctctaagtgccttccccgcacaaccacctgttgaagagctgggacaggagcagcctcaggccgtagccctgctcgtgtcctccaagcccaagtcagctgtccctctggtccatgttaaggagaccgtgagcaaaccatacgtcactgagagcccagccgaggactccaactgggtgaacaaagtattcaagaagaacaaacagaaaacaagcgggacacgaaaaggtttcccccgacacagcggatccaagaagccatcctctaaagttcagtag

SEQ ID NO: 198735 - DNA, 1599 bp, Artificial Sequence
  Description of Artificial Sequence: Synthetic coding sequence
atggaggagcaggtgttcaagggcgaccccgacaccccccacagcatctcgttctccggcagcgggtttctttcgttttaccaagccggggccgtcgacgctctgagggatttagctccaaggatgctggaaaccgctcaccgatttgctgggacatcagcaggagcagtcatagctgccttggctatatgtggtattgagatggacgaatatttgagggtgctcaacgtgggcgtggctgaagtcaagaaatcatttcttgggcctctctccccctcctgtaaaatggtgcagatgatgaggcagtttctttacagagttttgccagaggactcatacaaagtcacaactgggaagttacacgtctctttgactagactgacggacggggagaatgtcgtagtgagcgaattcactagtaaggaggagctcattgaagccttgtattgcagttgcttcgttcccgtatattgtggtctgatcccacctacttatcggggggtgcggtacattgatggcggtttcactggaatgcagccatgtgcattctggaccgacgccattacaataagcaccttttcgggccagcaggatatttgtcccagagactgccctgccatttttcacgacttcagaatgttcaattgctctttccagtttagcctggagaacattgcaagaatgacacatgccttgttccctccagacctggtgatcctacacgactactactacaggggctacgaggacgcggtgctgtacctccgcaggctgaacgctgtctacctaaattcttcatcgaaacgagtgatcttccccagggtggaagtgtactgccagatcgagctggccctcggtaacgaatgtccggagcgttcccaaccaagtctacgcgctaggcaggcaagtctagagggcgcaacccagccacataaggaatgggtccccaagggggatgggcgaggcagtcacggtccgcctgtgagccaacctgtccagaccctcgagttcacttgcgaatcacccgtgagtgcacctgtttcgcctttggagcagccccccgctcaaccactggctagcagcactccactcagtctgtccggcatgccccccgtgtccttccctgctgtccacaagccaccttccagcacgcccggcagttccctccctaccccaccccccggtttgagccctctcagcccccaacagcaggtccagcctagcggctctccggctaggtcgctgcactctcaagccccaacatcccctagaccatccctgggaccgagcaccgtgggggctcctcagacactgcctagaagctcactttccgcctttccggcgcagcctcctgtggaagagttgggacaagagcagccacaggccgtcgctcttcttgtgtcaagcaagcccaaatcagccgtgcccctggtccacgtaaaagagaccgtctcaaaaccatatgtcacggagtctccggcggaagattctaattgggtgaataaggtctttaaaaaaaacaagcagaagactagtggcacgcgtaaaggcttcccccgacattctggcagcaagaagccatcctcaaaagtgcaatag

SEQ ID NO: 198736 - DNA, 1602 bp, Artificial Sequence
  Description of Artificial Sequence: Synthetic coding sequence
atggaggagcaggtgttcaagggcgaccccgacaccccccacagcatcagtttctctgggagcgggttcctgagtttctatcaagcaggcgctgtggatgctttaagggacttggccccccgtatgctcgagacagctcaccgattcgccggaacgagcgccggcgccgtcatcgctgctctggccatttgcgggattgaaatggatgagtacctccgggtgctgaatgtgggggtggcagaggtgaaaaagagctttctgggtcccctgtctcccagttgcaaaatggtgcagatgatgaggcagttcctctatagagttctgcctgaggacagttacaaggtgacaaccggtaaattgcatgtgagcctgacgcgcctgaccgatggcgaaaatgtggtggtgtccgagttcaccagtaaggaggagctcatagaggccgcgctttattgctcatgcttcgtgcctgtgtactgcggactaattccccccacctataggggagtccggtacatcgatgggggctttacagggatgcagccatgtgccttttggactgatgctattacaatcagcacattttccggtcaacaagacatatgcccccgcgactgcccagccatctttcatgattttcgaatgttcaactgtagcttccagtttagtctagagaatatcgcaagaatgacgcatgccctctttcctcctgatttagtgatccttcacgactattactatagaggttatgaagatgcggttctgtacctgcggcggcttaacgcggtttacttgaactccagcagcaaaagagttatttttcccagggtcgaggtgtattgccagatcgagcttgcgctgggcaacgaatgccccgaacgttcacaaccttcgcttcgagctagacaggcctccctggaaggcgccacgcagccacacaaagagtgggtacccaagggcgatggcagggggtcccacgggccccctgtcagccagcctgtgcagacattagaatttacttgtgaaagtccagtgtctgcaccagtaagccccctggaacaaccccccgcacaacctctggccagtagcacaccactgagtttgtccggaatgcctcctgtgtccttccctgctgtgcataagcccccttcctcaacgccaggttccagcttgcccactccaccacctggactgagcccgctgtccccacaacaacaagtgcagccctccggcagtccagctcgttcgctccacagtcaagcccctacatcaccccgtccgtctctgggtccttccaccgttggcgccccccaaactttgcctagatcaagcttgtccgcttttccagcacagccccctgtcgaagaactcggccaggaacagccgcaggcggtggcactcctggtcagttcaaaaccaaagagcgcagttccattggttcatgtgaaggagaccgtgtcaaaaccctatgtcactgagtcaccagctgaggacagtaattgggtcaacaaagtcttcaagaaaaacaaacaaaaaacctccggaacaagaaaaggattccccagacactccggctccaagaaaccttcctccaaagtgcaatag

SEQ ID NO: 198737 - DNA, 1341 bp, Artificial Sequence
  Description of Artificial Sequence: Synthetic coding sequence
atggtgcagatgatgcggcagttcctgtaccgggtgctgcccgaggattcttacaaggtgactaccggaaaattgcacgtgtcattaactcgcctcaccgacggagagaacgtagtcgtctctgaatttactagtaaagaggagcttattgaggcattgtattgttcctgctttgtcccagtgtactgcggcctcatcccccccacctaccggggggtgtgggctttcctcacattacctccccagagatacatcgatgggggattcaccggtatgcaaccctgtgccttttggaccgacgccatcacaatatcaacattcagcggccaacaggacatctgcccaagagactgcccagctattttccacgactttcggatgttcaactgctcattccagttctccctagagaacatcgcccgaatgacacacgcactttttccccctgaccttgttattctccacgattattactaccgaggatatgaggacgcagtgctctacctgaggaggttaaacgcagtctaccttaactcctcaagtaagcgcgtgatctttcccagggtcgaagtctactgtcaaatcgaacttgctctaggcaacgaatgcccagagcgctcccagcccagtctcagagcccgacaggccagtttggaaggcgcaacccagcctcacaaggagtgggtgccaaagggcgacggtcggggcagtcatggacctcctgtctctcagcctgttcagaccttagagttcacctgtgagagtccagtatctgctcctgtcagcccactggagcagccgccagcccaacccctggccagtagcaccccactttctctcagcggtatgccaccggttagctttcccgctgttcacaagcctcctagttctacgcccggcagctctctgcctaccccaccaccaggactgagccctctatccccccaacagcaggtacagcctagcgggagtcctgcaagatctctgcattcccaggcccccacaagcccacgtcctagcttgggacccagtacagtgggggcaccccagaccctgcctcggtcatccctaagcgcatttccggcccaacctcccgttgaggagcttggacaggaacagccgcaggcagtggccctgctcgtttccagtaagcctaagagtgcagtgcctcttgtgcacgtcaaggagaccgtgtccaaaccatacgtcactgaaagccccgccgaggatagtaactgggtgaacaaagtgtttaaaaaaaacaaacagaagactagcggaaccaggaagggttttccgaggcatagtggtagtaagaagccctcctccaaggtacagtag

SEQ ID NO: 198738 - DNA, 1515 bp, Artificial Sequence
  Description of Artificial Sequence: Synthetic coding sequence
atgttcccccgggagaagacctggaacatcagcttcgccggctgcgggtttctgggcgtgtattatgtcggtgtagcgagttgcctgcgtgaacacgctccatttctggtggctaacgccactcacatctacggcgcctccgccggagccctaactgccaccgctctggtgactggagtctgcctcggtgaagcaggagccaagttcattgaggtttcaaaagaggctcgcaaacggttcttgggccctctgcacccctcctttaatctcgtcaagatcatcagatctttcctcctgaaagtcctgcccgccgacagtcatgaacacgcttccgggcgactcggcatttcactgactcgggtgagcgatggcgaaaacgttatcatcagccattttaattccaaggacgaactgatccaggctaacgtgtgcagcggtttcattcccgtgtactgcggactcataccaccttccttacaaggcgtccggtatgtggatgggggaatttccgacaacctacccctgtatgagctgaaaaacactattacagtgagtcctttctccggcgagtcggatatctgcccccaggattcttcaactaacatccatgaactgagggtgacaaacacgtctatccagtttaatttgaggaatctgtacagactgtccaaggccttgttccctcccgaacctctggtgcttcgcgagatgtgcaagcaaggttaccgcgacggactccgcttcttgcagcggaacggcctgctcaaccggcccaatccgctgctggctctgccacccgctcgaccacacggcccagaggataaggaccaagccgtggagagcgcccaggctgaagattattcgcagctcccaggggaggaccacatcttagagcacctacccgctaggctgaacgaagccctccttgaggcatgcgtggagcccaccgatctgctgacaaccctgtcaaatatgctgccagttagactggccacagctatgatggtgccttacacactgccactggaaagtgctctgagctttacgataagactcctggaatggctaccggatgtgcccgaagacatacggtggatgaaagaacaaaccgggagcatttgccaatatcttgtgatgcgggccaaacggaagttaggacggcacctgccgagtaggttgcccgagcaggtggagctgagaagagtgcaatcattacctagcgtgcctctatcgtgtgcagcctacagagaagctctgcccggatggatgcgaaataacctcagcctcggagatgctttagctaagtgggaggaatgtcagcggcaactgctcctgggactcttttgcacaaacgttgctttcccccccgaggctcttcgtatgcgggcccctgccgatccagctcccgctcccgccgatcccgcatcacctcagcaccagttggccggtccagctcctttactctcaactcccgccccagaggcccggccggtcatcggcgctttgggcctttag

SEQ ID NO: 198739 - DNA, 1290 bp, Artificial Sequence
  Description of Artificial Sequence: Synthetic coding sequence
atgggcttcctggaggaggagggccggtggaacctgagcttcagcggggctggctatcttggagcgcaccatgtgggcgctaccgagtgccttagacagcgagcgccaaggctactccagggtgcccgacgtatctatggatcctcatcaggcgccctgaatgcagtgtctatcgtctgtggaaagagcgtcgatttttgctgcagccatctgttaggaatggttggacagcttgagcggttgagcttgagcatcctacatcctgcttacgcgcccattgagcacgtcaaacagcagttacaggacgcattgccacctgacgctcacgtgttggccagccagagacttggcatttctctaacccgatggcccgatggccgcaacttcttagttaccgatttcgccacctgcgatgagctaatccaggcactcgtatgtaccctgtattttccattttattgtgggttgatcccacctgaattccggggtgaacggtacattgatggagctctgtcaaataatttaccgttcgcagactgtcccagcacgatcactgtctctccttttcacggaacagttgacatctgtccccagtctacatctcccaatctgcacgagcttaatgtgtttaatttctccttccaaatctctacggagaacttcttcctgggcctcatatgcttaatacctccatccctggaagtcgttgcggacaattgcaggcaggggtacctggatgccctgcggtttctagaacggcgcggcctcacgaaggaacccgtgctctggactctcgtcagtaaggagccccctgccccagctgacgggaactgggatgcgggctgtgaccagcgctggaaaggtggtctcagccttaactggaaagtgccccatgtgcaggtcaaagatgtgcctaactttgagcaattgagccctgaacttgaagctgccttgaagaaggcctgcacacgggatccctcccggtgggcaagattttggcattccgggccaggccaggtgctgacctacctgcttctcccttgtacactgcccttcgaatatatttattttcgctcaagacgcttagtggtgtggctgcccgacgtgcctgccgacctgtggtggatgcaggggctactacggaatatggctctggaggtgttctccaggactaaagctcagttactgggcccaatttcccccccagccacccgggtgctggagacatctcctctgcagccacagatcgctccccaccgagaggagttgggacctactcaccaggcatag

SEQ ID NO: 198740 - DNA, 1515 bp, Artificial Sequence
  Description of Artificial Sequence: Synthetic coding sequence
atggccgcccagcggcggagcctgctgcagagcgagcagcagccctcctggactgacgatctgcccctctgccatttgtccggcgttgggtcagccagcaacagatcctatagcgcagacggaaaaggtaccgagtcgcatccacccgaagatagttggctgaagtttcgcagcgagaataattgtttcctgtacggcgtcttcaacggttacgatgggaacagggttacgaacttcgtcgcacagaggttgagcgccgagctgctgctaggacagcttaacgcagaacacgctgaggccgacgtgagacgtgttctcctccaggcattcgacgtcgtggaaagaagttttctcgagtctatcgatgacgctctggcggagaaggcatccctccagtctcagctcccggagggcgtgccccagcaccagctgccaccccagtaccagaagatacttgagcgcctgaaaacccttgagcgagaaatctcaggaggcgccatggctgtcgttgccgtactactgaataacaagttgtacgtggctaacgtcggtacgaacagagccctgctctgcaagagtacagtcgatggccttcaggtaactcagctgaacgtggatcacaccaccgagaatgaagacgaactatttcgtctgtcacaacttggcttggacgctggtaagattaaacaggttggtataatttgcgggcaagagtccacaagacggatcggtgattataaggtgaagtacggctataccgatattgatttattatctgcagccaagtccaaacccataattgctgagccagagatccatggcgcccagcccttggacggagtcaccgggttcctggtgctgatgtcggagggcctttacaaggcgctggaagctgcccatggccccggccaggctaaccaggagatagctgcaatgattgacaccgagttcgccaaacaaactagcttggacgcagttgctcaggcagtggtagacagagtcaagagaatacactctgacacattcgcaagcggtggcgagagagcacgcttctgtccaaggcatgaggacatgaccctgctcgtgaggaactttggatacccactgggggagatgtctcagccaactccctccccagctcccgctgccggaggacgggtgtatcccgtcagcgttccttattcctccgcgcaatcaaccagtaagactagcgtcaccctgagcctcgtaatgccaagccagggacagatggtgaatggggctcactcagcctctaccctggatgaagcaacacctactctcacaaaccaaagccccacactgaccctccagagcacaaacacccatacccagtcatcttcctccagcagtgatggaggacttttcagaagtcgacccgcccatagtttaccccctggggaggacggtagggtcgagccatacgttgactttgcagagttttatagactgtggagcgtggatcacggcgaacagtccgttgtcacagccccctag

SEQ ID NO: 198741 - DNA, 948 bp, Artificial Sequence
  Description of Artificial Sequence: Synthetic coding sequence
atgggcttcctggaggaggagggccggtggaacctgagcttcagcggtgcagggtatttaggggcacaccacgtgggagctaccgaatgtctgaggcagagggcgccacgcctgctgcagggggcacgcaggatatatggctcaagtagcggcgctctgaacgcagtttccatcgtgtgtggaaagagcgtagattgcccctcgacaattacagttagtccttttcacgggaccgtggacatatgccctcagtccaccagccctaatctgcatgaacttaatgtcttcaatttttccttccagatctcaacggagaatttcttcctaggcttgatctgtctgataccgccctcacttgaggtcgtcgctgataactgcagacagggctaccttgacgcactcagatttctggagagacgtggtctgacaaaggaacccgttctgtggacactggtatccaaggaaccccccgcgcccgccgatggtaattgggatgccgggtgtgaccagaggtggaaagggggtctgagcctgaactggaaggttcctcacgtgcaagtgaaagacgtcccaaatttcgagcagctgtcaccggagttagaggcagccctaaaaaaagcctgcacaagggaccctagtcggtgggctcgattttggcattccggacccggccaggtcctgacttacctcttgctgccgtgcacactgccctttgagtacatctacttccgctctcgccgcctggtagtttggttgcccgacgtgcccgccgatctctggtggatgcagggcctcctccgaaacatggcactagaggtattttcaaggaccaaggcgcaattattgggcccgatttcgcctcccgccacccgcgtccttgaaacaagtcccctacaaccgcaaatagctccgcacagagaagaacttggccctacccaccaggcatag

SEQ ID NO: 198742 - DNA, 807 bp, Artificial Sequence
  Description of Artificial Sequence: Synthetic coding sequence
atgggcttcctggaggaggagggccggtggaacctgagcttcagcggcgctgggtacttgggcgctcatcatgtaggggctactgagtgtctcaggcaacgagcacctcgcctcctgcagggagcccgaaggatttacggcagctctagcggagcattgaatgccgtatctatcgtgtgcgggaagtccgtcgacttctgctgttcccatctgctgggaatggtgggccagctggagagactaagcctgagcatcctgcatcctgcctatgctcccattgaacatgttaaacaacagctccaagatgccctgccccccgatgcgcatgtgctcgcctctcagcggctgggcatctccctaacacggtggcctgatggacgtaattttttggtgacagattttgccacctgtgatgaactgatccaagtggtggcagacaattgtcggcaaggttacctggatgcgctcaggtttctggagagaagaggtcttacgaaagagcctgtcctgtggacgctcgtttccaaagagcctcccgctccagctgatggaaactgggacgcaggctgcgatcagagatggaagggcgggctctccctcaattggaaagtccctcacgttcaggtcaaagatgtacctaatttcgagcagctctcacctgaacttgaggcagctctaaagaaggcatgtacaagggatccttctcgatgggcccggttctggcactccgggcctgggcaggttttaacctacctgctgctcccttgcactctgccctttgagtacatctactttcgcagccgctag

SEQ ID NO: 198743 - DNA, 948 bp, Artificial Sequence
  Description of Artificial Sequence: Synthetic coding sequence
atgggcttcctggaggaggagggccggtggaacctgagcttcagcggcgcaggttatttgggagcgcatcatgttggcgcaacggaatgcctgagacaaagagccccccgcctgctgcagggcgctaggcgcatctacgggtcttcctcaggcgcactgaacgcagtgtctatcgtctgcggtaagtccgtggattgccctagtaccattacagtgtcacccttccatggaacggtggatatctgtccccagtcaacctctcccaacctccatgaactcaacgtgtttaatttcagtttccaaatcagtactgagaatttctttttgggactaatctgcttaatccccccgtccctggaggtcgttgccgataattgccgacagggctatctggacgctctgcggttcctggagaggagaggactcacgaaagaaccagttctctggacccttgtcagtaaagaaccaccagctcctgcggacgggaattgggatgccgggtgcgaccaacggtggaaggggggcctgtcacttaattggaaggtgccccacgtgcaggtgaaagatgtcccaaacttcgagcagttatcacccgagctcgaagcggcgctgaagaaggcttgtaccagagatccctcaagatgggcccgattttggcacagcggtcctggtcaagtgctcacttacctcttacttccttgcacactcccttttgagtatatatacttcaggagccgtaggctagtcgtatggctgcccgacgttcccgccgacctgtggtggatgcaaggactgcttcggaacatggccctggaggtcttctccaggacaaaagctcagttattaggccccataagtccacccgccacgcgtgtcctggagacatccccattgcaaccgcagatcgccccccacagagaggaattaggcccaactcatcaggcctag

SEQ ID NO: 198744 - DNA, 708 bp, Artificial Sequence
  Description of Artificial Sequence: Synthetic coding sequence
atggaggaggagacccacaccgacgccaagatccgggccgagaacggcacaggaagtagtccacgcggaccgggatgctcactcagacacttcgcctgcgaacagaaccttttgtctcggcccgatggcagtgcttcttttctgcagggggataccagtgtactggcaggggtgtatggccccgctgaggtgaaggtcagcaaagagatctttaataaggctacacttgaagtcatactgcggcctaaaattggcctgccaggagtggctgaaaagagcagagagcgcttaattaggaatacatgcgaggccgttgtgctcggaacattgcatcccaggacaagcattactgtcgtactccaggtagtgtccgacgcaggttcactactcgcttgctgcttgaacgcagcttgtatggcattggtggacgctggggttcctatgcgcgcactgttttgcggcgtagcctgtgcactcgattcagacggcaccttggtcctcgatcccacatctaagcaggagaaggaagccagggcagtactgacttttgcactcgactcggtagaaaggaaattgctaatgtcaagcaccaaaggcctctatagcgacacagagttacagcagtgcctggccgcagcacaggccgcgtctcagcacgtattccggttctatcgggaatccctccagcgacgatactcaaaatcttag

SEQ ID NO: 198745 - DNA, 4128 bp, Artificial Sequence
  Description of Artificial Sequence: Synthetic coding sequence
atggaggcccccctgcagaccggcatgatgggcaccagcagccacggcctagcaactaattcgtctggggccaaggtagcggagagggacggttttcaggacgtgcttgcaccgggagaggggtccgcgggcaggatctgtggcgcccagccggtgccctttgtgccgcaggtgctgggcgtgatgattggcgccggcgtggccgttgtggtgacggccgtgctgatcttacttgtggtgagaaggttgcgcgtcccaaagaccccagctcccgatggtcccaggtaccggttcagaaagagggacaaggtcctgttctatgggagaaaaatcatgagaaaggtctcccagagcacctcgtctctagtggatactagcgtctctgcaacatcccgacccaggatgcgtaaaaagctaaagatgcttaatattgcaaaaaagattttgcggattcagaaggaaacccctactttacagcggaaggagccgcctccagcagtcctggaggccgaccttacagagggagatttagcaaactcgcacctacctagtgaagtgctttacatgctgaagaacgttagggtgttaggccacttcgagaagccactcttcctggaactgtgccgccatatggttttccagagactcgggcagggagattacgtatttagacccggtcagcccgacgcctccatttatgtggtccaggacggtctgctcgagctctgtttgccagggcccgacgggaaggaatgtgtcgttaaggaagtggtaccaggcgatagtgtcaactcactgctgtctatcctagatgtgattaccggccatcagcacccacaaagaactgtgagtgcacgcgctgctcgggacagcacagttttacgcctgcccgtggaggcctttagtgccgttttcaccaaataccctgagtctttggtgcgagtggtgcaaatcattatggtcaggctacagcgggtcacatttctcgctctccacaactacctgggccttacaaatgaactgtttagccacgagattcagccactgcgtctgttcccctctccaggacttcctactaggacatctcctgtacggggctccaaaaggatggtcagcacctctgctacagacgaacctagggaaactcctggaaggccgcctgatcctacaggtgccccgctccctgggccaacgggggatccggtcaaaccaacctcacttgaaaccccttccgccccactgctcagtagatgcgtgtcaatgcccggagacataagcgggctccagggcggcccaagatctgactttgatatggcatatgagagaggtcgcatctctgtcagcctgcaggaagaggcttctgggggatcccttgctgctcccgctagaacccccacgcaggaacctagagaacagccagcaggcgcctgcgagtattcatactgtgaagatgagtcggccaccggcggctgcccgtttggcccataccaaggtagacagaccagcagcatatttgaagctgcgaagcaggaactcgccaagctaatgcggattgaggaccctagccttttgaactcacgggtccttctgcaccacgcaaaggccggtaccatcatcgccaggcagggggatcaggatgttagtttgcattttgtgctgtggggctgcctgcacgtgtaccaacggatgatcgataaggcagaagatgtgtgtctcttcgtggctcaacctggtgagttggtaggccaactagccgtcctgacgggagaacctttaatcttcaccttgcgggcgcagcgagactgtacatttttgagaataagcaaaagcgacttctatgagattatgcgcgctcagccctcagtcgttctgtctgctgctcacaccgtggcagcccggatgagtccctttgtgagacaaatggacttcgcaattgactggacagctgtcgaggcagggagggccctgtaccgacaaggtgaccgcagtgattgcacctacatagtcttgaacggccgtctacggtcagttattcagagagggtccggcaaaaaggagttagttggcgagtatggtcgcggtgatctgatcggcgtggtcgaggctctcacgcggcagcctcgagcaaccaccgtgcatgctgtgagagacacagaattggctaagctgcctgaaggtacgctcggacacattaaaagacgctacccccaggtggtgaccaggctgatacatttactgtcacagaaaatcctgggaaatctacaacaactgcagggtcctttccctgccggttccgggcttggcgttcctccccactcagagttaacaaaccctgcctcgaacctagccacagttgcaattttaccagtttgtgccgaagttccaatggtcgccttcaccctcgagctacagcacgctcttcaggccatcggacccactctcttactgaatagcgatatcatccgcgctcgactaggggctagcgcattggattcaatccaagaatttcggttgtcaggatggttggcccagcaggaggacgcgcaccgcatcgtgctttatcaaacagatgcttctctgaccccctggacagtccggtgcctcagacaggccgactgcatcctaatcgtgggcctgggggaccaggaaccaacgctagggcagctggagcagatgctggagaacacggccgtccgggctctcaagcagctcgttctcctccaccgggaggagggagcggggccaacccgcaccgttgagtggctcaatatgagaagctggtgcagtggtcacctgcacttacgatgtccacgtcgcctcttttctaggcgctcgcccgctaagctgcacgagttgtatgagaaggtgttctctcggagggcagacaggcacagcgatttctcaagactggccagggtactgaccggcaacactatcgccctggtactgggaggcggaggagctaggggctgctcacacattggcgtcctgaaggccctggaggaagccggtgttcccgtggatctggtcggaggcacttcaatcggctcctttattggagccttgtatgccgaggagagaagcgccagccgcaccaagcaacgtgcccgagagtgggccaaatctatgacatctgttctcgaacccgttctcgacctgacctacccagtcacctccatgttcaccggctccgcgttcaaccggagcattcaccgggtattccaagacaagcagattgaagacctgtggctgccgtactttaatgtgacaaccgacatcaccgccagtgccatgcgggtgcacaaagacggttccctctggcgttacgtcagggcaagcatgacactgtcgggctacctcccacccctgtgtgacccaaaggatggccaccttctgatggatggaggctacatcaataatttgccagccgacatcgctcgcagcatgggggccaagactgtgattgctatagatgtgggctcgcaggacgagacggacctgagtacgtatggcgatagcctctcaggctggtggctgctgtggaagagactgaatccgtgggccgacaaagttaaagtgccagacatggcagaaattcagtcccgactcgcgtatgtctcctgtgtgcgccagctcgaagtagtgaagtcaagctcctactgcgaatatttacggccacctatagactgctttaagacaatggattttggcaagtttgaccaaatatacgacgttggatatcaatacggcaaggccgtgttcggcggctggagtcgaggcaacgtgatagaaaaaatgttaactgataggagaagcacggacctgaacgagtcacgacgcgccgatgttcttgccttcccgagttcaggcttcacagatctggcagaaatagtgagtcgaatcgagccgcctacctcctatgtgtctgatgggtgcgccgacggagaggagtcagattgcctgactgagtacgaggaggacgccggcccagactgctcaagggacgaaggtgggtcaccagagggcgcatccccaagtaccgcgagtgaaatggaggaggagaaatctattttacggcaaaggagatgtctgcctcaggaaccgccaggttctgcaacagatgcttag

SEQ ID NO: 198746 - DNA, 3984 bp, Artificial Sequence
  Description of Artificial Sequence: Synthetic coding sequence
atggaggcccccctgcagaccggcatggtgctgggcgtgatgatcggagccggagtcgctgtggtggttaccgctgtcctcattctgctcgttgtgaggcgcctccgcgtgccaaagacaccggcccctgatggccccagatacagattcaggaaacgtgacaaagtcttgttttatgggcggaagattatgcgaaaggtcagtcaatccactagcagtctagtggacaccagcgtgagcgccactagtcgcccaaggatgagaaagaagttgaaaatgttaaacatcgccaagaagattttgaggatccaaaaagagaccccgacgctgcagcgaaaagagcctcccccagccgtgctggaggccgacctgacagagggcgatcttgctaactcgcacctgcctagcgaggtcctgtacatgttaaaaaatgtcagggtcttggggcattttgagaagcctctgttcttggagctgtgcagacacatggtgtttcagcgtctagggcagggagactatgttttccgtccgggccaaccggatgcgtccatctacgtggttcaggatggcctcttggagttatgcttgccaggccccgacgggaaagagtgcgttgtaaaggaagtggtgccaggagactccgtgaatagcctgttgagcattctcgacgttatcaccgggcaccagcaccctcaaagaacagtctccgccagagccgctcgtgacagtactgttctgagactccctgtggaggcattttctgctgtcttcacaaaatacccagagagtttagtgagagtcgtgcagatcattatggtgaggctgcagcgtgtcacgttcctggcactgcacaactacctggggcttactaatgaactgttcagccatgaaatccagccactgcggctcttccctagtccagggctgcccaccagaaccagtcccgttcgggggtctaagaggatggtgtccacatcagcaaccgatgagccacgggaaacaccaggaagacccccagatcccacaggggctcctttgcctggcccaaccggcgatcccgtgaagccaacaagccttgagactccatctgcaccgttgttatcccgttgcgtcagcatgcccggggacatcagtggtctgcaagggggcccccgaagtgattttgacatggcttacgagcgtgggcgcatttcagtcagtctgcaggaagaggcttctggggggtcactggccgctcccgctcgaactccaactcaagagcctagagagcagcctgccggagcatgtgaatattcctactgcgaagacgaatcagcgaccggcggctgtcccttcggcccttatcagggtaggcagacctcatcaattttcgaggctgccaaacaggaactggcaaagctgatgcgcatagaggatccatctctcttgaactctagggtgttgctccaccatgcgaaggccggtacaattatcgcacggcagggtgatcaggacgtttctctgcatttcgtgctttggggttgcctgcacgtttaccagaggatgatcgataaagccgaagacgtctgccttttcgtcgcccagccaggggagctggtgggtcagctggcagtcctcacaggggagcctttaatattcaccctaagggcccagcgagactgtacgttcctgagaatcagcaagtcagatttctatgagatcatgagagcacagccttcagttgtactcagcgccgcccatacggtggccgcccggatgagcccttttgtcaggcagatggacttcgccatagactggactgccgttgaagccggacgcgctctgtatagacagggcgacagatctgattgtacatatatagtcctaaatgggaggctacggagtgtgatccaaaggggcagcggcaagaaagaattggtgggagaatatggccgcggcgatctgattggggtggttgaagcacttaccagacagccccgagcgacgaccgtgcatgcggtgcgagacacggaactcgccaaactccccgagggcacactgggtcacatcaagaggcggtaccctcaggtcgttacacgccttattcacctgctcagccaaaaaatcctcggcaacctccagcaactgcaggggcctttccctgctggcagtggcctgggcgtgccacctcacagcgaactgaccaatcctgccagcaatcttgcaaccgtcgccattctccccgtgtgcgcagaggtgcctatggtggcatttacacttgagttgcagcatgctctccaggcgatcggccccactctgcttttgaatagcgacatcatccgggccaggctcggagccagcgccctcgatagcattcaagagtttaggctcagcggatggctagcccagcaggaggacgcgcatcggatcgttctctaccagactgatgcctctttgacgccttggacggtgcggtgtctccgccaggctgactgtatactcatcgttggcctcggagaccaggagcctacactgggtcagctcgagcagatgttggaaaacaccgccgtcagagctctcaagcagcttgtcctccttcatagagaagaaggcgccggtcccactcggaccgttgagtggttgaacatgcggtcatggtgttctggacatcttcacctgaggtgtcctcgacgactgttcagccggcggagcccagcaaaacttcacgagctttacgagaaggttttttctagaagggccgaccggcattccgactttagtagacttgctagggtgctgaccggtaatacaatcgccttggtgttgggtggggggggagcacgggggtgctcacacatcggtgtactcaaggccctggaggaagccggtgtgcctgtggacctcgtaggaggcacaagcatcggcagcttcatcggcgcattgtatgcagaggagcgctcagcttccaggaccaaacagcgggcccgcgagtgggcgaagagcatgacctccgtgctcgaaccagtactagacctgacatacccagtaacctctatgtttacaggtagcgcttttaacaggtctatccacagagtctttcaggacaaacagattgaggatctgtggctcccctattttaatgttacaacggacattaccgccagtgctatgcgggtgcataaagacggttccctctggcgttacgtacgggcctccatgacgctcagcggctatctccccccactgtgcgatccaaaggacggccacctcctgatggacgggggctacatcaataatttgcccgcagatatcgcgagaagcatgggcgcaaagacagtgattgccatagacgttggctcgcaggatgagactgacctatctacctacggagattcgctcagtggttggtggctgctctggaagcgcctcaacccttgggccgataaggtcaaggtcccggatatggcggaaattcaaagcagactggcatacgtaagctgcgtgagacagctggaggtggtgaagtcctcttcatactgtgagtaccttcgccctccgattgactgcttcaagaccatggattttggaaagtttgatcagatctacgatgtgggataccagtacggaaaagccgtgtttggcgggtggtcaaggggtaatgtgatcgaaaaaatgctcaccgataggaggtcgaccgatttgaatgagtctaggcgggctgatgttcttgcctttccgagcagcggcttcactgacttagcggagatagtgtcccggatcgagcccccaaccagctacgtctcggacggctgtgccgacggcgaggagtcagattgcctgactgaatacgaagaggacgccgggccggattgctcacgcgatgaaggcgggagccccgagggggcttctccatccacagcatcagaaatggaagaagagaagagcattctgcgtcaacgacgctgtttacctcaggagccccctggctcagccaccgatgcttag

SEQ ID NO: 198747 - DNA, 1371 bp, Artificial Sequence
  Description of Artificial Sequence: Synthetic coding sequence
atgcggaaggtgagccagagcaccagcagcctggtggacaccagcgtatccgctacctccagaccgcgaatgcgcaaaaaacttaaaatgctgaatattgctaagaagatactgcggatccaaaaggaaactccaacactgcagcggaaagaaccgcctcccgccgtgttagaggcagatctgaccgagggcgatctggcaaatagccatctgccctcagaggtgctctatatgttgaagaacgtaagggtgttgggccactttgagaagccgctgttcctggagctgtgcagacacatggtgttccagaggctgggacagggtgactacgttttcaggcctggtcaaccagatgcctctatctacgtggtgcaagatggactcctagagttgtgcctgcctggccccgacggcaaggagtgcgtggtgaaagaagtggtccctggtgacagcgtcaacagcttattaagcatactggacgtgattactggacaccagcacccgcagcgcactgtctctgccagagccgcacgcgactcaaccgtgttgcggctgcctgtcgaggctttttccgccgtttttacaaaatatccagaatctctggtcagggtcgttcaaataataatggtgaggttacagcgggtgaccttcctcgctctccataactatctcggcctaaccaacgaattattcagtcacgaaatccaaccactcagattgttcccttcccctggcctccctacccgcacaagcccggttcgcggaagcaagcgcatggtctcaacctctgcaaccgatgagccgcgagagacacccggccggccgcctgacccgaccggtgcaccccttcctgggcctaccggtgaccctgtgaagcccacctccttggagacacccagcgctcctctactgtctcggtgcgtgagtatgcccggagacatttctgggttgcaaggtggccctaggtccgacttcgatatggcctacgaacgaggccgtattagtgtgagtctgcaggaagaagcatccggcggctcactggccgcacccgcaaggacgcctacacaggagccgagggaacagccagcgggagcctgtgagtatagctattgcgaggatgaaagtgcaactggaggatgcccctttggaccgtaccagggccggcagacttcttccatcttcgaggcagctaagcaagaactagctaaattgatgcgtatcgaagaccccagcctgctgaatagcagagtgttgttgcatcacgccaaggctgggactatcatcgcgcggcaaggcgatcaagatgtgtccgggccccacactggcctcacctgtcccgagagaggatgctctgtggccctgatgacctag

SEQ ID NO: 198748 - DNA, 3903 bp, Artificial Sequence
  Description of Artificial Sequence: Synthetic coding sequence
atggaggcccccctgcagaccggcatggtgctgggcgtgatgatcggcgctggcgtggccgtcgtggtaactgccgtactcattcttctggtggtcagaagactgcgtgtacctaaaacgcctgccccggatggcccacggtaccgcttccgcaagagggacaaggtgctgttttacggaaggaaaatcatgcgcaaggtttcccagagcacatcttctctggtggatacttctgtgtccgcaaccagtaggccaaggatgcggaaaaagctgaaaatgttaaatattgcaaaaaaaatcttaaggatccagaaggagacccctaccctgcagaggaaggaaccgcccccggcggtacttgaggctgatctcacggaaggcgatcttgccaacagtcacctgccgtccgaagtgctttacatgttgaagaacgtgagagtattaggccactttgaaaaacccctctttcttgaactttgtcggcacatggtcttccaacgactgggtcagggagattatgtgtttcgacccggacagcctgacgcaagcatatatgtcgtgcaagatggtctgcttgaactctgcttgcccggccccgacggcaaggagtgtgtcgtaaaagaagtggtgccaggggacagtgtcaacagtcttctgtccatactggacgttatcacgggccatcagcatcctcagagaaccgtgagtgctagggcagcaagggactcaacagtcttgagactgcccgtcgaagccttctctgcggttttcactaagtatcctgagagcctcgtccgagtggttcagatcataatggtccgactgcagcgtgtgactttccttgccctacataattacctgggcctgaccaacgagctgttcagccacgagatccagcctctccgcctctttccttccccaggtctccccacacgaacgtcccccgtccgggggtccaagcggatggtgtctaccagtgcgaccgatgagccccgcgaaaccccaggccggccgccggatccaaccggagctccactgccaggacccaccggagaccctgtgaaaccaacctctctggaaactccgagcgcccccttgctaagccgatgcgtctccatgcctggtgatatctcaggacttcagggagggccacgcagtgatttcgatatggcatacgaaagaggccgaatctctgtgagcctgcaggaagaggcaagcggagggagcttagccgctccagctagaacacctacacaggagccgcgcgagcagcctgccggggcatgtgagtattcatactgtgaggacgagtcagcgacgggggggtgccctttcggcccctaccagggccgccagacttctagcatatttgaagccgccaaacaagagctggccaagttgatgcggatcgaagacgtctcattgcattttgtcctttgggggtgtctgcacgtctaccagcgaatgattgacaaggctgaagatgtgtgcctgttcgtcgcgcaacctggggagttggttgggcagctggctgtcctgactggtgagcccctgatcttcactctgcgcgctcaacgcgattgcacttttctacggatttctaaatctgatttctacgagataatgagggcgcaaccctcagtggttctgtcggctgctcacaccgtcgctgcaaggatgtcccccttcgttaggcaaatggacttcgccatcgattggaccgccgtggaagcaggtagggcactgtataggcagggagacagaagtgattgcacatatattgtcctgaatggtcggctgcgatcagtcatccaacggggatctggcaagaaggagttggtgggggaatatgggcgaggcgatttgatcggagtggttgaggctctgactcgtcagcctagggcaacaaccgtccacgctgtccgggatactgagctcgcaaagctacccgaagggaccttgggccacatcaagcgcaggtatcctcaggtggtaacaagactcatacatctgctgagccagaagatcctgggtaaccttcagcagctgcaagggcccttcccaggttctggcctgggagtgcccccccattctgagctaaccaatccggcgagcaatctcgctaccgttgccatcttgccagtgtgtgcagaggtgcctatggtcgcattcacactcgagctgcaacacgcactgcaggcaataggccccacactcttgctgaacagtgacattatccgcgccaggctgggtgcctcagccctcgacagcattcaggagttcagactgtccggctggctggctcagcaggaagacgcccatcgtatcgttctgtaccagacggacgcctctctgacaccatggacagtgagatgtctgcgccaagcagattgtattcttatcgtgggacttggagatcaggagccaacactgggacagcttgaacagatgctggagaacacagctgtaagagcactgaagcagctggtgctcctacatcgggaggagggagcagggcccacaaggacagtggaatggctgaacatgaggtcttggtgcagtggccacctccacctgaggtgtcctcgtcgcttattctctcgccgcagccccgccaaactgcacgagttgtatgagaaggtatttagcagacgggcagacagacactccgatttttcccgcctggccagagtcctcactggcaatacgatcgccctggtcctgggggggggtggggcaagaggatgtagccatattggtgtgttaaaagccctagaggaggctggcgtccccgtggatttagtaggcggaaccagcattggatccttcattggagcactgtatgccgaggaacggagtgcgtcccgcactaagcaaagagctcgggagtgggcaaagagtatgaccagcgttctggaaccggtgctcgatcttacttatccagtaaccagcatgtttactggctccgccttcaaccgatctatccatcgcgtctttcaggacaaacagatcgaggacttgtggctgccatactttaacgtgactaccgatatcacagctagcgccatgagggtgcacaaggacggctctctctggagatacgtgcgagcatcaatgaccctgtcgggttatctgccccccctctgcgaccccaaagacggacaccttctgatggatggaggctatatcaataacctaccagctgatatcgcaaggtccatgggggccaagactgtgatcgccatcgatgtgggtagccaggacgagaccgacctgagtacctatggcgattctctctcaggctggtggctgctctggaagcggcttaacccctgggccgacaaggtgaaagttcccgatatggctgagatccagtctcggctcgcctacgtttcatgcgtgagacagttagaggtagtgaagtctagttcctactgcgaatatctccggccccccattgactgctttaaaaccatggacttcgggaagttcgatcagatctatgatgtgggctatcagtatggtaaagccgtgtttggtggatggtctcgcggtaacgttatcgaaaaaatgctgacggataggcggagtactgacctgaacgaatcacgacgtgccgatgtgctggcttttccgtcctctggtttcactgatcttgccgagatcgtatccagaattgagccacctacaagctatgtgagcgacggatgtgctgacggcgaggagtcagattgcttgactgaatatgaagaggacgccggaccagactgtagtcgggacgaaggaggaagcccagaaggcgcctccccaagcaccgcctccgagatggaagaggaaaaatccatactccgccagaggcgatgccttccacaggagccgccaggcagcgcaactgatgcatag

SEQ ID NO: 198749 - DNA, 3954 bp, Artificial Sequence
  Description of Artificial Sequence: Synthetic coding sequence
atggaggaggagaaggacgacagcccccagctgaccggcatcgccgtcggagctctattagcccttgctttggtgggcgttctcattctgttcatgtttagaaggcttcggcagttcaggcaggcgcagccaacgccgcaatatcgcttcaggaaaagggataaagtaatgttctatggtagaaagatcatgcgcaaagtgactacactacctaataccctggttgaaaatacagccctgccacgccagcgcgctagaaaacgaacaaaagtgctgtctctggcgaaaaggatcctgagatttaaaaaagagtaccccgctctgcagccgaaggaaccaccaccgagcctgcttgaggctgacctcacagagttcgacgtgaaaaattctcatctgccttctgaagtgctgtacatgctcaaaaacgtccgcgtcctcggtcactttgagaagcccctgttcctagaactgtgtaagcatatagtctttgtccaactgcaagagggcgaacatgtgtttcaaccaagggagcccgaccccagcatttgcgtcgtgcaagacggccgcctggaagtctgcatccaggatactgacggaactgaagttgtggttaaagaggtactcgctggggactctgtccactccttgctgagtattttagatatcatcaccggccatgcagctccatacaagaccgtgtctgtccgagcagccataccgagcacaatactgaggctacctgccgcagcattccatggggtgttcgagaagtaccccgagacgctggttagggtcgtgcagattatcatggtgaggcttcagcgcgttacatttttggcgctacacaactacctgggtctgacaaccgagttgttcaacgctgagtcacaggctattcctctggtttcagtcgcatctgtcgccgcagggaaagccaaaaagcaggtgttctacggggaggaggagaggctgaagaagccgcccagactgcaggagtcttgtgattccgatcacggagggggacggccggctgctgctggtcccctcctaaagcggtctcatagcgtgcccgccccgtccatccgcaaacaaatcttggaggaattggaaaagccgggagctggggatcccgacccgtcggcaccacaagggggccccggtagcgcaacatccgacctgggcatggcgtgtgacagagccagggtgttccttcattcagatgaacatccaggctcaagcgtcgcttctaaatccaggaaatccgttatggtggctgaaatcccatctacagtgagtcaacatagcgaaagccacaccgacgagacactggccagcagaaaatctgatgcgatattcagggccgccaagaaggaccttctcactcttatgaagctggaggacagctctcttctcgatggccgcgtggctcttctacacgtcccggcaggcaccgtggtcagcagacagggcgaccaggatgcatcaattctgttcgtggtatccggcctcctgcacgtgtaccagcgcaaaatcggtagccaagaggatacctgtctctttctcactcgtccaggggagatggtgggccaacttgccgttctaaccggcgagcctctaatctttactgtgaaggctaatcgggactgtagttttctttcaatatctaaagcacacttctacgaaattatgcgcaaacaacccactgtggtcctgggagtagctcatactgtggtgaaaagaatgtcctcatttgtgcggcaaattgacttcgccctggattgggttgaggtggaggccggcagagcaatctaccgacagggggataaaagtgattgcacgtacatcatgctgtctggacgcctgaggtctgttattcggaaggatgatggcaaaaaacgtcttgctggtgaatatggaaggggggatttggtcggcgtcgtagagacgctgacacaccaggctagagctacaaccgttcatgccgtgcgagactccgaactggccaagctgcctgctggggcactaacatccattaagcgccgctaccctcaggtggtcacacggctaatccatctgctaggcgagaagatccttggaagcctgcagcagggacccgtgacggggcaccagctggggctgcctacagagggaagtaagtgggacttgggcaaccctgctgtgaatctcagtacagttgccgtgatgccggtgtccgaggaggtgccacttacagccttcgctctggagctggaacacgccctctctgctattgggcctacattgctccttaccagcgataacatcaaacgtaggctcggcagcgcagccctggactccgtgcatgaatacagactgagctcttggttgggccaacaggaagacacacatcgaatcgtgttgtatcaggtggacgggacactcactccttggactcagagatgcgtcagacaggctgactgtatcctgattgtggggttgggggatcaagaaccaactgtgggggaactggagcgaatgttggagtctacggcagtgcgggcacagaaacagctgatcttactccatagagaggaagggccagcaccagccagaaccgtagagtggcttaatatgcggtcctggtgttctggccacctgcacctgtgttgccccagacgtgttttctccaggcgttccctgccaaaactagtcgaaatgtacaagcacgttttccaacggccccctgacaggcattccgatttcagccgtcttgccagagttctgactggcaatgcaattgcattagtgctcggggggggcggagccaggggttgcgctcaggtgggggtcctcaaagccctcgccgagtgcgggattcccgtggatatggtggggggaacctccatcggggcctttgtaggagctctatattccgaggaacggaactactcccagatgcgcatccgtgctaagcagtgggctgaggggatgacgtctcttatgaaggctgctctggacttaacctacccaatcacctcaatgttttcgggcgccggatttaactcgagtattttttctgtatttaaggaccagcagattgaagacctttggattccatacttcgccatcaccaccgacattacggcctccgccatgcgagtccacaccgacggatcactttggtggtatgtacgtgctagcatgtctctctccggctatatgccccctttgtgcgaccccaaggatggccacttgctgatggatggaggatacatcaacaacctaccagctgacgtggcacggtccatgggagctaaggttgtgatagccatcgatgtcgggagccgggatgaaaccgatctgaccaattacggtgacgcactgtctggttggtggctgttatggaagagatggaatccgttagcgaccaaggtcaaggtattaaatatggctgagattcagactaggctggcctacgtgtgctgcgtccgccagctcgaggtcgttaaatcctcggactactgtgaatatcttcggcctcctatagatagttacagcaccttggacttcggtaagttcaatgaaatatgtgaggtcgggtaccagcacgggaggacagttttcgacatttggggccgatctggcgtccttgaaaagatgctccgggaccaacagggaccaagtaaaaaaccggcttcggccgtactgacctgcccaaatgcttcatttaccgatcttgccgagattgtgtcaagaattgagcccgctaaacccgcgatggtggatgacgaatcggactatcaaactgagtatgaagaggagctgctcgatgtgccccgagacgcatatgcggactttcagtcgacgtcggcccagcagggctccgatctggaggatgaatcatccctgcgccatcgccatccctcactcgctttccccaaactgagcgaagggagcagcgatcaggatggttag

SEQ ID NO: 198750 - DNA, 2178 bp, Artificial Sequence
  Description of Artificial Sequence: Synthetic coding sequence
atggtgcggctgcagcgggtgaccttcctggccctgcacaactacctggggctcaccactgagctgttcaacgctgaatcacaggcgattccacttgtctcagtggccagcgtcgcggcgggcaaggccaaaaagcaggtgttttacggagaggaggaaaggctgaaaaaaccacccagactccaggagagctgtgacagcgctgatcacggggggggacggccggccgccgctggtccattgctcaaacgatctcacagcgtaccagccccgtccattcggaagcaaatcctggaggaattggagaagccaggagcaggagatccggatccctcagcaccgcaaggccatcagctaggcctcccgaccgaaggctcgaaatgggaccttggcaaccccgcagtcaacctgtccaccgtcgccgtgatgccagtttctgaggaagtacctctaactgcattcgccctcgaacttgagcatgctctctctgccatcggtccgaccctgctgctgactagtgataatattaagcggaggctcggcagcgctgcactggactcagtccatgaatataggcttagctcatggctgggacagcaggaagacacccaccgcattgtgctttatcaggtagatggcactttaaccccatggactcagcggtgcgtgaggcaggccgactgtatcctcatcgtaggtcttggagaccaggaacctacggttggcgagctcgaacgaatgttggaaagcactgcagtgcgggcccaaaagcagctgatcctgctgcaccgtgaggagggtcccgctcccgcaagaaccgttgaatggttaaacatgcgctcctggtgctctgggcatttgcacttgtgttgcccacgacgggtgttctccaggaggtcccttccaaagctggtagaaatgtacaagcacgttttccagaggccccctgaccggcactctgacttttcccgccttgcacgggtgctcactggcaatgccattgccctggtacttggcggaggaggtgcgagaggctgtgcccaggtgggagttctgaaggcattagccgaatgcggtatacccgtggatatggttggcgggacaagtataggagcgtttgtgggcgccctttactccgaggagcggaactacagtcagatgcgtattcgtgcgaagcaatgggctgaaggcatgacttctttgatgaaggccgccctggacctgacctacccaattacgagtatgttctcaggtgctggcttcaactcatctatattcagcgtgttcaaggaccagcagatcgaggatttgtggatcccttatttcgcaattaccacagacattaccgctagtgctatgcgagtgcacacggacgggtcactatggtggtacgttcgcgcaagtatgagcctctctggatacatgccgcccctgtgcgaccccaaggacggacacttactgatggatggggggtacataaataatctgcccgctgatgtggccaggagcatgggagcaaaggtagtgatagcaattgacgttggcagtcgggatgaaactgacctcaccaactatggtgacgctctgtcggggtggtggctcttgtggaaaagatggaaccccctggccacgaaggtcaaggtgcttaatatggccgagatccaaacacgcctggcctacgtgtgctgcgtccgtcaattagaggtggtgaagtcctcagactattgtgagtacttacgtccgcccatagactcctacagcaccctcgatttcggaaaattcaatgagatttgcgaggtggggtatcagcacggcagaacagtttttgacatatgggggcgcagcggggtgcttgaaaaaatgttgagagaccagcaaggaccatccaaaaagccggcctctgctgtgcttacctgtcccaatgcatctttcaccgatcttgctgagattgtttcccgcatcgagccagccaagccagctatggtcgatgacgagtctgactatcagacagaatatgaagaagaactcctcgatgtgccccgcgacgcatatgcggacttccaatcgacgtccgcccagcaagggagtgatctcgaagatgagtcaagcctgcgtcatcggcacccaagtttagcttttcctaaactgagcgaaggatccagcgatcaggatggttag

SEQ ID NO: 198751 - DNA, 1377 bp, Artificial Sequence
  Description of Artificial Sequence: Synthetic coding sequence
atggaggaggagaaggacgacagcccccaggccgacttctgcctggggactgctctgcatagctggggcctgtggtttacggaggaaggctctccttccaccatgctaacaggcatagcggtgggggccctgctcgccttggctttagtgggtgtgctaatcctgtttatgttccggagattaaggcagttccgccaggctcaacctaccccacaatacagatttaggaagcgagataaagttatgttctacggtagaaagatcatgcggaaggtgactaccctgcccaatactctcgttgagaacaccgccctccctcgacagcgggcccgaaagcggaccaaagtgcttagcttggcaaagaggattctgcgtttcaaaaaagaataccctgctctccagccaaaagaaccaccaccgagccttctcgaagctgacctaacagagtttgacgtgaagaactcacacctccccagcgaggtgctgtacatgctgaagaacgtgcgcgtcctcggtcatttcgaaaaacctctgttcctcgagctgtgtaaacatattgtatttgtccagcttcaggagggggagcatgtgttccagccaagggagccagaccccagtatatgtgtggtgcaggacgggagactggaagtgtgcatacaggacaccgatggcaccgaggtggttgtgaaggaggtgcttgccggggactccgtccattccctgctgtccatcttggacatcataacggggcatgccgcaccatataagacagtatcagtgcgggccgccataccatcaacaatcctgaggctgcccgcagcagcgttccacggtgtgttcgagaaataccctgaaacacttgtgcgagtcgtccagattattatggtgcgacttcaaagagtgacctttttagcactacacaactaccttggattaacaacagagctgtttaacgctgaaagccaggcaatacctctcgtgagcgtcgctagcgtcgcggccgggaaggcgaaaaagcaggtgttttatggtgaggaggagagactcaagaagcctccacgcttgcaagagtcctgtgattcggatcacggagggggcagaccagcagcggctggacctttgctgaagcgttcacactctgtgcccgcccctagcatccggaagcaaatcctggaagaactagagaagcccggagccggagaccccgacccttcagcgccccaggctagagtcttgtgccttttgccacagtgtctaggcggccttccccccacagacaccagcgtctatagttctgcttccagtgattgctgtggttgttcgatgcctgtgttgtgtattatgggccacaagccccacgtgaccgtcgacacttag

SEQ ID NO: 198752 - DNA, 3765 bp, Artificial Sequence
  Description of Artificial Sequence: Synthetic coding sequence
atggaggaggagaaggacgacagcccccagctgaccggcatcgccgtgggcgccctcctagccctcgctttagtgggagttctcattcttttcatgtttaggcggctaagacagttccgacaggcccagcccacccctcaatatcggttcagaaaacgggataaagttatgttttatggcaggaagatcatgaggaaagtcacgacacttcctaacaccctggtggagaatactgccttgccaaggcagagggcccgcaagaggacaaaagtgttaagtctcgcaaagcggattctaagattcaagaaggaatatcctgccttacagcctaaagagcctccgccctccctgctcgaagcagatctcaccgaattcgatgtaaagaatagccatctccccagcgaagtgttatatatgctcaagaatgtacgggtgctgggccacttcgagaagcctctattcctggagctgtgtaagcacatagtcttcgtccaactccaggagggggagcatgttttccagcctcgagagcccgatccaagcatttgtgtcgtgcaggacgggcggttggaggtgtgcatacaggataccgacggcacggaggtcgtcgtgaaggaggttttagcaggggacagcgtccatagcctgctcagcattctcgacataatcaccgggcatgctgctccgtataagaccgtgtctgttcgagccgcaattccatccacaatactcaggcttccagcagcggcctttcacggggtctttgagaaataccctgaaactcttgtgcgggtcgtgcagattattatggtgcgtctccaacgcgttaccttcttagcactgcacaattatctggggttgacaaccgagctctttaacgctgagtcacaagccatacctctggtatcagtcgccagtgttgcagccggcaaagccaagaagcaggtgttttacggggaagaggaacggctgaagaagcctccacggctgcaggagtcgtgcgactcagatcacggcggagggcgcccggcggcagctgggcctctgttgaagcgttcccacagcgtgccggccccctcgatacggaagcagatcctagaagagctcgagaagccaggagccggtgaccccgacccctctgcgcctcagggcggcccggggagtgccacttccgacttaggaatggcgtgcgaccgagcacgtgttttcttgcatagcgacgagcatccgggctcttccgtggccagcaagtcaaggaagtcagtcatggtggccgagatcccctctactgtttcccagcatagcgagtcccacaccgacgagacactggcatccaggaagagtgatgctatctttcgagctgcaaagaaagatctcctgaccttgatgaagctagaggacagttccttactggatggcagagtggcacttctgcacgttcccgctggtaccgtcgtctctaggcagggagatcaggatgcgagcatcctgttcgttgtaagtggactactgcatgtttatcagagaaaaatcggctcacaggaggacacctgtttattccttacacgccccggggagatggtgggtcaacttgccgtactgactggagagccattaatcttcacagtgaaggccaatagagactgtagcttcctgtctataagcaaggcacacttctacgagataatgagaaaacagccgaccgtggtactgggagtggcccacacagtggtgaagcggatgagctccttcgtaagacagatagattttgccctcgattgggtggaagttgaggccgggagagctatctaccgtcagggcgataagtccgactgtacatatatcatgctctcaggtagactccgctctgtgattcggaaggacgacggtaaaaaaagattggccggagaatatggcagaggggatctggtgggtgtcgtggagacactgacccaccaggcaagagctactaccgtgcatgccgtgcgggatagtgagcttgccaagttgccagccggagccctcacgtctattaaacgacgctatccccaagttgtgacccgcctgatccacctgttgggagagaaaatactcgggtcgctgcagcaaggccccgtgaccggacatcagctgggactcccaaccgaggggtctaagtgggatcttggcaatccagcagtgaacctttctaccgtggccgtgatgcccgttagcgaagaggtgcctctgaccgctttcgcactcgaattggagcatgccctctcagctattggccccaccctgctgctgacaagcgataatatcaagagacgccttgggtctgccgctctggactccgttcatgagtatcggttgagttcatggctgggtcagcaggaagacactcacaggatcgtgttataccaggtggatggtaccttgactccttggacccaaaggtgcgtgcggcaagccgattgcatcctgatcgtcggcctgggagatcaggaaccgactgtgggtgagttggaacgcatgctcgagagtactgcggtgagagcccagaaacagctaatcctgttacacagagaggaggggccagctccagctaggaccgtggagtggctgaacatgaggagctggtgcagcggccacctgcatttatgttgccccaggcgcgttttttcccgccggagtctgcctaagctcgtggaaatgtacaagcatgttttccagcgtccccccgataggcatagcgattttagtcgcctggctcgcgtcctaacagggaacgctatcgccctcgtcttaggcgggggcggagctcgcggatgtgcccaggttggagtattgaaggccctggccgaatgtggtattcccgtcgacatggttggcggtaccagtatcggcgccttcgtcggtgctttgtattcagaagaaagaaattatagtcagatgagaataagagccaagcagtgggccgaaggtatgacctcccttatgaaggcagccctggaccttacatacccaattacatcgatgttctccggggcaggcttcaattcaagtatttttagcgtatttaaagatcagcagatagaagatctgtggatcccgtacttcgccattaccacggatattacagcgtcggcaatgcgggtgcatactgatggttctctctggtggtatgtgcgtgcctctatgtctttgtccgggtatatgcccccgttatgtgacccaaaggatggacacctgctgatggatggaggctacataaacaacctgcccgcggacgtggcaaggagcatgggcgccaaggtggtaattgcgatcgacgtcggatccagggacgagaccgaccttacgaactatggcgacgccttaagtggctggtggctgttatggaagcggtggaaccccctagctactaaggtaaaagtgctgaatatggctgagatccagacacgtctcgcctatgtgtgttgtgtccgtcaattggaggtagttaagtcaagcgattactgtgagtatcttcggcccccaatcgactcttacagcacccttgacttcgggaaatttaatgaaatttgcgtgccggatgaaagcgactaccagaccgagtacgaggaggagctcttggacgtgccgagggacgcctacgctgacttccaaagcaccagcgctcagcaggggagcgatttggaagacgagtccagcctgcggcaccgacatccttccctcgcttttccgaaactgagcgaggggtccagcgatcaggatggatag

SEQ ID NO: 198753 - DNA, 2772 bp, Artificial Sequence
  Description of Artificial Sequence: Synthetic coding sequence
atggcctgcgaccgggcccgggtgttcctgcacagcgacgagcaccccggtagcagcgtggcgagcaaatctcgaaaatctgtaatggtcgcagagattcctagcaccgtgagccagcatagtgagtcccacacagacgagaccctggctagccggaaatcggatgcaatcttcagggccgccaagaaagacttgctgacactgatgaagcttgaagatagcagtttgttagatggacgcgtcgcgctgctccatgtgccagcaggcacagttgtcagcagacagggggaccaggacgcctccatactgtttgtcgtgagcgggctccttcacgtttatcagcggaagattggatctcaggaagacacctgcctgtttctgaccaggcccggtgagatggtgggccaacttgctgttctgacgggcgaaccactgatcttcaccgttaaagctaaccgggattgctcctttctcagtatctcaaaagctcacttctatgaaatcatgaggaagcaaccgaccgtagtgttaggtgtggctcatactgtcgtcaagcggatgtcctcctttgtccgacagattgacttcgcgcttgattgggtggaggttgaagccgggagggctatttatcgccagggcgacaaaagcgactgtacttacattatgctcagcggaagattacggtctgtgatccgcaaggatgacgggaaaaaaagacttgcaggagagtatggcaggggcgatttggttggagtcgtcgagacccttacccaccaggcccgcgccaccactgtgcacgccgtgcgcgatagcgaactggctaaattgccagccggagcactgacctcaatcaagcggcgataccctcaagtagtgacgcgcttgattcaccttctgggggagaaaatactgggcagcctgcagcaggggccagtgacgggccatcaactcggactgccaacggaaggcagtaaatgggatctgggaaaccccgccgtcaacctttctacggtggccgtcatgccagtctctgaggaggtgccactgaccgccttcgcactggaattggagcatgccctcagtgccatcgggcctacgctgcttcttactagcgacaacattaagaggcggctgggtagcgctgctctcgacagcgtccacgagtatcgcctcagtagctggttggggcagcaggaagacacacaccggatcgtcctctaccaggtcgacggcacactgactccttggacacaaagatgtgttcgccaggcagactgtattctcattgtaggactcggcgaccaagagccaacagtgggcgagttagagcgcatgttagaatctactgccgtgagggcccagaagcagctcatcttgctacatcgggaggaggggcctgctccagcgagaaccgtcgaatggctgaacatgcgcagctggtgcagcggacatctacatctatgctgtccgaggcgtgtcttttcccgccggagcctcccaaagctcgttgaaatgtacaagcacgtttttcagcgccctccagaccggcattccgacttctccaggttggccagggtccttacggggaacgcaatcgcactcgtgctggggggagggggagcgagagggtgcgcccaggttggcgtgctgaaggccttggctgaatgcggaattccagtggatatggtggggggcactagcatcggggccttcgttggggcactatacagtgaagagagaaattattcacagatgaggatcagagcaaaacaatgggcagaaggcatgaccagcttaatgaaggcagctctggatctgacttaccctattacaagcatgttcagtggcgctggttttaactcatctatcttcagtgtcttcaaagaccagcaaatagaagatttgtggattccttatttcgctattactaccgacatcacggcttccgcgatgcgagtgcatacagatggctcactctggtggtacgtgagggcgtctatgtctctcagtggatacatgcctccactatgcgatccaaaggacgggcatctgctgatggacggagggtacattaataatctccccgctgacgtggctcgatctatgggagctaaggtggtgatagcaatcgacgttgggagtagagacgaaaccgatttaacaaactacggggacgcactgagcggttggtggctgttgtggaaaagatggaacccgcttgctactaaggtgaaagtgcttaacatggctgaaattcaaaccaggctggcttacgtttgttgcgtgaggcaactggaagtggtaaagagcagcgactactgtgaatacctcaggccacctatagatagttacagcactctggacttcggcaaatttaacgaaatatgtgaggtggggtaccagcacggtcgtacagttttcgacatctggggcaggagtggggtgctcgaaaaaatgcttcgcgatcagcagggtccctccaagaagccggcttccgctgttctgacttgtcctaacgccagcttcactgatcttgccgaaatcgtcagccggattgagcccgcaaaacccgctatggtggatgacgagagcgattaccagacagaatacgaggaggaactgctggatgtgcctcgagatgcgtacgctgactttcagtccacatccgctcagcaaggatccgacttggaggatgagagcagtctccgccacaggcaccccagtttagctttccccaagttgagcgaagggtccagtgaccaagatggatag

SEQ ID NO: 198754 - DNA, 4029 bp, Artificial Sequence
  Description of Artificial Sequence: Synthetic coding sequence
atggaggaggagaaggacgacagcccccaggccgacttctgcctgggtaccgctctccatagttggggcctttggttcaccgaggaggggtctccctcaacgatgctgaccggtattgcagtcggggctctcctggctctggcattagtaggcgtcctcatcctttttatgttcagacgcctcaggcagtttcgtcaggctcagcctacaccccagtatcgatttagaaagcgggataaggtaatgttctatggtagaaaaattatgcgaaaggttacgaccctgcccaataccctcgtggagaataccgccctgcctcggcagcgtgccaggaaacgtacaaaggtgctgagtctggcaaagaggattttgagatttaagaaggagtaccccgccctgcaacccaaggagcctccaccctctctgctggaagccgacctgaccgagtttgacgtaaagaacagtcacctcccaagtgaggtcttatacatgcttaagaatgtaagggttctggggcacttcgagaaacccctcttcctggagctctgcaagcatattgtgtttgtgcagcttcaggaaggggagcatgttttccagccacgcgaacccgacccaagtatttgtgtggtgcaggatggccgcctggaggtttgcatccaggataccgatggcaccgaagtagtggtcaaggaggtccttgccggtgactcagtccacagcctcctttccattctcgacatcattactgggcacgctgctccctataagacagtgtccgttcgggccgctatcccatccaccatcctgcgtctccccgccgcggcgttccacggtgtgttcgagaagtacccagagacactggtgcgcgtggtccagattatcatggtgaggctgcagcgcgtgacctttctcgctctgcacaactatctgggccttaccacggaactctttaacgcagagagccaggccattccgctcgtgtcagtcgcgtctgtagctgcgggcaaagcaaagaagcaagtgttttacggcgaagaggaaaggcttaagaagccgccgaggctccaagagtcttgtgattccgaccatgggggcgggcggccagcggcggctgggccactccttaagcgtagtcacagcgttccagcaccttctatccgaaaacaaatactcgaagaactcgagaagccaggcgccggcgaccccgacccgtctgcccctcagggaggcccaggatcagccacaagtgatttaggaatggcctgtgaccgagcccgggtgttcctacattctgatgaacaccccggaagctccgttgcaagcaaaagtagaaaaagcgtgatggtggccgaaatcccgtccactgtgtcccagcactcagaatcacatactgacgaaaccctggcctcacggaagtctgacgcaatcttcagagctgccaagaaagatctgttgacattgatgaaattggaggatagtagtcttctggacggccgagtcgccctgttacatgtgcccgccgggaccgtggtcagccggcagggcgaccaggacgccagcatactcttcgttgtgtctggtctgcttcacgtgtaccaaagaaagatcggaagccaggaggacacctgcctcttcctcaccaggcctggcgaaatggtcggtcagttggctgtgctcaccggcgagcccttgattttcacagtgaaagctaacagagactgctctttcttgagcatcagcaaggcccatttttacgagattatgcggaaacagccaacggtggtgttgggggtggcccatactgtggttaaaaggatgtcctctttcgtgcggcagattgattttgctttggattgggtggaagtggaggcagggagggctatttacaggcagggggacaagtccgattgcacatatataatgctcagtgggcgcttgagatcggtgatacgaaaagacgacgggaagaaacggttggcgggcgagtacgggcgaggcgacctcgtgggtgtagtggagactctaactcaccaggctagagcgaccaccgtgcacgcagtaagggatagtgagctggcaaagctccccgccggtgctctgacgtcaattaagcggagataccctcaggtagttacaagactgatccatctgctgggcgagaaaatacttgggtccctgcaacagggcccagtcacgggccatcagttgggcctgcctaccgagggcagtaagtgggatctgggaaaccccgcagtcaacctgagtaccgtcgcggtgatgcctgtctcagaggaggtgcctctcaccgcattcgccttggagctggagcacgcactgagtgccatcggccctactctgctgctcacctctgacaatattaaacgccgactaggaagcgcagcacttgacagtgttcacgagtatcgactgagcagctggttaggtcaacaggaggacacccatcgaattgtactgtaccaggtggacggcacgctcaccccctggacacaaaggtgtgtaagacaggccgactgtatcctgatagtgggactaggggaccaagagccgaccgtaggcgaactcgagaggatgttggaatctaccgctgttcgtgctcagaaacaactgattctgctccatcgggaggagggccctgcccccgcccggactgtggaatggctgaatatgagatcttggtgttctggccacttacacctctgctgtccacgcagagtgttctcccggcgttccctgccaaaattagtggagatgtataagcatgtgttccagcgccccccggatcggcatagtgacttttccagactggctcgggtgcttacaggtaatgccattgcactcgttctgggaggtggtggagcccgagggtgtgcccaggtgggcgtcctgaaggcccttgcggagtgcggcatcccagtagacatggtgggtggaacctccattggggccttcgtgggcgcactgtacagcgaggagcgaaactactcccaaatgagaattagggcgaaacagtgggccgaagggatgacgtcgctgatgaaggctgccctcgatctgacatatcccatcacatccatgtttagtggagccgggtttaatagttccatcttttcagtatttaaggatcaacagatagaggacctctggatcccttactttgcgattaccactgacatcaccgcatctgccatgagagtgcataccgacggctcactgtggtggtatgtgcgggcatctatgagcctgtcagggtatatgcctcccttgtgtgatcccaaagatggccacctgctgatggacgggggatacattaacaacctccccgctgatgtagccaggagtatgggggccaaagttgttatagcgatagatgttggatcacgggatgaaactgacttgaccaattacggtgacgctctctctggttggtggttattgtggaagcgatggaacccgctggccaccaaggttaaagtactgaatatggcagagattcagactaggctagcgtacgtttgctgtgtaaggcagcttgaggtcgtgaagtcttctgactactgcgaatatctgagacctccaattgatagctacagcacactcgactttggcaagttcaatgaaatttgcgaagtggggtatcaacacggacgcacagtgtttgacatttggggaaggagtggcgtgctcgagaagatgctccgcgatcagcaaggtccctctaaaaagccggcctcagctgtactgacctgtcccaatgccagcttcactgacttagccgaaattgtctcccgtatcgagcctgcgaagccagcaatggtcgacgatgagagcgactaccagactgagtacgaagaggagctgctagacgtgcccagggacgcttatgccgatttccagtcaacaagcgcccagcaggggtcagacctcgaggacgaaagctctctgagacaccgtcatccttctctcgcgtttccgaaactgagcgagggctcctcggaccaagatggctag

SEQ ID NO: 198755 - DNA, 3846 bp, Artificial Sequence
  Description of Artificial Sequence: Synthetic coding sequence
atgctgaccggcatcgccgtgggcgccctgctggccctggccctggtgggggtgcttatactgtttatgttcaggagactccgccagttcagacaggcccagccgaccccccagtaccgattccgtaagcgagataaagttatgttctatggcaggaagattatgcgcaaggtgacgaccttgccaaacacacttgttgagaacacggccttgcccagacagcgggccaggaaacggaccaaagttttgtcactggccaagcggatcctgagattcaaaaaagaatatccagcactacaacccaaagagccccccccgtccctgctggaagccgacttaaccgagtttgacgttaagaacagccacctgccatccgaagtgctgtatatgcttaagaatgtacgggtcctcggtcatttcgagaagccgctgttcttggagctgtgtaagcatatcgtctttgttcaacttcaggagggggaacacgtctttcagcccagagagccagaccctagcatctgtgttgttcaggatggccgcctggaggtgtgtatccaggacaccgacggaactgaagtggtcgtaaaagaagttctggccggagactcggttcatagtctcctcagcatccttgatattattacaggacatgccgccccgtacaagacagtgagcgtgcgggccgcaatccccagcacaatcctacgactgccagccgccgccttccatggggttttcgagaagtatccagaaacccttgtgagggtcgttcagatcatcatggtacgcctgcagcgtgttaccttcctcgctctacacaactatttgggtctgactactgagctgttcaatgccgagagtcaggcaatccccctggtgtccgtggctagcgtggcggccgggaaggctaagaagcaggtgttttacggggaggaagagcgactgaaaaaaccgccaaggctgcaggaatcttgtgattcagatcatggcggggggagacccgccgccgccggtcccctcctaaagcgttcccattctgtgcctgccccatcaatacggaaacaaattttggaggagctcgaaaagcccggcgccggagacccagacccctcggcccctcaaggaggccctggctccgccacaagcgacctaggcatggcctgcgacagggctcgagtgtttctgcatagcgatgaacatccaggcagctcagtcgcttccaagtctcgcaaatctgtcatggtcgctgaaattcccagcacagtgagccagcactctgagtctcatacagatgagaccctggcctccaggaaatccgacgccatctttcgcgctgccaagaaagaccttttaactctgatgaaactggaggatagcagtctgctggacgggagggtcgcgctccttcatgtgcccgcaggaaccgtcgtgtcacggcaaggtgaccaggacgccagtattctctttgtggtttcaggcctgctgcatgtgtatcagcggaaaatcggttcccaagaggacacttgtctgttcctaacccgccccggagaaatggtgggccaactcgccgtgctgaccggcgaaccactgatctttacagtcaaagccaaccgggattgctcctttctgagcatctccaaagcacatttttacgaaattatgcgtaagcagcctaccgtcgtgctcggtgtcgcccacacggttgttaagagaatgtctagctttgttcgacagatcgacttcgctttggactgggtggaggttgaagcaggtagggccatctacagacagggcgataagagtgactgtacttacattatgctttcaggcaggctgcgatcagtaatcagaaaggacgacgggaagaagcgtctcgccggggagtacggacgtggtgacctggtgggcgtcgtcgaaacgctcacgcaccaggctcgagccaccaccgtccacgctgttagggattccgaactggccaagcttcctgcaggagcccttacgtctatcaaaagaaggtatccccaggtcgttactagattgatccacttgttgggagaaaagattctgggctcattgcagcagggccctgtgaccggtcaccaactgggcctcccgaccgagggtagcaagtgggaccttgggaatccggccgtgaatctgagcaccgttgcagtgatgcccgtgagtgaagaggtacctttaactgctttcgctctcgagctcgagcatgccctgagtgcgatcggaccgacactgctcctgaccagcgacaacattaaacgtaggctcggctcagccgcactcgacagcgttcacgaataccgactgtcctcctggctgggacaacaggaagacacccaccgaatcgtcctgtatcaggtcgatggaactttgactccgtggacccagcgatgcgtgagacaggcagattgcatcctgattgttggactcggggatcaagaacctacggtgggggagttggaacggatgctagagtctaccgccgtacgggctcagaagcaactgattctcctgcaccgggaggaaggccccgcacccgctcggacagtcgaatggctgaacatgcgctcctggtgctctggccacctgcacctttgctgtcccaggcgcgtattcagccgacgctcactgcctaagttggtagagatgtacaagcacgtgtttcaacggcctcccgaccgccactctgacttttcacgactcgcacgtgtgttgaccggcaacgctatcgccctagtgctgggtggcgggggcgctagaggctgtgcacaggtgggtgtattgaaggccctggccgagtgtgggatccctgtcgatatggtcggaggaacctccatcggagcatttgtgggcgccttgtatagcgaggaaagaaactacagccagatgagaataagagccaaacagtgggccgagggaatgaccagtttgatgaaagctgccttggacttaacgtacccgatcacatcaatgttttcaggcgccggatttaatagttctatttttagcgtcttcaaggatcaacagatcgaagacttgtggatcccttatttcgctatcacaactgacattacagcctctgcaatgcgcgtacatactgacggcagcctgtggtggtatgtccgcgcttctatgagcctgtccggatatatgccacccttgtgtgatcccaaggacggccatttgctcatggacggaggttatatcaataatctgccagctgacgttgcacgcagcatgggtgctaaagtcgttatcgctatcgacgtcgggtcacgcgatgagaccgacctgacaaattacggcgacgcattgtcgggctggtggctactgtggaagcgttggaacccgctggccactaaggttaaggttttgaatatggcggagatacagaccaggttggcttatgtctgctgtgtgagacagctcgaagtcgtcaagagtagcgattattgcgagtatctgagaccgccaatcgattcttacagtaccctggacttcggaaaatttaacgaaatttgcgaagtgggctaccagcatgggcgcactgtttttgacatctggggccggtccggcgttctggagaagatgcttagggaccagcagggcccttccaaaaagccagctagcgccgtattaacctgtccaaacgccagtttcaccgatttggccgagattgtctcacgcatcgagccggctaagcctgctatggtggacgatgaatcagactatcaaacagagtacgaggaggaactcctcgatgtgccccgcgacgcctatgccgactttcaaagcacatctgcccagcaaggcagcgacttgtag

SEQ ID NO: 198756 - DNA, 2349 bp, Artificial Sequence
  Description of Artificial Sequence: Synthetic coding sequence
atgagcatcaacctgaccgtggacatctacatctacctgctgagcaacgcacgcagtgtgtgtgggaaacaaaggtccaagcagctgtacttcttattcagccccaagcattactggcgcatcagccatatatcactccagcgggggttccacacaaacattatccgctgcaagtggacaaaatcagaggctcacagctgtagtaaacattgttacagcccatccaaccatggacttcacattggcattttaaagctgtccacatcagctccaaagggactaacgaaggtgaacatttgtatgagcagaattaaaagcactctgaatagcgtctccaaggctgtgtttgggaaccagaatgagatgatcagccggctggcccagtttaaaccaagtagccagatcctgcggaaagtcagcgattctggctggctgaagcaaaagaacatcaaacaggcaattaagtccttaaaaaagtattccgataagagcgctgagaaaagtccctttccagaagaaaaatcccatattatcgacaaagaggaggacataggaaaacggtccctgtttcactatactagctcaataaccaccaagttcggcgatagcttttactttttgtccaatcatatcaacagttattttaagcggaaggagaagatgagtcaacagaaagagaatgaacacttccgggataagtccgaacttgaggacaagaaagtagaagagggcaagttacggtctccggatccaggtatactcgcctataagcctggctcagagtcggtccacacagtggacaaacctacaagcccaagcgcaatccccgacgtgctgcaggtttctaccaaacagagtattgccaattttttgagtcgcccaacggaaggcgttcaggcgctcgtcgggggctatatcggtggactggttcctaagctcaaatacgatagcaaaagccaatcagaagaacaagaagaacctgcgaagactgaccaggcggtcagtaaagataggaatgctgaggaaaaaaagaggctgtccctccagcgggagaagatcatcgcccgcgtgtccatcgacaataggaccagggctttagttcaagccctcagaaggaccacagatccaaaattgtgcataactagagtcgaagagcttacttttcatttgcttgagttcccagaaggcaagggtgtagccgtgaaggagcgcattatcccttacctactgaggctcagacagatcaaagatgagactctacaggcagccgtgagggagattctggcactcattgggtatgtggatccggttaagggtcgagggatccggatcctgtcaattgatggtggaggcacgagaggcgtggtagccttgcagactctacggaagttggtggaacttacacagaagcccgtgcaccaactgttcgactacatatgcggagttagtaccggtgctatactggccttcatgctggggctatttcacatgcctctggacgagtgtgaagagctctacaggaaattaggaagcgatgtgttctcccagaatgtgattgtcggcactgtgaaaatgagctggagtcacgctttctacgattcccagacatgggagaatatcctgaaagaccggatgggcagtgcactgatgatcgaaaccgcccgcaatccaacttgcccgaaagtggcagccgtgagtacaatcgttaatagaggaataactcccaaagcattcgtatttagaaactatggccacttccccggcataaattctcactaccttggagggtgccagtataaaatgtggcaagcaatacgggcaagtagtgctgcgcctggctactttgcagagtatgcccttggaaacgacctgcatcaagacggtggcctcctgcttaacaaccccagcgccctggccatgcacgaatgtaagtgcctttggcctgatgtccccctggaatgcatcgtctccctgggaacagggcgatatgaatccgatgtgaggaatacagtaacctataccagcctgaagaccaagctttcaaatgtgattaacagtgccacagataccgaggaagtccacatcatgctggacggtctgctgccaccagacacttatttcaggttcaatcccgttatgtgtgagaatatccctttagacgagagccggaacgagaagctggaccagctacagttggaaggactgaagtacatcgagcggaacgagcagaaaatgaagaaggtagctaagatcctaagccaggaaaagactaccctccagaaaattaatgactggatcaagctgaaaacagatatgtacgagggcctgcctttcttctccaaactttag

SEQ ID NO: 198757 - DNA, 2163 bp, Artificial Sequence
  Description of Artificial Sequence: Synthetic coding sequence
atgagcatcaacctgaccgtggacatctacatctacctgctgagcaatgcgcgaagtgtttgcgggaagcagcgcagtaagcagctttacttcttgttcagtcccaagcactactggagaattagccatatctcactgcagaggggtttccataccaacatcatcagatgcaagtggactaaaagcgaagcgcactcgtgtagcaaacattgctactccccttcaaatcatggtctgcacatagggattctcaaactgtccacatccgcccccaaggggttgacaaaagttaacatctgcatgtctcgaataaagagcacgctcaatagcgtgagtaaggctgttttcggaaatcagaacgagatgattagcaggctcgcccaatttaagccctcgagtcagatcctcagaaaagtgagcgacagtgggtggctgaaacaaaaaaacatcaagcaggccattaaatcactgaaaaagtacagcgataagtctgctgagaagtctcctttccctgaggagaagtcacacattatcgataaagaggaggatattgggaaacggtcactctttcactatacgagtagtatcaccacaaaattcggtgatagtttttattttctttccaatcacattaattcttactttaagaggaaggaaaagatgtcccaacagaaagaaaacgagcattttcgggacaaaagcgaactcgaggacaagaaggtcgaggagggcaaactgagatcgcccgatcccggcatcctggcctacaaacctggtagcgaatccgttcacactgttgacaagccaacctcaccgtcagccatccccgacgtgctgcaggtctccacaaagcagtcaattgccaatttcttatcccggcctacggagggcgtacaggccctggtcggtgggtatataggtggacttgtgcctaaattaaagtacgatagcaagtctcagtctgaggaacaggaagagcccgctaagactgaccaagccgtaagcaaagatcgcaacgccgaagaaaagaagaggctctctctccagagggagaaaatcatcgcccgcgtcagcatagataaccgcacccgggccctggtccaggccctccggcgaactactgatccaaaactctgcataacccgagtggaggagctcacttttcatttgctggaattcccagagggcaaaggagtggctgtgaaggaacggattataccctatctgctccgcctgcgccagatcaaagatgagactttgcaggctgctgtgagagaaatcctggcgttaattggctacgttgatccggtgaaaggacgaggaatacggatcttatctattgatggcggcgggactcggggtgtagtggcattacagaccttacggaagttagttgaactgacacaaaaacccgtacatcagcttttcgattacatctgcggggtgagtacaggcgcgattctggcattcatgctgggcctttttcatatgcccctggatgagtgtgaagagttgtatcgaaaactcggcagcgatgtcttctcccagaacgtgattgtgggaaccgtgaagatgtcctggtcacacgccttttacgacagccaaacctgggaaaacattcttaaggatcgcatgggcagcgctctgatgatcgagactgcaagaaaccccacatgccctaaagttcggaaagacggtggtcttctcctgaataatcccagcgccctggctatgcacgaatgcaaatgcctgtggcccgatgtgcctcttgagtgtatcgtttccttgggaacaggacgctacgaatcagacgtgcgcaacacggttacgtacaccagcttaaaaacgaaattaagcaatgtgattaactcagccaccgacaccgaggaggtccatattatgttggacgggctgttaccacccgacacttactttcggttcaatcccgtgatgtgcgaaaacattccgctcgatgagtctaggaatgagaaactggatcagctccagctagaaggcctaaagtatatagaaaggaacgagcagaaaatgaaaaaggttgccaaaattctgtcgcaagaaaaaaccacactccagaaaatcaacgactggatcaagttgaaaaccgacatgtacgagggtttacccttcttctcaaagctgtag

SEQ ID NO: 198758 - DNA, 168 bp, Artificial Sequence
  Description of Artificial Sequence: Synthetic coding sequence
atgagcatcaacctgaccgtggacatctacatctacctgctgagcaacgcgcggagtgtctgtggcaagcagcgctccaagcagttgtacttcctcttctcgccaaaacactattggcgcatctctcatatctctctccaacgtggctttcatactaatatcatctag

SEQ ID NO: 198759 - DNA, 2349 bp, Artificial Sequence
  Description of Artificial Sequence: Synthetic coding sequence
atgagcatcaacctgaccgtggacatctacatctacctgctgagcaatgcacgaagcgtgtgtgggaagcaacgcagtaagcagctgtatttcctattctcaccgaagcactactggagaatcagccatatttcattgcagcgcgggtttcacactaatatcatcaggtgcaagtggacaaagtccgaagcacactcgtgctcaaaacattgttattctccgagtaatcatggtctccatattgggatcctcaaactgtccacatcggccccaaaaggcctaaccaaagtgaacatctgtatgtcccggatcaaatcaactctcaactccgtcagcaaggcagtgttcggcaaccagaatgaaatgatatcaagacttgcacagttcaaaccctccagtcagatcctgaggaaggtttccgacagcggctggttaaaacagaaaaatattaagcaggccatcaagagcttgaagaaatatagtgataaatccgcggagaaaagcccgttccctgaagagaagtcccacatcatcgacaaggaggaggatattggtaagcgatcactgtttcattataccagttcaattaccaccaaattcggcgacagtttttactttttgagcaatcatatcaattcatattttaagcgcaaggaaaagatgagccagcagaaggaaaacgaacacttcagggataaatctgaactcgaagataagaaagtggaggaaggaaagctgagatcaccagaccctggcatcctggcttataagccagggtctgagtctgtccatactgtcgacaagcccacatccccctccgcgatacccgacgttctccaggtttcaacaaagcagtcaatcgcaaacttcttgtcgagaccaacggagggcgttcaggccctggtaggcggttatattggtggcctggtgcctaaactgaaatacgatagcaaaagccagagcgaggaacaggaggagccagccaaaacagaccaagctgtaagtaaagaccgcaacgcagaagaaaaaaagcggctcagcttgcaaagagagaaaatcatcgcgagggtgagcatcgacaaccgtacccgcgccctggtccaggccctgaggaggactacagaccctaaattatgtatcacaagggttgaggagctgacattccatctgttggaattcccagaaggaaagggcgtggcagtgaaggagagaattatcccttaccttcttcgattgcggcagatcaaggatgaaaccctccaggctgcagtgcgggagatcctggccctcattggctacgtcgacccagtgaagggccgcgggataagaatcctttccatagacggcggcggcactagaggagtcgtagctctgcaaaccctgcgcaaacttgtggaactgacccagaagcccgtccaccaactgttcgactacatctgtggggtgagcactggcgcaattcttgccttcatgctgggcctgtttcacatgccgttagacgagtgcgaggagctctaccgcaaacttgggagtgatgtgttctcacaaaacgttatcgtaggaaccgtgaaaatgtcgtggagccacgccttttacgactcacagacatgggaaaacattttgaaggatcggatgggatcggctctcatgatcgagaccgcccgcaatcccacctgcccaaaggtggccgctgtttcaaccatagtgaacagaggaatcaccccaaaggcattcgttttccgtaattatggccactttccaggtattaactctcattacctggggggctgccagtacaaaatgtggcaggcaatcagagccagtagtgctgcaccaggttactttgccgagtacgcactggggaatgacctgcaccaggacggcgggctgcttctcaacaatccaagcgcactagcgatgcacgaatgtaagtgcctgtggccggacgtgcccctggaatgcatcgtgagtctcgggacagggcgctatgagtcagatgtgcgaaacacagtgacctatacgtcattgaagaccaagctgagtaacgtgattaactccgcaaccgacactgaggaggtacacatcatgctggacggcctgctgccccctgatacttattttcgattcaatcccgttatgtgtgagaacatccccctcgacgaatctagaaatgagaagctggatcagctgcagctcgaaggactgaagtatattgagagaaacgaacaaaagatgaaaaaagtggcaaagatccttagccaagaaaagacaacattacagaagatcaatgactggatcaagctgaagacagatatgtacgaaggactgccctttttttccaagctctag

SEQ ID NO: 198760 - DNA, 582 bp, Artificial Sequence
  Description of Artificial Sequence: Synthetic coding sequence
atgagcatcaacctgaccgtggacatctacatctacctgctgagcaatgctaggagcgtttgcggcaaacagcgcagtaaacaattatactttcttttttccccgaagcattactggcgcatttcacacatctccttacagcggggattccatactaacattatccgctgcaagtggacaaaatccgaagcacatagctgctccaagcattgctacagtccgagtaaccacggccttcacatcggcattctgaagttgagcactagcgctcccaaaggactcactaaggtcaatatatgtatgagtagaatcaaaagcaccttgaatagcgtgtcaaaagccgtattcggaaaccaaaacgagatgatcagtaggctggcgcagtttaaaccctcctctcaaattctgcgaaaggtatctgacagtggatggctcaagcagaagaacataaagcaagcaatcaagtctctgaaaaagtattccgacaagtccgccgagaaaagccccttcccggaagaaaagtcccacattatcgacaaagaggaggatatcggtaaacgcagtctttttcattatacctag

SEQ ID NO: 198761 - DNA, 2349 bp, Artificial Sequence
  Description of Artificial Sequence: Synthetic coding sequence
atgagcatcaacctgaccgtggacatctacatctacctgctgagcaatgctcgtagcgtatgtggcaaacagcggtctaaacaactctactttctgttcagcccaaagcactactggcggatatctcatatatcgctacagcgaggcttccacaccaatattattcggtgtaagtggactaaatctgaggcccacagctgctccaagcactgttattccccctctaaccatggcttgcacatcggaatccttaaactgagcacctccgcaccaaagggcctcacaaaggtaaatatctgcatgtcgcgcataaagtctacactgaattcagtgtccaaggccgtattcggcaaccagaacgaaatgatttctcgactcgcccagtttaagccctctagccagattcttaggaaggttagtgattccggatggttgaagcaaaagaacatcaaacaggcaattaagtccctaaagaaatattctgacaaatccgcggagaagtcccccttccccgaggagaagtcgcacatcatcgacaaagaggaagatatcggaaagcgctctctctttcactacacctccagtatcacaactaagttcggggactccttctatttcctgagtaaccatatcaattcctatttcaagcggaaagaaaaaatgtcccagcaaaaggagaatgagcattttcgcgataagagcgaactggaagacaagaaggtggaggagggaaagctccgcagcccggaccccggtattttagcctataagccgggttccgaatctgttcacaccgtggataagcctaccagcccttcagcgatccctgatgtgctgcaagttagcactaagcagagtatcgcaaacttcttaagccgccctacagaaggggtacaggccctggttggaggttacataggagggctcgttccaaagttaaagtacgattcaaagtcacagagtgaagagcaggaagagccggccaaaaccgaccaggccgtgagcaaggaccgcaacgctgaagagaagaagaggctttccctccagcgggagaagattatagcgagggtgagtatagataaccgcacacgtgccttagtccaagccctgcggcgtacaactgacccgaagctctgcatcactagagtcgaggaactgacttttcatctcttggaatttcctgagggcaaaggagttgctgtaaaggagcgtatcataccctatctgttgaggctgaggcaaatcaaggatgagaccctccaggctgcagtccgagagatactcgctctgatcggatacgtcgaccccgtgaaaggacgtgggatcagaatactgagtatagacggtggcggtacgaggggcgtggttgctctccagactttacggaagttggtagaactgacacaaaaacccgtccaccagttgtttgattacatatgcggtgtctcaacaggggcaattctggcatttatgctgggactgttccacatgcccctggacgagtgtgaagagctttacagaaagctgggaagcgatgtattttcacaaaatgtgattgtgggcacggtgaagatgtcctggagccacgctttttatgacagccagacatgggagaacatcctgaaagataggatggggtcagctctgatgatcgagactgcacgaaaccctacctgtcctaaggtggcagccgtcagcaccatcgttaaccgggggataacacccaaagcattcgtgtttcgaaattatggacattttccaggaatcaactcgcactatctgggcggatgccagtataagatgtggcaagccattagagccagtagtgccgctcctggttatttcgccgaatatgccctggggaatgatctgcaccaggatggtggcttacttctcaacaacccgagcgctctggcgatgcatgaatgtaagtgcttgtggcccgatgtgcctctggaatgtatagtgagcttgggaactggacggtacgagtctgacgtcaggaatacggtgacatacacgagcctaaagaccaagctctcaaacgtgatcaacagcgctacagataccgaagaggttcacatcatgctggatggccttctgccccctgacacatattttaggttcaacccagtgatgtgtgaaaatattcccctagacgagtcccggaatgagaaattggatcagctccagctcgagggacttaaatacatcgaacggaatgaacaaaagatgaaaaaagtggcaaaaatcttgtcccaggagaagaccacacttcagaagattaatgactggattaaactcaagactgacatgtatgaggggctgcctttctttagcaagttgtag

SEQ ID NO: 198762 - DNA, 2154 bp, Artificial Sequence
  Description of Artificial Sequence: Synthetic coding sequence
atgagcatcaacctgaccgtggacatctacatctacctgctgagcaacgccaggagcgtgtgtgggaagcagcggtcgaaacagctgtactttctgttttccccgaaacactactggcggatctcccatatctctctgcagcgcggatttcacacaaacattattcggtgtaaatggacgaaaagcgaggcccactcttgttcgaagcattgctattctcctagcaatcatggccttcacatcggcattctgaagctttcaaccagcgccccaaaaggcctgacaaaggtgaacatttgcatgtctaggattaaatctaccctgaacagcgtgtctaaggcggttttcgggaaccagaacgagatgatatcacgcttggcccagttcaaaccgtcaagccaaatcctgcgtaaggtcagtgacagcggctggctgaaacaaaaaaacataaagcaagctataaaaagtctcaagaaatacagcgacaagtccgccgagaagagtccgttccccgaggaaaaatcacatatcattgataaggaagaagatatcggaaagcgcagtttgtttcattacacctctagtatcaccactaagtttggggatagtttttatttcctgagcaaccatatcaactcctatttcaaacgcaaagagaagatgagtcagcagaaggagaatgagcacttccgggacaaatctgagctcgaggacaaaaaggtggaagaaggaaaactgcgatctcctgaccctgggattctggcctacaaaccgggcagtgagtccgtgcacacagtggataagcctaccagcccttctgccatcccggatgtgctgcaagttagtaccaaacaatcgattgcgaacttcctctcgaggcccaccgagggggtacaagctctggttggcggctatatcggaggcctggttcctaagttaaagtacgactccaagtcccagtccgaagagcaggaagagcctgcaaaaaccgaccaagccgtatctaaagataggaacgccgaagagaaaaagcggctgtctctgcagagggagaagattattgcccgagtctccatcgacaaccggaccagagcgcttgtgcaagctttgcgaagaacaacagacccgaagctgtgtatcacacgcgtggaagagctgaccttccacctacttgagttccccgagggaaagggagtggcagtgaaggagagaattataccttacttgctgaggttgagacagatcaaagatgagacactccaggcagcggtcagagagatcctcgccttaattgggtacgtggatcctgtcaaaggcaggggcatacgaatactcagcattgacggcggcggaacaaggggggtggtggcccttcagacgctcaggaagctggtggagcttacccagaagcccgtgcaccaactgtttgattatatttgtggcgttagtacgggggccatcctggcttttatgctggggctgtttcacatgcctctggatgagtgtgaagaactgtatagaaagctggggtcagatgtgttctcccagaacgtcattgtggggacagtgaaaatgtcatggagccatgcattttacgacagccagacttgggaaaatatcctgaaagatagaatgggcagtgcactcatgattgaaaccgcgaggaaccctacctgtcctaaggatgggggcttgttgctgaacaatccgtccgcccttgccatgcatgagtgcaagtgtctttggccagatgttccactggaatgtattgtgagcctgggaactggcagatatgagtccgatgttcgtaatacggtaacctatacaagtctgaaaacaaagctgtcaaacgtaattaattctgcgactgacacggaagaagttcacataatgctggacggcctgctgccccccgacacatattttcggtttaatcctgtgatgtgcgagaacattcccctcgacgaatccaggaacgaaaagctggaccaacttcagcttgagggtctgaagtatatcgagagaaatgagcaaaagatgaaaaaagtcgcaaaaattctttcccaggaaaaaacgaccctgcagaagatcaacgactggattaagctaaagaccgatatgtatgaagggttaccgtttttcagtaaattatag

SEQ ID NO: 198763 - DNA, 2049 bp, Artificial Sequence
  Description of Artificial Sequence: Synthetic coding sequence
atgagccggatcaagagcaccctgaacagcgtgagcaaggccgtgtttggcaaccagaatgaaatgataagtcggctcgcccagttcaagccttcttcccagatcctgaggaaagtatccgacagtggttggctgaaacagaaaaatatcaagcaggccatcaagtctctcaagaaatatagcgataaatccgcagagaaatcaccgttcccggaggagaagtcacatataatcgacaaggaagaggacattgggaagagaagcctgtttcactacacctcttctataactaccaaatttggcgattctttttatttcctctcaaaccacattaactcttacttcaagcgcaaggaaaagatgagtcagcagaaagaaaatgagcacttcagagacaaaagcgagttggaagataagaaagtggaagaggggaagctcaggtctcctgaccctggaattctagcttacaagcctggtagtgaaagcgtgcacactgtggacaagcccacatcaccatctgcaattccggatgtgcttcaagtgagtactaagcagagcatagccaatttcctcagtagaccaactgaaggtgttcaagctctagtcggaggctatattggtggtctcgtccccaagctcaaatatgattctaaatcacaatctgaggaacaggaagagccggcaaaaacagaccaagccgtaagtaaggaccgcaacgccgaggaaaagaagcggctcagtttgcagcgggaaaagatcatagcacgggtgtcaattgacaaccgcacccgagctctcgtccaggccctcagaagaactaccgatccaaagctgtgcatcacaagagtcgaagagctcaccttccaccttctggaattccctgaaggcaaaggggtggctgttaaggaacgcattataccgtatcttctgcgtctgcgacagattaaagatgagacactccaggcggcagtgcgagaaatcctggccttgatcggttacgtcgatcctgtgaagggtagagggatcagaattctgtccattgacggcgggggtactagaggggtggtagccttgcagacgctcagaaaactcgtggagctaactcagaagcctgtccatcagttgttcgattatatctgtggggtctctacaggagcgatcctggctttcatgctgggtctctttcatatgccccttgatgaatgcgaagaactgtatcgcaaactgggaagtgacgtgttctctcagaacgtcatcgttggaacagtgaaaatgagctggtcccacgctttctacgactcacagacttgggagaatattctgaaagaccgtatgggctctgctctcatgatagagactgctcgcaatccaacctgccctaaagtggctgcggtaagcacaatcgtaaacagaggaattacccccaaagcctttgtgtttagaaattacggacactttcctggaataaacagccactatctgggaggctgccagtacaagatgtggcaggctatcagagcaagctccgctgccccaggctacttcgcagaatatgcactgggcaacgacttgcaccaagatggcggcctcctgctgaacaatccatccgcgctcgccatgcacgagtgcaagtgtctttggccagatgtgcccctcgagtgcatcgtatctctcggtacgggtcgatatgaatctgacgtccgtaacactgttacatatacctcgctgaagacaaagctgtctaatgtgattaactcagcaaccgacactgaagaagtccacattatgttagacggtctgttaccccccgacacctattttaggttcaatcccgtgatgtgcgagaacatccctttagatgaatcccggaatgagaaactggaccagctgcagctagaaggcttaaaatatatcgagcggaacgaacagaaaatgaagaaggtggccaagatattatcacaggaaaagactacactgcagaaaattaatgattggatcaaactgaaaacagatatgtacgaagggctgcctttctttagcaaattgtag

SEQ ID NO: 198764 - DNA, 3612 bp, Artificial Sequence
  Description of Artificial Sequence: Synthetic coding sequence
atgacccggagcccccccctgcgggagctgccccccagctacacccctccggccagaaccgctgctcctcagatcctggctgggtccttaaaggcaccattatggcttagggcatactttcaggggctgctgttcagtttggggtgtggcattcagcgtcattgtggtaaggttctatttttgggcctgctggcatttggggccctcgcattgggcctgcgcatggcgatcatagaaaccaatttggaacagctgtgggtcgaggtcgggagtagagtctcacaggaactgcattatactaaggagaagctgggggaggaggcggcctacacgtctcagatgctgatccagaccgctcggcaggagggcgaaaacatcttgacccctgaagccttaggtctgcacctgcaggctgctctcacggctagcaaggtgcaggtgtcgctctacgggaagtcttgggatctgaataagatctgttataagtccggcgtcccactcattgagaatggcatgattgagaggatgattgaaaaactgttcccatgcgtcatcctgaccccgcttgactgtttctgggaaggagcaaagctgcagggagggagcgcctacttgcccggtaggccggacatccagtggacgaacctggaccctgagcagctcctggaggaattggggccctttgcatccttggagggcttccgagaactcttagataaagctcaggttggccaggcatatgtgggaagaccatgtttgcacccagatgatctccattgccccccgtccgctccgaaccatcactccagacaggcccccaacgtcgcccacgagctgagtggcggctgccacgggttcagtcacaagttcatgcattggcaggaggagttgctgttgggcggtatggctcgggatccacagggtgagttacttcgggccgaagccctacagtcaaccttcttgctgatgtccccgcgccaactgtacgaacatttccggggggattaccagacccatgacattggctggagtgaggagcaagcctccacagtcctgcaggcttggcagcggcggtttgttcaacttgctcaagaggcgctccctgagaatgccagccagcaaatccatgcttttagttcaactactctagacgacattttgcacgcattctccgaggtgtctgcggcaagagtagtcggcgggtacctgctgatgctcgcatacgcctgcgtcactatgctcagatgggactgtgctcagagtcagggctctgtgggcctggcaggtgtactgctcgtagctctcgcagtggcctcgggtctaggcttgtgcgccctcttggggatcactttcaacgcggcaaccacccaggtcctaccctttttggccttgggtatcggtgtggatgacgtttttctattagcgcatgcctttacagaggcactacccggcacccctcttcaggagagaatgggcgaatgtctccaacggacaggtacatctgttgtgctcactagcataaacaatatggcagcctttttgatggctgctctggtccccatacctgctctgcgcgcgttttcactgcaggctgccatagtagtggggtgtacatttgttgctgtcatgcttgtattcccagccatcttgtccctggacctgcggcgccggcactgtcagcgcctggatgtgctgtgctgcttctctagtccctgcagcgctcaggtgatccagatcctgccacaagaactgggcgacggaactgtgcccgtggggattgcccatttgaccgcgacagtgcaggccttcacacattgcgaagcttcatctcagcacgtggtcaccatacttccaccgcaagctcatctagtaccacccccgagcgatcctctggggagtgagctcttctcgcccgggggctcaacccgcgatctgctgggacaggaggaagaaactcgccaaaaggccgcatgcaagtccttaccttgtgcaagatggaatttagcgcattttgcacgctaccagtttgcccccttgctgttacagtcccacgccaaggccattgtgctggtacttttcggcgctctgctgggattgagcttgtatggcgccaccctggtccaagacggactggcccttacagacgtagttcccagggggacgaaagaacacgcgtttctcagcgcccagctgagatattttagtctgtatgaggtggcattggtcacgcagggcggcttcgactatgcccactcccagcgtgcattatttgacctacaccagagatttagttcactgaaagccgtcctcccgccaccagccacacaggcccccaggacatggctgcattactatcgcaactggctgcagggtattcaggctgcgtttgaccaggactgggctagcgggaggatcacccgacactcttacagaaatggttctgaggacggcgcgcttgcctataagctgctgatccagactggggatgctcaggagccactcgattttagtcagcttacaactaggaagttggtcgatcgggaagggcttattccgccagagctcttctatatggggctgactgtctgggtgtcctccgatcccctcggactggccgcctctcaagcgaacttttaccccccccctccggagtggctgcatgataaatacgatactacaggggagaacctccggataccaccagcacagccactcgagttcgctcagttccctttccttctgcgagggctacaaaagaccgcagacttcgtggaggccattgagggcgcgagggccgcatgtgctgaagccgggcaggccggcgtgcacgcttacccctcaggttcgccgtttctgttctgggaacagtacctcgggctgagacgatgcttcctgctggccgtctgcatccttctcgtatgtactttcctcgtgtgtgccctgctcctgctcaatccttggaccgccgggttgattgtgctcgtattggccatgatgaccgtggaactttttggtattatgggctttttgggtattaagctctcggctatcccggtggtgatcctagtcgcttctgttgggattggtgtggagttcaccgtgcacgtggcacttgggttcctcactacgcagggcagccggaacttgcgagccgctcacgctcttgaacacacatttgcgccagtcaccgacggggccatctctacccttctgggcttactgatgctcgctggcagccactttgattttatcgttcgttactttttcgctgctctgacagttttgactctcttgggacttctgcacggcctggtcctgctacccgtcctgttgtctatccttggaccccctcctgaggtgattcagatgtacaaggagagcccggaaatcttgtctcccccggcccctcagggcggtggccttagatggggcgcgtccagtagcctgccccaatccttcgccagagtgacaacgagcatgacagtggctatccatccgcccccactacccggtgcgtacatccatccagccccagacgagccaccctggagtcccgctgccacttctagcggcaacctctcctcaaggggtcccgggcctgctacagggtag

SEQ ID NO: 198765 - DNA, 267 bp, Artificial Sequence
  Description of Artificial Sequence: Synthetic coding sequence
tgattcgacttcatcgtgcggtacttcttcgccgccctgaccgtgctaactctcctgggattgttgcacgggctcgtgctgttacccgtgctgctgtcaattttgggacctccccctgaagttatccagatgtacaaggaatccccagagattttgtcccctcctgcacctcagggcggtggactgcgcgttggttcactgcaggtaaacatcagctactggaaggagctcctctggtgccaggacctgcgtcctgaagaaatctag

SEQ ID NO: 198766 - DNA, 3441 bp, Artificial Sequence
  Description of Artificial Sequence: Synthetic coding sequence
atgacccggagcccccccctgcgggagctgccccccagctacaccccgccagccagaacagccgcaccacaaattctggcagggtcgctgaaagcacctttgtggttgcgggcctattttcagggcttgctgttctccttaggatgcggtattcagcggcattgcggcaaggtcctgtttctgggtcttctggcattcggtgccctggcactcggactgcgcatggcaatcatagagactaacttagagcagctgtgggtcgaggtcgggagtcgtgtgtctcaggaattgcactacaccaaagaaaagctgggcgaagaggccgcttatacatctcagatgttaatccagaccgcgcgccaggaaggtgagaatattttgacaccagaggctctcgggctacacctccaggcagccctcacagcttccaaggtccaggtcagcctctacggtaagtcgtgggatctaaacaaaatctgctataagagcggggtgcctctaattgagaatggaatgatcgaaaggatgattgagaagctgtttccatgcgttatactcacaccattggattgcttctgggagggcgcaaaattacaggggggcagcgcctatctccccggacgtccagacatccagtggaccaacttagatccagaacagctattagaggaactcggtccttttgcctccttagaaggttttcgcgaactccttgataaggctcaggtgggacaagcctacgtaggtagaccctgtttgcatcccgatgacttacactgtcctccatctgcgccaaatcaccacagccgccaggctccgaatgtggcgcacgaactttcaggcggttgccatggtttctctcacaagttcatgcattggcaggaggagctgctcctcggagggatggccagggatcctcagggagagctgctaagagctgaggcacttcaaagcactttcttgttaatgagcccgcggcaactttacgaacacttccgcggagattaccaaacccacgacattggctggtccgaagaacaggccagcacagtgctccaggcctggcaacgcaggttcgtccagcttgcccaggaggctctgcccgagaacgcatctcagcaaatccacgctttcagcagcaccaccttagacgatatcttgcatgccttctccgaagtgtccgctgctcgagttgtcggaggatacctacttatgctcgcttatgcatgcgtcacgatgcttcgctgggactgtgcccagtcacagggatcggtggggctggccggggtacttctggttgcactggccgtggcatcgggcctcggcctgtgcgccctgctcggcataacctttaacgctgcaaccacacaggtactgcccttcctggcccttgggattggggtagacgatgtttttctgctggcacacgccttcacagaggcactcccgggtactcccctccaagagcgcatgggcgaatgtttacaaaggaccggtaccagcgtggtgctgacctcaatcaataacatggcggctttcctgatggcagcgctggttccaattccggcactgcgggccttttcactccaggccgctattgtggtaggctgtaccttcgtcgctgtgatgctggtcttccctgcaatactgtcgctcgatctcaggcgccggcactgtcaaagactggatgtgctgtgttgcttttcatcaccttgcagcgcccaggtgattcagattctaccacaggaattgggggacgggacagtgccagtcggcattgcacatctgacggctacagtccaggcattcacacattgcgaggcgtcgagccagcacgtggtcaccatactccctccccaagcgcatctggtgccccctccaagcgatccactaggctctgagctcttctctccgggggggtctactcgggatctgctcggccaggaggaagagacacgtcagaaagccgcttgtaagtctctgccgtgcgccaggtggaatctggctcattttgctcggtaccagtttgcacccctgcttctacaatctcacgccaaggccattgttttagtcctcttcggtgcactactgggtctgtctctgtatggggcaactctggttcaggatgggcttgcactcacggacgtggtgcccaggggtactaaagaacacgccttcctgtctgcccagctccgatatttttccctctatgaggtggccttagtcacccaaggaggattcgactatgcccacagccagcgggccctatttgacctgcaccagcgcttttctagtctcaaggccgttcttccaccacctgccacccaggccccgaggacttggctgcactattatcggaattggttgcaaggaattcaagccgcttttgaccaggactgggcaagcggccgtatcaccagacactcgtaccgcaatggctcagaagatggggccctggcctataagctcctcattcagacgggcgatgcacaggaaccacttgacttctcacagttgaccacccgcaaattagtcgaccgggaaggcctgattcccccagaactgttctatatggggcttaccgtttgggtcagcagcgatcctctgggcctcgccgcgagtcaggcaaacttttatccaccaccacctgagtggctgcatgataaatacgataccactggagaaaacttacggattcctccggcccagccattggagtttgcacagttcccatttctccttcgaggactgcagaagaccgccgattttgttgaggctatagaaggcgctagagccgcatgtgctgaggcaggccaggccggagtccacgcttatcctagcgggtctccattcctgttctgggaacagtatctgggattgagaagatgctttctgttagctgtctgcatcctgcttgtctgtacttttctcgtctgcgcactgctgctgctgaatccttggacggctggcctcatagtgctcgtgctggccatgatgaccgtggaactctttggtataatgggatttctgggcatcaagctctcagcgataccagtcgtgatactcgtggcttccgtcggcattggtgtagaatttacagtccatgtggcgctgggcttcctgaccacacagggaagccgaaacctgagagccgctcacgcactcgaacacacatttgcacctgtcacagatggtgctatctccaccctcttagggttgctaatgttagctggaagccacttcgattttatcgtgagatatttcttcgccgccctgaccgtgctcacactgctggggctactgcacgggctggtgctcttgcctgtgttgctcagcattttgggacctcctcccgaggtgattcaaatgtacaaggagagcccggagatcctctccccgcccgccccccaggggggaggactgaggcctgaggagatctag

SEQ ID NO: 198767 - DNA, 2667 bp, Artificial Sequence
  Description of Artificial Sequence: Synthetic coding sequence
atgctgcggcaggtgctgcaccggggcctgcggacctgcttcagcagactgggtcacttcatcgcaagtcacccggttttctttgccagtgccccggttttgattagcatcctgctgggtgcttctttcagtcgctaccaggttgaggaatccgttgaacacctattggcaccacagcatagcctggccaagattgagagaaacctagtgaactctctattcccggtaaaccgtagtaaacatcgtctttacagcgatctgcagactcccggccggtacggacgcgtcatcgtgacctctttccagaaggcgaatatgctggatcagcatcatacagacctgatccttaaactgcatgcagcggtgaccaagatacaggtgccccggccaggcttcaattacacttttgcccatatctgcattctgaataatgacaaaacctgcatcgtggacgacatcgtgcacgttttggaggagttgaagaacgcccgggcgacaaatcgcaccaatttcgccatcacttaccctattacacatttaaaggatggacgagctgtctacaatgggcatcagctaggtggagtaacagtgcacagtaaggatagggtgaagagtgcggaggccatacagttaacttactacctgcagagtattaatagccttaacgacatggtggctgaacggtgggagtcctctttctgtgataccgtgcgattatttcaaaaatcgaactccaaagttaaaatgtatccctatacctcttcctcattgcgtgaggactttcagaagacctccagagtatcagagcgctatttggtgactagcttaattctggtagtcacaatggctattctttgttgctctatgcaggattgcgtgcggtcaaaaccctggctcggtcttctgggcctggtgactataagtctggctacccttactgccgctggcatcatcaatctgaccgggggtaagtataattctacgttccttggagtcccttttgttatgttaggacatggactgtatggcaccttcgagatgttgagctcgtggcggaaaacaagggaggaccaacatgtgaaggagcgcacggctgccgtctacgccgactccatgctcagttttagcctgaccactgcaatgtatctcgtcacttttgggattggcgcgagcccttttactaacattgaagccgctaggatcttttgctgcaactcttgcatcgcgatcttctttaattatttatacgtgctcagtttttatgggagctccctggtctttaccggctatatcgagaataattaccaacactcaatattttgtagaaaggtccccaagccggaagccttacaagagaaaccagcatggtatcggtttcttcttactgctcgtttctcagaagatacagcagagggggaagaagcaaatacgtatgaaagccacctgctcgtctgcttcttgaaaagatattactgtgactggatcactaatacatacgtgaagccattcgttgtcctgttctacctgatttacatttcttttgctctaatgggctaccttcaggtttccgagggaagcgatctgagcaatattgttgccacagcgacacagacaatcgagtatacaactgcccagcagaaatactttagtaattactctccagtgatcggattctacatttatgagagcattgagtattggaatacatccgttcaggaggacgtgttggagtacaccaaaggctttgtgcggataagttggttcgagagttacttaaattacctgcggaaactaaatgtttcaactggcttgcctaagaagaatttcaccgacatgctccggaattccttcttgaaagccccacagttcagccacttccaggaagatatcattttctccaaaaagtataacgatgaggttgatgtggttgccagccgtatgtttctcgtggcaaagacaatggagaccaatcgcgaggaactctacgatctgcttgagacactgaggcgtctgtccgtgacttcgaaggtgaagtttatcgtgtttaacccaagcttcgtgtatatggaccgctatgccagctcactgggagcccctctgcacaactcctgtattagtgccttatttttgttattcttcagtgcttttttagtggccgattccctcattaatgtatggatcacactgacagtggtgagcgttgagtttggggtaatcgggtttatgaccctgtggaaggttgaactggattgcatcagcgtgctctgtttaatctacggtattaactatacaatcgataactgcgctccaatgctctctacatttgttcttgggaaagactttacacgtactaagtgggtgaagaacgcattagaggtgcatggagtcgccattcttcagtcatatctctgttatatcgtagggcttatcccactggcagctgtgccctcaaatcttacgtgcacactgtttcgatgtctgtttctcatagctttcgtgacgttttttcactgcttcgccatcctgcccgtcattttaacgtttctccccccaagcaagaaaaaacggaaagagaagaagaaccctgagaatagagaagagatagaatgtgtggaaatggtagacatcgatagtactagagttgttgaccagatcacaactgtttag

SEQ ID NO: 198768 - DNA, 4179 bp, Artificial Sequence
  Description of Artificial Sequence: Synthetic coding sequence
atggacaccgaggacgaccccctgctgcaggacgtgtggctggaggaagagcaggaggaggaggaggcaaccggcgaaactttcctgggggcccagaaacccggcccacagcccggagcaggagggcaatgttgttggcgccactggcctctggccagccggccgccggcctctgggttctggagcaccctgggttgggctttcaccaacccctgctgcgctgggctcgtgctgtttctcgggtgttccatacccatggctttatctgccttcatgttcctgtattacccccccttggatatcgatatcagctacaatgccttcgagattcggaaccatgaagcatcccagcggtttgatgcccttacattggctctgaagtcccagttcggcagttgggggagaaacagaagggacctagccgactttacatccgaaacgctgcagcgtcttatctccgagcaacttcagcagctgcatttgggtaacaggtctcgccaagcatcccgagcccccagggttattcccgccgcctctctcgggggccccggcccttaccgtgacacgagcgcagcgcagaagcctacagcgaaccggtcgggaagactgagaagggaaaccccaccgttagaagaccttgctgccaaccagtcagaagatccacgaaatcagcgactctctaagaacggtagatatcagccttcgatccccccacacgcggccgtcgcggcaaatcagtctagagctcgccgaggggcgtctaggtgggactacagccgagcttatgttagcgctaacacccagacacatgctcactggcggatcgaactgatttttcttgcccgcggcgatgcggaacgtaacatcttcacttccgagcgattggtaacaatccatgaaattgagcgaaaaatcatggaccaccctggtttcagggaattctgctggaaaccacacgaagtcttaaaagacctgcccctcggctcctactcttattgcagccctcccagcagtctgatgacttacttctttcccaccgaacgagggggcaagatctattatgacggcatggggcaggatttggcggacatcagaggctctcttgagctggcaatgacccacccggaattctactggtatgtggacgagggactatccgctgataacctgaaatcaagccttcttcgctctgaaatcctttttggtgcccccctaccgaactactacagcgtagacgacaggtgggaggaacagagagcaaaattccagtccttcgtcgtgacgtatgtggccatgcttgccaagcagtccacatctaaagtccaggtgctgtacggcggtacggacttgtttgactatgaagtccggagaacctttaataatgatatgctcttagctttcatcagtagctcctgcatcgccgcgctagtatacatccttacatcatgtagcgtatttctgtcattctttggtattgcctctatcggcctgtcttgcctagtggccctgttcctgtaccacgtggtctttgggattcaatacctgggcatccttaatggcgttgctgcctttgtgattgtaggaataggcgtcgacgacgtgttcgtgttcattaatacttaccggcaggccacccacctggaggaccctcagctgaggatgattcatactgtgcagaccgccgggaaggcgaccttcttcacatccttgactaccgcagccgcctatgccgccaatgtgttctcacagatccccgctgtccatgactttggcctttttatgtccttgattgtatcttgttgttggttagcagtgctggtgacgatgcccgctgccctgggactgtggtctctttaccttgcacccctagagtcatcttgccagacgagttgtcaccagaattgttcacggaaaacgtcattacatttccccggagacgtgttcgcggctcctgagcaggtgggcggctcccctgctcagggaccaattccgtacctcgatgatgacataccactgctcgaagtagaagaggaaccagtttccttagaactaggtgatgtgtccctggtgtccgtgagtccagagggacttcagcctgcgagtaacactggcagtcgagggcacttgatcgtccagctgcaggagctgctgcaccattgggttctgtggagcgccgtgaaatctcgctgggttattgtgggccttttcgtctctatcctcattttatctctcgtattcgcttcccgactaaggccagcaagccgcgctccacttctgttcaggcccgatacgaacattcaggtcttgctggacctgaagtataacctgagcgctgaagggataagttgtattacctgtagcgggctatttcaggaaaagccacacagcttgcaaaacaacattaggacatctctggaaaagaagcgaagaggctctggtgtgccctgggcttccagacctgaagccaccctgcaagattttccaggcaccgtctatattagcaaagtgaaatcacagggacatcctgctgtatatcggctgtctctgaatgcttctctgccagccccatggcaggcagtttcccctggcgacggagaggttccgtcttttcaggtgtatcgagcgcccttcggcaattttacaaaaaaactgactgcgtgtatgagtaccgttggactgttgcaggcagcgagtccctccagaaagtggatgctcactaccctggcttgcgacgctaagagaggttggaagtttgattttagcttctatgttgccacgaaagaacaacagcacactagaaagctttatttcgcgcagtcccacaagcctccctttcatggccgggtgtgcatggctccgcccggatgtttattaagctcctctcccgacgggcctacaaagggatttttctttgtgccatccgagaaagtcccaaaggccaggctctccgccacatttgggttcaatccttgtgtgaacacgggctgtggcaaacctgcggtcagacctctggtggataccggggcaatggtgtttgttgtttttggcatcattggcgtcaatcgaaccaggcaggtcgataatcacgtgatcggggaccccggctccgtcgtttacgattccagctttgatctttttaaagagatcggtcatctatgtcacctatgtaaagccattgccgcaaattctgagttagtcaaacctggaggcgcacagtgtctgccctctgggtatagtatttcgtcttttctgcaaatgctgcaccccgagtgcaaggagcttccggaaccaaacttgctgcctgggcagctatctcacggggccgttggagttcgcgaaggacgggtccagtggatcagtatggccttcgagtcaactacctacaaggggaagtcgtcctttcaaacatattctgattatctgcggtgggagtccttcctgcagcagcagctgcaggcccttcctgaaggcagtgtgttaaggcgggggttccagacctgcgagcactggaagcagatcttcatggagattgttggagtccaatccgccctatgcggtctggtgctatctctgctgatatgcgtcgccgctgtcgccgtgtttacgacccacattcttctacttctgcccgttcttctttcaatcttgggtattgtatgcctcgtggtgacaattatgtactggtctggctgggagatgggggcagtcgaggcaatcagcctttcaatcctggttggtagcagtgtggactactgcgtgcatctcgtcgaggggtacctcctcgcaggcgaaaatctaccgccacaccaagccgaagacgcccgtacgcagcggcagtggaggactctggaggccgttaggcatgtgggggtggcgattgtcagcagcgcgctcaccaccgttattgcgaccgtacccctgtttttctgcatcatcgctcctttcgccaaatttggcaagatcgtggccctcaatacaggggtatccatcctgtatacgctcaccgtgtccacggccctgctgggtattatggccccaagctcgtttacgcgaaccagaacctcgtttctgaaagctctcggggctgtactgctggcgggcgctcttggcctgggcgcttgcttagtactgctgcagtcagggtacaaaatccctctacctgcaggggcatccctgtag

SEQ ID NO: 198769 - DNA, 4179 bp, Artificial Sequence
  Description of Artificial Sequence: Synthetic coding sequence
atggacaccgaggacgaccccctgctgcaggacgtgtggctggaggaggaacaagaggaggaggaggccaccggggagaccttcctcggcgcacagaagcccggaccacagcctggtgcaggcggtcagtgctgttggcggcactggcccctggcgagccgaccccctgcctctggtttttggagcacgctggggtgggcattcaccaacccctgctgcgccggcctggtcttattcttaggttgctcgattccgatggccctgagtgcgtttatgtttctctactatcccccactcgatatcgatatatcctacaacgcttttgaaatcagaaaccacgaagccagccagagatttgatgcactcaccctggctctgaagtcccaatttggttcctggggacgcaaccgcagggacttagccgatttcactagcgagaccctgcagaggctaatttcggagcagttacagcaacttcacctgggtaaccgttcacgtcaggcctccagggcccccagggttattcccgccgcctccttgggcggccccggcccctatcgggacacctctgccgcccagaagccaactgcaaatcgctcagggaggcttaggagggagactcctccactggaggacttagccgctaatcagagcgaagaccctaggaaccaacggctgagcaaaaacggccggtaccagccctcaatcccaccccacgctgccgtggccgccaaccagagccgcgcaaggcggggtgcttcccgctgggattacagcagagcttacgtgagtgcaaacacccagacccatgcccattggaggattgagctgatattccttgcaaggggagatgccgaacgcaatatcttcacatctgagagactggtgacaatccacgagattgagagaaagatcatggatcatcctggattccgagaattctgctggaaacctcacgaggtgctgaaagatctacccctaggatcttattcctattgttctccaccatcaagtctgatgacttacttcttcccgacggaaaggggcggcaagatatattatgacgggatgggccaggatcttgcagacattcgcgggtctcttgagttggcaatgacccaccctgagttttactggtatgttgacgaaggactgtccgcggacaacctgaagagctccctgctgcggtccgagattcttttcggcgctccgctgcccaactactacagcgtcgatgatcggtgggaagagcaaagagcaaagttccagtccttcgttgtgacatacgttgccatgctcgctaagcagagcacctcgaaggttcaagttctgtatggaggaacggatttgttcgattatgaggtccggaggacgttcaataatgatatgctgctagccttcatcagcagctcttgcatcgcggcgctggtgtacatattgacgtcttgtagcgtctttctgtctttctttggaatcgccagcattgggctaagttgcttagtcgcattattcttgtaccatgtggtgtttggaatccagtacctggggattctcaacggtgtggccgcctttgttatcgtgggaattggggtcgacgatgtgttcgtgtttatcaatacatataggcaggccacccatctggaagacccccagctgaggatgatccacacagtccagaccgccggtaaggcaactttttttacgagtcttacaactgcggccgcctatgccgccaacgtttttagccagatccccgcggtacatgattttggcttgttcatgtccctgattgtcagttgctgttggctcgcagtgttggtaaccatgcctgctgcattggggctgtggtccttatacctggcccctttggaaagcagctgccagactagctgccatcagaactgttcaagaaaaacttcattacacttccccggggacgtgtttgccgctccagagcaagttgggggaagccctgcccagggccccatcccctatcttgacgatgatatacccttactggaagtcgaagaggaaccagtgtctctcgaactcggggatgtttccctggtgtctgtgtctcccgaagggctccagccagcaagcaataccggctcacgagggcatctcatagttcaactacaggaactgcttcatcactgggttctgtggtctgctgttaagagccggtgggtaattgtaggactcttcgtgagtatcctaatcctttcgttggtctttgctagccggttgcgaccagcctcccgagcgccattgctgtttcgcccagacaccaatattcaggtcctccttgacttaaaatacaatctgagcgccgaaggaatcagctgcataacttgttcagggctcttccaggagaagcctcactccctccagaataatatccgaacatcactggagaaaaagcgcaggggatcgggtgttccatgggcgagtagaccagaggctaccctgcaggactttccaggaactgtgtacatctcaaaagtgaagtcacaggggcatcctgcagtgtatcgactttctctgaacgccagcctgccagccccttggcaggccgtatcgcctggagatggcgaagttccctcctttcaggtctaccgcgccccttttgggaactttacgaaaaaactgactgcctgcatgtcaacagtgggccttctgcaggcggcttcccccagcagaaaatggatgctcacaactctcgcttgtgacgccaagcggggctggaaattcgatttctctttttacgtggctacaaaggaacagcaacatacccggaagctgtacttcgctcaaagccataaaccaccatttcacgggcgggtctgcatggcaccccctggttgtcttctgagctcatctccagatggccctactaagggatttttttttgtgccgagcgaaaaggtgccgaaggctcgtctgagtgccaccttcggctttaacccctgtgtgaacacaggttgtgggaaaccagcagtgcgaccgctggttgacaccggcgccatggtgttcgtggtttttggtatcataggcgtgaaccgaacccggcaggtcgataatcacgtgataggagatcctggcagcgtggtttacgatagcagctttgacctctttaaagaaatcggccatctttgccacctctgtaaagcgattgccgcaaattcagagctggtcaagcccgggggggctcagtgcctcccaagtgggtacagtatctctagtttcttgcagatgctccaccctgagtgcaaggaactgccagaacccaatctcctgcccggacaactatcccatggcgctgtgggcgtgagggagggccgggtgcagtggatctcaatggcgtttgagagcacaacctacaagggtaagagttcgtttcaaacttattccgattatctccggtgggaaagttttctacaacaacagctgcaggctttgccggaggggagtgtactgaggcgcggcttccagacctgcgagcactggaagcagatcttcatggagatcgccggcgtgcagagtgccttgtgcggcctggttctgagtctcctgatctgtgtcgccgcagtggccgttttcaccactcacattttgctgctgcttcccgtactcttgtcgatcttagggattgtgtgtcttgtggtaacgataatgtactggtcggggtgggagatgggagctgttgaggcaatcagcttgtcaatcctggttgggtcatctgttgattattgtgtccacctggtcgaagggtacctgctggctggagagaacctgcctccacatcaggcggaggacgccaggacacagaggcagtggagaaccctagaggccgtcaggcatgttggtgtagccatcgtctcatcagcactaaccactgtgatcgcaaccgtcccgctgttcttctgcattatagcccctttcgcgaagttcggcaagattgtggcgctcaatacaggcgtgagcatcttatacaccctgaccgtgagcaccgccctcctagggattatggctccgagcagctttacgcgaacgagaacttcttttcttaaagccttgggggctgtacttctcgctggtgcactaggtctcggcgcctgcctggttctgctgcagagtggctataagatacctttacctgcgggcgccagcttgtag

SEQ ID NO: 198770 - DNA, 2304 bp, Artificial Sequence
  Description of Artificial Sequence: Synthetic coding sequence
atgccctgggtggagcccaagccccggcccggccccgagcagaagcctaagctgaccaaacccgatagcgccaccggccctcagtggtaccaggagagccaggagagtgagtccgagggaaaacagcccccccccggccccctggcacctccaaagagccctgaaccatccgggcctctggcgagtgagcaagatgccccacttcccgagggtgatgacgctcccccgcgtccttctatgctcgatgacgcccctcgtctccccctcgaattagacgatgctcccctccctgaggaggagacccccgagcccacagccatttgccgacatagacaccgctgtcatacagactgcttggaaggccttctgagcagaaccttccagtggctgggatggcaagttggtgcacatccgtggatctttttgctcgcccccctgatgctgacggcggccctaggcacaggattcctttatttgccgaaagacgaggaggaagacctggaggaacactatactcctgtgggaagtcctgctaaggcagaaaggaggttcgtgcaggggcacttcaccaccaacgactcgtaccgcttctccgcatcccggagatcgacagaggccaattttgtgtctctcctcgtggtgtcgtacagcgactcattactggaccccgcgacctttgcggaagtatctaaactggacggagccgttcaagatttgcgcgtggcacgagagaagggcagccaaatccagtatcagcaggtatgcgctagatacagagcgctatgcgtcccacccaatcctattctgtacgcctggcaggtcaataagaccctcaatctctcctccatcagcttcccagcatataaccacggtcgccatcccctctacctgacaggcttctttggaggctatattcttggtggttctctcggaatgggacagcttctgctgcgggctaaggcaatgcggctcttgtattatttaaaaactgaggatcctgaatatgacgtccagtccaagcagtggctcacacatctgctggaccagtttacgaatatcaagaatatcctcgcccttaagaaaattgaagtcgttcatttcacatccttaagtcgtcagttagaattcgaggcaactagcgtgacggtgatccctgtgtttcacctggcctacatactgattattctgtttgctgtgaccagctgctttaggtttgattgtatccgcaacaagatgtgcgtggcagcattcggggttatctcagccttccttgctgtggtgtcaggctttgggctgctactgcatataggagtgccattcgtgataatcgtggctaatagtccattcctgattctcggcgtcggcgtggatgatatgtttattatgatatccgcgtggcacaagacaaatttggctgacgacatccgagagcgtatgtccaacgtgtatagtaaggccgctgttagtatcactatcaccactattaccaacattttggcattgtataccggtatcatgtcctccttcagatctgtacagtgcttttgcatatacacagggatgacactgcttttctgttacttttacaatatcacctgtttcggcgccttcatggctctggatggtaaacgagaagtggtttgcttgtgctggctcaagaaagcggatcctaaatggccttcttttaaaaagttttgctgttttccattcggtagtgtgcctgatgagcacgggaccgacatccacccaattagtctcttttttagggactattttggccctttcttgactcgctccgagtcaaaatattttgtggtgtttatttacgtgctttacattatttcttccatttatggctgcttccatgttcaggaaggacttgacctgagaaacctcgcgtctgacgatagctatatcaccccctacttcaacgtcgaagagaattattttagtgactatggccctcgagtgatggtcatcgttacaaagaaagtggattactgggataaagatgtccgccagaagctggaaaactgtactaagatttttgagaagaatgtttacgtagataaaaacctgacagaattttggctggacgcatacgtacagtacttgaagggtaactctcaagatcctaatgagaagaacacttttatgaacaatatccctgacttcttatccaactttccaaactttcagcacgatataaacattagcagctccaacgaaataataagctctagaggatttatccaaacaactgacgtgagttccagtgctaagaagaaaatcttactattttag

SEQ ID NO: 198771 - DNA, 978 bp, Artificial Sequence
  Description of Artificial Sequence: Synthetic coding sequence
atgaccgagcggcggcgggacgagctgagcgaggagatcaacaacctgagagaaaaagtgatgaagcagtcggaggaaaataacaatctgcagagccaggtgcagaagcttacagaagaaaatacaactcttcgagaacaggtggagcccacaccagaggacgaggatgatgatatcgagctccgcggcgcagccgccgcggccgctccgcccccacctattgaggaagagtgccccgaggacctcccagagaagttcgacggtaatcctgacatgttagctccattcatggcccagtgtcagatctttatggagaagagcactagagatttcagcgtggacagggtcagggtctgtttcgtcactagcatgatgacaggtcgcgccgctcgatgggcctccgcaaagttagagagatcgcactatctcatgcacaactacccagcatttatgatggagatgaaacacgtcttcgaagacccccagcgccgggaggtggccaaacggaagatccgtcgccttcgccagggcatggggtctgtgattgactatagcaatgcttttcagatgattgcgcaggatctggactggaacgagccggccttaattgatcagtatcacgaaggactaagcgaccatattcaggaagagctttcacacctggaggtggctaagagccttagcgccctgatcggtcaatgcatccacatcgaacggaggctagctcgggctgctgccgcccgtaaacctaggtccccacctagggccctggtattgccccatattgcatctcatcaccaagtggaccccacagagccagtgggcggcgcgcggatgcggttaactcaggaagagaaggagcgtcgccgaaagcttaatctgtgtctgtactgtggaactggtgggcattacgctgataactgccccgccaaagcatccaagtctagtccagccgggaattcccctgcccccctgtag

SEQ ID NO: 198772 - DNA, 978 bp, Artificial Sequence
  Description of Artificial Sequence: Synthetic coding sequence
atgaccgagcggcggcgggacgagctgagcgaggagatcaacaacctgcgagaaaaagtgatgaagcagtctgaggagaacaataatttgcagagccaggtgcaaaaactgactgaggagaacacaactctgcgtgagcaagtggaaccgactcccgaggacgaggacgacgatatcgaactgcgtggggccgccgccgcggcggcacctcccccaccaattgaggaggaatgcccggaagatcttcctgagaagtttgacgggaatcccgatatgctggctccttttatggcacagtgtcagatattcatggaaaaatccacacgcgacttttccgtggaccgcgtgcgggtgtgtttcgttacatcgatgatgacagggcgcgctgcccggtgggcttccgctaaactggagaggtcccactacctgatgcacaattatcctgctttcatgatggagatgaaacacgtcttcgaagatccgcagagacgcgaagtcgccaaacgcaagatccgtagattaaggcaggggatggggagtgtcattgactactccaacgccttccagatgatcgcacaggacctggactggaatgagcctgccctcatcgaccagtaccatgaaggactctctgatcacattcaagaggagcttagccacctggaggttgcaaaaagtctctctgccctgatcgggcaatgcattcatatcgaacgccgccttgcccgcgctgccgccgcaagaaagccccggagcccgcctagggcgctggtactgccccacattgcctctcaccatcaggtcgatcccaccgagcccgtggggggagcacgaatgagactgacacaggaggaaaaggaaaggaggcgaaagctgaatctgtgcctgtactgtggaaccggcggacactacgcggacaattgcccagctaaagcctctaagtcatcccccgccggcaattccccggctccgttatag

SEQ ID NO: 198773 - DNA, 1311 bp, Artificial Sequence
  Description of Artificial Sequence: Synthetic coding sequence
atgatggccacccagaccctgagcatcgacagctaccaggacggccaacagatgcaggtggtgaccgaactgaaaacagagcaggaccccaattgcagcgagcccgacgcggaaggcgttagccctcctcctgtggaatcacagacgcccatggacgtggacaaacaggccatctacaggcaccctctatttcccctgctggccctgctcttcgaaaagtgcgagcaatctacacaagggtccgagggtaccacctccgcttctttcgatgtagacatagaaaacttcgtgcgcaaacaggagaaagagggaaagcccttcttctgtgaggatcccgagacagacaacctgatggtgaaggcaatacaggtcctccgcatccacttactagagctggaaaaagttaacgagttgtgcaaagacttctgttctcgatacatcgcatgccttaaaacgaaaatgaattcggaaacactattgagcggcgaacctgggtccccttactcccccgtacagtctcaacaaatccagtcggctattacgggaacgatatctccacagggaattgtggttcccgcaagcgcactgcagcagggcaacgtggccatggccacggtcgcaggcggaaccgtgtatcaacccgtcaccgttgtcaccccacagggtcaagtggttactcagacactgtcaccaggcaccatcagaatccaaaacagccagctccaactgcaacttaaccaggatctgtccatactccaccaggatgacggcagcagcaagaacaagaggggcgtgctgcccaagcatgcaactaacgtaatgcggagctggctcttccagcacatcggtcatccttatcctaccgaggacgaaaagaagcagatcgcagcacagaccaatttaaccctgttgcaagtgaacaactggtttatcaatgcccgacgacgaatccttcagccaatgctcgattcctcatgctccgagacacccaaaacaaaaaagaagaccgctcagaaccgacccgtccagcgcttctggcccgactcaatcgcaagcggggtggcacagccacctccaagcgaacttactatgtcggaaggagcagtcgtgacaatcactacaccggtgaatatgaatgtagactccctgcagagcctcagtagcgacggcgcaaccctggcagtccagcaggtgatgatggccggacagagtgaggatgaaagcgtggattcgaccgaggaagatgcaggggcccttgcacccgctcacatctcaggactggttctggagaattctgatagcctccaatag

SEQ ID NO: 198774 - DNA, 960 bp, Artificial Sequence
  Description of Artificial Sequence: Synthetic coding sequence
atggtgaaggccatccaggtgctgcggatccacctgctggagctggaaaaggtgaatgaactctgcaaagatttttgtagcagatatatcgcttgcctcaaaactaagatgaattctgaaaccctgctctcaggggagccaggcagcccctactcgccagtccagagccagcagatacagagcgcaatcacggggacaatttctccccagggcatcgtggtcccagctagcgcactgcagcagggaaatgtagcaatggctactgtggcaggggggacagtgtaccagcctgtaactgtagtcactccgcaggggcaggtggtgacgcagaccttgtcccctgggactattagaatacagaatagtcaacttcagctacagttgaaccaggacctgtcaatcctgcaccaagatgacggctcttcaaaaaacaagcgaggcgttcttccaaaacacgccaccaacgtgatgagatcatggctgtttcaacatatcggacacccctatccaacggaagacgagaagaaacagatagcagcccagacgaaccttacactgctccaagtgaacaattggtttataaacgcccgacgacgcattctccagcctatgcttgacagcagctgctcagaaacacctaagaccaaaaaaaaaacagctcagaatagacccgttcagcgattctggccagacagtatcgcctcaggggttgcacagcctccaccttccgagcttacgatgtccgagggtgccgtggtcaccattacaacaccggtgaacatgaatgtggattctctgcaaagcctcagctcggacggagccaccctggcggttcagcaggtgatgatggccggacagtctgaggacgagtccgtggactctaccgaagaggacgccggcgcacttgctcccgcccatatctctggcttggtgctcgagaacagtgattcccttcagtag

SEQ ID NO: 198775 - DNA, 1260 bp, Artificial Sequence
  Description of Artificial Sequence: Synthetic coding sequence
atgatggccacccagaccctgagcatcgacagctaccaggacggccagcagatgcaggtcgtcacagagcttaaaaccgagcaagatccaaattgcagcgaaccagatgccgaaggagtgtcaccccccccagtcgaaagccagacccctatggacgtggataagcaggcgatctatcggcatcctctgttccctctgcttgccctgttatttgagaaatgtgagcagtctacccaagggagcgaaggaaccacttcggcctcattcgatgtcgacatcgaaaacttcgtgcggaagcaggagaaggaaggcaagccatttttttgtgaagatcctgaaactgataatctcatggtcaaggcaatccaggtgctacgcatccatctgcttgagctggaaaaagtgaatgaactgtgtaaggacttttgctcccgatatatcgcttgcctgaagacaaagatgaactcagaaacactattgagcggggagccaggcagtccgtattcccccgtgcagtcacagcagattcagtccgctattactggaaccatttccccacagggcatcgtggttcctgctagtgctctgcagcagggaaatgttgccatggctactgtcgccgggggcactgtgtaccaaccagtgaccgtcgtgaccccgcagggccaagtcgtgacacaaacactctctcctggaaccatccgaatccagaactcgcagctccagcttcagctcaatcaggacttgagtatactgcaccaggacgatggatctagcaagaacaagaggggagtgctgcccaagcacgccaccaatgtcatgcggtcttggctcttccagcacattggtcacccctatcctaccgaggacgaaaagaagcagattgccgcccaaaccaatctcacactactacaggtaaacaattggttcatcaatgccaggaggagaatccttcaaccgatgctagacagcagttgctccgaaacacccaagactaagaaaaagactgcacagaacaggcctgtacagcggttttggcccgactccatagccagtggggtcgctcaacctcccccatccgagctaacaatgtccgagggcactgggggacgcccaagaccagacatggtggatcacggcgttggcatcatgaacaaacgtcccggttccggtctgttagcaccacctcggccagctgagaatgacatcctgaaaccgcctctccggtcttccttcgtgaattgtttgctgatattctag

SEQ ID NO: 198776 - DNA, 1419 bp, Artificial Sequence
  Description of Artificial Sequence: Synthetic coding sequence
atgatgcagcacgccagccccgcccccgccctgaccatgatggccacccagaatgttccccctccgccttatcaagactctccacaaatgacggcaacagctcaaccgccttcaaaggctcaggcagtgcatatttcagccccatcggccgcggcaagtaccccggtgcctagtgcaccaatcgacccccaggcgcaactcgaggctgacaagagggctgtgtacagacacccactgttcccgcttttgactctactcttcgagaagtgtgagcaggctacgcaaggtagcgagtgcatcacgtcggcatcattcgacgtggacatcgaaaatttcgtacatcagcaggagcaggagcacaaacctttcttttccgatgacccggagctcgataatctgatggtaaaggctatacaagttttgcgcattcacctgctggaacttgagaaggtgaatgaactgtgcaaggatttttgcaataggtatatcacctgtctgaagacgaagatgcattccgataacttactgagaaatgacttgggtggtccctactctcccaatcagccatcaatcaatctgcatagtcaggatctcctgcagaactcccccaactctatgagcggcgtcagcaataaccctcagggtatcgttgtacccgccagcgcacttcagcaaggaaatattgctatgactacagtaaattctcaggtggtcagcggcggcgccctgtatcagcctgtgacgatggtcacaagtcaggggcaggtcgtgactcaggccataccacagggtgccatccagattcagaacactcaggtaaacctggacctgacttctctgctggacaacgaagataagaagagcaagaataaaagaggggtgctgcctaagcatgcaacgaatattatgcggagttggctttttcagcacttaatgcatccttaccctaccgaagatgagaagcgacaaatcgccgctcagactaacctgacactgctgcaggtcaacaattggtttattaacgctcgaaggcggatcctccagcctatgctcgatgccagtaatcccgacccagcaccgaaagccaagaaaattaagtctcagcatagaccaacacaacgcttttggcccaacagcatcgccgctggtgtgctacaacagcagggcggcgcaccgggcaccaacccagatgggagcatcaacctggataatttgcagagcctttccagtgatagcgccacaatggccatgcagcaggccatgatggcggcccacgacgattccctagacgggactgaagaggaagatgaagacgaaatggaggaggaagaggaagaagagttggaggaggaggtagatgaactgcaaaccaccaacgtttcagatctggggttagagcatagcgatagcttagaatag

SEQ ID NO: 198777 - DNA, 120 bp, Artificial Sequence
  Description of Artificial Sequence: Synthetic coding sequence
atgatgcagcacgccagccccgcccccgccctgaccatgatggccacacagaatgtgccaccacctccttatcaggactctccccagatgaccgctaccgcacagccaccctctaagtag

SEQ ID NO: 198778 - DNA, 1332 bp, Artificial Sequence
  Description of Artificial Sequence: Synthetic coding sequence
atgaccgccaccgcccagccccccagcaaggcccaggccgtgcacatctctgcccctagtgccgccgcatctacacccgtgccctcggcccctatcgatccacaggcccagttggaagctgacaaacgggctgtgtaccggcatcccctgttcccgttactgaccctgctgttcgaaaagtgcgagcaggcaactcagggttctgaatgtatcacttcagcatccttcgacgtcgatatcgagaatttcgtgcatcagcaggagcaggaacataagccctttttctccgacgatccggagttggataatttgatggtgaaggctatccaggttctgcgaatccatttgctggagctggaaaaagtaaatgagctctgtaaggatttctgcaatcgatacataacgtgtctcaagaccaagatgcacagcgataatctgctccgcaatgacctgggaggaccctacagtcccaaccagccatctatcaatctgcactctcaggatctgctccagaactccccaaattctatgtctggcgtcagcaacaatccccagggaattgtagttcccgccagcgccctgcagcaaggtaacatagccatgaccacggtgaactcacaggtggtctctggtggcgccctctaccagccggtcaccatggttacctctcaggggcaggtggtgacacaggcaattccacagggcgctatccagatccaaaacacccaggtgaacctggatttgacctccctgctggacaatgaggataagaagtcgaagaacaaaaggggagtgctgcccaagcacgccaccaatatcatgcgatcttggctattccagcacctgatgcatccataccctacagaggacgagaagcggcagatagccgcccagacaaacctgactctcttgcaggttaataattggttcatcaacgctcgccggagaatcttacagcctatgctcgatgcctcaaatcccgatccagcccctaaggctaaaaagatcaaaagccaacaccgcccgacgcaaagattctggcccaacagtattgctgctggagtcctacagcagcagggcggggcaccaggaaccaaccctgatggtagcattaatctagataacctgcaaagcctctctagtgattccgcaacaatggccatgcaacaagccatgatggccgcccatgacgactcattggacggcacagaggaagaggatgaggatgagatggaggaggaggaggaagaagaactggaggaagaagtagatgaacttcagaccacaaatgtgtctgatctcgggttggaacactccgactctctcgagtag

SEQ ID NO: 198779 - DNA, 1332 bp, Artificial Sequence
  Description of Artificial Sequence: Synthetic coding sequence
atgaccgccaccgcccagccccccagcaaggcccaggccgtgcacatatctgcccctagcgctgccgcgtcaacccctgtacccagcgccccaattgatcctcaggcccagctggaggcggacaagcgggcagtgtatcgtcatcccctgtttcccctactgactcttctctttgaaaaatgcgagcaggctacacaaggttctgagtgtattacctccgcatcatttgatgtggacatagagaattttgtacaccagcaggaacaagagcacaaacccttctttagcgatgaccctgaactggacaacctgatggtgaaagccatccaagtgctccgcattcatctacttgagttggaaaaggtgaatgaattgtgtaaagacttttgtaatcgatacatcacttgcctgaagactaagatgcattctgacaacttgttgcgcaacgacttagggggcccatactcacctaatcagccgtccataaaccttcattcacaggatctgctgcaaaactcacccaatagcatgtccggggtctcgaataatccgcaggggattgtggtgcctgccagcgctctgcagcaggggaacattgcaatgaccactgtaaacagtcaagtcgtatcgggaggagccctgtaccagcctgtaaccatggtgacgagccaggggcaggtcgttacccaggctataccgcagggagcgattcagatccagaacacccaagtcaatctggaccttacaagtctcctggacaacgaggacaaaaaaagcaagaataaacggggagtgctgccgaagcatgccacgaacatcatgcggtcatggctgtttcagcacctaatgcatccctatcccacagaagacgaaaaacggcaaattgctgctcagactaatctgaccctcctccaagtcaacaactggtttattaacgcacggaggcggattctgcagcccatgttagacgcgtctaaccccgacccggcgcccaaggctaagaaaattaagtcccaacaccggcccacccagagattctggcccaattcaatcgctgccggtgtgctgcagcagcagggaggagcgcccggcaccaatcccgacggctcaattaacctcgataatctccagagcctgtccagtgattcagctaccatggctatgcaacaggccatgatggctgcgcatgacgattccctggatggaacagaagaggaggacgaagacgaaatggaagaagaagaggaggaagagctcgaagaggaggtggacgagttacagaccacaaacgtgagtgacctaggtttagagcattctgatagcctggaatag

SEQ ID NO: 198780 - DNA, 123 bp, Artificial Sequence
  Description of Artificial Sequence: Synthetic coding sequence
atgatgcagcacgccagccccgcccccgccctgaccatgatggccacacagaacgtgcctccgccgccctatcaggatagtcctcagatgacggccaccgctcagccgccttccaaggcctag

SEQ ID NO: 198781 - DNA, 921 bp, Artificial Sequence
  Description of Artificial Sequence: Synthetic coding sequence
atgatggccacccagaacgtgcccccccccccctaccaggacagcccccagatgaccgccaccgcccagccgccctcaaaggcacaagccgtccacatctcagctccctcagcagctgcatccactcccgtcccatcagcccctattgaccctcaggcccagctcgaagctgataaacgtgctgtctacagacaccctttgtttcctctcctgactctgctgtttgagaagtgcgagcaggcgacccagggcagtgagtgcattactagtgcctcgttcgacgtggatattgaaaattttgtgcaccagcaggagcaggagcacaagccctttttttcagacgatccagagctggacaacctaatggtgaaagccatacaagtcttgcgaattcatctgctcgaactcgaaaaagtgaacgaactgtgtaaagatttttgcaataggtacatcacatgcctaaagactaaaatgcatagcgataacttattgagaaacgacctaggcgggccctatagtcccaaccagccttctatcaatctgcattcacaagacctgcttcagaacagtccaaattcgatgtcaggggttagtaacaacccgcagggaattgtagtgcctgcttcagccctgcagcaaggcaacatagctatgacgaccgtcaacagtcaagtcgtatctgggggcgcactttaccagcccgttactatggtgacatcccaaggccaggtggtgacacaggcaataccacaaggcgccattcaaattcagaatacacaggtgaacctggatctgacctccctgctcgacaatgaggataagaaatctaagaacaaacgcggcgtcctaccaaagcatgcaacaaacattatgcgctcctggctgtttcagcaccacgcccccctgccacatggcggctag

SEQ ID NO: 198782 - DNA, 1227 bp, Artificial Sequence
  Description of Artificial Sequence: Synthetic coding sequence
atgagccggccccaccccacccggaccgcccaccggcaccccctgtttccactcctcacactgttgttcgagaagtgtgagcaggccacacagggatccgaatgtataacctcggcgagctttgatgtggacattgaaaattttgtccatcagcaggagcaggagcataaacctttcttctcagacgatccagagctggataacctcatggttaaggcaattcaggtgttgcgaattcacctgttagagttggaaaaggttaacgagctgtgtaaggatttttgtaatcgctacattacctgtcttaaaaccaagatgcattcggacaaccttcttaggaatgaccttgggggcccatatagtccaaatcagcccagcatcaatctacatagccaggaccttctgcagaattcacctaatagtatgtcgggcgtctctaataaccctcaagggatagtcgtccctgcttcagcactgcagcagggaaacatagcaatgacgacagttaattcccaggtggtctcaggaggcgccttgtatcagcccgtgaccatggtgacctcacagggacaagtggtaacccaggcaatccctcagggcgcgattcagattcaaaatacccaggtaaacctagacctgacatccctactcgacaacgaagacaagaagagcaagaacaaacggggggtacttcctaaacatgcaacgaatattatgagatcctggttattccagcacttgatgcatccttaccccacagaagatgagaaacgacagattgctgctcagaccaatctcaccctgttgcaagtcaacaactggtttatcaatgcgaggaggagaatactgcagcccatgctggacgcttcgaatccagaccctgccccaaaagccaagaagattaagtcacagcataggcctacccagcggttctggccaaatagcatcgctgccggcgtacttcagcaacagggcggcgctccaggaactaacccagacgggagcatcaatctggacaacctgcaatctctatccagcgactccgccaccatggcaatgcaacaggctatgatggccgctcacgacgactctctggatggcacggaggaggaagatgaagacgagatggaggaagaggaggaagaggaactggaagaggaagtggatgagctgcagaccacaaacgtttcagacctcggtcttgaacacagcgattctttggaatag

SEQ ID NO: 198783 - DNA, 297 bp, Artificial Sequence
  Description of Artificial Sequence: Synthetic coding sequence
atgatgcagcacgccagccccgcccccgccctgaccatgatggccacccagaatgtgcctccgccaccctatcaggactcaccacagatgaccgccaccgctcagcccccttctaaggcacaggcagtccatatttccgcgccaagcgcggcggccagcacgccagtcccctccgcaccaatagatcctcaggcgcagctcgaagccgataaaagggccgtgtacaggcaccctctgttcccactgctgacacttctgttcgagaagtgcgaacaggccacccaggggtcagagtag

SEQ ID NO: 198784 - DNA, 234 bp, Artificial Sequence
  Description of Artificial Sequence: Synthetic coding sequence
atgatgcagcacgccagccccgcccccgccctgaccatgatggccacgcagaatgtcccaccaccgccctatcaggattcacctcagatgactgctactgctcagccccccagtaaagcccaggccgtgcatataagtgctccatctgcagccgcttccacccctgttccctctgctccgatcgatccccaggcccagctggaagcagataagcgggccgtctatagatggtag

SEQ ID NO: 198785 - DNA, 990 bp, Artificial Sequence
  Description of Artificial Sequence: Synthetic coding sequence
atgacccgggacttcaagcccggcgacctgatcttcgccaagatgaagggctaccctcattggcccgcacgggtagatgaggtgccggacggcgccgtgaaaccgccaaccaacaagttgccgatttttttctttgggacacatgaaaccgcattcttggggccaaaagatatattcccttactcagaaaacaaagaaaaatatggcaagccgaataagaggaagggctttaacgaaggcttatgggaaatagacaacaatcccaaggtgaaattctctagccagcaagcagcgactaagcaatccaatgcaagcagtgatgtcgaggttgaggagaaggaaacttctgtgagtaaggaagacaccgaccacgaggaaaaggcctctaatgaggacgtgactaaagctgtggacatcactacaccaaaggctgccagaaggggcaggaaacgaaaggcagagaaacaggtcgagaccgaagaggccggggtcgtgactactgccactgccagtgtcaatctgaaggtctctcccaaacgagggcgtcccgccgctacagaagtaaagattcccaagccccgaggtcgccccaagatggtgaaacaaccctgcccgtcagaatccgacattatcaccgaagaggacaaatccaagaagaaaggccaggaggaaaagcagcccaagaagcagccaaaaaaagacgaggagggccaaaaagaagaagacaagccaagaaaagaaccagacaagaaagagggaaagaaggaggttgagagcaaacggaaaaacctcgctaagaccggggtgactagcaccagtgactccgaggaggaaggcgacgatcaagaaggggagaagaagcgaaaaggaggaaggaactttcaaaccgcacatcgacgcaatatgctgaagggccagcacgaaaaggaagccgcggacagaaaaagaaaacaggaggaacaaatggagactgaacactttgcactttag

SEQ ID NO: 198786 - DNA, 1002 bp, Artificial Sequence
  Description of Artificial Sequence: Synthetic coding sequence
atgacccgggacttcaagcccggcgacctgatcttcgccaagatgaaaggctatccccattggcctgctcgggtggacgaggtgccggacggggccgttaagccccctaccaataagttgcctattttctttttcggtactcatgaaacagccttcctggggcccaaagatatcttcccgtacagcgagaataaagaaaagtacggaaaaccaaataagcgcaaaggattcaatgaaggcctgtgggagattgataacaaccctaaggtcaaattttcaagccagcaggccgccaccaagcagtctaatgcatccagtgatgtggaggtcgaagagaaagagacttccgtctccaaagaagacaccgatcacgaggaaaaggccagcaacgaggatgtgaccaaggccgtggacattacgaccccaaaagcagccagacgagggagaaagagaaaggccgagaagcaggtggagacagaggaggctggcgtcgtgaccacggccacggccagcgtaaacctgaaagtgtccccaaaacgcggccggccagcagcaactgaggtgaaaattcctaagcctcggggacgacctaaaatggtcaaacagccttgccccagcgaatccgacatcatcaccgaggaggacaagtccaagaaaaaaggacaggaagagaagcagcctaagaaacagccgaaaaaggacgaggagggccagaaggaagaagacaagccgagaaaggagccggacaagaaagaaggcaagaaggaagtggaatcgaagaggaagaacttagccaaaactggagtgacatcaacatccgacagcgaggaggagggagatgaccaggagggtgaaaagaagcggaagggcggccgaaactttcagaccgcccatagacgcaatatgctgaaagggcagcacgaaaaggaggcagcggaccgtaaacgcaaacaggaggaacagatggagactgagcaccaaaccacatgcaatctgcagtag

SEQ ID NO: 198787 - DNA, 1593 bp, Artificial Sequence
  Description of Artificial Sequence: Synthetic coding sequence
atgacccgggacttcaagcccggcgacctgatcttcgccaagatgaaggggtaccctcactggccggcaagggtggacgaagtgccggacggggcagtcaaaccccctaccaataagctccccattttttttttcggcacccatgagaccgcttttctgggtccaaaggacatcttcccttattctgagaataaggagaaatacggcaagccaaacaaacgtaaagggttcaatgaagggctttgggaaatagataataacccaaaggtgaagttctcgtctcaacaagccgcaacaaagcaatcgaacgcgtcttccgatgttgaggtcgaggagaaggagaccagcgtatcaaaggaagacaccgatcacgaggagaaagcatctaatgaagacgttacaaaagcggtggacatcacaactccaaaggctgcccggaggggccggaagcggaaggctgagaagcaggtggagaccgaggaggccggcgtcgttaccaccgcaactgcctccgtcaatctgaaggtgtcacctaaacgcggaagaccagctgctaccgaagtcaagatccccaaacctagaggccgtccgaagatggtgaaacagccgtgcccaagcgagtcagatataattactgaggaggacaaaagcaaaaaaaagggacaggaggaaaaacagccaaagaagcaaccgaagaaggacgaggagggccagaaggaggaggacaaacctaggaaggagcccgataagaaggaggggaaaaaggaagtggaatccaagcggaagaacctcgccaagaccggggtgacgagtacctccgacagtgaagaagagggggacgaccaggagggcgaaaagaagcgtaagggtgggaggaactttcagaccgcacacaggcgtaatatgctcaaaggacaacacgaaaaggaggctgcggaccggaaacggaaacaggaggagcagatggaaaccgagcaacagaacaaagatgagggcaagaaacccgaggtcaaaaaagtagaaaaaaagagggagacgtctatggattccaggcttcagcgcatccacgctgaaatcaagaattcactgaaaatcgacaatctggacgtgaaccgatgtatcgaagcgcttgatgagctagctagcttgcaggtaaccatgcagcaggcccagaagcatacggagatgatcactacactcaaaaaaattcgcaggtttaaggtttcccaagtgattatggagaagtctacaatgttatacaataaatttaagaacatgtttctggttggagaaggcgattctgtgatcactcaagttctgaataaatctctcgcagagcagcggcagcacgaggaagctaacaaaacaaaggatcaaggcaaaaaaggaccaaacaaaaaactggaaaaagaacagactggatcaaagacactcaacgggggatccgacgcccaggacggcaatcaacctcagcacaatggcgagtctaatgaagactctaaagataaccacgaagcatctacaaagaagaaacccagctcggaagaaagggaaaccgaaatctctctaaaggacagcactctggacaactag

SEQ ID NO: 198788 - DNA, 1593 bp, Artificial Sequence
  Description of Artificial Sequence: Synthetic coding sequence
atgacccgggacttcaagcccggcgacctgatcttcgccaagatgaaaggatacccacactggcccgcccgcgtggacgaagtgcctgatggcgcggtaaagcctcctactaataagcttccaatcttttttttcggaactcacgaaactgcttttctggggccgaaagacattttcccttattctgagaacaaagaaaagtatggcaagcccaataaacggaaaggcttcaatgaaggcctgtgggagatcgacaataaccctaaggtcaaatttagttcccagcaggctgccaccaaacaatctaacgcgtcctccgacgtggaggttgaagaaaaggaaacgagtgtgtctaaagaggacacagaccacgaagaaaaggcaagtaatgaagatgtaacaaaagctgttgatatcacaacacctaaagccgcacggcggggacgtaaacgcaaagccgagaagcaggtggagactgaggaagcaggcgttgtcaccaccgccaccgcctctgtaaacctcaaagtgagccccaagaggggtcgccctgcagccacagaggttaaaattcccaagccacgtggtcggcctaaaatggtgaaacaaccgtgcccaagtgaaagcgatattatcaccgaagaagacaagagcaaaaagaaaggacaggaggaaaagcagcctaaaaaacagcctaagaaggacgaggagggacagaaggaagaggacaaaccaagaaaagagccagataagaaggaaggtaaaaaggaagtcgaatccaaaagaaaaaacctcgctaaaaccggagtaacttctacctctgactccgaagaagagggggacgatcaagagggagagaagaagcgcaagggcggtaggaacttccagaccgcccacagaagaaacatgctcaagggtcagcacgaaaaagaggctgccgaccgaaagcgtaagcaggaggaacagatggaaacagagcaacagaacaaagatgaaggcaagaagcccgaggtgaagaaggtggaaaaaaagcgggagacatctatggacagccggttgcagagaatccatgcagaaatcaaaaattctctaaagatcgataatttagacgttaacaggtgtatcgaagccctagatgagttagcgtccttgcaggtcactatgcagcaggcccaaaagcatacggaaatgatcaccaccctgaagaagattcgtcggttcaaggtgagccaggtgatcatggaaaaatcaaccatgctctataataagttcaaaaacatgtttctcgttggcgaaggggattccgtgattacacaggttttgaataagtctcttgcagagcagcgtcagcatgaagaagccaacaagacaaaggaccaagggaaaaaaggccctaataagaagctcgagaaggaacagacagggtcaaagaccctcaatggcggatccgacgcccaagacggcaatcaaccacagcacaatggggagtccaatgaagacagcaaagataaccacgaggcgtccacgaagaagaaaccctcctcagaggagagagaaactgagatctccctgaaggattcaactctcgacaactag

SEQ ID NO: 198789 - DNA, 1002 bp, Artificial Sequence
  Description of Artificial Sequence: Synthetic coding sequence
atgacccgggacttcaagcccggcgacctgatcttcgccaagatgaaaggctaccctcactggccagcgagagtcgacgaggtgcctgatggagccgtaaaaccaccaacaaacaagctccccatctttttttttggcacacacgagacagccttcctggggcccaaagatatctttccgtatagcgagaataaggaaaagtatgggaaaccaaacaaaaggaaaggatttaacgaaggtctctgggagattgacaataacccaaaggtcaagtttagcagccagcaagcagccaccaaacagagcaacgcttcaagcgacgttgaggttgaagagaaggaaacttcagtttccaaagaggatacagaccatgaagaaaaggctagcaatgaagacgtcaccaaggccgtggatatcaccactcccaaagccgccaggaggggccgaaaaaggaaagccgagaagcaggttgagactgaagaggccggagtggtcaccaccgcgaccgcgtcggttaacctcaaagtgtcaccaaaaaggggaagacctgccgccactgaggtcaaaatccctaaaccccgaggtaggcccaagatggtgaagcagccatgccccagtgaatctgacattatcaccgaggaggacaaatcgaagaaaaaaggacaggaagagaagcagccaaaaaagcagccaaaaaaagatgaagaggggcaaaaagaggaggacaagccaagaaaggagcccgataaaaaagaggggaaaaaggaagtcgagtccaaacgtaaaaatctcgccaaaacaggggtgacttctactagcgacagtgaggaagaaggggatgaccaggaaggtgagaagaagagaaaaggtgggcggaacttccagactgcccaccgccggaacatgcttaaggggcaacatgaaaaagaggccgccgaccggaagagaaagcaggaggagcagatggagactgaacaccagacaacatgcaacctacagtag

SEQ ID NO: 198790 - DNA, 1362 bp, Artificial Sequence
  Description of Artificial Sequence: Synthetic coding sequence
atggcccacatcaccatcaaccagtacctgcagcaggtgtacgaggctattgacagtcgggacggagcctcctgcgccgagctagtgtcatttaaacatccccacgttgctaatccgagactccagatggcgagtcctgaggaaaagtgccagcaggtactggagcccccctacgacgagatgttcgcagctcaccttagatgtacttatgctgtcgggaatcacgactttatcgaggcatacaagtgccagaccgtcatcgtacagtatcccttgtcctttatggcggccgtcccacatcggactcatgctgtcgactacctgggtttggagacccgcaagcactgggcctcatgttccttcttgcagctcgagagaaacgactctgtcctcgagcagaaactggtgtctgctctgtctctgggaacctctttccttcgggctttccaggcgcataaggaggaaaactgggctttacctgtcatgtacgccgttgccttggatttgagggtgttcgccaataacgccgaccaacagctggtcaagaaggggaagagcaaagttggagatatgcttgagaaggccgccgagttgctaatgtcttgcttcagagtgtgcgcttctgacacaagggccggtattgaagattccaaaaagtgggggatgctttttctggtgaaccagttgtttaaaatttactttaagattaacaagctgcatctgtgcaaacccctcatcagggcaattgatagctctaacctgaaggacgattattccacggcgcagcgagtaacatataaatactacgtgggacggaaagccatgtttgattctgattttaaacaagcagaagagtacctcagctttgcatttgagcactgccaccgtagctcgcaaaaaaataagcggatgatcttaatctatctcttgcctgtgaagatgcttctcggccacatgcccacagtcgagctgctgaaaaagtaccatctcatgcagttcgcggaagtgactcgtgccgtgtctgagggaaacctgctgttgctccatgaggctctcgccaagcacgaagccttcttcatcaggtgcggcatattcctgattctggaaaagctgaagattatcacatatcgaaacctttttaagaaggtatacctgctgctgaaaacacaccaattgtcccttgacgcttttctcgtggctttgaaatttatgcaggtagaagatgtagatatcgacgaggtccagtgtattcttgcaaatctgatatatatggggcacgtcaagggttatatttcacaccagcaccagaagctggtagtctcaaaacagaatccatttccgccattgtcgaccgtgtgctag

SEQ ID NO: 198791 - DNA, 1200 bp, Artificial Sequence
  Description of Artificial Sequence: Synthetic coding sequence
atgcggctgaccgacgtggtgcagcagctggtgtacgaggccatcgatagccgcgatggcgcatcttgtgcagagctggtgtctttcaaacaccctcatgtggcaaacccgaggttacaaatggcttctcccgaagagaagtgccagcaggtcctggagcctccatacgatgagatgttcgcagcccacctgcgttgtacttacgcagtgggcaaccacgattttattgaggcctacaagtgtcagactgtcatcgtgcaatataccagtttcttgagggcattccaggcacacaaagaggagaattgggcgctgccggtgatgtatgccgtcgcactcgacctcagagtgtttgcaaacaatgcagatcagcagttagtgaagaaaggcaaaagtaaagtaggggacatgctggaaaaagctgccgagttacttatgtcttgtttcagagtgtgcgcaagcgacacccgtgctggtatcgaagactccaagaagtgggggatgctgttcctggtcaaccagctcttcaagatttactttaagattaataaacttcatctctgtaagcccttgattcgagctatcgattcatcaaacctgaaagatgactatagcaccgcccagagggtcacttataaatattacgtgggcaggaaagccatgtttgacagtgattttaagcaggccgaggagtatcttagcttcgcatttgagcattgtcaccggtcctcacaaaagaataagcgtatgatactaatttacttgctgcctgtgaagatgctactgggccatatgcccacggtggaattactgaagaagtatcatttgatgcagtttgcagaagttacccgcgctgtctctgaaggaaacctactcctactgcacgaagcactggctaaacatgaggccttctttattagatgtggcatttttcttattctggagaagctgaagattattacctacagaaatttgttcaaaaaagtttacctgctgctgaaaacacaccaactaagcctggacgcctttcttgttgcacttaagttcatgcaggtagaggacgtggacatcgacgaagttcaatgcattcttgccaacctcatttatatgggccatgtcaagggatacatctctcatcaacatcagaaactcgtggtgtctaagcagaacccctttcctcccctctccacggtgtgttag

SEQ ID NO: 198792 - DNA, 1200 bp, Artificial Sequence
  Description of Artificial Sequence: Synthetic coding sequence
atggcccacatcaccatcaaccagtacctgcagcaggtgtacgaggccattgattcaagggatggcgcgtcttgcgctgagctcgtatcattcaagcatccacatgtcgccaacccccgcctgcagatggcaagtcccgaggagaagtgtcaacaggtgcttgaaccgccatacgatgaaatgttcgctgctcacctgcggtgtacatatgccgtaggtaaccacgactttattgaggcatataagtgtcagaccgtgatcgtacaatcctttctgcgtgcttttcaggctcacaaggaggaaaactgggcgctaccagtgatgtatgccgtggcactagacttaagagtgttcgctaacaatgccgatcagcagctggtcaagaaaggaaaaagtaaggtaggtgatatgctggagaaggccgcagagctgctgatgtcctgcttcagggtgtgcgcctccgacacccgagccgggatcgaagacagtaagaaatggggcatgttgttcttggtcaaccagctctttaaaatctattttaagattaataagctacacctttgtaagcccctcattagggccatagatagttcgaacttgaaggatgattacagcaccgctcagcgggtaacctacaaatattacgtgggtagaaaggctatgtttgacagtgacttcaaacaagcagaagaatatctttccttcgcttttgagcattgtcacaggtcatcacagaaaaacaaaaggatgatactcatctatctgctgccggttaagatgctcctgggccacatgcctacagtggaactgctaaaaaaatatcacctcatgcaattcgccgaagttactcgtgctgtgtctgagggaaatctattgttgctgcacgaagcactcgccaagcacgaggcattcttcattcgatgtggtattttcctgatactggagaaactcaagattatcacgtatcgcaatctgtttaaaaaggtttacctgcttctgaaaacacaccagttatcactggatgcattcctggttgctctgaagttcatgcaggtcgaagatgtagatatagacgaagtgcaatgtatcctcgccaatctgatttacatgggtcacgtgaaggggtacatctcccatcagcatcagaagctggtagtatctaagcaaaacccatttcctcccctgtcaactgtctgctag

SEQ ID NO: 198793 - DNA, 1131 bp, Artificial Sequence
  Description of Artificial Sequence: Synthetic coding sequence
atggcccacatcaccatcaaccagtacctgcagcaggtgtacgaggctattgactcccgggatggtgcttcctgcgccgaactcgtttccttcaagcacccccacgtggcaaaccctagactacagatggcgtctccggaagaaaagtgccagcaggtcctcgaacctccctacgacgaaatgtttgccgcccacttacgttgcacctacgctgtcgggaaccacgacttcattgaggcttacaagtgccagactgtgattgtgcagtaccctctgtccttcatggcggcagtagccgatcagcagctggttaagaagggaaaaagcaaggtgggagatatgctagagaaagctgcagagctgctgatgtcctgttttagagtctgtgcctccgatacacgtgcaggaatagaagatagcaagaaatggggcatgctctttctagtcaatcagctgttcaagatttattttaagattaacaagctccacctgtgcaagcctctgatccgagcgattgatagttcaaatctcaaggatgattactccaccgcccagcgagtgacctataagtactacgtagggagaaaggcgatgttcgacagcgattttaagcaggcagaggagtacttgtcttttgcatttgagcattgtcaccgatccagtcaaaagaataaaaggatgattcttatttacttgttaccagtgaagatgctattaggccacatgccaaccgtcgagctccttaagaagtatcatctcatgcagtttgctgaagtgactcgcgctgtgagcgagggcaaccttctgctgttgcacgaggcgcttgccaaacatgaggccttttttatccgctgcggcatttttttgatcctggagaagctcaaaattatcacttacagaaaccttttcaaaaaggtctacctgctgctgaaaacccatcagctaagtttggatgccttcttagtggccttgaagtttatgcaggtggaggatgtggacatcgacgaagtgcagtgcattttggccaatctaatatatatggggcacgtgaagggctatatcagtcaccagcatcagaagttggtagttagcaagcagaacccatttccccctctgagtaccgtatgctag

SEQ ID NO: 198794 - DNA, 1200 bp, Artificial Sequence
  Description of Artificial Sequence: Synthetic coding sequence
atggcccacatcaccatcaaccagtacctgcagcaggtgtacgaggccatcgattcacgcgatggagcaagttgtgccgagctggtctctttcaaacatcctcatgttgccaaccctcgactgcaaatggcctcacctgaggagaaatgtcaacaagttttagagccaccctacgatgagatgttcgcagcgcacctacggtgcacgtatgccgtggggaatcatgattttatagaggcttacaaatgccagactgtgatcgttcagtcttttctccgagcctttcaggcccataaggaggaaaattgggccttgccggtgatgtacgctgtggcgcttgatttacgcgtctttgccaacaatgccgaccagcaactggtcaagaagggcaaatctaaggtgggagacatgctggagaaagcagcggagcttctgatgagctgcttccgtgtctgtgcaagcgatacgagggctgggatcgaggactccaaaaagtggggcatgctattcctggtgaaccagttgttcaagatatatttcaaaataaacaagctgcatctctgtaaacctttgattcgagccatcgacagttccaaccttaaggatgactactcaactgcgcaacgagttacctataaatattacgtaggtcgaaaggctatgtttgatagcgacttcaagcaagcggaagagtacctatcattcgcctttgagcactgtcaccgcagctctcagaaaaataaacggatgatcctcatctacctgctccccgttaagatgctcctgggacacatgcctaccgtagaactcctaaaaaaatatcacctgatgcagtttgccgaagtgaccagagctgtgtcggagggaaacttattgctcctacatgaagcgctggcaaagcacgaagctttcttcataaggtgtggaatttttctcatcctcgagaagcttaagattattacataccgtaacttattcaagaaagtctatctactgcttaagactcaccaattgagtctcgacgcctttctagtcgccctgaaatttatgcaggttgaagacgtggacatcgacgaagtgcagtgcattttggccaacctcatctatatgggccacgtgaagggttatattagtcaccagcatcagaagctcgtggtgagcaaacagaaccctttcccccctttatccaccgtgtgctag

SEQ ID NO: 198795 - DNA, 1200 bp, Artificial Sequence
  Description of Artificial Sequence: Synthetic coding sequence
atggcccacatcaccatcaaccagtacctgcagcaggtgtacgaggccatcgattcccgggacggggccagctgtgccgaactcgtgtctttcaagcacccccacgtggcgaacccgaggctccagatggcgagtcctgaggagaaatgtcagcaggtccttgagcccccctacgacgagatgttcgccgcccatctgcggtgtacctacgctgtcggaaatcacgattttatcgaagcgtataaatgccagaccgtgatcgtgcagtccttcttaagggccttccaggctcataaagaggagaattgggcccttcctgtgatgtatgccgtggcactggatctgcgagtcttcgcaaacaatgccgatcaacagttagttaagaaaggcaaatcaaaagttggcgacatgttggagaaggcagcagagctgcttatgtcttgcttcagagtatgcgcgtccgatacaagagccgggattgaggactcaaagaagtggggcatgttgtttctcgttaatcagctgtttaagatctattttaagatcaacaagttacacctgtgcaaaccgttgattcgggcgatcgactcgtcaaacctcaaggatgactatagcacagctcagagggttacatacaagtattacgttggtagaaaggcgatgttcgatagtgattttaagcaggccgaagagtatttgtccttcgcttttgagcactgtcaccggagttctcagaaaaataagcgtatgatattaatctacctgctcccagtgaaaatgcttctggggcacatgcccaccgtcgagcttttgaaaaaataccacctgatgcagttcgctgaagttactagggctgtatctgaggggaatctgctcctgctgcacgaagcccttgctaaacacgaggccttcttcatcagatgtggcatctttttaatattggaaaaactcaagattatcacgtataggaatctcttcaagaaggtatatctcctgctaaagacccaccagctgtccttggatgcctttcttgttgccctcaaatttatgcaggtggaggatgtcgacatcgacgaggtgcaatgtatactcgccaatctgatttatatgggacacgtaaaagggtatatatctcaccagcaccaaaaattggtggtgtccaaacagaatccatttccacctctgtctactgtctgttag

SEQ ID NO: 198796 - DNA, 1194 bp, Artificial Sequence
  Description of Artificial Sequence: Synthetic coding sequence
atgcggctgaccgacgtggtgcagcagctggtgtacgaggccatcgattcacgcgatggtgcatcttgcgccgagttagttagctttaaacatcctcatgtggctaaccctcgtctccagatggccagtccggaggagaagtgccagcaggtcctcgaacctccttatgacgagatgttcgcggcccatctccgctgcacctatgcagtgggtaaccatgacttcattgaggcgtataagtgccagacggtcattgtgcaaagtttcctgagagccttccaggcccacaaagaggagaattgggctcttcctgtgatgtacgctgtcgcactcgacctaagagtgtttgccaacaacgccgatcagcagctcgtgaaaaaaggcaaatctaaggtcggggatatgttggaaaaggccgccgagcttttgatgagctgttttagagtttgtgcaagcgatacccgggccggcatcgaggatagcaagaagtgggggatgctttttctggtaaaccaactgtttaagatatattttaagattaacaagttacacttatgcaaacccctcattagggccatcgatagctccaatttgaaagacgattattccacggctcagagagttacttacaagtactatgtaggacggaaagcgatgttcgattccgactttaagcaagcggaagaatatctatcatttgccttcgaacattgtcaccgctcatcacagaaaaataagcgtatgatcctgatttatctgctacctgtgaagatgttactgggccacatgccgaccgtggagctgctcaagaaataccacctgatgcagttcgctgaggtgacgcgcgctgtttcagagggcaatttactgctgcttcacgaggcactagctaaacacgaggctttttttataaggtgtggcatttttcttatattggaaaaactgaaaattataacctataggaacctgtttaagaaagtctatttactgcttaagacacatcaactttcgctggacgcttttctggtggccctgaagtttatgcaggtagaagatgtcgacatcgacgaagtgcagtgtatactagccaatctgatctatatgggccacgtgaaagggtatataagtcatcaacatcagaagctggttgttagcaaacagaacccctttcctccactttccactgtgtgctag

SEQ ID NO: 198797 - DNA, 546 bp, Artificial Sequence
  Description of Artificial Sequence: Synthetic coding sequence
atgcccaagggcggccggaagggcggccacaagggccgggcccggcagtacacgtcaccggaggagattgatgctcagttacaagccgaaaaacagaaggcacgagaagaagaggagcagaaagaaggtggcgatggcgcagccggagatcccaagaaagaaaagaaatctcttgactcggacgagtccgaggacgaggaagacgattatcagcaaaagagaaagggtgtggaggggttgattgacattgagaacccaaaccgcgtggcccagactaccaagaaagtgacacagctggacctggacgggccgaaggaattgtctagaagagagcgcgaggaaatcgagaaacagaaagccaaagaaagatatatgaaaatgcacctcgccggaaagacagaacaggccaaggcggacctggctcggcttgctatcatccgaaagcaacgagaggaggctgcaagaaaaaaggaggaggagaggaaggccaaggacgacgcgactctgtccggcaaacgtatgcaatccttgtcactcaacaagtag

SEQ ID NO: 198798 - DNA, 1026 bp, Artificial Sequence
  Description of Artificial Sequence: Synthetic coding sequence
atggtgagcagccagcccaagtacgacctgatccgggaggtgggcaggggaagttacggagtcgtgtacgaggccgtcatccggaaaacatctgctcgggttgcggtgaaaaaaatccgctgccacgccccggaaaatgtggagctagcgctgcgagagttctgggctctttcttccattaaaagtcagcatccaaatgtgatccacctcgaggagtgtattctgcagaaggatggaatggttcagaagatgtcccatggctctaactcctctctttacctccagttagtggaaacaagtctcaagggggaaatcgccttcgatcctcggtctgcttactacctctggtttgtgatggatttctgtgacgggggagatatgaatgagtacctccttagcagaaagccgaaccggaagactaatacttcctttatgttgcagctgtcttcagctttagcttttctgcataagaaccaaattattcaccgcgacctcaagcccgacaatatactaatctctcagactcgactggatacaagcgacctggagccaaccctcaaggtagccgactttggattgagtaaggtttgctccgcttcgggccagaacccagaggagccagtctctgtgaacaaatgctttttatccactgcttgcggaacagacttctacatggcccccgaagtgtgggaagggcactataccgctaaggccgacatcttcgccctaggaattatcatctgggcaatgttagaacggatcacctttattgataccgaaaccaaaaaagagctgttgggctcatacgtcaagcaaggtaccgaaatcgtgccagtcggtgaagcgctgttggaaaaccccaagatggaacttctcatccccgttaagaagaaatccatgaacggaaggatgaaacagttaataaaggaaatgctcgccgccaatccgcaggatcggccggatgcttttgagctggaactgaggcttgtgcagatcgccttcaaggacagctcatgggagacttag

SEQ ID NO: 198799 - DNA, 1026 bp, Artificial Sequence
  Description of Artificial Sequence: Synthetic coding sequence
atggtgagcagccagcccaagtacgacctgatccgggaggtgggcagaggcagttacggtgtagtgtacgaggctgtaatacggaaaacctctgccagagttgcagtcaagaagatcaggtgccacgcccctgaaaacgtggaactggccctgcgggagttctgggccttgtcttccatcaagtcccagcacccaaatgttatccacctggaggagtgcattctacaaaaagacggtatggttcagaaaatgagccatggctcaaattcttcattgtatctccagctcgtcgaaaccagccttaagggagagattgcctttgatcccagatctgcctattatttgtggttcgtgatggatttctgcgacggaggcgatatgaacgagtacctgttgtcaaggaagccaaatcggaagacaaacacttcctttatgctgcagctgagcagcgccctggctttcctccacaagaatcagattattcacagagacttgaagcccgacaacatcctgatttctcagactagattagatacaagtgacctggagcctacgcttaaggtggccgatttcggtctatccaaagtgtgctcagcaagtggtcaaaatcctgaggagccagtttctgtcaacaaatgtttcttgtcaactgcctgtggcacagacttctacatggctccagaggtgtgggaggggcactatacagccaaggccgatatttttgctctagggatcataatctgggccatgctcgagagaatcacgtttattgacacggagaccaagaaggagcttctggggagctacgtgaagcaggggacagagatagttcctgtgggagaggcactgctagagaaccctaaaatggaattgttgattcccgtgaaaaagaaaagtatgaatggacgcatgaaacagcttattaaggaaatgctggcggccaacccgcaggacaggccagacgcattcgagctggagcttaggctggttcagattgctttcaaggatagttcctgggagacttag

SEQ ID NO: 198800 - DNA, 576 bp, Artificial Sequence
  Description of Artificial Sequence: Synthetic coding sequence
atggtgagcagccagcccaagtacgacctgatccgggaggtgggcagaggatcctatggcgtggtctatgaagctgtgattcgaaaaacatcagcccgcgtggcagtcaagaagatcagatgccatgcacctgaaaacgtggagctagcgttacgcgaattttgggccctatctagtatcaaaagccagcatcctaacgtaattcacttggaagaatgcatcctccagaaggatgggatggtgcaaaaaatgtcccatgggtccaactcctcactatacctgcagctggtcgaaacgagtctcaaaggagaaattgctttcgatccccgatcagcttactacctttggttcgttatggacttttgtgacggcggtgatatgaatgaatacctactgagtcggaaacccaatcgcaaaaccaatacttctttcatgctgcagctgagttcagccctcgcatttttgcataagaatcagatcattcacagagatctgaagccagataacattctcatcagtcagacgagactcgatacatccgacttggaaccaaccttgaaagtcgccgatttctag

SEQ ID NO: 198801 - DNA, 4014 bp, Artificial Sequence
  Description of Artificial Sequence: Synthetic coding sequence
atggacttcaccgcccagcccaagcccgccaccgccctgtgcggcgtagtgtcagccgacggaaagatcgcctacccgccaggggtcaaagagatcaccgacaagatcacaaccgacgaaatgattaagagactgaagatggtggtgaaaacctttatggacatggaccaggattccgaggacgaaaagcagcagtatctaccactcgcgttgcacctggcctccgaattctttctacggaaccctaacaaagatgtgcgattgttagtggcgtgttgcttggctgacatattcaggatttatgctcccgaggctccatatacctctcacgataaactgaaggatattttcctctttatcacccgacaactgaagggcctggaggacacgaaatcacctcagttcaatcgttatttctatctgctggagaatctggcctgggtcaagagttataacatttgttttgaactggaggattgtaatgaaatcttcatccaactctttagaactctcttttcggtcatcaataatagccataacaagaaggtccagatgcacatgctggaccttatgtccagtattattatggagggcgacggcgtgactcaggagctccttgatagcatcctgattaacctcatccctgctcataagaatctcaacaagcagagctttgatttagctaaggttctcctaaagaggacagtccagacaatagaggcgtgtatcgctaactttttcaatcaggtgctagtgcttggcaggtcatcagtgtctgatctttcagagcatgtctttgatctgattcaagaactgtttgccattgatccccatctgcttctttctgtgatgccccagctggagttcaagctcaagtctaatgacggagaagagcggttggccgtagtgcgccttttggccaagcttttcggcagcaaggactcggaccttgctacacagaacagacccctctggcagtgttttctaggccggtttaatgatatacacgtacctgtcaggctcgaatcggtcaagttcgccagccattgtctaatgaatcacccggacctcgcgaaggacttaactgagtaccttaaggttagaagtcatgatcctgaggaggctatcaggcatgatgtgatcgtgactataatcacggcagcgaagcgcgatctcgctttagtcaacgatcaactgttagggttcgtgagggaacggactctggacaagcgctggcgcgtacgcaaggaggcgatgatggggctcgctcagctgtacaagaagtactgtttacacggcgaagctggcaaggaggccgccgaaaaggtgtcttggattaaggataagctactgcatatttattaccaaaacagtatagatgacaagctgctggtggagaaaatttttgcccagtatctcgtaccccacaacctggagacggaagaaagaatgaaatgtctgtattacttatacgcatcattggatccgaatgctgtgaaagctctgaacgaaatgtggaagtgccagaatatgctaagatcacacgtacgagagttgttagatttgcataagcagcccacgtcagaagctaactgtagcgcaatgttcgggaaactgatgactatcgcaaagaatctccccgatcccggaaaagcccaggactttgtgaaaaaatttaatcaagtgctgggagacgacgagaaactgcgtagtcagctggaactgctgatctctcctacttgcagttgcaagcaggcagacatttgtgtgagagaaattgccaggaaactggctaatcctaagcaacctacgaacccttttttagagatggttaaattcctcctggagcggattgcccctgtgcatatagatagtgaggcaatatcggccctggtgaaattaatgaataagtccatagaggggaccgctgatgatgaggaggagggagtgagccccgataccgccattaggtctggcctggagctgttgaaagtgttgagcttcacacacccaacaagctttcattcagctgagacttacgaaagtctgctgcagtgcctcagaatggaggacgacaaggtggccgaggccgctatacagatcttccggaatactggccacaagatcgaaacagatctgccacagatacgctcaacactgattcctatcctccaccagaaggcaaagagaggcacaccacaccaagccaaacaggccgtgcactgcatccacgccatctttaccaataaggaggtccagctggcacagattttcgagcctctctccaggagcttgaatgcagatgtcccagagcaactcattacccccctggtgagtctcggacatatctccatgctggcccccgaccagttcgcatctccgatgaagtccgtggtggcaaatttcattgtgaaagaccttctgatgaacgaccgaagcactggtgaaaagaacggcaaactatggtcccctgacgaagaggtgagccctgaagtcctcgccaaggtacaggctattaaactgctagtacggtggcttctgggaatgaaaaataaccagtcaaagtccgctaactcgactttgagacttctatccgcgatgcttgtttctgagggcgatttgaccgaacaaaagcggataagcaagagcgacatgtctcgtctacgcctggccgccggatccgcaatcatgaagctagctcaggagccttgttatcacgagataatcacgcccgagcagtttcagctctgcgcactggtgattaatgacgagtgctaccaggttcgacaaatctttgctcagaagctacacaaggctctcgttaaactcctacttccacttgagtatatggcgatttttgcgctgtgtgccaaggaccccgtaaaggaacgacgggcacacgccagacaatgtttgctgaagaatatttctatacgcagagaatacattaagcagaaccccatggcaacagagaagctcttgtccctgctccccgagtacgttgtgccttacatgatccatttgctggcacacgacccagattttactcggagccaggatgtggaccagctgcgtgacatcaaagagtgtctctggtttatgctggaggtactgatgacaaaaaatgagaataactcccatgctttcatgaaaaaaatggcagagaatatcaagctgacccgagatgcccagtcccccgacgagagcaagacaaacgagaagctgtacaccgtttgtgacgtggccctctgtgttattaattccaaatccgcgctgtgcaatgcagactccccaaaggaccccgtacttccaatgaagttctttacccaacctgaaaaggacttttgcaatgacaaatcctacatatcagaggagacgagggttctgttactgactggtaaacccaaaccggcgggcgttctgggcgcagtaaataagcccctgtccgctacagggagaaagccttatgtccgaagtacaggtaccgagactggatcaaatatcaatgttaacagcgaactaaacccttctactgggaaccggtctcgggagcagtcaagtgaagccgcagaaaccggagttagcgaaaacgaggaaaatccagtgcggatcatctccgtcacacccgtgaagaatatcgatccagtgaagaacaaggagatcaactcagaccaggccacccaggggaatattagcagcgatcgtggaaagaaacgaactgtgacagccgccggtgccgagaacatccagcaaaagaccgatgaaaaagtggatgaaagtggtccgcccgctcccagtaaacctcggagggggaggcggcccaaaagtgagagtcagggaaacgccaccaagaatgatgatctcaacaaacccatcaacaaggggcggaagagggctgccgtaggtcaagaatcccctgggggcctcgaggcggggaatgccaaagcacctaaactacaggacctcgctaagaaggccgctcctgctgagcgccagattgacctacagcgatag

SEQ ID NO: 198802 - DNA, 1803 bp, Artificial Sequence
  Description of Artificial Sequence: Synthetic coding sequence
atggacttcaccgcccagcccaagcccgccaccgccctgtgcggcgtggtgagcgccgatggcaagatagcctatcctccaggcgtgaaagagattacggataaaattaccacggatgagatgattaagaggttaaaaatggttgtgaagacctttatggatatggatcaggatagcgaggatgaaaaacagcagtatctccctttggcccttcacctggcttctgaattttttctgcgaaacccgaacaaagatgtgcgactcctagtggcctgttgcctggccgatatcttccgtatatacgctcctgaggcaccatacacgtcccatgacaaactcaaggacatcttcctcttcattacacgccagctgaaaggcttggaggacaccaaaagtccacaatttaaccgttacttctatctgctggagaaccttgcctgggtgaaatcgtacaatatttgttttgaactagaggattgtaacgaaatttttatccaactgttcagaactctttttagtgtcataaacaactctcacaacaagaaagtgcagatgcatatgctggatcttatgtcaagcatcatcatggagggcgatggtgtgacccaggagctcttagactccatcctgatcaaccttattcctgcccacaagaacctgaacaaacagagctttgatttagccaaagtgctccttaaaagaactgtgcagaccattgaggcctgtatcgctaactttttcaatcaggtcttggtcctgggcaggagctccgtaagcgacctttcagaacacgtgttcgatctgatccaggaactcttcgccatcgacccccacctcctgctgagtgtcatgccccaactcgagttcaaactgaaatccaatgatggcgaggaaagactcgctgttgtacgtttattggccaagttatttggcagcaaggacagcgacctggcaactcagaatcgccccctctggcagtgttttttggggcgattcaatgatatacacgtccccgtcagattagagtctgtgaagtttgcaagccactgcttgatgaatcaccctgatctggctaaggacctgaccgaatacctcaaggtccgcagtcacgatcccgaagaggctataagacacgacgtaattgtaactataataaccgcggcaaagcgcgatctcgccctggtgaacgaccagttactgggatttgtcagagagcgcactttggacaaaagatggagggtccgcaaggaagccatgatgggtcttgcacagttatataagaagtactgtctgcacggagaggcgggaaaagaggccgccgagaaggtctcctggatcaaggacaagttgttgcatatctactatcagaatagcattgacgacaagctgttggttgagaagattttcgctcagtatcttgtcccccacaacctcgagacagaggaaaggatgaagtgtctgtactacctgtacgcgtctctggatcctaacgccgtgaaggccctaaacgagatgtggaaatgtcaaaacatgctcaggtcgcacgtccgcgagctactcgacctgcacaagcagccaaccagcgaggctaactgctctgccatgtttgggaagttgatgactatcgccaagaacctgccggacccaggcaaagcacaggacttcgtgaagaagttcaaccaggtgctgggagatgacgaaaaattgcgcagtcagctggaactcctaatatcgccaacttgtagttgtaagcaggctgacatctgtgtcgttagcaaaagctacttcacattgtttctttag

SEQ ID NO: 198803 - DNA, 990 bp, Artificial Sequence
  Description of Artificial Sequence: Synthetic coding sequence
atgaccacccagcagatcgacctgcagggccccggcccctggggcttccgcctagtgggtggcaaggactttgaacaacctctcgcgatttcaagagttacccccggctcaaaagcagctctcgctaacctgtgtataggggacgtcatcacggccatcgacggcgaaaatacatcaaacatgacgcacctggaggcccagaaccggattaaggggtgtaccgataacctgacattaacagttgcccggtctgagcataaggtctggagcccacttgttactgaggaagggaaaaggcacccttacaaaatgaatctcgcctccgagccccaggaagtgctgcatattggttcggcccacaatcgcagtgcgatgcccttcacagcctctccggcaagttccaccaccgccagggtgattacaaaccaatacaacaatccagctggcttgtactcttctgagaatatttctaactttaataatgccttggagagtaagacggcagcttctggcgtcgaagcaaactcgaggccactggaccatgctcaacccccatcctcccttgtgatcgacaaggagtcagaagtgtataaaatgctgcaagagaagcaagaactcaatgagcccccaaaacagtcaacttcctttctggttctgcaagaaatcctggagtctgaagaaaagggcgatcccaataagccaagcgggttccgctctgtgaaagcccctgttactaaggtggctgctagcatcggtaatgcccaaaaactgcctatgtgtgacaagtgtgggacgggaatcgtaggtgtttttgtcaagctcagggaccgacaccgccatcctgaatgttacgtgtgcactgattgcgggaccaacttgaaacagaaggggcatttttttgtggaagatcaaatctactgtgaaaagcacgcccgagaacgcgtgacccctccggaggggtacgaagtggttactgtcttcccaaagtag

SEQ ID NO: 198804 - DNA, 1101 bp, Artificial Sequence
  Description of Artificial Sequence: Synthetic coding sequence
atggccctgaccgtggacgtggccggccccgccccctggggcttccggataacaggcggccgggattttcataccccaatcatggtgaccaaagtggcagaacgaggcaaagccaaggacgctgatttgagaccaggagacatcatcgtagcaatcaacggagaaagcgcagaagggatgctgcacgctgaggcacagagcaagatccggcagtcacccagcccacttcgactgcaattggaccggagtcaggccacctccccaggacagaccaatggggacagcagcctggaggtgcttgccacccgcttccagggatccgtcaggacctacactgagtcgcaatcaagcctgagaagcagttactcctcacctacatcgctctctcctcgcgccggctctcctttttcccccccacccagtagcagctccctcaccggagaggcagcgatttcaagaagcttccagtccctagcatgtagtcccggtctgcctgctgccgaccggctgagctactccggccggccgggaagcaggcaagctggcctggggcgcgccggcgactccgccgtgcttgttctgcctccatcccccggaccacgcagcagccggccttctatggattctgaaggagggtctctgctgctcgacgaggatagcgaggtattcaagatgctgcaggaaaatcgcgagggcagggctgcaccccggcagagcagttctttccgcctgctgcaagaggccctggaagctgaagagagaggggggaccccagcttttcttccttcatcgctgtccccgcagagctcactcccagcctcccgggcactggccactcctccaaagctgcacacctgtgaaaaatgttctacctctatagccaatcaggcagtgcgaatccaggaaggtagatacaggcatcccgggtgctacacatgtgcagattgcgggctgaatcttaagatgagaggccacttttgggaagatgcatgcgctatggagggcatgcgcctcagccttgaggctctggagggcatggtggagggcgcgaaacgtagagataggagaaaaacaagacggccaatccagccttcatggtag

SEQ ID NO: 198805 - DNA, 1809 bp, Artificial Sequence
  Description of Artificial Sequence: Synthetic coding sequence
atgcggggcggccgggcccggcccgcctgggagagcttcatgggcctgccacctaggagtagcgccaagtggggggctgggcaatcactggacaggctctgctgtgccccgggctcaagaggtttggctggcgcaccaggacgcatgcgtgcccctccagctggaaggtctcagccagctgggggacccggagattcacttccccacccacctgggggcctgggcccgggaggctccgcgtgggctcggcgagccgaggccgcagcttctagggctcgaggcggtggccgtggcgggcccggtatcacttgggccgaggctggtcctggcgccccagggggattgtctcctgagagtggtcgcaggcagagagagcgctggaggctccctgccttcccgccttcaagggcatgggctccctctcgtacaggtgagaggcagcccggggagcgcgcgcacctcagactgtccgcccggccggcactgcctggagccggactgctatcagccccattgagtgcaaggaaccccggattggttagagggccagcaccctggagcctcgcaagtgccggagcgccgccccgcgcagccctgagtcctgccggggccctgctacttcagcctcccgcgcggagagtcttatgcccaagatcagagggcgggagtcgaactgggcgggccgggccgagcggctgggcgccacctcgcggtgccaggagcgcggagtctactgacaggctcaaaggcatggccttaacagtcgatgtggctggacccgctccatggggctttaggattactggcggacgtgacttccacacccctattatggtgaccaaagtggccgagagaggtaaagccaaggatgcagatttgcgacctggggatatcattgttgccattaatggggaatccgcagaggggatgctccatgccgaggcccagagcaagatacgacaatctcccagcccattaagactacagcttgaccggagccaggccactagcccaggccagactaacggagattcctctttggaggtgctggccacccggtttcaaggaagcgttcggacttacacggagagccagtcatccctgcggtcctcatacagctcacctacgtctctgtcccccagggctggcagccctttctcacctcctccttcatcttcaagtctgacgggcgaagcagccattagccgaagttttcagtcgctagcttgttcaccagggctgcccgcagcggataggttgagttatagtgggcggccaggtagccgccaggctggcttgggaagagccggggactctgcagttcttgtcctccccccatctccaggcccacgaagcagcaggcccagtatggacagcgaagggggatctttactgctcgacgaagactccgaggtctttaaaatgttgcaggaaaaccgagaaggcagggctgccccccggcagagttccagctttcggttattacaggaggctctggaggcggaggaacggggaggaacccccgcatttctcccaagcagtctgtcaccacagtcctctcttccagcgtctcgtgcgttagctacccctcccaaactgcacacgtgtgagaaatgttctacctctatcgcaaaccaggccgttcggattcaagagggcaggtataggcacccggggtgctatacttgcgccgattgcgggttgaacctcaagatgcgggggcatttctgggtcggggacgagctctactgtgagaagcacgcccgacagcgatattcagcccccgcgactttgtccagcagggcatag

SEQ ID NO: 198806 - DNA, 837 bp, Artificial Sequence
  Description of Artificial Sequence: Synthetic coding sequence
atggccctgaccgtggacgtggccggccccgccccctggggcttccggatcacagggggcagagatttccacacgccaataatggtgacaaaagtggctgagcgggggaaagcgaaggacgcagaccttagacccggcgatatcatcgtagctatcaatggagagtccgccgagggcatgctgcatgccgaagcacagagtaaaattagacaaagtccgtcccctttacgactccagctggatcgctctcaggctacttccccaggacagacaaatggtgattccagtctggaggtgctggctaccaggttccagggtagtgtgcggacttataccgagtcccagtccagcctcagatcttcttacagctctcctacttcgctgagtccaagggctgggtcaccattttctccaccaccaagcagtagcagcctgaccggcgaggcagcaatcagcagatctttccagtcactcgcctgtagccccggattacctgctgccgatagactgtcatacagcggaaggcctgggagcagacaggcaggactgggacgggctggcgacagtgctgtgttggtgctgcctccaagtcctggacctagatcttcacggccgagcatggacagcgagggagggtcactgctgctggacgaggactccgaagttttcaaaatgttacaagagaatagagagggtagggcggctccccggcaatctagttctttccgcttgctgcaggaagccttagaggccgaagaaagagggaccaggttgtgtgccagccgcagagccggtactgctactccagctgctacaccagtgcccaccgtgggttag

SEQ ID NO: 198807 - DNA, 675 bp, Artificial Sequence
  Description of Artificial Sequence: Synthetic coding sequence
atggccctgaccgtggacgtggccggccccgccccctggggcttcaggatcactgggggccgtgatttccacacaccaatcatggttacaaaggtcgctgagaggggcaaagccaaagatgcggatctgaggccaggggatataatcgtcgccattaatggagagtctgctgaaggcatgttacatgctgaagctcagagtaaaattagacagtcccccagtccgctcaggctgcagctcgatcgaagccaggccacaagccccgggcagacaaatggcgactcctctctcgaagtgctcgctactcgttttcaaggatcagtgaggacctatacagagtctcagtcatccctgcgatcatcatactcttcccccacaagcctgtccccaagagccggatccccgtttagcccaccaccaagcagctcttcgcttacaggcgaggctgcaatatcgcggagtcgacctagaccacgctggagattaggcggcgccggagccgctgcctttcccgggccctcctttttgcaggcccagcacggtttaggtcgcgggaaaccccccccaggacgcggccttggtagcctgcaggacgctgctgggaagagccgggggaccggtggacctccaacggtccagctgctgtccgctcttgctgggtctcccggtggttag

SEQ ID NO: 198808 - DNA, 1059 bp, Artificial Sequence
  Description of Artificial Sequence: Synthetic coding sequence
atggccctgaccgtggacgtggccggccccgccccctggggcttccgaatcacaggcgggcgagacttccatactccaataatggtgacgaaggtagccgaaaggggcaaggctaaggacgcagaccttcggcctggtgacatcatcgtagccattaatggggagtcagcagaaggaatgctgcacgccgaggctcagtctaagatcagacagtctccgagccctctgcgcctacagctggacagatcccaggccaccagtcccgggcagaccaacggtgactcttcccttgaggtactcgcaactcgcttccaggggagcgttagaacatacaccgagagccagtcaagtctgcggtcatcatattccagccccacttctctgagtcccagggctggctcaccattcagcccacccccttcttcgagctcactgaccggggaggctgcgattagcagatctttccaaagcttagcgtgtagcccagggctgcctgcggcagatagactaagctacagcggtcggcctggaagtagacaggccggcctggggcgggcaggcgactccgccgtgttagttcttcccccctcaccggggccgcgatctagtagaccctccatggactccgaaggggggtcacttttgttggacgaagattccgaggtgttcaagatgctacaggaaaaccgcgagggccgagccgcgccaaggcagtcttcttcattcaggctcctacaagaggcgctcgaggccgaagagaggggcggtaccccagcctttctgccctccagcctaagccctcagtctagcctgcccgcctccagagctctggcgacacctccaaagctgcacacctgcgagaagtgctctaccagtattgccaaccaagccgtgagaatccaggaagggaggtaccgccatcccgggtgctatacttgcgcggactgcggtttaaacctcaagatgcgggggcatttttgggtaggcgatgagctgtactgcgagaaacacgcaagacagaggtactctgctcctgcaaccctgtcttcacgtgcttag

SEQ ID NO: 198809 - DNA, 1059 bp, Artificial Sequence
  Description of Artificial Sequence: Synthetic coding sequence
atggccctgaccgtggacgtggccggccccgccccctggggcttccgcattacagggggaagagatttccacacgcccattatggtgactaaggttgccgagcggggtaaagctaaggatgctgatcttcgccccggagacatcatcgtggctataaatggcgagagcgccgaagggatgttgcatgcggaagcgcagagtaaaatacggcagtcacctagtcccctgcgactccagcttgatcgcagtcaggcaacttccccaggtcagacaaatggtgattcaagcttggaggtgcttgccacccgcttccagggatctgtgaggacatacactgaaagccagtcgagtctccgctcgagctatagctctcctacatccttaagccctagggccggtagccctttttcccctcctcctagttccagctcgctcacaggcgaggcagctatttcccgatctttccagtccctggcgtgcagcccaggcctgcctgccgcggacagactgtcctactcaggacggcctggctcccgacaggcgggcctgggcagagcaggagatagcgcagtgctggttctgccaccctcccctggtcctagaagcagtagaccctctatggatagcgaaggcgggtcccttctacttgacgaggactccgaagtgtttaaaatgttgcaagaaaacagagaaggccgcgccgccccgcgacagtctagtagcttccgcctgctgcaggaagccctggaggctgaggagcgaggcggcacgccagcgtttctccctagctccctgtctccgcagagctctctccctgcctcccgcgcccttgcgacccctccaaagcttcatacatgtgagaaatgtagtacctctattgcgaatcaggcagtccgtattcaggaggggagatatcggcatcctgggtgttacacgtgcgccgactgcggtctcaatctgaagatgcgcgggcacttctgggtaggggacgagctctactgtgagaaacacgcccggcagaggtattctgcacctgctaccctctctagccgagcttag

SEQ ID NO: 198810 - DNA, 837 bp, Artificial Sequence
  Description of Artificial Sequence: Synthetic coding sequence
atggccctgaccgtggacgtggccggccccgccccctggggcttccgaatcaccggtggtcgggattttcacacgccaatcatggtgacaaaagtggctgaacggggcaaggccaaagatgccgatctgaggccgggcgatatcattgtcgcaatcaatggtgagtcagctgagggtatgctccatgccgaagctcaaagtaaaattcgacaaagcccctcacctttacggctccagttggataggtctcaggctacctctccagggcaaaccaatggggactcatctctagaggtgctagccacacgtttccaaggatcagtacggacatacactgaaagtcaaagtagcctgcgaagttcctactcgagccccacatccctgtctcctagggccggatctccattctccccccctccctccagctcttcgctgacaggtgaggctgccatctcccggagctttcagtctctggcatgctcccccgggctacctgcagctgacagactctcttactcgggccggcctggaagccgccaggctggattggggagagccggagatagtgcagtgctggtgctgccccccagccctggtcccaggagctcaagaccgagcatggacagtgaaggtggctcactgctcctagacgaggactccgaagtttttaaaatgctgcaggaaaaccgggaaggcagagccgcccccaggcaatcctccagcttcaggcttctgcaggaagcgttggaagcagaggagcgcggtacccgactgtgtgccagcagacgcgccggtacagcaacacccgctgcgactccagtccctaccgtggggtag

SEQ ID NO: 198811 - DNA, 1059 bp, Artificial Sequence
  Description of Artificial Sequence: Synthetic coding sequence
atggccctgaccgtggacgtggccggccccgccccctggggcttcaggataactggtggacgggacttccatacccccattatggtcactaaagtcgctgaacggggaaaagctaaggatgccgatttgcgtcccggagatattatcgtggcaataaatggagagtctgcggaaggtatgctgcacgccgaggcccagtccaagatccgacaatcgcctagtcctctgcgcctgcaattggaccggtcccaggcaacatcgccaggacaaacaaacggcgacagcagcctggaagtgttggcgactcgttttcagggcagcgtcaggacttatacagagagccagtccagtctgcgttcctcgtacagctctcctaccagtctgagccctcgcgcgggatccccctttagcccaccacctagttcctcgagcctgaccggggaggctgctatctcgcgctctttccagtcactggcatgcagccctggactgcctgcggcagacaggctgagctactctgggcgccctggctcaagacaggctgggctaggtcgtgccggggactcagctgtattggtgctcccgccttccccggggcccagaagctcccgcccgtccatggattccgaaggtggaagcctcctactcgacgaagacagtgaagtgttcaaaatgctgcaagaaaaccgggagggtcgtgcagctcctcgccagagctcatcattcagacttttgcaggaggcccttgaggccgaagaaagggggggaacacccgcctttctgcccagttcactctcgccccaaagttccctccctgcttcaagggcgctggcaacaccacccaaactgcacacctgtgaaaaatgcagcacatccatcgctaaccaggcggtgcgcatacaggaaggacgctaccgtcatcccggatgttatacttgcgcagattgcggtctaaatctcaaaatgagaggccacttctgggtcggcgacgaactctactgtgagaaacacgccagacagcgctacagcgcgcccgccactctgagtagccgtgcctag

SEQ ID NO: 198812 - DNA, 1560 bp, Artificial Sequence
  Description of Artificial Sequence: Synthetic coding sequence
atgaccagcaccttcaacccccgggagtgcaagctgagcaagcaggagggccagaactatggctttttcctccgcatcgagaaggacactgaggggcatcttgtaagggttgtagaaaagtgtagtcccgccgagaaggcaggtctgcaagatggagacagggttctaaggatcaacggagtgtttgtagacaaggaagaacacatgcaagttgtggacttggtgcgtaagtctggaaattcggtaacccttttagttttagacggggactcgtacgaaaaagcagttaagacccgggtagacttgaaagaactcggccaatcacaaaaggaacaggggctgtcagacaacatcctctctcccgtgatgaacggaggggtgcagacttggactcagccccggctgtgctacctggtgaaggagggtggtagttatggcttcagtctcaagaccgtacagggtaaaaaaggtgtttacatgaccgacatcaccccacagggagtggcaatgcgagccggggttctcgcagatgaccacctcattgaagttaacggagaaaacgtggaggacgctagtcatgaggaggtggtggaaaaggtcaagaaatcaggaagccgagtgatgtttctgcttgtggacaaggaaacagataagcggcatgtcgaacagaagattcaattcaagcgagagacagctagcttaaagcttctgccacatcagccgagaattgtggaaatgaagaagggaagtaatggttatggcttttacttaagagctggctccgagcagaagggccagatcatcaaagacatcgatagcggcagcccagcagaagaagcagggctgaagaacaacgatcttgttgtagctgtgaatggcgaaagcgtcgagacattagaccatgatagtgtcgtggaaatgatccgtaagggcggcgatcaaacgagcttactggtggttgacaaggaaactgataatatgtatagacttgcccacttttctccttttctgtactaccagtcgcaagaactgcccaatgggtcagttaaagaggcgccggcccccacacccacctcactggaggtctcatcccccccagacacaaccgaggaggtcgaccacaagccgaagttgtgtcggctcgcaaagggggaaaacggctacgggttccacctgaacgcgatcagaggcctgcctggatcctttattaaagaggtgcagaaaggcggacccgctgacctggcaggactggaggatgaagatgtgattattgaggtgaacggtgtaaacgtccttgacgagccctatgaaaaagtggtggaccgaattcagtcatctggaaaaaatgtgaccctcctggtgtgcggaaagaaagcctacgactacttccaagcaaagaagatacctattgtgagttctctggccgaccccctcgacacgccccctgactccaaagaggggattgtagttgagagcaaccatgacagtcacatggcaaaagagcgggcgcacagcacggcatcccactcgagctccaacagcgaggacacagagatgtag

SEQ ID NO: 198813 - DNA, 1560 bp, Artificial Sequence
  Description of Artificial Sequence: Synthetic coding sequence
atgaccagcaccttcaacccccgggagtgcaagctgagcaagcaggagggtcagaattatggattcttcctgcggatagaaaaagacaccgagggccacctggtgagggtggtagagaagtgtagcccggctgagaaggcgggactacaagacggtgacagagtgttacggataaatggtgttttcgtcgacaaggaggaacatatgcaggtggtggatctggtcagaaagagcggaaactcagtgacacttctcgttctcgacggtgacagctatgaaaaggcagttaaaacacgggttgacctgaaggagttaggtcaatctcagaaagagcaggggctgagtgataacattcttagtcctgttatgaatggtggagtgcagacttggactcagccaaggctgtgctacctcgtgaaggagggagggtcttacggcttttccctcaagacagtgcagggtaagaagggggtgtatatgactgacattactccccagggtgtcgctatgagggcgggtgtcttggccgatgatcatctgattgaggtgaatggcgagaatgttgaagatgctagccatgaagaggtggtggaaaaggtgaaaaagtcagggagtcgtgtgatgtttcttctcgttgataaagagactgacaaacgtcacgtcgaacagaagatccaatttaagagagaaactgcttcgctgaaactgctcccacatcagccgagaattgtggaaatgaagaaaggcagtaacggttacggcttctacctgagagccggatcagagcagaaggggcaaatcattaaggatatcgatagcggaagccctgcagaagaggccgggctgaagaacaacgaccttgtcgtcgccgtcaatggcgaaagtgtagaaaccctggaccatgatagcgtcgtagagatgattagaaaggggggcgaccagacgagtctgctggtggtcgacaaagagactgataacatgtaccggctggcccatttttctcccttcctctattatcaatcccaggagctgcccaatggttctgtgaaggaagctcccgcaccgacaccgaccagtttggaggtgtcctctcctcctgacaccaccgaggaggtggatcataaacctaagctgtgcagactcgctaaaggagagaatggctatgggttccatctgaacgccatcagaggcctgccgggctcttttattaaggaagtgcaaaaaggcggtcctgcagatcttgcagggcttgaggatgaagacgtcatcattgaagttaacggggtaaatgtgctggatgaaccttatgagaaggtggttgatcgtattcagagtagtggcaaaaatgtcacattactcgtgtgtgggaagaaggcttacgactacttccaagccaagaaaatacccattgtttcctcattggcggacccactggatacaccgcctgactcaaaggaagggatcgtagtggagtctaaccacgatagtcatatggccaaggaaagagcccatagtactgcaagccatagctcctcaaattccgaagacactgagatgtag

SEQ ID NO: 198814 - DNA, 795 bp, Artificial Sequence
  Description of Artificial Sequence: Synthetic coding sequence
atgaccagcaccttcaacccccgggagtgcaagctgagcaagcaggaaggccagaactatggcttttttttgcgcattgagaaggatactgagggtcacctcgtgcgcgttgtagaaaaatgttcacccgcagaaaaagccgggctacaggatggcgatagggtattgcggatcaacggcgtcttcgtcgacaaggaggagcacatgcaggttgttgacctcgtcagaaagagcggaaattcggtcaccctgctagttttggatggtgattcatacgaaaaggccgtgaagacgagagttgatctcaaagagctgggacagtcacagaaggaacaaggattgagcgacaacatactgtcccccgtcatgaatggcggggtccagacatggacacagccacggctctgctacctggttaaagaaggtggctcctatgggttcagtctcaagaccgtacagggtaagaagggggtatatatgactgatatcacccctcagggcgtggctatgcgcgccggggtactcgccgatgaccatctgattgaggttaatggcgagaacgtggaagacgctagccatgaggaagttgttgagaaagtcaaaaagagtgggtctagagtgatgtttttgctggtggacaaagagactgataaacgccacgtagagcagaagattcagtttaagagagaaaccgcatcactgaagttattaccccaccaacctcggatagtggaaatgaaaaaaggatcgaacggatacggattttacctgagggccgggagcgaacagaagtag

SEQ ID NO: 198815 - DNA, 1227 bp, Artificial Sequence
  Description of Artificial Sequence: Synthetic coding sequence
atgaccagcaccttcaacccccgggagtgcaagctgagcaagcaggaaggtcagaattacggcttttttctccggatagaaaaggataccgaggggcatctcgtgagggttgtggaaaaatgctcaccagctgaaaaggctgggctccaggatggagatcgcgtcctgagaatcaacggggtgttcgtagataaggaagaacatatgcaggtagtggatctggtgaggaaatcaggaaactccgttactctcctggtcctggatggagactcgtacgagaaggccgtcaaaacccgcgtggacctcaaggagctgggtcaatcccagaaagaacaggggctgtccgacaacattttgtccccagtcatgaatggcggagtacagacatggactcaacctcgactgtgctatctcgtcaaggagggaggaagctatggcttctccctgaagaccgtgcaaggccaaatcatcaaagatatcgactccgggagcccagcagaagaagcgggcctgaaaaataacgacttggtggtagcagtaaatggcgagtctgtggagactctcgatcacgactctgttgtcgagatgattaggaaaggcggggaccagacatcactgttggtggtcgacaaggagactgacaatatgtaccggctggctcacttctccccttttctgtattatcagtcacaagaacttcccaacggttcagttaaggaagcaccagcacccacccccacatctctggaagtaagttccccacccgatactaccgaggaagtcgaccataaacctaaactgtgccgtctcgcaaagggcgagaacgggtatggctttcacctcaacgctatacgtggactaccaggcagctttatcaaagaggtacagaaaggaggacccgccgacctggccgggctggaagacgaggatgttatcatagaagtcaatggggtgaatgtcctggacgaaccttacgaaaaggtcgtggataggatacagtcttccggtaagaacgttaccctgctggtgtgtgggaaaaaagcgtatgattatttccaggcaaaaaaaatacctatagtttcctcactggcagatcccctggacacaccccccgactcaaaggagggtatcgtcgtggagtcaaatcatgattcccatatggccaaggagcgagcacacagcactgcctcccattcatcctccaactccgaagatacagagatgtag

SEQ ID NO: 198816 - DNA, 423 bp, Artificial Sequence
  Description of Artificial Sequence: Synthetic coding sequence
atggacagccggatcccctacgacgactaccccgtggtgttcctgcctgcttacgaaaatcccccggcatggatccctccccatgaacgcgtgcatcacccagattataacaacgagctgacgcagtttctgccaaggaccataacactgaaaaaaccacccggagcgcagctgggctttaacatccggggcggcaaagcctctcaactgggaatttttataagtaaggttatcccagactccgacgctcaccgagccggcctccaagaaggtgaccaagttctcgccgtcaatgacgttgattttcaagatatcgaacatagcaaagccgtggaaattcttaagacagcacgcgagataagcatgcgagtgcgcttcttcccgtacaattatcatcgacagaaagagcgtacagtgcactag

SEQ ID NO: 198817 - DNA, 423 bp, Artificial Sequence
  Description of Artificial Sequence: Synthetic coding sequence
atggacagccggatcccctacgacgactaccccgtggtgttcctgcctgcttatgagaaccctcctgcgtggattccccctcatgagcgcgtgcaccaccccgactacaacaatgagctgacccagttcctcccacggacgattaccctaaaaaaaccaccgggcgctcagctaggatttaatatccgaggcgggaaggcaagtcagctgggtattttcattagtaaggtgattcccgatagtgatgcgcatagggctgggctgcaagagggcgatcaagtgctggcagtgaatgatgttgacttccaggatatcgagcactcaaaagctgtagagatactcaagacggctagggagatcagcatgcgcgttcgttttttcccttacaattatcaccggcagaaggagcgtacagtgcactag

SEQ ID NO: 198818 - DNA, 8520 bp, Artificial Sequence
  Description of Artificial Sequence: Synthetic coding sequence
atgcccatcacccaggacaacgccgtgctgcacctgcccctgctgtaccagtggctccagaactctcttcaggaggggggggacggtcctgagcagcgcctgtgccaggctgctatccaaaagctccaggagtacatccagctgaacttcgccgtggacgagagcacggttcctccggaccattcccctccagagatggagatatgcacagtctacttgacaaaagagttgggtgatacagagaccgtgggcctgagcttcgggaacattccggttttcggagactacggcgagaaaaggcgtgggggcaaaaaaagaaagactcaccagggtcccgtactggacgtggggtgcatctgggtcacggagctcagaaagaatagtccagctgggaaatcaggaaaggttaggctaagagacgagattctgtctctgaatgggcagctgatggtcggggttgacgtgtctggggccagttatctggccgagcagtgctggaacggtggatttatttaccttatcatgcttaggaggttcaaacacaaagctcactccacttacaatggcaattcttcaaactcatcggagcctggcgaaacccccacattggaactaggtgatagaacggctaaaaagggcaaaaggactcgaaagttcggggttatctccagaccgccagccaataaggccccagaggagtctaagggttccgctggatgcgaggtaagctccgatccgagcacagaactggagaacggaccagaccccgagctgggtaatggccatgtcttccagcttgagaacggccctgatagcctgaaggaagtcgctggcccacatctggaacgcagtgaagtggatcgcggcactgagcacagaatccccaaaactgacgccccgcttacaaccagcaatgacaaacgtcgtttttctaaggggggcaagacggactttcagagctcggattgcctggcccgcgaagaggtgggacgaatctggaaaatggagctgttaaaggagtcggatggactcgggattcaggttagcgggggtaggggttctaaacgttccccccatgccattgtggtgactcaggttaaagaggggggggccgcacaccgcgacggccgactgagtctaggcgacgagctcctggtgatcaacggtcaccttttagttggcttatctcatgaagaggcagtggcgatattgaggtccgccaccggcatggtccaactcgtcgtggccagtaaggagaatagtgctgaagaccttctgcgtttgacttctaaaagtctgccggacctcacaagttcagtggaggatgtgtctagctggacagataacgaggatcaggaagccgatggggaggaagatgaaggaacatccagttccgtccaaagagccatgccaggtaccgacgaaccccaggatgtgtgtggcgccgaggagagcaagggcaatttggagtctccaaagcagggaagtaacaaaatcaagctcaagtcccgcctttccggcggcgtccacagactggagagcgtggaggagtacaatgaactaatggtgaggaatggcgaccctaggatccgcatgttggaagtgagtcgcgacggcaggaaacattccttaccgcagctgttggactcatctagtgcaagtcaggagtatcacatcgtgaagaaatcaacccgcagcctgtctacaacccaggtggaatccccctggcggttaattcgcccatccgtcatctccattataggattatacaaggagaaaggtaaaggactcgggttttctatcgcaggaggcagagattgtatccgaggtcagatgggtatttttgtgaaaacaattttcccgaacggatctgctgccgaagatggtcgccttaaggaaggcgatgagatcttggatgtgaatggcatccctattaaggggctcacctttcaggaagctatccatactttcaaacagattagatccggactttttgtcctcacagtaagaacaaaactcgtatctccatctctaaccccttgtagcactccaactcatatgagcagatctgcctcccctaatttcaatacgagcgggggggcatccgctggggggagtgacgaaggatcctccagctccttaggcaggaagacaccaggacctaaggataggattgtgatggaggtgacattgaataaggaacccagggtggggctgggcataggcgcctgttgtctcgctctcgaaaactccccccccggaatttatatccacagccttgctcctggcagtgtggccaagatggaatctaacctctcccgcggcgaccagatcctggaggtaaattccgttaacgttagacatgccgcactgagtaaggtgcacgccatcctttccaagtgccctcccggacctgtgcggctggtgatcggccgccaccccaatcctaaagtatccgagcaggagatggacgaagtgatcgcacggtcaacttaccaggagagtaaggaggcaaactcgagcccaggtctcgggacgccccttaagtctccctcacttgccaaaaaggattccttgatatccgaaagcgaattatcacaatattttgcgcatgacgtcccgggccccttgagcgattttatggtggctggatcagaggatgaggatcaccccgggtccggatgtagcaccagcgaagagggcagcttgcctccatctacctctacccataaggagccaggcaaacccagggcgaattccctggttactctgggtagccatagggcatcagggctctttcataaacaggtcacagtggctcggcaggcgtctcttccagggtccccccaagctctaagaaaccccctgctgagacaaaggaaggtgggctgctatgatgccaatgacgcctcagatgaagaagaattcgacagagagggagattgtatttccctgccgggcgctcttcccggacccatccgtccgcttagcgaggacgaccctagacgcgtcagcatctcttcatctaagggaatggatgtgcacaatcaagaggagagacccaggaaaactttagtgtctaaggccatcagcgcaccccttctcggctccagcgtagacctagaggaaagtatacccgagggaatggttgacgcggccagctacgctgctaatttgaccgacagtgcagaagctcctaagggctcccccggatcatggtggaagaaggaactcagcggcagttcttcggcccctaaactcgaatacacagtcaggactgacactcagagcccaacgaatacaggctctccatcttccccacaacagaagtccgagggcttgggttcaagacaccgccctgttgctcgggttagcccccactgcaaacggagtgaggctgaggctaaaccctccgggtcccagaccgtgaatctaaccggtagagccaatgacccatgtgatctggactccagggtacaagctacatccgtcaaggtgaccgtggccggttttcagcctggcggcgctgtggaaaaagaatccctcggcaagcttacgactggcgatgcgtgtgtgtccacgagttgcgaactggccagcgccttgtctcacctagatgcttcacatcttactgaaaacctccctaaggctgccagtgaactgggtcagcaacccatgaccgaactcgactctagtagcgaccttattagtagccctggcaagaagggggcagcccaccctgatccctcaaaaacctccgtggataccggccaggtcagccgacctgagaacccaagtcagccagctagcccacgcgtgacaaagtgcaaggctcggtctcctgtgaggttgcctcatgagggctcaccctccccaggcgaaaaagccgctgcaccacctgattactccaagaccagatcggcatccgagacatctaccccacataatactcgacgggtggccgcactccgtggagctgggcccggcgccgaggggatgacaccagctggcgccgttttgcctggcgacccattaacctcccaggagcaacgccaaggggctccagggaaccattcgaaggcccttgaaatgacgggtattcacgctcctgagagctcacaagagccttctttactcgagggggcagatagcgtgagttcacgggctccacaggcttcccttagcatgcttccttctacagacaacacaaaagaagcatgtggacacgtcagtgggcactgctgtcccggaggttctcgtgagagtcctgtgaccgacatcgactccttcataaaggagcttgacgccagtgcagctaggagcccctcttctcagaccggagatagtggctctcaagaggggtcggctcagggacaccctcccgccggggcaggaggcggttcctcctgtcgcgctgagccagtgcctgggggccagacgagcagtccacgcagggcctgggcagcaggcgctcctgcctacccccagtgggcttcccagccttccgtgttggattcaatcaatcccgataaacatttcacagtcaacaaaaacttcctctctaactacagcagaaacttttcttccttccacgaagattccacttctctgtccgggttgggagattctacagaaccctccctcagtagcatgtatggcgatgctgaagatagctcctccgatcccgaatctctgacagaagcaccccgggcctccgcccgagacggatggagccctcccaggtctagggtatccctgcacaaagaggacccttcagagagtgaggaagagcaaatagagatttgtagcacacgaggctgtcccaatcctccatccagcccggctcatttgcctactcaggccgctatttgtcccgctagcgccaaggtgctgtctcttaaatatagcactccccgggagtccgtggctagcccaagggagaaagcagcctgcttgcccgggtcttacacaagcggacctgacagtagtcagccatccagccttcttgaaatgagctcccaggagcacgagacccatgccgatatctctacttctcagaaccacaggccaagctgcgcggaggagaccactgaggtaacctccgcaagctcagctatggagaattcacctctttctaaagtggccaggcactttcattctccccctatcattctctcatccccgaacatggtcaatggcctagagcatgatctgcttgacgacgagaccctgaatcagtacgagacctccataaacgccgcggcttccctctcttccttctcagtggatgtgcccaaaaatggggagagcgtcctggagaatctgcatattagtgaatctcaggatttggatgaccttttgcagaagcctaagatgattgctaggagaccaattatggcctggtttaaagaaattaataaacataatcaaggaactcacctgcggtctaagactgagaaggaacagcccctgatgcccgcccggtcccctgactccaaaatccaaatggtcagcagttcacagaaaaaaggggtgaccgtgccgcactcccccccgcagcccaaaaccaacctggaaaacaaggacttgtccaagaagtctccagcggagatgctccttacaaatggtcagaaagcaaaatgcggtcccaaactcaagcgactctccctgaaaggaaaggccaaagtgaacagtgaggcacctgctgccaatgctgtcaaggcaggcggaaccgaccatcggaagcccctcattagcccgcagaccagtcacaagactcttagtaaagccgtatcccagagattgcatgtcgccgatcatgaagatcctgacaggaataccactgccgcccctagatcaccacagtgcgtccttgagagcaaaccgccactggccacaagcggtccactgaagccctctgtgtccgacactagcatccgcacttttgtgagtccgcttacttcaccgaagcctgttcctgaacaaggcatgtggtcacgttttcacatggccgtgctgtcagagccggaccgcgggtgtcccacaacacctaaatcaccgaagtgtagagccgagggacgggccccccgggctgatagcggcccagtcagccccgcagcttcaaggaatggtatgagcgtggccggcaaccgccagagtgagcctcggctggccagtcatgtcgccgcagatacagcgcaacctaggccgacaggggagaagggcggcaatatcatggcaagcgatcgacttgaaagaaccaatcagttgaaaattgtcgaaatttccgccgaagctgtcagtgagaccgtgtgcggtaacaaaccagctgagtcagacagacgtggcgggtgcctggcccagggcaattgtcaagaaaagagcgagatccggctatatagacaggtcgcagagtcaagcacctctcatccttctagtctccccagccacgcgagtcaggccgaacaggagatgtctagatctttctctatggcaaagctcgcatctagcagttccagcctacagacagcaatacgcaaagcagaatactcccagggcaaatcaagcctgatgtccgattcccgcggcgtccctcggaattcaataccaggcggaccttcaggcgaagatcacctatacttcacccctagaccagcgacaaggacctattcaatgcccgcgcaattttcatctcacttcggccgcgaggggcatcctccccattctctggggcgctcccgggatagccaggtgcccgtcacctcaagtgtggtgcctgaggccaaggcatcccgcgggggcctgccaagcctggcgaacggacagggcatctactctgtcaaaccactactggacacatcccggaaccttccagcaactgacgaaggggatatcatatccgtgcaagagacctcatgccttgtgacagataagattaaagttacacgaagacactactgctatgaacaaaactggcctcatgagtcgaccagcttcttcagtgtaaaacagcgaattaagtccttcgaaaacctggcgaatgccgatagaccggtggccaagtcaggcgcctcgcccttcctgagcgtgagtagcaaaccccctattggaagacgctcatcaggctccatcgtaagcggcagcctcggacaccccggcgatgcagcggctcgcctgctacgtcggagtctgagctcgtgtagtgagaaccaatccgaggccggcacccttttgccacagatggccaagtctccaagtataatgaccctgacaatatcccgtcagaatccgcccgagacgagttccaagggatccgattctgaactgaaaaagtctctgggacctttgggaattcctacccccacaatgaccctggcctcgccagtgaagcgaaataagtccagcgttaggcatactcagccgtctcccgtctctcgatctaagctgcaggagctgcgcgccctgtcaatgcccgacctggataaactgtgctctgaagattacagtgccggtccctccgctgttctcttcaagaccgaactggaaattaccccgcggcgcagccccggacctccggcaggcggggtctcctgccccgagaaggggggaaacagagcctgtcccggtggctccgggcccaagacatctgccgccgagacaccctcgagcgcgtcggacaccggtgaagcagctcaggacctgccttttcgtagaagctggtccgtgaacctcgatcagctgctcgtgtctgcaggagaccaacagcggctgcaaagcgtgctctcatctgttgggtccaagtctaccattctgaccttgatacaggaagccaaggcccagtccgagaacgaggaagatgtgtgctttatcgtgcttaataggaaggaaggcagtgggctgggcttctcagtagccgggggaactgacgtcgagccaaagtccattactgtgcaccgggtgttttcacaaggggctgcatcgcaggagggcacgatgaacagaggggatttcctgctgtctgttaacggagctagtctcgcaggcctggcacacggtaatgtcctgaaggtgcttcaccaagcacaacttcataaggacgctctggtcgtgattaaaaaggggatggatcagcctaggccgagtgccagacaggagccacccacagccaacggcaagggcctgttatcaaggaaaaccatcccactggaacctggaattggaagaagtgttgctgtgcacgatgcactctgtgttgaggtgctcaagacttccgctggtctcggattgtctctggatgggggcaaatctagtgttacaggagatggccctctggtcattaagagggtgtacaaggggggagccgccgagcaggctgggataattgaggctggcgatgagattctggccataaatggtaagcctctggtgggactcatgcacttcgatgcctggaatatcatgaagagcgtgccagagggccccgtgcagctgcttatccgcaagcacagaaattcaagttag

SEQ ID NO: 198819 - DNA, 7923 bp, Artificial Sequence
  Description of Artificial Sequence: Synthetic coding sequence
atgcccatcacccaggacaacgccgtgctgcacctgcccctgctgtatcaatggctgcagaactctctccaggaaggtggggatggccccgagcagagactgtgccaagcagctattcagaaactgcaggagtacatccagcttaattttgctgtcgacgagtctaccgtaccccccgaccatagccctccggagatggaaatatgtaccgtgtaccttacgaaggagcttggcgataccgagacagtgggcttgagtttcgggaatatccctgttttcggagattacggcgaaaaacgacggggcggaaagaagaggaaaacccatcaagggcctgtcttggacgtgggttgtatttgggtaaccgaactgagaaaaaacagccctgccgggaagtccggcaaggttcggctgagggacgaaattttgtccttgaacgggcaactcatggtcggggtggacgttagcggtgcctcatatctggccgagcagtgctggaacggaggtttcatctacttgataatgctgcgaaggtttaagcacaaggctcattcgacgtataacgggaacagctccaattcctccgaacccggagagacccctacccttgaactgggggacagaacggccaaaaaaggcaagagaactcggaaattcggcgtcatatctcggccccccgcaaacaaggcgcccgaggaatcaaaaggatcagcagggtgcgaagtcagctccgaccccagcacagaactggaaaacggtcccgacccagaattgggcaacggccatgtcttccagctggagaatgggcccgattcccttaaagaagtagccgggcctcacctcgaaagatcagaagttgacagaggaactgagcatcgcatcccaaaaaccgacgccccacttacaacaagcaacgacaagcgccggttcagcaagggcggtaaaaccgactttcagagctctgactgtttggcccgggaagaggtgggccggatctggaagatggagttgctgaaagagagcgacgggctgggcattcaggttagcggcggcagaggcagcaagaggtctcctcatgccattgtagtgacgcaagtgaaggaaggaggcgccgcccatagggagtatcatatagtgaaaaaatcaacccgctcgctgtctaccactcaggttgaaagcccttggaggctaatccgccccagcgtaatatctatcattggactttataaggagaaagggaagggattagggtttagcatagctggtggaagggattgcatccggggtcagatgggcatttttgtaaagaccatatttcccaatggtagcgcagccgaagatggaaggcttaaagaaggcgacgagatcctggacgtaaatggcataccaattaagggacttacattccaggaagcgatccacacatttaagcagatcagatccggtctgttcgtccttaccgtccgcacaaagctggtgagcccctcactgacaccatgctcaacaccgacccatatgtctcgctcagcaagtcctaactttaataccagtgggggagcctccgccgggggaagtgatgaaggctcatcctcaagcctagggcgaaaaacgcctgggcccaaggatagaattgtcatggaggtgacattaaataaggagcccagggtgggcctgggaattggcgcgtgctgcctggctctcgagaactcaccacctggcatatatattcattcacttgcacctggttcggtggctaagatggagagcaacctgagcaggggggaccagatcctggaggtgaatagcgttaacgtccggcacgccgctctctccaaagttcatgctatactcagtaaatgccccgtgtccgagcaggagatggatgaggtgatagctaggagcacttaccaggaaagcaaagaagctaatagcagtcccggcctgggaacgcccctgaagagcccaagcctggcgaagaaggacagcttaatctcagaaagcgagctgagccagtatttcgcacacgatgtgcccggccctcttagcgatttcatggtcgccggaagtgaagatgaggatcatcctggctcgggatgttcaacttctgaagagggctcattaccaccaagcacaagtaaggaaccgggcaaacctagagccaacagtcttgtgacactcggatcacaccgggctagcggcctgttccataagcaggtgacagtcgcgcgccaggcctccttgccagggtcgcctcaagcacttaggaacccactcctgaggcagcgcaaggtcggctgctatgatgccaatgatgcctccgatgaggaggagttcgatcgggaaggcgactgtatttcactccccggcgccctgccgggccctattcgcccgctgtccgaggatgatcccaggcgggtgtccatctccagctctaagggcatggatgtccacaaccaggaggagagaccgcggaaaacacttgtgtctaaggccatctccgccccgctgctggggagtagcgtggatcttgaggaaagcatcccggaaggcatggtcgacgcagcgtcctatgctgccaacctgacagacagtgctgaagcacccaaaggctcgccaggatcgtggtggaaaaaagaactgtctggctcctccagtgcgccgaaattggagtacaccgttcggaccgatactcagagcccaaccaataccgggtcgcccagctccccacagcagaaatccgagggactggggtctaggcatagacctgttgcgcgggtgagcccccactgtaagcggtctgaggccgaagccaaaccatccggttcccagacggtgaatctgaccgggagagctaacgatccttgcgatctggattcaagggtgcaagccacctccgtcaaagtgactgtcgcagggtttcagcctgggggtgcagtggaaaagctctgccaagaaagcctcggaaagctcactacaggagacgcctgcgtgtctactagctgcgaactggcaagtgccctctcccaccttgatgcctcacacctaaccgagaacttgccaaaggcagcttccgagcttgggcagcagcccatgactgcatcggacctcatttcctctcccggtaagaagggcgccgcacacccagatccctccaagacctcagttgatacggggcaggtgtctcgcccagaaaatccttcccaacctgcatctcctcgcgtgaccaagtgtaaggccagatctcccgtcagactacctcacgaggggtccccctctccaggcgaaaaggccgcagctccacccgattacagcaagacacggtctgcctctgagacgtccacccctcataacactagacgggttgccgcgctgaggggcgctggcccaggtgcggaggggatgacacccgccggggcagtactacccggcgaccctctcacctcccaagagcagcggcaaggcgcccccggaaatcacagcaaggcactcgagatgacaggaattcatgcccctgagtcatctcaagagccctccctactggagggggccgatagcgttagttctcgggccccccaggctagtcttagcatgttaccaagcacagataatacaaaggaggcatgcggacatgtgagcgggcactgctgcccaggcggttcaagagagtccccagtgactgatattgactccttcattaaagaattggacgctagtgctgctagaagcccgtcttctcagacaggtgactctggtagccaggagggctctgcacaggggcaccctcccgccggtgccggcgggggatccagttgtcgggctgagccagtacccggaggacagaccagctcccctagacgtgcctgggctgccggagcccccgcctacccccagtgggcaagccagccttccgtcctcgactcgatcaaccctgacaaacacttcaccgtcaacaagaacttcctgtcaaattactcaagaaacttcagcagctttcacgaggattcaacctccctctcaggcctgggcgattccacagaaccctctctgagcagtatgtacggagatgccgaagatagctcttccgaccccgaaagcttaacagaagcacctcgtgcttctgcacgcgatggctggtctcctccgcgctcccgggtgagcctgcacaaagaggacccaagcgagtcagaagaagaacaaatcgaaatttgcagtacacgggggtgtccaaatcctcccagctccccagcacatctgcccacgcaggcagcgatttgtcccgccagcgccaaagtgctgtccctgaagtacagcacccctcgcgagtccgtggcaagcccacgagaaaaggctgcgtgtctccctgggtcgtacacctcaggccctgattcttcccagcctagcagcctcttggagatgtcatcccaggagcacgagactcatgccgatatctcaacttctcagaaccaccgcccttcctgtgccgaagaaactacagaggttaccagtgcaagctcggcaatggaaaattcaccgctctcaaaggtggctcgccacttccactctccacccatcatcttatccagccccaatatggtaaacggcctcgaacacgacctccttgacgatgaaactctcaatcaatatgagacaagtattaacgccgcggcctcgctctcctccttttccgtcgacgtacctaaaaatggagagtcagtgctagaaaatttgcacatttcagagtctcaggaccttgatgatttgctgcagaagcccaagatgatcgcaaggcgacccatcatggcctggttcaaggaaattaacaagcataatcagggcactcaccttaggagcaagaccgagaaggagcagccactgatgcccgctcgctccccagatagcaagatacagatggtatcctcgtctcagaagaaaggggtcactgtcccgcactcccccccacagccgaagacgaacctggaaaataaggatctgtcaaaaaagtcacccgccgaaatgctcctgactaacggacagaaagcgaagtgcggcccaaaattgaagagactgtctctgaaaggcaaagcaaaagtgaactccgaggctcccgccgccaacgcggttaaggctggcggtacggaccacagaaagccgctcatctcaccccagacaagccacaaaacactatccaaggccgtgagtcagaggctgcatgtggcagaccacgaagacccagataggaacaccacggctgcaccgagatccccacagtgtgtgcttgagtccaagcctcccctggccactagtgggcctctgaaaccgtccgtgagtgatacttccatcaggactttcgtatcccctctgactagtccaaagccagtgccagaacagggaatgtggtccaggtttcacatggccgtgctgtcagaacctgaccggggttgccctactacacccaagtcaccgaaatgccgggcggaaggaagagcccctagagctgactctgggccagtgagtcccgctgccagccgtaatggtatgtccgttgcagggaaccgccagtcggaacctcggctcgcgtcccatgttgcggccgacacggcgcagccccggcctacaggggagaagggtggcaacataatggcttccgaccgcctggagcggacaaaccagctaaagatagtagagatctctgcggaagccgtgagtgagacagtgtgtggaaacaagcccgcagaaagcgataggaggggtggatgtctagcgcagggcaactgccaggagaaaagtgagattaggctgtaccggcaggtggcagagagttctactagtcacccctccagcctgcccagtcatgcctcgcaggcagagcaggaaatgagccgcagcttttccatggcgaaactggcaagctcaagctcctcattacagactgccattaggaaagccgagtatagtcaaggcaagagctccctgatgtctgacagcagaggagtgcctcgcaactcaattccgggcgggcctagcggggaggatcacctctattttactcctagaccggccacacgtacttatagcatgccagcacaattctcatctcatttcggcagggaaggccatcccccacactccctgggccgcagcagggattcccaggtgccggttacctcttccgtcgtccctgaggccaaagcaagtcggggcgggcttccttccctggcgaacggccaaggcatctattctgtaaaacccctgttggataccagccgaaacctgccggcgacagacgaaggcgatatcatctccgtgcaagaaacaagctgcctcgtgacagataagattaaagtcacgcgacgccattattgctacgagcagaactggccacacgaatcaacctcttttttctctgttaagcaaaggattaaatcctttgagaatcttgccaacgccgacagacctgtcgccaagagtggcgctagcccctttctgtccgtgtcctcaaagcctcctatcggtaggcggtcaagcggatcgattgtgagtggatcactaggccaccccggggacgcagccgctagacttttacggaggtcgctaagctcttgctccgaaaaccagtccgaagcagggactctgctacctcagatggcaaaatcaccgtcaatcatgaccctaacaatctctagacaaaacccaccagagacgtcttccaagggatctgacagcgagttgaaaaagtccctgggacctctgggcatcccaacccccacaatgacccttgcctctccagtgaaaagaaataagtcgagtgtgcgccatacccagcctagccccgtgtctcgatcaaaactgcaagaactgcgtgcactttctatgccggacctggacaagttgtgctccgaagactattccgccgggcctagcgccgtattgttcaagaccgaattggagatcacaccaagacgttctcctggcccccctgctggcggggtcagctgtcccgaaaaaggggggaacagagcctgccccgggggttctgggccgaagacaagcgccgctgaaacaccctcctcggctagcgacaccggcgaagccgctcaagatcttccttttagacggagctggagcgtgaatctggaccagttgttggttagtgccggtgaccagcagcgcctccagtcagtgctttcgagtgtgggctccaaaagcaccatcttgacccttattcaggaagccaaggcccaatccgagaacgaggaggacgtgtgcttcatcgtgttgaaccgcaaagaaggatccggactggggtttagcgtggcgggaggaactgacgtcgagcccaaatctattaccgtccacagggtctttagccaaggcgcagcatcccaggaggggacgatgaacagaggcgattttctcctctcagtgaacggagcatcactagccggactggcccacggcaacgtactgaaagtgctgcaccaggcacaactgcataaagatgcactcgtggtcataaagaagggcatggaccaaccccggccatctgcccgccaagagccgcccactgctaatggaaaaggactgctgtctagaaaaactattcctctcgaacctgggatcggccgctcggttgcggtccacgatgccctgtgcgtagaggtactgaagacaagcgctggattgggtctctcattggacggaggcaagtcctccgtcaccggcgacggccctctcgtgatcaagcgcgtgtataaaggaggagcagctgaacaggccggtatcattgaggcgggtgacgaaatcctcgccatcaacggcaaaccgctcgtggggctgatgcactttgacgcgtggaacattatgaaaagcgtaccagagggccccgtgcagcttctgattcggaaacataggaattccagctag

SEQ ID NO: 198820 - DNA, 8520 bp, Artificial Sequence
  Description of Artificial Sequence: Synthetic coding sequence
atgcccatcacccaggacaacgccgtgctgcacctgcccctgctgtaccaatggctgcagaattccctgcaagaggggggtgatggtcccgaacagagactttgtcaggctgcgatccagaaacttcaggaatacatccagctgaactttgctgtggatgagtcgaccgtgcctccggatcactcacctcctgagatggaaatatgtactgtctacctgaccaaggagttgggcgacactgagaccgttggactaagcttcggcaacatcccagtttttggcgactatggggaaaagcggagaggcgggaaaaagcgcaagactcatcagggccctgttctggatgtcggttgcatctgggtcacggagctgagaaaaaactcccccgcgggaaagtcgggcaaggtaaggttaagggacgagatcctgtcgctgaacgggcagctcatggtaggagtggatgtctcaggagctagttatctggccgaacagtgttggaacggaggcttcatctatttgattatgctgcgtagattcaagcacaaagctcattccacatacaatggaaactcctctaactcatcagagcccggagaaacccccactttagagctgggtgatagaacagctaaaaaggggaaaaggacccgtaagtttggtgtgataagccgtcccccagccaataaagccccggaggagagcaaaggatctgcgggctgtgaagtgagcagcgacccaagcacagagctagagaacggacctgacccggaactgggtaatggccatgtcttccagttagaaaacggccccgactcattgaaggaagtcgctggacctcatctcgaaaggtctgaagtcgatcggggcactgagcaccgaatcccgaagaccgacgcccccctaaccacaagcaatgacaagcgccgtttctccaagggaggcaagaccgactttcaaagctctgactgtcttgccagggaggaagttggccgtatttggaagatggagctgctgaaagagtccgatggcctgggaatacaagtttcaggcggccgcggctctaaaagatcaccgcatgctattgttgtcacccaggtgaaggagggtggggcagcccaccgtgatggacgtttgagcctgggcgacgagctgcttgtgattaacggccacctcctcgttggcctctcacacgaagaggcagttgcaattctgcgctccgcaacgggcatggtgcaactggtcgtcgcctctaaagaaaactctgctgaggacctgctcagactcacttctaagagcttacccgatctgacctcttcagtggaggatgtctccagctggaccgataacgaggaccaggaagcagacggggaagaggacgagggaacttcatcttctgtgcagcgggctatgccaggtacggacgaaccccaggatgtttgcggtgctgaggagagcaaagggaatctcgaaagtccgaaacaggggtccaacaagatcaagctgaaatccagactttccggtggagtccaccggctggagagcgttgaggaatataatgagctgatggtacgcaacggggatccgcggatccgtatgttagaggtttcgcgcgacggtcggaagcattccctccctcaactgctcgattcctcctcagcgagccaggagtatcacatagtgaagaaatccacacgttctttaagcacaacccaggtcgaatcgccttggcggctgattaggccgtctgtaattagtatcattgggttatataaggaaaagggcaagggcttgggttttagcattgccggggggcgcgattgcatccggggacagatggggatctttgttaagacgatcttcccaaacgggtcagctgctgaagacggtaggctgaaagaaggagacgagattctggatgttaacgggatccccatcaagggcctgaccttccaggaagcaatacacaccttcaaacagattaggtcagggctgttcgtcctcactgtccggactaaacttgtcagtcccagcctgactccttgtagcacgcctacccacatgagcagaagtgcctctccaaatttcaacactagcggaggggcctctgctggcggatctgacgaagggagctcgtccagcctgggccgcaaaacccccggcccaaaggatcgaatcgtcatggaggtgacccttaataaagagccccgagtggggcttggcatcggcgcttgttgcttggccctggaaaactccccgcctggtatttatatccattccctggcgccaggatctgtagccaaaatggagagcaacctctctcgcggggaccagattctggaagtgaactctgtgaacgtgaggcacgcagccctatctaaagtacatgcaattctctccaagtgtcccccgggtcctgtccggctggttatcggtcgacatccaaatcctaaagtgtcggagcaggagatggacgaggtgattgcacggtccacttatcaggagtctaaggaggccaacagcagccctgggctcggtacccccctgaaatccccctcactcgctaagaaggacagccttatcagcgagtctgagttgtcccagtatttcgcccatgacgtgcctgggccgctttccgattttatggtggccgggtcagaagatgaagatcatcccggctctgggtgttcaacatctgaagaaggatctcttccgccctcgacatcaacccataaggaacccggaaaaccccgtgccaattccctagttacgctggggtctcatcgggctagcggactgttccataagcaggtcactgtggctcggcaagccagtctgccagggtcccctcaggccctgcgtaatcccctcttgcgacagaggaaggtagggtgctacgatgctaatgacgcatcagacgaggaggagtttgatcgggagggtgattgtatctctctgccaggggccctgccaggcccaattcgtcccctgagtgaagacgatcccagaagggtcagcatcagtagctctaaggggatggatgtgcacaaccaggaagaacgcccacggaagaccctcgtttccaaagcaatcagcgcgcccctactgggatcatccgtagacctcgaggaatctatccctgaaggcatggtcgatgcggcatcatatgccgctaacctgaccgatagtgccgaggctcctaagggatctccaggaagctggtggaagaaggagctgagcggtagcagctcagccccaaagttggaatatactgtaagaaccgacacccaaagtccgacaaatactggcagcccctcatctccacagcaaaagagcgaaggacttggttcccgtcacagaccggtagcccgagtcagcccccactgtaaacggagtgaggcggaggcgaagccctccggttctcagacagtaaacttgaccggtcgcgcgaacgatccatgtgacttagatagtagggtacaagccacatctgtcaaagtgaccgtcgcggggttccagcccggcggagctgttgagaaagaatctctagggaaactgacaaccggggacgcttgcgtgagcacaagttgtgagctcgcttccgcactctctcacctcgacgcctcacacctgaccgagaatttacctaaagccgcctctgaacttggccagcagccgatgactgagctggatagcagctctgatctgatatcttcacctggcaagaaaggagcagcgcatcccgacccaagcaagacgtcagtcgatactggccaggtaagcaggcccgaaaacccgtcccaacccgcttcaccgagagttactaagtgcaaggcacggagccctgtgcgcctcccacatgaaggttctccatcccccggagagaaagctgctgccccaccagactattctaaaacacgaagcgcttcagaaacttctaccccacataacactagacgtgtcgctgccctcaggggcgccggtccaggcgccgaagggatgactccagctggagctgtactgccgggtgacccactgacgagtcaagagcaacgccagggtgcgcccgggaatcacagcaaagcgctggaaatgaccggtatccatgctcccgaatccagtcaggagccttcgttactggagggcgctgacagtgtgagctcccgagctccgcaagcctcactgtcgatgctgccttccacagataacacaaaggaggcctgcgggcatgtgtcaggccactgttgcccgggaggctcccgagagagcccggtgacagatatcgactctttcatcaaggaactggacgcctctgccgcccgctctccatcgtcccaaacgggggactcaggttcccaggagggctctgctcagggacatcctcccgccggagcaggcggaggaagctcctgccgggccgaaccagtacccggaggacaaacatctagcccgcgacgggcatgggctgctggcgcccccgcttatcctcagtgggcatcgcagcctagtgtcctagattccatcaatccggataagcattttacagtgaacaagaatttcctttccaactactcccgtaacttcagctcatttcacgaggactctacgtccctgagcggtttaggcgactctacagagccctccctgtccagtatgtacggtgatgccgaggattcatcaagcgaccccgagagcctgaccgaggcacctcgcgcctctgctcgtgatggctggagcccgccccgctccagggtatccctgcataaggaggacccctcggagagtgaggaggaacagatcgagatttgctccacccggggctgtccaaatccccctagtagtcctgctcaccttcccacacaggctgccatctgtccggccagtgcaaaagttttatctcttaaatattcgactcctcgtgagtccgtggcctcacctagggaaaaagcagcctgtcttccgggctcctatacttccggcccggacagttcccagccctcatccctgctcgagatgtcttcccaggaacacgaaacacacgctgacatcagcactagtcaaaaccatcggcctagctgtgcagaagaaactacagaggtgacctctgcctctagcgccatggagaatagccctcttagtaaagtcgcccggcattttcacagcccacccattattttgtcatctcccaacatggtgaatggccttgaacatgatctgctggacgatgagacgctgaaccagtacgaaacaagtatcaatgcagctgcaagcctatcctctttttccgttgacgtcccaaaaaacggagagtcagtgcttgaaaatttgcatatttcagagtcacaagacctggacgaccttttgcagaaacctaaaatgattgcgaggaggccgataatggcctggttcaaggagattaacaagcataaccagggcactcacctcagatcaaaaacggaaaaggaacagccactgatgccggcccggagtccagactcaaaaattcagatggtgtccagcagccagaagaaaggagttaccgtcccccactcccccccccagcctaagaccaacctcgaaaacaaagatctgagcaaaaaatccccggccgaaatgctgctgactaatgggcagaaagctaagtgcgggccgaagctgaagaggctgtcactgaagggtaaagccaaggtgaattctgaggctcccgcagccaatgccgtcaaggcagggggaacagatcatcggaaacctctgatctccccccagacaagccataaaaccctgagcaaggccgtgagccagcggctgcatgtagcggatcacgaagaccctgatcgaaacacaactgcagcacctaggtccccccagtgtgtgttagaaagtaaacctcccttggccacttccggccctttgaaaccatccgtgtccgacacctcaattagaacttttgtctccccactgacctccccaaaacctgtccccgaacagggaatgtggtccaggtttcacatggcagtgctgagtgagcctgataggggctgcccgaccacccccaagtcacctaagtgtagagcggagggcagagccccccgtgcagatagcggacccgtgtccccagctgcatctcggaatgggatgtcggtcgcaggtaatagacaatcagaaccccgtttggctagccatgtggcagctgacacagctcagccaagaccaaccggcgagaaaggcggaaatattatggcatcagatagattggagcggaccaaccagcttaagatcgtggaaattagcgcggaagctgtttctgagacggtctgtgggaacaaaccagccgagtccgaccggcgcggcgggtgtctggcccagggaaactgtcaggaaaagtcagaaattaggttgtaccgacaggttgccgagtcgagtacaagtcacccctcatccctgccctcacatgcctcacaggcagagcaagaaatgtcgagatccttttccatggcaaagcttgctagctcatcctcatccctccagacggctatcagaaaggcagagtatagtcagggtaaatcctcactcatgtccgatagcagaggtgttccaagaaacagtatccctgggggccccagtggggaggatcacctgtattttacgccccgacctgcaacacggacctattccatgcccgcacagttttcgagccacttcgggagggagggacatccaccgcattctcttggcagatcccgggactcccaagtgcccgtgacctcgtctgtcgtgcctgaggctaaagccagtagaggcggcttaccctctctggcgaatgggcagggcatttactctgtgaagcctctactggacacctcccgcaacctgcccgccacagatgagggtgacataatatccgtccaagagacctcatgtcttgttaccgataagatcaaggtcacgagacgccattattgctatgaacagaactggccacacgaaagcacgtcttttttctccgtgaagcaaaggattaaatctttcgagaatctggcaaatgcagacagacccgtggccaaatccggagcctcaccattcctctccgtgtctagcaagcctcccattgggcgcaggagctccggaagcattgtgagtgggtcgctgggccatccaggagacgcggcagcacggctgctgcgccgatcgcttagctcctgttccgagaatcagtcggaggcgggcacactgctgccgcagatggcgaaatccccatccataatgacccttaccatttctcggcaaaacccacccgagacctcctcgaaaggatcagattccgaattaaaaaagagccttggcccgctcggtatccctacccctaccatgacccttgcaagccccgtgaagaggaacaaatcctcagtgcgccacacacagccatcaccagtgtcccggtctaagctgcaggagctgagggcactttcgatgcctgacctggacaagctctgcagcgaagattactccgctggcccaagtgctgtcttgtttaagaccgagttggagattacccccaggcgttcacctggcccgcccgcagggggggtgagctgtcccgagaaaggagggaatcgcgcgtgtcctgggggtagcggtcccaaaacgagcgctgctgagaccccctcttcagcctcggacaccggagaggcagcacaggacctgccgtttaggcgcagctggagtgttaatctagaccagctactcgtatcagcaggggaccagcagagactgcagagcgttctcagcagcgtgggaagtaagtctaccattctcacgctgattcaggaagcaaaagcacagtctgaaaatgaagaggatgtctgcttcattgtgttgaatcgcaaggagggaagcgggttggggttcagcgtggctggagggacggacgttgagcccaaatctattacagttcaccgagtgtttagccagggagccgcctctcaggaaggcacaatgaaccgtggcgatttcctactgtctgtcaatggcgcctctctcgcaggcctcgctcacggcaatgtactcaaggtgctccatcaggcacagctccacaaggacgctctagtggtgatcaaaaaagggatggatcaaccccggccctccgccagacaagaaccccccacggctaatgggaagggactcctgagtaggaaaactatcccattggagcctggcattggcagatcagtggcagttcacgatgcgctgtgtgttgaagtgctcaagacgtccgcagggctgggcctctccctggatggtgggaaatcatctgttacgggcgatggtcccctcgtgattaagagagtgtataagggaggggctgccgaacaggccgggattatcgaggccggcgacgaaattcttgcaatcaatggcaagccactagttggactcatgcattttgacgcttggaacatcatgaaatccgtgcccgaagggccagtacagttactcatcagaaaacatcgaaattcatcctag

SEQ ID NO: 198821 - DNA, 45 bp, Artificial Sequence; identical to SEQ ID NO: 92627
  Description of Artificial Sequence: Synthetic coding sequence

SEQ ID NO: 198822 - DNA, 1476 bp, Artificial Sequence
  Description of Artificial Sequence: Synthetic coding sequence
atggagaaggccgccgacctgcaggacaccgccagcctgaccctgaagttcaagtttaaccctaaactgggaattgataatcccgttctttctctcgcagaagaccacgacccatacgacccatggagtctggagaggcccaggttctgcctactcagtaaggaagaagggaagtccttcgggttccacttgcagcaggaactaggccgggctggccacgtcgtatgcagggttgacccggggactagcgcccagcgccagggcttgcaggagggcgaccggattctggccgtaaacaacgacgttgtcgagcacgaggactacgctgtggtcgttcggcgcatccgggcatcgtcaccccgcgtgcttctaactgtgctcgctagacacgcccacgatgtggccagagctcagttgggtgaagacgcgcacctgtgtccaaccttggggcctggtgtgcggccccgactgtgtcacatcgttaaagacgaggggggatttggcttctcagtcacccatggaaaccagggccccttttggcttgtactgagcacagggggcgctgccgagagggctggcgtccccccgggggcaaggctcctcgaggtgaatgggttatggcagtccgggcagcaggtaactcttctggtcgcaggacctgaggtggaagaacagtgcaggcaactcggactgccactggccgctcctttagctgaaggctgggccctcccaacaaaacctaggtgcctgcacctcgagaaaggaccccaaggcttcgggtttttgctgagggaggagaaaggcctagacggtcggccaggacagttcctgtgggaggtggatcccggtctgcctgctaaaaaggcagggatgcaggcaggcgaccgcctggttgccgttgccggggagagtgtcgaaggcctcggccacgaggagactgtgagccggatacagggtcagggctcttgtgtaagtttgacggtggtggatcccgaagcggataggttcttttccatggtcagactgagtcctctcctgtttctagagaacacagaggccccagccagccctcggggcagttccagtgcttctctcgtggagaccgaggacccatctctcgaagatacatcagttccctcagtacccctaggttctaggcagtgcttcctgtaccccggtccgggaggctcctacgggttccgcctctcatgtgtggctagcggcccccgtctatttattagtcaggtgaccccaggcggctcagccgctcgggccggacttcaggtgggtgacgtaatccttgaggtgaatgggtatcctgtggggggtcagaatgatctcgagcgtctacagcagttaccagaggccgagcctcctctctgcttgaaactcgccgcccgctctttgcgcggcctagaagcctggattccgcctggggcagctgaggactgggccctggcgagtgacctgctctag

SEQ ID NO: 198823 - DNA, 1518 bp, Artificial Sequence
  Description of Artificial Sequence: Synthetic coding sequence
atggagaaggccgccgacctgcaggacaccgccagcctgaccctgaagttcaagttcaaccctaaactgggcatcgacaacccagtcttgagcctggctgaagaccacgatccctacgacccctggtcgctggaacgcccaaggttttgcctgttgagcaaagaggaaggcaaatcttttggttttcatctgcagcaagaactggggcgcgcaggacatgtggtgtgccgcgtggatcccggaacatcggctcagcggcagggcttacaggaaggcgacagaatcctggctgttaacaatgacgtggtggaacacgaggactatgcagtggtggtccgaagaatccgagcgtccagcccaagggtgcttctgaccgtccttgcacgtcacgctcatgacgtggcccgcgcacagttgggagaagatgctcatctgtgtccaacccttgggccaggagtgcgacctagactgtgccacatagttaaagacgagggtggatttggattttctgtcacacacggcaaccagggtccattctggctcgtgctttctaccggcggagcagccgaacgagcaggcgttccacccggggcacgcttgctcgaagtgaatggtgtctctgtagaaaagtttacacacaaccagctgacccgcaagctatggcagtctggccagcaggtgactttgctagttgcaggacccgaggtcgaagagcagtgcaggcaactgggacttccactggccgctcctctggctgagggctgggcactgccaacaaagcctaggtgccttcacctggaaaaaggacctcaagggttcggctttctgctgagggaagagaaaggacttgacggtcggccaggacagtttttatgggaagtggatcctggcctacccgccaagaaggctggcatgcaggccggggatcgactcgtggctgtagctggagagtcagtggagggcctaggacatgaagagacagtgagccggatccaagggcagggctcttgcgtaagtctgaccgttgtcgatccggaagctgaccggttttttagtatggtgaggttgtcccctctcctgttcttggagaacaccgaagccccagctagcccgcgcggttctagctcggcatccctggtggagacagaagaccccagtctagaggacacctccgtcccaagtgtccctctaggctctcggcagtgttttttatatcccggaccgggtggtagctacggtttcagactaagctgtgtcgcctccggccccagactgtttatcagtcaggtgacccctggcggatcggctgccagagctgggctgcaagtaggagacgtcattctagaagttaacggataccctgtgggcggacagaacgatttggaacggctgcaacagctgcctgaggcagaaccaccactttgtctgaaactggctgctcgatcactgcggggccttgaagcttggataccacctggcgctgcagaggattgggccctcgcctctgatctgctatag

SEQ ID NO: 198824 - DNA, 1716 bp, Artificial Sequence
  Description of Artificial Sequence: Synthetic coding sequence
atggtgacccccagcccccccggcaaccacagcctgagcctggaggcccccaggctgcatactgccagcgatctgctgggtaatcactccctggggctgcctctcatcactgctctggtgggatcaagggacagacgtggcagagtcttttcacctgttccagttccactccccactaaccctacgacacagcaccccacacggcaaaaactcccgagcactctcagcggtcatcgagtgtgccaggcacacggggaacccgtgctggggctttgtccactgttgccgctattttgctgtcctcctcatcctcctgatccttggagcttggagcgtcctagattctgcctgctctctaaagaggagggcaaatccttcggatttcatctgcagcaggaactcggcagagctggacacgtggtttgtcgagtagatcctgggacaagcgcacagagacaggggctacaggaaggggaccgtatccttgctgttaataatgatgtggtagaacacgaggattatgccgttgttgtccgacgaattagagcgtcatcgccacgtgtcctcttgacggtgctggcaagacacgctcatgatgtcgcacgagcccaactgggcgaagatgcacatttgtgtccgaccctgggcccaggcgtgcgtccccgtttgtgccatatagtgaaagatgaaggtgggttcggtttcagtgtgactcacggaaatcagggccctttttggctcgtgctgagcacaggtggagccgctgagcgagcaggggtaccgccaggcgccaggctgctcgaagtcaatggcgtgtcagtggaaaaatttacacacaatcagctgacccgaaaactgtggcagagcggccagcaggttaccctgctggtggccggaccagaggtagaagagcagtgcaggcagcttggcctcccacttgctgccccattagccgagggatgggctttacccactaaacctaggtgtttacacctggagaaaggcccacagggattcggattcctgctgcgcgaggaaaaaggactggacggccgcccaggccagtttttgtgggaggtggatccggggctcccagccaagaaagcagggatgcaggccggggaccggctggtagcagtggccggcgaaagtgtggaagggcttggccacgaggagactgtaagcagaatccagggccagggctcctgtgtgagtctgacagttgtggacccagaagctgaccgattctttagtatggttagactgagcccgttgctgttcctggaaaatacagaggcacccgcctcccctcgcggttcatctagcgcctcattggtcgaaaccgaggacccatctctggaggatacctcagttccttcggttcccctaggctctaggcagtgctttctctacccgggacctgggggctcgtatggatttcgtctctcctgcgtggccagcgggcctcgactgtttatcagtcaggtgactcccggggggtccgccgccagagccggtctccaagtgggagatgtcatactcgaagtcaatggctatcccgtcggtggccaaaatgacctggagcggctccagcagctccctgaggccgaacccccactgtgcctgaagctggccgctcggagtcttcgcggtctagaggcatggatccctcccggggccgcagaggactgggcactagcctctgatctattgtag

SEQ ID NO: 198825 - DNA, 1518 bp, Artificial Sequence
  Description of Artificial Sequence: Synthetic coding sequence
atggaggaggccctggacctgcaggacaccgccagcctgaccctgaaatttaaattcaatcccaaactcggaatcgacaatcctgtactgagccttgccgaggatcacgacccatacgatccctggagtctggaacggccgagattctgtctgctgagcaaggaggaaggaaagtctttcgggttccacttacagcaagagttgggaagagcaggccacgttgtgtgtcgggttgaccctggcaccagtgctcaaagacaagggctacaggagggcgatcgaatcctggccgtgaacaatgacgtggtggagcacgaagattatgcagtggtggtgcgacgcattagagccagctcccccagggtgctacttacagtactggctaggcacgcccatgacgttgctagagctcagctgggtgaggacgcacacctttgccccacactcggccctggcgtgcgacctaggctctgccacattgtgaaagacgaggggggcttcggcttttctgtgacccacggtaatcagggtccattctggttggtgctgtccaccggcggtgccgcggaacgggccggtgtgccccctggggctcgtctgctggaagttaacggtgtgagtgttgaaaaatttacacacaaccagctgacccgtaagctttggcagtccggacagcaagttactctgcttgtggcaggccccgaagtggaagaacagtgcaggcagctgggactgcccctagcggcgccgcttgccgagggatgggcccttcctacaaaaccacgctgtctccacctcgagaaaggcccccagggcttcggcttcctgctccgtgaggagaaaggactggacggtagacccggtcaattcctgtgggaagtggatcccgggctcccggcaaagaaggccggaatgcaagccggagatagattagtcgccgtggcgggagaatccgttgaaggactcggccacgaagagaccgtgtctcggatacagggccagggatcctgtgtgtctctgacggtggtggatcctgaagctgaccgattcttcagtatggttcgtctcagcccactgctcttcctagagaataccgaagcccccgccagtccccggggctcctccagcgctagcctggttgagaccgaggaccctagtctcgaggacacatctgttccatcagttccccttggaagcagacagtgcttcctttaccctgggccaggaggctcgtacggcttcagattgagctgcgtggcgagtggccccagactgttcatttctcaggtgacgcctggcggtagcgccgcaagggcggggctgcaggtgggagacgtcatcttagaagtgaacggctatccagtgggcggccaaaatgacttagaacgcctgcagcaattgcccgaagccgagcctcctctatgtctcaaactggctgctagaagtttacgagggcttgaggcttggattcctcccggcgctgccgaagattgggccctggcatctgacttgttgtag

SEQ ID NO: 198826 - DNA, 1716 bp, Artificial Sequence
  Description of Artificial Sequence: Synthetic coding sequence
atggtgacccccagcccccccggcaaccacagcctgagcctggaggcccctaggctacacacagcatcagacctgctgggtaatcactccctgggtctgccactgatcaccgccttagttggaagtcgggaccgccggggtcgagtgtttagtcccgtgcccgtgcctctgcccaccaaccccacaacacagcatcccaccagacagaagctcccctccacccttagcggccaccgcgtgtgtcaggctcatggggagcccgtgctcggcctgtgcccactgctccccttattctgttgccctccacacccccctgacccttggtctcttgagaggcctagattctgtcttctctcaaaagaggaggggaaatctttcggcttccacttgcagcaagaattagggcgagccggtcacgtggtgtgcagagtcgatccgggaacatcagcccagcgacaggggctgcaggagggggatcgaatcctggctgtgaacaatgatgtggtagaacacgaggattacgccgtcgttgtgcgacggatccgagcttcatcaccccgcgtgctgctaacagtgctggcgaggcatgctcatgatgtggcgcgagcgcaacttggcgaggacgcccatctgtgtcctacccttggaccaggagttcgcccacgcctgtgccatatcgtcaaagatgagggcgggtttggctttagcgtgacccacggaaaccagggtccgttttggctcgtgctgtccaccggtggggctgcggaaagggcaggggttcctccaggcgctcgtcttctggaagtgaatggcgttagtgtggaaaaattcacccacaatcagttgacccgcaagttatggcagtccggtcagcaggtgactctactcgttgccggaccagaggtcgaggaacagtgtagacagctcggtttgcctttagccgccccattagcagagggctgggcactgcctactaagcctcggtgccttcacctggaaaaaggcccccagggttttggcttcctgctccgggaggagaaagggctggatggacggccagggcagtttctatgggaggtagaccctgggctgcctgccaaaaaggcaggcatgcaggccggcgaccgtctggtcgcggtagccggggagagtgtcgaaggattggggcatgaagagaccgttagccgaattcaggggcaaggctcctgtgtttcattaaccgtcgtcgaccccgaggccgataggttcttctctatggtgcgcctgtcacccttgctgttcctcgagaataccgaggcccccgcctctccaagaggtagctcttccgcatcattggtggagacagaagacccgtcacttgaggacaccagcgtccctagtgttcccctcgggtcgcgccaatgttttctgtatccaggcccaggtggcagttatggctttcggctgagttgcgtggcctcgggacctagactgtttatttcacaagtcactcctggcgggtccgccgctagggccggactgcaggtgggagacgtgattctggaggttaacggctaccctgtggggggccaaaacgatttagagcggctccaacaactccctgaagctgagcctccactttgtctcaagctcgccgctcggtcacttagaggcctggaggcttggattccccctggcgcagcggaggactgggctctggcctccgacttattgtag

SEQ ID NO: 198827 - DNA, 2310 bp, Artificial Sequence
  Description of Artificial Sequence: Synthetic coding sequence
atgggctgcaacatgtgcgtggtgcagaagcccgaggagcagtacaaggttatgctgcaggtgaatggcaaggagcttagcaagctgtcccaagagcagacgctgcaggcgctgaggagctctaaggaacctctggtcatccaggttctaaggaggtccccccgcttacgcggcgatagtagctgccatgacctgcagctggtagattcggggacccaaactgacattacgttcgaacacatcatggccctcggcaagctccgccctcccacccctcctatggttatactcgagcctcctccaatttctcatgagtactacgacccagctgagtttatggaaggaggaccccaagaggccgacagactggatgaactcgagtacgaagaggtcgagctctacaaatcctcacacagagacaagctggggctaatggtctgttataggacggatgacgaggaggacctgggaatttatgtcggcgaggttaatccaaactctatcgcagctaaagacgggcggattagggagggcgaccgtattatccagattaatggcgtagatgtccagaatagggaggaggccgtagcaattctcagccaggaagaaaataccaatatttctttgctagttgctaggccagaaagccaactagctaagagatggaaagactccgacagagacgattttttagacgacttcggctctgagaacgagggtgagctgcgcgccaggaagttgaaatcaccccccgcacaacagcctggaaatgaagaggagaagggggcccctgacgcgggacctggtctcagtaattcacaggagctcgacagtggcgtgggccgtacggatgagagcaccagaaacgaggagtctagcgagcacgacttactaggggacgagccaccaagcagcacaaatactcccgggagccttaggaagttcgggctgcagggggatgcactgcagagtagggatttccacttcagtatggacagcctgctagctgaaggagctggcctgggtggcggggacgtgcccggtctaaccgacgaggagtacgaacgctatcgagagctgctggagataaagtgccacctggagaatggcaaccagctagggcttctgttcccacgggcctccggcggaaattccgcactggacgtcaatcgcaacgagtctctgggtcacgagatggcaatgctcgaagaggaacttaggcaccttgagttcaaatgcagaaatatactgcgcgctcagaagatgcagcagctgcgcgagcgttgtatgaaggcttggctcctcgaggaggagtcactgtatgacttggccgcctctgagcctaagaaacatgagcttagcgacataagtgaacttccagaaaagtcagataaggattcaacgagcgcctataacaccggagagagttgtcgcagcaccccgctcctggtggaacccttgcctgagtccccgttacggcgggccatggctggaaatagcaatttgaataggacaccaccaggaccagcggtggcaacacccgcaaaagcagccccaccgcctggctctccggcgaaatttcgctctctttccagagatccagaagccggtaggagacagcatgctgaagaacgcgggcggcgaaatcccaagacgggactgacgcttgagagagttggtcccgaatctagtccatacctgtccaggcggcaccgtgggcaggggcaggagggcgagcattaccattcttgcgttcagctcgcccctaccaggggcctcgaggagctcggccacgggcctctgtccttagcaggcggcccgcgggtgggaggggtggctgctgcagccacggaagccccgcgtatggagtggaaggtgaaagttcggtcagatgggaccagatacgtagccaaaaggcccgtccgagacagactgcttaaggcccgggctttgaaaatacgggaggagcgaagcggtatgaccactgacgacgatgcggtgtccgaaatgaagatgggtcggtattggagcaaagaggaaaggaaacagcatctgatcagagcccgggagcagaggaagagacgggagttcatgatgcagtccaggctcgaatgcctcagggagcaacagaacggtgatagtaagcccgaattaaatattatcgccttaagccaccgtaaaacgatgaagaaacggaataaaaagatcctggataactggatcacaatccaagaaatgcttgcccacggcgcccggtccgcggacggtaagcgggtgtataatcccctgctctccgttacaactgtgtag

SEQ ID NO: 198828 - DNA, 2085 bp, Artificial Sequence
  Description of Artificial Sequence: Synthetic coding sequence
atggccctgggcaagctgcggccccccaccccccccatggtgatcctcgaaccctacgtgctttccgaactgcctcctatatctcacgagtattatgatccggccgagttcatggagggtggaccacaggaagccgatcggcttgacgagcttgaatacgaggaagtcgagctgtataagtccagccatcgggataagctgggcctgatggtctgctatcgcaccgacgatgaggaggacctgggaatctacgtcggcgaggtcaaccccaattccatagccgccaaggacggccggattagagagggtgacagaatcatccaaattaatggtgtagacgtgcaaaaccgggaggaggctgtggctatcttgagtcaggaagaaaatactaacatctctttgctcgtcgcccgccccgaatcacagctggcaaagagatggaaggattcagatagagatgactttctggatgattttggttctgagaacgaaggcgaactccgggccaggaaactcaaaagcccccccgcccagcagccagggaacgaagaggagaaaggggcaccagacgcaggccctggcttaagcaactcccaggaactcgatagtggcgtcgggcgcaccgacgaaagcactcggaatgaagaatcatcagagcacgaccttttgggggacgagccccccagctccacgaacacgccagggagtctccggaaatttggcctccagggcgatgccctgcagtctcgggatttccatttcagcatggactccctgctcgcagagggagccggtctcggcggcggtgatgtgcctgggctcacagacgaggaatacgagcgataccgggaactcctagaaatcaagtgtcacctcgagaacggcaaccagcttggattgctgttccctcgtgcctctggcggtaactcagccttagacgtgaacagaaacgagtctctgggccatgagatggcaatgctcgaagaagaactgcggcacttagaattcaagtgtagaaacatcctgcgggcacagaagatgcagcagctgcgggaacgatgtatgaaagcttggttactggaggaggagtcactgtacgatctggctgcgtctgagcctaaaaagcatgaactgtctgatatcagcgagctgcccgagaaaagcgacaaagacagtacatccgcatacaacaccggcgagagctgccgcagcaccccactgctagttgaaccactcccagagtccccactccgacgcgccatggcgggaaactccaacctgaataggacaccacccggtcctgccgtcgcaacccctgccaaagccgcacctccaccaggaagtcctgctaagttcagatctttgtcccgcgatcctgaagccggccgaaggcagcatgcggaagaacgggggcgtcgcaaccctaagaccggattgactcttgaacgtgtggggcctgaatcctcgccatacttaagcaggaggcacaggggccagggccaggagggcgaacattatcatagctgcgtgcagttggcgcctaccagaggcctggaggaactcggacacggaccattatcattagccggcggtccacgggtagggggcgtggccgctgcggctaccgaggcaccacggatggaatggaaagttaaagttcggtctgacggaacacgatatgtcgctaagaggccagtgcgtgatcgccttctgaaggcgcgtgcactgaagattagggaggagcgctctggcatgaccaccgacgatgacgccgtgtctgaaatgaagatgggcagatattggtcgaaggaagagcggaagcaacacctaatacgagcccgcgagcagagaaagcggagggaattcatgatgcagagccgactggagtgtctgcgcgagcagcagaacggagacagcaaacctgagttgaacattattgccctttcccatcgaaaaactatgaaaaagagaaataagaaaattctggacaactggatcaccatccaggaaatgctggctcatggcgcccgctctgctgacggaaaacgagtgtacaaccccctgctgtcagtgacaactgtctag

SEQ ID NO: 198829 - DNA, 2022 bp, Artificial Sequence
  Description of Artificial Sequence: Synthetic coding sequence
atgaccgccccccccatcagccacgagtactacgaccccgccgagtttatggagggcggaccccaggaggccgatagactagatgaactggagtacgaggaggtagaactatataaatcctcgcatagagataaactgggattgatggtgtgctatcggactgatgacgaggaagacctgggcatttatgtgggcgaggttaatccgaactcaattgcagcaaaggacggccgcatcagggagggagatcgaataatccagatcaatggggtcgatgtgcagaatagagaggaagcagtcgctattctgagtcaggaagaaaatactaacatatcactactagtcgcacggcccgagtcccagctcgcgaagagatggaaggatagtgaccgcgacgatttcctcgatgatttcggctccgaaaatgaaggagagcttcgggctcgcaaactcaaaagtccgcctgctcagcagcccggtaacgaggaggaaaaaggcgctcccgacgccggacccggcctcagcaattctcaggagctggacagcggggtcggccggacagacgaatctacccggaacgaagaatcctccgaacatgatttgctgggggacgagcctcccagcagcacgaacaccccaggcagtttgcgcaaatttggtctgcaaggtgatgctcttcaatcaagagactttcactttagcatggactcacttcttgctgagggtgcagggttgggcgggggggatgtgccgggcctgaccgacgaagagtatgaacggtatagggaactcctggagattaagtgccatttagaaaacggcaatcagcttggcttactgttccctcgcgctagtgggggtaatagcgcccttgacgtgaaccgcaacgaatcactgggccacgagatggctatgctcgaggaggaactgagacatctggagtttaagtgtcgcaacattctgagggcacagaagatgcagcagctgagagagagatgcatgaaagcctggctgctggaggaggaatctttgtacgatctcgcagcctcagaaccaaagaagcatgagctttctgacatctctgagctgccagaaaagagcgacaaggactctacgtctgcttataacactggtgagtcctgcagaagcactccacttctggtggaacctttaccagagagccctctgcggcgcgccatggccgggaatagcaacctgaatcggactcctcctgggcctgcagtggctacccctgccaaagcagccccgccaccgggctcacccgcaaaatttagatctctgtcacgcgacccggaagcgggccgccgccagcacgcagaggagagagggcgccgcaatccgaagactggccttactctcgaaagggtcgggcctgagagctcaccctacctgagtaggcgccacaggggacagggccaggagggtgagcactatcactcatgtgttcagctggcacccacccgtggacttgaagaactgggtcacggaccactctcgctcgccgggggcccccgtgttggaggagtggccgctgcggctaccgaggcgccccgaatggagtggaaggtaaaagtaagaagtgatggaacccgatatgtggcgaagcgacctgtgcgggatagattgttgaaggcacgggccttaaaaataagggaagagcgctccgggatgacaaccgacgatgacgcggtaagcgagatgaaaatgggcagatactggtctaaggaagaaagaaagcaacatttaattcgagctagggaacagagaaaaaggcgcgagttcatgatgcagagccgcctggagtgtctcagggagcagcagaacggagacagtaagccagaactgaacataatcgccttgagccatcgtaagaccatgaaaaaacgcaataagaagatactagacaattggatcaccatccaagagatgctggctcacggcgctagatctgccgatgggaaacgggtttacaatccacttctatccgtgaccacggtatag

SEQ ID NO: 198830 - DNA, 1983 bp, Artificial Sequence
  Description of Artificial Sequence: Synthetic coding sequence
atgggctgcaacatgtgcgtggtgcagaagcccgaggagcagtacaaggtcatgcttcaggaagtggaactgtacaaaagctctcaccgggacaagctggggcttatggtctgttacaggacagacgatgaggaagacctcggcatatatgttggggaggtcaatcccaatagcattgctgccaaggatggacgcatacgggagggtgatcggatcatccagatcaatggcgttgacgtacagaaccgcgaggaggctgtggcgatcctttcccaggaggagaacaccaacattagccttctggtggctaggccagagagtcagctggcgaagcggtggaaagactcggaccgtgacgattttttagatgattttgggtccgaaaacgagggtgagctgcgagcgcgcaagctcaagagccctcccgcgcaacagcctggaaacgaagaagagaagggggccccagacgctggaccaggcctgagcaatagtcaggagctggacagcggagtgggaaggacagacgaatccaccagaaacgaggagagcagcgagcatgatctactgggagacgaaccacctagttccacaaacacgcctggctccctccggaagttcggcctgcagggggacgcacttcagagccgggatttccacttctccatggactcgctcctggccgagggcgccggactcggcggaggtgacgtgcccggtctgaccgacgaagagtatgagaggtatcgagaactgctagagattaagtgccatctggaaaatgggaatcagctgggcctcttgtttccccgcgcctctggagggaacagtgctcttgacgtgaaccggaatgagtcattaggacatgaaatggccatgcttgaagaggaactgcgccatcttgagttcaaatgcagaaacattctgcgggctcagaagatgcagcagcttagagaaagatgcatgaaggcttggctgttggaagaggaatctctatacgatttggcggcaagtgaacctaaaaagcatgaactctcagatataagcgaacttcccgagaagtcggataaggacagcacttcggcctataacacgggggagtcatgccggtctactcccctgttggtagagcccctgccagaatcccccctgcggagggctatggccggtaactctaacctgaatagaaccccccctggacctgccgtggccactccagctaaggccgccccaccaccaggcagccctgcaaagttccggtcccttagtagggatcccgaggctggccgacgccaacatgccgaggagcggggacgccggaaccctaaaacaggattaacattggaacgggtgggcccggaatccagtccttatttatctcgcaggcaccggggacagggacaggagggagagcactaccactcctgtgtgcagttggcacccacgagagggctggaggaattaggtcacgggcccttgtccctcgctgggggccctagagtgggtggagtcgccgctgccgccaccgaggccccaaggatggaatggaaggttaaggttaggtctgacggcacgcgctatgtggctaagagacccgtacgagaccggctgcttaaagcccgcgcactgaagatccgagaagagcggtcaggcatgacaaccgacgacgatgctgtgagcgaaatgaagatgggacgttattggagcaaagaggaacggaagcagcacttaatacgggcacgcgagcagcgtaaaagaagggaatttatgatgcagagtaggctcgaatgtctcagggaacagcaaaacggagatagcaagccagaactcaacattatcgctctttctcacaggaagaccatgaagaaaagaaacaaaaaaatattggacaattggattactatccaggagatgctagctcacggagctagatctgccgacggcaagcgtgtctataatcccctgctttcggtcaccacagtgtag

SEQ ID NO: 198831 - DNA, 1554 bp, Artificial Sequence
  Description of Artificial Sequence: Synthetic coding sequence
atggcccagggcttcgccgtgggcttcgaccccctgggcctgggcgacctctccagcggctcactgagctctctctccagtcgcggacacctcggttccgacagtgggagcaccgccaccaggtatcttctgagaaagcagcagcggctgctcaacgggcctccccgggggattcgggccagcagcccaatgggtcgggtcattctcattaattcacctatcgaagcaaactctgatgagagtgatataatccacagtgtccgcgttgaaaagagtcctgctggcaggctagggtttagtgtgcggggaggaagcgaacacggactcgggatcttcgtgtcaaaggtcgaggaaggaagcagcgctgagcgggccggcctgtgtgttggagacaagataacagaggttaacggtctctctctcgaatctaccaccatggggagcgccgtcaaggtgctcacatcttcatcacgattgcacatgatggtgcggagaatggggcgggtccccggtatcaagttttctaaggaaaagactacttgggtggacgtagttaatagacggctggtcgtggagaagtgcggatccaccccttctgatacatcatcggaagacggtgttcggcgcatcgttcacctctacaccacatctgacgacttttgcctgggcttcaatatacgtggcggaaaggagttcggcttgggaatctacgtatcaaaagtggaccacggtggcttagcggaggaaaacggcatcaaggtcggcgatcaagtcctggcggccaatggcgtacgattcgatgacattagccactcacaggcagttgaggtcctcaagggacagacacatatcatgctgacaataaaagagacgggacgctatcctgcttacaaagaaatggtatccgagtactgttggctggaccgcctatctaatggggttctgcagcagcttagtcccgcttcagaatcttcctcaagcgtttctagttgtgcctccagcgcaccttatagctccggcagccttccctctgataggatggatatttgcctcgggcaggaggagcccggtagccggggtcctggctggggccgcgccgataccgctatgcagacagagcctgatgcgggcggtagagtggagacttggtgctccgtcaggcctacagtaatcctgcgtgacacggccatacgttcagacggtccgcaccccggtaggagattggactccgcattatctgagagccccaagactgctctgctgctcgccctgtcccgccctcgtccacccattacacgctcccagagctatttgactctgtgggaggaaaagcagcaacgaaagaaggaaaaatccgggtcccctggcgagaaaggagccctacagcggtccaaaactctgatgaatctgtttttcaagggggggcggcagggcagactcgcacgcgacggaaggagggaggcatggacccttgacagcggatctttggctaagacgtacccccgcctggacattgagaaagagatgggtgtctcaccctgctgccccggttag

SEQ ID NO: 198832 - DNA, 3102 bp, Artificial Sequence
  Description of Artificial Sequence: Synthetic coding sequence
atggcccagggcttcgccgtgggcttcgaccccctgggcctgggcgatctctcatccggcagcttatccagcctaagctctcgaggtcatttaggaagcgattctggatccaccgctacacggtacctccttaggaagcaacagcggctgctcaacggtcctcctagagggatcagggcctcctctccaatggggcgagtcatcttaataaactccccaattgaagccaatagtgatgagagtgacattatccactcggttcgggtagaaaaaagtccagcgggaaggttgggctttagtgtgaggggcgggtccgaacacggcttgggtattttcgtgagcaaagtcgaagagggatctagtgccgagcgggcgggcctgtgcgtgggagataagatcactgaggtgaatgggctctccttggagtcaacaactatgggcagcgccgtgaaagtccttacaagcagttccagactccacatgatggtgcggcggatgggtcgggtgccaggtattaagtttagcaaagagaagaccacctgggtagacgtggtaaacagaaggcttgtggtcgagaagtgtggatcaaccccctctgacaccagttccgaggatggtgtgcgtcggatcgtccatttgtatactacatctgatgacttttgtctagggttcaacatacgtgggggaaaggagttcgggctgggcatctacgtttctaaagtggaccacggcggcctggccgaagagaatggaattaaagtaggagatcaagtcttagctgccaacggagtacggttcgatgatatttcccattcacaggctgtggaggttctaaagggccaaacccatatcatgcttaccattaaggaaaccgggcgctacccagcatacaaggagatggtcagcgagtattgttggcttgacagactttctaacggagttctccaacagctcagccctgccagcgagtctagttcgtcagtgagcagctgtgcaagctctgcaccctatagttccgggtctctccctagcgatcgcatggacatttgcctgggccaggaggaacccggtagccgcggccctgggtggggacgcgcagacacagcaatgcagacagaaccagatgctggagggagagtggagacatggtgctctgtcagacccacagtgatactaagggatacagctatccgatcagacggtccacatccaggcaggcggctggactccgccctctcggaatcccccaagacagcgctactgctcgccttgtcccgcccaagaccccctatcacccggtcacagtcttatttgacactctgggaggagaaacaacagcggaagaaagaaaaatccggtagtcccggcgagaaaggagccctacagcgatccaagactctgatgaacctgtttttcaaaggcggacggcagggccgcttagctcgtgacggccggcgggaagcttggacactggatagtggcagcctggcaaaaacctatccaaggctcgatattgagaaagccggcggagttggacccgttcagaagtttgtgacttggcgtcttcgcagagatcaagagagaggaagagccttgctgagtgcacgcagcggatctcccagtagtcagctgccaaacgtcgacgaacaagtccaggcttgggagtctagaagacccttgatccaagaccttgcacagcgtctgctgaccgatgatgaggtactcgctgtgactcgtcactgctcccgttatgtccatgagggaggaattgaggatctagttcgtccactcctggccatcctggatagaccagagaaactactgctgcttcaggatatccgctctgttgttgcgcccactgacttgggacgtttcgactcaatggtgatgcttgtggaattagaggccttcgaggctctgaagtccagggcagtgcgccctcccgctctccgacccgctcgccaggatacccctcccaaaaggcatctcatcacgccagttccagattcccgtgggggattctatctgcttcctgtgaacgggttcccagaggaagaggataacggagaactgcgcgaacggctgggggccctcaaagtgagtccctcagcatcagccccccgacatccgcacaagggcattcctcccctccaggacgtgcctgtggatgctttcactcccctgcgcattgcgtgtaccccacctccacagctgccgcccgtcgccccgcggcccctgcgtcccaactggctgttaaccgagcctctaagtcgtgaacatcccccacagtcccagatccgaggacgagcccagtctcggagccgctccagatctaggagtaggtcaagaagcagccgggggcagggcaaaagtccaggacgccgcagtccttcacccgtgccaacccccgccccctctatgaccaatggccgctaccacaaacccagaaaggcaaggccaccattaccgaggcctctagacggcgaagctgccaaggtgggggcaaagcaggggccatctgagagcgggactgagggcaccgccaaagaggccgctatgaaaaatccatccggagaacttaagaccgtcactttgtctaaaatgaagcagtccctaggaatcagcatcagcggaggcatcgaaagcaaggtgcagccgatggttaaaatcgagaagatcttccctggtggggcggctttcctctccggcgcattacaggctgggttcgagctggtggccgtcgatggcgagaaccttgagcaggtgacccatcaaagagccgtggacacaatccgcagggcttaccggaacaaggcccgagagccaatggaactggtggtgcgtgtccccggacctagcccacggccgtccccctccgacagtagcgccctcacagacgggggactgccggcagaccacctgcctgcccaccagccgctcgatgctgcacctgtgccagcgcattggctgccagaaccacccacaaacccccagacgcccccaaccgatgctaggctgttacaaccaactccatcaccagccccatccccagcactccaaacaccagactccaaaccagcacccagtccgcgcatcccctag

SEQ ID NO: 198833 - DNA, 627 bp, Artificial Sequence
  Description of Artificial Sequence: Synthetic coding sequence
tgaccccggccccccatcacccggagccagagctacctgaccctgtgggaagagaagcagcagaggaaaaaagagaagagtggctcacctggcgaaaaaggagccctgcaaaggagcaagacactgatgaacctcttctttaaaggcggccgccagggaaggctcgcccgcgacgggagaagggaggcctggaccttggacagtggttcccttgccaagacatacccccggcttgatatcgagaaagcaggcggagtaggccccgtgcaaaagttcgtgacctggcgcctgcgtagagaccaggagcgggggcgggcacttttatctgcgcggagtggctcaccgtcaagtcagctgcccaacgtggatgagcaggtccaggcctgggagagcaggagacctctgatccaggacctggcccagagattacttactgacgatgaggtcctcgcagtgacccgccactgctccagatacgtccacgaaggaggaatcgaggacttagtcagacctttgttggcgattctcgatcgtccagagaagcttcttttactgcaggacattcgctctgtagtagcaccgactgacctggggagattcgactcaatggtcatgctggtagaatag

SEQ ID NO: 198834 - DNA, 3465 bp, Artificial Sequence
  Description of Artificial Sequence: Synthetic coding sequence
atgggcctgctgctgatgatcctggccagcgccgtgctgggcagctttctgaccctgctcgctcagtttttcctgctgtacaggaggcagccggagccgcctgcggacgaggccgcccgagcgggcgaaggcttcagatacatcaaaccggttcccggtctgttgttaagggaatacctgtacggcggaggacgggatgaggaaccctctggcgccgcccctgaaggcggcgctaccccgactgcagctccagagactcctgctccgccgacccgcgaaacttgttatttcctaaacgcaacaatcctcttcctgttcagggagctgcgggatacggccctcactagaaggtgggttactaagaagattaaggtagagtttgaggaactcctacagactaagaccgcagggagactcttggagggcctgagcctgcgggacgtgttcttgggcgagactgtgcccttcatcaagaccattcggctcgttcgacctgtggtccctagcgccaccggggagccggatggtcctgagggggaggccttgcctgccgcttgcccagaagagcttgcctttgaagctgaggtcgagtacaacggcggattccatttggcaatcgacgtggacttggtcttcgggaaatccgcttacctctttgtgaagctgtctagagtggttggtaggctgcggcttgtctttacgcgggtacctttcacccattggtttttttcctttgtggaggatcctcttatcgattttgaagtcagatctcagttcgaggggagaccgatgcctcagctaacatccataatcgtgaaccagctcaagaaaatcattaagcggaagcatactttgccaaattataagattcggtttaaacccttctttccctaccagaccttgcaaggcttcgaggaggatgaagaacatattcacattcagcagtgggcactgacggaaggccgtctcaaagtgaccctgcttgaatgttctaggctactgattttcggatcttacgaccgtgaagccaacgtccactgtaccctcgaactgagcagttctgtgtgggaggaaaaacagaggtcctctatcaagacagttgaactgatcaaggggaacctgcagagcgtgggcctaactctacgactggtccagtccaccgatggttatgccgggcatgtcattatcgagaccgtcgcccctaattcacctgcggctattgcagatttgcagcggggcgacaggctaatcgccattggtggggttaaaattacttcgactctgcaggtgctgaaactgatcaagcaggccggtgacagagttctggtttattatgaacggcctgtgggacagtcgaatcagggcgccgtcctgcaagacaattttggacagctggaggagaactttctctctagttcctgccagtcaggctacgaggaggaggccgccggtttgaccgtcgacactgaatcgagagagctagattctgagttcgaagatctcgccagcgatgtgcgagcacaaaacgagtttaaggacgaggcacagtctctcagtcacagtcccaagcgggtaccaaccaccctcagtatcaagccgttaggcgctatttcccctgtacttaaccgaaagctcgctgttggttcacatcccctccctccaaagattcaatccaaggacgggaacaagcccccccctcttaagacttctgagatcaccgatcccgcccaggtctccaaacctacacagggcagtgctttcaagccacccgtgccgccaagaccccaggctaaggtgcccctgccaagtgctgacgctcctaaccaggccgaacccgatgtcctcgtcgagaagcccgagaaggtcgtcccaccaccgctcgttgataagtctgctgagaagcaggccaaaaatgtcgacgcaattgacgatgccgcagctcccaagcagttcctggcaaaacaagaggtggcaaaggatgttaccagcgagacgtcttgtcccactaaggacagcagcgatgaccgccagacctgggaatcatccgagattctctataggaataaactggggaaatggacacgcacgagagctagttgcctgtttgacattgaggcatgtcatagatacctcaatatcgcactgtggtgtagagatccatttaagctgggagggctgatttgtcttggacatgtaagcctgaaattggaagatgtcgctctgggatgcctcgctacaagcaatactgagtatctctctaagctgcgtctggaggctccttcacccaaagcgatagttactcgaactgccctccgcaacttgagtatgcagaaaggtttcaatgacaaattttgttatggagatataacaatccacttcaagtatttaaaggagggtgaaagtgatcaccacgtagtcacaaatgtagaaaaggagaaggaaccacaccttgttgaggaggtcagcgttcttccaaaggaggagcagtttgtgggccagatgggcttaacagaaaacaagcactcatttcaggacacgcagttccagaacccaacctggtgcgattattgcaaaaaaaaagtgtggactaaagccgcatcccaatgcatgttctgcgcctacgtatgccacaagaaatgccaggagaagtgcctcgccgaaacgtcagtgtgcggcgccacagaccgtcgaatagataggactcttaagaatttacggcttgagggacaggagactcttcttggcctccctcccagagttgatgccgaggcttctaagagcgtgaacaaaaccaccggcttgactaggcacatcattaatacctccagtaggctcctgaacctccggcaggtgtctaaaaccaggctgagtgagcctggtactgatctcgtggaaccttcccctaaacacacgcccaacaccagcgacaatgaaggctctgatactgaggtgtgcggccccaattctccttctaagcggggtaacagcactggaattaagctggtccgcaaggagggaggcctcgacgattccgtcttcattgcagtgaaggagatcggtcgagatctgtacaggggcctgcctaccgaggaaaggattcaaaagctggaattcatgcttgacaaactgcagaacgagattgaccaggaattagaacacaataatagtctggtgcgggaggagaaggaaacaacagatacacgcaaaaagtctctgctgagcgccgccctcgctaagtccggggagagactccaggccctgacattgctgatgatccactacagagccggcatcgaggatattgagacgcttgaaagcctttctctggaccagcacagcaagaagatctccaagtacaccgatgacactgaagaggacctggacaatgagatcagccagctgatcgactcccagccgttttcatccattagcgacgacctgtttggaccatcagagtctgtttag

SEQ ID NO: 198835 - DNA, 3201 bp, Artificial Sequence
  Description of Artificial Sequence: Synthetic coding sequence
atgggcttcgagctggaccggttcgacggcgacgtggaccccgacctcaaatgcgccctgtgtcacaaggttctggaagatcccctcactaccccatgcggacacgtcttttgtgctgggtgtgtactcccctgggttgtgcaggaaggttcatgccccgcacgctgcagaggccggcttagtgctaaggaattaaatcacgtgcttccccttaagcggctcatcttgaagttagacataaaatgtgcttacgcaactcgcggctgtggcagagtggtcaaattacagcaactccccgagcacttggagcgctgtgacttcgccccagctcgctgtagacatgctggctgcggacaagtgctgcttcgtcgggacgtggaggcccatatgcgggatgcgtgtgatgccaggcccgtcgggcgttgccaagagggatgtggattgcctttaacacacggtgaacaacgagctggagggcattgttgcgccagggcactacgagctcataatggcgctctgcaggctagactaggagccctccacaaggccctcaagaaggaggccctgcgggccggtaagagggagaagtccctggttgcccagctggcggccgctcaactggagcttcagatgaccgctctaaggtatcagaagaagtttacggagtattctgcacgccttgatagcttaagtagatgtgtggccgccccccccggaggcaaaggagaggaaacgaaaagcttgaccttagttctgcatcgggactcgggtagcctcggcttcaacattattggtgggcgacccagcgtggacaaccacgatgggagctcctctgagggaatatttgtgagcaagatcgtcgattccgggccagccgccaaggaaggcggactgcagattcacgaccgaatcattgaagtgaatggccgtgacctgtctcgcgccactcacgatcaggcagtggaggctttcaagactgccaaggaaccaattgtcgtgcaggtactacgacgcaccccgcgcaccaaaatgtttactccaccctcagagagtcaattggtggacaccgggacccagaccgacatcacattcgagcatatcatggccctgacaaaaatgtcctctcctagtccacccgtcctggacccttacctgctccccgaagagcacccttccgctcatgagtattatgatcctaacgattacatcggtgatatccatcaggaaatggatcgtgaggagctagagttagaggaggtcgacctctatcgcatgaattcacaggacaagttgggcttgaccgtgtgctaccgtacggacgacgaagacgatatcggtatttatattagcgaaatcgacccaaattctatagccgccaaagacggacgcatcagagagggcgacaggatcatacagatcaacggcatcgaagtgcaaaatcgggaggaagctgtagccctgctgaccagcgaagaaaacaaaaacttctcactgctcatcgctagaccagagttgcagctggatgaaggttggatggatgacgaccggaacgactttttggacgacctccacatggatatgctcgaggagcagcaccatcaggccatgcaattcaccgcatctgtattgcaacagaaaaagcacgatgaggatggcggtacgaccgacaccgcgactatcctcagcaatcagcacgagaaggatagcggagtcggccggacggacgaaagtactcgtaacgacgaatcctcagaacaggaaaataatggagacgatgctacggcctccagcaaccccttggccggacagcgcaagttgacttgcagccaagataccctcggcagcggggacctccccttttctaacgagagcttcatctccgcagattgtaccgatgcagactacctcggtattccggttgatgagtgcgaaagatttcgggaacttctggaacttaaatgtcaggttaaatccgctaccccatacggactttattaccctagtggacccctggacgccggaaagtcagatcctgagagtgtggacaaggaacttgagctgctcaatgaagaactcaggtccattgagctagaatgtctctcaattgttagagcccacaagatgcagcagttgaaagaacaataccgggagagttggatgctccacaattcagggtttagaaactataacacctccatcgacgtcagacgacatgaactgagcgacatcacagaattacccgagaaaagtgacaaggatagcagtagcgcctacaacaccggagaatcctgccgatctacccccctgacgctggaaatcagcccagacaattctctgcgcagggctgccgaggggatttcttgcccttctagcgagggagccgtgggcactaccgaagcctatggtccagcatcaaagaacttgcttagcattacggaagacccagaggtgggcacgcctacatactctccgtctctcaaagaactggaccccaatcagcctctcgaatctaaagaacggcgtgctagtgacgggtcccggagccccacgccgtctcagaagttaggcagcgcttatctgcccagttatcaccatagtccgtacaagcacgcacacatccccgcccacgcccagcattaccagtcatatatgcagttgatccaacagaaaagcgccgtggaatacgcacaaagccaaatgtctctagttagcatgtgcaaggacttatcgtcacctactccatcagagcctcgcatggaatggaaggtcaagatcagaagcgatggcacccgttatatcaccaagagaccagttcgcgatcgtctcttgcgcgaacgggctttgaaaattcgggaggaaaggtctggaatgacaactgacgatgatgcagtctccgaaatgaaaatgggaaggtactggtctaaggaagagcgcaaacagcacctcgtaaaagcaaaagaacagcgccgaaggcgggaatttatgatgcagtcaagactcgattgcctcaaggagcagcaggccgcggatgatcgaaaggaaatgaatatactagaactttcccataagaagatgatgaagaaacggaacaagaaaatcttcgataattggatgactatccaggaactgctaacccacggcacaaagagtcccgatggcacccgggtttataactccttcttatccgtcacgacggtttag

SEQ ID NO: 198836 - DNA, 2190 bp, Artificial Sequence
  Description of Artificial Sequence: Synthetic coding sequence
atgggcttcgagctggaccggttcgacggcgacgtggaccccgacttgaaatgcgcattgtgccacaaagtactggaagaccctcttactactccctgcgggcatgtattttgtgcagggtgtgtcctgccatgggtggttcaggaggggtcctgccctgcccgttgcagaggacggttgagcgctaaggagctgaatcacgtcctaccactgaagcgcctcattctgaagctcgacattaaatgcgcttacgccacccgggggtgcgggagagtagtcaagttgcaacagctgcctgagcacctcgagcggtgcgacttcgcacccgcacgttgtcggcatgcaggctgtgggcaagtgctgctcagaagggacgtggaggcccacatgcgggatgcctgtgacgcaaggccagtagggcgttgccaggaaggttgcggcttgcctctgacacacggagaacagcgggcaggtggccattgctgcgcgagggccctgcgcgctcataacggcgctcttcaagcaagattaggtgcgttgcacaaagcgttgaaaaaggaggctctgcgtgccggaaagcgagagaagtcattggtagcacaattagcagcggctcagttggaactccagatgacagcactgaggtaccaaaagaagttcaccgaatatagcgctcgcttggactcactgagcagatgcgtcgctgccccccctgggggtaagggcgaggaaactaaaagcctgacccttgtcctgcaccgcgattccggatcactcgggttcaatatcatcggcggtcggccttctgtagacaatcatgacggatcgagtagcgagggaatctttgtatcaaagatcgtcgactccgggcctgccgcaaaggagggcggcctccagatccacgatcgcatcatcgaggtcaatggacgagacctatcccgcgcaacacacgatcaagcggtggaggccttcaagactgctaaggagcccatagttgtccaggttctgaggaggacaccgcggactaagatgttcaccccaccctctgaatctcaactggtcgacaccggaacacaaactgacataaccttcgagcacatcatggctctcactaaaatgtcgagcccaagtcctccagtgcttgacccctacttgctgcccgaggagcacccatccgcacacgaatactacgaccccaatgattacatcggcgatatccaccaagagatggatcgcgaggagctcgagctggaggaagtagacttatatcgtatgaactctcaggataagctggggctcacagtgtgttatcgaactgatgacgaggacgacattggaatttacatctctgaaatagaccccaactccatcgctgctaaggacgggcgcatccgagagggggaccgcattattcagatcaatgggatagaggtacagaatagagaggaagcagtcgccttgctgacatctgaggaaaataagaatttctccctattgatagctcgcccagagctgcaattagatgagggatggatggatgacgacaggaacgactttctggatgacttgcatatggacatgttagaggaacagcatcaccaggcaatgcagtttactgcctccgtgcttcaacagaaaaagcatgatgaggatgggggcactaccgatacggctaccatcctgagcaatcagcacgaaaaagactctggtgtcgggaggacagacgaaagtacacggaacgatgagtcctccgagcaggaaaataatggcgacgacgccacagcatcgagcaaccctctggcgggccagaggaaactgacttgttcacaagacactctcggctctggcgacctgcccttcagcaatgaatcttttatcagtgccgactgtactgacgctgactacttgggtatacctgtggaaggtgaggatcctcaacggagggacgcgctgcatcatcaggaggcgcgtgctggaccccctgcggcaggcgcacggccagaagatccaggacgcgcccagagacatgaccaccgccggcggaggggcgagcgcgatgaggatggcgcgctgttagaacaaggtggcgaagaagcagcgcccggcgaaggacagggggctgccgctgcagcgagggtccacgacgccgagcaagtcgggctgtcgcagggagccgcatcctctcgatag

SEQ ID NO: 198837 - DNA, 2352 bp, Artificial Sequence
  Description of Artificial Sequence: Synthetic coding sequence
atgggctgcagcctgtgcagcctgcagaagcaggaggagcagtacaagcttctgtatgaggtgtgccaggtcaacgggcgggacctgtctagagccactcatgaccaggctgtggaggcattcaagactgcaaaagaacccatagtggtgcaggtgctgagaagaacacctcgaacgaaaatgttcactcccccatctgagtcccagctagtcgacaccggaacacaaacagacattaccttcgagcacatcatggcactaacgaaaatgtcgagccccagtccacctgtgttggatccatacttactacccgaggaacatccaagtgctcatgagtattatgatccgaatgactatatcggcgatatccaccaggagatggatcgggaggagttggagctcgaagaggtggatctgtataggatgaactcgcaggataagctgggtttgaccgtatgctaccggacagacgatgaagatgacatcggtatatatatttccgagatcgatccgaacagtatagcagcgaaggacgggaggatcagagagggggacagaattatacaaattaacgggatagaggtacaaaatcgggaagaggcagtcgctctgctgacaagcgaggaaaataaaaatttctccctgcttatcgcgaggcccgaactgcagctggacgaggggtggatggatgatgaccgcaacgacttcctcgatgacttacacatggacatgttggaggaacaacaccaccaggcaatgcagtttactgcatctgtgctgcagcaaaaaaaacacgatgaagatggaggcaccaccgatactgcaaccatattatctaaccaacacgagaaggatagcggagtcggccggaccgacgagagcactagaaatgacgagtccagtgagcaagagaataacggtgacgacgctacagccagctcgaaccccctcgccggtcagcggaagctgacctgttcacaagatacactcggctctggcgacttacctttcagtaacgagagtttcatatccgccgattgcaccgatgctgactacctgggcattcccgtggatgagtgtgaacggttcagggagctactcgagctgaaatgccaggttaagtcggcgacaccctatggcctgtactatccctcaggacctctggatgctgggaagtccgaccctgagagtgtcgataaagagctcgaactgttgaatgaggagcttaggtctatcgaattggagtgtctttcaatagtgagggcccataaaatgcagcagttgaaggagcagtaccgggagtcttggatgctccataacagcggctttcgcaactacaatacctccatcgacgtcagaaggcatgaactctctgatatcaccgaactaccagaaaaatccgataaggatagtagtagcgcttacaatacgggggaatcttgtagatcaaccccgcttactctcgagatttctccggacaacagtttgcgcagggccgctgagggcatttcttgtccaagtagcgaaggggccgtgggcacaaccgaagcctatggaccagccagcaaaaatcttctctccataaccgaggacccagaagtgggaacacctacgtacagccccagcctgaaggaacttgatcctaatcagcccctggagtcaaaagaacggcgagcctccgatgggagccgaagcccaactcctagccaaaagctaggaagcgcgtatctgccctcatatcaccacagtccttacaaacatgcccatatccctgctcatgcccagcattaccaatcatacatgcagctgattcagcagaagagcgcagtggagtatgcccagtcccagatgagcctcgtgtcaatgtgtaaagatctctctagtcccacacccagcgaacctagaatggaatggaaggtgaagattcgcagtgatggcacgagatacattacgaaacggcccgttcgcgatcggttgctaagagagagagcattaaaaatacgcgaggaaagaagtggcatgaccacggatgacgatgctgtgagcgaaatgaaaatggggcggtactggtcaaaagaggaaagaaaacagcacctggttaaagctaaggaacaacgccggaggcgtgagtttatgatgcagagcagactggactgcctgaaggagcagcaagcggcagatgacagaaaagagatgaatatcctggagctgtctcacaagaagatgatgaagaagcgtaacaagaagatctttgataactggatgacaatacaggagctactaacacacgggactaagagtccagatggcacccgagtatataactcattcctttccgtcaccaccgtatag

SEQ ID NO: 198838 - DNA, 2367 bp, Artificial Sequence
  Description of Artificial Sequence: Synthetic coding sequence
atgaagatggagcacaagcggatgatcctgctgttcagcaagttcactttgatccacaaacctcatgggggacgctggtatctggtgaatgggcgcgatctctcacgggccacccacgatcaggccgtggaggcttttaaaactgccaaagagccaattgtcgtgcaggtcctgcggcgcactccaagaactaagatgtttacaccgccttctgagagccagctcgtcgatacaggcacacaaactgatatcacttttgagcatatcatggcactgactaaaatgtccagtccaagcccgccagtccttgatccttacctgcttcctgaagaacatccttcagcgcacgagtattatgatcccaacgattatattggggatatccaccaggagatggaccgggaagagctagaactggaagaagtggatctttaccgcatgaacagccaggacaaactgggtctgactgtctgttaccgcacagacgacgaagacgacataggaatctatatctcagaaatcgatcctaactccattgctgcaaaagatgggcgaatcagagagggtgatcgtattatacagataaatggcatcgaggtgcaaaacagagaggaggccgtagcccttcttactagcgaggaaaataagaatttctctcttctaatcgcccgtcctgaactgcagctcgacgaaggctggatggacgatgatagaaatgactttctggacgacctacacatggatatgctcgaagaacagcaccatcaggcaatgcagttcactgcttccgtactacaacagaaaaagcatgacgaggacgggggaacaaccgacactgccactattctctccaatcagcacgagaaagactcaggcgtaggcagaaccgatgagagcaccaggaacgatgagtccagcgagcaagaaaacaatggagacgacgctacggccagtagcaatccactggcggggcaacgaaagttgacgtgcagtcaagacacattggggagcggagacttgccgttcagtaacgaatcatttatctctgccgactgcactgatgccgactacctgggcataccggtcgacgaatgcgagcgatttcgagaactgctcgagctaaagtgccaggtgaaaagtgctaccccctacggtttgtactacccttcaggacctttagacgccgggaaatctgatcccgagtcggtcgacaaagagctagagttgctgaacgaagagttgagatctattgagctggagtgtctgagtatcgtgcgggctcacaagatgcagcaacttaaggagcaatatcgtgaaagctggatgttgcacaatagcgggttcagaaactacaacacttcgatcgatgtgcgcagacatgagctgtccgacatcactgaactacccgaaaagtctgacaaggattcctcctctgcatataacacgggggagtcttgccggtccaccccattgactctggaaatatcaccagataactctctgagacgtgccgccgaaggaataagctgcccttcgtctgagggtgcggtcggaaccaccgaggcatacggcccagcctcaaaaaatttgctttccattaccgaagacccagaagtcggcacgcctacatattccccatccctgaaggaactagatccaaatcaacccttagaatcgaaagagagacgggctagtgacgggagccggtctcctactccctctcagaaactgggctctgcctatctgccatcgtaccatcacagtccatacaaacacgcgcatatccctgcccacgcccagcactatcagagctatatgcagctaattcagcagaaatcggccgtcgaatacgcccaatcccagatgagtcttgtttctatgtgcaaagacctatcctctccgaccccaagcgaaccaaggatggaatggaaagtgaaaattcgcagcgacggcaccaggtatatcactaaaaggccggtgcgggaccgcctcctgagagagcgagccttgaagatcagagaggagaggagtgggatgacgactgacgatgatgccgttagcgaaatgaaaatgggccgctactggtccaaggaggaaagaaaacaacacctcgtcaaagctaaagaacagcggcgcagacgcgagttcatgatgcagtcccgtctagactgcctgaaagaacagcaggcagccgatgataggaaagagatgaatatcctggagttgtcccacaagaagatgatgaaaaaaaggaataagaaaatcttcgataattggatgactattcaggagttattgactcatggcacaaagagtccagatggcacgagagtgtataattcatttctttcggtgaccactgtgtag

SEQ ID NO: 198839 - DNA, 2331 bp, Artificial Sequence
  Description of Artificial Sequence: Synthetic coding sequence
atgagcggcaagcggcagttcttcctgaagcccctggccctgctgacctgttggccaagtaccgtcaacggaaaagacctgtccaaagcgacccatgaagaagctgttgaggcctttcgaaatgccaaagagcccatcgttgtacaagttttgcgacgaacgcctctgtctcgacctgcatacggcatggcaagcgaggtgcaactcatgaatgctagcacccaaaccgatatcacattcgaacatataatggcccttgctaagctccggccgccgacaccccccgttccagacatatgcccgtttctgctgagcgactcttgccacagtttgcacccgatggaacacgaattctatgaagataacgaatatatctcctcactgcccgctgatgctgaccggaccgaggattttgagtacgaagaagtggaactgtgcagggtgagtagtcaggaaaaactgggcctgaccgtctgctatcggactgatgacgaggaggacacaggtatctatgtttccgaagtcgaccccaactccatagcagccaaagatgggcggatacgggagggcgacaggatcctccagattaacggagaggatgtgcagaatagagaagaggcagtggctcttctgagcaacgatgagtgcaagagaatcgtgctactcgtggcacggccggagatccaactggatgagggatggttggaggacgaacggaacgagttcctggaggagctgaatctggagatgctggaggaagaacataatgaagcgatgcagccaactgccaacgaggtggaacagcccaagaaacaggaggaagaggagggcaccaccgatacggccacatcttcaagtaataatcatgagaaggacagcggggtgggccggactgatgaatcactgcggaatgacgaaagcagcgagcaagagaatgccgctgaggacccaaattctacatccctcaaatctaagagggacttggggcagagccaggataccctgggatctgtggagttgcagtacaatgagtccctggtcagcggggagtatatagacagcgattgtattggtaatcccgatgaggactgcgagaggtttagacaactcctggagctcaagtgcaagattaggaatcatggagaatacgacctctattacagctcttccaccattgaatgtaaccagggcgaacaggagggggtggagcatgagctgcaattgctgaatgaagaattacgcaatattgagctggagtgtcaaaatatcatgcaggcccaccggctgcagaaggtcaccgatcagtacggagacatatggacacttcacgacggcggcttcagaaattacaacacatcaattgacatgcagcggggcaagttggacgatattatggagcaccctgaaaaaagtgacaaggattcctcatccgcatataatacagcggagagttgccgctctaccccactgacagtggatcgctctcctgatagttcactgccaagggtgattaacctcaccaacaaaaaaaatctgagaagcacgatggccgcgacacaatcttcaagcggccagtcaagcaaggagtcaacatcaacaaaggcgaagactaccgagcaaggatgtagcgctgaatctaaagagaaagtcctggaaggaagcaaactacccgaccaggagaaggccgtatccgagcacataccctacctgtctccctatcattccagctcttatagatatgccaatatccccgctcacgctcggcactaccagtcttatatgcagctcatccagcagaaatctgctgtcgaatacgcccagagccagctgtcccttgtgagtatgtgcaaagaaagccagaagtgttcagaaccaaagatggaatggaaagtcaagatccgaagcgacggcaccaggtacatcaccaaacggcctgtgcgggacagaattctgaaagagagggccctcaagatcaaggaagagcgctccgggatgacaacagatgatgataccatgtccgaaatgaagatgggcaggtactggagcaaagaagagaggaagcagcatcttgtgagagccaaggaacaaagaaggcggcgcgaattcatgatgcgttcgagacttgagtgtcttaaggaatccccccaatctggatctgagggcaaaaaagaaatcaacatcatcgaactgtcacataaaaagatgatgaaaaagcgaaataagaagattctggacaactggatgacaatccaggaactgatgacccatggcgcgaaatctcccgacggcacgagagtacacaatgcattcctatcagtcacaacagtgtag

SEQ ID NO: 198840 - DNA, 3111 bp, Artificial Sequence
  Description of Artificial Sequence: Synthetic coding sequence
atgggcttcgccctggagcggttcgccgaggccgtggaccccgccctagaatgtaagctttgtgggcaggtgctggaggaaccactctgcaccccttgcggacatgtcttctgtgcctcatgtctgctcccctgggccgtccggcggcggagatgcccactgcagtgtcagccattagcccctggcgagttgtatagagtgcttcccctacgcagccttatccaaaaactgagggtccagtgtgactaccgtgccaggggctgcggccactccgtgcggttgcatgagttggaagcccacgttgagcactgtgatttcggccctgcacgcaggctgcggtctaggggaggttgtgcatccggattgggggggggcgaagttccggcccgtggcggctgcgggccaactccacgcgccggtagaggtgggggagcacgcggaggaccacctgggggcagatggggccggggaagagggccggggcctcgagtactcgcctggcgaagaagggagaaagcactcttggcccagctatgggctctgcagggggaagtgcaactgacagcccgacgatatcaagagaagtttacccagtatatggctcacgttcgtaactttgtaggcgatcttggaggcggccataggcgcgacggggaacacaaacctttcactatcgtgctagagagagagaacgacaccctcggctttaatattattggaggacgcccgaaccaaaataatcaggagggcactagtacagaaggcatctacgtgagcaaaattttagagaacggcccagccgatagagccgatgggctggagatccacgacaagattatggaagtgaatggcaaggaccttagtaaggcaacacatgaagaagccgtagaagcttttcgaaatgccaaggaacccattgtcgttcaagttctgcggcgtaccccacttagtcggcccgcgtatggaatggcatccgaagtccaacttatgaacgcctccactcaaaccgatattacttttgaacacataatggctctggctaagcttcggcctccaactccccctgtgcccgacatctgtccctttttattgtccgactcatgtcatagcctgcaccccatggagcatgaattttatgaggataatgaatatatatcctccctacccgccgatgcagaccgcacagaagactttgaatatgaagaggtggaactgtgccgggtatcttctcaggaaaagctaggtcttaccgtttgttatcggacggatgatgaggaagacaccgggatctatgttagtgaggtcgacccaaacagtatcgcagctaaggatgggcggattagagaaggggatcgaatcctgcaaattaacggcgaggacgtccagaaccgggaagaagcagtagcccttctctctaacgatgagtgcaagaggatcgttctcctggtcgctaggcctgagattcagctcgacgagggctggctcgaagacgaaaggaacgagttccttgaagaacttaatctggagatgttggaggaggagcacaacgaagcaatgcagcccacagccaacgaggtggagcaacctaagaagcaggaagaggaagaaggcaccacagacacagctacttcttcaagcaacaatcacgagaaagatagcggcgtcgggcggacagatgaatccctgcggaatgatgagtcatccgaacaggaaaacgccgccgaggaccctaattccacctccctgaaatctaagcgagatctcggacaaagtcaggacacgctggggtcggtggaactgcagtacaacgagagcctggtcagtggagagtacatcgattccgactgtatcgggaacccagatgaggactgcgaacgattccgccagctgctggagttgaagtgcaagatccggaatcacggagagtacgacctgtactactccagtagtactattgaatgcaatcaaggggaacaggaaggcgtagagcacgagttgcagctgctcaatgaggagctgcgcaacattgagcttgagtgtcaaaacattatgcaagctcatcgacttcagaaagttactgaccagtacggagacatttggaccttgcacgatggcggcttccgcaattataatacctctatcgatatgcagcgtggtaagctggatgatatcatggaacaccctgagaagagcgataaggactcttcctctgcctataatacagcggagagctgcaggtccaccccactgaccgtggataggagccctgatagttcactgccacgagtgattaaccttaccaataaaaaaaatctgagatcaactatggcggctacccagtcttctagcggccaaagctctaaggagagtacttcaacgaaggctaaaaccaccgagcagggatgttctgccgagtctaaggaaaaggtgttggaggggtctaagctccccgatcaggaaaaggccgtgtccgagcacattccctacctcagcccttaccattcctcctcctaccgttatgccaatatcccagctcacgcgcgacattatcagagttatatgcagctcatacaacaaaagtcagcggtggagtatgcgcaatcccagctgagcctggtgtcgatgtgtaaggaatcccaaaaatgttcggagccgaagatggagtggaaagtgaagatccgcagcgacgggacaagatacatcaccaagcgaccagtgcgagaccgcattctcaaagaacgcgctctgaagatcaaggaagagcggagtggcatgacgaccgacgatgatacaatgagcgagatgaagatgggaagatattggtcaaaagaggagagaaaacagcaccttgtgcgcgctaaagagcaacgcagaaggagagaatttatgatgaggtcccgcctggaatgtttgaaggaaagtccccagtccggaagtgaaggcaagaaagaaataaacatcatcgagctgtctcataaaaagatgatgaagaagcgcaataagaaaattctggacaactggatgaccatccaggaactcatgactcacggggccaagagtcccgacggcacacgcgtacacaacgcgttcttgagcgtgaccactgtgtag

SEQ ID NO: 198841 - DNA, 2337 bp, Artificial Sequence
  Description of Artificial Sequence: Synthetic coding sequence
atgggctgcaacctgtgcaccttccagaagcgggaggagcactacaaactgttgtatgaagtgtcccaggtgaacggaaaagatttatccaaagctacccacgaggaggcagtggaagcatttagaaacgctaaggagccaatcgtggtccaggtgctgcgacgcactcctctatcccggccagcctacgggatggcctctgaggtgcagttaatgaacgcaagcacccaaaccgacattacatttgagcatattatggccttggccaaacttagacctcccaccccccccgttcctgatatatgccctttcctgctcagcgactcttgccacagcctacacccaatggaacatgagttctacgaagacaacgaatacattagtagtctgccagcagacgccgatcgtactgaagattttgagtatgaagaggtcgagctttgtagagttagttctcaagagaagctcggattgacagtgtgttataggaccgacgatgaagaggacacaggcatatacgtttctgaagtcgatcctaatagcattgctgcaaaggacggccgcatccgcgagggggaccgaattctgcagatcaacggtgaagatgttcagaacagagaagaggcagttgcactactgtcaaacgacgagtgcaagaggatagtgctactagttgcacggcccgaaatccagcttgacgagggatggctggaggacgaacgcaatgaattccttgaagaactgaacttggagatgctggaggaggaacacaatgaggcgatgcagcctactgcaaatgaagtcgagcagcctaagaaacaggaagaagaagaaggaactacagacactgccacaagctcttccaataatcacgaaaaggactcgggcgtgggcagaacagatgagagtctgcggaatgatgaatctagcgagcaggagaacgcagccgaagaccctaactctacatcactgaaaagcaagcgtgacctgggtcagagtcaggacacattagggtccgtggaactgcagtataacgagtccttagtcagcggagaatatatcgattcggactgtataggaaatcccgatgaggattgtgagcggttcaggcagctgctggagttgaagtgcaaaattagaaaccatggcgaatatgacctgtattactcctccagcaccattgagtgtaatcaaggggaacaagagggagttgagcacgaacttcagttgttgaatgaggagcttaggaatatcgagctggaatgtcagaacatcatgcaggctcacagattacagaaggtgacggatcagtacggtgatatttggactctacacgacgggggcttcaggaattacaatacgtctatcgatatgcaacgcggaaagttagacgatatcatggaacatcccgagaaaagtgacaaagatagcagcagcgcctataacaccgccgaatcatgtcgctctacaccactgaccgtcgatcggtctccagatagctccctcccacgcgtcatcaacctgactaacaagaaaaatctgaggtccacaatggcagctacccaaagcagcagcggtcagtcctctaaggaaagcacttctactaaggctaagaccactgagcagggttgcagcgcggagtcgaaagagaaggtactggaggggagtaaattgccagaccaagaaaaggctgttagtgaacatatcccatatttatcgccttaccactccagctcatatcgatatgcaaatattccagcccatgcgagacattaccaaagctatatgcagctcatccagcagaagagcgccgtggaatacgctcagtctcaattaagtttagtctcgatgtgcaaagaatcccaaaagtgttccgagcctaagatggagtggaaggtgaagataagatccgacggaactcggtacattactaaacgacctgtgcgggaccgcatcctcaaggagcgagccctcaaaatcaaagaagaacggagcggcatgacaacagatgatgatactatgagtgaaatgaagatgggaaggtattggagcaaagaggaacgtaaacaacacctggtcagagccaaggaacagagaaggcgcagagagtttatgatgaggtcaagactggagtgtctgaaggagagtcctcagagtggttctgagggaaagaaagagatcaacatcatcgagctcagtcacaaaaaaatgatgaagaagaggaacaaaaagatccttgataattggatgaccatccaggaattgatgacacatggggctaagagccccgatggcacacgtgtgcataacgcttttcttagtgtgacaaccgtgtag

SEQ ID NO: 198842 - DNA, 1158 bp, Artificial Sequence
  Description of Artificial Sequence: Synthetic coding sequence
atgaagctggtgcggaagaacatcgagaaggacaacgccggccaggttaccctggtgccagaagagcctgaggatatgtggcacacctataatctggtgcaggtgggtgatagtttaagggcgtctactattcgaaaggttcagaccgagagcagtactggaagcgtgggctctaatagagtgcgaaccaccctgacgctgtgtgtggaagccattgacttcgactcccaagcatgtcagcttagagtcaaagggaccaatatccaggagaacgaatacgtgaagatgggcgcttaccacaccattgagcttgaacccaaccgccagtttacattagcaaaaaagcagtgggactcagtggtactggaacgcattgaacaagcgtgcgatccagcatggagtgctgatgtagcagctgtggtgatgcaggaagggttggcacacatctgcctggtgactccgagtatgaccctgacacgcgctaaggtcgaggtcaacatacctcggaaacgcaaaggtaattgctcacagcacgatcgtgcgctggagcgtttctatgaacaggtagtgcaggccattcagcgtcatattcatttcgatgtggtcaaatgcatcctagtggcgtcacccggattcgtccgggaacagttttgcgactatttgtttcagcaggctgtgaaaactgataataagttactcctcgagaatcgcagcaaatttctgcaggtccacgccagttctggtcataaatactctctgaaagaggctctgtgcgaccccacagtggccagccggctgtcagacaccaaggccgccggcgaggtcaaggcgctggacgacttttataagatgctccagcacgagcctgaccgcgccttctatggactcaaacaggtagagaaggcaaatgaggcaatggccattgacacgttattgatttctgatgaactgtttcgccaccaggatgtcgccaccaggtcaaggtatgtacggcttgtggatagtgtgaaagagaatgcagggaccgtaagaattttcagctctctgcacgtgtctggcgagcagctctctcagttgacgggagtcgcagcaatccttaggttcccagtgcccgagcttagcgaccaggagggcgacagcagcagcgaagaagactag

SEQ ID NO: 198843 - DNA, 855 bp, Artificial Sequence
  Description of Artificial Sequence: Synthetic coding sequence
atggccagctacccctaccggcagggctgccccggcgccgccggccaggctccaggcgcacctccagggagttattacccagggccgccaaactcaggtggacagtatggcagcggtctgcccccaggcggcggttatggaggacctgcgccagggggcccgtatgggccaccggctggcggcggcccatacggccatcctaacccgggaatgttcccatcaggcacacccggtgggccctacggaggtgccgcccccggtgggccctatggacagccacccccctcaagctatggcgctcagcagcctggcctgtacgggcagggcggtgcacccccaaacgtggacccagaagcgtacagctggttccaatctgtcgacagtgaccatagtggctacatctccatgaaggagttgaagcaggccctggtgaactgtaactggtctagtttcaatgatgagacctgtttgatgatgatcaacatgttcgataagacaaaatccgggcgcatagatgtgtacggattcagtgcgctgtggaaattcattcagcagtggaagaatttattccagcagtatgaccgggataggtccggcagcataagttatactgaacttcaacaggcattgtctcagatgggctataacctgtctcctcaatttacccagcttctggtgagtcgctactgccctcgatccgccaaccctgccatgcagttagatcgctttatccaggtatgcacgcaattacaagtgcttactgaggcttttagagagaaggatacagccgtgcagggtaatatcagattaagtttcgaagacttcgtaactatgacagccagcagaatgctttag

SEQ ID NO: 198844 - DNA, 423 bp, Artificial Sequence
  Description of Artificial Sequence: Synthetic coding sequence
atggccagctacccctaccggcagggctgccccggcgccgccggccaggcaccgggggcacctccaggtagctattatcccggccccccaaactcagggggtcagtacggatctggactgcctcccggtggtggatatggtggtcctgcacccggcgggccttacggaccacctgccgggggaggtccatacggccacccgaatcccgggatgttccccagtggcaccccaggggggccctatggcggagccgcccccggcggtccttacggccagccacccccttcctcatatggagctcagcaacccggactctacggccagggcatccatgctgagggagcagcacccgtatgggatatgctgtctttgtggcagagagagggtgccggagagctcgcacggatgcataatgctagttag

SEQ ID NO: 198845 - DNA, 1146 bp, Artificial Sequence
  Description of Artificial Sequence: Synthetic coding sequence
atgcacctgctggccatcctgttctgcgccctgtggagcgccgtgttggctgagaactcagatgactacgatctgatgtatgtgaacttggacaatgagatcgataatggtcttcacccgacagaagacccgacaccctgcgcctgtggacaggagcacagcgagtgggacaaactcttcattatgttggaaaatagccaaatgcgcgagcgtatgctgctgcaggcgacagacgatgtactgcgaggggagctgcaacgactaagggaagagttgggaagactggctgagagcctggctcggccctgcgccccaggtgcccctgctgaggcacggctcacgtcagctcttgatgaactgttacaggcaactagagacgcaggaaggagactcgcacgaatggaaggagctgaggcacaacgacccgaggaggctggcagggcgttagcagccgttctggaggaactgaggcaaactagagcagatctccatgctgtccaaggatgggccgcccggtcttggctccctgccggctgcgaaactgcaatcctgttccctatgcgctccaagaagatcttcggcagtgtccaccccgtaagaccaatgcgcttggaaagctttagcgcatgcatctgggtgaaagccactgatgtgctgaataaaactatcctattttcttatgggacaaagaggaacccatacgagatccaactctacctgtcataccaatcaattgtgttcgtggttggaggcgaagagaataagctagtagcagaggcaatggtgtcattaggacgctggacccacttgtgcggtacttggaacagcgaggagggcctaacttccctgtgggtgaacggcgaactggcggccaccactgtcgagatggctacaggtcacatcgttcccgagggcggcatcctacagatcggccaggagaagaacggatgttgcgtgggaggaggcttcgacgaaactctggcgttcagcggcagactaaccggttttaacatatgggacagtgttctctccaacgaagagatcagagagacaggtggggccgagtcctgccacattaggggcaatatcgtggggtggggggttaccgagatacagcctcatggtggggcacagtacgtgagttag

SEQ ID NO: 198846 - DNA, 1422 bp, Artificial Sequence
  Description of Artificial Sequence: Synthetic coding sequence
atgggcagcggcaactgggaggtgaccggccccccctgcggcagccggtgcgagcggcctcctggtctgcctagaggagttcatggccaattcagaagcgctgtcggcttgtccggcctcaggtggtttagacgtttccaagaagtgacgtggacacacttgcagaacattgcttccaattataatgtgtcctataacgttgatgtccgcttcaggagcttagccgaagagtcgcaggctgtggcccaagccgttaaccggtcccaggcctctgtccagggagagctagcgcaactgaaggcctgggttcggaagctgcagcggcgcggcagaaaggtcgatacacgacttcgggccttagatctaacgctcggagaacgcagccagcagcgggcacgggaacggaaggcccacaaagctcagcgggacgccctccaggacagcctggcccggctcgagggtctggtccatagccagggtgcacgcctcgcagctctggagggccgtttgcccgttgcccaccccggaaccgccgctctgggacctgccttggtccccacccctactcaaccagaggaactgggcccaacttctcttaaacttcagagagatcgccaggagctccgcgccgcttctgaacatcgaggtccaccccaggattctagcgcccctctgcaaggacggcgggaaccccctgcctctggctctcaccgggtgctgtccggcactgcccccaaagatcctcgccaacaggcctggtctccacaggttcctggggagatctgcggagttggaccaacgctggtcttccccaatgcatccacacggaatgtcgtgtttctctccccaggttttgttacggctctgagggcactgtcgttttgctcctgggtccggactgccagcggccgcctcggcacgctcctgtcatacgccactgaggataacgacaataagttggtactccacggtcgtgattcactgctgcccggcagcattcacttcgtaatcggggatcccgcattccgcgaacttcccctgcagttgctgcttgacggccaatggcaccacatctgtgtcatctggacctccacccagggacgatactggcttcacgttgatcgcaggctggtggccactggaagccgattccgggagggatacgagattcccccaggcgggtctctggttctgggccaggaacaggactctgtgggggggggttttgactcaagcgaggccttcgtgggaagtatgtctggcttagctatctgggacagggcactggtgcctggggaggttgcgaatctggcgatcgggaaagaatttccaactggagccattttgaccctggcaaacgcagctctggccggcgggttcgtgcagggcgctaattgcacctgtctggagagatgtccgtag

SEQ ID NO: 198847 - DNA, 1437 bp, Artificial Sequence
  Description of Artificial Sequence: Synthetic coding sequence
atgggctgcagctggcggaagaccctgagcttcttcctggtgttcgtccccatatacctgcacggagcttcatctcaagaggccgcgccagtcggcccgcgcaagccgttctttgaacggctgagacgcttagaggagcagttccgccgcttccaggaggtgacctggacccatttacagaacattgcaagtaattacaacgtctcttataacgtagatgttcgattccgttccttggccgaggaatcccaagcagttgcccaagcagtgaacagaagccaagcgtcggttcagggcgaattagcccagctgaaagcttgggtccgaaagctgcagcggaggggccggaaagttgacactcgactacgagctctcgatctgaccctgggggagaggtctcagcagagggccagagagcgaaaagcccacaaggcccagcgcgatgccctccaggactctctcgctcggctggaggggctcgtccattcacaaggggctcggttggctgccttggagggaagactgcccgtggcacatcccggcacagcagcattgggccctgcactcgtacctaccccaactcagccagaagaactcggcccaacttccttgaagctccagcgcgatagacaggagctacgcgccgcctccgagcacagaggccctccacaggacagcagcgccccactacagggtcggagggaaccccccgcgtccgggtctcaccgcgtgctctcgggtactgcaccgaaggaccctcgtcagcaagcttggtctccccaggtacccggcgaaatctgtggagtgggtccaacattggtgtttcctaatgcatcaacaaggaacgtggtttttctgagccctggattcgtgactgctcttagggccctgagcttttgctcctgggtacgcactgcatctggcagactggggacattgctgtcttacgcgacagaagataacgataataaattggtattgcacgggcgggatagcctactaccagggtccattcattttgtgattggcgacccagccttccgggagctgccacttcaactcttgcttgacgggcaatggcaccacatttgtgtgatctggaccagcacacaggggcgatactggcttcatgttgaccggcggctcgtggccacaggcagccgctttcgagaggggtatgaaattccccccggcggttcccttgtgcttggtcaagagcaggattccgtgggcggcggattcgacagctccgaggcatttgtggggtctatgagcgggttggcaatctgggaccgcgccctcgtacctggagaggtggccaacttggccataggaaaggaatttccgacaggcgctatcctgacacttgctaacgctgctctcgccggcgggtttgtccagggagcaaactgcacatgtctggagagatgtccctag

SEQ ID NO: 198848 - DNA, 1167 bp, Artificial Sequence
  Description of Artificial Sequence: Synthetic coding sequence
atgaagtggctgctgctgctgggcctggtggccctgagcgagtgcattatgtataaagtgcccctaatcagaaagaagtccctgaggagaactttaagtgaacgggggctgctgaaagacttccttaagaaacacaatcttaaccccgccagaaagtattttcctcaatggaaagctcctacactggtggatgagcagcctttggaaaattacttagacatggagtacttcggcactatcggcattgggacacccgcacaggatttcacagtggtatttgatacaggctccagtaacctttgggtccctagcgtttactgctcatccctggcctgcacaaaccacaacaggttcaatccagaggattcgagcacttaccaatccacatccgagacggtcagcattacctacggaacgggtagcatgacaggcattcttggctacgacactgtccaggtgggaggcattagcgacacaaaccagatttttggactctcggaaaccgagcctggatctttcctgtactatgccccattcgacggcatcttgggcttggcctatcccagtattagtagctcaggggcaacgcctgtgttcgacaacatatggaatcaggggctcgtgagccaggatcttttctccgtttatttgagcgctgacgatcagtcgggaagcgtagtgattttcggcgggatcgacagctcttattacacggggtcattgaattgggtaccagtgacggtcgagggctactggcagatcacggtcgactccattacgatgaacggtgaagcgatcgcttgtgcagagggatgtcaggccatcgtcgatactggaacttctttgttaaccgggcccaccagccctatcgccaacatccagagcgacatcggagctagcgagaatagtgacggcgatatggttgtctcttgtagcgccatttcatcactgcctgatatcgtatttacaataaatggggttcagtaccccgtgccccctagtgcctacatcctgcaaagtgagggctcttgtatctcagggtttcagggcatgaatctcccaacagaatccggcgagttatggattctcggcgacgtcttcatacggcagtattttaccgttttcgaccgcgcgaacaatcaggtgggcctggcacccgtcgcttag

SEQ ID NO: 198849 - DNA, 849 bp, Artificial Sequence
  Description of Artificial Sequence: Synthetic coding sequence
atgaagtggctgctgctgctgggcctggtggccctgagcgagtgcatcatgtataaggtaccactcattcgcaagaaaagtttaagacggaccctgagcgagcggggactcctgaaggattttctaaagaaacataacctgaaccctgcaaggaagtatttccctcagtggaaggctccaaccttagtcgacgagcagcctcttgaaaattatttagacatggaatacttcggaactatagggatcggcacccccgctcaggatttcaccgtggttttcgataccggcagtagcaacctctgggtgccatcagtctattgctcttccttggcgtgtaccaatcataatcggtttaatccagaagactcaagcacctaccagagcacatccgagaccgtcagcatcacctatgggactggttcgatgaccgggattctcgggtatgataccgtacagacagttgcgatctggaggtccgctgcaatggggctagtgtctcaggacctgttctccgtttatctcagtgcggatgaccagtccggtagcgtggtgatctttggagggattgactcatcctattacaccggatcacttaattgggtcccggtgacagtggaaggatattggcagattacagttgatagcattaccatgaatggagaagccatcgcatgtgctgagggatgtcaggccattgtggacacaggcacatcactgttaacggggcctacaagcccgatcgccaacatacagtctgatatcggagcgagcgaaaactcagacggggatatggtggtgtcatgttcagccatctcgtcccttccggacatcgtgtttaccatcaactag

SEQ ID NO: 198850 - DNA, 750 bp, Artificial Sequence
  Description of Artificial Sequence: Synthetic coding sequence
atgaccggcatcctgggctacgacaccgtgcaggtgggcggcatcagcgataccaaccaaatctttggcctcagcgagacagagcccggtagttttctgtactatgccccctttgatggaattctcgggctggcatatcctagtattagcagctccggcgcaaccccagtctttgacaatatctggaaccagggactggtgtctcaagatctgttcagtgtctacctctccgccgacgatcagtctggtagtgtggtgatttttggcgggatcgattccagctactacacagggagtctgaattgggtccccgtgactgtagaaggatattggcagatcaccgtggattcgatcaccatgaatggcgaggctatcgcctgtgccgagggctgtcaggccatagtggacaccggaaccagtttattgaccggcccaacctcgcctatagccaacattcagagcgatattggggcaagcgagaacagtgacggcgacatggtcgtctcatgctcagcgatttcttcccttcccgacatagtgttcacaattaacggagtgcaataccctgtgccaccctccgcctatatcctgcagctgccctctgagggctcttgtatttccgggttccagggaatgaacctgcctactgaatctggtgagctgtggatcttaggggacgtgttcataaggcagtactttactgtgtttgaccgtgctaataaccaggtgggcctggcgcccgtcgcttag

SEQ ID NO: 198851 - DNA, 1167 bp, Artificial Sequence
  Description of Artificial Sequence: Synthetic coding sequence
atgaagtggctgctgctgctgggcctggtggccctgagcgagtgcataatgtataaagtgcctctcatccgcaagaagagcctgaggaggacactgagcgaaagagggcttctcaaggacttcctcaagaagcataatctcaatcctgcaagaaagtacttcccgcagtgggaggctccgactcttgttgatgaacagcctttggagaattaccttgacatggaatacttcggcactatcggcattggtacacctgcacaggatttcaccgttgtgtttgataccggctcatcaaacctttgggtccccagcgtctattgctctagcctggcttgcaccaatcataatcgtttcaaccccgaggacagctccacatatcagagcaccagcgagaccgtcagtattacatacggcacgggaagtatgacgggcattctgggatatgacaccgtgcaagttggaggcataagtgacaccaatcagatctttggactttcagagaccgaaccgggatccttcctttactacgcccctttcgatggtatcctcggcttagcctatcccagtatttcttcttccggagccaccccagtgtttgacaatatctggaatcagggattggtgagccaagacttatttagcgtgtacctctcagccgacgatcaatcagggagcgtggtgatattcggggggattgactccagctattatacaggttctctgaactgggttcccgtgactgttgagggctactggcagattacagtggatagtattacaatgaacggagaggccatagcctgtgcagagggctgccaagccatagttgatacaggtacctcccttctcaccggcccaacttctccgatagccaatatccaaagcgacataggcgcaagtgaaaactctgacggcgatatggtggtcagctgctccgcaatttcaagcctccccgacattgttttcactatcaatggcgtgcagtacccggtgcccccctccgcatacattttgcaatcagaagggtcttgcatcagcggctttcaggggatgaacctacctaccgaatcaggcgaactttggatactcggggacgtgttcattcggcaatacttcacagtcttcgaccgggccaataatcaggtaggactcgctcctgtggcatag

SEQ ID NO: 198852 - DNA, 1167 bp, Artificial Sequence
  Description of Artificial Sequence: Synthetic coding sequence
atgaagtggctgctgctgctgggcctggtggccctgagcgagtgcattatgtataaagtgcctctcatacggaaaaagtccctccggcggactctgagtgagaggggactgctgaaggatttcttgaaaaagcacaatctgaaccccgctcggaagtattttccacaatgggaagcgccaacgctggtagacgaacagcccctggaaaattacctcgatatggagtacttcggaactatcggaatcggaactcccgcccaggacttcacagtggtgtttgacactgggagttccaacctgtgggtcccatctgtgtactgtagttcccttgcgtgcaccaatcacaaccgatttaatcctgaggatagttctacgtatcagagtacctctgagacggttagcattacgtatgggaccggttctatgaccgggatacttggatacgatacagtgcaggtcggggggatttctgatacaaaccaaattttcgggctcagcgagaccgagcctggttcctttctgtattacgctccatttgacggaatcctaggccttgcgtatccaagtatcagctcctctggggccactccagtgtttgataatatctggaaccaggggctggtcagtcaggacctgttcagcgtgtatctgtcagctgacgacaagtctggatctgtggtgatttttggaggcattgattcaagctactacaccggatcactgaactgggtcccagtgaccgtagagggttactggcagatcacagttgattcaattaccatgaacggtgaaacaatcgcttgtgccgaaggttgtcaagcgattgtggacacagggacttcactgctcaccggtcccacttctcccattgccaacattcagagtgacatcggagcttccgagaattccgacggcgatatggtcgtttcatgcagtgcgatctcatcgcttccagacatagtctttactattaacggagtgcagtatccggtcccaccctccgcctacatactccagagcgaaggtagctgtattagcggtttccagggtatgaacgtgccgacagagtccggagagttatggatattgggagatgtatttatccgacaatacttcactgtattcgatcgtgccaacaaccaggtggggctagccccagtggcctag

SEQ ID NO: 198853 - DNA, 849 bp, Artificial Sequence
  Description of Artificial Sequence: Synthetic coding sequence
atgaagtggctgctgctgctgggcctggtggccctgagcgagtgcatcatgtataaggtgcctctgattcgcaaaaagtcgctcaggcgcactctgagcgagcgcggcctactaaaggacttcctaaagaagcacaatctgaacccagccaggaagtattttcctcagtgggaagcgcccacattggttgatgaacagccactcgaaaattacctggacatggagtatttcggtacgataggcataggaaccccggcccaagatttcaccgtggtcttcgataccgggagctcgaacctgtgggtcccgtctgtgtattgcagtagtctcgcctgtacaaaccacaaccgctttaatcctgaggatagcagtacctaccaaagcacaagtgaaacagtctcaattacttatggcactggctccatgacagggatactaggctatgacacagtgcaaaccgtggccatatggaggtctgccgccatgggcctcgtctctcaagacctgttctctgtgtatttgagcgccgacgatcagtccggaagcgtcgtgatcttcgggggaattgacagtagctactacacaggttccctgaactgggtccccgtgactgttgaaggatactggcagattacagtggacagcatcaccatgaatggagaagctattgcctgtgcagaggggtgtcaagcaatcgtggataccggcacatctttattgacgggccccacctcccctatcgcaaatatccagtccgatattggagcaagcgaaaatagtgacggcgatatggtcgtgtcatgcagtgccattagctctctcccagatattgtgttcactatcaattag

SEQ ID NO: 198854 - DNA, 750 bp, Artificial Sequence
  Description of Artificial Sequence: Synthetic coding sequence
atgaccggcatcctgggctacgacaccgtgcaggtgggcggcatcagtgataccaaccagatcttcggtctctccgagaccgagcccggcagcttcctttattatgccccctttgacggcatcctaggcctggcctaccctagtatttcctcttctggtgcgacccctgtgttcgacaacatctggaaccagggacttgtgagccaagacttgttctccgtgtatcttagcgccgatgatcagtcgggaagtgttgtgattttcggcgggatcgacagcagttactacactgggagcctcaactgggtgcccgttacagttgagggatactggcagattacagttgatagcattacaatgaatggtgaagcgatagcttgtgctgagggctgtcaggctattgttgacactgggacttcactactgactggcccaacatctcccattgccaacatccagtcagatatcggcgctagcgaaaattcagatggggatatggtggtatcttgttctgccattagcagcctgccagatatcgtgttcacgatcaacggggtgcagtatcccgtgccccccagcgcttatatactgcagctaccctcagaagggagctgcatctcagggtttcaagggatgaatttgcctacggagagtggagagctctggatcctcggagacgtctttatacggcaatactttaccgtcttcgatcgagcaaacaaccaggttggtctggctcctgtggcatag

SEQ ID NO: 198855 - DNA, 1167 bp, Artificial Sequence
  Description of Artificial Sequence: Synthetic coding sequence
atgaagtggctgctgctgctgggcctggtggccctgagcgagtgcataatgtataaggttcccttgattcgtaaaaaatctctgaggcgaacgttatccgaacgtggactactcaaggattttctgaaaaagcataatctcaatccagcaagaaagtatttcccacagtgggaggcgcctaccctcgtggacgagcaacccctcgagaactatctggatatggagtactttggaaccatcggaatcggaactccagctcaggacttcaccgtcgtgtttgataccgggtccagtaacctgtgggtgccatccgtctactgctctagcttggcatgcaccaaccataaccggttcaaccctgaggactcctctacctaccagtctacatctgaaactgtgtccataacatatgggacagggagtatgactggaatcttggggtatgataccgtgcaggtcgggggtatcagtgatactaaccagatttttggcctctcagaaactgagcccggcagcttcctttactacgccccatttgatggcatcttaggcctggcctatccgtctataagtagcagcggggcaacaccagtttttgacaacatttggaatcagggtttagtttctcaagacctgttctctgtctatctctccgcagacgacaagagtggctccgtcgtgattttcggcggtattgactcatcgtactatactggtagtcttaattgggtgcctgtaactgtagaggggtattggcagatcacggtggacagcataaccatgaacggcgagaccatcgcctgcgctgaaggctgccaggccatcgtggacacgggcacaagccttctcaccggcccaacatccccaatagctaacatacagagcgacattggcgcatctgagaattcagacggcgatatggtagtctcatgcagtgctatcagttccctgcccgatattgttttcactataaatggggtgcagtatcccgtcccaccatcagcctatatccttcagtcagaaggctcctgcattagcggattccagggcatgaacgttccaacggaatccggggagctgtggattctcggggacgtgtttattcggcaatacttcaccgtatttgaccgagctaataatcaggtaggactggccccagttgcctag

SEQ ID NO: 198856 - DNA, 849 bp, Artificial Sequence
  Description of Artificial Sequence: Synthetic coding sequence
atgaagtggctgctgctgctgggcctggtggccctgagcgagtgcatcatgtacaaggtccccctgatcaggaagaagagtttacgcagaacactatctgagcggggcctgctgaaagatttcctcaaaaagcataacctaaacccagcccgcaagtatttcccccagtgggaggcccccaccctagttgacgagcagccattagaaaactacctggatatggaatatttcggaacaatcggcattggtactcccgcccaggattttactgtcgtattcgataccggcagttcaaatttgtgggttccaagcgtgtattgctcaagcctggcctgcactaaccataatcggtttaatccagaggacagctctacctatcaaagtacatcagaaacagtcagtattacgtatgggaccgggtccatgacaggcattctcggctatgatacagtccagaccgtagctatctggcgctctgctgcaatgggcttggtcagccaggacctgttttcagtgtacctttctgctgatgataagtcggggtccgtggttatttttggcgggatcgactcctcatactatacagggtccctgaactgggtgcctgttaccgtggaggggtactggcagataactgtggattcgatcacaatgaacggtgagactattgcatgcgctgagggttgccaggccatcgttgacactgggaccagcctcctaacaggaccaacatcccccatcgccaacatccagagtgacattggcgccagtgagaattctgacggcgatatggtcgtgtcatgcagtgcaattagttccctgccagatatcgtctttacaattaactag

SEQ ID NO: 198857 - DNA, 750 bp, Artificial Sequence
  Description of Artificial Sequence: Synthetic coding sequence
atgaccggcatcctgggctacgacaccgtgcaggtgggcggcatcagtgatactaatcaaattttcggactcagcgagacggagccaggaagctttctctactacgcaccgtttgatggcattctgggcttggcctacccctcaatatcaagctctggggcgacacccgtttttgacaacatctggaatcagggccttgtgagccaggacttgttctcagtgtacttgtctgccgacgataagtccgggtctgtggtgattttcggcgggatagactccagttattatacaggtagcctgaattgggtccctgtgacagttgaaggctattggcaaatcacagtggattctataaccatgaacggcgaaacaattgcctgtgcagaaggttgccaggctatcgtcgatacaggtacctccctgttaaccgggcccacgtccccaatagctaatatccaatcagacatcggagcctctgagaattccgatggggacatggtcgtgagctgctcagccatctcaagcctcccagacatagtgtttactattaacggagtacagtatcccgtccctccatctgcatacatactgcagctgccttccgaggggtcttgtatcagcgggttccagggtatgaacgtacctaccgagtccggggaactatggattttgggcgacgttttcatcagacagtactttaccgtgttcgatcgcgcgaacaatcaggttgggctggctcctgttgcttag

SEQ ID NO: 198858 - DNA, 1578 bp, Artificial Sequence
  Description of Artificial Sequence: Synthetic coding sequence
atggccgccgtggtgctggccgccacccggctgctgcggggcagcgggtcttggggctgcagcagactgcgatttgggccccctgcctacagacgtttttcgtctggcggtgcataccccaacatccctctcagctcaccgcttcctggagtacccaagccagtgtttgcaacagtggatggacaggaaaaattcgagaccaaagtaacaacactagataatggcctgcgcgttgcaagtcagaacaagtttgggcagttctgtacggtgggtatactgatcaatagtggcagccgttacgaggctaaatatctctccggaatcgctcatttcctggaaaagctagccttttcctcaaccgcccggtttgactctaaggacgagatcttgctcacactcgagaagcacggggggatttgtgattgtcaaacctctcgcgacacgacgatgtacgctgtttccgcagattccaaagggttggacactgtggttgctctgctggccgacgtggtattacaaccccgccttacggatgaggaggtcgaaatgacaaggatggcggtgcagttcgagttagaagacttaaacttgcgcccggaccctgagccgctgctgaccgagatgatccacgaagccgcttatcgcgaaaatactgtgggccttcacaggttttgccctaccgaaaatgtggctaagatcaatagggaggtgctgcatagctacttaagaaactattacacacctgaccgtatggtcctggcgggcgtgggcgtcgagcacgaacaccttgtcgactgtgctaggaagtacttgctaggcgtccaaccagcttggggcagcgccgaggctgtcgacattgaccgttctgttgcccagtacactggcggaattgccaagctggaacgcgatatgagcaatgtttccctgggacccactcctatcccagaactcactcacatcatggttgggctggaatcatgctccttcttggaagaggacttcatcccctttgccgtgctgaatatgatgatgggagggggagggtccttctcagccggggggccggggaaaggaatgttcagccggctgtacttgaatgtgctcaaccggcaccactggatgtacaatgctacctcatatcaccactcctatgaagacacagggctgctgtgtatccatgcctctgctgacccaaggcaagttcgagaaatggtcgagattattaccaaagagtttatcctgatgggagggaccgtggacaccgtggagttggagagagccaagacccaactgacttcaatgctgatgatgaacctagaatcgaggccagttatattcgaggatgttggtcggcaagtgctagcaacgcgcagccggaaactgccccatgagctgtgcacacttatccgaaatgtcaaacccgaggatgtcaagcgcgtagcatccaagatgctcagaggtaaaccagcagtcgctgccctcggggacctgaccgatttgccaacctatgagcatattcaaacagccttatcgtccaaggacggccgcttgccccgcacctaccggctctttcggtag

SEQ ID NO: 198859 - DNA, 441 bp, Artificial Sequence
  Description of Artificial Sequence: Synthetic coding sequence
atggccgccgtggtgctggccgccacccggctgctgcggggcagcggcagttggggatgtagtagattgcggttcgggccgccagcgtacaggcgcttttcatccggtggtgcttatccaaacattcccctctcctctcccctcccgggtgtaccaaagcctgtctttgccaccgtggatggccaggagaagtttgagacgaaggtcacaactctggataacggactgagagtcgcttcacagaacaagtttggacaattctgcaccgtagggattcttattaattcaggcagtcggtacgaagcaaagtatctctcaggcatagcccattttcttgagaagctcgctttttcctccacagctcggtttgacagcaaggatgaaattctcctgacacttgagaagcatgggggaatctgcgattgccagacttctcgttag

SEQ ID NO: 198860 - DNA, 1185 bp, Artificial Sequence
  Description of Artificial Sequence: Synthetic coding sequence
atgaagcggaacaccctggtggagctgctgaccttctggaagaactggcatttcagactcctgctggatctgacagcaaaaatgaagttctgtctgcggtggaaatcaatgggcgtgtcggtgacagccaggcaccaagacgaggaggttgagatgacccgtatggctgtgcagtttgaactggaagatctgaatctgcgacccgatcccgagcctttgttgacagaaatgatccacgaggctgcctacagagaaaatactgtggggctacataggttttgtccaaccgagaacgtggccaaaattaatagagaggttttgcacagttatctgcggaactattacacccctgatagaatggtccttgccggcgttggagttgaacacgagcacctcgtggactgtgcacgcaaatacttgctcggcgtacagcccgcttgggggtctgcagaggcggtggacatcgatcgatcggtggcccagtacactggtgggatagccaaactagagcgcgacatgtctaacgtgagcctgggtcccacccccattcccgagctcacccatatcatggtgggactcgaaagttgcagttttttggaggaggatttcatccccttcgcggtgctcaatatgatgatgggtggcggcggcagcttcagcgctggcggcccggggaagggtatgttttcccgcctttatctgaacgttctgaatcgccatcattggatgtacaacgccacctcttatcaccactcctacgaggacacgggattactctgcattcacgccagcgctgatccaagacaggttcgggagatggtggagattattactaaggagtttatactaatgggcggaaccgtcgatacagtggaattggaacgggcgaagacgcagcttacctcgatgctcatgatgaatctagagtcccggcccgtaatctttgaggacgtaggcaggcaggtccttgcgacacggtctagaaaacttccacacgaattgtgtacacttattcgtaacgtcaaacctgaagacgtcaaaagagtggcctctaagatgctgcggggtaagccagccgtagctgccctgggtgacctaactgacctgccaacctacgaacatatccaaaccgctcttagctccaaggacggaagactccctagaacatatcggttgttccgatag

SEQ ID NO: 198861 - DNA, 816 bp, Artificial Sequence
  Description of Artificial Sequence: Synthetic coding sequence
tacaccggcggcatcgccaagctggagcgggacatgagcaacgtgtctctaggaccaactccgatcccagaactgacacacatcatggtgggcctggaatcgtgcagctttctggaggaggattttatcccttttgccgtacttaatatgatgatgggaggcggagggagcttctcggccggaggaccaggtaagggaatgttttctagactgtacctcaatgtgcttaaccgacatcactggatgtataacgccacatcctatcaccacagctatgaagatacggggttgctttgcatccacgcatctgctgatcctcggcaggtacgtgaaatggttgagataattactaaagagtttatattgatgggaggtacagtcgatacggtggagcttgagagggctaaaactcagctcacctctatgctaatgatgaacctcgagagcagacccgtgatcttcgaagacgtgggcaggcaagttctagccacgagaagtcgcaagctgccccacgaattgtgcaccttgatcagagagtatcggaggggatccgagggattgccccaggccagcgcaagactgcgaggcggcagactggcgcttccccaggctgttgtggggttatggtacgtgcatcacacccagaatttggggccgagccctgtcgtcttatccagaggcgggcaggggcaggggcgtggggtggctgatctcgtttccttaccaggcccaaccatgcaccttcttccaccctggcaggtcacgccgccctctgcaccattaggcggggccgtcacaactgcccagtcctgctag

SEQ ID NO: 198862 - DNA, 1482 bp, Artificial Sequence
  Description of Artificial Sequence: Synthetic coding sequence
atggccgccgccaccggccccagcttctggctgggcaacgagaccctgaaggtcccgctggccctcttcgcattgaatcggcagcggctgtgtgagcgactgaggaaaaatcctgctgtgcaggccgggtcgatcgttgttctgcagggtggtgaggagactcagcgctactgtaccgataccggggttcttttcagacaggagtccttttttcactgggccttcggcgtgaccgagccaggctgctacggcgtcattgatgtggatactggaaaaagcacgttatttgttccaaggctgcccgccagccacgctacatggatggggaagatccactccaaggaacacttcaaggaaaagtatgctgtggatgacgtccaatacgtcgacgaaatcgccagcgttcttacgagccagaaacctagcgtgctgcttactctgcgcggagtcaatacggattcgggatccgtgtgtcgagaggcctcattcgatgggatttcaaaattcgaggtgaataataccatcttacatcctgagatcgtcgagtgcagagtcttcaagactgatatggaattggaagtgctgcggtacaccaacaagatatcaagtgaagcccatcgtgaggtgatgaaggcagttaaggtcggtatgaaagagtacgaactagagtccctgttcgaacactactgctattccaggggtggcatgagacactcgtcttacacctgcatctgcggaagtggggaaaatagcgcagtcctgcactacggacacgctggcgctcccaacgaccggaccatccaaaatggcgatatgtgcctattcgatatgggaggtgaatattactgttttgcaagtgacattacatgttctttcccggccaacgggaagtttaccgctgaccagaaagctgtgtacgaggcggtcctgcgttcctcccgggctgtcatgggcgcgatgaagccaggagtttggtggccagacatgcatcgtctggcagaccggatccacctagaggagctggcccacatgggtatactgagcggctcagtggacgccatggtccaggctcatctgggggcagtgttcatgccccacggcttgggccatttcctggggatcgacgttcacgacgttgggggctatcccgaaggggtcgagcgaattgacgagcccggactcaggtctctgcggacagcccggcacctacagccaggcatggtgctgactgtggaaccggggatatacttcatcgatcacctcttggatgaagccctggccgaccccgcgagagcttcctttctcaatcgtgaagtgttgcagagattccgcgggttcggcggagtgcggattgaagaggatgtcgtcgtcaccgattccggaattgagctgttgacttgtgtgcctcgcaccgtggaagagatagaggcttgtatggctggatgcgacaaggcttttacccctttttctggaccaaagtag

SEQ ID NO: 198863 - DNA, 1359 bp, Artificial Sequence
  Description of Artificial Sequence: Synthetic coding sequence
atggccgccgccaccggccccagcttctggctgggcaacgagaccctgaaggtacctctggccctgtttgccctgaacagacaacggttgtgcgaaaggttgcgaaaaaaccccgcagtgcaggcaggcagcatcgtcgttcttcagggcggtgaggagacccagagatattgtactgacaccggggttctgttcaggcaggaaagcttcttccactgggcctttggggtgacagaacccgggtgttacggcgtcattgacgtggacaccgggaagagcaccctgtttgtgcctaggcttccagcttcgcacgccacctggatggggaaaatccacagtaaagagcattttaaggagaagtacgcggtagatgatgttcagtacgtagacgagattgcctctgtcctcaccagccaaaaacccagtgtacttctgaccctgcgcggggttaataccgactcaggatcagtgtgcagagaagcttcttttgatggaattagtaaattcgaggtcaataacaccattctgcacccagaaatcgtggaatgcctgtttgaacactattgctatagcagaggcgggatgcgccatagcagttacacctgtatctgtggctctggggagaattcggccgtcttacactatggccacgctggtgcacccaatgaccgcacgatccagaacggagacatgtgcctctttgatatgggaggcgaatattattgcttcgcaagcgatataacctgtagttttcccgccaatggaaaattcaccgcggatcagaaggctgtgtacgaggcagttcttcggtcgtccagggccgtgatgggggccatgaaacctggagtgtggtggccagacatgcatcgattggctgatcgaatccacctggaggagcttgcgcatatgggcatcttaagcggatctgtggacgccatggtgcaggcgcatttaggcgccgtctttatgccgcatgggctgggccattttctggggattgacgtgcacgatgtaggcgggtacccagaaggagttgagcgtattgacgagccagggctgaggtccctgcgaactgctaggcacctgcaacccggcatggttctgactgtagaacctggtatctatttcatcgaccaccttctggacgaggcactggctgatcccgcccgggcttcttttctgaaccgagaggttctccagagattcagaggattcggaggggtgagaatcgaggaagacgtagtggtcactgacagtgggatagagctgctcacatgcgttcctagaacagtcgaggagattgaagcttgcatggccggatgcgacaaggctttcacaccattttccggccccaagtag

SEQ ID NO: 198864 - DNA, 1290 bp, Artificial Sequence
  Description of Artificial Sequence: Synthetic coding sequence
atggccgccgccaccggccccagcttctggctgggcaacgagaccttgaaggtgcctcttgcgctgttcgcgttaaatcgccagcggctctgcgagagactgcggaagaaccctgccgtccaggccggcagtattgtggtcctgcaagggggcgaagagacgcagaggtactgtacagacactggtgtgctgttccgtcagattgcttcagttttgacctcacagaagccatcagtgctgctcacactgaggggtgtcaacaccgatagtggttccgtttgtcgcgaagcctcctttgacggcataagcaagttcgaagtaaacaacaccatcctccaccccgaaattgtggagtgtcgggttttcaaaactgatatggaactggaggtgctgcgctacactaacaagattagcagcgaagcacaccgcgaagtgatgaaagccgttaaggtcggtatgaaggagtacgagttggaatccctctttgagcactattgttactctcggggcggaatgaggcatagcagctatacgtgcatctgcggctcaggagagaattctgctgttctgcactacggtcatgccggcgcgcctaatgatcgtactatccagaacggcgatatgtgtctcttcgatatgggcggagaatactattgcttcgcttctgatattacctgttctttcccagcaaacggaaaatttacagctgaccagaaagctgtgtatgaagccgtgttgaggtccagtagagcagtgatgggggctatgaagccaggcgtttggtggcccgacatgcatcgcctggctgatagaattcacctggaggagctagcccacatggggatcctaagcggcagcgtggatgcaatggtgcaggctcaccttggcgcagtctttatgccccacggccttggacacttcctaggcatcgacgtccatgacgtggggggttaccccgaaggtgtggagcgaattgatgagccaggcttgcggtcattgcgcacagccaggcacctacagcccgggatggtgctgactgtggagccggggatttatttcatagatcatctactcgatgaagcccttgctgatccagcacgcgcgagctttctcaatcgtgaggtcctgcaacggtttagagggtttgggggtgtacgcattgaggaagacgtcgtcgtgaccgactcaggcattgaactgctgacatgtgtgccgcggacggtggaggagatcgaagcttgtatggcgggttgtgacaaggcgtttacccctttctccgggccaaagtag

SEQ ID NO: 198865 - DNA, 354 bp, Artificial Sequence
  Description of Artificial Sequence: Synthetic coding sequence
atgcgggccagcagcttcctgatcgtggtggtgttcctgatcgccggaactctggttctcgaagccgctgtgacgggagtccctgttaaagggcaggacactgtcaaaggaagagtgcctttcaacgggcaagaccccgtgaaaggccaggtgagcgtgaaaggtcaggacaaggttaaagcccaggaacccgtgaaagggccagtttccaccaagcctggctcctgtcccattatccttatacgatgcgcaatgcttaatcctcccaatcggtgcctgaaagacaccgattgtccaggtataaagaaatgctgcgagggcagctgcgggatggcttgcttcgtgccccaatag

SEQ ID NO: 198866 - DNA, 732 bp, Artificial Sequence
  Description of Artificial Sequence: Synthetic coding sequence
atggcccggctgtggggcgccctgagcctgtggcccctgtgggccgcagtgccctggggaggagcagcagccgtaggggtcagggcttgcagctctaccgccgctcctgatggcgtggagggccccgctttaagacggagctactggagacatcttagaagattggtgctcggccctccagagcctccatttagtcacgtgtgtcaagtcggggacccggtcctgaggggagtagctgctccagtggagcgcgcccaactgggcgggccagaattgcaacgcttaactcagcgacttgtccaggtgatgagacggcggcgatgtgtagggctaagtgctcctcagctgggcgtccctcgccaggtgctcgctctagaacttcccgaggcgctgtgtcgtgaatgcccacccagacagcgagccctgagacagatggaaccatttcctctgcgtgtattcgtgaacccatctcttcgcgttctggatagtagattagttactttccccgagggatgcgaaagcgtcgcaggatttcttgcatgcgtcccaagatttcaggccgtgcagatttccgggctggatcccaatggcgagcaagtggtttggcaagcatctggatgggccgccaggattatccagcatgagatggaccatctccagggctgtttgtttatagacaaaatggacagcagaacttttacgaacgtatattggatgaaggtaaacgactag

SEQ ID NO: 198867 - DNA, 294 bp, Artificial Sequence
  Description of Artificial Sequence: Synthetic coding sequence
atggtgttcgtgcggcggccctggcccgccctgaccaccgtgctgttagccctcctcgtctgtttgggcgcactggtggatgcatacccaataaagccagaagctccacgcgaggacgcgtcccctgaggaattgaatcgctactacgcttccctgcggcattacctcaatcttgtgacccgtcagagatacggcaagagagatgggcccgacaccctgttaagcaaaactttctttccggatggtgaagacaggcctgttagaagtcggagtgaggggccagacctttggtag

SEQ ID NO: 198868 - DNA, 1992 bp, Artificial Sequence
  Description of Artificial Sequence: Synthetic coding sequence
atggcccccaagcgggtggtgcagctgagcctgaagatgcccacccacgcggtttgcgtggttggtgtcgaggcccacgtcgacatccactcagatgtgccaaaaggcgctaattctttcagagtctcaggaagcagcggggtagaggtctttatggtgtacaatcgcacgcgcgtgaaagagcccattggtaaagctagatggccactcgataccgatgctgacatggtagttagcgtgggaacagcaagcaaggaactgaaggacttcaaagtcagagtatcatacttcggcgagcaagaagatcaggccctcggaaggtccgtgctgtatctcacaggggtggatatctcactggaagttgataccgggagaacaggcaaggtgaagagaagccagggagacaagaagacatggaggtgggggcctgaggggtatggcgccatcctgctagtgaactgcgatcgggacaaccaccgcagcgcagagcctgacctgacccacagctggttgatgtccttggccgaccttcaggatatgtcccccatgcttctgtcatgcaacggccctgacaaattgtttgatagccacaagttggtgctcaacgtccccttctctgattccaagagggttagagttttctgcgcaaggggtggcaacagcttgtctgattacaagcaggttcttgggccccagtgccttagctacgaggtggagagacagccaggtgagcaggaaatcaaattttacgtggaggggctcacatttccagatgcagactttttgggcttggtgtctctcagcgtgtcactcgttgacccgggaaccctccctgaggtgacattgttcacagatactgtcggcttccgaatggctccatggataatgacacccaacacccagccccccgaggaactctacgtgtgccgcgttatggacactcacggctccaatgagaaattcctcgaggacatgtcctatttgacactcaaagcaaattgcaagctgacgatttgcccgcaagtcgagaacagaaatgaccgctggattcaagacgaaatggaatttggttatatcgaagcccctcacaagtcctttcccgtggtctttgacagccctagaaaccgtgggcttaaggatttcccatacaagaggatcttaggccccgactttggttacgtcaccagagagatccctctacctggcccaagcagtctggattcattcggcaatctggatgtgtcgcctccggtcacagtggggggcaccgagtacccactgggccgaattctcattggcagctcttttccgaaatccggaggccggcaaatggcacgggctgtaaggaatttcctcaaggctcagcaagtacaggctcctgttgagctttattcagactggctctccgtgggtcacgtggacgaattcttgacatttgtgccaacctccgatcaaaaagggttcagactgttgctcgcatcaccatcagcttgcctgaaattatttcaagagaaaaaagaagaaggctatggagaggccgcacagtttgatggtctcaagcatcaggctaagcgctcgataaatgaaatgttggccgaccgacacctccagcgggacaacttacatgctcagaaatgtattgattggaatcggaacgtcctgaagagagagcttggtcttgccgaatccgatattgtggacataccacagctgttttttctgaagaatttctatgctgaagccttttttcccgacatggtgaacatggtggtgttaggaaagtatttaggaataccgaagccatacggccccatcatcaacggcaggtgctgtctcgaggagaaagttcagagcctgctggagccactggggctccattgtatttttatagatgactacctcagctaccacgagctacaaggggaaatccattgtggaacaaatgtcaggaggaaaccttttccttttaagtggtggaatatggtgccctag

SEQ ID NO: 198869 - DNA, 537 bp, Artificial Sequence
  Description of Artificial Sequence: Synthetic coding sequence
atggcccgggccgtgcggaacttcctgaaggcccagcaggtgcaggcccccgtagagctgtacagcgattggctttcggttggccacgtcgacgaatttcttactttcgtgcccaccagtgaccagaagggcttccgcttactgcttgcttccccatccgcctgcctgaagttatttcaggagaagaaggaagaaggatatggcgaagcagcacagttcgatgggttaaagcaccaagccaagagatcaatcaatgaaatgctagcagatcggcacctgcaacgagataatctgcatgcgcaggtgaatatggtggtactgggtaaatacctaggtatccctaagccttacggccccattatcaacggtcgctgctgtctggaagagaaggtccagtcactactggagccgctgggattgcattgtatttttatcgatgactatctgtcttatcacgaactacagggcgagattcactgtggcactaatgttcggcgcaagccctttccattcaagtggtggaatatggtcccctag

SEQ ID NO: 198870 - DNA, 405 bp, Artificial Sequence
  Description of Artificial Sequence: Synthetic coding sequence
atgctggccgaccggcacctgcagcgggacaacctgcacgcccagaaatgtatagactggaataggaacgttctgaagagggagctgggtctggcagagagtgacattgttgacattccccagttattcttcctgaaaaacttttacgcggaagcattctttcccgacatggtgaatatggttgttttgggaaagtatctgggaatccctaagccatacggaccaataatcaatgggaggtgctgtcttgaggaaaaggtgcagtccctgctggagccgctcggtctgcactgtatttttattgatgactatctttcttatcatgaattgcagggagaaattcactgcggcaccaacgtcagaagaaaacccttccctttcaagtggtggaatatggtgccctag

SEQ ID NO: 198871 - DNA, 663 bp, Artificial Sequence
  Description of Artificial Sequence: Synthetic coding sequence
atggcccgggccgtgcggaacttcctgaaggcccagcaggtgcaggccccggtcgagctgtattccgattggctgagcgttggacacgtcgatgagttcctcactttcgtgcctactagcgatcagaaaggcttcaggctgctgctggcaagcccctccgcatgcctgaaattgtttcaggaaaagaaggaggagggatatggcgaggcggctcagtttgatgggttaaagcaccaggccaaaagatctatcaacgaaatgcttgcggacagacacctgcagcgagataatctacacgctcagaagtgcatagactggaatcgtaacgtgcttaagagggagctggggcttgccgaatccgatatcgtagacatcccgcagctgttttttttaaagaatttttacgccgaagccttctttcccgacatggttaatatggtggtgctcggcaagtacttaggcattccaaaaccgtacggccccatcataaacgggcggtgctgtctggaggagaaggttcagtccctcctggagccactgggcttgcattgcattttcattgacgactacctctcataccacgagctgcaaggagaaatccattgcggcactaatgtgcggagaaaaccttttcccttcaagtggtggaacatggttccctag

SEQ ID NO: 198872 - DNA, 1314 bp, Artificial Sequence
  Description of Artificial Sequence: Synthetic coding sequence
atgctgcgggagcggaccgtgcggctgcagtacggcagccgggtggaggccgtttacgtgctggggacatacttgtggactgacgtatattcagctgccccggccggtgcacagacttttagcctgaagcactccgaacatgtgtgggttgaagtcgtgcgggacggtgaggcagaggaagtggccacaaacggtaagcagaggtggttgttgtcaccttcaacaacactgcgggtgactatgagtcaggcaagtacggaggcttcgtcagacaaagtcactgtaaactattatgacgaggaggggtctattccaattgatcaggctggactttttctgactgctattgagattagtcttgacgttgacgcagacagagacggtgtggtggagaaaaataatccaaagaaggcatcatggacatggggaccagaaggtcagggagccattctattggttaactgcgatcgggagacaccatggctccccaaggaagattgccgggacgaaaaggtgtacagtaaagaggaccttaaagacatgtcgcaaatgatcctccgaacgaaaggtccggaccgcctgccagcagggtatgagatcgtgttatacatttccatgagcgactccgataaggtcggggtcttttatgttgagaacccgttcttcggacagagatacattcacattctcggtaggagaaagttatatcacgtcgttaagtacacaggcggctctgccgagctcctattcttcgttgagggcctgtgttttcctgacgagggattttcaggcctagtgtccattcacgtatctttgctggaatacatggcccaggatattcccctcacacccatatttaccgacacggtgatcttccggatcgcgccatggatcatgacccctaatatcctccctccggtctccgtcttcgtgtgttgcatgaaagacaactatctcttcctcaaagaggttaaaaatctggtggaaaagactaactgcgagcttaaagtttgtttccaatacttaaacagaggagaccggtggatccaggacgaaattgagttcggatacatcgaggcaccacacaagggattcccagtggtcctagactcccccagggatggtaacctcaaagacttccctgtgaaggagctcctgggacccgacttcgggtacgttaccagggagccactgtttgaatccgtgacgtctctcgatagctttgggaatctcgaagtctcaccgcctgtaacggtgaacggcaaaacctacccactgggaagaatcctgatcggttcgtcgttccccttgtag

SEQ ID NO: 198873 - DNA, 1998 bp, Artificial Sequence
  Description of Artificial Sequence: Synthetic coding sequence
atgctgcgggagcggaccgtgcggctgcagtacggcagccgggtggaggccgtatatgtgctgggcacctatttgtggaccgacgtatattccgccgctcctgcgggtgctcagactttcagccttaagcactcggagcatgtctgggtcgaagtggtgcgggatggagaggctgaagaggttgcaactaacgggaaacagcggtggctgttgtcccccagcactacactcagagtaacaatgagtcaggcctctacggaggctagtagcgataaggtcaccgttaattattatgacgaggaagggtccattccaattgatcaagctggtctgtttttaacagcaattgaaatttcccttgacgttgatgccgatcgggacggcgtagtggagaaaaacaatcccaagaaggcctcatggacttgggggccggaagggcaaggtgcaatcctgctggtgaattgcgatcgcgagaccccttggttgccgaaagaggattgcagggatgagaaggtgtactcaaaggaggacttaaaggacatgagccagatgatattgaggacaaaggggcccgatagactgccagccggatacgaaatcgtgctgtacatttctatgagtgactcggataaggtcggagttttctacgtggagaaccctttcttcggtcagcggtatattcatattctcgggaggcgcaagctataccatgtggtgaagtacaccggaggctcagctgagctactcttctttgttgaaggcctgtgcttccccgacgagggcttcagcggactggtcagcatccacgtcagtttgttagagtacatggcacaggacattcctctgaccccaatatttacagacacggtgatctttaggattgctccatggattatgacgcctaacattcttcccccagtgtccgtatttgtgtgctgtatgaaagataattaccttttcctcaaggaggtgaaaaacctggttgagaagaccaattgtgaattaaaagtatgtttccagtatctgaatcgcggcgatcgctggattcaggatgaaatcgagtttggctacatcgaagcccctcacaaagggtttcctgttgtcctcgactcgccacgtgatggtaacctgaaagacttccccgtcaaagaacttctcgggcccgacttcggttatgtgacacgcgaaccccttttcgagtccgtcacttcattagactcattcggcaaccttgaggttagcccgccagttacagtgaatggcaaaacctatcctctagggcggatcctgatcgggagctcattccccctaagcgggggccgaagaatgacaaaggtggtacgcgattttctgaaggcacagcaagtccaagccccggtggaactgtactccgattggctcacagtcgggcacgtggacgagttcatgtcattcgtgcctatccccggaaccaaaaagttcctgctgctgatggccagcacctccgcttgttataagttgtttcgggagaagcagaaggatggccatggcgaggcaatcatgttcaaaggattaggcggcatgtcatccaagcgaatcacgataaataagatcctcagcaacgaaagccttgtacaggagaacttatattttcagcgctgcctggattggaacagggatattctgaagaaggagctcggacttaccgagcaggatatcatcgaccttcccgccctctttaagatggacgaggaccatagagctcgggcgttcttccccaacatggtaaacatgatcgtgttggacaaggacctaggaatccccaaaccgttcggtcctcaggtagaggaagagtgctgtctcgagatgcacgtgcgcggcctgctggagcccctgggtctcgagtgtacttttatcgatgacataagcgcttaccacaagttcctgggtgaagtccattgcggcactaacgtgaggcggaagccgtttaccttcaaatggtggcatatggtgccttag

SEQ ID NO: 198874 - DNA, 1650 bp, Artificial Sequence
  Description of Artificial Sequence: Synthetic coding sequence
atgctgcgggagcggaccgtgcggctgcagtacggcagccgggtggaagcagtatatgtgcttggtacttatctctggaccgatgtgtattcggcagcaccggccggagcgcagactttcagcctgaaacattcagaacacgtttgggtggaagtcgtacgggatggcgaggccgaggaagtggccacaaacgggaaacaacggtggttactgagtcccagcactaccctgcgggtcacaatgagccaggcgtcaaccgaagcatcttccgataaagtcactgtaaattactatgacgaggaaggaagcatccccattgaccaggcagggctgttcctgactgccatcgagatttcactggatgtggacgcagaccgggacggcgtggtagagaaaaataatccaaaaaagacccgcagtagtgccaatgccatatctaccagctgggcggggggctcaagcaccatgtggtcctccacccgcgttgcaccaaggagctgctgttcctcttggaaggcctctgtgagccccaccagagctagccaggcctggtcaccctcgatgtctgcctgttggtccacatggccctctatgaaggataactacttgttcttgaaagaagtgaaaaatctggttgaaaagaccaactgtgagcttaaggtttgcttccagtatctgaatcgtggtgacaggtggattcaggacgaaatcgaattcggctatattgaggcaccccacaagggcttcccagtggttcttgactcaccaagggatgggaacttgaaagattttcccgtaaaagagctcttggggccggattttggctatgttacaagagagcctctgttcgagagtgtgacctcacttgattctttcgggaatcttgaagttagtcctccagtgacagtcaacggcaagacctatcctctgggtcgtattcttattggatcaagtttccctctgagcgggggaagaaggatgacgaaggtggtcagagatttcctgaaagctcagcaggtccaagcaccggttgagctctacagcgactggctgactgtgggacatgtggacgagttcatgagctttgtgcctatcccaggaacaaagaaattcctgctcttgatggccagcacaagtgcatgctacaaactttttcgcgagaagcaaaaagacgggcatggcgaggctattatgtttaaaggtctgggcggcatgagttctaagcgtatcaccattaataagatcctgagtaatgagtcactggtgcaggagaacctgtacttccagcggtgtttagattggaatagggacatactgaagaaggagctaggcctgaccgaacaggatatcatagacttacctgccctgttcaagatggacgaagaccaccgagcaagagcgtttttcccaaacatggttaacatgatcgtcctggacaaagatctgggcatccctaagccattcggacctcaggtcgaagaggaatgttgtttagagatgcacgtccgtgggctgctggagcctctggggttggagtgtacgttcattgacgacatttccgcctaccataagtttctgggggaagtgcactgtggtaccaatgtaagaaggaaacctttcactttcaaatggtggcacatggtgccctag

SEQ ID NO: 198875 - DNA, 1995 bp, Artificial Sequence
  Description of Artificial Sequence: Synthetic coding sequence
atgagcctgcagcggatcgtgcgggtgagcctggagcaccccacctccgctgtttgcgtagcgggcgtggaaaccctggtagacatttatgggtcagtgcccgagggcaccgaaatgtttgaggtgtacggcactcccggcgtggatatctatatctcccctaacatggagcgtggccgcgaaagagccgatactaggaggtggcggtttgatgcaacactcgaaattatcgtcgtaatgaatagccctagtaacgatttgaatgactcacatgtgcagatttcgtaccattcctctcatgagcccttgccactggcttacgccgtgctgtacttgacttgtgtggacatttcgctggactgcgacctgaactgtgaaggcagacaggatcgaaatttcgtagataaacgccagtgggtctggggaccttcaggctacggtggcatcctactggtgaactgcgaccgtgatgatccttcatgcgacgtccaggataactgtgaccaacacgtgcactgtctccaggacttggaggatatgtccgtgatggtattgcgaacacagggccctgcagccctatttgacgaccataaacttgtgttgcacacttcgtcctatgatgcaaagcgagcacaagttttccatatatgcggtcccgaggatgtatgtgaggcctaccgacacgttctagggcaagataaggtttcttatgaggtgcctcgactgcatggggatgaggagcggttttttgtggagggactaagcttcccggatgctggttttacaggtctaatctcctttcatgtcaccctgctggacgattctaacgaagacttttccgcatcccctattttcactgataccgtggtgttcagggtagctccatggattatgacgccaagtactctcccacccctcgaggtgtacgtgtgtcgggtgagaaacaacacctgttttgtcgacgccgtggctgagctggctaggaaagcaggatgcaagctgacaatctgccctcaggccgagaataggaatgataggtggattcaagatgaaatggaattgggatacgtccaagccccacataagacactccccgtggtctttgactctcctcgtaatggagaactccaggacttcccctataagcgtatcctgggacccgatttcggttacgtcacgcgggaaccacgggaccggtctgtttcaggcctcgactcgtttggaaaccttgaggtgagcccaccagtggtcgccaacggcaaggagtaccccttgggtcgcattttgatcggaggcaaccttcccggctcttctggcagaagggtgactcaggtggtgcgtgacttcttgcatgcccagaaggtgcaaccacccgtggaactctttgtggactggctggccgtgggacatgtggacgagttcttgtccttcgtgcccgctcccgacgggaaggggtttcggatgctgctggccagcccaggggcttgtttcaagctgttccaggaaaagcagaagtgcgggcacggccgcgccctactctttcagggggttgtcgatgatgaacaggtcaaaaccataagcattaatcaggtcctgtcaaataaggacctcataaactacaataaatttgtgcaaagttgtatcgactggaacagagaagtccttaagcgagagctggggctggccgagtgtgacataatcgatataccccagctatttaagacagagcgtaagaaagccaccgccttttttccagacctcgttaacatgctggttttgggaaagcatctcggcatcccaaaaccattcggtcctattatcaacgggtgctgttgcttggaggaaaaggtgcggtccctgttggaacccctcggactgcactgtacatttatcgacgacttcactccatatcatatgctacacggcgaggtccattgtgggaccaatgtgtgccgaaagcccttcagctttaaatggtggaatatggtaccgtag

SEQ ID NO: 198876 - DNA, 645 bp, Artificial Sequence
  Description of Artificial Sequence: Synthetic coding sequence
atggcccagggcaccctgatccgggtgacccccgagcagcccacccacgccgtctgcgtgctggggactttgactcaactcgatatttgttcttccgctcctgaggactgtaccagttttagcattaatgcaagcccaggggtagtagtagatatagcccatgggcctccagcaaagaagaaatccaccgggtcttctacctggccactggatccaggggtagaagtgacccttaccatgaaggtcgcaagcggcagtacaggtgatcagaaggtgcagataagttactacggcccgaagacccctcccgtgaaagccctcctctatttgacaggcgtggatggtgtgtcgccatgtcaccctgggtggtccgccatgcacgatctggcacactgtaaccttcgactgcaagtccaggctatcctgtgtttttccgtcccctccagctggacgaccggagcctgccatcacgcttggctgattttcgtcttcctggtcgaaatggagtttcaccatgtcgggcaagccggcctggagctgcttacgtctggcgacctgcctgccagcggaagtcagagcgcacgtatcacaggaatgaaccattgtgcacggccctccatcttccttattctgaagtatctctag

SEQ ID NO: 198877 - DNA, 1992 bp, Artificial Sequence
  Description of Artificial Sequence: Synthetic coding sequence
atggcccagggcaccctgatccgggtgacccccgagcagcccacccacgctgtatgcgtgctcggtactctcacccagctagatatctgtagtagtgcacctgaagattgcacctccttcagcatcaatgcatcacctggcgtcgttgtggatatagcccacgggccgcccgcaaagaaaaagtcaactgggtctagcacctggcccttagatccaggtgtggaagtgaccctgacaatgaaggtggcttccgggtccaccggcgaccaaaaggtgcagattagctattacggacctaagaccccaccagtaaaggcgctcctgtacctaaccggtgtcgaaatctcgctgtgcgcagacatcacacggacggggaaggttaaacctactcgggcagtcaaggatcaaaggacctggacgtgggggccatgtggacagggcgcaatactgctggtgaattgtgacagggataatctggagtccagtgcgatggactgcgaagatgatgaggttctcgattctgaagatctgcaagatatgtcgttaatgactctgtctactaaaactcctaaggacttcttcacaaaccacacattggttctgcatgtggctcgctctgagatggacaaagttagggtatttcaggctacccggggaaaactgtcttcgaaatgctcagtagttctcggccccaagtggccttctcactatctgatggtccctggcggcaagcataacatggacttttacgttgaggccttggcctttccagatacggatttccccggtctcattacgctgacaatttcactgctggacacatctaatttggaactgcccgaggcggtcgtgtttcaggactctgtggttttccgggtagcgccatggatcatgacccccaatacacagcccccccaggaagtatacgcctgcagtattttcgagaatgaggacttcctgaagtccgttactaccttggcaatgaaggccaagtgtaagctgaccatctgccctgaggaggaaaacatggacgatcagtggatgcaggatgagatggagatcgggtacatccaggctcctcataagactctccctgttgttttcgacagccctcgcaatcgcgggctaaaagagtttcctatcaaacgcgtgatgggtcctgactttggatacgtgacccggggccctcaaactgggggcatctctggactggatagcttcgggaatctggaggtcagccctcctgtcactgtgcgaggcaaggagtacccattgggcagaattctgttcggcgattcgtgttacccctccaatgattctaggcagatgcatcaagctttgcaggactttcttagtgcacaacaggtccaagccccggtgaaactttactcggactggctctcggtaggccacgtggacgagtttctgtctttcgtgccggcacccgacaggaaggggttcaggctgttgcttgccagtcccagatcgtgttacaagctatttcaagaacagcagaacgagggtcatggcgaagccctgcttttcgagggcatcaaaaagaagaagcagcagaagatcaagaacattctctcgaacaagaccctccgcgaacataatagcttcgtggagagatgcattgattggaaccgcgagctgcttaaacgcgagctagggctggcggaaagcgacattattgatatcccccaattatttaaactcaaggagttttccaaggccgaggcatttttcccaaacatggtcaacatgctggtattgggaaaacacctgggcattccgaagccctttgggcctgtgattaatggaaggtgttgtctggaagagaaggtgtgcagcctgctggagcccctaggtctgcagtgcacctttatcaatgacttcttcacctatcacattagacacggggaagtgcattgtggaaccaacgtgcgaagaaaaccattttcattcaagtggtggaacatggtaccttag

SEQ ID NO: 198878 - DNA, 384 bp, Artificial Sequence
  Description of Artificial Sequence: Synthetic coding sequence
atggcccagggcaccctgatccgggtgacccccgagcagcccacccatgctgtttgtgtgttaggaactcttactcagctggacatttgcagctcagcccccgaagactgtacaagctttagtataaacgctagccctggagttgttgtagacatcgcccacggcccccccgctaagaaaaaatcgactgggagcagtacttggccactggatccaggagttgaggtgacattaacaatgaaggtggcctcagggtcaactggcgaccagaaggtgcaaattagttattatgggccgaaaacccctcctgtgaaggccctgctgtacctgacaggtgtcgacggggtgagtccttgtcacccaggatggtccgcgatggcctag

SEQ ID NO: 198879 - DNA, 2628 bp, Artificial Sequence
  Description of Artificial Sequence: Synthetic coding sequence
atggacaccgtgcaccacatgctgctgttcggctgcaacatgccctcttccactggctcctactggttctgtgacgaggggacttgtactgacaaagcgaacattctatatgcgtgggctagaaacgcaccacctactagactcccaaaaggcgtaggcttccgggttggcggtgagaccggttccaaatactttgtgctgcaagtgcattacggcgatatctccgcattccgtgacaacaacaaggactgtagcggtgtgtccctgcacctaaccaggttaccacagccgctgattgctggaatgtatctgatgatgagtgtagacacagtgatccctgcgggagagaaagtagtcaactctgatatatcctgccactataagaattaccccatgcacgtttttgcctacagggtgcatacacatcatttaggaaaggtcgtcagcggatacagagtgcgcaacggacagtggacattgatcgggagacagtcaccgcaattgcctcaggcattctatcccgtggggcaccccgtggatgttagcttcggggatcttctcgccgctcgttgtgtgttcacaggcgaggggagaactgaagctacgcacataggagggacatcgtcagacgaaatgtgcaacctttatattatgtactacatggaggccaaacatgctgtgtccttcatgacctgcacccaaaacgtggcccccgacatgttccgtacgatccccccagaagcaaacattccaatccccgtcaaaagcgatatggtgatgatgcatgaacatcacaaagagactgaatacaaggataagattccccttttgcagcagccgaagagggaagaggaagaagtcttagatcaaggcgacttttacagcctgttgagtaagctactgggagagcgcgaagacgttgttcacgttcataagtataaccccactgagaaggccgagagcgagagcgatctcgtggccgagatagcaaacgtagtacaaaagaaagacctgggtcgctctgatgcacgagagggcgccgagcatgagcggggcaacgccattctggtacgagatcgcatccataaatttcaccggttggtgtccacacttagacctcctgagtcacgggtattctctctgcaacagccccctcccggagagggtacctgggaaccagaacacacaggcgattttcatatggaggaggctttggactggccaggggtgtacctcctgcccggtcaggtaagcggtgtcgctctcgatcctaagaacaatctcgtcattttccatagaggtgaccatgtgtgggatggaaactcatttgattcaaaatttgtgtaccagcagatagggctgggccccattgaggaggatacaatcctggtaatcgacccaaataatgccgctgtgctgcagagctccggcaaaaacttgttctatctccctcatggcctgtccatcgacaaagacggaaactactgggtcaccgacgtggccctgcaccaagtgtttaagctggatccaaataataaagaaggcccagtgttgatcctgggacgctcaatgcagcccggcagtgatcagaaccacttctgccagcctacagatgtcgccgtagatcctggcacgggtgcaatctatgtgtcagacggctattgtaattctagaatcgtgcagttttccccaagtggaaagtttattactcagtggggcgaagaatcaagcggcagcagcccgctgcccggccagtttacggtccctcactctctggccctcgttccattacttggccagctgtgcgtggctgacagggaaaatggccggatccagtgttttaagacagacaccaaggagtttgttagggagattaagcactcctcattcgggaggaatgtctttgccatcagctacatcccgggcctattattcgcggtgaacggcaagccacacttcggagaccaggagcctgtgcaagggtttgtaatgaattttagcaatggagaaattattgacatcttcaagcccgtgaggaagcacttcgacatgcctcatgatatcgtcgcttctgaagatggcaccgtctacattggagatgctcatacaaatactgtctggaaatttacgctaactgagaagttagagcatcgatcggttaaaaaggctggtattgaggtgcaggaaattaaggccgaagctgtcgtagagactaaaatggaaaacaaaccaaccagctctgaactccagaagatgcaggaaaagcagaaactcatcaaagagcccggctcaggtgtacccgtcgtcttaataaccacactgctggttatcccggtcgtggtcctgctggctatcgctatctttatcagatggaagaaatccagagcatttggggattccgaacataagctggagactagttcggggagggtcctgggacggtttcggggaaaagggagtggaggcctcaatctgggtaacttctttgcgtcccgcaagggttactcacgcaaaggcttcgatagactgagcactgagggttctgatcaggagaaggaggacgacgggtccgagtccgaggaagaatattccgctcccctgcctgcgctggctccctcatcctcttag

SEQ ID NO: 198880 - DNA, 2925 bp, Artificial Sequence
  Description of Artificial Sequence: Synthetic coding sequence
atggccggccgggtgcccagcctgctggtgctgctggtgttccccagttcttgcctggctttccgtagtccgctctctgtgtttaagcgcttcaaggagacaacccgcccattttctaatgagtgccttgggaccacgagacccgtggtgcccatagattcgagcgattttgccctcgatattcggatgcctggggtaacacctaagcagtcagacacttacttttgtatgtctatgagaatccccgtcgacgaagaggctttcgtgatcgatttcaaacctagagcttctatggacactgtgcatcacatgttgctgttcggctgcaatatgccatctagtactggctcctactggttctgcgatgaaggcacgtgtacagacaaggcgaacatcttgtatgcttgggcccggaatgcgccaccaacccgactccccaagggcgtggggtttagagtgggcggagaaaccggtagtaaatatttcgttttgcaggtgcattatggggacatttcagccttccgcgacaacaacaaggattgcagcggagtttcactgcacctaacaaggctcccacagcctcttatagccggcatgtatctgatgatgagtgtcgacactgttatcccagcgggagagaaggttgtgaactccgatatatcctgtcattacaagaactaccccatgcacgtttttgcctacagggttcatacgcatcatcttgggaaggttgtgtcaggatatcgggtgaggaacgggcagtggaccctcattggccggcagagtccccagctgccacaggcattttacccggtgggtcaccctgtcgacgtgtcctttggcgatcttctggctgcgcgatgcgtcttcaccggggaaggaaggactgaggccacccacattggcggcacttcaagcgatgagatgtgcaatctctatataatgtattacatggaggcaaaacatgctgtgtccttcatgacatgtacccaaaatgtcgcacccgacatgtttagaaccattccacctgaggccaacattcccattccagtcaaaagcgacatggtaatgatgcacgagcatcacaaagaaactgagtataaggacaagatacccctgctgcagcagccaaagcgagaggaggaggaagtcctggatcagggcgatttttatagtctcctcagcaagttgcttggagagagagaagacgtggtacatgtccacaaatataacccgactgaaaaagctgagagcgaatcagaccttgtggcggaaattgctaacgtagtgcagaagaaggacttgggacgatccgatgcaagggaaggagccgagcacgaacgcggaaatgctatcctggtcagggatagaatacataagttccacagactggtgagtacccttagacctccagaaagtcgggtgttcagccttcagcagccccctcccggcgagggcacttgggagccagaacatacaggtgacttccacatggaggaggctttagactggcctggcgtatacctcctgcctggacaagtgtccggtgtggccctggaccccaaaaataatctcgtaattttccacagaggggaccatgtatgggacgggaactctttcgatagtaagttcgtgtaccagcagataggcctaggccccatagaagaagacaccatactagtgattgaccccaacaacgcagctgtgctgcagagctccggtaagaatctgttctatttgccccatgggctgtccattgacaaggacggaaactactgggtcaccgatgtagctctgcaccaggtgttcaagctggaccctaacaataaagaaggcccagtgctgattctcggtcgatccatgcaacccggatctgaccaaaaccacttttgtcagcccactgacgtggctgttgatccaggcaccggggctatttatgtatcggatggatactgcaacagccgaatagtgcaattctcgcccagcggaaagttcattactcagtggggtgaagaaagctccggctctagcccattgcccggccaattcactgttccgcattcccttgcacttgtcccacttctgggacagctttgcgtcgcagaccgggaaaatggccgcatccaatgcttcaaaacagacaccaaagagttcgttcgcgagataaaacatagtagtttcgggcgtaatgtgtttgctatttcctacatccccggcctgctctttgcagttaatgggaagcctcacttcggagaccaggagcccgtgcagggatttgtgatgaatttctccaatggcgaaatcatagacatatttaagcctgtgagaaaacacttcgacatgcctcacgatatcgtggcctcagaagacggcaccgtttacatcggtgacgcccataccaatactgtctggaagtttaccctcacggagaagctcgaacataggtctgtgaagaaagcgggcatagaagttcaagagatcaaagaagccgaagccgtcgtcgagaccaaaatggagaacaagcctaccagctcagagcttcagaagatgcaggaaaaacaaaaattgatcaaggaaccaggctcaggggtcccagtggttctcattactaccttgctggtcatccccgtcgtggtcttattagccattgcgatattcattaggtggaagaaatcccgtgcctttggagcagatagcgaacacaagttggagacaagctctggaagagtgcttgggagattccgaggcaaaggctcaggaggactcaacctcggaaatttttttgctagtcgtaaaggctatagtcgaaaggggttcgaccggctctccacggagggctcggaccaggagaaagaggacgatgggtcagaaagcgaggaggaatacagcgctcccctgccggccttggcaccttcgtcctcatag

SEQ ID NO: 198881 - DNA, 2664 bp, Artificial Sequence
  Description of Artificial Sequence: Synthetic coding sequence
atggccggccgggtgcccagcctgctggtgctgctggtgttcccctctagctgcttagcattccgctcccccctctccgtatttaagcggtttaaggaaacaacacgtccattcagcaacgagtgtttgggaacaacgcgcccggtggtgcctattgattcgtcggacttcgctctggatattaggatgcccggtgtgacccccaagcagtcagatacctacttttgtatgtctatgcggattccggtggatgaagaggccttcgtgattgactttaagccccgggctagcatggacaccgtccaccacatgctgcttttcggttgcaatatgccgagcagtacaggcagctactggttctgtgatgaggggacatgcactgataaggccaatattctctatgcctgggccagaaacgcaccacctacacgcctccccaagggagtgggtttcagagtcggcggcgaaactggtagtaagtactttgtgttgcaagtccactacggagacatatcggccttccgcgacaataataaggactgtagcggagtgtctctgcacctgaccagactgcctcagccattgattgccgggatgtacctgatgatgtcggtggacactgtaattccagccggggaaaaggtggtcaactctgacatctcttgtcactacaagaactatcctatgcacgttttcgcgtacagagtccacacacatcacctggggaaggtggtgagtggttatagggtgcgtaacggtcagtggacccttatcgggcggcagtctccccagctgccacaggccttttacccagttggacatcccgtggatgtatctttcggggatttacttgctgcccgctgtgtgttcactggcgagggccgcacggaggccacacacattggcggcacaagcagtgatgagatgtgtaacctatacattatgtattacatggaggccaaacatgccgtaagctttatgacatgcacccaaaacgtggcccctgacatgttccgcaccatacccccagaggcaaatattccaatcccagtgaagtcagacatggttatgatgcatgagcatcacaaagagaccgagtacaaggataagatccctttgttgcaacagccaaaacgggaggaggaagaggtcctggaccagggcgatttttacagcctcctgagtaaactgctcggcgagagggaggatgtggtgcatgtgcataaatataatcccacagagaaagctgagagcgaaagcgatcttgttgccgagatcgccaacgtcgtgcagaagaaagacctgggacggtccgacgcccgggagggtgcagagcacgagcgcggaaatgcaatactggttcgggacaggatccacaagtttcacaggttggtttccacgcttcggcccccagagagccgagtgttttcactccagcagcctcctcctggagaagggacgtgggagccagaacatactggcgacttccatatggaggaggcgcttgattggcccggagtgtacctgctgcctggacaagtgtcgggcgtcgcgttagaccccaaaaacaacctagttatttttcataggggggatcatgtttgggatggaaacagtttcgattctaagtttgtgtatcagcagatcgggctgggacccatcgaagaagatactattctggtgatcgaccccaacaatgctgctgttctacagtcctcgggaaagaatctcttttacttgccccacggactatccattgacaaggatggaaactattgggttacagatgtggcgttacaccaagttttcaaactggacccgaataacaaagaaggtccagtgctgatcctcggccgcagcatgcagccaggttccgatcaaaatcatttctgccaacccacagacgtggccgtggaccctggaacgggagctatttacgtgtcagacggatactgtaattcccgcatagtgcagtttagccctagtgggaagttcatcacacagtggggagaggaatcgagcgggtcttccccactgcccggacagtttaccgtaccccatagtctggcgctggttcccttgctgggtcagctctgtgtggcagatcgcgagaatggccgcatccagtgctttaaaaccgatacaaaggagtttgttcgggagataaagcattcctccttcggccgaaatgtgttcgcaatatcttacatccctggtctgctattcgcagtcaatggaaaaccccattttggcgatcaggaacccgtacaggggtttgttatgaatttctccaatggcgagatcatcgatattttcaaaccagtacgaaagcattttgatatgccccacgacatcgttgcgagcgaggacgggacagtttacataggcgatgcccacactaacacagtctggaagtttacattgacggagaaactggagcacaggagcgtcaagaaggccgggatcgaagtgcaagagattaaggggaagggcagcggggggctgaatctcggtaacttcttcgcctcccggaagggatacagtcgcaagggattcgatcgcctgagcactgagggtagcgaccaggagaaggaagatgacggctccgagagcgaagaagaatacagcgctcccctacccgctctggccccatcaagctcatag

SEQ ID NO: 198882 - DNA, 2601 bp, Artificial Sequence
  Description of Artificial Sequence: Synthetic coding sequence
atggccggccgggtgcccagcctgctggtgctgctggtgttccccagctcatgtctggccttccgatctcccctgagcgtctttaaacggttcaaggaaaccacgcggccttttagcaatgagtgtctggggacgaccaggccggttgtccctattgatagctccgactttgctctggacatccgtatgccgggcgttactccaaagcagagcgacacatacttctgcatgagtatgcgaatccctgtggacgaagaggcttttgtgatcgactttaagcctagggccagtatggataccgtgcatcacatgctactgtttgggtgtaacatgccatcaagcaccgggtcctattggttttgcgatgaaggcacatgcacagacaaagctaacattttgtacgcatgggcccgcaatgcacctcctactcggttgcccaaaggcgttggcttccgcgttggcggagaaacaggcagcaagtacttcgtgctccaggtacattacggcgacatcagcgcattccgcgataacaacaaagactgtagcggggtgagtctgcacctgacccggctcccacagcccctgattgcaggtatgtacctgatgatgagtgttgacacagtgatcccagcgggcgaaaaggttgttaatagcgacatcagctgccactacaaaaattacccaatgcacgtgtttgcttatcgcgtgcacacccaccacctggggaaagtggtttctgggtaccgggtgagaaacggccaatggacactaatcggtcgccagtcgccacagctcccacaggcattctatccagtgggacatcccgtggatgtgagcttcggggatttactggccgctcgttgtgtgtttactggtgaggggcgtacagaagctactcacatcggagggacgagctccgacgagatgtgcaatctgtacatcatgtattatatggaggccaaacatgcagtgtcctttatgacttgcacccagaacgttgctcctgacatgtttagaactatccctccggaagccaatatccccatacccgtgaagtctgatatggtcatgatgcacgaacatcacaaagaaaccgagtataaagacaaaatccccctgctccagcagccgaagcgtgaagaggaggaggtgctcgaccaggacttccacatggaggaggcgttggattggccaggggtatatctcctgccgggacaagtgagcggcgtagcgttggaccccaagaataatctggtaatctttcatcggggtgatcacgtgtgggacggtaactctttcgattctaagttcgtatatcaacaaatcggactgggcccgatcgaggaagacactatcctggtcatcgatcccaacaatgccgcagttctgcagtctagtggcaagaaccttttctatcttccgcatggcctctctatcgataaggatggcaactactgggtgactgatgtggctctgcaccaggttttcaagctagatcctaacaacaaagaaggccccgtgctgatccttgggagaagtatgcagccggggagcgaccaaaaccacttttgccaaccgactgatgtggctgtggaccccggaactggcgcgatctacgtctccgatggatattgcaattcccgtatcgtccaattttctccatcagggaaatttatcacgcaatggggcgaggaaagtagtggctcttcccctctccccggacaattcactgtgcctcactccctggctctggtccctctgcttgggcagctttgcgtggccgatagagaaaatgggagaatccaatgcttcaagactgacaccaaggaatttgttcgggagattaagcattcatcctttggacgtaatgtgtttgctatatcatacattccaggattactgttcgcagtgaatgggaaacctcactttggagaccaggagccagttcagggttttgtaatgaatttcagcaatggggagatcatagacatattcaaaccagttcgcaaacattttgatatgcctcatgatattgtagcctccgaagacggtaccgtgtacattggcgacgcccacactaataccgtatggaagtttaccttgaccgagaagctcgaacacagaagcgtgaagaaggccggtatcgaggtccaggagatcaaagaggctgaggccgtggttgagacaaagatggagaacaagcctacctcatcggagctccagaagatgcaggagaagcagaaactaatcaaagagcccggttctggcgtgccggtggtcctcattacaacattgctggtgatcccagtcgtagttctgctggcaattgccattttcataagatggaagaagtcaagggcttttggggattctgaacacaaattggagaccagctccggaagggtattgggacgatttagaggcaaggggtcaggcggcctaaacttgggaaatttctttgcctctcggaagggctattcccggaaaggatttgacaggctatccactgaaggatccgaccaggagaaggaggatgacgggagcgagagcgaagaagaatacagcgcccccctccctgccctggccccctcgtcgtcatag

SEQ ID NO: 198883 - DNA, 1008 bp, Artificial Sequence
  Description of Artificial Sequence: Synthetic coding sequence
atgcagcccggcagcgaccagaaccacttctgccagcccaccgacgtggccgtggaccccgggaccggcgcaatctacgtgtctgatggttattgtaatagcaggatcgtccaattctcacccagtgggaagttcattacccagtggggagaagagtcttcgggcagctcgcccctcccagggcagttcacagtgccacactcattagccctggtgccactgcttggccagctgtgcgtggctgatagggagaacggaagaatccagtgctttaagaccgatactaaagagttcgtgcgcgaaataaagcattcaagttttggacgaaacgtttttgcgatctcttatattccaggactcttatttgctgtaaacggcaaaccccatttcggagatcaggagcctgtgcagggctttgttatgaattttagtaatggtgaaataattgacattttcaagccagttcggaaacatttcgacatgcctcatgacatagttgcctctgaggacggcacggtgtacattggggatgcgcatacgaacactgtgtggaaatttaccctgacggagaaattggagcatcgaagcgtgaaaaaggccgggattgaagtgcaggagatcaaggaagctgaggccgtggtggagacaaagatggaaaataaacccacttcatcagagcttcagaaaatgcaggaaaagcagaagctgatcaaggagcctgggtctggtgtgccagtggtgctgatcacgacactgttggttatccccgttgtcgtgcttctcgctatagctatattcatccggtggaaaaagtcacgggctttcggtgggaaaggatccggggggcttaatctcggcaacttcttcgcgagccgaaagggatattctagaaaggggttcgatcgtctttcgactgagggttcagatcaagagaaagaagacgacggatcagagagcgaggaggagtacagcgcccccctgccagctctcgcgcccagtagctcatag

SEQ ID NO: 198884 - DNA, 468 bp, Artificial Sequence
  Description of Artificial Sequence: Synthetic coding sequence
atgcacgagcaccacaaggagaccgagtacaaggacaagatccccttacttcaacagcctaagagagaagaagaagaagtgctggatcaaggtgatttttattcactcttgagcaaattgctgggagaaagagaggatgtggtccacgtacataaatataacccaaccgagaaagctgagtccgagtctgatctggtggcagagattgcaaatgtcgtgcagaagaaggatttaggaagaagtgatgcacgcgaaggggctgagcacgagcgggggaatgcgattctggttagggaccgaatacataaattccacaggttggtatcaacccttcgcccccccgagtcaagagtgttctctctacagcagcctccgccgggcgagggaacgtgggaacccgaacataccggcgctcgccgtgaggatatgaagtgcttccagtgcaaggaaatgatctccgtgcagtag

SEQ ID NO: 198885 - DNA, 2922 bp, Artificial Sequence
  Description of Artificial Sequence: Synthetic coding sequence
atggccggccgggtgcccagcctgctggtgctgctggtgttcccctcctcctgccttgcctttcggtctccgttatccgttttcaaaagatttaaagagactactagacctttcagtaacgagtgtctgggaaccactaggccagtggtgcctattgactcctctgactttgcactggatatcaggatgcctggggtaactcctaagcagagcgatacctacttctgtatgtcaatgcgcataccagttgatgaggaggccttcgttatcgacttcaaacctcgcgcttccatggatactgtacaccatatgctgttgtttgggtgcaatatgccaagcagtaccggttcctactggttctgcgatgagggaacttgtaccgataaggctaacattctctacgcctgggctcggaacgcaccacctaccagactgcctaagggagtgggatttagggttggcggagagaccgggtccaaatattttgtccttcaggttcactacggagatatatctgcttttcgggacaataataaagactgctccggcgtttccttacaccttacgaggcttcctcaacctctgatagccggtatgtacctgatgatgtctgtggacaccgttatccccgccggggagaaggtggtgaactctgacatctcgtgtcattacaagaactacccaatgcacgtcttcgcttatagggtccacacacatcacctgggaaaggtcgttagtgggtaccgggtgcgtaatggccagtggacattgattggccgtcaatcacctcaattgccccaggcattttatcctgtggggcaccctgttgatgtttccttcggcgacttgctcgctgctcggtgtgtcttcacaggggaagggcgtactgaggccacccacatcgggggtacgagctccgacgagatgtgcaatctctacattatgtactatatggaagctaaacacgctgtgtccttcatgacctgcacacaaaacgtggcccccgacatgtttcggactattccccccgaggctaacataccgatacccgtgaaatccgatatggtcatgatgcacgagcaccataaggaaaccgaatataaggacaaaatacctctcctccagcagccaaaacgagaggaggaggaagtgctcgaccaaggcgacttttattcactcctgtccaaacttttaggagaaagagaggatgtggtgcacgtgcataaatataacccgactgagaaggctgagtctgaaagcgacctggtggcggaaatcgccaatgtggtgcagaaaaaagaccttggacgcagcgatgcgcgggagggtgcagagcatgagcgtggtaacgccatactggtacgagatcggatccataaattccacagactagtgtctacgctgcggccacccgaatcccgtgtgtttagccttcagcagccacctccgggcgagggaacttgggagcccgaacataccggagattttcacatggaggaggcactcgattggccaggcgtatatcttctcccaggtcaagtgtccggcgtggccctcgacccaaaaaacaacctcgtcatcttccaccgtggagatcatgtttgggatggtaactcatttgatagtaaatttgtgtaccagcagattggactcgggcccatagaggaagacactatcctagtgatcgatcctaacaacgccgccgtgctgcagagctccggtaaaaacctcttctacctcccacacggactgagcatcgacaaggatggtaactattgggtaactgacgtcgcccttcaccaggtcttcaagctggacccaaataacaaagagggtcctgtgctgattctggggcgaagtatgcagcccggaagcgaccagaaccacttttgccagcccacagacgtcgcggtggaccctggcacaggcgctatctacgtttctgacggttattgtaacagcagaatagtgcagttctcaccctcagggaaatttatcacccagtggggcgaggaatcctcgggatcttcgccactgcctggacaatttaccgtgccgcattctctggcccttgtccccctcttggggcagttatgtgtggccgaccgggagaacggacggatccaatgttttaaaacagacactaaggagtttgttcgtgaaataaagcactcaagtttcggccggaacgtgtttgcgatcagttatatccccggattactcttcgccgtgaacggaaaaccacatttcggagatcaggagcctgtgcaggggtttgtcatgaacttttccaatggcgagatcatagacatttttaagcctgttcgcaaacatttcgacatgcctcatgatatagttgcctctgaagatggtacagtatatatcggcgatgctcatacgaacacggtgtggaagttcacacttacagagaagctggaacaccgctctgtgaagaaggccggaatcgaggtgcaggagattaaagaggccgaggcggttgttgaaactaagatggaaaacaaacctacgagcagcgaactccagaaaatgcaagagaagcaaaaacttataaaggaacctgggtccggtgtcccagttgttctcattaccacactactggtgatccctgtggttgtgctgctagccatcgccatctttattcggtggaaaaaatccagagccttcggagattctgagcataagctcgaaactagtagcggccgcgttttggggcggtttcgtggcaagggatccggagggctgaatctgggcaactttttcgccagccggaaaggctacagcagaaaaggcttcgaccgcttatctaccgagggatctgaccaggagaaggaggacgacggatcagagagcgaagaggaatacagtgcacccctgcctgcgctggcccctagctcaagctag

SEQ ID NO: 198886 - DNA, 2718 bp, Artificial Sequence
  Description of Artificial Sequence: Synthetic coding sequence
atggccggccgggtgcccagcctgctggtgctgctggtgttcccctctagttgcctcgcatttaggagccctctgtcagtgttcaagcggtttaaagaaacaacaagaccattctctaacgaatgcctcggaaccactcggcccgtggtgcctatagatagttcagattttgccctggacattcggatgcctggagttaccccaaaacagagtgacacttatttctgcatgtctatgcgcatcccggtagacgaagaggctttcgtgattgacttcaaaccacgggcctctatggatacagtccaccatatgctgctgtttggctgtaacatgcccagcagtacgggtagctattggttttgcgacgaaggtacatgtactgacaaggccaacatcctgtacgcctgggccagaaatgcccctccaacaaggttgcccaaaggagtgggcttccgcgtgggcggtgagaccggaagcaagtacttcgtgctccaggtgcactatggcgacattagcgccttccgcgacaataacaaagactgctctggtgtctccctccatctgacacggctgccacagccactcatcgcagggatgtacctcatgatgtcggtggacactgtgatcccagcgggagagaaggtggtaaattcagacattagctgccattataagaattatcccatgcatgtgtttgcctatagagtgcacacgcaccacctcggaaaggttgtttcagggtatagggtaagaaacggccagtggaccctcattgggaggcagtcgccccagctgccgcaagctttctacccggtgggacacccagtagacgtcagtttcggcgatcttttggctgctcgttgcgttttcaccggagaggggcgcaccgaggcaacccacatcggtggaacctcaagcgatgagatgtgtaacctttacatcatgtactatatggaagctaaacatgctgtgtcattcatgacttgcacgcagaatgttgcccccgatatgtttagaaccattccaccggaagcaaacatcccgattcccgtcaagagcgacatggtgatgatgcacgaacatcacaaagagactgagtacaaggataaaatccccctgctacagcagcccaaaagagaggaggaggaggtgctcgatcaaggcgatttctactccctgctgagcaagttacttggggaacgcgaagacgtggtgcatgtgcacaagtacaaccccaccgaaaaagcagagagtgagagcgacctcgtggctgaaatcgccaatgtggtccagaaaaaggatctggggaggtcagacgcaagagaaggcgctgaacatgaaaggggcaacgctatcctcgtgcgagacaggatccacaaatttcataggttagttagtactttgagaccccctgagagtcgggtattctcgctgcagcagccccctcctggagaaggaacatgggagcctgagcacactggagacttccacatggaggaagcgctcgactggcccggggtctatctgctgcccggccaggtatccggcgtggccctcgatcctaaaaacaatttggttatttttcacaggggggaccacgtgtgggatggcaacagctttgacagcaaatttgtgtaccaacaaatcgggctgggtccaatcgaggaggatactatcctagtgatagaccccaataacgccgctgttctgcagagcagcggcaagaatttattctacctgccgcatggcctaagcatcgacaaagatgggaactactgggtcacagatgttgcccttcatcaagtcttcaaactagatccgaacaacaaagaggggcccgttctgattctgggtcgatccatgcagcccgggagcgatcagaatcacttttgccagccgacagatgtggccgtggatcccgggacaggagctatctacgtgtcagacggatactgtaacagcaggattgtgcagttcagtccttctggaaagtttatcacacagtggggcgaagaatcatccgggtcttcccctctgcccgggcaatttaccgtgcctcactcgctcgctctcgtgcccctgctggggcagctctgcgttgctgacagggagaatggaaggatccagtgctttaagacggatactaaggaatttgttcgtgaaattaaacattcgtctttcggtaggaatgtatttgctatttcctacatacctggactgctgtttgccgtgaacgggaagcctcatttcggcgatcaggaaccggtacaggggtttgtaatgaacttttccaacggcgagatcatcgacatctttaaacccgtgcgaaagcacttcgatatgccgcacgacatcgtggccagcgaggacgggaccgtgtatattggcgatgcccataccaacactgtgtggaaatttaccctgacagagaaactggagcaccggtctgttaaaaaagcaggcatcgaagtccaagaaatcaaagactctgagcataaactcgagacaagcagcgggagggtgttaggacgctttcgcggaaagggaagcggcgggctgaacttgggcaatttttttgcttcacgcaaaggatactctcgcaagggtttcgatcgtctcagtaccgaaggaagcgaccaagaaaaagaagatgatggaagtgaaagcgaagaggagtatagcgccccactcccagctctcgccccttcctctagttag

SEQ ID NO: 198887 - DNA, 90 bp, Artificial Sequence
  Description of Artificial Sequence: Synthetic coding sequence
atggccggccgggtgcccagcctgctggtgctgctggtgttccccagcagttgcctcgcctttaggtctcccctgtcagtgtttaagtag

SEQ ID NO: 198888 - DNA, 87 bp, Artificial Sequence
  Description of Artificial Sequence: Synthetic coding sequence
atggccggccgggtgcccagcctgctggtgctgctggtgttcccctccagctgtctggccttccgatctcccctgtccgtgttttag

SEQ ID NO: 198889 - DNA, 162 bp, Artificial Sequence
  Description of Artificial Sequence: Synthetic coding sequence
atggccggccgggtgcccagcctgctggtgctgctggtgttcccctcctcatgtctggcttttcggagccccttatccgtcttcaaaagatttaaagagaccacccgcccattttcaaatgagtgtctaggtacaaccagaccagtcgtcccaattgactag

SEQ ID NO: 198890 - DNA, 129 bp, Artificial Sequence
  Description of Artificial Sequence: Synthetic coding sequence
atggccggccgggtgcccagcctgctggtgctgctggtgttcccctctagctgcctcgcctttcgaagtcctttgagcgtatttaagagattcaaggaaaccacgagaccattttccaatgagtgctag

SEQ ID NO: 198891 - DNA, 207 bp, Artificial Sequence
  Description of Artificial Sequence: Synthetic coding sequence
atggccggccgggtgcccagcctgctggtgctgctggtgttcccctcctcctgtctggctttccgctctcctttgagcgttttcaaaagatttaaagaaacaacgcggcctttcagcaacgagtgtctgggtacaactaggccggttgtgcctatagattctagcgatttcgctctggacatacgaatgcccggtgtaacaccatag

SEQ ID NO: 198892 - DNA, 78 bp, Artificial Sequence
  Description of Artificial Sequence: Synthetic coding sequence
atggccggccgggtgcccagcctgctggtgctgctggtgttcccctcttcctgcttagctttcaggagcccgctgtag

SEQ ID NO: 198893 - DNA, 501 bp, Artificial Sequence
  Description of Artificial Sequence: Synthetic coding sequence
atggccgccatcccccccgacagctggcagccccccaacgtgtacctggagacgagcatgggtataatagtcctagagctgtattggaagcacgctcctaagacgtgcaaaaatttcgcagagctagcacgtaggggctattataacggaactaagtttcacagaatcatcaaagacttcatgatacagggtggggatccaactggaaccggaaggggaggcgctagcatctacggcaaacagtttgaggacgaactgcaccctgacctgaaattcacaggggccggaatcctcgccatggctaatgccggacccgatactaatgggtcccaattctttgttaccctggctcccactcagtggttggacggcaaacacactatctttggtcgggtctgccagggcatcggcatggttaatcgcgtgggcatggtagagacaaatagccaagatcgccctgtagacgacgtgaagattattaaggcctacccatctgggtag

SEQ ID NO: 198894 - DNA, 1563 bp, Artificial Sequence
  Description of Artificial Sequence: Synthetic coding sequence
atgggcaagcggcagcaccagaaggacaagatgtacatcacctgcgccgaatacacacatttttatggaggaaaaaagccagaccttcctcagacgaactttcgaagacttcccttcgaccattgctcactgtcactacagccttttgtctatcctgtgtgcactcccgacggcatcgtatttgacttgctcaatatcgtgccatggctcaagaagtacgggaccaacccgagtaacggcgaaaaactcgatggacgctctctgattaagctcaacttcagcaaaaactccgaaggcaagtaccattgccctgtgctttttaccgttttcactaacaacactcatattgtggctgtgagaacgacagggaatgtgtacgcatatgaagccgtggagcagctcaatatcaaggccaagaattttagggacctacttacagatgagcctttttccaggcaggatattatcactcttcaggatcccactaatctcgataaatttaacgtgagcaatttttatcatgtgaaaaacaacatgaaaatcattgatcctgatgaagaaaaagcaaaacaagacccatcttactatctcaagaacacaaacgccgagacacgggaaaccttacaggaactctacaaggaatttaagggagatgagattttggcagccaccatgaaagcccctgaaaagaaaaaggtggacaagctgaacgcagcccactattccacgggaaaagtgtcagccagttttacatccaccgccatggtgccggaaacaacacatgaagccgcagccatagatgaggacgtcctgcgataccagttcgtcaaaaaaaagggttacgttcgcctgcacactaataagggtgatcttaatctagagttacattgtgaccttacacctaagacctgcgagaattttatccgcctgtgcaaaaaacattactacgatggcaccatctttcacagatctataaggaactttgttatacagggtggtgacccaacgggtacaggaacaggcggcgagtcttattggggcaaaccgttcaaagacgagttcagaccaaacctatctcacactgggcggggcattctgtcgatggccaattccggacccaactccaatcggagccaattcttcatcaccttccgcagctgcgcttatctggacaagaagcatactattttcgggagagtcgttgggggcttcgatgtgttgactgccatggagaacgtggaaagtgaccccaaaacagaccgccccaaggaggaaattcgaattgacgccaccacagtgtttgtggacccttacgaggaagctgacgctcagatcgctcaagagcggaagacgcagctcaaggtggcgcctgagacgaaagttaaaagctctcagccccaagcaggatctcaggggcctcagactttccggcagggggttggcaagtacattaacccagctgctaccaagcgcgccgcagaggaagaacctagtaccagcgccaccgtcccaatgagcaagaaaaagccgagcaggggctttggggacttttcctcttggtag

SEQ ID NO: 198895 - DNA, 1563 bp, Artificial Sequence
  Description of Artificial Sequence: Synthetic coding sequence
atgggcaagcggcagcaccagaaggacaagatgtacatcacctgcgctgaatatacccatttttatgggggcaaaaagccagacctgccccagacaaacttcaggagactgccattcgaccactgttctctgagtcttcagcccttcgtgtacccagtttgtactccagatggaatagtcttcgacctgttgaacatcgtgccttggctgaagaaatatgggacgaatccctctaacggcgagaaactcgacggccgaagtctcatcaagctaaatttctctaagaactccgagggtaagtaccactgccccgtgcttttcaccgtttttaccaataatacccacatcgtggcagtgcgcaccacgggcaacgtgtatgcctatgaggctgttgagcagctgaacatcaaggctaagaatttccgggatcttctaacagacgaaccttttagccgacaagacatcattaccctccaagaccctaccaatctggacaagtttaatgtgagtaacttctatcacgttaagaacaacatgaaaatcatcgaccctgacgaagagaaagctaagcaggatccctcttattatcttaaaaatacgaatgccgaaacgagagaaacactacaagaactttacaaggagtttaagggcgatgaaatcctggccgccactatgaaagccccagagaaaaagaaggtggataagctaaatgcggctcactactcaaccggaaaagtgtctgcaagcttcaccagcaccgccatggtgccggagaccactcacgaggcagccgccatcgacgaggacgtgctgcggtaccaattcgtcaagaaaaagggatacgttagactccacacaaataagggagatttgaacctcgagctgcattgcgacttaacaccaaagacctgcgagaattttattcggttatgcaaaaaacactactatgacgggacaattttccatcggtctattaggaacttcgttatccaaggcggggaccctaccggaacggggactggaggcgagtcatactggggcaaaccttttaaagacgagtttcgccctaatctgtcacacactgggagagggatcctatccatggctaactccgggccaaactcaaatagaagccagttttttatcacattcagatcctgcgcgtatctggataagaaacataccatattcggccgagttgtgggcggtttcgatgtgcttactgccatggagaacgtggaatccgatcctaaaactgaccgacctaaggaggagatcagaatcgacgccactacagtttttgtggatccgtatgaagaagctgatgctcagattgctcaagagcgcaagacccagttgaaggtcgcgccagagaccaaagtcaaaagttcccagccacaggcggggtcacagggaccgcagaccttccgtcaaggtgtcgggaagtatatcaaccctgccgccactaagcgggcagccgaagaggaaccctccacctcggccacagttcctatgagcaaaaagaagcccagcagaggctttggcgacttcagctcctggtag

SEQ ID NO: 198896 - DNA, 1563 bp, Artificial Sequence
  Description of Artificial Sequence: Synthetic coding sequence
atgggcaagcggcagcaccagaaggacaagatgtacatcacctgcgccgaatatacccatttttatggaggcaagaagcctgaccttcctcaaaccaactttagaaggctcccttttgaccactgtagcctgagtcttcagcccttcgtctatcctgtctgcacccctgatgggatcgtgtttgatctgctgaacatcgtgccctggctgaagaaatatgggaccaacccatctaatggcgagaaactggatggccgaagccttatcaagctgaacttctctaagaacagcgaagggaaatatcactgccccgttctgttcacggtttttaccaataacacacatatcgtggctgtgcgtactacaggcaatgtgtacgcctatgaggcagtcgagcagctgaacatcaaagcgaagaacttccgggacctactcaccgatgagccttttagccgccaagacatcatcactcttcaggaccctaccaatctggataagttcaatgtaagcaatttttaccacgttaaaaataacatgaagataattgacccagacgaggaaaaagctaaacaagacccatcatactatctgaagaatacaaacgcggagacaagagaaacgctgcaagaactttataaggagttcaaaggagacgaaatactggctgcgacaatgaaggcacccgaaaaaaagaaggtagataagctcaacgcagctcactattctactggcaaggtaagtgccagtttcacttctacagcaatggtgcccgagacaacccacgaggccgctgctatcgacgaggatgttctaaggtaccagtttgtgaaaaagaagggctacgtgagacttcatacgaataaaggagacctcaacctggagctgcattgcgatctcactcccaagacctgcgaaaactttatccggctgtgcaagaagcattattacgacggcacaatctttcacagatcaatcaggaactttgtgatccagggcggtgacccaaccggaaccgggaccggaggtgagagctactggggcaagccgtttaaggatgagtttcggcccaatctctcccataccggacgaggcattctgtccatggcaaacagcggtcctaattctaatagatcacaatttttcattacgtttaggtcttgcgcttacctggacaaaaaacacaccatatttggccgcgtggtgggtggatttgatgtgctcaccgccatggagaacgtggagagcgaccctaagaccgacagaccgaaggaggaaatccggatcgacgccaccacagtatttgtggatccctacgaagaggctgatgcccagatcgcccaagagaggaagacccagcttaaagtggccccagagacaaaagtcaagagcagtcaaccccaggcaggcagtcaagggccccagacgttccgacaaggggtcggaaagtatattaatccggcagccacaaaaagagccgcggaagaagagccatcaacctcagcgaccgtccctatgtcaaagaagaaacctagtcgcggatttggagacttcagctcatggtag

SEQ ID NO: 198897 - DNA, 1584 bp, Artificial Sequence
  Description of Artificial Sequence: Synthetic coding sequence
atgggcaagcggcagcaccagaaggacaagatgtacatcacctgcgcagaatacacccatttctatggcggcaagaaaccagacctcccacaaacaaatttccgtcgtctgcccttcgatcattgcagcctctccctgcagccctttgtctatcccgtatgcacaccagatggaatcgtcttcgatctgctgaatatcgtaccatggctgaaaaaatacgggacaaacccgagcaacggggagaaattggatggccgtagtctgattaaattaaatttctccaagaacagcgagggcaaataccattgcccagtgctctttaccgtgttcactaacaatacccatattgtagctgtgagaaccaccggcaatgtctatgcttatgaggcggtagaacaactgaatatcaaagccaaaaatttccgagaccttttgaccgacgagccattttctcgccaagatatcattaccctccaggatccaactaacctagacaagttcaatgtttctaacttttaccacgtcaaaaataatatgaaaatcatcgaccctgatgaggagaaagctaagcaagatccaagctactatctgaagaacacaaatgcagagacgagggagacccttcaagaactctacaaagagtttaagggcgacgaaatcttggcagccactatgaaagccccagagaaaaagaaggttgacaaactgaatgccgctcactatagcactggaaaggtgtcagcttctttcacctcaaccgcaatggtacctgagactactcatgaggcagccgccatcgacgaggacgtgcttcgataccagtttgtgaagaaaaagggctatgtaaggctgcataccaataaaggggatttgaatctggagttgcactgcgacctaaccccgaaaacatgtgagaacttcattcgcttgtgtaagaaacactactatgatggaaccattttccataggagcatacgtaactttgtcatccagggaggggatcctacagggactggcaccgggggcgagtcctattggggaaagcccttcaaggacgagtttcgcccaaacctttcacacacagggcgcggcatactatctatggcaaactctggccctaacagcaaccggtcacaattctttatcaccttccgtagttgcgcctatctggataagaagcacaccatttttggtcgggttgtcggcgggtttgacgtgctcaccgccatggaaaatgtcgaatcagaccctaagactgaccggcccaaagaggagatacggattgacgctacaacagtgttcgtggatccctacgaggaggcagatgctcagattgcccaggagcgtaagacccagctgaaagtggcacccgagaccaaggtgaaatcatctcaaccgcaggctggtagccagggcccccaaacattccggcagggggttgggaagtacattaaccctgcggccactgaacagcaaagaaagtctccccagccagtccctctgtccccatgtccgcgacgaagccccgtcggagtccttggtacgagcgcgcctggcagctccaggctgccagacgaccactag

SEQ ID NO: 198898 - DNA, 1470 bp, Artificial Sequence
  Description of Artificial Sequence: Synthetic coding sequence
atgggcaagcggcagcaccagaaggacaagatgtacatcacctgcgctgaatatacccatttctacggcggtaagaagcccgacctgcctcagacaaatttcagacgcttgcccttcgaccactgtaggaatatcgtaccctggctgaagaagtatggaacaaatccttctaatggcgagaagctggacggccggtcattgatcaagctcaatttctccaaaaattcggagggaaagtatcattgccctgtcctctttactgtttttaccaacaatacgcatattgtggccgtacgtacaactggaaatgtctacgcttacgaagccgtggaacagctaaatatcaaggccaagaacttccgcgatctgttgactgatgaaccattctcacgacaagacatcatcacgcttcaggacccgaccaacttggataaatttaatgtctccaacttttaccatgtgaaaaacaatatgaaaattattgacccggacgaggagaaggcaaaacaggatcccagttactacctcaaaaacacaaacgctgagactcgtgagacacttcaggaactgtacaaggaattcaaaggagatgaaatactggcggccaccatgaaagctcctgagaaaaaaaaagtagataagcttaatgctgcacactactccaccggtaaggtgtctgcctcttttacttctacagctatggtgcccgagactacgcatgaagccgccgccattgatgaagatgtgctgcggtatcagtttgtaaaaaagaaagggtatgtgcgtttacacaccaataagggagacctaaacttggagctgcactgcgatcttacacctaaaacctgcgaaaactttattcgtctctgtaaaaaacattactacgacggcacgattttccacaggtccatccgcaacttcgtgattcaggggggggatcctaccggcacaggcacagggggtgaaagctactggggtaaaccctttaaggacgagttccgacccaatctgtcccacacggggcgggggatcctgtctatggctaattccggtccaaatagtaatcgttcgcagttttttattacattccggtcgtgcgcctacctggacaaaaaacataccatcttcgggcgagttgtcggaggcttcgacgtccttaccgctatggaaaatgtggagtcagaccctaaaacggataggcccaaagaagaaatccgaatagacgccaccaccgtgtttgtcgatccttacgaggaagctgatgctcagatcgcacaggaaagaaagactcagcttaaggaagcttctagccgggggcgcgcattgaatcagtgccactgtccccacgtacaggaagaggcccaatcagggttctgggggctgcaactgctagtcgccgctgcaacctgccgcctgtacctttgtccatctttctcccatcagtccctgatgctgaagctgcaggcatag

SEQ ID NO: 198899 - DNA, 1563 bp, Artificial Sequence
  Description of Artificial Sequence: Synthetic coding sequence
atgggcaagcggcagcaccagaaggacaagatgtacatcacctgcgctgaatacacccacttttatggcggaaagaaacccgatctgcctcagacgaattttagacgcctgcccttcgatcactgctccctcagcctgcagccatttgtgtacccggtgtgtactccagacggcatcgtgtttgatctccttaatattgttccatggctgaaaaaatatggcacaaatccaagcaacggcgaaaagttagatggaagaagcttaattaaattgaatttttcgaagaacagcgagggaaaatatcactgccccgtgcttttcacagttttcactaataatacgcatatcgtggcagtgagaactacagggaatgtatatgcctacgaggccgtggagcagcttaatatcaaagccaagaattttagagatctgctaaccgacgagccctttagcagacaggacatcattacattgcaggaccctaccaatctagacaaatttaatgtgtctaatttctatcatgtaaagaacaatatgaagatcattgaccccgacgaagagaaggcgaaacaggatccatcttactacctcaaaaacaccaacgcggagacacgcgagactctgcaggagctgtacaaagaattcaaaggggatgaaatattagcagctacgatgaaagccccggaaaagaagaaagtggataaactgaatgctgcgcactactccaccggaaaggtcagcgcatctttcacctcgacagccatggtgccggaaacgacccatgaggctgccgcaatcgatgaggacgtgctgagataccaattcgtgaagaagaagggatacgtgaggttgcataccaataagggtgacctaaatctggagttacattgcgacctaacaccgaagacttgtgagaacttcatcagactatgtaaaaagcactactacgatggcacgatatttcataggtcgattagaaactttgtaatacaagggggcgacccgaccggtaccggcaccgggggcgagtcctattgggggaagcctttcaaggacgaattccggccgaacctcagtcatacaggtagaggaattctgagtatggcgaactctggcccgaacagtaacaggagccagttcttcatcacctttagatcatgtgcttacttagataaaaagcatacaatttttgggagagtagtggggggtttcgacgttctgacagccatggaaaacgtagaaagcgacccaaagacagatagacctaaagaggaaatacgcatagacgcaaccactgtatttgtggatccatacgaggaggcagatgcccagattgctcaggaacgcaaaacccaactgaaggtggcacccgagactaaggtcaagagttcccagccacaggcgggctcccagggcccacagaccttccgccaaggagtagggaaatacattaaccccgctgcaacaaagcgggccgctgaggaggagccatctacctccgcgacagttccgatgtcaaaaaaaaagccttcccggggcttcggggacttctccagctggtag

SEQ ID NO: 198900 - DNA, 1479 bp, Artificial Sequence
  Description of Artificial Sequence: Synthetic coding sequence
atggccgtgctgctggagaccaccctgggcgacgtggtgatcgacctgtataccgaagaacgcccaagagcctgcctgaattttctgaagctgtgtaagatcaagtactataattattgtctcatacacaacgtgcagcgtgacttcatcatacagaccggagatcctactggtacaggacggggcggcgaaagcattttcggccagctgtacggagatcaggctagttttttcgaagcagagaaggtccccaggataaaacataaaaaaaaagggactgtaagtatggtcaacaatggatcagaccagcatgggagtcagttccttatcaccactggggagaacctggactatctcgacggggtgcataccgtattcggggaggtcaccgaagggatggacattatcaagaagattaacgaaacatttgtagataaggactttgtcccatatcaagacatccgcatcaatcacacagtgatcctggacgacccttttgatgaccctcctgacctactcatccccgacagaagccccgagccaacacgcgaacagctcgatagtgggaggattggagctgatgaggaaattgacgacttcaaaggccgatcggcagaagaagtggaagagataaaagcagagaaagaagctaagacacaggccatcttgctggagatggtgggggatctcccggatgccgatatcaaaccaccagagaacgttctgttcgtatgcaagctgaaccctgtcaccaccgacgaggacctggagattatatttagtcggttcggcccaattcgcagctgcgaggtcattagagattggaaaaccggcgaatcactgtgttatgcttttattgaattcgagaaggaagaagattgtgagaaggcctttttcaaaatggacaacgtacttatcgacgatagacggattcacgtggacttttcgcagtctgttgcaaaggtcaagtggaaggggaagggggggaaatataccaaatccgatttcaaggagtacgaaaaggagcaggataagccccctaacctcgtgctcaaagacaaggtaaagcccaagcaagataccaaatacgatctgatcttagatgaacaggccgaggacagcaaaagtagccattctcatacttctaaaaagcacaaaaaaaaaactcaccactgtagcgaggagaaagaagatgaggactacatgccgatcaaaaacactaaccaggatatttaccgggaaatgggattcggccattacgaggaagaagagtcttgctgggaaaaacagaagagcgagaagcgggacaggacccaaaacaggtcccggagtaggtcacgtgagagggatgggcactactccaactctcacaagagcaagtatcaaacggacttgtacgagcgagagagatcaaagaaacgggatagatccagatctcccaagaaaagcaaagacaaggagaaatccaaatatcgttag

SEQ ID NO: 198901 - DNA, 384 bp, Artificial Sequence
  Description of Artificial Sequence: Synthetic coding sequence
atgagccggcccaagacccagaaccaggtgacccacacccaggtgaagaacacaagacggaaacctataaccgtgctgaaacgcaagaagatgagaactacatgccagtccaaaatcctgattaggatctcaatagagaagtggggcctggttacaatgaaaaagaagaaggccgtagggaggaataaaagggtgaaacgtgagactgagctgcgcacagaggtggtcgctgacctcgagagaggaatggccataattgtcatcgttatcaaccaaaacacgaaacaaatcttcatgaaggagaagggagttaagcgagagaccgaggccgaggtccaacgcagccccaaaatcaagaagaatctttcaatcgatgaacgttag

SEQ ID NO: 198902 - DNA, 318 bp, Artificial Sequence
  Description of Artificial Sequence: Synthetic coding sequence
atgtgccagggcggcgacttcacccggcacaacggcaccggcggcaaaagcatttacggagagaaatttgaggatgagaatttcatcctgaagcacacggggcctggtatactgtccatggccaacgcggggccaaacaccaacggctcacagttcttcatttgtacagccaaaactgagtggctcgacgggaaacacgttgtgtttgggaaggtcaaggaggggatgaatatcgtcgaagctatggaaagattcgggagccgcaatggaaaaacatcgaaaaagatcaccatcgcagattgtgggcagctggagtag

SEQ ID NO: 198903 - DNA, 390 bp, Artificial Sequence
  Description of Artificial Sequence: Synthetic coding sequence
atggtgaaccccaccgtgttcttcgacatcgccgtggacggcgagccattgggtagggtgtctttcgaactgttcgctgacaaagtgcccaagacagctgaaaactttcgggccttgtccaccggcgaaaagggatttggttacaagggctcttgtttccacaggatcattcccggctttatgtgtcaggggggggattttaccagacacaatggcaccggaggtaagtctatctgtactgccaagacagagtggctggacggcaaacacgtggttttcggcaaggtcaaggaaggcatgaatatagtggaggccatggaaaggttcgggtccaggaacggaaaaaccagtaagaaaattaccatagccgactgtgggcaactagagtag

SEQ ID NO: 198904 - DNA, 498 bp, Artificial Sequence
  Description of Artificial Sequence: Synthetic coding sequence
atggtgaaccccaccgtgttcttcgacatcgccgtggacggcgagccactgggacgcgtcagctttgaactgtttgcagacaaggtaccaaagacagccgaaaatttccgtgccttgagcaccggggaaaaggggtttggctacaagggctcctgcttccaccggatcatccctggcttcatgtgtcagggaggggatttcacgcgacacaatgggactggtggaaagtccatctacggcgagaaattcgaggacgaaaattttatactgaaacacacaggaccaggcattctctccatggccaatgccggcccaaataccaatggaagccagttttttatttgtaccgctaagacagagtggctagacggtaaacacgtggtcttcggcaaagtgaaggaaggaatgaatattgtggaagccatggagaggtttggttcgcgaaatggtaaaacctcaaaaaagataacaatagctgattgcggccagctcgagtag

SEQ ID NO: 198905 - DNA, 495 bp, Artificial Sequence
  Description of Artificial Sequence: Synthetic coding sequence
atggtgaacagcgtggtgttcttcgacatcaccgtggacggcaagcccttaggacgtatcagtatcaaattatttgcggataaaatcctgaagacagcggaaaactttcgtgcgttatcaaccggcgaaaagggtttcaggtacaagggaagttgctttcaccgaattattccaggcttcatgtgtcaggggggagattttaccagacataatgggaccggagataaaagtatatatggtgaaaagttcgatgatgaaaacctgatcagaaagcacacgggctccggtatattgtctatggctaatgctggcccaaacacaaatggatcccaattcttcatatgtgcggcaaagacagagtggcttgacgggaaacatgttgcatttgggaaggtcaaggagagagttaacatcgtggaggccatggagcactttgggtacagaaacagcaagacctccaaaaaaataaccatagcagattgcgggcaattctag

SEQ ID NO: 198906 - DNA, 651 bp, Artificial Sequence
  Description of Artificial Sequence: Synthetic coding sequence
atgctgcggctgagcgagcggaacatgaaggtgctgctggccgccgctctgatcgctgggtcagtgttcttcctcctgctacccggaccctccgcggccgatgaaaagaagaaaggtcccaaggtcaccgttaaggtgtacttcgacctaaggataggcgatgaagatgtcggaagggtgatctttggtttatttggaaaaactgtcccgaaaacggtagacaactttgtggccctggcaactggcgaaaagggattcggctacaagaatagcaagtttcatcgggtgatcaaagacttcatgatccagggaggtgatttcactagaggggatgggacaggcggtaaatctatctacggggagcggtttccagatgaaaacttcaagctgaaacattacggtccgggatgggtcagcatggccaacgcaggtaaagacactaatggttctcagttcttcatcacgacggtgaagactgcatggctggatgggaaacacgttgtgtttggcaaggtactggaggggatggaggtggtgaggaaagtcgaatcaaccaagacagactcacgggacaaaccgctcaaagacgtgataattgccgattgtggtaagattgaagtggaaaaacctttcgctatagccaaggaatag

SEQ ID NO: 198907 - DNA, 639 bp, Artificial Sequence
  Description of Artificial Sequence: Synthetic coding sequence
atgggccccggcccccggctgctgctgcccctggtgctgtgcgtgggccttggagcacttgtgttctctagtggtgctgaagggttcaggaagaggggtccttccgtcacagcaaaggtgtttttcgacgtcaggatcggagataaagacgtcgggcggatcgtgatcggcctgtttggtaaggtcgtgcctaagaccgtcgagaattttgtggctctcgcgaccggcgaaaaaggatacggttacaaaggcagcaaattccatagagtaatcaaagatttcatgatccaggggggtgacatcacaaccggggatggaaccggcggcgtctccatttatggcgagacttttccggacgaaaacttcaagttaaaacattatggaattgggtgggtgtcaatggcgaatgcgggccccgacacaaatggaagccagttttttattactttgaccaagcccacgtggttggacggcaagcatgtggtgttcggcaaagtgatcgatggaatgacagtggtgcactccatcgagctccaggctaccgatggtcacgaccggcctctgacgaactgctcaatcatcaacagcggcaaaattgacgttaagaccccctttgtggtggagattgccgactggtag

SEQ ID NO: 198908 - DNA, 1113 bp, Artificial Sequence
  Description of Artificial Sequence: Synthetic coding sequence
atgagccaccccagcccccaggccaagcccagcaaccccagcaacccaagggtgttttttgatgtagatataggcggggaaagggtaggccggattgtgcttgagctcttcgcagatatcgtccctaagactgcagagaattttcgcgcactctgcacaggggagaaggggattggccatacaaccggcaagcccctgcatttcaaaggttgtccttttcatcgcattatcaagaaattcatgatccagggcggcgacttctcaaaccagaatgggaccgggggggaaagcatatatggggagaaatttgaggatgagaactttcactataaacacgatagagaaggactgttgtccatggcgaacgccggacgcaataccaacggatctcaattcttcattacaaccgtgccaacaccacacttggacgggaagcatgttgtctttggacaagtgatcaaaggcattggcgtcgctcgtattctggaaaatgtcgaggtgaagggcgagaaacccgcgaagctgtgcgtaatcgccgagtgtggggagttgaaagagggtgacgacggggggatcttccctaaggacggttccggtgactcacaccccgactttcctgaggacgcggacatcgacctgaaggacgtggacaaaattctattgataacagaggatctgaaaaatattggcaacacctttttcaaatctcagaattgggagatggccatcaaaaagtacgcagaggtcctgcgctatgtggattcctcaaaagcggtgatcgagacggcagacagagcaaagctgcagcctatcgcattgagctgtgtactgaatataggggcctgtaagttaaagatgtctaattggcagggagcaatagacagctgtctggaggcccttgaattggacccaagcaacactaaagcgctctacaggagggctcagggctggcaaggacttaaggagtatgatcaggctctggccgaccttaagaaagcacaaggcattgcaccagaagacaaggccattcaggcagagctgctgaaggtgaagcagaaaatcaaagcacagaaggacaaagaaaaggccgtgtacgctaagatgtttgcctag

SEQ ID NO: 198909 - DNA, 597 bp, Artificial Sequence
  Description of Artificial Sequence: Synthetic coding sequence
atggacgccatcctgaactaccggagcgaggacaccgaggactactacactctgttaggatgtgacgagctctcgtccgttgagcagattttggccgagtttaaggtaagggcgcttgagtgccacccagacaagcacccagaaaacccaaaagccgtggagacctttcagaagctccagaaggccaaggagatactgacaaacgaggagagtcgcgcacgttacgaccattggcgtaggagccagatgagtatgccattccaacaatgggaggctctaaatgattccgtaaagacttctatgcattgggtggttagagggaaaaaagatcttatgcttgaggaatcggataagacccacacaaccaaaatggagaacgaggaatgcaacgaacagcgtgaacgaaagaaggaagagctggcctccacagccgagaaaaccgagcagaaagaaccaaagcccctggaaaaatctgtgtctccacagaattctgattcgtccggctttgcggatgtgaacggctggcacctgcgctttaggtggtcaaaagatgcaccaagtgagctgttaagaaagtttagaaactatgagatctag

SEQ ID NO: 198910 - DNA, 468 bp, Artificial Sequence
  Description of Artificial Sequence: Synthetic coding sequence
atgctggccctgcggtgcggcagccggtggctgggcctgctgagcgtgccccggagtgtacctctgaggctgccggctgccagagcatgctccaaggggagcggcgacccaagctcgagcagctcgtctgggaaccctctggtctatctcgacgtcgatgccaacggtaagcccctgggacgggtggttttagaactgaaggccgatgttgttcccaagacggctgaaaactttcgggccttatgcactggagaaaagggatttggctacaaagggtcaacgtttcacagggtcatcccctccttcatgtgtcaggccggggatttcactaatcacaatggtacgggcggtaagtcaatttatggaagtcgtttcccggacgagaactttactttgaagcatgtcgggcccggatggatggctagcatgctgtgtagtgtgacaagcaagagagcgtggacctcctag

SEQ ID NO: 198911 - DNA, 498 bp, Artificial Sequence
  Description of Artificial Sequence: Synthetic coding sequence
tgaagcagcagcagcagcagcggcaaccccctggtgtacctggacgtcgatgcgaacggaaaaccactgggccgggttgtgctcgaactcaaagccgatgtggtcccgaaaacggctgaaaactttcgggccctgtgcacaggtgaaaaagggtttgggtacaaggggtcaacattccacagagtgatccccagctttatgtgccaagccggtgactttacgaatcacaacggcacaggcggcaagagtatctatgggagccggtttccagacgaaaactttacgcttaagcatgtcggacctggcgttctctcgatggcgaatgccggccccaacactaatggttcgcagttcttcatctgtactatcaaaactgactggtccatggccctcgacgatatcgctttgcactgttgttctcctgggtcaccagttcttaccggatggatggctagcatgctgtgctcagtcacttccaaaagagcctggacaagttag

SEQ ID NO: 198912 - DNA, 2265 bp, Artificial Sequence
  Description of Artificial Sequence: Synthetic coding sequence
atgggcatcaaggtgcagcggccccggtgcttcttcgacatcgccatcaacaaccagccagctgggcgcgtggtttttgagctgttcagcgatgtgtgccctaaaacctgtgagaactttcgatgcctgtgtaccggagagaaagggactgggaagagcactcagaaacctcttcactacaagagttgccttttccacagggtcgtaaaggacttcatggtgcagggcggagacttctctgaagggaacggcaggggcggtgaatccatctacggtgggttttttgaagacgagtccttcgctgtgaaacataacaaggaattcttgctgagtatggctaatagaggcaaggatactaacggatcacagttttttatcacaactaagcctactcctcacctagacggccatcatgtggtctttggacaggtcatttccggccaagaggttgtccgcgagatcgaaaaccaaaagactgatgccgcctcgaaaccttttgcagaagttcggatactgagttgtggcgaactgatccctaaaagcaaagtcaaaaaagaggagaagaaacgacacaagagctcctcgagttccagcagctctagttctgacagcgacagtagttcagacagccagtcttcaagtgattctagcgatagcgagagcgccacagaggaaaagtctaagaaacgcaaaaaaaagcataggaagaattctagaaaacacaagaaggagaagaagaaaaggaagaagtcaaagaaaagcgcatctagcgagagtgaagccgaaaacctcgaggctcagcctcagtcaacagtcagaccagaagagatccctccaatccccgagaatcggttcttgatgcgtaaatctccccctaaggcggacgagaaggaaaggaaaaaccgagaaagagagcgagaacgcgaatgtaatccccccaattcgcagcctgcttcctatcagagaaggctgctagtgaccagatctggtagaaaaatcaaagggagaggaccaagaaggtatcgtacccctagtcggagccgaagtcgcgaccgattcagaaggtcagaaacccctccgcactggcggcaagaaatgcagcgcgcccagcggatgcgcgttagcagcggagaacgctggatcaagggcgacaagtcagaactcaacgaaatcaaggaaaatcaacgatctcctgtgcgcgtgaaagagcgcaagatcaccgaccacaggaacgtgtctgaaagcccaaacaggaagaacgagaaagagaaaaaagtgaaagatcacaaatccaatagtaaggagcgcgatatcaggcgaaatagtgaaaaggacgacaagtataaaaataaagtgaagaagagggcgaaatctaaaagtcgcagtaagagcaaagaaaagtctaagagcaaggaacgggactccaagcacaataggaatgaggagaagcgtatgaggagccggagtaaaggaagggatcatgagaatgtaaaagaaaaggaaaagcagtctgactcaaaaggcaaggaccaggaaaggagccggtctaaggagaaaagcaaacagcttgaaagcaaaagcaatgaacacgaccatagcaagtccaaagagaaggatcgccgggcgcagagccggagtagggagtgcgatattacaaaaggcaaacatagttacaacagtcgaaccagagaaagaagtaggtccagagaccgctcaaggagggtaagaagccgcacacacgacagggacaggagccggtctaaggagtaccaccgctatcgggaacaggagtacaggaggcgagggaggagccggtctcgagagaggaggaccccaccggggcgttcccgaagcaaggaccgtaggagacggagaagagatagcagatcatctgagcgagaggagagccagtctcgtaataaagataagtatcgcaatcaggagagtaagagcagccacaggaaagagaattctgagtccgaaaagcggatgtacagcaaatcgagagatcacaactcatcaaataatagtcgcgagaaaaaggccgatagagaccagagccccttctccaaaatcaagcagagtagccaagataatgagctcaaaagcagcatgctgaagaacaaggaggacgaaaagatacgctcaagcgtggaaaaggagaaccagaaatccaaagggcaggagaatgaccatgtgcatgagaagaacaagaaatttgatcacgagtcctccccggggaccgacgaagataaaagtggctag

SEQ ID NO: 198913 - DNA, 741 bp, Artificial Sequence
  Description of Artificial Sequence: Synthetic coding sequence
atgggcatcaaggtgcagcggccccggtgcttcttcgacatcgccataaataaccaacctgccggccgggtagtcttcgaactgttttctgatgtctgccccaagacctgcgaaaatttcaggtgtctgtgtactggcgaaaaagggacaggaaagagcacccagaagcccctgcactataagagctgcttgttccacagagtcgtgaaagatttcatggtgcaggggggagattttagcgaaggaaacggcaggggtggcgaatctatctacggaggctttttcgaagacgaaagcttcgctgtcaaacataataaggaattcctcttgagcatggcaaaccgcggtaaagacaccaacggaagccaattttttatcactactaagcccactccccatctcgacggtcaccacgtagtgtttggccaggtgatatcaggtcaggaggtcgtcagagagattgaaaaccagaaaaccgacgccgcgtcaaagccttttgcggaggtgaggatccttagctgcggcgagctcatcccaaagtcaaaggtcaagaaagaagaaaagaagcgccacaaatcaagctcttcatccagctcttctagtagcgatagcgactcctctagcgacagtcaaagtagctcagattctagcgattcggaaagtgccacagaagaaaagagtaagaaaaggaagaaaaagcacaggaaaaattcgaggaaacacaaaaaggagaagaagtag

SEQ ID NO: 198914 - DNA, 180 bp, Artificial Sequence
  Description of Artificial Sequence: Synthetic coding sequence
atgggcatcaaggtgcagcggccccggtgcttcttcgacatcgccattaataatcagcccgccggtcgcgtggtgttcgagctcttcagcgatgtctgcccaaaaacatgcgagaactttagatgtctatgcaccggggagaagggcaccgggaaatcgacccaaaagcccctccactag

SEQ ID NO: 198915 - DNA, 2265 bp, Artificial Sequence
  Description of Artificial Sequence: Synthetic coding sequence
atgggcatcaaggtgcagcggccccggtgcttcttcgacatcgccatcaacaatcaacccgctggccgcgtggtgttcgaattatttagcgacgtttgccctaagacctgcgagaacttcaggtgcctgtgtacgggcgaaaaggggacagggaagtctacccaaaaaccactccactataagtcgtgtcttttccacagagtggttaaggacttcatggtacagggtggagacttttctgagggcaacggccgcggaggtgagtccatatacggcggtttctttgaggacgaatcatttgccgtgaagcataacaaggagttcctcttgtctatggctaatagaggaaaagataccaacgggtcccagtttttcatcaccacaaagccaacccctcacttggatggacaccacgtggtctttggtcaggtcatctcgggacaggaagtggtgagggagatcgaaaatcagaagaccgacgccgccagtaaaccgtttgcagaggtgcgcatcttgtcttgcggagaactgatcccaaaaagcaaagtcaagaaggaggaaaagaaacgccacaagtcaagctcctcttcctccagcagcagttccgactcagatagctctagcgatagccagtcaagtagtgacagcagcgactcggaaagtgccaccgaagaaaagagcaagaagagaaagaagaagcaccggaaaaactccagaaaacataagaaggagaagaagaaaaggaaaaaaagcaaaaaatctgcgagtagtgagtccgaagcggagaatctggaagcacagcctcagagcaccgtgcgtcccgaagaaataccaccgatacccgagaacaggttccttatgcggaagtccccacctaaggcagacgagaaagagcggaaaaacagagagcgggaacgggagagagagtgcaacccccctaactctcagcctgcatcgtaccaaaggaggttgctcgtcactcgaagtggcaggaagatcaaagggcggggcccgcggcgctatagaactcctagtcgctcccgctcccgggatcgattcagacgttcggaaactcccccgcattggcggcaggagatgcagagagcccaacgtatgcgggtgagctccggcgagaggtggattaagggggacaagtccgaactgaacgagatcaaagaaaaccagcggagtccagtacgcgtgaaagagcggaagatcactgatcatcggaatgtctctgagagccccaaccgcaagaacgaaaaagagaagaaagttaaggaccacaagtctaactccaaggagcgtgatataagaaggaatagtgaaaaggatgacaaatataagaataaggtgaagaaaagagcaaaaagtaaatctagaagtaaatccaaggaaaaatcaaagtccaaagaacgtgacagtaaacataataggaatgaagaaaaaagaatgcgcagcagatcaaagggaagggaccacgaaaatgtaaaggagaaggaaaagcagagcgattctaagggcaaagaccaggaaagatccagatctaaagaaaaatcaaaacagctcgagtcaaaaagcaacgaacatgaccactctaagagcaaagagaaagaccggagagcacaaagcaggtcgagagagtgcgatattaccaagggaaagcactcatataatagccggacccgggagcgatctagatcccgggaccggtcacgcagagtgcgctcccgtacgcacgaccgcgatagaagcaggagtaaggagtatcatagatacagagaacaagagtaccgcaggcgaggccggtcacggtccagagagcgtaggacccctccaggtaggagtagatcaaaagacaggagacgccggcgaagagatagtcgctcttccgaaagggaagagtcccagagtagaaataaagataagtacagaaatcaagagtctaagagctcacaccgcaaagaaaactccgagagcgagaagcgcatgtatagtaaaagcagagatcacaatagcagtaacaatagccgtgagaagaaagctgacagagaccaatctccatttagtaagataaagcagagctcacaagacaacgaactgaagagcagtatgttaaaaaataaggaggacgagaagattagaagttctgtagaaaaggagaaccagaagagcaagggccaggaaaacgaccatgtgcacgaaaagaacaaaaaattcgaccacgagagcagtccgggtacagacgaggataaatccggctag

SEQ ID NO: 198916 - DNA, 1347 bp, Artificial Sequence
  Description of Artificial Sequence: Synthetic coding sequence
atgggcatcaaggtgcagcggccccggtgcttcttcgacatcgccatcaacaatcagccagcggggagagttgtattcgaactctttagcgacgtctgtcccaaaacttgcgagaactttcgctgcctatgcactggagaaaagggaaccgggaagtcaactcagaaaccactccattacaagtcgtgcctatttcaccgggtggtgaaggacttcatggtccagggaggagactttagcgagggaaacggtagaggtggtgagtcgatatatgggggcttcttcgaggacgagagctttgctgtgaaacataacaaggaattccttctaagtatggccaatagaggaaaggataccaacgggtctcagttctttattacaacaaaaccgacaccccatctagacggacatcatgtagtatttgggcaggtaatctcgggacaagaggttgttcgggaaatcgagaaccagaagaccgacgctgcttcaaagcccttcgcagaggtcaggatactgtcctgcggcgagctcatccctaaatctaaggtaaagaaggaggagaagaagaggcacaaatcatcctccagttctagctcctcttcctccgattcggactccagttcggattctcagtctagctctgattcttctgatagcgaatccgctacagaagaaaagtctaaaaagcggaagaagaagcacagaaagaatagccgcaaacataaaaaggagaaaaaaaagaggaaaaagagtaaaaaatccgcctcctccgagtccgaggctgaaaaccttgaggctcagccccagagtacggtgcggcctgaagagatcccaccaataccggagaacaggttcctgatgagaaagagccctcccaaggctgacgagaaggagaggaaaaatcgtgagcgcgagcgtgagcgcgaatgcaacccccctaacagccagcccgcaagttaccaaagacgactcctggtgacgcgcagcggtcggaaaatcaaggggcgcggccctcgccgataccgcaccccttcgcgcagtaggtctagggatcgattccgcaggagtgagacaccaccacattggcggcaggagatgcaacgggcccagcgtatgagggttagctcaggcgaacggtggattaaaggagacaaatctgaactgaatgagattaaggagaaccaaaggtctcccgtgcgagtgaaagagcgcaagataactgaccaccggaatgtgagcgaatctccgaaccgtaagaatgagaaggagaaaaaggtgaaagatcacaaaagcaattctaaagaaagagacattcggcggaagaagaaaaaaaaaaagaagaagtag

SEQ ID NO: 198917 - DNA, 534 bp, Artificial Sequence
  Description of Artificial Sequence: Synthetic coding sequence
atggccgtggccaacagcagccccgtgaaccccgtggtgttcttcgatgtcagcatcggcggacaggaagtcggccgcatgaagatcgaactgtttgccgatgtggttcccaaaacggctgagaatttcagacaattctgcactggcgagtttcgtaaggacggtgtccctatcggatacaaaggctctactttccatcgtgtgatcaaggattttatgatccaaggcggtgatttcgtaaacggcgatggaacgggagttgcgtcaatttataggggccccttcgccgatgagaattttaaactgaggcactcagctccagggctcctgagcatggcgaactcaggcccatcaaccaacggatgccaattctttatcacgtgttctaagtgcgattggctcgacggaaaacacgttgtttttggtaaaatcattgatggtctgctggtcatgcgaaaaattgagaacgtcccgacgggacccaacaacaagccaaagctgccagtggtgatcagccagtgcggcgagatgtag

SEQ ID NO: 198918 - DNA, 174 bp, Artificial Sequence
  Description of Artificial Sequence: Synthetic coding sequence
atgaagatcgagctgttcgccgacgtggtgcccaagaccgccgagaacttccgccaattctgcaccggggagtttcgctcagtctccgatgttttcgatttctttgcatgtagccgcggcgtgttttggggttgtagcgagggaatcggagaacccccggcaggactcgagtag

SEQ ID NO: 198919 - DNA, 405 bp, Artificial Sequence
  Description of Artificial Sequence: Synthetic coding sequence
atgatcgccggcgacagcgaccggcggaaggacggcgtgcccatcggctacaaagggagcacctttcacagggtaatcaaagactttatgatccagggtggggatttcgtgaatggtgatggcacaggggtggcgagcatctatcgcggacctttcgccgatgaaaactttaaattaagacacagcgcgcctggtcttttgagcatggccaactccgggccttccaccaatgggtgtcagtttttcatcacttgttccaagtgtgattggctcgatgggaaacacgtcgtgttcggaaaaattatcgacgggttacttgttatgagaaagatcgagaacgtacctaccggccccaataataagcccaaactgccggtagtgatttcccagtgcggcgaaatgtag

SEQ ID NO: 198920 - DNA, 207 bp, Artificial Sequence
  Description of Artificial Sequence: Synthetic coding sequence
atggtgaactggaagggcctggtgctgcccgccgtgacccccagcttgtttctgtttggctaccggaaagatggggtacccatcggttacaaaggaagtacattccaccgtgtaattaaagatttcatgattcagggtggtgactttgttaacgtttcaacaataccgttcctgtctaagacaagaagcttcagtttttgttgctag

SEQ ID NO: 198921 - DNA, 435 bp, Artificial Sequence
  Description of Artificial Sequence: Synthetic coding sequence
atgaagatcgagctgttcgccgacgtggtgcccaagaccgccgagaatttccggcagttctgtaccggggaatttcgcaaggacggagtccctattgggtataaaggcagcaccttccatcgggtcatcaaagactttatgattcaggggggtgacttcgtgaatggagacggtaccggcgttgcgtctatataccgcggtccatttgccgacgagaatttcaaattgcgacactctgcacccgggctactgagcatggccaacagcggccccagtactaacggctgccagtttttcattacgtgcagcaagtgtgactggctcgacggcaagcacgttgtgtttggtaaaatcatagacggactgctggtgatgagaaaaatagagaatgtcccaaccggccccaacaataagcctaagctccctgtggtctag

SEQ ID NO: 198922 - DNA, 405 bp, Artificial Sequence
  Description of Artificial Sequence: Synthetic coding sequence
atgatcgccggcgacagcgaccggcggaaggacggcgtgcccatcgggtataagggatcgacgttccaccgggtaatcaaagactttatgatccagggtggagattttgtgaacggtgatggcacaggcgtcgcttcaatctacaggggccctttcgccgacgaaaattttaaactccgccacagtgctcccggccttctgagcatggctaactccggtcctagtactaacggttgtcagtttttcatcacctgttctaagtgtgattggctggacgggaagcacgtggtgttcggcaaaattattgatgggctcctggtgatgaggaaaatcgagaacgtgccgaccggccctaacaataaacctaagttacctgtggtgatttcccaatgtggtgagatgtag

SEQ ID NO: 198923 - DNA, 540 bp, Artificial Sequence
  Description of Artificial Sequence: Synthetic coding sequence
atgcccagcaagagcctggtgatggagtacctggcccaccccagcaccttgggcttggcggtaggcgttgcttgtgggatgtgtttggggtggagcctccgggtttgtttcggaatgctgcctaaaagcaagacctctaaaacccacaccgataccgagagcgaggctagcattctgggagatagcggggagtataaaatgatacttgttgtgagaaatgatctgaagatgggcaagggaaaagtggctgcccagtgttcccacgcagcagtgtccgcttacaagcagatccaaaggaggaaccccgagatgctgaaacagtgggagtattgtgggcagccgaaagtggtagttaaggcacctgacgaggagacactgatcgctctgttggcccatgcaaaaatgctcgggctcaccgtcagcctgattcaggatgccggaaggacacagatcgctcccggttcacaaacagttcttggcattggccctggtccggcagaccttatcgacaaggtcaccgggcacctcaagctttactag

SEQ ID NO: 198924 - DNA, 543 bp, Artificial Sequence
  Description of Artificial Sequence: Synthetic coding sequence
atgatgcccagcaagagcctggtgatggagtacctggcccacccctctactctggggcttgccgtaggcgtcgcctgcggaatgtgcctaggttggagcctccgggtttgctttggtatgctcccaaagtctaaaacatctaagacacatacagatacagagtctgaagcctccattctgggggactccggggagtataaaatgatcctggtggtgaggaacgacctgaagatggggaaaggcaaagtcgcagcccagtgttctcacgctgcggtgtcagcttacaagcagatccagcgaaggaatccagagatgctgaagcaatgggagtactgcggacagccgaaagtagttgtgaaagctcctgacgaggagactctcatcgcattgctggcgcatgccaagatgttaggtctaacagtctctctgatccaggacgcgggccggactcagattgctccgggcagccagacagtgctgggaatcggcccagggccagcagacctcattgacaaggtgaccgggcatttaaaactatactag

SEQ ID NO: 198925 - DNA, 540 bp, Artificial Sequence
  Description of Artificial Sequence: Synthetic coding sequence
atgcccagcaagagcctggtgatggagtacctggcccaccccagcactctcggcctcgccgtgggcgtcgcatgtggcatgtgtctcgggtggagcctgagggtctgcttcggaatgctgccaaaatctaagacatcgaagacacacaccgacacagaatcagaggcatcaatcctgggcgacagtggcgaatacaaaatgatactggtggtacggaatgacttaaagatgggcaagggcaaagtggctgcccaatgctcgcacgctgcagtctccgcatataaacaaatccaaagacggaacccagaaatgctgaaacagtgggaatactgcggacaacctaaggtcgtggtcaaggcgcccgatgaggagactctgattgccctgttggcacacgccaaaatgttaggactgacggtatccctaatccaggatgcgggaaggactcagatagcccctggcagccagacagtgctgggcatcggaccggggcccgccgatctaatagacaaggttacaggccatcttaaactatactag

SEQ ID NO: 198926 - DNA, 1668 bp, Artificial Sequence
  Description of Artificial Sequence: Synthetic coding sequence
atggccgcccggctgctgctgctgggcatcctgctgctgctgctgccgttacccgtgcctgctccatgccatacagccgcgaggtcggagtgtaagaggtcccacaaatttgtgcccggcgcatggctggccggggagggcgtggatgtgaccagcctccgccgttccggatcattccccgtggacacgcagcgcttcttacgacctgatggcacttgtactttgtgcgaaaatgcgcttcaggaagggacactacaaaggctgccgctggcattgaccaattggcgcgctcagggttccgggtgtcaacgccacgtgacgcgtgccaaggtcagctccacagaggctgttgcccgagatgcggcccggtctatccgcaatgattggaaggtcggcttagatgttacgcccaaacccacgagtaacgtgcacgtaagcgttgcggggtcccactcacaggccgccaactttgcggcacaaaagacacaccaggaccagtatagctttagcacagatacagtggagtgtagattttacagcttccacgttgtgcacacacctcctctgcaccccgatttcaaacgggccctcggcgatctccctcatcacttcaacgccagcactcagccagcatacctcagattgatttccaattacggaacccacttcatccgggcagtggagctgggcggccggatttccgccctcacagccctgcgtacctgcgagctggcattagaaggactgacagataatgaagtggaagattgccttactgtggaagcccaagtcaacataggtatccatgggagcatttcggctgaagcaaaggcttgcgaagagaagaaaaaaaagcacaagatgactgcaagtttccatcagacgtacagggaaaggcatagtgaggtggtaggtggacatcatacgtctatcaacgaccttctgtttggcattcaagcaggacctgaacagtacagcgcatgggtcaactctctgccaggcagcccaggcctggttgattataccctggagccgttgcatgtcctgctggactcccaagacccgcgcagggaggcactccggcgcgctctgtcacaatacttaacggaccgggcgcgctggcgggattgctcccgaccctgccccccaggtcgtcagaagagcccacgcgacccctgtcagtgtgtttgtcacggaagcgccgtcactacacaagactgctgccccaggcagaggggcctcgcccaattagaagtgacgttcatccaggcgtggggcctgtggggggattggtttacagcaactgacgcctatgtgaaattattctttgggggccaggagctaagaacaagcacagtgtgggataacaataatccaatttggagtgtgaggctcgatttcggggatgtgctgctagctaccggcggcccgttgaggctgcaagtgtgggaccaagactccgggagggatgatgacctgctgggaacctgcgaccaagcacctaagtcagggagccacgaagtccggtgtaatctcaatcatggccacctcaagttccggtatcacgcacgttgcttaccccacttgggcgggggaacctgcctcgattacgtgccacaaatgttactgggggagcccccgggcaatcggtccggggctgtgtggtag

SEQ ID NO: 198927 - DNA, 1668 bp, Artificial Sequence
  Description of Artificial Sequence: Synthetic coding sequence
atggccgcccggctgctgctgctgggcatcctgctgctgctgctgccactccccgtccccgcaccatgccatactgccgccaggtctgagtgcaagcgctcacacaagttcgtccctggcgcatggctagcaggcgagggtgtggatgtcacttcactacggcgatctggctcattcccagtggatacacagcgctttttaagacccgacgggacatgcaccctgtgcgagaacgctctccaagagggcacactacaacgcctgcctctcgctttaaccaattggcgagcccaaggttctggatgccagcggcatgtgacaagggcgaaggtgtcatccacagaagccgtggcgagggacgccgcccgaagcatccgtaatgattggaaagtggggctcgatgttacaccaaagcccacgagtaacgttcacgtgagtgtcgctggttctcatagccaggccgccaattttgccgcccaaaagactcaccaggaccagtacagtttctcaactgataccgtggagtgtcgattctattccttccacgtcgttcacacacctcctctgcacccagactttaagagagctcttggcgatctcccccaccatttcaacgcctcgactcaaccagcttacctacgtctgatatcaaattatggcacgcacttcataagggccgtcgagctcggaggacgcatttccgctctcactgctctgaggacatgtgaactcgccctggagggcctgacggataacgaggtggaagattgtctgacagttgaggcacaggtcaatataggcattcacggcagtatctcagcagaagccaaggcctgcgaagaaaaaaagaaaaaacataaaatgacagctagtttccatcagacctatcgtgagcgtcactcagaagtggtcgggggacaccacacgtcaattaatgacctattgtttgggatacaggccggaccggagcagtattcagcttgggtgaatagcctgccagggtccccgggattggtagattacacactcgagcctctgcatgtattacttgacagccaggatccacgcagagaagcactccgccgtgctttaagccagtatcttacggatagagcccgctggcgggactgcagtcgaccttgcccgcctgggcgccagaaatctcctcgggacccttgtcagtgcgtgtgccacggatccgcagtgacaacacaggattgttgcccaagacagagaggccttgcccagttagaagttacattcatccaggcctggggactctggggcgactggtttacagccacagatgcttatgtaaaactgtttttcggagggcaggaacttcggacaagtacggtgtgggacaacaacaacccaatatggtccgtgcgcttggacttcggcgacgtgctgctggctactggaggtccattaagattgcaagtgtgggaccaagatagtggacgggatgatgacttattgggcacctgcgatcaggcgccgaaatccggcagccatgaagttcgctgcaatctgaatcatggacatttaaaatttagatatcacgcgagatgccttccacatctcgggggtggcacatgccttgattatgtaccccagatgcttctgggggaacccccaggtaatcgctccggtgcagtgtggtag

SEQ ID NO: 198928 - DNA, 1668 bp, Artificial Sequence
  Description of Artificial Sequence: Synthetic coding sequence
atggccgcccggctgctgctgctgggcatcctgctgctgctgctgccgctccccgtcccggcaccgtgccacacggcagcccgctctgaatgtaaacgctctcacaagtttgtccctggcgcatggttggcaggagagggtgtggacgtcacttcactccgtagatcgggctcatttccggtggacacacagcgatttcttcggccagatggcacctgcactctgtgcgagaacgcactacaagagggaaccctccagcggctcccactggcactaactaattggcgcgcacagggcagcggctgtcagcgacacgtcacaagagcaaaggtcagctctactgaggcagtggcgcgggacgcggccaggtccattagaaatgattggaaggtgggactagacgtcacacctaaaccaacctctaatgtgcacgtatcagtggctggaagccacagccaggctgccaattttgctgcccagaagactcatcaggaccagtacagcttttccaccgacacagtggagtgccgattctacagtttccacgttgttcatacccccccgctgcacccagatttcaaaagggcactgggtgacctccctcaccactttaacgcctctacacagccagcctacctgcggctgatcagtaactacgggacacatttcatcagggccgtggagctgggtggacggatctccgcccttaccgccttgcggacatgcgagcttgctctggagggattgactgacaacgaagtggaagattgcctcaccgtggaagcccaggtcaatatcggcatccatggcagcatcagtgcagaagccaaggcctgcgaggagaagaaaaaaaagcacaagatgacagcctcctttcatcagacctaccgcgagcggcattctgaagtcgtaggcggccatcacacgtccatcaatgacctcttattcggaatccaggccggtcccgagcagtattcagcatgggtcaacagtcttccaggcagcccgggtcttgtggactacactctggaacctcttcacgtcctgctggatagtcaggatcccaggcgggaggccctccgaagagcactgtcacagtatctgaccgatcgcgcccgctggcgggattgtagccgcccgtgcccccctggacggcagaagtccccaagggacccgtgccaatgcgtctgtcatgggagcgcggtgacaacccaagattgctgtcccaggcaaaggggactggcgcaacttgaagtgacatttatacaggcatggggtctttggggcgactggtttacagctaccgacgcctacgttaaactgttttttgggggccaggagctgagaacttccaccgtctgggataataacaatccgatatggtccgtgaggctcgatttcggcgacgttcttctcgcaacaggggggcccttacggctccaggtatgggatcaggattccggccgcgacgatgatcttctcggtacgtgcgaccaggcaccaaaatccggatctcacgaggttagatgcaatttgaaccacggccacctgaaattccgatatcatgctagatgccttccccacctgggtgggggcacgtgcctcgactatgtaccccagatgttactgggggaaccccctggaaacaggtcaggagcggtttggtag

SEQ ID NO: 198929 - DNA, 444 bp, Artificial Sequence
  Description of Artificial Sequence: Synthetic coding sequence
atggaggcccggagccggagcgccgaggagctgcggcgggccgagttagtcgaaatcatagtggaaactgaagcccagacgggtgtgtccggaatcaatgttgccggcggcggcaaagaaggtattttcgtgcgcgaactgcgggaggattctccagccgctcgctctctaagcttgcaggaaggggaccagctcctttcagccagagtattttttgaaaatttcaagtacgaagacgcccttcgcctccttcagtgtgctgagccatacaaagtgagcttctgtctgaagcggactgtgcctactggggacctggcccttcgtccagggacagtctccggctacgagattaaagggccacgcgccaaggttgccaagctggtgcgagtcctgtcgccggctcctgcattggattgtccgagcgatcccgtctccgccccttag

SEQ ID NO: 198930 - DNA, 4386 bp, Artificial Sequence
  Description of Artificial Sequence: Synthetic coding sequence
atggaggcccggagccggagcgccgaggagctgcggcgggccgagctggtcgagataatagtggagacggaggcccaaacgggcgtgagcggtataaatgtagcgggcggcggaaaagagggaattttcgtgagagagctccgagaagatagccccgccgcgagaagcttgtcgctacaggaaggcgaccagttgctcagcgcgagggtgttttttgaaaattttaaatacgaagatgctctgcgcctgctgcagtgtgccgagccttacaaagtgtccttctgtctgaaacggaccgtcccgactggcgacttggctctcaggccgggcacagtgtccgggtatgagataaaaggccccagggctaaggtggctaagctcaacatccaatctctctctcctgtcaaaaaaaagaaaatggtgcccggggcccttggtgtgcctgctgacctggcaccagtggacgtagagttctcttttcccaagttttcacgtctaagacgggggttgaaggctgaggccgttaaaggtccagtgcctgctgcacctgccagaagaaggctgcagctgcccagacttagagtccgggaggtcgctgaagaggcccaggctgcccgtctggccgctgccgctccaccaccccggaaagccaaggttgaggccgaagtagcagcgggagctcgatttacggcccctcaggttgaactggttggtcccagacttccaggggcagaggtaggcgtgccgcaggtgtcggcccctaaggcagccccctcggccgaagccgctggagggtttgccctgcacttgccaaccttgggacttggcgctcctgctcctccagcggtggaagcccctgcagtcgggattcaagtgccccaggtggaactgccggctctgccatcgttgcctactctgcccacactgccctgtctggaaactagggagggggctgttagcgttgttgtgcccaccctcgacgtggctgcaccaaccgtgggagtggatctcgccttgcctggcgcagaggtagaagcccgaggtgaagccccagaggtggctctgaagatgccaaggctctcatttcctcgattcggagctcgcgccaaagaagtggcagaggccaaagtagctaaggtgtctccagaagctagggtgaaggggccaaggctgaggatgcccaccttcgggctctctctcttggaaccccggcccgctgcccctgaagtggtggagagtaaattaaaattgcccaccatcaagatgccctctctgggtataggcgtgagtggccccgaggtgaaggtccccaagggtccggaggtgaagttgcccaaggcacctgaggtgaaactgccaaaggtgccggaggctgcgctaccagaagtgagactgccagaggtcgaactaccaaaggtgagcgagatgaagcttccaaaggtgcctgaaatggcagtgccagaggtccgcctcccagaggtggagcttcccaaagtgtctgagatgaagcttccaaaagtgccagagatggctgtccccgaagtgagacttccggaggtacagttgcttaaagtttcagaaatgaagctgccgaaggttccagaaatggccgtgccggaagtcaggctgcctgaggtgcaactcccaaaagtatctgagatgaaactgcctgaagtcagcgaggtagccgtcccggaagtccgtctgcctgaggtgcagctccctaaagtccccgagatgaaagtacctgaaatgaagctcccgaaagtgcccgaaatgaagcttcctgagatgaaattgcctgaggtgcaattgccgaaagtgcctgagatggccgtgccagacgtccacctccccgaagtgcagttgcccaaagtacccgaaatgaagctgccagagatgaagctaccggaggtcaagcttccaaaagtaccggaaatggcagtgccagatgtgcatctgcccgaggtccagctcccaaaggtgcccgagatgaagctccccaagatgccggaaatggccgtaccagaagttcgcctgcccgaagtccagctccctaaggtctccgaaatgaaactccccaaagtgcccgagatggcagtcccagatgtccacttacccgaagtgcagctgccaaaggtgtgtgagatgaaggtgccagacatgaaactacccgaaattaagttgccaaaagtgcctgagatggcagtccctgatgtgcatttgcccgaggtccagttacccaaggtttctgagatcagactccccgagatgcaggttccaaaggtacctgacgtccatctgccaaaagccccagaggttaagctgccgcgggccccagaagtacaacttaaggccaccaaagcagaacaggccgaggggatggaattcggctttaagatgcctaagatgactatgccaaagcttggccgagcagagagtccatcccgtggcaaacctggtgaggctggggcagaggtatccggcaagctggtgacactgccttgtctacaaccagaggtagacggcgaagcacatgtaggcgttccctcgctgacacttccatctgtggaactggatctaccaggcgctctgggtcttcagggccaagtgcctgccgccaagatgggaaagggtgagagagttgaaggtcctgaagttgctgctggcgtaagggaagtgggcttcagggtgccaagtgttgagatcgtgacccctcagcttcccgccgtggaaatagaggaaggcagactagaaatgatcgaaactaaagtgaaacctagctctaagttcagcctaccaaagttcggcttaagtggcccgaaggtcgctaaggctgaggctgagggggccggccgggccaccaagttaaaagtgtcaaagtttgccatctcgctgcccaaagctcgggtgggggcggaggcagaagcaaagggcgccggcgaggcaggactgctgccagccctcgacttgtccattcctcaactgtctcttgacgcccatttgccttcaggaaaggtggaggtagccggagcagatctgaagttcaaaggtcctaggtttgcattacctaagtttggtgtgcgcggcagagatactgaggccgctgaactcgtcccaggagtggccgaactggaaggcaaagggtggggctgggacggaagggtcaaaatgcccaagcttaagatgcccagcttcggccttgcgagaggaaaagaagccgaggtgcagggagaccgagcatctcccggtgagaaagccgaaagtaccgccgtgcagctgaaaattcccgaggtggaactggtcactctcggcgcacaggaagagggtcgtgccgagggcgcggtagccgtgtccggaatgcaactgagcgggctgaaagtgagcacagcaggccaggtcgtaactgaggggcatgatgctggcttgaggatgccgccactaggcatttccctgcctcaggtggagctgacagggttcggcgaagccggcacacctggccaacaggcccaatcgacggttccttctgccgaaggaacggccggatatagggtgcaagtccctcaggtcaccttgagcttgcccggcgcgcaggttgcgggaggagagttactggtcggcgaaggagtctttaaaatgccgacagtaactgtgccccagctggaactggatgttggcctaagccgagaagcacaagcaggcgaagctgcgactggggaaggaggactcagattgaagctcccaactctcggggcacgggcacgcgtgggcggagaaggggctgaggagcagccccctggagccgaacgtacattttgtctgagtctgcccgatgtagaattatctccgtcaggggggaaccatgctgaatatcaggtggctgagggtgagggtgaggccgggcacaaacttaaggttagactcccccggttcggcttagttcgcgcgaaggagggtgcagaagagggagaaaaggctaagtcccctaaacttcgattaccgagagtgggcttttctcagtccgaaatggtgaccggcgagggatcaccatctcctgaagaagaggaggaggaggaagaagaagggtctggggaaggggcctccggacgaagggggcgggtgcgtgtccgtctgccacgggttggtttggcggcaccctccaaagcctctcgagggcaggaaggagacgccgcaccaaagagccctgtgcgagaaaaatctcctaagttccgcttccccagagtgtccctgagccccaaggctcggtcagggtcaggggatcaggaggaaggtggcttgagagttcggctgccctcagtaggcttctctgaaacaggggcccctgggcccgctcggatggagggcgcccaggccgccgcagtgtag

SEQ ID NO: 198931 - DNA, 4191 bp, Artificial Sequence
  Description of Artificial Sequence: Synthetic coding sequence
atggaggcccggagccggagcgccgaggagctgcggcgggccgagctggtcgagataatcgtggagaccgaagcccagactggcgtcagtggcatcaacgtggcaggcggaggcaaggagggcatttttgtgagagagttgcgggaggattcccctgcagccaggagcctgagtcttcaggaaggggatcagctgttatccgctagagtttttttcgagaatttcaagtatgaggatgctctccggttgctgcagtgcgcagagccctacaaggtcagtttttgtctgaagagaaccgtccctaccggtgatttagctctgaggcctggaaccgtgagcggatacgaaatcaaagggcctagggctaaggttgcaaagttgaatatccaaagcctcagccccgtaaaaaaaaagaaaatggtcccaggcgcattaggcgtgcctgcagatctcgcccctgtcgacgtggagttcagtttccccaagtttagccggttgcgcagggggctcaaagctgaggccgtgaagggccccgtgcctgctgccccggcgcggcgcaggctccaacttccccggctgcgagtgcgggaagtggccgaagaagctcaggccgctaggcttgccgcagctgctcctcccccacggaaagctaaggtcgaggcagaggtggctgctggcgctaggttcactgcccctcaagtagagttggtgggcccgcgcttgcctggagcagaggtgggcgtccctcaagttagtgcccctaaggctgccccttccgctgaggcagcaggaggctttgcattacacctgcctactctcggacttggcgccccagcaccacccgcagtagaggcccctgcagtcggtattcaggttccccaggtggagctaccagccctaccatctctgcccacgctgccgacactgccctgtttggaaacccgagagggggctgtttctgtagtggtgcctaccctggacgtggcggcacctaccgtgggtgttgacctggctctgcccggggccgaggttgaagccaggggtgaagcgcctgaagtggctttgaagatgccccgattaagcttcccccgattcggcgcacgcgctaaagaggtggccgaggcaaaggtagccaaggtgagtcccgaggccagggtcaaaggcccaagacttagaatgccgactttcgggctgagcctcctagaacccagacccgccgctcccgaagttgttgagagtaaacttaagctacccactataaaaatgccttccctggggatcggagtgtcaggtcccgaagtgaaagttcctaaggggccagaagtgaaactgccaaaagcccctgaagttaagctgcctaaggtccccgaagctgcgctgcctgaagtgaggctgccagaagtcgaactgccaaaagtctctgagatgaaactcccgaaggtgccagaaatggcggtgccggaggttcgactgcccgaagtagagctaccaaaagtgtccgaaatgaaactgcctaaagtcccagaaatggcagttccagaggttaggttacccgaggtgcaactcctcaaggtctccgaaatgaagttgcccaaggttcccgagatggccgtgcctgaggtgcgactgccagaggtgcaattgcccaaggtctctgaaatgaaacttccagaggtgtccgaggtggccgtgccagaagttcggctgccagaggtccagctgcctaaggttcctgagatgaaagtgccagagatgaagctccctaaggtgcccgagatgaaactaccagagatgaagttaccagaggtgcagctacccaaagtgcccgaaatggctgtgccagacgtgcacctccctgaggtgcagcttccaaaagttcccgagatgaagctgcccgagatgaaattacctgaagtcaaactgcctaaagtgccagagatggcagtgcccgatgtacacctgcctgaagtgcagcttcccaaagtccccgaaatgaaactaccaaaaatgccagagatggctgtcccagaggttcgtctgccggaagtccagcttcctaaagtcagtgagatgaaattgcctaaggtgcccgaaatggcagtgccagacgttcacctgcctgaggtgcagttacccaaggtatgtgagatgaaggtgccggacatgaaactgccagagattaaactgcccaaagtcccagagatggcagtccctgacgtccatctgccagaggtgcagctgcccaaggtttcggagatcaggctaccagagatgcaggtaccaaaggtgccggatgtgcatttgcctaaggcacctgaagtgaaactccctagagctccagaggtgcagctcaaagcgacaaaggcagagcaggcggagggcatggagttcgggttcaagatgccaaagatgaccatgccaaaactcggtagagccgagtctccctctcgggggaagcccggggaagccggcgctgaagtctctggcaagctggtcacactgccgtgcctacaacctgaagttgatggtgaagctcacgtcggcgtaccatcactgaccttaccaagtgtagagcttgatctgcccggcgccctgggactccagggacaagtgcccgctgccaagatgggcaagggagagagagtggagggccccgaggtggccgctggagtacgcgaagtgggttttcgggttccgtcagttgagatcgtaacaccgcagctgccggccgtggagatcgaagagggaaggctggaaatgatcgagaccaaagttaaaccgtcctctaagttcagccttcccaaattcggtctatcgggtccaaaggttgcgaaggcagaagccgagggcgctggaagagccaccaaactgaaagtctccaaattcgccatcagcctgccgaaggcccgggtgggagctgaggctgaagctaaaggagctggcgaggccggccttctccctgctctggacctgtccataccccaactttctctggacgcgcacctgccgtccggaaaggtggaggtggccggcgccgaccttaagttcaaggggccaaggttcgctttgcctaaatttggagtgcgcggccgggatactgaagccgccgaactggttcccggggtcgctgagctggagggcaaaggctggggctgggatgggagagtcaaaatgcctaaacttaaggtgtcaaccgctggtcaggtcgtgactgaagggcatgacgcagggcttcggatgccaccactgggtatttctctgcctcaggtggaactcacgggatttggtgaggcgggcaccccaggccaacaggcccagagcacggtgccctcagcggaggggaccgctgggtaccgggtacaagttccgcaggtaaccctcagcttacccggagcccaggtggcgggcggcgaattgctggttggagaaggagtgttcaaaatgcctacagtgaccgtcccacagctggaacttgacgttggactgagcagagaagctcaggccggagaggccgccaccggggaaggggggctgcggctcaagctgccaacgctgggtgcacgtgccagggtggggggcgagggggccgaagagcagccgccgggtgctgaacggactttctgtctgtccctcccggatgtcgaactgtctccttccgggggcaatcatgcagagtaccaggtggccgaaggcgagggcgaggctggccataaattaaaggttcgtttgcccaggttcggactggtacgcgcaaaagaaggggctgaagaaggagagaaggccaaaagtccaaaattacggctgccaagggtgggattctcccagtcagagatggtgaccggtgaaggaagccctagcccagaggaggaagaagaagaagaagaggaaggcagtggagagggcgctagtggccggagaggccgcgtacgggtgcggctgcctcgtgtgggcctggcagccccatccaaggcaagccgcgggcaggagggtgatgccgctccaaagtccccagtcagggagaaatctcctaagttcagatttccgagagtttcactaagtccaaaagcacgttctggctctggcgatcaggaagagggggggctccgggtgaggctgcccagcgtgggctttagtgagacaggtgctcctgggccagcaagaatggagggggctcaggcagcggccgtgtag

SEQ ID NO: 198932 - DNA, 2214 bp, Artificial Sequence
  Description of Artificial Sequence: Synthetic coding sequence
atggaggtggagcaggagcagcggcggcggaaggtggaggccggcagaactaaactggcccactttaggcagaggaaaaccaagggggacagcagccactcggagaagaagaccgccaaaagaaaggggtctgcagtggacgctagcgtgcaggaggagtcacccgttactaaagaggacagcgcactgtgtggggggggggacatttgtaagagcacttcatgcgacgacacccccgatggggcgggcggggcctttgccgctcagcctgaggattgcgatggagagaagcgggaggacttggagcagctacagcagaaacaagtgaacgatcaccccccagagcagtgcgggatgtttaccgtgagtgatcacccaccggagcagcacggcatgttcaccgtcggggaccacccacccgagcagaggggcatgtttactgtctctgatcacccccccgaacagcgagggatgtttaccatttctgatcatcaaccggaacaacggggcatgtttacggtctccgatcatacgcccgagcagcgcggaattttcacaatcagcgaccatcctgccgaacaaagggggatgttcacgaaggaatgcgaacaagaatgtgaacttgctattactgacttagagagtgggagagaagatgaggcgggtctacatcagagccaagccgtgcatggcctcgagcttgaggccctgagattgagtctctccaacatgcacactgcacagctggagctgacacaggcaaacctccagaaagagaaggagactgctttaacggaacttcgcgagatgcttaactcaagacgcgctcaagaattggcactgctccagagccggcagcagcatgaacttgaactgctgcgcgagcagcacgctcgcgaaaaagaggaagtcgtgctgcgctgcggacaggaagccgctgagctgaaggagaagctgcagtctgagatggagaagaacgctcagattgttaagacactaaaggaagactgggaaagtgaaaaagacctttgccttgagaacctcagaaaggaactgagcgccaaacaccagagtgagatggaagatctccaaaaccagtttcagaaggagctcgccgagcagcgcgcagaactggagaagatctttcaagacaagaaccaggctgagcgcgccttaaggaatctggagagccaccatcaggccgccatcgaaaagttaagggaggacttgcaatccgagcatggcaggtgtcttgaagacttggaattcaagttcaaggagtcagagaaagagaagcagcttgaactggagaatttgcaggcctcctacgaggatctgaaggcacagtctcaggaggagatcagaagactgtggtcacagctcgattccgcgaggacctctaggcaggagctatccgaactgcatgagcagctgttggctcgcacctccagagtcgaggatcttgagcagcttaaacagcgtgaaaagacacaacacgagagcgaacttgagcagctaagaatatatttcgaaaaaaagctccgggatgccgagaagacatatcaggaagacctgaccctgctgcaacagcgcttgcagggcgccagggaggatgctctgctggatagcgtcgaggtgggcctgtcatgtgttggactcgaggaaaagccagagaagggccgtaaagaccatgtcgatgaactggagcccgaaaggcataaggagagcctgcctagatttcaagccgaactggaggagagccataggcaccagctcgaagctttggaaagtccgctgtgtatccagcacgagggccacgtatccgaccggtgctgcgttgagaccagtgccctcggccatgaatggcgccttgaacctagtgagggccatagtcaggagctgccttgggtgcacctgcagggcgtgcaggacggtgacctggaggccgatacggagcgcgcggcacgagtactgggtctggaaacggagcacaaggtgcagctcagccttctgcaaacagagctgaaagaggaaattgagctcctcaagatcgagaaccggaatctgtacggtaagctgcagcatgaaacaaggcttaaggacgatttggagaaggtcaagcataaccttatcgaagatcaccagaaagaacttaacaatgccaagcagaaaactgagctcatgaagcaagagttccagcgcaaagagacctag

SEQ ID NO: 198933 - DNA, 10011 bp, Artificial Sequence
  Description of Artificial Sequence: Synthetic coding sequence
atggaggtggagcaggagcagcggcggcggaaggtggaggccggcagaacgaaattggcccatttccgacagcgtaaaacgaaaggggacagttctcattcagaaaaaaaaaccgctaagaggaagggcagcgccgtcgacgcatcggtgcaggaggagtcccccgtgacgaaggaggatagtgcactgtgtggaggaggtgacatatgcaaatctacaagctgcgacgacactccagacggagctggaggggctttcgcagcacagcccgaagactgtgatggtgagaaacgggaagatctggaacaactgcagcagaagcaggttaacgaccatccacctgagcagtgcggcatgtttacagtgagcgaccacccccctgaacagcacggcatgttcacagtgggagatcacccccccgagcagagaggtatgttcacagtctccgatcacccacctgagcagcacgggatgttcaccgtgagcgaccaccccccagagcaaagagggatgttcacaatctctgatcatcagccggagcagcgtggaatgttcacagtgagtgatcatacacctgagcagaggggcatcttcaccatttccgaccaccccgctgaacagcgcggtatgttcactaaagagtgcgaacaggagtgtgagctagccattaccgacctggaatcaggtcgcgaggatgaagccggactgcatcaaagccaagcagtccacggtctcgagcttgaagctttaaggctttcattgtctaacatgcataccgcgcaactggagctgacacaggcgaaccttcagaaggaaaaggagaccgcgctgactgagctccgagaaatgcttaacagtcgacgcgcacaggagctcgccctgctgcaaagccgccagcagcacgagctggagcttcttcgcgagcagcacgcacgcgagaaagaagaagtggtgctgagatgtggccaagaggctgccgagctgaaggaaaaactccagtccgagatggaaaaaaacgcacagatcgtcaaaacactaaaggaggattgggagtctgagaaggacttgtgtctggagaacctgcggaaagagctgtccgcaaagcatcagagtgaaatggaggatttgcagaatcagtttcagaaagagcttgctgagcagagagcagaactcgaaaaaatttttcaggacaaaaaccaggccgaacgagctctccgcaatcttgaatcgcaccaccaagccgccattgagaagcttcgggaagacctacaaagtgaacatggaaggtgcctcgaggacttggagtttaagtttaaggagagcgagaaagagaagcaactcgagctggaaaatctgcaggcctcgtatgaggatttaaaagctcaatctcaggaggaaattagacgtctttggagccagttggatagtgccaggactagccggcaggaattaagtgaactgcacgagcagctcctggccagaacctcgagggtggaggatctagaacagctaaaacagcgcgagaagacacagcatgaatcagagctcgaacaactccggatctacttcgagaaaaagctacgggacgccgaaaaaacctatcaagaggacctgaccctcctgcagcagaggctgcagggagcgcgcgaagacgcactgctagactcagtggaggtcggactctcatgtgtgggactcgaagagaagccggaaaaggggcggaaggatcatgtggacgagctggagccggagagacataaggagagcctccctcgcttccaggccgaactggaggaaagccacagacaccagctggaagcgctggagagccctctctgcattcaacacgagggccacgttagcgatcgatgttgcgtagaaactagtgcgctaggacatgaatggcggcttgagccatcagagggccattcacaagaacttccttgggtacaccttcagggggtacaggacggagatttggaggccgacacagagagagccgccagagtgctcggcctggaaactgagcataaggtgcagctgagcctcctccaaaccgagctgaaggaggaaattgaactgctgaaaatcgagaacagaaacctatacggaaaactgcaacacgagacccgactgaaagatgatctcgagaaggtgaaacataacctgatcgaggatcatcagaaagagctgaacaatgccaaacagaaaacagagctgatgaagcaagaattccagcgaaaagaaaccgattggaaagttatgaaggaggaactccagcgggaggctgaagagaaactgactctgatgctcctcgaactcagagagaaagcagagtcagaaaagcagactatcataaacaagttcgaactgcgtgaggccgagatgaggcagttgcaggaccaacaggctgcacaaatattggatctggagcgctccctgaccgagcaacagggccgtcttcaacagcttgagcaggatctgaccagcgatgacgctctgcattgtagtcagtgcggtagggagcctccaactgcccaagacggagagttagccgcacttcacgtaaaggaggactgtgctttacagctgatgttagcccgctctagattcctcgaagagagaaaagagataactgaaaagttctcggccgaacaggacgcatttctgcaagaggcccaggagcagcatgcgcgcgagctccagcttctccaggaacggcaccaacagcagctgctgtccgtgaccgcagagctggaggcccggcaccaggccgccctcggggagcttactgcctccctggagtcgaagcagggcgccttgctggctgcgagagtggctgaacttcaaaccaagcacgctgccgatttgggcgctctggagactcgccacttgagcagccttgattccctggagagttgctacctaagcgagttccagaccattagggaagagcaccggcaggcactggaactgcttagagcagactttgaggaacagctgtggaaaaaggattctctgcaccagaccatacttacacaggaactggagaagctgaaacgcaagcacgaaggggaattacagtccgtacgggatcacctgcgtactgaagtgtcaaccgagctggcaggaaccgtggcccatgaactgcaaggggtgcaccagggcgaatttgggagtgaaaagaagaccgctctccacgagaaggaggagactctgagattgcagtctgctcaggcccagcccttccatcaagaagagaaggagagcctgagcctccaactgcaaaaaaagaaccatcaggttcagcagctgaaggaccaagttctgtcactgtcacatgagattgaagaatgcaggtccgaactggaggtgttacagcagaggcgcgaacgagaaaatagggagggggccaaccttttgagtatgctcaaagcagatgtgaatctgagccactcagagagaggcgcactgcaggacgcactgagacggctgcttgggttgtttggagagaccctgagggctgccgtcactctgcgatctcgcatcggcgaacgggtagggctgtgtctggacgacgccggcgccggtttggcactcagtacggctcctgcactcgaagagacttggtctgacgtagcactgccagagctcgacaggactctttcagaatgcgcggagatgtcaagcgtggcagagatttcttctcacatgcgagaatctttcctgatgagtcctgagtccgttcgcgaatgtgaacagcccattcggcgagttttccagagcttatcccttgccgtggatggactgatggagatggcgctcgactccagccggcagcttgaggaggcccgacagatacatagtagatttgagaaagagttctccttcaaaaatgaggaaacagcccaggttgtccgcaagcatcaggagctcctggagtgcttgaaggaagagtcggccgcaaaggctgagctcgccttggaactgcacaagactcaggggacactagaggggtttaaggtggagacagccgaccttaaagaggtcctggccgggaaagaagatagcgagcacagattggtgctggagctagagtcactgaggagacagttacagcaggccgcccaggagcaggcagccctgagggaggagtgtactagactgtggagccgcggtgaagcaacagcgactgacgccgaagctcgagaggccgcgctcaggaaagaggtcgaagatctaacaaaagagcagagcgaaacccgcaagcaggcagagaaagataggagcgctttactctcccagatgaagattcttgaaagtgagctcgaggagcagctgagccagcatcgtggatgcgcgaagcaagctgaggcagtaaccgccttggaacagcaggtcgcatccctcgataagcaccttaggaaccagcgccagttcatggatgagcaggctgctgaaagggaacacgaaagggaggagtttcaacaggagatccagcgcctggagggtcaattgcggcaggcggcaaagccccagccctggggacccagggacagtcaacaggcgcctctagatggcgaggtcgagctcctgcagcagaaactgagggaaaaacttgacgagttcaacgaactggcaatccaaaaggagagcgccgatcgccaagtcctgatgcaggaggaggaaattaaaagactggaagagatgaatatcaacatcaggaaaaaggtggcacagttacaagaagaagtcgagaagcaaaaaaatatagttaagggcctcgaacaggacaaagaagtgttgaagaaacagcagatgtctagtttgcttttagccagcacgctccagagcactctggatgctggtcgatgtcccgagcctccatccgggtccccaccggagggtccagaaattcagctcgaagtgacgcagcgcgccctgttgcgtagggagtcagaggtcctcgacttgaaggaacagctggaaaagatgaagggcgatctcgagtccaagaatgaagaaattcttcacctgaacctcaaactggacatgcagaattcacagactgccgtaagtctccgggagctcgaggaggagaatacctcactgaaagtgatttacacacggtcttcggagatagaggagctgaaagccactatcgagaatttacaagaaaaccagaagcgcctgcagaaagaaaaagcagaggagattgagcagttacatgaggtgattgaaaagctacaacacgaactctctcttatggggcccgtggtacacgaagtgtctgacagtcaggcagggtctctccagtctgaattactgtgttcacaggctgggggccctcgcggacaggccttgcagggcgagctggaggctgcgcttgaagcaaaagaggccctttctagactgcttgccgaccaggagaggaggcactcacaggccctggaagccctgcagcagagactccagggcgctgaggaggcggcagaattacagctggctgaacttgagcgcaatgtcgctctgcgtgaggcagaagtcgaagatatggcatcacgaatccaggagttcgaggcagctctgaaggccaaggaagccaccattgccgaaaggaacctggaaattgatgccttgaatcaacgcaaggccgcgcactctgccgagctcgaggccgtgctgctcgcgctggcgagaatcagacgcgcccttgaacaacagcccctggccgccggagctgcgcctccagagctgcagtggctccgggctcaatgcgcacgcctaagtagacagctacaggtgcttcaccagagattcctgaggtgtcaggttgagctagaccgacgtcaagcccgtcgcgcaaccgcacacaccagagtaccaggagcacatcctcagcctcgcatggacggaggcgccaaggcacaggttaccggagacgtcgaggccagccacgacgcggcattggaaccagtcgtacccgacccccaaggagacctgcagcctgtgctggttaccctcaaagacgcgccgctatgtaagcaggagggtgttatgtccgtgctgaccgtgtgtcagcggcagttgcagtctgaactcttgttagtgaagaacgagatgagactttccctagaggacggcggcaagggcaaggagaaggtgcttgaggactgtcagttacccaaggtggatctagtcgcacaagttaagcaactgcaagagaagttaaaccggctactttatagcatgacctttcagaatgttgatgccgcggacaccaagagcctgtggccgatggccagcgcgcatttgctcgagagctcttggtcggatgacagttgcgatggtgaagaaccagatatatcgccccacatcgatacctgtgatgccaacacggccacagggggcgtgaccgatgtgataaagaatcaagccatcgacgcgtgcgacgcgaatacaactcccggaggagtgactgacgtaattaagaattgggattctctcatacccgacgagatgccggattccccgatccaagagaaaagcgaatgtcaggatatgagcctctccagtccaacttccgtcctcgggggctcacgccaccagtctcatacagcagaagccgggcctcgcaaatcccccgtgggcatgcttgatctctctagttggagcagcccagaagtcctcaggaaagattggacactggagccatggcctagcttgccagtgacaccgcatagcggggctctttctctctgttcagctgacacaagtctgggtgaccgggccgacacaagtttgccacagacacagggacccgggcttctctgttctccaggggtcagtgctgcagctctagccttgcagtgggcagaatctcctcccgccgacgatcaccacgtgcagagaaccgccgtggaaaaagacgtggaagatttcatcacaaccagctttgatagccaggagaccctttccagcccaccaccgggtctcgaggggaaggcagataggtcagaaaagtccgacggctcgggatttggggcacgcctttctccgggcagcggtgggcccgaagcacagacggccggccctgtgacccctgcttccatttctgggcggttccagcccctgcccgaggcgatgaaggaaaaagaggttaggcctaagcatgtgaaagcgcttctgcagatggttagggatgaaagccaccagatcttggccctctcagaagggctggcccccccatccggcgagccgcatcccccacgtaaggaagatgagatccaggacatcagcctccatggggggaaaacccaagaggtccctaccgcctgtcccgattggcggggggacttgctacaggtcgtccaggaggccttcgagaaggagcaggaaatgcagggggtggagctacagccccgacttagtgggagtgatctgggtgggcacagcagtctgttagaaaggttagagaagattatccgggaacagggagatttgcaggagaagagccttgagcacctgagactccccgatagatcatcccttttaagcgaaattcaggcactgcgcgcccagctcaggatgacacatctacagaatcaggagaaattacagcatctacgcaccgccctcacctccgccgaagcccggggctctcagcaggaacatcagctgaggcggcaggttgagttgctggcgtacaaagtagaacaggagaaatgcatagcaggtgatttgcaaaagactcttagcgaggaacaggaaaaagctaacagcgtgcagaagctactcgctgccgaacagactgtagtgagagacctgaagagtgacctgtgtgagtcccggcagaaaagtgaacagctgagcagatctctgtgcgaggtacagcaggaggtcttgcagctgcggtctatgcttagcagcaaggaaaacgaacttaaggctgctctgcaggagctcgagagcgaacagggcaaaggcagagcgttgcagtcacagctggaagaagaacagctcagacatctgcaaagggagtcacagtctgctaaggccctcgaggagctgcgcgcctctctggagactcagagagcccagagcagccgcctgtgtgtggccctcaagcatgagcagactgcaaaggataacttgcagaaagagctaaggatcgaacactctcgatgcgaagcactcctggctcaggaaagatcacaactgagcgagctccagaaagatttagccgcagaaaagtccagaactcttgaactttcggaggctctgcgtcacgaacgattgctcaccgagcagttatctcaacgaacccaggaagcgtgcgtgcatcaggacacacaggcgcatcacgctctccttcagaaacttaaagaagaaaagtctagggtagtggatctgcaggccatgctcgaaaaggtgcagcagcaggccttgcatagccagcagcaactggaggctgaggcgcaaaaacactgcgaggcgctgaggagggagaaggaagtttccgccaccctcaagtcaacagtggaggctctgcacacccaaaagagggagctccggtgttcacttgaacgtgaaagagaaaaacccgcttggctgcaggccgagcttgagcaaagccatccacgcctgaaagagcaggaaggtcgcaaagctgcccggcgctcagccgaggccaggcaaagtccagccgctgccgagcagtggcgaaaatggcagcgtgacaaggagaagctaagggagctggagctacaaagacagagggacctccacaaaataaaacaattgcagcagaccgtgcgggacctggagtccaaggacgaagtccctggatcccgcttacatctgggttccgcacgccgcgccgcaggaagtgacgctgaccatttacgagagcagcagcgagaattggaagctatgcgacagagattactcagcgccgcccgactgctaacatcctttacttcacaggccgttgataggaccgtcaatgattggacctcctccaatgaaaaggctgtaatgagcctccttcacaccctggaagagctgaagtcggatctgtctcgccctacttccagtcagaagaaaatggctgctgaattacaattccagttcgttgacgtgctgctgaaagacaacgtatccctgacgaaagctttaagcacggtcacacaggagaaattggagctgtccagagctgtgagcaaactggaaaagctgctcaagcaccacctccagaaggggtgctcaccaagcagatcagagcggtctgcttggaaacctgatgagaccgctccacagtcgagtcttcgccggcctgaccccggaaggcttccccctgccgcaagcgaggaagcgcacacgagcaacgtgaaaatggaaaaactgtacttacattacctcagggcggagagctttcgaaaagctctcatttatcagaagaagtacttactattgttgattggcgggttccaggactctgaacaagagactctctcaatgattgctcatctgggcgtttttccgtcaaaggccgaacggaagattacctctaggcccttcacccggtttcgtaccgctgtgcgtgtagttattgctattctacgactgcgttttctcgtcaagaaatggcaagaagtggaccgcaagggagcgctagcccagggcaaggcacccagacccgggccacgggctcgtcagccccagtcaccacctcggacccgcgaatcccctccaacccgcgacgtgccatctggccacacgcgagatccagcccggggtaggcggctagccgccgccgcgagcccacactcaggcggccgggctaccccctctcccaacagcaggttggagcgtagcctgacggcaagccaggaccccgagcactcattgacagaatatattcaccatctggaggtcatacagcaacggctggggggagtgctcccagactccacaagtaagaaatcttgtcatcccatgatcaaacagtag

SEQ ID NO: 198934 - DNA, 6075 bp, Artificial Sequence
  Description of Artificial Sequence: Synthetic coding sequence
atggccaccggcggcggccccttcgaggacggcatgaacgaccaggatctacctaattggtctaatgagaacgtggatgaccggctgaataatatggactggggggcacagcagaaaaaggccaatcgctcttccgaaaaaaacaaaaagaaatttggcgttgagagcgacaagcgggtgactaatgacatctccccagagtcctcacctggcgttggaagaaggcggacaaagaccccgcatacctttccccacagtagatatatgagccaaatgtccgtgccagagcaagcagagttagagaaactgaagcagagaatcaacttctctgatttagatcagaggagtataggaagcgattcccagggacgcgccaccgctgccaacaataaacgacaattgagcgagaaccggaagccatttaatttcctgccaatgcagattaacaccaacaaatccaaagacgcctctacaaacccacccaatagagaaacgataggttctgcccaatgtaaagagttgttcgcgtccgccctctctaatgatcttctgcagaactgccaagtttctgaagaggatggaaggggtgagcctgccatggagagctctcaaatcgtttcacgcttggtgcagattagggactacatcacaaaagctagctccatgagggaggacctcgtcgagaagaacgagcggagcgccaacgtggaacgacttacccacctgatagaccacctgaaagaacaggaaaagtcgtacatgaaattcctgaaaaaaatcctagctagggaccctcagcaggagcccatggaggagatagagaatctgaagaaacagcacgaccttctgaagcgaatgctgcagcagcaggaacagctgcgggcactccagggccgacaggcggctctgctggcactgcagcataaagccgaacaggcaatagctgtgatggatgattctgtggtagccgagaccgcaggttctctgagtggcgtcagcattaccagcgagctgaacgaggaattgaatgatctgatccagagattccataaccagttgagagactctcagcccccggccgtgccagataatcgtagacaggcggaatccctatccctgacaagggaggtatcgcaatctcggaagccatctgcgtcagagcgattgcctgacgagaaagtggagcttttttcaaagatgagagttctccaagagaaaaagcagaagatggacaagctcctcggagagctgcataccctgcgggatcagcatcttaataactcctccagttctccacaacgttctgtggatcagaggagcacctctgctccttcggcgtccgttgggctcgcccctgtggtcaatggagaatccaattccctcactagtagtgtgccttatccaaccgccagtcttgtgagccagaacgaaagcgaaaacgaaggacacctgaaccccagcgagaagctgcaaaagctgaacgaagtgaggaagaggcttaatgagttgcgggagctcgtccactactatgagcagacctccgacatgatgaccgatgccgtcaatgaaaatcgtaaagatgaagagaccgaggaatcagagtatgatagtgagcatgaaaatagtgaacccgttaccaatattaggaacccgcaggtggccagtacatggaatgaggtgaatagccactcgaatgcacagtgtgtgtcaaataaccgagacgggaggaccgtgaacagcaactgcgagattaataaccgctcagctgccaacataagggcactgaatatgccacctagcctcgactgtagatacaatagggagggcgagcaggaaattcacgtggcacagggtgaggacgatgaggaagaggaagaagaagctgaagaggaaggggtgtcaggcgcatctttgtccagtcatcgctctagcctggttgacgaacaccccgaagatgcagaattcgagcaaaaaattaacagacttatggctgccaagcagaaactgagacagttgcaagatctcgttgccatggttcaggatgacgacgccgcacaaggcgtgattagtgctagtgcaagcaatcttgacgacttttacccggctgaagaagacaccaaacagaatagcaacaacaccagaggaaacgccaacaaaacccaaaaggacaccggcgtgaatgaaaaggccagagaaaagttttacgaggccaaactgcagcagcagcagcgtgagctcaaacaattacaggaggaacgaaaaaagctcattgatatacaggagaagatccaagccctgcagaccgcctgcccagatctgcagctcagcgctgccagcgtggggaattgccctacaaaaaagtatatgccagcagtcacaagtacccccactgttaaccagcacgagacaagcacgagcaaaagcgtatttgagccggaggacagttcaattgtcgataatgagctgtggagtgaaatgcggcgacatgagatgctgagggaagaattaaggcagcgtcgtaaacagttggaggctctcatggccgaacatcaaaggaggcagggactagctgagaccgccagccccgtcgcggtatctctgcggtccgatgggagcgagaatctatgcacgcctcaacagtcccggacagaaaagacaatggcaacctggggcggctccactcagtgcgctctcgatgaagagggcgacgaagacgggtatcttagcgaaggaattgtgcggacagacgaggaagaagaagaggagcaggacgcctctagtaacgacaacttctcagtttgcccgagtaactcagtgaatcataacagttacaatggcaaggagactaagaacagatggaagaacaattgtccgtttagcgcagacgaaaactatagacccttggctaagactaggcaacaaaatatttcaatgcagagacaggaaaatctcaggtgggtttcagagctaagctatgtagaggagaaggagcagtggcaggagcagataaatcagctgaagaaacaactggatttctccgtttctatttgtcagaccctaatgcaggatcaacagaccctcagctgtcttcttcagaccctcctcacaggcccctactccgtgatgccgtcaaatgttgcctctccacaggtgcacttcatcatgcaccaattgaatcagtgctatacccagctgacgtggcagcaaaataatgtgcaaagactgaagcaaatgctcaatgagctgatgcggcagcagaaccaacacccagaaaagcctggtggaaaagaacggggctctagtgcctcacacccccctagcccctcccttttttgcccctttagtttccctactcagcctgtgaatctttttaatattcctggcttcacgaactttagcagcttcgcgcctgggatgaatttctcccccctttttccatccaatttcggagacttctctcagaatatatccactccttctgaacagcagcagccacttgctcagaatagttccgggaaaacggaatatatggcatttccgaagccattcgaatcgagctctagcataggggccgaaaaaccaaggaacaaaaagctgccagaagaagaggtcgagagttcccgcacaccctggctctatgagcaagaaggggaagtggagaagccctttatcaagacgggttttagcgtgtcggttgaaaagtccacatctagcaatcggaagaaccagcttgataccaacgggcggcggaggcagtttgacgaagagtctctggagtccttctcatccatgcccgaccccgtggatcccaccaccgtcactaagaccttcaagactcgcaaagccagcgcacaggcatctctggccagcaaagacaagactcctaaaagtaaaagcaaaaaacgcaatagcacacaactcaaatcacgtgtcaagaatatacgatatgaatcagcttcaatgtcttctacatgtgagccttgcaagtcgcggaataggcattcagcccaaactgaggaacctgtgcaggctaaggtgttcagtcgcaagaaccatgagcagctcgaaaagattattaagtgcaacaggagcactgagatcagctctgagacggggtctgacttttcaatgttcgaggcactgcgcgataccatatactccgaagtcgccacccttataagccaaaacgaaagcaggcctcatttcctgatagagctgttccacgagcttcagttgctgaacactgattatctgcgccagcgggccctctacgcactccaagacatcgttagccgacacatttccgaaagccatgaaaagggcgagaatgtcaagagtgtgaactctgggacatggattgccagtaacagtgagctgaccccaagcgagtccctcgcaacaacagacgatgagacatttgagaaaaactttgaaagggaaactcataagattagtgagcagaatgatgcagacaacgccagcgtgctgagcgtgtcctccaattttgagccattcgccactgatgacctcggcaacaccgtgattcacctggaccaggcactcgctcggatgcgcgagtacgaaagaatgaagacagaggccgaaagcaattccaacatgcggtgtacttgtcgaataatcgaggacggggacggcgctggggccggaaccaccgtgaataatctggaagagacccccgtgatcgaaaaccgctccagccaacagccagtgtccgaggtctcaaccattccgtgtccccgaattgacactcagcagttggatcgtcaaatcaaggctataatgaaggaagttatccctttcttaaaggaacatatggacgaagtctgctcctcccagctgctcacttcggtgcgccgcatggtcctgacccttacccagcagaacgatgaatctaaggagttcgtcaaattctttcacaagcagcttggtagcatccttcaagattctttagcgaagttcgctggaaggaaactgaaagactgtggagaggacttgcttgtggagatctccgaagtcctatttaacgaactcgccttctttaaactcatgcaggacttggacaataatagcatcaccgtcaagcagcgatgtaaaaggaaaatcgaggctacaggcgtgattcagtcttgtgcaaaggaagctaaacgaattctggaagatcacggcagtcccgccggcgaaattgacgatgaggataaggacaaggatgaaacagaaacagtgaagcagactcaaacctccgaagtctatgacggacccaaaaatgtacgctctgacattagcgaccaggaagaagacgaggaaagtgagggatgtccagtaagcataaatctcagcaaggcggagacgcaggcactcaccaactatggatctggagaggatgaaaacgaagacgaagaaatggaggaatttgaggaaggcccggttgacgtacagactagtctgcaggctaataccgaggctaccgaagaaaatgaacacgatgagcaggtgcttcagcgagattttaagaagaccgccgaatcaaaaaatgtgccgctcgaaagagaggctaccagcaagaatgaccagaataattgccccgtgaaaccttgctacctgaacatcttagaagacgagcaacccttgaatagtgccgcccataaggaatcaccgccaactgtggattccacacaacagcctaatccccttccgctgcgacttcctgagatggagccactagtcccccgagtgaaagaagtcaagtccgcgcaagaaacccctgaaagttctctggccgggtctccggacacagagagccctgttctggtgaacgactatgaggccgagtcaggaaatatcagccaaaagtccgatgaagaggacttcgtcaaggtggaagacctacctctgaagctcacaatatattcagaggccgacctgcggaagaaaatggtagaggaagagcaaaaaaatcacctcagcggcgaaatatgtgaaatgcagacggaggagttggccggaaactctgaaactttgaaagagcctgagactgttggcgcccagagcatttag

SEQ ID NO: 198935 - DNA, 1590 bp, Artificial Sequence
  Description of Artificial Sequence: Synthetic coding sequence
atggccaccggcggcggccccttcgaggacggcatgaacgaccaggatctccctaactggtctaacgagaacgtggatgataggctgaataacatggattggggcgcccagcagaagaaggcaaaccgcagcagcgaaaagaacaaaaagaaatttggagtggagtccgacaagcgggttaccaacgacatttcacccgagtcttcgcccggggtgggacgacggcgaacgaaaacacctcacacttttccgcactcccgctacatgtctcagatgtccgtccccgagcaagccgaacttgaaaagttgaagcagagaataaatttcagcgatctggatcagagatcaattggttccgatagccagggccgggcaacggccgccaataacaagagacagctatcagagaaccgtaagccctttaatttcctgcctatgcagattaacactaataagtccaaggatgcatctaccaatccacctaatcgggagaccataggcagcgctcagtgcaaggaattattcgcgagcgctctgtcgaacgatctgctccagaactgtcaggtctccgaggaagatgggcggggcgagcctgctatggaatctagccagatagtctctcggttagtacagatccgggactacattaccaaggctagcagtatgcgcgaggatctggttgagaagaatgagcgcagcgcaaatgttgaacgactgacccacctgatcgaccatctaaaagagcaggagaaatcttatatgaagtttctgaaaaagattctggcaagggagaacgaggaggaggacgtgagaaccatagacagcgccgttggcagcggcagcgttgcggagtccacatccctgaatattgacgttcaatcagaggcatccgatacaacggctcgggacccgcagcaggaaccaatggaggaaatagaaaacctgaaaaagcagcatgatttgctgaagaggatgcttcagcagcaagaacagctacgggctttgcagggcagacaggccgcactgctcgccctgcagcacaaagcagagcaagccatagcagtcatggatgactcagtggtagctgaaactgccggctcactgtctggagtgtctattacctccgaactgaacgaggagctgaatgatctgatccagcgctttcataaccagctgagggattcccaacctcctgctgtgcccgataacaggcgccaggctgagagcttgagcctaacacgagaagtctctcagtcaaggaaaccttccgctagcgagcggctgcctgacgagaaagtggaacttttctccaagatgcgtgttttgcaggagaagaaacagaagatggacaaacttctgggtgaactgcacacccttcgggaccagcacctgaacaattcctctagtagccctcagcggagcgtcgaccagcgctctaccagcgccccaagtgcctccgttgggcttgctccagtggttaatggtgaaagcaacagcctgacatctagtgtgccttatccgactgcaagcctggtgtcccaaaacgaatccgaaaacgagggccacttgaacccttccgagaaattatag

SEQ ID NO: 198936 - DNA, 2172 bp, Artificial Sequence
  Description of Artificial Sequence: Synthetic coding sequence
atgagcagcacctgcgagccctgcaagagccggaaccggcacagcgcccaaacagaggagcctgtgcaggctaaggtattcagcagaaagaaccatgagcagctggaaaaaataattaaatgtaacagatctaccgaaatcagtagcgctcatgcgcgtaggattcttcagcagtccaatcgaaacgcctgcaacgaagcccccgagaccggcagtgatttcagcatgtttgaagcattgcgagatactatatatagcgaggtggccacactgatctctcagaacgaatctaggcctcattttctgatcgaactgtttcatgaactccagctgctcaacacagattacttaagacaaagggccctgtacgccctccaagacattgtgagccggcatataagtgagtcacacgagaagggcgagaacgttaagagcgttaattctgggacttggatcgcaagcaattctgaactaacaccctccgaatctctggccaccaccgacgacgagacatttgagaaaaattttgaacgggagacccacaagataagcgaacaaaacgacgcggacaatgcatctgtcttatccgtctcatcaaatttcgagcctttcgcgaccgatgatctgggcaacactgtaattcacctggaccaggccctcgctagaatgagagagtacgagcgaatgaaaacagaggccgagtccaattcgaacatgcggtgcacctgccgcatcattgaagacggcgatggcgccggtgctgggacgacagtgaacaatctggaggagactccagtcatcgaaaaccgatccagccagcagcctgttagtgaagtgtctacaatcccctgtcctcgtatagatacccaacagctcgaccggcagataaaagccataatgaaagaagtgattccgttcctaaaggaacatatggacgaggtgtgctcctctcaactgctaacatcagtgcggcggatggtgcttactctcacccagcaaaatgatgaaagcaaagagtttgtgaaattctttcacaaacagctcggctcaattttacaggattccctggctaaatttgctggacggaagctgaaagactgcggcgaagatttgctagttgagatcagtgaggtgcttttcaatgagttagcctttttcaagctcatgcaggaccttgataataattcaattaccgtaaaacagcgttgcaaaagaaaaatcgaggctacaggagtaattcagtcctgcgccaaagaggcaaagcgaatcctggaggaccacggatcccctgcaggcgagattgacgacgaggataaggacaaggacgagacagagacagttaagcagactcagacatccgaagtttacgatggccccaaaaacgtgcgctcagacatctcagaccaggaagaggacgaagaatctgaaggatgccccgtttctattaacctttccaaggctgaaacacaggctctgaccaattacgggagcggcgaggacgaaaatgaagacgaagaaatggaggaattcgaggagggtcccgtcgatgtgcagaccagcctgcaggcaaatactgaagcaaccgaggagaacgaacatgatgagcaagtattgcagagggacttcaagaaaacagccgaatcaaaaaatgtgcctctggaacgggaggcgacatcgaagaatgatcagaacaattgcccagtaaagccgtgttatttgaatatcctggaagacgagcagccgctgaattcagccgcccacaaggaaagcccaccaacggtggactccactcagcagcccaatccgctacctcttcgcctccctgaaatggagcccctggttcctcgcgtgaaagaagtcaaaagtgcgcaggagacaccagagtcatccctggctggatcccctgatacggaaagcccggtacttgtgaatgattacgaagcagaaagtggcaacatatctcagaagtccgatgaggaggactttgtgaaggtggaggacctgcccttgaaactgacaatatattctgaggccgatctgaggaagaagatggtggaggaagagcagaagaaccacctcagcggagaaatctgtgagatgcagaccgaggagcttgccggcaatagcgaaacactgaaggaaccagagacagtgggcgcccagagtatttag

SEQ ID NO: 198937 - DNA, 2295 bp, Artificial Sequence
  Description of Artificial Sequence: Synthetic coding sequence
tgaaaggccagcgcccaggccagcctggccagcaaggacaagacccccaagtcaaaatcaaaaaagagaaactcgactcagttgaagtcccgcgtcaagaacataagatatgaatcagcaagcatgtctagtacttgtgagccttgtaaaagcaggaacaggcacagcgcccagactgaggagccagtgcaggctaaagtctttagccggaaaaatcacgagcagctggagaaaattatcaaatgtaacaggtcaacagagatttccagcgcccatgccaggcggatcctacagcagagcaaccgcaacgcatgcaatgaggcacctgagaccggttccgacttttcaatgttcgaggcactcagggacaccatctattcagaggtcgcaaccctcatctctcagaatgagtcgcggcctcattttttgattgaactgttccatgaattacaactcctcaacactgattatttgagacaaagagccctgtacgcccttcaggacattgtcagccgtcatatttctgagtcacatgaaaagggtgagaatgttaagagtgtaaatagcggtacctggattgccagcaattctgaactgacccccagcgaatctctcgccaccactgatgacgagaccttcgagaagaacttcgagcgggagactcacaaaatcagcgaacagaacgatgcagacaacgcctctgttctgtcagtctcctctaatttcgaaccattcgctacggacgacctcggaaatacggtgatccacctcgatcaggcactcgccagaatgcgcgagtacgaacgcatgaagacagaggccgaatctaactccaacatgcgttgtacctgcaggattatcgaggatggtgacggtgctggggccggtacaacggtgaataatctggaagagactccagtgatcgaaaacaggtccagtcagcaacccgttagtgaagtcagcactatcccctgtccaagaatagatacacaacagctggaccgacaaattaaggctatcatgaaggaagtcatcccttttcttaaagagcatatggacgaggtgtgtagcagccagttacttaccagcgtgcggagaatggtcctgacactgacacaacagaatgacgaatcaaaagaattcgttaagttctttcacaagcagttggggtctatccttcaagactccttggcgaagtttgccggtcgcaagctcaaggactgtggggaggatcttctcgttgagatatccgaggttttgttcaatgagctcgccttttttaaactgatgcaagatctggacaataactcaattacggttaaacaaaggtgcaagcggaagatagaagcaacaggcgtcatccagtcatgcgctaaggaggcgaagagaatcctagaagaccatggctccccagccggagagatcgatgatgaagataaggacaaagatgaaaccgaaaccgtcaaacagactcaaaccagtgaggtctacgacggccccaagaatgtacggtctgacattagtgaccaggaagaggatgaggagagcgaaggctgtccggtgagcataaatctgagcaaagctgaaactcaggcgctgactaactatggatccggggaagatgaaaatgaagacgaggaaatggaggagttcgaggagggccccgtggacgtacagaccagcctgcaggctaacaccgaagccacagaagaaaatgagcacgatgaacaggttttgcagagggattttaagaaaacggcggagtctaagaatgtaccattggaacgtgaggccacttcaaaaaacgatcagaataattgccctgtgaagccatgttatctcaacatcctggaagacgagcagccattgaactccgcggctcacaaagagagcccgcccacggtcgactctactcagcagcccaatccactcccactcaggctccctgaaatggagccactggtgccaagagtcaaagaggtgaagagcgcgcaggagacccctgagagctctctggcgggatcccctgatacagagagtccggttctggttaacgactacgaggcggaatcaggcaacatatcacagaaaagcgacgaagaggacttcgtcaaggtcgaagatctccccctcaaactgacaatctattccgaagccgacctcaggaagaaaatggtcgaagaagaacagaagaaccatctttccggcgagatctgtgaaatgcagacggaggagctggcaggcaactcagaaacgctgaaggaacccgaaacagtgggcgcccagtccatctag

SEQ ID NO: 198938 - DNA, 1227 bp, Artificial Sequence
  Description of Artificial Sequence: Synthetic coding sequence
atggccaccggcggcggccccttcgaggacggcatgaacgaccaggacctccccaattggtccaacgaaaatgtggatgaccggctcaataacatggactggggcgcgcagcagaaaaaggccaatcgctccagtgaaaagaacaagaaaaaatttggagtcgagtccgataaacgcgtgacgaacgacattagtccggagagtagccccggtgtaggccgtcgacgcacaaagacgccacacactttcccacacagccggtacatgtcacagatgtctgtacctgaacaggctgaactggagaaattgaaacagcgaatcaacttctcggatctggatcaacgctcgattggatccgactctcagggtagagctacagctgctaacaacaagcggcaactatctgagaatcgaaagccttttaacttcttgcctatgcagatcaacaccaacaaaagtaaggacgcgagcacaaacccacccaaccgggaaactatcggaagcgcgcagtgcaaggaactgttcgcttccgcattgagtaacgaccttctgcaaaattgtcaggtgagcgaagaagatgggaggggcgagcccgctatggagtcctcccagatcgtctcccgtctggtgcagataagggattacattaccaaggcttctagtatgagggaggatctggtggaaaagaacgaaagaagcgccaacgtcgagagactgacccacctaatcgatcacttaaaggagcaggaaaagtcctacatgaagttccttaagaaaatattagccagggaccctcaacaggaaccaatggaagaaatagagaacttgaagaaacagcatgatctcctgaagcgaatgttgcagcagcaagaacagctgcgggccctgcagggtaggcaggccgcactactggctctccagcacaaagccgagcaggctattgccgtcatggacgactctgtcgttgcggagacggcaggtagtctgtcgggagtgagcattacatctgagctcaatgaggagctgaacgatttaattcaaaggtttcataatcagttgcgtgactcccagccacctgcagttcctgataaccgtcgccaagcagaaagtctgagcctgacccgggaagtgtcccagtcacggaagccgagcgccagcgagcgcttaccggacgaaaaggtggagctgtttagtaagatgcgcgtgttgcaggagaagaagcagtag

SEQ ID NO: 198939 - DNA, 1569 bp, Artificial Sequence
  Description of Artificial Sequence: Synthetic coding sequence
atggccgtgaacaagggcctgaccctgctggacggcgacctgcccgagcaagaaaatgtattacagagagttctccagctgcccgtagtttccggaacttgtgagtgctttcagaagacatatacgtctactaaggaggctcatcctctcgtggcatccgtctgcaatgcctacgagaagggagtgcagtccgccagcagtctcgcagcgtggagcatggaaccagtggtgagacgcctctccacgcaattcacagcagcaaatgaactcgcctgccgcggtttggaccaccttgaagaaaagattcccgctctgcagtatccccctgagaaaatagcttctgaattaaaggacaccatttccacccgtctgagaagcgcccgaaatagcatatctgtccctattgctagcactagcgacaaagtgttaggagcagctctcgcaggatgtgaacttgcctggggagtcgcccgtgacactgccgagttcgccgctaacacacgtgccgggcgcctagcctccggcggtgccgaccttgctctaggatcaatcgagaaggtggtggaatacctcctgccacctgacaaggaagagagcgctccagctcccggacatcaacaagcccagaagtcacccaaggccaagccaagcctcctgagtagagtgggcgccctgactaacactctgagtaggtatacagtgcagactatggcaagggccctggagcaagggcacacggttgcgatgtggatccctggggtcgtgccactctctagtctggcccaatggggcgcgtccgtggccatgcaggcagtgtctagaagaagaagcgaagtgcgtgtgccttggctacactcgctcgcggccgcgcaagaagaagatcacgaagaccaaacagatacagagggtgaagacactgaggaagaggaagagctggaaaccgaagagaataagttctcagaggtagccgctctccctggtcctaggggtctgctgggcggcgtggctcacaccctacagaagacactgcagaccactattagcgctgtgacctgggcacccgcagccgtgctaggaatggccggtagagtgctgcacctcactccagccccggccgtctctagtacgaaaggacgggccatgtccctgagcgacgccctcaagggggtaacagacaacgttgtagatactgttgttcattatgtgcccctcccgagactgtcgctcatggagccagagagcgagttccgtgatattgacaatccgcctgcagaagtggaaaggagagaagcggagcggagagcaagtggagccccatctgcgggaccagaacccgccccccggcttgcacagccccgtcgctctctgcgtagcgcacagtcgcccggagccccaccaggccccgggctcgaagacgaagtcgccacccccgctgcacccagaccaggattccctgccgtgccccgggagaaaccaaaaaggcgggtaagtgatagtttttttcgaccgtctgttatggagcccattctcggaagaactcactactcacagctgcggaaaaaatcttag

SEQ ID NO: 198940 - DNA, 1569 bp, Artificial Sequence
  Description of Artificial Sequence: Synthetic coding sequence
atggccgtgaacaagggcctgaccctgctggacggcgacctgcccgaacaggagaatgtgttacagcgcgtcctccagctgcccgtggtttcaggcacttgcgaatgcttccagaaaacttacaccagtaccaaagaggcccaccctctagtggccagcgtgtgcaacgcttatgagaagggggttcagtctgcatcttcacttgcggcctggtctatggagccagtggttcgcagactcagcacccagttcactgcggctaatgaactggcttgcaggggcctggaccacctcgaagaaaagattcccgctctccagtatccacctgagaaaatagcgtctgaactgaaagatactatctctacacggctgcgatcagctcgcaactccatttccgtccccattgcatctacatccgataaagtactgggcgcagctctggctggatgcgagctggcatggggagtagcccgcgacacagccgaatttgccgccaacacgagggccggcaggctggccagcgggggtgctgacctcgcgctgggaagcatcgaaaaggtcgtggagtatctgctgcctccagataaagaagaatctgcccccgcacctgggcatcagcaggcccagaagagtcctaaggcaaagcccagcctgctgagcagggttggggctctgaccaataccctgtccaggtatacagtgcagactatggctagagccttggaacaaggccacactgtcgccatgtggattcccggggttgttcccctgagctcattggcccagtggggcgctagtgtggccatgcaggcagtatctagacggcgctccgaggttcgtgtcccatggttgcatagcctggcagctgcacaggaggaagaccacgaggatcagactgacacggagggggaggatactgaagaagaggaagagctggagaccgaggaaaacaaattctcggaagttgcagccctgccagggcccaggggtttacttgggggcgtcgcccacaccctgcagaagaccctccagacaaccatctcagcggtcacttgggctcctgctgccgtactcggcatggcgggacgggtgctacacctgaccccggcaccagccgtcagctcaacaaaaggtagggcaatgtctctgtctgatgccctgaaaggagtcactgataacgttgttgacactgtggttcactacgtgcccttgccccgcctgagtctcatggagcctgaaagcgagtttagagatatcgacaaccctccagccgaagtggagcggcgggaggctgaaagacgtgcctctggagctccctctgctggaccagaacccgccccccgcctcgctcagccccgacggagccttcgctcagctcagtctccaggggcaccaccaggaccaggcttagaagacgaggtggccactcctgccgcgcctcgcccagggttccctgccgtcccacgggagaaaccgaagagaagagtaagcgactccttttttcgccctagcgtgatggaaccaattctgggcagaacccattactcccaactcaggaagaagtcttag

SEQ ID NO: 198941 - DNA, 1314 bp, Artificial Sequence
  Description of Artificial Sequence: Synthetic coding sequence
atggccagcgtggccgtggacccccagcccagcgtggtgacccgggtggttaacctccctctggtaagctcaacatacgacctgatgagctcagcctacctgagcaccaaagaccagtatccatatctgaaaagcgtgtgcgaaatggccgagaatggcgtgaaaacaattacatccgtggccatgacatccgcccttcccatcatccagaagctggaaccacagatcgctgtggccaatacttacgcttgtaagggactcgacagaattgaggagagattgcccatcctgaaccagccatccacgcaaatcgttgcaaatgcaaagggtgctgtcaccggagcaaaggacgcagtcacgacgaccgtgacgggcgctaaagattccgtcgcctctacaatcactggagttatggacaagactaagggtgctgtgacagggagcgtggaaaagacaaaaagcgttgtctccggaagcataaatacagtgctcggcagccgaatgatgcaacttgtatctagcggcgtggagaacgcattaactaaatctgaactccttgtggagcagtacctcccattaacagaagaggaactagaaaaggaggccaaaaaggttgagggttttgatctggtgcagaagcctagctactacgtacggttgggaagcctgtccaccaaactacactccagagcttaccaacaggccctgagtcgcgttaaagaagccaagcagaagtctcagcagaccatctcccaattacattccacggtgcaccttattgaatttgccagaaaaaacgtctactccgctaatcagaaaatccaggatgctcaggacaaactttatctttcatgggtggaatggaaaagatctataggctacgatgacaccgatgaaagccattgtgctgagcatatcgagtcaaggaccctggcaattgctcggaaccttactcagcagttacagacaacctgccacaccctcttgagcaacattcagggtgtcccacagaacatccaggaccaggcgaaacacatgggcgtcatggcaggcgatatctactccgtgttcagaaacgcagcttccttcaaagaggtgtctgactcactcttaacatcctctaagggacaactccagaaaatgaaagagtcccttgacgacgtgatggattatttggtgaataacacccccctgaactggctcgtggggccattttatcctcaactcacagagtcgcagaacgctcaggatcagggagccgaaatggataaaagttctcaagagacccagaggtccgaacacaagacccactag

SEQ ID NO: 198942 - DNA, 333 bp, Artificial Sequence
  Description of Artificial Sequence: Synthetic coding sequence
atggccagcgtggccgtggacccccagcccagcgtggtgacccgggtagttaacctgcccctggtctctagcacgtatgacctgatgagctccgcttacctttctaccaaagaccagtatccctatctgaaaagcgtatgtgagatggctgagaacggtgtcaagacaattacttcggtcgccatgaccagtgccttgccaatcatccagaagctcgagcctcaaatcgcggtggccaacacatacgcatgtaaaggccttgaccggatcgaagaaaggcttcctattctaaaccagcccagtactcaggtttcattaggacaaaagtgctag

SEQ ID NO: 198943 - DNA, 381 bp, Artificial Sequence
  Description of Artificial Sequence: Synthetic coding sequence
atggccagcgtggccgtggacccccagcccagcgtggtgacccgggtcgtgaatcttcccttagtatcgtctacatacgatttgatgagttcagcttatctttctactaaggaccagtacccgtacttgaaatccgtgtgcgagatggccgagaacggagtgaagaccatcacttctgtcgcaatgaccagtgcgctgccgataattcagaagcttgagcctcaaatagccgttgcgaatacatacgcttgcaaaggattagacaggatagaagaaagactgcccattctcaaccagccgtcaacccaggctaatacctgctttcctaatctcgatcttgatgtatgtctgaagaataacggacacttcttgactagttag

SEQ ID NO: 198944 - DNA, 1071 bp, Artificial Sequence
  Description of Artificial Sequence: Synthetic coding sequence
atggccagcgtggccgtggacccccagcccagcgtggtgacccgggtcgtgaacttgcccctggtgtctagcacctatgacctaatgtcgtcagcgtacctctccactaaagaccagtacccctatctgaagtcagtctgcgaaatggccgaaaacggcgttaaaactatcactagcgtggctatgacaagcgccctgccgattatccagaaactggagccacaaattgccgttgcaaacacttacgcttgtaagggcctggatcgtattgaggaacgcctcccaatcctcaaccaaccgtccactcagatcgttgccaacgccaagggggccgtcacaggcgcaaaagacgcagtgactacgactgttacaggggccaaggattccgtagcctctaccattacaggcgtgatggataaaacaaagggagctgtgacgggtagtgtcgaaaaaacaaaaagcgtcaagaagaaacagaagaaattgaaggatctaatctggtttcgcagccagcttcactctactgtccacctcattgagttcgctcgcaagaatgtgtacagtgccaaccagaaaatccaggatgcgcaggacaagctgtacctgtcctgggtggagtggaagagaagcatcggttatgatgacactgacgagtcccactgtgccgagcacattgagagtcgcacgttagccatagccaggaatctgacgcagcagctgcagaccacctgtcacaccctgctgtcaaatatacaaggggtaccacagaatattcaggatcaagcaaagcacatgggcgtcatggctggcgacatctattctgtgtttcgcaatgcagcctcctttaaggaagtgtccgacagcttgctcacatcttctaaaggccagttgcaaaaaatgaaggagagcctggacgacgtaatggattacttggtgaacaataccccattaaattggcttgtgggcccgttttaccctcagctaacagaatctcagaatgcacaggaccagggggcagagatggacaagagtagtcaggagactcaacgatccgagcacaaaacccactag

SEQ ID NO: 198945 - DNA, 378 bp, Artificial Sequence
  Description of Artificial Sequence: Synthetic coding sequence
atggccagcgtggccgtggacccccagcccagcgtggtgacccgggttgtcaacctcccattagtctcgtccacatacgacctgatgtcatctgcctacctatccactaaagatcaatacccatacctgaagagtgtgtgtgagatggccgagaacggggttaaaactatcacttctgtggctatgacctccgcgttacctataatccaaaaattagaaccgcagatagccgtggcaaacacttatgcctgtaagggactggacaggattgaggagaggctgccaatcctaaaccaaccgagtacccagatcgttgcaaacgccaagggggccgtgactggagcaaaggacgctgttaccacgaccgtaactggatag

SEQ ID NO: 198946 - DNA, 735 bp, Artificial Sequence
  Description of Artificial Sequence: Synthetic coding sequence
atgggcccccccagcgccgccccccggggcggccaccggccctggcagggcttactgataactgcatcactcctgacgttctggcatcctcctaccacagttcagtttaccattgaggccctgccatcttccgccgccgagggcaaagacgtcctgctgcttgcatgcaacatatcagagacaattcaggcatactattggcataaggggaagacagcggagggcagcccattgatagctggctacattactgacatccaggccaacatcccaggcgccgcttattcgggtagggagacggtttacccaaacggatctctgctgtttcagaatattaccctcgaggatgcaggctcgtataccctaaggactattaacgcttcttacgacagtgaccaggcaaccggacagctgcacgtgcaccagaacaatgttccaggcttgcccgtaggcgccgtggccggaatagtgactggcgtgctcgtgggagtggcactagttgcagccctcgtttgtttcctgttgctgtctagaaccggacgagcaagcattcagcgggatctgagagagcaaccaccgcccgcctccactccaggccacggcccatcgcaccggtctacattctccgcgcctctgccttccccgagaaccgccacacccatttacgaggaattattatattccgacgctaatatctattgccaaatcgaccataaggccgacgtggtatcctag

SEQ ID NO: 198947 - DNA, 1269 bp, Artificial Sequence
  Description of Artificial Sequence: Synthetic coding sequence
atgagcgccgacggcgccgaggccgacggcagcacccaggtgaccgtggaggaacccgtgcagcagccttcagtcgttgaccgcgttgcatcaatgcccctgatttcaagcacctgtgatatggttagcgcagcttatgccagtaccaaagaatcataccctcacatcaagaccgtgtgtgacgccgcagagaaaggggtgagaaccctgacagctgcagcagtgtcaggtgctcagccaatcttgtccaagttggagccgcaaattgcatcagccagtgaatacgcccataggggtctcgataaattagaggagaatcttcctatactacagcagccaactgaaaaggtcagtggagcacaagagatggttagtagtgccaaagatactgtggccactcagctcagcgaggccgtcgatgctacccgtggcgccgtccagtctggcgtggacaagaccaaatcagttgtgactggaggcgtgcagtctgtgatgggcagccgattggggcaaatggtcctctctggcgtggacacagtgctggggaaatctgaagagtgggctgataaccatctaccgctcactgacgctgagctagcacgcattgcgacctcactagacgggtttgacgttgcatcagtccagcagcagcggcaggaacagagctactttgttcgcctcggttcactgtcagagcggctcaggcagcacgcctatgaacacagtctaggcaagctgagagccacaaagcagcgtgcccaggaggctcttcttcagttgtcccaggttttgtctttgatggagaccgtgaagcagggtgtcgatcagaagctggtggaaggccaggagaagctccatcaaatgtggctttcatggaaccagaaacagctccagggaccagagaaggaaccccccaagccagaacaggttgaatctagagcgctgacaatgtttagagatatcgcacagcaactgcaagccacttgtacatccctcgggtcctccattcagggcctccctactaatgtgaaggatcaggtccagcaagccaggcgtcaggtggaggatctgcaggctactttttcttcaattcattcattccaagatctgagctcatccatcctggcacagtctcgagagagggtcgccagcgcaagagaggcattggaccatatggttgagtacgttgcccagaacacccccgtcacctggttagtgggtcctttcgctccgggcattactgagaaggccccagaagaaaaaaaatag

SEQ ID NO: 198948 - DNA, 1392 bp, Artificial Sequence
  Description of Artificial Sequence: Synthetic coding sequence
atgagcgaggaggaggccgcccagatcccccggagcagcgtgtgggagcaggaccagcaaaacgtggtgcagagggtcgtcgccctcccgctggtgagagctacctgtactgcggtctgcgatgtgtatagcgccgcaaaggaccgccaccctttactcggctcagcttgccgcttggccgagaattgtgtgtgcggcctgactacccgtgccttagaccatgcgcagcctttgctggaacatcttcagcctcaactggccacaatgaacagtctcgcatgtcgcggactcgataaactcgaggagaaacttccatttttacagcagccctccgaaaccgtggttacttcagccaaagacgtggtggctagctctgtgacaggggtcgtcgacctcgccaggcgcggccgccgttggagtgtcgagctaaaaaggtccgtgtcgcatgctgtcgatgttgtgctggagaagtccgaggaactggttgaccattttctcccgatgaccgaggaggaattagccgcactggcggccgaggccgaaggcccagaagtcggtagtgtcgaagaccagaggcgtcaacaaggctacttcgtgcgcctggggtctctctctgcacgaatcagacacctcgcctatgaacactccgttgggaagctgcgacagagtaagcaccgcgctcaagacacgctcgcgcaactccaggagaccctcgaactgatcgaccatatgcagtgcggagtgaccccgacggccccagcttgtcccggtaaggtgcacgaactgtggggcgaatggggtcagcgccctccagaatctaggcgccggtcgcaggccgaactggagacactggtccttagcagatcattgactcaggagctgcagggcaccgtggaggctctcgagtcttcagtgcgtggactgcccgccggcgcccaggagaaagtggccgaagtgaggaggtccgtggacgcccttcaaacagccttcgctgacgcacgatgttttagggacgttcctgcggctgccctggctgaaggtcgagggagggtggcccatgcacatgcctgtgttgacgagctcctcgagcttgtggtccaggcggtgcctttgccatggctggtgggccctttcgctcccattttggtcgagcgtccagagcccctgccagatttagccgacctagtcgatgaggtcattgggggccctgacccacggtgggcccacttagattggcccgctcagcaacgggcctgggaagccgaacacagagacgggagcggtaatggcgatggagatagaatgggcgtggcgggcgatatttgtgagcaggaacccgaaacccctagctgcccggttaagcacacacttatgcccgaactggacttttag

SEQ ID NO: 198949 - DNA, 3768 bp, Artificial Sequence
  Description of Artificial Sequence: Synthetic coding sequence
atgaacggctacgccgagttcccccccagccccagcaaccccaccaaagaacccgttgagccccagcctagccaggtcccactgcaggaagatgtggacatgtccagcggctcatccggtcacgagacaaatgagaactgttcaacggggagagattcgcaggggtctgattgcgatgattccgggaaggaactgggcatgttagtcgagcccccagacgctcggcagagccctgatacatttagtctgatgatggccaagtctgaacataacccctctacaagcggatgttcctcagatcagagctcaaaggtggacacccacaaggaactcattaagacgctaaaagagctgaaggtgcatctgcctgcggataaaaaggccaaagggaaagctagtactctggcaactctgaaatatgccttgcgcagcgtcaaacaggtgaaggctaatgaggagtactatcaactgctcatgtcttctgaggggcacccctgcggggccgacgtgccctcttacactgtggaggagatggaaagcgtgaccagtgaacatatagtgaaaaatgctgacatgtttgctgttgccgtgtccctggtgtcaggcaaaattttatacataagcgatcaggttgcaagtatctttcactgtaaacgggacgcctttagcgacgccaagtttgttgagtttttagcaccacacgacgtgggcgtctttcactcatttactagcccatacaaacttccactatggtctatgtgttccggggcagatagctttacccaggagtgcatggaagaaaaatccttcttttgtcgggtgtctgtgaggaaatcacacgaaaatgaaataagatatcaccctttcagaatgaccccatacttggtaaaagtgcgggatcagcagggggcggaaagtcagctgtgctgtctccttttggctgaacgcgtgcatagtggatacgaggctccgaggattccgcccgaaaaacgcatcttcaccaccacccatactcctaactgcctgtttcaggacgtggacgagcgggccgtcccgctgctgggttatttaccccaggatctgattgagacccctgttttagtccagctccacccctccgacaggccactgatgctggccatacataagaaaattctgcagagcggcggacaaccattcgactactcaccgattcggtttagagcacggaacggagaatacatcactctggatacatcctggtcctccttcattaacccatggtcaagaaaaatatcatttatcatcgggcggcataaggtgcgcgtgggtcctctcaacgaggatgtgtttgcagcacatccatgcaccgaggaaaaagccctgcacccaagcatccaggaattgaccgagcagatacacagactgctgctgcaacctgtaccccacagcggatccagtggctacggcagcctcggctccaacggttcacacgagcacctgatgtcacagaccagcagttctgacagtaacggccatgaagattcaagacgacggcgagccgagatctgtaaaaacggcaataaaactaaaaacaggagccactactctcatgagagcggcgaacaaaagaaaaagtctgtgactgagatgcaaactaaccctcccgctgagaagaaggctgtgccagcaatggaaaaggattcactcggcgtctccttccctgaggaactggcgtgcaagaatcaacctacttgcagctaccagcaaatatcctgtctagattcagttatccgttatctggagtcatgtaacgaggctgctacactcaaacgtaaatgcgagtttcccgccaatgtgccagcgttgcgatcttctgataaacgtaaggccactgtgtcccctggaccacatgccggcgaggcagaaccacccagtcgagtgaatagtagaaccggggtgggaacccacttgacgtctctggcactcccgggtaaagcggaatctgtggcgtcgctgacttcccaatgctcatactcttccaccatcgtgcacgtgggcgataagaaaccacaacctgagttagagatggtggaggacgcagccagtgggccagagagccttgattgtctggcaggcccggcgctagcttgcggattatcgcaggaaaaagagccctttaaaaaactggggctgacaaaggaggtgctcgctgctcatactcagaaggaggaacagagtttcctgcagaagttcaaggagatcagaaaattgtcaatctttcagagtcactgccactactatctgcaggagaggagcaagggccagccgagcgagcggactgcacctggattgcgcaatactagcggcatcgattctccctggaagaaaaccgggaagaatagaaagttgaagagtaagcgggtaaaacctagagattcctcagaaagcaccggatcaggaggaccagtgtcagctcggccgccgctggttggactgaacgctactgcctggagcccctccgacacgagccaatcttcctgtccggccgtgccatttcctgctcctgttcctgccgcatactctctcccagtgtttcctgccccaggtaccgtagctgccccacctgccccccctcacgcaagtttcactgtccccgccgtcccagtggatctccagcaccagtttgccgtgcagccgccaccctttccagcccccttggcacctgtgatggcattcatgctgccttcttacagtttcccctcaggcactcccaatctgccccaagccttctttcccagtcaaccacagtttccttctcaccccactctgacgtcagagatggcctcggccagtcagcctgagttcccgtctagaacttccataccacgccagccttgtgcgtgcccggctacccgagccactcccccctccgctatgggaagggcaagccccccccttttccagtcccgaagctcttcccctctccaactgaatctacttcaattagaggaagccccagaaggcggtaccggagccatgggcacaactggcgccacggaaactgcagcagttggagccgattgtaagcctggcacctcccgggatcagcagcccaaggcaccactcaccagggacgagccgagcgatacgcaaaactctgatgccctcagcactagctccgggctgctgaacctcctgcttaatgaagacctatgctccgcctctggctccgctgcctccgaaagtctagggagtggatccctgggatgcgatgcttccccctccggggcaggcagttccgataccagtcatacctcgaagtactttggctcaattgactcctccgaaaataatcacaaggccaaaatgaacacaggaatggaggaatctgaacattttattaaatgcgtgctacaggatcctatttggctgctgatggcggacgcagattcctcagtgatgatgacatatcagctccctagcaggaatctggaagctgttcttaaagaggaccgcgagaagctcaagttactgcaaaaacttcagccccgtttcacagagagccaaaagcaggaattacgtgaggtccaccagtggatgcagactggcgggttacctgcagcaatcgatgtggcagagtgtgtgtattgtgagaacaaagaaaaagggaacatttgcatcccctacgaggaggacattccctccttagggctgtccgaagtgagcgataccaaggaagatgaaaatgggagtccgctgaatcataggattgaagagcagacgtag

SEQ ID NO: 198950 - DNA, 1215 bp, Artificial Sequence
  Description of Artificial Sequence: Synthetic coding sequence
atgaacggctacgccgagttcccccccagccccagcaaccccaccaaagagcctgtggagccccaaccttcccaagtccccctgcaagaggatgttgatatgtcgtctgggtcctcaggccacgagactaacgaaaactgcagtaccggacgggatagtcagggcagtgattgcgatgactccggaaaggaactgggtatgctggtggagccccccgatgccagacagtcgcctgacaccttcagcttgatgatggccaagtccgagcacaaccccagcacaagtgggtgttcgagcgatcaaagcagtaaggtggatacgcacaaagagttgattaagaccctaaaagaattgaaagtgcatctgccggccgataaaaaggcaaagggaaaagcttccacactggccaccctgaaatatgcgttgcgctctgtgaaacaggtaaaagcaaacgaagaatattatcagctgctaatgtcctccgaggggcatccctgtggagccgatgttcccagttacactgtggaggagatggagtccgtgacgtccgagcatattgttaaaaacgctgacatgttcgctgtggccgtcagcctcgtctcaggaaagattctttacatcagtgaccaggtcgccagcatcttccattgtaagcgggacgcatttagtgacgccaaattcgttgaatttttggccccccacgacgttggcgtgttccattctttcaccagcccatataagctgccgctgtggagtatgtgcagtggcgccgatagcttcacgcaggaatgcatggaagagaagagtttcttctgcagagtctcagtccgtaagtcccacgagaatgaaataagatatcaccctttcagaatgaccccatacctggttaaggtccgtgaccaacaaggcgcagagagtcagctgtgctgcctgttgctggccgaacgcgtccacagcggttatgaggcacctaggattcctcccgaaaagagaatttttactaccactcacacgccgaattgtctgtttcaggacgtagacgagtcacctgcggtgcggcgagcagctttcagactcttttcacactctgtaagtcggcccgagagaagagtgcaccacgtgggccatcaacttgtgcagctgcatcaaccaatggaacaggaaaatctgttgcaccattgggaggcacagtcacagggaggcccattcgagtag

SEQ ID NO: 198951 - DNA, 1215 bp, Artificial Sequence
  Description of Artificial Sequence: Synthetic coding sequence
atgaacggctacgccgagttcccccccagccccagcaaccccaccaaggaaccagtggaaccccagccctcccaggttcctttacaagaagatgtggatatgtcctctggctcatcaggccacgagacaaacgagaattgtagcaccggcagggatagccagggttccgattgcgatgacagcggcaaggaactcgggatgctagtggagcccccagatgcccgacagagtcctgacacattttctttgatgatggctaaaagcgagcataatccttcaacatctggttgttcgtctgatcagtcctcaaaggtggatactcataaggaacttataaagactttgaaggagttgaaggttcacctgccggcagacaaaaaggctaaagggaaagcaagtacactagccaccctgaaatatgcgctgaggtcggtgaaacaggtcaaggccaacgaggaatattaccagttgttaatgagttcggaggggcacccttgcggcgcagatgtaccttcatataccgtggaggaaatggagtccgtcacatcggagcacatagtgaaaaatgccgacatgtttgctgtggcagtgtctctcgtcagtggaaagatcttatatatttccgatcaggtggcgagtatcttccattgcaaaagggacgcgtttagcgacgcgaagtttgtggagttcctcgcgccacatgacgtgggagtctttcactcattcacatccccttacaaactgccattatggtcaatgtgctctggtgcggatagctttacccaggagtgtatggaagagaagtcattcttctgtagggtaagcgtgcggaaatcccatgaaaacgagattcggtaccaccccttccggatgacaccttatctggtgaaggttcgcgatcagcagggtgccgaatcccaactttgttgtctgctgctcgcagagagggttcactccggctacgaagctcctcgcatccctccagagaaacgcatttttacaactacccacacacccaactgtcttttccaggatgtggacgagtccccagcagttaggcgggctgcgttccggctgttttcacactccgtctcccgaccagagaggcgggtgcaccacgtgggacatcagctagtccaactccatcagccgatggagcaggagaatctactccaccattgggaggcgcagtctcagggtggaccattcgagtag

SEQ ID NO: 198952 - DNA, 330 bp, Artificial Sequence
  Description of Artificial Sequence: Synthetic coding sequence
atgaacggctacgccgagttcccccccagccccagcaaccccaccaaagagcccgttgaaccacagccaagtcaggtccctttacaggaggatgtggacatgagttctgggtcctctggtcacgagacaaacgagaactgcagtacagggcgcgattcccagggatctgactgcgatgattcaggtaaagagctgggaatgctcgtcgaaccccctgatgccagacaatcccccgatacattctccctaatgatggctaagtctgagcacaacccctccaccagtggctgttccagcgaccaatcctccaaagtcgacactcataagtag

SEQ ID NO: 198953 - DNA, 1452 bp, Artificial Sequence
  Description of Artificial Sequence: Synthetic coding sequence
atgaacggctacgccgagttcccccccagccccagcaaccccaccaaagagcctgtagagccacagcccagccaggtgcctcttcaggaggacgtagatatgtcctcagggagctcaggccatgaaacaaacgaaaattgtagtacaggcagagattcccagggaagtgactgcgacgacagcgggaaggaattgggcatgttagtggagcctcccgatgctcggcagtcccccgacactttcagtctcatgatggccaaatccgaacacaatccaagcacaagtgggtgcagtagcgaccagtcctccaaggttgatacgcataaagaattgattaaaactctgaaggaactgaaggtgcatctaccagctgataagaaggcgaaaggaaaagcgtccaccctggctacattaaaatacgctttacggtccgtaaagcaggtgaaagctaacgaggagtactaccaactgctgatgagttccgaaggccacccttgtggggcggacgtcccatcctacaccgtcgaggagatggaatccgtaactagtgaacatatcgtgaagaatgcagacatgtttgccgtcgccgtctccctggtttcagggaagattctgtacatctcggatcaggtggcgagtattttccactgtaagcgagatgcattttccgatgccaagttcgtggaattcctggcacctcacgatgtgggagtcttccactcgttcaccagcccgtataagctgcctctatggtccatgtgtagcggagcggattctttcacgcaggaatgcatggaagagaagtccttcttttgcagggttagcgtcaggaaatcccacgaaaatgagatccgctaccatccctttcgcatgacaccgtatctcgtcaaagtgcgagatcagcagggagcagagtctcaactgtgctgcctgctcctggccgagagggtccatagcggatacgaggctcctagaataccacccgagaagagaatcttcaccaccacccacacacctaattgcctgtttcaggatgtggatgaacgcgctgtccccttgctgggctatctgcctcaagatctgatcgagacgcccgtcctggttcagttgcaccctagtgaccggcctttaatgctagccatccacaaaaaaattttgcaaagcggcggccagcctttcgattactcccccattcggtttcgcgccaggaacggcgagtacataactctcgatacctcatggtcatcatttatcaacccatggtctcgcaagatttcttttatcatcgggcgccataaagtgcgcgtgggccccctcaatgaagatgtattcgcggcccatccatgtacggaggagaaggccttacatccctccatccaagagctgacagagcagatccaccggctgctgcttcaggtcggagtagtgccggcatgccccccacctcgttag

SEQ ID NO: 198954 - DNA, 2340 bp, Artificial Sequence
  Description of Artificial Sequence: Synthetic coding sequence
atgatccccttcctgcccatgttcagcctgctgctgctgctgatcgtgaatcctataaacgccaataaccattacgataaaattctagcgcacagtcgcatacgtggcagagaccagggacccaacgtttgcgcactccagcagattctgggaactaaaaagaagtatttcagtacgtgcaagaattggtataaaaaatctatttgcgggcagaaaacaacagtgctgtacgagtgctgtcccggatatatgagaatggagggcatgaaggggtgccccgccgtcctcccaattgaccacgtatacggcaccctcggcatcgtcggcgctactacaacgcagagatattcagacgcaagcaagctgcgagaagagattgaaggtaaaggctcctttacctatttcgcccctagcaacgaggcctgggacaatctcgattcagacattagaagagggctggaatccaacgtcaacgtcgagctgctgaacgcactacacagccacatgatcaataagcggatgttgaccaaggaccttaagaacgggatgattatacctagcatgtacaacaacctaggactctttatcaatcactaccccaatggagtcgtgaccgtgaattgcgccagaatcattcacggcaatcaaattgctacaaacggcgtagttcacgtgatagatcgagtgttgacacaaatcggtacttcgatacaagattttatcgaggccgaagatgacttgtcaagctttcgcgccgctgccataaccagcgatatacttgaggccctgggaagagacggccacttcacactttttgcccccactaacgaggcatttgaaaaactgccaaggggcgttctggaacgcattatgggcgacaaggtggcctctgaggccctcatgaagtaccatattcttaataccctgcaatgctctgaaagcataatgggcggggcggtcttcgagaccctggaagggaacactatcgagataggctgtgatggcgattctatcactgtgaatgggatcaagatggtaaataagaaggacattgtgaccaataatggggtcatccacctgatcgatcaggtccttatccccgattccgcaaagcaagtaatcgaattggcaggaaagcaacaaaccactttcacggatctggtagcgcagttaggtttggcgagtgccttaaggcctgacggtgaatacaccttgttggcgcccgtcaacaatgccttttccgacgatactctgtccatggatcagaggcttctgaagttgatattgcaaaatcacatcttgaaggtgaaggttggcctgaatgaactgtacaatgggcagattttggagacgattggagggaagcagttgcgagtcttcgtgtatcgaactgccgtgtgcatcgagaattcctgtatggagaagggatctaagcaggggagaaatggcgcgattcatattttcagggagatcattaagcctgcagaaaaaagtctgcacgagaagctgaagcaggataaacgtttttctacatttctctcactcctcgaagccgctgacctcaaagagcttttaactcaacccggggattggaccctcttcgtgcctactaatgatgcattcaaaggcatgacctctgaagaaaaggaaatactaatccgggacaagaatgctctgcagaacatcatcctgtaccacctgacccccggcgttttcataggaaaaggattcgagcccggagttaccaacattctgaagaccactcagggatctaagatattcctgaaggaggtgaacgatacactgctggtcaatgagctgaaaagcaaggagtcagacatcatgactaccaacggtgtgattcacgttgtcgacaaattgttatatcccgctgatacccccgtcgggaatgaccagctgcttgagatactgaataagcttattaaatacatccagatcaagtttgttcggggaagcacctttaaggagatccccgtaaccgtctacaagcctattattaagaagtacactaaaattatcgatggagttcctgtcgagattaccgaaaaagagacgcgcgaagaaagaatcataacaggccccgagattaaatatacacggatctccacaggagggggagagacggaggagaccttgaagaaactcctccaagaggaagtgaccaaagtgaccaaatttattgagggcggggacggacatctgtttgaagatgaggagataaagcgattattacagggtgatacccccgtgcgtaagctgcaggccaacaagaaggtgcagggctcacgtcggcggctgcgcgagggacgatctcagtag

SEQ ID NO: 198955 - DNA, 2430 bp, Artificial Sequence
  Description of Artificial Sequence: Synthetic coding sequence
atgatccccttcctgcccatgttcagcctgctgctgctgctgatcgtgaacccaatcaacgccaataatcattatgacaagattcttgctcactctaggattagaggtcgcgaccagggtcctaatgtgtgtgccttacagcagatcttaggcacaaaaaaaaagtacttttccacatgtaagaattggtacaagaaatccatctgtggacagaagaccacggtactatatgagtgctgtcctggatatatgcgcatggagggcatgaaggggtgtcctgccgtactcccaatcgatcacgtctatggcactctgggaatagtaggtgctacgactacacagcgatactccgatgcttccaagctgagggaggagatagaggggaaaggctcatttacatacttcgcccctagcaacgaggcctgggacaatctggactcagatatccgacgggggcttgagtcgaatgttaacgtggaactattaaatgccctccacagccacatgattaacaagcgcatgctcacgaaggaccttaaaaacggtatgataattccgagtatgtataataacttgggcctctttattaatcattatcccaacggtgtggtgacggtcaactgtgcacgaatcattcacggcaaccagatcgctactaacggagtggtgcatgtgattgaccgtgttctgactcaaataggcacatccatccaggacttcattgaggctgaggacgatctgtcttctttcagagccgcagccattacttcagacatcctggaagctctgggacgagatggccactttacacttttcgcgccaacaaacgaagcattcgagaagctgcccaggggggttctcgaaagaatcatgggcgataaagtcgcttcagaggcgctgatgaaataccacatcctgaacacactgcaatgtagcgaaagcataatgggaggtgcggtctttgaaacactcgagggaaataccattgagatagggtgtgatggtgattccataacagtgaatggcattaaaatggtgaacaagaaagacattgtgactaacaacggggtgattcacttaattgatcaggttttgatccctgattctgctaaacaagttatagaactggctgggaaacagcaaactacctttaccgacctggtggctcaactcggcttagcgagcgcccttcggccagatggcgagtacactctcttagcgccagtgaataacgccttttcggacgacaccctgtcgatggaccagagactcctgaagctgatccttcaaaaccatatactaaaggtgaaggtagggctgaatgagctatataacggacagattttggagaccattggcgggaagcaactgcgagtgttcgtgtaccggaccgctgtctgcatcgagaattcctgcatggagaaggggtcaaagcagggaagaaacggagcaatacatatctttcgcgagattattaaacctgctgagaagtctctccacgagaaactcaaacaggacaagaggttttcaacattcctttcgttgttagaggctgccgatctgaaagagctgctgacccagcccggagattggactctgtttgtgcccacaaacgatgccttcaaaggcatgacatctgaagagaaggagatcctgatcagagacaagaatgcgcttcagaacataattctctatcatctgacccctggggtgtttatcggcaaagggtttgaaccaggggtgacaaatatactgaaaacaacccagggaagtaaaatctttctgaaagaagtaaatgatacgttactggtgaatgagcttaagtccaaggaatcagacattatgacgactaatggagtcattcacgttgtggataagcttctttaccccgccgatacgccagtagggaatgatcagctgctggagattttaaataaactgatcaaatacatacagataaaatttgttagagggtccacttttaaagagatacctgttaccgtgtataggccgaccctgacaaaggttaaaattgagggcgagcctgaatttagattgattaaagagggcgagacaatcaccgaggtgatccacggtgagcctattattaaaaagtacacaaagattattgacggagtcccagtggagattacagaaaaagaaacgcgggaggaacgcattatcacaggccccgagattaagtacacccgtatcagcacagggggtggcgaaacggaggagaccctgaagaagctgctgcaggaggaggtgaccaaggtcacgaagtttattgaggggggagacggacacctcttcgaggatgaggagattaagaggttactccagggggataccccagttaggaagctacaggcaaacaaaaaggtgcagggctctaggagacgattgcgggaaggcagaagtcagtag

SEQ ID NO: 198956 - DNA, 2511 bp, Artificial Sequence
  Description of Artificial Sequence: Synthetic coding sequence
atgatccccttcctgcccatgttcagcctgctgctgctgctgatcgttaatcctattaacgccaataatcattatgacaagattctcgctcactcgcggattcgtgggcgggaccaaggacctaatgtgtgcgcccttcaacaaattctgggcacaaagaaaaagtatttttccacatgcaagaattggtacaaaaagtcaatctgtggacagaagactactgtcctttatgaatgctgtcccggctatatgagaatggaaggcatgaagggctgccctgctgtgttacccatcgaccacgtctatggcaccctggggatcgtgggagccacgacaacacagaggtactcggatgcatccaagctgcgcgaggagatcgaggggaaaggttctttcacatatttcgccccgagtaacgaagcttgggacaatctggacagcgacatacgacgcggactcgagagcaacgtgaatgttgaattactaaatgccctccactcccacatgatcaacaagaggatgcttactaaggatcttaaaaacggcatgatcatcccctcaatgtacaataacctaggtttattcattaaccactaccccaatggcgtggtaacagttaattgtgcaagaataattcatggtaatcaaatcgccaccaacggcgtcgtgcatgtgatcgacagggtactgacccagataggcacgtccatccaggatttcatcgaagcagaggatgacctgagctccttccgagctgcggctatcacttctgacatcctggaggcactaggtagagacggccacttcactctgttcgcccctacaaacgaggccttcgagaagttgcctagaggagtactcgaaaggattatgggtgacaaagttgctagcgaggcgttgatgaaataccacatcctcaacactctgcaatgctctgagagcattatggggggagctgttttcgagacactggaaggcaacaccatcgagattggatgcgacggagacagcataaccgtgaacgggatcaagatggtgaataaaaaagatatcgtgaccaacaacggcgtcattcacctgattgatcaggtgctgatacctgactcagctaaacaggttatagaactggcaggaaagcagcagactacatttaccgatctcgtggcccagctcgggctggcttctgcccttaggccagatggggaatacaccctcctcgccccagtgaacaatgcttttagtgacgatacactctccatggatcagaggttgctcaaacttatcctgcagaatcatatcctcaaggtcaaagtcggactgaatgagctctataacggacagatactcgagacgattggcggtaaacagctccgtgtgtttgtgtatcggaccgcagtctgcattgagaatagctgcatggaaaagggctctaagcaggggaggaacggtgcgattcacatctttagagaaatcattaaacccgcggagaagtctttgcatgagaagctgaagcaggataagcggttctcgacgttcctcagtcttctcgaagccgcagatctaaaagagctgttgacccaacccggcgactggaccttgttcgtgcctacgaatgacgcttttaaggggatgacctctgaagagaaagagatcctgattcgcgacaagaacgctctccagaatatcatcctgtatcacctgacccctggcgtcttcatcggaaagggcttcgagccgggggtcacgaatatactgaagactactcaggggtcgaagatctttctcaaagaagtgaatgatacgttgctcgtgaacgaactgaaaagcaaggaatccgatataatgactactaacggggtgattcacgtggtggacaaacttctgtatcctgccgatacccccgtgggcaacgatcagctcttggagatcctgaacaagctgattaagtacatacagattaagttcgtcaggggttctacctttaaagaaatccctgttaccgtgtacacgacaaaaatcattacaaaggtagtggaaccgaagattaaggtgatcgaaggaagcttgcagccaatcattaagacagaaggcccaacgctgacaaaggtgaaaatagaaggggagccggagttcagactaatcaaggagggggaaactatcacagaggtgattcacggggaaccaataatcaagaagtacaccaaaatcattgacggcgtaccagtcgagattacagagaaggaaactagggaggaacgcattatcacaggcccagagattaagtacacccgtatttccaccggaggcggcgaaaccgaggagactctgaagaaactgcttcaggaggaagtgaccaaggtcacgaagtttatagaagggggcgatggacacctgttcgaagatgaggagatcaagcgtctgctgcaaggcgacaccccagttcggaaattgcaggcgaataagaaagtccagggatctagaaggcgtcttagagaaggccgctcccagtag

SEQ ID NO: 198957 - DNA, 2427 bp, Artificial Sequence
  Description of Artificial Sequence: Synthetic coding sequence
atgatccccttcctgcccatgttcagcctgctgctgctgctgatcgtgaatccaattaatgccaacaaccactatgacaagattcttgcccattcccgaatacgcggcagggatcaggggcctaatgtgtgtgctcttcagcagatcctcggaactaaaaaaaaatacttcagtacttgcaagaattggtataaaaagagtatatgcggtcagaaaacgacagttctatatgagtgctgtcctggctatatgcgcatggaaggtatgaaaggctgccccgccgtgctgcccattgatcatgtatatggaacactgggaatcgttggagctacaactactcagcgttattctgatgctagtaagctcagggaagagattgaaggcaagggcagctttacctactttgcgcccagtaacgaagcctgggacaacctcgatagcgacatcaggaggggtttagaatccaatgtgaatgttgaattactgaacgcactgcactctcacatgatcaacaagcgcatgctgacaaaggatctgaagaatggcatgatcatccctagcatgtataataacttagggttgtttattaatcattatcccaatggcgtggtaacagtcaattgtgctcgtattatccacgggaatcagatagccacaaatggagtcgtacatgtgatagacagagtcctgacccaaatcggcacaagcattcaggattttatagaggcagaggatgacctttcttcttttagagccgccgctattactagcgacattctcgaagctcttggtcgagacggccacttcacattgttcgcccctacgaacgaggctttcgaaaagctcccccgaggagtgctggagaggattatgggagacaaggtcgcctccgaagccctgatgaaataccatattctgaataccctccaatgctccgagtcaatcatggggggtgcggtcttcgaaaccctggaagggaacaccattgaaattggatgcgatggggacagcatcacggtgaatggcatcaaaatggtcaacaagaaagacattgtcacgaataacggagtgatccatcttattgaccaggtgcttatccccgacagcgccaagcaggtgattgaattagccggcaagcagcagactacttttaccgatctcgtagcacagctcgggcttgcctctgcactgaggccagacggagagtatacactcctcgcgcctgtcaacaatgcattctcagatgacacactaagtatggatcagagactgcttaaactgatccttcagaatcacattctgaaggtgaaagttggcctgaatgagctttataatggacagattctggagaccataggaggaaagcagctgcgtgtcttcgtgtatcgtacggctgtttgtattgaaaacagttgtatggaaaagggtagtaaacaggggcgtaacggcgctatccatatttttcgggagataattaagccagcggaaaaatctctgcatgagaaactcaaacaggacaaaagattcagcacctttttatccctgctggaagcagctgatcttaaggagcttctcactcaacctggagactggactctgtttgtgcccacgaacgacgccttcaaaggcatgacatccgaggagaaggaaattctaattagagacaaaaatgcgcttcagaatatcatcctttaccatctgacacccggcgtgttcattggcaagggtttcgaaccaggtgtgacgaacatactcaagacgacccaaggctcaaagattttcctgaaggaggttaacgataccctgcttgtgaacgagctcaagtccaaggagtctgacatcatgaccacaaatggagttatccacgttgttgataagctcttgtacccagccgacacacctgtgggcaacgaccagctcctagaaatactgaacaaactcattaagtatattcaaataaagtttgtgaggggctctacctttaaggagattcctgtgacagtgtatacgacaaagatcatcaccaaggtggttgaaccaaagattaaagtgatcgaaggcagcctgcagcctatcatcaagacagaaggtccaacactcaccaaggtcaagatcgagggcgagcccgagtttcgtttgatcaaggagggcgagactataacagaggtcatacatggcgaacccataatcaaaaagtataccaagatcattgacggggtccccgtggaaatcaccgagaaggagacccgcgaggaacgcattatcaccggcccagaaattaaatatacacgcatctctactggtgggggggagacagaagagaccttaaaaaagctcctccaagaggatactcccgtgcgcaagctgcaggctaataaaaaggttcaggggtcacggaggcgtctgagagaaggaagatcacagtag

SEQ ID NO: 198958 - DNA, 834 bp, Artificial Sequence
  Description of Artificial Sequence: Synthetic coding sequence
atgcggatggagggcatgaagggctgccccgccgtgctgcccatcgatcatgtctatgggaccctgggcatagttggagctacgacaactcaacgttactctgacgcgtccaaactgagagaggagatagaaggaaaggggtcctttacatatttcgcccctagcaatgaggcctgggataatctggatagcgatatcagacggggcctggagtccaatgtgaatgtcgaactcctgaacgctctccatagccacatgataaataagagaatgcttacaaaagacctcaagaacgggatgattatcccctccatgtataacaaccttggcctgttcattaaccactatcctaacggcgtagttactgtcaattgcgctcggataattcatggaaatcagatcgcaacaaacggggtcgtccacgtgattgaccgagtgctgactcagataggcacatctatccaggacttcattgaagctgaggatgacctgagttccttcagagctgctgcaatcacttcggatatcctagaagctctcggacgggatggacacttcacgctcttcgcaccaactaatgaggccttcgagaaactgccgcgtggcgtgctggagcggatcatgggcgacaaggtcgcttcggaagcactgatgaaataccacatcctgaacacactgcaatgcagtgaatctattatgggcggcgccgtttttgaaacactcgaaggcaacacaattgagataggatgcgacggcgactctatcacagttaatggaattaaaatggtaaacaaaaaggacatagtaaccaattggtgcgacccttttgactag

SEQ ID NO: 198959 - DNA, 2346 bp, Artificial Sequence
  Description of Artificial Sequence: Synthetic coding sequence
atgatccccttcctgcccatgttcagcctgctgctgctgctgatcgtcaatcccattaatgctaataaccattacgataagatactggcacattcacgaattcggggtagggatcagggcccaaacgtttgcgccctgcagcagattctgggtacaaagaagaaatatttcagcacctgcaagaactggtacaagaaaagcatctgcggacagaagacaacagtgctttacgagtgctgtccaggctatatgagaatggagggcatgaagggctgtcccgccgtcttgcccatagatcacgtgtacggcaccctgggcattgtcggagcaacaaccactcaacggtactccgacgcatccaaactgagagaagagatcgaggggaaagggtcttttacctacttcgcacccagcaatgaagcctgggacaacctggatagcgacattaggcgcggacttgagagtaacgttaatgtcgagctgctaaacgctttgcattcacacatgattaacaaaaggatgctaactaaagatctgaagaacggcatgatcatcccaagcatgtataataacttgggactgtttataaaccattatccaaatggcgtggttaccgtcaattgtgcccggattattcacggtaatcaaatcgccaccaacggggtggtgcatgtgatcgatagagttctgacccagatcgggaccagcatccaagatttcattgaagcagaggatgacctgtcatcctttcgagcagcagctattacaagcgacatcctagaggcattgggacgcgacggccatttcaccttattcgccccaactaacgaagcgtttgagaaactacccagaggcgtcttagagcgcattatgggcgacaaggtcgcctcagaggccctgatgaagtaccacatcttgaacactctccagtgctctgagtctatcatggggggtgccgtgtttgaaacactggaagggaatacaattgaaatcgggtgtgatggggactctatcacagtgaatggaattaaaatggtcaataagaaagatattgttactaataatggagtgattcatttgatcgatcaagtgcttatccctgacagcgccaagcaggtgatcgagttagccggcaaacagcagacaacctttactgaccttgtggcgcagctgggtctggccagtgctctgaggcctgacggagagtatacattgctggcaccggtgaataacgccttttctgacgatactctgtctatggaccagcgcctgctcaaactcattctccagaatcacattctgaaggtgaaagtgggcctcaatgagctgtacaatggtcaaatccttgaaaccatcggtggtaaacaactgcgcgtgttcgtgtacaggacggctgtgtgcatcgagaatagctgcatggagaagggctcaaagcagggccggaacggggcaattcacatttttcgtgaaataattaaaccagccgagaagtctcttcatgagaagctcaaacaggataagcgcttctccacattcctgagtctgctcgaggccgccgacctgaaggagctactaacacagcccggagattggacattgtttgtacctaccaatgacgctttcaaaggtatgacgtccgaggagaaggagatcctcattcgggataaaaacgccttacagaatataattttataccacctcacccctggcgtgtttattgggaagggctttgagcccggagtcactaacattcttaagaccactcagggctccaaaatcttcctcaaggaggtgaatgatacactcctcgtaaacgaacttaagagtaaggaatcagacatcatgaccactaatggagttatccacgtggtggataagcttctttaccctgcagatacccccgtaggcaacgatcaactgcttgaaattttaaataaattaatcaagtatatccagatcaagttcgtccgggggtcgacatttaaggaaatcccagttacagtatataggcccaccctgacgaaagtgaaaatcgaaggagagccggagtttcgactgatcaaggaaggggagaccattactgaggtgattcatggagagccaattattaagaagtatactaagatcattgatggcgtccctgtggagattaccgagaaggagacacgtgaagaacgcattatcaccgggcctgagatcaagtacacacgaatctctacgggcggtggagagacggaggagaccctgaagaagctgctacaggaagacactcctgtaaggaagctccaggcaaataagaaggtccagggttcccgcaggcgcttgcgagaaggacgatcccagtag

SEQ ID NO: 198960 - DNA, 2250 bp, Artificial Sequence
  Description of Artificial Sequence: Synthetic coding sequence
atgatccccttcctgcccatgttcagcctgctgctgctgctgatcgtgaatcctatcaatgccaacaaccactatgacaaaatcttagcacatagccgcattcgtggaagagatcaaggtccaaacgtttgcgccttacagcaaattctcggcactaagaaaaaatacttctctacatgtaaaaattggtataagaagtccatatgtgggcaaaagactacagtgctgtacgaatgttgtcctggctatatgagaatggaaggcatgaaaggctgccctgccgtacttcctatcgatcacgtgtacggcaccctcggcattgtgggggccactacaactcagaggtattcggatgcgagtaagctgcgcgaggagatcgaaggtaagggctcttttacatactttgccccatccaacgaggcatgggacaacctggattccgatattcggagaggacttgagtctaatgtcaacgtagaattgctgaatgcactgcacagccacatgattaacaagaggatgttgacgaaagatctcaaaaatgggatgataattccaagcatgtataataatctggggttgtttataaatcactaccccaacggtgtggtgacagtgaattgcgcaaggatcatccacggcaaccagatcgccactaacggtgtggtgcacgtaattgaccgagttttgactcagataggcacctccatacaggattttatcgaagcagaagacgacctctcctcgtttcgggctgcagctatcaccagcgatatcttagaagctctggggcgagacggacatttcaccctgtttgccccgaccaacgaggccttcgagaagctgccaaggggagtcctggagaggattatgggcgacaaggtggcctcagaggcgctcatgaagtatcatatactcaacactcttcagtgcagtgagtccattatggggggagctgtcttcgagaccctggaaggaaatacaattgagataggatgcgatggagactcaatcacagtaaacggaatcaagatggtcaacaaaaaagatatagtcacaaataacggtgtaatccacctgatagaccaggtgcttattcctgatagtgcaaagcaggtaatcgaactagctggcaagcagcagactacatttacagatttggtagcccagctggggctggcgagcgctctgaggcctgatggcgagtatacgctgttggccccagtgaataatgctttttccgacgatactctgtcaatggatcagcggctgctaaagctgatccttcagaaccacattctgaaagtgaaagtggggctaaatgaattgtacaacggtcaaatactggaaacgattggcggtaagcagctccgggtctttgtttaccgtacagccgtttgtatcgaaaactcttgcatggaaaagggcagcaagcaaggacgaaacggtgccatccacatcttccgagagattatcaagcctgccgaaaagtcactacacgaaaagctcaaacaggacaagcgattttcaacatttttatccttgctggaggcagcagacctgaaagagctgcttacacaacctggcgactggacattgttcgtgcccaccaatgatgcctttaaagggatgacgagtgaggaaaaggagatactgattcgcgataaaaatgccttgcagaacataattctgtatcacctcacgcctggcgtctttatcgggaaagggtttgagcctggcgttaccaatattctgaaaaccacacaaggaagcaaaatctttctaaaggaggtcaacgacacgttactggtgaacgaactcaagtccaaggagtctgatatcatgacaactaacggggtgattcatgttgtggacaaacttctctaccccgctgacactccagtgggcaacgatcagctcctggagattctgaacaagctgataaaatacatccagatcaaattcgtgagggggagcacatttaaggagatacccgttaccgtctattcccccgagatcaaatatacgcggatctccactggaggaggtgagacggaggaaacgctcaaaaagcttttgcaggaggaggtcacaaaagtgaccaagttcattgagggcggtgatggacacctattcgaggatgaagagatcaagcggttgttgcagggggatacacccgttaggaagctgcaggccaataagaaagtccaggggagcaggcgccggcttcgggagggtagatctcagtag

SEQ ID NO: 198961 - DNA, 399 bp, Artificial Sequence
  Description of Artificial Sequence: Synthetic coding sequence
atgagcaacaagttcctgggcacctggaagctggtgagcagcgagaatttcgacgattacatgaaggcgcttggggtgggtctggccacacggaaacttgggaacctggccaagccaactgtgattatttcgaagaaaggcgatatcataactatccggacagagtctaccttcaaaaacacagaaattagttttaagctgggtcaggaattcgaggagactacagctgataaccgcaaaacaaagagcatcgtcacattgcagcgcgggtccttgaatcaggtgcagaggtgggatgggaaggaaactacaatcaagaggaagttggtcaacgggaagatggtggcagagtgcaagatgaagggcgtggtctgcacgagaatctatgagaaagtgtag

SEQ ID NO: 198962 - DNA, 483 bp, Artificial Sequence
  Description of Artificial Sequence: Synthetic coding sequence
atgctgctgctgctgctgagcatcatcgtgctgcacgtggccgtgctggtcttgctttttgtttctacaatcgtgtcacaatggatcgttggtaacgggcacgcgaccgacctgtggcaaaattgttcaaccagctctagtggaaatgtgcaccattgtttttcatccagcccaaacgagtggctgcagagcgtccaagccaccatgatcctatccatcattttttcaattctgtcactttttctattcttctgccagctttttacactgaccaaaggtgggcgcttttatatcaccgggatctttcagatcctggctggactttgcgtaatgtcggccgcagctatttataccgtcaggcaccctgagtggcacctcaactctgattacagttacggcttcgcttacattttggcatgggtagcattcccattagcactcttgagcggagttatttacgtaatcctgcgtaagcgggagtag

SEQ ID NO: 198963 - DNA, 357 bp, Artificial Sequence
  Description of Artificial Sequence: Synthetic coding sequence
atgctgctgctgctgctgagcatcatcgtgctgcacgtggccgtgctagtactgctgttcgtgtcaaccattgtctcacagtggatcgtcggaaacgggcacgccactgacctgtggcagaattgctccacctcttcttccggcaatgtacaccattgcttttcctcatctccaaacgagtggctccagtccgtgcaggctactatgatcctttctatcatctttagcattttgagtttattcctcttcttctgccaactgtttaccctgactaagggcggccggttttacatcaccggaatttttcagatcctagcggaatcaaattcctcgcagatgtgtggttatagagactag

SEQ ID NO: 198964 - DNA, 483 bp, Artificial Sequence
  Description of Artificial Sequence: Synthetic coding sequence
atgctgctgctgctgctgagcatcatcgtgctgcacgtggccgtgcttgttttgctgttcgtttcaaccattgtgtcacagtggatcgtgggcaacggtcacgccacggacctgtggcagaattgttcaacttccagtagcggcaacgtccatcactgtttctctagctcccccaatgagtggcttcagagcgtgcaagccacaatgatcctgtcaatcatcttctctatactgtctctattcctgttcttctgtcagctgttcaccctcacaaagggcggaagattttatatcaccgggatctttcagatactggcaggactctgtgttatgtctgctgccgctatttacaccgtgagacatcccgagtggcacctgaatagcgattacagctacggctttgcttatatactcgcttgggttgccttcccgctggcactactgtctggcgtcatttacgtgatcctccggaagcgtgagtag

SEQ ID NO: 198965 - DNA, 450 bp, Artificial Sequence
  Description of Artificial Sequence: Synthetic coding sequence
atgctgctgctgctgctgagcatcatcgtgctgcacgtggccgtgttggtgctgctgttcgtaagcaccattgtttcacagtggatcgtcggcaacggccatgctaccgacctctggcagaattgttccacaagttcatcgggaaatgtgcatcactgcttttccagcagcccaaacgaatggctccaaagtgtacaggcaacaatgattctgtctatcatcttcagtatcctgtccctatttttgtttttttgtcagctctttaccctgaccaagggtggccgattttatatcacagggatcttccagatcctggccggcctgtgcgtgatgtccgccgccgccatttatactgtgcggcatcctgagtggcatctgaattcggactattcttttccattggcacttctgtccggcgttatctatgtgatcctgagaaaacgagaatag

SEQ ID NO: 198966 - DNA, 1413 bp, Artificial Sequence
  Description of Artificial Sequence: Synthetic coding sequence
atgagccaccaccccagcggcctgcgggccggcttcagcagcaccagttacaggaggactttcggtcctccaccgtctctgtccccaggagcgttcagctactctagttcttccagatttagtagtagtagattgctggggagtgcatctccgagcagcagtgtgagattgggcagttttaggagccccagagctggcgctggtgctctcctgcgtttgcctagcgagagactggacttttccatggccgaagcactgaaccaggagtttctggccactcgcagtaacgagaagcaagaactgcaggaattgaacgaccggttcgctaattttatcgaaaaggtgagattcttagagcaacagaacgctgccctgcggggggaattatcccaggcaaggggtcaggagcctgctcgggccgaccagctctgccagcaggagctgcgcgagctgaggcgtgagctcgagctgctgggcagggagcgcgatagagtacaggtggaaagggatggcctcgcagaagatttagcagcgctgaagcaacggctggaagaggagactcgcaaaagggaagatgctgagcacaacctggtcttattccgcaaggatgtggacgacgcgactctttctcgcttagagttggaaaggaaaatcgaaagcctcatggacgagattgagttcctcaaaaagttacacgaggaagagctccgcgaccttcaagttagtgttgagtcacagcaagtccaacaagtcgaagtggaggcaactgtaaaaccagagctcactgcggcattgcgggatattcgcgctcagtacgagtcaatcgccgcgaaaaacttacaggaggctgaagaatggtacaaaagtaagtacgctgacctatcagatgccgctaataggaatcatgaggcactgcgccaggcaaagcaggagatgaatgagtcccgccggcagattcagtccctgacgtgcgaggtggacggtctccgagggacaaacgaagccctgttgcgacaattgcgagagctggaggaacagtttgccctggaggccggtggttaccaggccggggccgctagactggaagaagagttacgccagctgaaagaagagatggcaaggcatcttagggagtaccaagaacttttgaatgtgaaaatggctttggacatagagattgcaacgtataggaaattactggagggcgaagagtcccggatcagtgtgcccgtgcacagtttcgccagtttgaatatcaagaccaccgttcccgaggttgaaccgccccaggactctcactctagaaaaaccgtgctgataaaaaccattgaaacgcgcaatggagaagtggtaaccgagtctcaaaaggagcagcggtcagaactggataagtcatctgcccacagctactag

SEQ ID NO: 198967 - DNA, 603 bp, Artificial Sequence
  Description of Artificial Sequence: Synthetic coding sequence
atgggccaggagttcagctgggaggaggccgaggccgccggcgagatcgatgtagccgagttgcaggagtggtacaagaaattcgttatggagtgccccagtggcaccttgtttatgcacgagttcaagagattctttaaggtgaccgacgatgaggaagcatcacagtacgtggaaggaatgtttcgcgcattcgataagaatggggataataccattgactttctggagtacgttgccgcgcttaatctggtgctgcggggaactttagagcataagttaaagtggacttttaaaatttatgacaaagatggcaacggttgcatagatcgcctcgaacttttaaacatcgtcgagggtatctaccagctgaagaaggcatgcaggagagaactgcagacggagcagggccaattattgaccccagaggaggtggtagataggatcttcctactggtggacgagaacggcgatgggcagctctccctgaacgaatttgtggagggtgccagaagggacaaatgggttatgaagatgctgcagatggacatgaatccttcttcctggttagcccagcagaggcgcaaatctgccatgttttag

SEQ ID NO: 198968 - DNA, 1104 bp, Artificial Sequence
  Description of Artificial Sequence: Synthetic coding sequence
atgtggagcgagggccggtacgagtacgagcggatcccccgggagcgggctccaccccgtagccacccgagcgatggatataaccgtctggtgaatattgttcccaagaagccccccttgctcgaccgacccggggaggggagttataataggtactacagtcacgtagactatcgggactatgacgaagggaggtccttttcacatgatagaagatccggtcctccacacagaggagatgaaagcggctatcgatggactagagatgatcactcggcaagccggcagcccgaataccgggatatgcgagatggttttagaaggaagtccttctactccagccattatgccagagagaggagcccttataaacgggacaatactttcttcagggaatccccagtcggcaggaaagatagcccgcactctaggtccggcagctccgttagcagtcgctcctactctcctgagaggagtaagtcttatagtttccatcaaagtcaacaccggaaaagtgtgagacccggggcaagttataagaggcagaacgaaggcaacccagaaagggacaaggagcggcccgtgcagtcattaaagacctccagagacacaagtcccagcagcggaagtgcagtgagcagttccaaggtgctggataagccctcaaggctgacagagaaggagcttgccgaggcagcatcaaagtgggcagccgagaaattggaaaagtctgacgaatcgaacctgcccgagattagcgagtacgaagcaggcagcacagccccattattcaccgatcagccggaagaaccagagtccaacacaacacatggcatcgagctttttgaagattctcaactaaccactcgttctaaagccatcgccagcaagacaaaggagatagagcaggtttacaggcaggactgtgagacttttggcatggtcgtgaagatgctaatagagaaagaccctagcctggaaaagtctattcagttcgccctgcgtcagaatctgcacgaaatcggcgaaagatgcgtcgaggaactcaagcatttcatagcagagtacgacacatcaacacaggattttggagagcccttctag

SEQ ID NO: 198969 - DNA, 1377 bp, Artificial Sequence
  Description of Artificial Sequence: Synthetic coding sequence
atgtggagcgagggccggtacgagtacgagcggatcccccgggagagagctcctccgcggtcccatccctcagacggctacaaccgcttggtgaatatcgtgcctaaaaagccgcctcttttggacaggccaggagagggttcctataatagatactattcacatgtcgactatagagactacgacgaaggacgctccttcagccatgatcgaagaagtggaccgcctcaccgcggcgatgaaagtggctacaggtggaccagggacgatcattcggcaagtaggcaacctgagtaccgggatatgagggatggtttcagaaggaaatccttttatagttctcactatgcacgcgagcgcagcccttacaaacgtgacaacaccttctttcgcgaaagccccgtcggtagaaaggattctccacactccagaagtggtagcagcgtgagtagtcgcagctattccccggagcgtagcaaaagctacagcttccaccagtcacaacaccggaagagcgtgcgacccggggcctcctataaacgccagaacgaggggaatccggagcgtgataaggaaaggccagtgcaaagtctgaagacttccagggatacttctccttcatcaggctctgcggtcagttcttcaaaagtgctggacaaaccaagccgcctgacagagaaggaattggctgaagctgctagcaagtgggccgctgaaaagctggagaaaagtgacgagagtaacctgcctgagattagcgaatatgaagctggatcaactgctcccttgtttacagatcagccagaggagcccgaatcgaacacaacacacggcatcgagttatttgaggactcacagctgaccaccagatccaaagcgattgcttcaaagactaaagaaatcgagcaggtctacaggcaggactgtgagacatttggaatggtggtaaaaatgctgatcgagaaagacccctctcttgaaaagagcatacaatttgccttacgacagaatttgcacgagattgagagcgccggacaaacttggcaacaggtgccacccgtccggaacacagaaatggatcacgatggcactcctgaaaacgaaggcgaggagacagcccagagcgccccccagcctccacaggcaccacagcctttgcagccacgcaagaagcgtgtgagaaggaccacacagctccgaaggaccaccggagctcctgacattacctgggggatgttgaagaagactacccaagaagcagaaagaatcttgttacgtactcagacaccgttcacgcccgagaacctcttcctggctatgctaagtgtggtccattgcaattctcgcaaagatgtgaagcccgaaaacaaacaatag

SEQ ID NO: 198970 - DNA, 1125 bp, Artificial Sequence
  Description of Artificial Sequence: Synthetic coding sequence
atggcctaccggcgggacgagatgtggagcgagggccggtacgagtatgagcgcattcctagggagagggcaccacctcgctcacacccgtctgatggatataatagactcgtaaatatcgtgcccaagaagccaccccttcttgaccgccccggtgagggttcttacaatcgctactacagtcatgtggattatagggattatgacgaaggcagaagctttagccacgaccgtcgatctggccctcctcaccgaggagacgaatcaggttataggtggacccgcgacgatcattcagccagtagacagccagagtacagggacatgcgggacggattcaggaggaagtcattttattcctcccactacgctcgagagcggtctccgtataaaagagacaacacgttttttcgcgagtctccagttggccggaaggacagccctcatagccggtctgggtcctccgtgtcaagcagaagttattccccggagagaagtaaatcctattctttccatcagtcccagcaccgcaaatccgtgaggcccggcgctagttacaaacgtcagaacgaaggcaatcctgaacgcgacaaggagcggcccgtgcaatctcttaaaacgtctcgtgataccagccctagcagcggttccgctgtttcttcttctaaagtcctcgataaaccctctagactgaccgaaaaggagctcgctgaagcagcaagtaagtgggctgcagaaaagctggaaaagtccgacgaatcaaatttacctgagatatctgaatatgaagctggatctacagcgcccctgttcaccgatcaacctgaagaacctgagtctaacaccacccacggaattgaactgtttgaagacagccagttaaccaccagatctaaagccattgcttcaaaaactaaggagatcgagcaggtgtatcgccaggactgcgaaacgtttggcatggtcgtgaagatgctcattgagaaagacccttctctcgagaaatccattcagtttgccctccggcagaacttgcatgagatcggcgagagatgcgtcgaggagttgaaacacttcatcgccgagtacgatacaagcacacaggactttggcgaacccttttag

SEQ ID NO: 198971 - DNA, 1305 bp, Artificial Sequence
  Description of Artificial Sequence: Synthetic coding sequence
atgtggagcgagggccggtacgagtacgagcggatcccccgggagcgcgccccccccagatcccatcccagtgatgagagtggttaccggtggactagagacgaccattctgccagtaggcagccggaatatcgagacatgagggacggctttcgtagaaaaagcttctacagctctcactacgcccgggaacgcagcccctacaaacgggataatacctttttcagggaatctcctgtggggaggaaagattctccccactctcggtccgggagctctgtatcaagcaggagctattctccagagcgatcgaagtcctactccttccatcaaagccagcaccggaagagcgtcaggcccggtgccagctacaagcgacaaaacgaggggaaccccgagcgtgataaggagcggccagtgcagtctctgaaaacttcaagagatacttcaccaagctccggatctgcagtcagctcttccaaggtgctggataaaccaagtagactgacggagaaagaactcgctgaagccgcatcgaagtgggccgctgagaaattagaaaaatcagacgagtccaacctgcccgaaattagcgagtacgaggctgggtcaactgctcctctgtttaccgaccagcctgaggaacccgagagcaacaccacccatggtatagagctctttgaggattctcagttaacaactcgcagcaaggctatcgcgtccaaaacaaaagagatcgaacaggtttatcgacaagactgtgagacctttggcatggtggtgaagatgttaattgagaaagatcctagtcttgaaaagagcattcagttcgccctccggcaaaacctgcacgaaattgagtccgccggccagacttggcagcaagtgcctccagttagaaatactgaaatggatcacgatggcacaccggagaatgagggggaggaaacggcccaatctgctttgttcggattccagcacgacgccagcaatcatacaatcgtcggactgggacccaatcaggttccagaaatgaaagagaccaccttgcaggctccccaaccgccccaagcacctcagccactccagcccaggaagaagagggtgcgaagaaccacccagctgcggaggacaaccggggctcctgatatcacctggggaatgttgaagaagaccacacaggaagccgagaggatactgcttcgaacccagactcctttcacacctgaaaacttatttctggcaatgctgtccgtggtgcactgtaacagtcggaaagatgtcaaacccgagaataaacagtag

SEQ ID NO: 198972 - DNA, 1047 bp, Artificial Sequence
  Description of Artificial Sequence: Synthetic coding sequence
atgtggagcgagggccggtacgagtacgagcggatcccccgggagagagcacctccccgtagtcacccatcagacgggtacaatcggctggtcaatatcgttccaaaaaaaccaccgctcctggaccgtccaggagagggatcctacaacagatattactctcacgtcgactaccgggattacgacgaaggcagatcattttcacatgacagaaggtcaggtccccctcacaggggcgatgagagtggctataggtggactagagacgaccactctgctagtaggcagccagagtacagagacatgagagacgggttccggcggaagagcttttattcttctcactacgctcgagaacgcagcccgtacaaacgcgataatacctttttcagggagtcacccgtcggcaggaaagactctccccactctcgatcgggatcatctgttagcagtaggtcttacagccccgagcgctccaaaagttactcctttcaccagagtcagcacagaaataaggagagacccgttcaatcactgaaaacctctcgcgacactagccctagctctgggagcgcagtttcctcgagtaaggtactggacaaaccatcaagattgactgaaaaggagctcgccgaggcagccagcaaatgggcggccgagaagctcgagaaatcggatgagtccaacttgccagaaattagcgaatacgaggcagggagtaccgccccgctgtttaccgatcaaccagaggagccagaatctaatacgacgcacggtattgagctatttgaggacagccagcttacgacccggagtaaggctattgcctcaaaaaccaaggagattgagcaggtctaccgtcaggactgtgagaccttcgggatggtggtgaagatgttaatcgagaaggaccccagcctggagaagtccatacagtttgcattgcgccaaaatttgcacgagataggggagcgctgtgtcgaggagctgaagcattttatcgccgagtacgacacctcaactcaggattttggggagccgttttag

SEQ ID NO: 198973 - DNA, 486 bp, Artificial Sequence
  Description of Artificial Sequence: Synthetic coding sequence
atggcctaccggcgggacgagatgtggagcgagggccggtacgagtacgagcggattccaagggaacgtgctccccctcgctcccacccatctgacggctacaacagactggtgaacattgtccctaagaaaccaccactactcgatcgccccggggaggggtcgtacaaccgctattattcacatgtggactatcgggactacgacgagggacgttctttttctcacgaccgccggagtggaccaccacaccgcggcgatgagtcaggctacagatggacaagggacgaccactcggcaagccggcagcctgagtaccgggatatgagggacggcttccggaggaagtccttttactccagccattacgccagggagcgctccccttataaacgtgataataccttcttccgcgagtcacccgtgggaaggaaagacagtccacactctcggtctggaagttccgtgtcctcaagatcctactag

SEQ ID NO: 198974 - DNA, 507 bp, Artificial Sequence
  Description of Artificial Sequence: Synthetic coding sequence
atgtggagcgagggccggtacgagtacgagcggatcccccgggagcgggcccctccaaggtcacacccctctgacggctacaatcggttagtgaacattgtcccgaagaagccaccactgttggataggcctggagaagggtcatataacaggtattactcgcatgtcgactaccgtgactacgacgaaggacggagttttagtcatgatagacggtctggacccccacacagaggagacgagagtggctataggtggaccagagacgaccattccgcgtctagacagcccgaatacagagatatgcgggatgggttccggaggaaaagtttctacagctcacactacgctcgagagcggtccccctataagcgtgataataccttctttagagagtctcctgtggggagaaaggactcgcctcatagtagatccggatctagcgtgagctctcgctcttatagcccagaacggagcaagagctattcattccaccagagccagtag

SEQ ID NO: 198975 - DNA, 960 bp, Artificial Sequence
  Description of Artificial Sequence: Synthetic coding sequence
atggcctaccggcgggacgagatgtggagcgagggccggtacgagtatgaacgtatcccacgtgaaagggcacctcctcggagtcacccgtctgatgagtcaggttaccgttggacccgggatgaccactcagccagccgccaacctgagtatagagatatgagggacggattcaggcggaagtcattctactcctcccattatgctcgggagcgtagcccttataaaagggataatacgttcttcagagagagtcctgtggggagaaaagattccccacactccagatcaggcagctccgtgagtagccgatcttacagccccgagcggtcaaagagctactcatttcatcagtctcagcataggaaaagtgtgagaccaggcgcgtcctacaagcgacagaacgaagggaaccccgaaagggataaagagaggcctgttcaaagcctcaagacgagcagggatacaagcccctcttccggcagcgcagtgtctagctccaaagtgctggacaagccaagccggcttactgagaaagagctcgcggaggcggccagtaaatgggcggctgaaaagttggaaaaatctgatgaaagtaacctgccagaaattagcgaatacgaagccggcagcaccgccccactgtttacagaccagcctgaggaacctgaatccaatacaacacatggcatcgagttatttgaagactcacaactaactacccgtagtaaggccatagcatccaagactaaagagattgaacaagtgtacagacaagactgcgagacctttggtatggtggtgaagatgcttattgagaaagacccttcattggaaaagtccatacagtttgccctccgacaaaacctccacgaaatcggagagcgctgtgtggaagagcttaagcactttattgccgaatacgatacttctactcaggacttcggcgaacccttctag

SEQ ID NO: 198976 - DNA, 5271 bp, Artificial Sequence
  Description of Artificial Sequence: Synthetic coding sequence
atgaacagcctgttccggaagcggaacaagggcaagtacagccccaccgtccagaccagaagcatatctaataaggaactctccgaactgatcgaacagctacagaaaaatgccgaccaggtagagaagaacattgtcgatacagaggctaagatgcagtccgatctggctcgccttcaagagggtagacaaccagagcacagagatgtcacactgcagaaggtgttggacagcgagaagcttttgtacgtcttggaagcagacgctgccatcgccaagcacatgaaacatccgcagggcgatatgatcgccgaggacatcagacaactcaaagagcgggtcactaatcttagaggaaaacataagcagatctatcgtcttgcagtcaaagaggtggaccctcaggtgaactgggccgcactcgtcgaggagaaactcgataaattaaacaaccagtcttttggcacagatcttccgctcgttgatcaccaggtggaggaacacaatatcttccataacgaagtgaaggcaatcggcccccacttggcaaaggacggcgacaaagaacaaaactccgagctgagagctaaatatcaaaaactcctcgccgccagtcaggctagacagcaacacctcagcagtctgcaggattatatgcaaagatgtaccaacgaactgtactggctagatcagcaagctaaggggcggatgcaatacgactggagcgacaggaatctcgactaccctagtcgacgtcgtcaatacgagaactttatcaaccgcaacttagaagctaaggaagaacgtatcaataagttgcactccgaaggtgatcagctattagcagctgaacaccccgggcgtaactccatcgaagcacacatggaggccgtccacgccgactggaaagagtacttgaacctactgatatgtgaggagtcccacctgaagtacatggaagactatcaccagtttcacgaggacgtgaaagatgcccaagagctgctgcgtaaagtggattctgacctgaatcagaaatatggacctgattttaaggaccgctaccagatcgagttactcttgcgggagttagacgatcaggagaaggtgctggacaaatacgaggacgttgtccagggcttgcagaaacggggccagcaggtggttccactgaagtacagaagggagacacccttaaagcccattcccgtagaggccctctgcgattttgagggagaacagggcctcattagcagaggttattcgtacactctacaaaagaataatggggagagttgggagcttatggacagtgctggaaacaaactcatcgcacccgctgtgtgtttcgtgattccaccaacagatcccgaggcactcgctctggcagactctcttgggtcccagtacaggtcagtgcgtcagaaagctgcggggtcaaagcgcacactgcagcagcgatatgaagtcctgaagaccgagaatcccggagacgcttccgatctgcaggggcgccagctccttgctggacttgacaaggtggccagcgatctggatagacaggagaaagccatcactggcatcctcaggccccctctcgaacaaggccgagccgtgcaggacagcgccgaacgggccaaggatctgaagaatattaccaacgagctcctgagaattgaacccgaaaaaacgaggtccacagccgaaggggaagcattcatacaagcattgccaggctcaggcacaactccactgctgagaacccgtgtggaggatactaacaggaagtatgaacaccttctgcaactgctggacctggcacaggagaaggtggatgttgccaacagactggagaagagcctccagcagtcttgggaactgctcgctacacacgagaatcatctaaatcaagacgacactgtgccggaaagctcacgcgtcctggacagcaaaggacaagagctggctgctatggcctgtgaacttcaagcgcagaaatccctgctcggagaggtggagcagaatcttcaggctgcaaagcagtgcagtagcacactcgcgtctagatttcaggagcactgccccgatctggagaggcaggaggccgaggtgcataaattgggacagagattcaacaacctccgccaacaggtggagagacgggctcaaagcctgcagagcgctaaggccgcctacgagcacttccatcgtgggcacgatcatgtacttcaattccttgtctcaatcccatcctacgagccccaggagacggactccctgagccagatggagacaaagctcaaaaatcaaaagaatttactcgatgaaatcgcttcccgggagcaggaggttcagaaaatctgcgccaattcccagcagtaccagcaggctgtgaaggattacgagctggaggccgaaaagttgagatcgctgctggatttggaaaatggcagacggtcccacgtgtcaaagagggcccgtctacagagtcccgctactaaagttaaggaagaggaggccgctctcgccgcaaaatttaccgaagtgtatgccatcaacaggcagcgcctgcagaaccttgagttcgccctgaatctgctgaggcagcagcctgaggtggaggtgactcatgagactctgcagcgtaaccggcccgatagtggcgtggaggaagcctggaagatccgcaaggagcttgacgaagaaactgagagacgcaggcaactcgaaaacgaagttaaatccacacaggaggagatttggacactcagaaaccagggacctcaggagagcgtggttagaaaagaagtgctgaagaaagtgcccgatcccgtgctggaggagtcattccagcagctgcaacgcaccctggctgaagagcagcacaagaatcagctgttacaggaggaactggaggccctccaactccagttacgcgcgctggagcaagaaacgcgagacggaggtcaagagtacgtcgtcaaagaagtgctgcggatcgaacctgatcgtgctcaggccgacgaagtgttacagttaagggaggaactagaagccttaaggagacagaaaggtgcacgggaagccgaggtgttactgctccagcagagagtggcagccctggcagaggaaaagtcccgggcgcaggagaaggtgaccgagaaagaagtggtcaagctgcaaaacgacccacagctagaggccgagtatcagcagctgcaggaagatcatcagcgacaggaccagctccgagagaaacaggaggaagagctgagctttttacaggataaattgaaacggcttgagaaagaaagagcaatggccgagggcaagataaccgttaaggaggtgctgaaagtagagaaagacgccgcaaccgaacgagaagttagtgacctgacaagacagtacgaggacgaggccgctaaagccagggcatcccagcgcgagaaaacagaactgctgcgtaaaatttgggctctcgaagaagaaaatgccaaggtggtcgtgcaagaaaaagttagagagatagtgcggcctgaccccaaagccgagtccgaagtggccaacctcaggctagaactagttgaacaagagcggaagtataggggggccgaggaacaactcaggtcttatcagtctgagttggaggccctgcggaggagaggcccacaagtggaagtgaaagaggtcactaaggaggtcattaagtacaaaacagatcccgaaatggagaaggagctacagagactgcgtgaagaaatcgttgacaaaaccagactgatcgaacggtgcgatctggagatttaccaacttaaaaaggaaattcaggccctgaaggacacaaaaccgcaagttcagaccaaggaggttgttcaggagatcctgcaattccaggaagacccgcaaacaaaggaagaggtggcctccttacgggctaagctttcagaagaacagaagaagcaggtcgatctggagcgggagagggcttcacaggaggagcagatagcccgtaaggaggaggagctctctagagtgaaggagcgggtggtccagcaagaggtggtccgctatgaggaggagccaggcctacgcgcagaagccagcgccttcgctgagagcattgatgtggaattacgccagattgataagcttagggccgagcttcggagactgcagcgtagaagaacggagctagagcgtcagctggaagaactggaacgagagcgccaggccagacgggaagcggaacgcgaggtgcaaagattacagcagcggctggctgctctggaacaggaggaagccgaggcgcgagagaaggtgacccacacacagaaagtcgtcctgcaacaggatcctcagcaggcccgggaacacgccctcttaaggctccaactcgaggaagaacaacacagaaggcagttgttggagggtgaactggagacactcaggcgaaaactcgccgctttggagaaggcagaggtcaaggagaaggtggtcctcagcgagtccgttcaagtggaaaagggagatacagaacaggaaatccagaggttaaagtctagcctcgaggaagaatctcggagcaagcgggagcttgacgttgaagtgagcagactggaagctaggctgagcgaactggaatttcacaacagcaagagcagcaaagagctcgatttccttcgggaggagaaccacaaattgcagctggaaagacagaacctccagctggaaacgcgtcggcttcagtctgagatcaacatggcagccacggagacaagggacctgagaaatatgacagtggctgactcgggaaccaaccacgatagtaggctgtggagtctcgagcgggaactggatgatctgaagaggctctctaaagataaggacttagagatcgacgagttgcagaagcggctgggatccgttgccgtcaagagggagcaacgggagaatcaccttagacgaagcatcgtggtgatacatccggacactggcagagaattgtcccccgaggaagcacaccgagccggtcttatcgactggaatatgtttgtgaaattgagatcccaggagtgtgactgggaagaaatctcagtaaaagggcctaatggcgaatcttcagtcatccatgacaggaaatccgggaagaaatttagcatcgaagaagcactacagtctgggcggctcacgcctgcccagtatgaccgttatgtgaacaaggatatgtccattcaggagctggcggtactcgtctccgggcaaaaatag

SEQ ID NO: 198977 - DNA, 4440 bp, Artificial Sequence
  Description of Artificial Sequence: Synthetic coding sequence
atggccaagcggagccggggccccggccggcggtgcctgctggccttggtgctcttttgtgcttggggtaccctggcagtcgtggcccagaagcctggtgctggctgcccttctcgctgcctgtgttttaggactaccgtacgatgcatgcacctacttcttgaggcagtccctgccgtcgcgcctcagacctcgattctcgatctgcgctttaacaggatccgggaaatccaaccgggcgccttcaggaggttacggaacctcaatacccttcttctcaataataatcagatcaaaaggattcctagtggcgcgtttgaggatctggagaatctgaagtacctctatctgtataaaaatgaaattcagtctatagaccggcaggccttcaaagggttggccagcctggaacagctgtatctgcactttaatcaaatagagacgttggatcctgattcctttcaacacttaccaaagctcgaaagattgttcttgcacaacaatcggattacccatctggttcctggcacattcaaccatttagaatctatgaagcgactccgcttggactccaatactttacactgcgactgtgagatcttgtggctagcagacctgttaaaaacgtatgccgaatctgggaatgctcaggctgcggctatctgcgaataccctcgccggatacagggccggtccgtggccactatcacacccgaggagctgaactgtgagcgaccccgcattacaagtgagccgcaggacgcggatgtcacttcagggaacacagtgtacttcacctgcagagctgagggtaacccgaaaccagagatcatttggctgagaaacaataatgagctgtctatgaagaccgattctcggctgaatctgctggacgatggaacactaatgattcagaacacgcaagagactgaccagggaatctaccagtgtatggcgaagaatgtggctggcgaagtgaaaacccaggaggtcacgctgagatacttcggctccccagcccgacctacattcgtaattcaaccacaaaataccgaggtactagttggagagtccgtcactttggaatgtagcgccacgggacatcctcctccacggatttcttggacccgaggggatcgcacgcccctgccagtggatccacgggttaatataacaccttctggtggcctctatatccagaatgtcgttcagggggattccggagagtacgcctgcagtgccactaataatatcgattctgtccatgccacggccttcataattgtccaggctttgccacagttcaccgtgactccccaggatcgcgtagttatagaagggcagaccgtcgatttccagtgcgaagctaagggaaacccacctcccgtgatagcatggaccaagggtggctctcagcttagcgtagaccgaagacatttggtgctgtcctctggcacacttagaatctcgggcgtagccctgcacgaccagggacaatacgagtgtcaagctgtgaatattattggtagtcaaaaggtggtcgcccaccttaccgtgcagccccgcgtgacaccagtcttcgcatccattccgagcgacaccacggtagaagtcggcgccaacgtgcaactgccatgctcctcccagggcgagcccgaacccgcaatcacctggaataaggacggggtccaagtgaccgaatctggaaaattccatataagccctgaagggtttctcaccatcaacgacgtggggcctgcagacgctggacggtatgagtgcgtggcacggaatacaataggctctgcctcggtgtccatggtactgtctgtgaacgtgccggatgttagtaggaacggcgacccttttgtagctacgtctatcgtcgaggcgattgccacagtggaccgcgctattaattcgactaggacacacttgttcgatagtcggccccggtcaccgaatgatctgctggcccttttccggtacccgagggatccttatacagtcgaacaggccagagccggcgagattttcgaacgcacccttcagctgattcaggaacacgtgcagcacgggctgatggtggatctgaatggaaccagttaccattataatgatttagtgagcccccagtaccttaacctgattgctaatctatcagggtgcacggcccacaggcgcgttaataactgctcagacatgtgtttccatcagaagtaccgcacacacgatggcacatgtaataacctgcagcacccaatgtggggagcatccttgacagccttcgaacgcctgctcaagtcagtgtatgagaacggttttaataccccccggggtatcaatcctcacaggctttacaacgggcacgccctgcccatgccccgcctggtttctacaaccctaataggtaccgaaactgtgacccctgacgaacaatttacacatatgctgatgcagtggggtcagttcctggatcatgacctggacagtacagtcgtggcactgtctcaggcacgcttctccgatggccaacactgcagcaacgtatgttctaatgatcctccgtgttttagtgtcatgatccctcctaacgactccagagcacggagcggggcccggtgcatgtttttcgttcgaagctcacccgtatgtgggtctggcatgaccagcctcttaatgaattcggtgtatccacgtgaacagattaaccagttgacatcttatattgatgccagcaacgtttacggtagcaccgaacacgaggcacggagtattagggatttggctagtcacagggggctgcttcgccagggaatagtgcagcgatccgggaagccgctgctgccatttgcaaccggacctcctactgagtgtatgagagatgaaaatgagtctccaattccgtgcttcctggccggagatcaccgtgccaacgaacagcttggcttaacttcgatgcataccctgtggttccgagagcataatcgtatcgcgaccgaactactgaagctcaacccgcattgggatggcgacaccatctactacgagacccggaagatagttggagcggagattcagcacatcacctaccaacattggttgcctaaaatcctcggcgaagttggaatgcgaaccttgggggaatatcatggatatgatcctggcatcaacgctggaatcttcaatgctttcgctacagcagcattccggttcggccacaccttggtaaaccccctgctttaccggctcgacgagaatttccagccaatcgctcaagaccaccttcccttgcacaaagcctttttcagccccttcagaattgtgaatgaagggggcattgatccactgctgcgcgggctgtttggcgtagccggtaagatgcgggtcccctctcagcttctcaacacggaactgacggagaggctcttctccatggcccacacagtggcactggacctcgctgctatcaacatacagagaggacgcgatcacgggatccccccctatcacgattacagggtctattgcaacctttcggctgctcatacattcgaagatctgaaaaacgaaattaagaaccccgagatccgcgaaaagttgaaaagactatacgggagtactctgaacatagacctgtttcccgcgttagtggttgaggatctggtgccaggcagcaggctcggacctacactgatgtgtcttcttagcacacagttcaagaggctgcgcgacggagacagactatggtacgagaatccgggtgtattcagccctgcccagctgacccaaatcaagcaaaccagcctagctcgcattctgtgcgataatgcagacaatattaccagggtccagagtgatgtgtttcgagtggccgagtttccgcacgggtacggctcttgtgatgaaattccccgcgtggatctccgcgtctggcaggactgctgtgaagattgcagaacgcggggccagttcaacgccttttcctaccatttccggggccggcggtccctggaattttcttaccaagaggacaaaccaacgaagaaaacacgcccccggaaaattcccagcgtaggtcgtcagggtgagcatctgagtaatagcacctccgcctttagcacgaggtccgacgcatcaggaaccaacgactttcgggagtttgtgctcgagatgcagaaaaccattacagatctgagaacgcagataaagaagctagagagcagactgagcactactgagtgcgtcgacgccggcggcgaaagccatgcaaacaacactaagtggaaaaaagacgcctgcacgatttgcgagtgcaaagatgggcaggttacttgctttgttgaggcctgtcctcctgctacttgcgcagtccccgtgaatattcccggcgcgtgttgcccagtttgcttgcagaaacgggccgaggagaagccctag

SEQ ID NO: 198978 - DNA, 2172 bp, Artificial Sequence
  Description of Artificial Sequence: Synthetic coding sequence
tgacggggccccggccggcggtgcctgctggccctggtgctgttctgtgcgtggggaaccctagcggtggtggcccaaaaacctggagctggttgcccgagtcgttgtctttgctttagaacgactgtgaggtgcatgcatctactgctagaggctgttccagcagtcgcccctcagacctccattctcgacttaaggttcaatagaatacgagagatacagcctggcgccttccgtcgtctgcggaatttgaatactctgctgctgaataataaccagattaaaaggattccgagcggggccttcgaagatctggagaacctgaaatatctgtatctctataaaaacgagatccagagtattgaccgccaggcattcaagggtctcgcgtcacttgaacagctgtatcttcactttaatcagatcgagacactggatccggacagttttcagcatcttcctaagctggaacgcctcttcctacacaataacagaattacacacctcgttcccggaacattcaatcacttagaaagcatgaaacgcctgcgactcgacagtaacacattgcactgtgattgcgagatcctgtggttagccgatctgctgaagacatatgcggagtctggaaacgctcaggcagcagctatctgtgagtaccccagacggattcagggacgatctgtcgcaacaattacgcctgaggagttaaactgtgagaggcctcggattaccagcgagccccaggatgcggacgtgacatcagggaacactgtgtacttcacctgtagggccgaaggtaaccccaaaccagaaataatttggttacggaacaataatgagctgtccatgaagaccgattcccggctcaacctgctggatgacggtacactgatgatacagaatacacaggagaccgatcagggtatctatcagtgcatggccaaaaatgtggctggagaggtcaaaactcaagaagttacattacggtactttggcagcccagcacgccctactttcgtcattcaaccgcaaaacaccgaagtgctggttggcgagagtgtaacactggagtgctcagccacagggcatccgcctccaaggatcagttggaccagaggggatcgcacacctctaccagttgaccccagggtgaacatcaccccttccggaggtttgtacattcagaatgtggttcagggcgacagcggagaatatgcatgtagcgcaaccaataacattgacagcgtccacgctaccgcattcattatcgttcaggcattgccgcagttcacggtgaccccacaggaccgggttgtcatagaagggcagaccgttgactttcagtgcgaggctaaagggaatccgccgccagtcatagcctggactaaaggcggctcccagctgagtgtggataggagacacctggtgctcagcagcggtacattgcgcatcagcggcgtcgctttgcatgaccagggccagtacgaatgtcaggcagtgaacatcattggaagtcagaaggtagtggcccatctgactgtgcagccccgcgtgactcctgtcttcgcctccataccatccgacactactgtggaggttggcgctaatgtgcaactgccgtgtagctctcagggtgagcctgagccggccatcacttggaataaggatggtgtccaggtcaccgagtctgggaagttccacatctcccctgaagggttcctgacaataaacgatgtggggcccgcagacgccgggcgttacgagtgcgtggctcgtaacaccatcggctccgcctctgtgagtatggttctgagtgtgaatgtcccagatgtgtcacgaaatggagacccttttgttgctacaagcatagttgaagccatcgcaaccgtagatcgggcgatcaactcaacacgtacacacctattcgactctcgcccccgctcgcccaacgaccttttagctctcttccggtatccaagggacccgtacaccgtcgagcaagctcgcgccggtgaaatcttcgaaaggaccttgcagcttattcaagagcatgtgcaacacggcttgatggttgatctcaatggtacctcacagtgccagagtctgtttttcctcttacacggcctttcaaacggggtggagcacgcctcagtcaaatctcactcatag

SEQ ID NO: 198979 - DNA, 771 bp, Artificial Sequence
  Description of Artificial Sequence: Synthetic coding sequence
atggccgccgccgtgggccggctgctgcgggccagcgtggcccggcacgtgagtgcaatcccttggggaattagcgccacggccgcactgcgccctgcggcttgtggaagaacaagtctgaccaatttactatgttctgggtctagccaggccaaattgttctctacctctagctcctgtcacgcccctgccgtgacccagcatgccccctactttaaagggacagctgttgttaacggtgagttcaaagacttgtccttagacgatttcaaaggtaagtacctggttctatttttttaccctctcgattttacattcgtatgcccaacagagatcgtggctttttctgacaaagccaatgaatttcacgacgtcaattgtgaagtggtggccgtatccgtggattcgcatttcagccacctcgcttggattaacactccccgaaaaaacggaggcctcggtcacatgaatatcgcactgctttctgatctcacgaagcaaatttctcgggactatggggtcctactcgaaggatccggcctggctctgaggggcctctttataatagaccccaatggggttatcaaacatctgagcgtcaatgatctccccgtagggaggagcgtcgaggaaacactcagacttgtgaaggccttccagtacgtggaaacacatggggaggtgtgccccgctaactggacaccagacagtcccaccatcaagcccagcccagcggcctccaaagaatattttcaaaaggtgaatcagtag

SEQ ID NO: 198980 - DNA, 717 bp, Artificial Sequence
  Description of Artificial Sequence: Synthetic coding sequence
atggccgccgccgtgggccggctgctgcgggccagcgtggcccggcacgtaagcgccattccatggggaatctccgctacagcggcactgaggcccgccgcctgcggacgaacatctctgaccaatctgctctgttcgggcagcagccaggctccctacttcaagggcacagccgtggtgaatggcgaattcaaggacttgtccctcgatgactttaaaggcaagtacctggtgctctttttctatcctctggatttcactttcgtgtgccccaccgaaatagtggcattctcagataaggccaacgaatttcatgatgtcaactgcgaagtcgttgcagtgtctgtggacagccatttctctcacctggcatggattaatacccccagaaaaaacggaggacttggccatatgaatattgccctactcagcgatctcacaaagcaaatcagcagggactatggagttcttctggaaggatctggcttggccttgagggggctatttatcatcgatcccaacggcgtcattaagcatttgtctgtcaatgatctacccgtgggccggtctgtggaggagacccttcggctggtgaaggctttccagtatgtcgaaacacacggagaggtgtgccctgccaactggactcctgactctccaaccataaagccatcaccggcagccagcaaagagtatttccagaaggtcaatcaatag

SEQ ID NO: 198981 - DNA, 645 bp, Artificial Sequence
  Description of Artificial Sequence: Synthetic coding sequence
atgggcctggccggcgtgtgcgccctgcggcggagcgccggctacattctggtggggggggcaggcggacagtctgcggccgctgccgctagacgatacagcgagggcgaatgggcttctgggggagttagatcctttagcagggccgcagctgcaatggcccctatcaaagtgggggacgccatccccgcggtggaggttttcgagggcgagcctggcaataaagtgaacctggccgagctcttcaaaggaaaaaaaggcgtgctattcggggtccctggggcttttacgccagggtgtagtaagacccatctcccaggtttcgttgaacaggctgaggctcttaaggcaaagggtgtgcaggtagttgcatgtctttctgtgaatgacgcctttgttactggggagtggggccgcgctcacaaagcggaaggaaaagtcaggttgctcgcggatcccactggggccttcgggaaagaaaccgatcttctccttgacgactcccttgtctcgattttcgggaaccggcgtctgaagcgttttagtatggtcgtccaagacgggattgtaaaagctttgaacgtggagcccgatggcactggccttacctgctcactcgccccgaacattatatctcaactgtag

SEQ ID NO: 198982 - DNA, 378 bp, Artificial Sequence
  Description of Artificial Sequence: Synthetic coding sequence
atgggcctggccggcgtgtgcgccctgcggcggagcgccggctacattctcgtcgggggcgccgggggtcaatcggccgcagctgccgctaggaggtattctgaaggagaatgggcatcggggggggtcagatcatttagccgggctgcagcggccatggcccctatcaaggtccgcctcctggccgatccaacaggcgccttcggcaaagagacagatctgctcctcgatgactctctcgtctctatttttggcaaccggaggctgaaacgtttcagcatggtagtccaggacggcattgtgaaagccctgaatgtggagcctgatgggaccggtctgacgtgttccctcgcccccaacatcatatcacagctatag

SEQ ID NO: 198983 - DNA, 513 bp, Artificial Sequence
  Description of Artificial Sequence: Synthetic coding sequence
atgggcctggccggcgtgtgcgccctgcggcggagcgccggctacatcctggtgggcggtgcggggggtcagagcgccgccgccgccgccaggaggtattctgagggcgagtgggcctccggaggtgtgcgctctttttctcgcgcagcagccgccatggcccctatcaaggtgggggatgctatcccggcggtagaagtgttcgaaggagaaccagggaacaaggtgaatctggccgagttgtttaaggggaagaaaggagtgctgtttggtgtgcctggcgctttcacccccggctgttccaaggtgagactcctggccgatcccactggtgcttttggaaaggaaaccgatcttctcttagacgattccctcgtatcaatcttcgggaacaggcgactaaagaggtttagcatggtcgtccaggacggtatcgttaaggcattaaacgtagaaccggatggcactggcctcacctgttctctcgctcctaacatcatctcccagctatag

SEQ ID NO: 198984 - DNA, 675 bp, Artificial Sequence
  Description of Artificial Sequence: Synthetic coding sequence
atgcccggcggcctgctgctgggcgacgtggcccccaacttcgaggccaatacaacagtgggtagaattcgttttcatgacttccttggggactcctggggcatcctgttttcgcacccccgcgatttcactccagtgtgcacaactgaactgggtagggccgcaaagcttgcccctgagttcgccaagaggaatgtcaaactcatagcactgtccatcgactctgtagaggatcacctagcatggtccaaagacatcaatgcctacaactgtgaggaacccactgagaagcttcccttccctatcatcgacgatagaaacagggaactagcaatcctgctgggcatgctggaccccgccgagaaagatgaaaaggggatgcccgtgaccgcacgtgttgtgttcgtgttcgggcccgataaaaagctcaagctttcaatactctacccggcaaccactggacgcaattttgatgagatcctacgagtggtcatctcgctgcaactgaccgccgaaaaacgagtggctacacctgtagactggaaggacggtgactcagtgatggtccttccgacaatccccgaggaagaggccaagaaactgtttcctaagggcgtgttcactaaagaactgccaagtggcaaaaagtacctgcgatataccccacaaccttag

SEQ ID NO: 198985 - DNA, 3852 bp, Artificial Sequence
  Description of Artificial Sequence: Synthetic coding sequence
atgtggggcagcgaccggctggccggcgccggcggcggcggcgccgcagtgaccgtcgcctttactaacgccagggattgttttctccacctgccacggcggctcgtggcccagctgcatctgctccagaaccaggctattgaggttgtctggagccatcagcctgccttcctctcttgggtggaaggaagacacttctctgaccagggagagaatgtagccgaaatcaaccgacaagttggccagaaacttgggttatcaaacggcggccaggtgttcctgaagccttgcagccatgtcgtcagttgtcagcaggtggaggtggaacccctgtctgccgatgactgggaaattctcgaactgcacgcagtttcactcgaacagcatttgctggaccaaatcagaatcgtatttcctaaagctattttcccagtgtgggtcgaccaacagacgtatatatttatccagattgtcgcccttattccagccgcttcctatgggcgactggaaacagacaccaaactgctgatacagcccaagactcgcagagctaaggagaataccttctctaaggctgatgcagaatacaaaaagttacattcttacggccgtgatcagaaaggaatgatgaaggagctgcaaacaaaacagcttcaaagtaataccgtcggaataacagagtcaaatgagaatgagtccgagatcccggttgactcatcctccgtggctagtttatggacaatgataggctccatcttctcatttcagtctgagaagaaacaggagacgagctgggggcttaccgaaatcaacgctttcaagaatatgcaatctaaagtagtcccactcgacaatattttcagagtgtgcaagagtcagcctccgagcatctacaacgccagcgccacctcagttttccacaagcattgtgcgatacacgtgttcccttgggatcaggaatacttcgacgtcgagcctagctttactgtgacctatggcaagctggttaaactcctgtcccccaagcagcagcagtctaaaactaagcagaatgtgctgtcccctgagaaggagaaacaaatgtcagagccactagatcaaaagaaaatcaggtccgaccataatgaagaggatgaaaaagcatgcgtgttacaggtggtgtggaatgggcttgaggaactgaacaacgcgatcaagtatactaagaatgtcgaggtactgcatctcggcaaggtctggatccctgatgatcttaggaagaggctcaatattgaaatgcacgccgttgtgaggattacaccggtcgaggttacaccgaagatcccccgttctctcaaactgcagcctcgggagaatttacctaaagatatctccgaagaagatattaaaacagtcttctatagctggttgcagcagagtacaaccacgatgctgcctctggtgattagtgaggaggagttcatcaaactggaaacaaaggacgggctgaaggaattcagtcttagcattgtgcactcatgggagaaggagaaggacaagaacatttttttgttatctccaaatctcctgcagaagacgacaatccaggtgctcctggacccaatggtgaaggaagagaacagcgaggaaatcgatttcattctgcctttcctcaaactgtcctccctcggaggagtgaacagcctgggagtgagcagcctggaacacatcacccactccttgctcggtagacctctcagccgccaacttatgtccctcgttgctggactgagaaatggagccctccttctgacaggcggcaaaggctccgggaagtcaacactcgctaaggccatttgtaaagaggctttcgacaagctggacgcccatgtggagagggtggattgtaaggctctgaggggcaagagacttgaaaatatccagaagacacttgaggtagccttttcagaggccgtttggatgcagccaagcgtcgtactcctggacgacctcgacttaattgctggtctgccagccgtgcccgaacacgaacactcgcccgacgctgtgcaatcccagcggctggcacacgccttgaacgatatgatcaaagaatttatcagtatgggaagtcttgtcgccttgattgccacgtctcagtcccagcaatccctgcaccctctgctcgtgtctgcccagggggtccacattttccagtgtgtgcaacatatccagccaccaaaccaagagcagcggtgtgagattttgtgcaacgttatcaagaacaagctggactgcgatattaataagttcaccgatttggacttgcagcacgtagcaaaagagaccgggggttttgtggcacgggactttaccgtgttagtcgatagggccatccactcccgcctatctcggcaaagcatctcaacaagggagaagttagtactcactacactcgacttccaaaaagcgctaagagggttcctgcctgccagcctgcgctctgtcaatctccacaagccaagagatctgggatgggataagattgggggattgcacgaagtcagacagatcctgatggacacaattcaactcccagctaagtatccagagctgtttgcaaacctgcccatccgacagcgcaccgggattctgctctacggaccccccggaactgggaaaactctcctcgctggcgtgatcgctcgcgagtcccgcatgaacttcatctcagtgaaggggcctgagctgctctccaagtacattggagcaagcgagcaagctgtgagagacatcttcattagggctcaggccgctaagccctgcatacttttcttcgacgaatttgaaagtatcgcaccacgacggggccatgacaacaccggcgttacagatagggtagtaaatcagttactaactcagctggatggtgtcgagggcctgcagggcgtgtatgtgctggccgcaaccagcaggccagacctgatcgacccagctctgcttcgaccgggtaggttagataagtgtgtctattgcccacccccagaccaagtgagtcgcctggagatactgaacgtgttgtccgactccttgcccctagccgatgacgtggatctgcagcacgtcgcttctgttaccgactcattcacaggcgccgatcttaaggccctcctttacaacgcacagctggaggctttacatggcatgttacttagcagcgggctacaggacggctccagttcctccgatagcgatctgagcctgagctccatggtgtttctcaatcactccagcggcagcgacgactccgctggggacggagagtgtggactagaccagagtctggtgtccctggagatgagcgaaatccttcctgacgaatccaaatttaatatgtaccggctttactttgggtcatcttatgagtcagaactcggaaacggtacaagctccgacctgagttcccagtgtctgtctgccccaagctctatgacccaggaccttcccggagtccccggcaaagaccaactcttctcccaaccacctgtactacggacagcgagtcaggaggggtgccaggaactcacccaggaacaaagagaccaactcagagccgatatcagcattataaaagggcgatacagaagtcagagcggcgaggatgaaagtatgaaccagcccggccccattaaaactagactcgcaatatctcaatcccatttgatgaccgcactcgggcacactcgccccagtataagcgaggacgactggaaaaactttgctgaattgtacgaatctttccagaatccaaaaaggaggaagaatcagtctggcaccatgttccggccagggcaaaaggtcacactagcatag

SEQ ID NO: 198986 - DNA, 3681 bp, Artificial Sequence
  Description of Artificial Sequence: Synthetic coding sequence
atgtggggcagcgaccggctggccggcgccggcggcggcggcgccgcagtgacggtggcattcactaacgcccgggattgttttttacatctgccccggagactggtggcacagttgcatcttcttcaaaaccaggctatagaagtggtgtggtcacaccagccggccttcctgtcttgggtcgaagggagacatttcagtgatcagggggagaacgtcgccgagatcaatcggcaagtggggcagaaactaggattatccaatggagggcaggtgtttctaaagccatgcagccatgtagtgtcctgccagcaagttgaggtcgagcccctgtccgcagacgactgggaaatactggagcttcacgcagtgagcctcgagcaacatctgctggatcagatacgaattgtttttccaaaggccatcttccctgtctgggtagaccaacagacgtacatttttattcagatagtggctctaattcctgccgcttcatatgggaggctggaaactgacactaagctgctcatccagcctaagacgagacgggccaaggaaaacaccttcagcaaagctgacgcagagtataagaagttgcattcatacggacgcgatcagaaagggatgatgaaagagttgcagacaaagcagctacagagcaatacagtgggcatcaccgagtccaacgaaaacgaatcagaaattcccgtcgactctagttcagttgcttctttgtggactatgataggttccatattctcatttcaatcagagaagaagcaggagacatcctggggactgactgagatcaatgcctttaagaatatgcaaagcaaggtggttccactggataatattttcagagtgtgcaagagtcagccgcccagtatatataatgcatctgcaacttcagtcttccacaagcactgtgccattcatgtgtttccgtgggatcaggaatatttcgacgtcgagccatctttcactgtgacatatggcaagctggtcaagctgctgagtcccaagcagcagcagagtaagaccaaacagaacgttctgagcccagagaaggagaaacagatgagcgaacccctggaccagaaaaagatcaggagcgatcacaatgaggaggacgaaaaagcctgcgtcttgcaggtcgtctggaacggcctggaggaactgaataatgctataaaatacaccaagaacgtcgaggtgctgcacctcggcaaggtgtggataccggatgacctgagaaagcggctgaacatagaaatgcatgccgtggttagaatcacccccgttgaggttactccgaagattccaagatccctgaagctacagcctcgagagaacctcccaaaggacatcagcgaagaagacatcaagaccgtgttctacagttggttgcagcagtcaaccaccaccatgctcccactggttatttccgaggaagagttcattaagctggagacaaaggatggcctgaaagaattctccttgtctatcgtccattcatgggagaaggagaaggataaaaacatattcctgctaagtccaaatttgttgcagaagactaccattcaagtcctgttggatccaatggtaaaggaagaaaactcagaagaaatagatttcattttaccatttctgaagttgagttctctcggtggtgtgaatagtctaggagtctcatccctggaacatattactcacagcctcctggggaggcctctgagccgtcagctcatgtcacttgtcgcagggttaaggaacggggccttactgctcaccggcggaaaaggttcaggcaaaagcaccctcgctaaagccatctgtaaggaggccttcgacaagctcgatgcccacgtagagagagtcgactgtaaagcactgcgggctctcaacgatatgataaaggagttcataagcatgggatctctcgtggccctgattgcaacctctcaatctcagcagtctcttcacccactgctggtgtcagctcaaggagtccacatttttcagtgcgtgcaacatatccagccgcctaatcaggaacagcggtgtgaaatcctatgcaacgtcattaagaacaaattagattgcgacatcaataagtttacagacctagatcttcaacacgtggcgaaggaaactggggggttcgttgccagggactttaccgtgctggtcgatcgggcgatccacagtagactcagccgccagtcaatcagtaccagggaaaagctcgttttaacgacactcgatttccaaaaagcactccgcggcttcttaccagctagtcttcggagtgttaacttgcataagcccagagatttggggtgggacaagattggagggttacatgaggtgagacagattctgatggacacaatacagctgcccgcaaaatatccagagttattcgcaaatctgcccattaggcaacgaacagggattctgctttatggcccccctggcacaggtaaaacccttttggccggagtaatagcacgggagtcacgcatgaatttcatctccgtgaaagggcctgaacttctatcaaaatatattggggcatccgaacaggccgttcgcgatatctttatccgtgcccaggccgccaaaccttgcatccttttttttgatgagttcgaatctatagcaccacggagagggcacgacaatactggcgtcacagatagagtcgtaaaccagctccttacacagttagacggtgtggagggcctccaaggtgtttacgtcttggcagcaacttcccggcctgacttaatcgatcctgctctactgaggcccggaaggctggataaatgtgtatattgtcccccgccagatcaagtgagccggctggagatactgaatgtcctcagcgatagtttgcctctcgcagatgatgtcgatctgcagcatgtcgcttctgtgacagattcctttaccggggccgatttgaaggcactgctgtacaacgcgcaactggaagccctgcacgggatgctgttatcctctggactccaagatgggtcctccagctcggatagcgacttatcgctctcgagcatggtcttcttaaaccacagcagtggttctgacgactcagcaggagacggcgaatgtggactcgaccagagcctagtgtctctagagatgtccgaaatcttgcctgacgagtccaagtttaatatgtatcggctctatttcggcagctcctatgagtcggaattaggcaacggcactagctcagaccttagctcacagtgtctttcagcgccctcaagtatgactcaggaccttcctggagtgcccggaaaagatcagctcttttcgcaaccccccgtcctgcgcacagccagccaggagggctgccaagaactgacacaggaacagcgcgatcagctgcgggccgacatatccataatcaaaggtagataccgctcccaatccggcgaagatgaaagcatgaaccaaccaggaccaatcaagacaaggctggcaatttcacagtctcatcttatgaccgccttgggtcacacgcggccatcaataagcgaagatgactggaaaaacttcgccgagctttacgagagcttccaaaaccctaaacgacggaagaatcagtcgggcaccatgtttagaccaggacagaaagtgactcttgcgtag

SEQ ID NO: 198987 - DNA, 483 bp, Artificial Sequence
  Description of Artificial Sequence: Synthetic coding sequence
atgagcctggtggccggcctgcggaacggcgccctgctgctgaccggcggaaagggatctggaaaaagcacgctagccaaggccatctgcaaggaggcttttgataaactggatgcccatgtcgaaagggtagattgcaaggccctccgggggaagcgcctggaaaacatccagaagacactagaggttgcattctctgaggccgtctggatgcaaccgtctgtcgtgctgttggacgatctcgaccttatcgccgggctgcctgcagtccctgaacatgaacacagcccagacgccgtacaatcacagcgcctggcccacgcactgaatgacatgatcaaggagtttatatctatgggttccctcgtagcgctcattgccacctcccagtcccagcaatccctgcatccgctgctggtgagtgcccaaggggtgcatatctttcagtgcgtccaacatatacaaccgccaaatcaaaattag

SEQ ID NO: 198988 - DNA, 1899 bp, Artificial Sequence
  Description of Artificial Sequence: Synthetic coding sequence
atgtggggcagcgaccggctggccggcgccggcggcggcggcgccgccgtcacagttgccttcaccaacgcccgcgattgttttttgcaccttcccaggaggctggttgctcagcttcacctccttcagaaccaggctatagaagttgtgtggtcccaccaacctgcatttctttcatgggtcgagggccgccactttagtgaccaaggagagaatgttgccgagatcaatcgccaggttggacaaaaactggggctctcaaacggtggacaagtgtttctcaagccttgtagccatgtcgtgagctgtcagcaggtggaagtggagccactgtcggctgatgactgggagatcttagagttacacgccgtgagtctggagcaacatctgctggatcagatccgcatcgtctttcctaaggctatattccctgtttgggtcgaccagcaaacctacatcttcattcagatcgttgcgctgatacccgccgctagttacggtagactcgaaacggacaccaagctactaatccaacccaagacaaggagggccaaagagaatacgttttctaaagctgacgctgaatataagaaactccattcatacggtagagatcaaaaaggcatgatgaaggagctgcagacaaagcagttgcaatccaatacagtcggcataacagagtcaaacgagaacgagtcggagatcccggtcgacagttcttccgtggctagtctgtggaccatgatcggttcgatcttctcttttcagagcgaaaaaaagcaagaaaccagctgggggctgaccgagatcaacgctttcaagaatatgcagtctaaggtcgtccccctcgataatatattccgggtttgcaagtcacagcccccatccatttataacgctagcgctactagtgttttccacaaacattgtgctatccacgtgtttccttgggaccaggaatactttgatgtcgagcctagctttacagtcacttatgggaagctggtaaagctgttatcacctaaacaacaacaaagtaaaacaaaacagaacgtcctctctccagagaaagagaagcaaatgagcgaacctctcgatcagaaaaaaatcaggagcgaccacaacgaagaagacgaaaaggcctgcgttctgcaggtggtgtggaacgggcttgaggaactgaataatgccatcaagtatacgaaaaacgtagaggtcctgcatttagggaaagtctggatccccgacgacctcaggaaaaggctgaacatcgaaatgcacgctgtcgtccggatcacgccagtggaggtaacccctaagattccccgctctcttaaactgcagccgcgcgagaatttgccaaaggacatatctgaagaggatattaagactgttttttactcctggttgcagcaatcaacaaccacgatgctcccattagtgatttccgaggaggagttcatcaaattggagacaaaagatggactgaaagaattcagcctgtcgatcgtgcacagctgggaaaaggaaaaggacaaaaacatcttccttctctcgccaaatcttctccagaagaccactatccaggtgctgctggatcctatggtaaaagaagagaactccgaagagatagactttatcctgccctttctcaaattgagtagcttgggaggagttaactccctcggcgtctcctcactggagcatattacccactctctactaggtcggccattgagccggcaactgatgtccctggtcgccggactcaggaacggtgccttgcttctcacgggcggaaaaggaagcggaaaatccacacttgccaaggcgatttgtaaggaagcctttgataaactggatgcgcacgtcgagcgggtcgattgtaaggccctgtag

SEQ ID NO: 198989 - DNA, 1041 bp, Artificial Sequence
  Description of Artificial Sequence: Synthetic coding sequence
atggcccccgccgccgccagcccccccgaggtgatccgggccgcccagaaggatgaatattaccgcggcgggctgcgatcagccgcgggcggcgctttacacagcctggcgggggccaggaaatggcttgagtggcggaaggaggtcgagctgttgagtgacgttgcctactttgggcttactaccctggcaggatatcagacattgggcgaggagtacgtgtccatcatccaggtggatcccagtagaatccatgtaccgagctcactccgtaggggggtgctggtcactcttcacgccgttttaccatacctcctcgacaaggcgctgctgcctctagagcaggagctccaggccgacccagactcaggaagacctctgcagggctctctaggacctggtggcaggggctgcagcggcgcccgccgctggatgagacaccatactgccactttgaccgaacagcaacgccgtgcgctgctaagggccgtgtttgtgctaagacagggcctcgcgtgtctgcagcgccttcacgttgcatggttttatatccatggcgttttctatcatctagcaaaacggctaacgggcatcacctaccaggcactacgacctgatcccttgagagtgctcatgtctgtggccccgagcgctctacagttgcgcgtgcgctccttgccaggggaggacctgcgcgctcgagtatcctacagattgttgggagtcatcagccttctgcacctggttctgagcatggggctacagctttacgggtttcgacaacgccaacgggctcgaaaagagtggagactccatcgtgggcttagtcatcggcgcgcttccctcgaggagagggcagtgtccagaaatcctctgtgcaccctgtgtctggaagagcggagacaccccaccgctaccccctgtggacatctgttctgttgggaatgtattacggcctggtgctcttctaaggccgaatgccctctttgcagagagaagttcccccctcaaaagctgatatatctgcggcattaccgctag

SEQ ID NO: 198990 - DNA, 981 bp, Artificial Sequence
  Description of Artificial Sequence: Synthetic coding sequence
atggcccccgccgccgccagcccccccgaggtgatccgggccgcccaaaaggacgaatattaccgcggtggactgagatctgccgctggaggcgccttgcactcactcgccggggctaggaaatggctagagtggagaaaggaagtggaattgcttagtgatgtcgcgtacttcgggctgactaccctcgccgggtaccaaaccttgggggaggaatatgtgtcaattattcaggtcgatcccagcaggatccacgtgcccagctctctgcgacgcggggtgcttgtcacccttcacgccgttctcccttatctgctggacaaagcactgttgcccctcgagcaggagctgcaggctgacccagattctgggcgccccctgcaagggagtttgggccccggggggcgaggatgcagtggggcgaggaggtggatgcgtcaccacaccgctactctcactgagcaacaaaggagagccttgttgcgcgctgtcttcgttttgagacaaggtttggcctgcctacagcgtctgcacgtggcatggttctatatccacggtgtgttttatcacctcgcaaaacggctgacagggattacctacctgagggtgaggtcactgcccggcgaggacctgcgcgcgagagtgagttacaggcttcttggggtcatttctctgctccatctcgtgctctcaatgggattacagctctatggatttagacaacggcagagggcgagaaaggagtggcggcttcatcgcggcctatcacacaggagggccagcctggaggagagggccgtgagcagaaaccctttgtgtacactgtgtttggaagagcgccggcatcctaccgccactccctgcggtcacctgttctgttgggaatgcatcacggcatggtgctcctcgaaagccgagtgtccgctctgcagagagaaatttcctcctcaaaaactgatctacctcagacactatcgatag

SEQ ID NO: 198991 - DNA, 744 bp, Artificial Sequence
  Description of Artificial Sequence: Synthetic coding sequence
atggacgccttcacccggttcaccaaccagacccagggccgggaccggctattccgggctacccagtacacatgcatgctgcttcgatacctgctagaacctaaagcaggcaaggagaaggtcgttatgaaactcaagaagctcgagagctctgtcagtaccggacgcaaatggttccgtctgggaaatgtggtccatgcaatccaggccaccgagcagagcatccacgccacagacctggtaccacggctctgcctaaccctggctaatctgaaccgcgttatttattttatctgtgataccatcctgtgggttaggagcgtagggctgaccagcggtattaacaaggagaagtggcgaactagagctgcacaccattactactattctcttctgctgagtctagtgcgggacttatacgaaatatccctgcaaatgaagagagtgacgtgcgaccgagctaaaaaggaaaagtccgcctcccaggatccactatggttctccgtagcagaggaggagacagaatggctgcagtcctttctgctgctgttgttcaggtctcttaagcaacaccctccactgttgctggacaccgtgaaaaatctttgcgacattctgaatcctcttgatcagttaggtatttacaagtcgaaccccgggattatcggcttaggagggttagtcagttccatcgcgggcatgatcaccgtggcctatcctcagatgaagctgaaaacgaggtag

SEQ ID NO: 198992 - DNA, 1209 bp, Artificial Sequence
  Description of Artificial Sequence: Synthetic coding sequence
atgccctggaagctgtggcggggcagcgtgggctgccccggcgacctgtcatccgacggacttctcttcaggctcggccctccaaagccacccacggagctggagcctgagcccgaaatagagggattgttgacaccagtcctagaggcgggcgatgtggacgaaggacctgtggcccgccctctaagccctactaggctccagcccgcccttccccctgaagcacaaagcgttcccgaattagaggaggtggcccgtgtgctggcagagatccctagacccctaaagaggcgaggctccatggagcaggctcccgcagtggccttgcccccaacccacaaaaaacaatatcagcagattataagcaggcttttccaccggcacgggggccctgggccaggaggcccagagccggaactgagtcccataaccgaaggctccgaagcccgagccggcccccccgccccagccccgcccgcacctatccccccacccgcacctagccagtcatcccccccagagcagccgcaaagtatggagatgagatcagtgttaagaaaagccggctcacctaggaaggctaggagggcgcgactgaaccctttggtgctactcctggacgccgccctgaccggagagctggaggttgtgcaacaagcagttaaggagatgaatgatcctagccaacccaacgaagaagggatcaccgcactgcataacgcaatctgtggcgcaaactactcgatcgtagatttcctgatcacagccggtgccaacgtcaatagtccggacagccatggatggacccccctgcattgtgccgcctcatgcaatgacactgtaatatgcatggcgctggtccagcatggagcggctatttttgctacaaccctttccgatggcgccaccgctttcgaaaagtgcgatccatatcgtgaagggtatgccgactgtgccacttatttggctgatgtggaacagtcaatgggccttatgaatagtggcgccgtctatgccctgtgggactacagcgccgagttcggggacgagctgagctttagagaaggggagtctgtcacggtgttacgcagggacggtcccgaagagacagattggtggtgggctgccctgcatggccaagagggctatgtccctcgcaactacttcggactctttccaagagtcaaaccccaaagaagtaaagtctag

SEQ ID NO: 198993 - DNA, 507 bp, Artificial Sequence
  Description of Artificial Sequence: Synthetic coding sequence
tgataccggggccgggaccggctgatccgggtgctgggctactgctgtcagctcgtgggcggagttttggtggaacagtgccctgcccgaagtgaggtaggcactagacttctcgttgtgagtacccagctctctcactgcagaaccatcttgaggctttttgacgatttagcaatgttcgtgtacaccaaacaatatggcttaggcgcccaagaagaagacgcttttgttcggtgcgttagcgtcctgggcaacctggcagaccagctctattatccctgcgaacacgttgcatgggccgcagacgcacgcgtgctccacgtcgacagtagccgatggtggaccctctccacaactctctgggctcttagcctccttttgggtgtggcaagaagcctatggatgctgctgaagctaagacagcgactgaggagtccaactgctccttttaccagtatgtaccaggccgctagggcaggagggcaggcggaggccaccaccccttag

SEQ ID NO: 198994 - DNA, 1212 bp, Artificial Sequence
  Description of Artificial Sequence: Synthetic coding sequence
atggccagccagcccccccccccccccaagccctgggagacccggcggatcccaggagccggacctggccctggcccaggccccacgttccagagtgccgacctaggtcccacactgatgactcggcccggccagcccgccctgactcgggttccccctccaatcctgcctcgcccctctcagcagaccggcagcagctcagtgaatacatttagacccgcctattccagcttcagctcagggtacggcgcctacggaaattcgttctacggcggatatagcccttactcttacggctataacggtctggggtacaaccggctcagagttgacgacctgcccccctcaaggtttgttcaacaagcagaagagagctccagaggcgcttttcaatctattgaatctatcgtgcacgctttcgcttccgtctctatgatgatggatgccacgtttagcgcggtttacaactccttccgggccgttctggacgttgccaatcattttagtcggctgaaaatccacttcaccaaggtcttctcagcttttgcgctcgtcagaacgatccgttatctttacagaaggctgcagaggatgttgggcctccgaagaggatccgagaatgaagatctgtgggccgagtctgagggcacagtcgcctgcctgggcgccgaagatagagctgccacatctgcaaaatcatggccaatattcttattcttcgccgtgattctgggtggaccgtaccttatctggaaattattgtctacgcattctgacgaggtgactgacagcatcaactgggctagcggcgaggatgaccacgtggtagcccgcgcagaatacgactttgccgcggtgtcagaagaggagatctctttccgcgccggcgatatgttgaatttagcactgaaggaacaacagcctaaggtaagaggttggctcctggcaagcttggatggacaaaccaccggactcattcccgccaactatgtgaagatccttggaaagagaaagggtcggaagactgtggagtcctccaaagtatcaaagcagcaacaaagctttacaaaccccactctgacaaagggcgccacagttgctgattcactggatgagcaagaggccgcattcgaatccgtcttcgtggagaccaataaggtgcccgtagctcccgacagtatcggaaaggatggtgaaaaacaggacttgtag

SEQ ID NO: 198995 - DNA, 1134 bp, Artificial Sequence
  Description of Artificial Sequence: Synthetic coding sequence
atggccagcagcgagcaggccgagcagcccagccagcccagcagcacccctgggtccgaaaatgtgctgccacgcgaaccccttattgctaccgcggtgaaattccttcaaaacagccgagtccggcaatctcccctggcaaccagaagggcgtttctcaagaaaaaggggctgactgacgaggaaattgacatggcgttccagcaatccggtactgccgctgatgaaccctctagtctggggcccgcgactcaggtcgtgcctgtgcagccacctcacctgataagccagccctactctcccgctggctcccgatggcgtgattacggcgctttagctatcattatggccgggatcgccttcggatttcatcagctttacaagaaatacttgctgcccctaatactggggggaagggaagaccgcaagcagctcgagaggatggaagcaggactgagcgagctcagcggtagtgtggcccagactgtcacgcaactgcagaccacccttgctagtgtgcaggaactactgatacagcagcagcaaaagattcaagagctcgcccacgaattagcggctgccaaagctacaacaagcacaaactggatcctagagtcccaaaacatcaatgagttgaaatctgagattaattccctgaaagggctgctgctcaatcgccgccagttcccgcccagcccaagcgcacccaaaattccctcatggcaaattcctgtgaagagcccgtctccctccagccctgcagccgtcaatcaccactcatccagcgacatttcacctgtgtccaacgaaagtacaagcagcagcccaggaaaggaagggcattctcctgaggggtctaccgtcacgtaccacctgctcgggccccaagaagagggtgagggggtggtggacgtcaaggggcaggtgagaatggaggtgcagggggaagaagaaaagcgggaagacaaggaggacgaggaagacgaggaagatgatgatgtctcacacgttgatgaggaagactgtttgggagtccagagagaagatcgtcgcggtggggatggtcagattaatgagcaagttgagaagctgcggagaccggaaggagccagcaacgagtccgaaagagattag

SEQ ID NO: 198996 - DNA, 942 bp, Artificial Sequence
  Description of Artificial Sequence: Synthetic coding sequence
atggccttccagcagagcggcaccgccgccgacgagcccagcagcttagggcctgcgacccaggttgtccccgtgcagcccccccatctgatctcccaaccctattctcctgcgggatcccgttggagggactacggggctctcgcaatcatcatggctggtatagcgttcggattccaccagttgtacaagaaatatctgcttccgctcatactcggcggccgcgaggacaggaagcagctcgaacgaatggaagcaggcctgtcggagctctcgggctctgttgcacagacagttacacagttacagactacattggccagcgttcaggaactgctcatccagcagcagcaaaagatccaggaactcgcccacgagctggctgcagcaaaagctaccacatctacgaactggatcctggaatctcagaatataaacgaactcaaaagcgagattaatagtttaaaaggcctactgcttaatagacgccaatttcctccgtccccctccgcgccaaagattccttcatggcagatcccagttaaaagcccatcacccagtagcccagctgcagtaaaccatcactcgtctagcgatatttcacccgtgtctaatgaatcaacatcctcgagccccgggaaggaggggcactcccccgagggaagcacagtgacataccacctccttggaccacaggaggagggggagggcgttgtagacgtgaagggccaagtgcgtatggaagttcaaggagaggaagagaaaagagaagacaaagaagacgaagaagatgaggaggatgatgacgtcagtcacgttgacgaagaggattgcctaggcgtccaacgagaagatcggagaggtggagatggacagatcaatgaacaggtggagaagctgcgaagaccggagggagcttctaatgagtcagagcgagactag

SEQ ID NO: 198997 - DNA, 1041 bp, Artificial Sequence
  Description of Artificial Sequence: Synthetic coding sequence
atggagaagctgcggctgctgggcctgcggtaccaggagtacgtgacaaggcaccctgcagccactgcccaactggagacagctgtccgcggtttctcctatttgctcgccggaagatttgctgattcacatgagttgagcgagttagtgtattccgcctctaacctcttagtacttttgaacgacggcatcctgcggaaagaactgaggaagaagttgcctgtctccctatctcagcagaagctgttaacttggctcagcgttttagagtgcgtggaagtcttcatggagatgggggcggcaaaagtatggggcgaagtgggtagatggctcgtgattgcgttggtgcaattggccaaagccgtgctgcgaatgctattactgttgtggttcaaggccgggctgcagacttcacctcccatcgtgccacttgaccgcgagacccaagcccaaccccctgatggcgatcattcccccggaaatcacgagcagagttatgttgggaagcgcagcaaccgcgttgtgaggactctgcagaacacgccttcattgcattctcgccattggggagcacctcaacaaagagagggtagacagcaacagcatcatgaggaactctctgctacacctacacctctaggcctccaagagacaattgcggagtttctatacatcgcccggccgttgctgcacttgctgtccctcggtttgtggggtcagcgatcctggaagccctggctgttggcaggcgtggtcgacgtaactagcctcagccttctgtccgatcggaaggggctgactcggcgggagaggcgtgagctgaggcgccgaactatcctcctcctgtattacctgttgagatctcccttctacgaccgctttagcgaggcgcgtattctgtttttgctgcagctcctggcagaccatgttcccggcgtgggcttggtcacgacctctcaaagggcagccagcccctgtctcccagctcgcccccacactcagccatggagcccacccgcttttctccccggacacccctag

SEQ ID NO: 198998 - DNA, 1011 bp, Artificial Sequence
  Description of Artificial Sequence: Synthetic coding sequence
atggagaagctgcggctgctgggcctgcggtaccaggagtacgtgacaagacacccggcagctaccgcccagcttgagaccgctgtgagagggttctcataccttctggccggcagattcgcggactctcatgaattgagtgagctggtttactccgcctccaacctgctggtgctcctgaacgatgggatccttagaaaagagctgaggaagaagctgcccgtttccctctcacagcaaaaactgctcacctggctcagcgttctggagtgcgtcgaggtcttcatggagatgggagccgccaaggtctggggtgaggtgggacgctggctggtgatagcacttgtgcaattagccaaagccgtgctgaggatgttgctactcttgtggtttaaggcaggactccagacctccccgccaatagtccctttggatcgcgagacgcaggcacagccccccgatggggaccacagccctggcaaccatgaacagagttatgtgggcaagaggtccaacagagtagtgaggacactccaaaataccccctccctccattctagacattggggggctccgcagcagcgcgagggcagacagcaacaacaccatgaggaactaagtgcaacccccactcccctggggctgcaggaaaccatagccgagttcctatacattgccagacctcttcttcatttgttaagccttggcctgtggggccagcgctcatggaagccttggcttctggcaggagttgtggacgtgacctccttgagccttttatctgaccggaaaggcctcacgaggcgagagagacgcgagttaaggcggagaactatcctgctattatattatctcctgcgctcgcccttctacgaccgttttagcgaggctcgcattttatttcttctacaactcctggctgaccacgtcccaggagttggtctggtcactcgcccgctcatggattatctgcctacgtggcagaaaatttacttctactcgtggggctag

SEQ ID NO: 198999 - DNA, 900 bp, Artificial Sequence
  Description of Artificial Sequence: Synthetic coding sequence
atggccgccgccgaggagggctgcagcgtgggcgccgaggccgaccgcgaactcgaggaacttctagagtccgctctggatgactttgataaggcaaagccctcaccagcacctccctcgacaactactgctccggatgctagtggaccccagaaacgttcccccggcgacacagcgaaagacgcactgttcgcttcccaggagaagttctttcaggagctgttcgacagcgagcttgccagccaagcaaccgccgagtttgagaaggcaatgaaggagcttgctgaagaggagccgcacctggtagagcaatttcaaaaactgagtgaggctgcgggcagagtggggagcgatatgacgagccagcaagaatttacatcttgcctgaaggagacactctcaggcctagccaaaaatgctactgatctgcaaaattcctcaatgtccgaagaagaactgaccaaggccatggagggacttggtatggacgagggggatggagaaggcaatatcctgcctattatgcagagcattatgcaaaacttgctttctaaggacgttctctacccatccctgaaagagatcacagagaagtatccggagtggctgcagtcccatcgcgaatctctaccccccgaacaattcgaaaaataccaggaacaacactctgtaatgtgcaagatttgtgagcagtttgaggcggagacgcccaccgattcagaaacaacccaaaaggccaggttcgaaatggtactcgacctcatgcagcaacttcaggacctcggacacccaccaaaagagctggctggcgagatgcctcccgggttaaacttcgatctcgatgccctgaatctaagcggaccgccgggcgcttcaggcgaacagtgtctgatcatgtag

SEQ ID NO: 199000 - DNA, 708 bp, Artificial Sequence
  Description of Artificial Sequence: Synthetic coding sequence
atggagagcggcgccctggacgacttcgacaaggccaagcccagcccagctcctcccagtactactacagcccccgatgcttccggtccccaaaagaggagtccaggagacactgctaaggacgccctttttgcatcacaggagaagttcttccaagagctgtttgattcggagttggcctcccaggcaactgctgaatttgagaaagcaatgaaagagctggctgaggaggagcctcatttggtcgaacagtttcagaagttatccgaggctgctggcagggtaggctctgacatgacgtctcagcaagaattcacaagttgcctaaaggaaactttatcagggctcgccaagaacgctactgatttgcagaattctagtatgtcagaggaagagctgacaaaagccatggaaggcttaggtatggatgagggagacggggaggggaacatcttaccaatcatgcagtcaattatgcaaaatctgctgtctaaggatgtgctctatcctagcctgaaagaaataactgagaaataccctgaatggctccaatctcaccgagagagcctgccccccgagcagttcgagaagtatcaggaacagcacagcgtgatgtgtaagatttgtgaacagtttgaagctgaaaccccgacagatagcgagacgacgcaaaaggcccggttcgagatggttctggatctcatgtag

SEQ ID NO: 199001 - DNA, 840 bp, Artificial Sequence
  Description of Artificial Sequence: Synthetic coding sequence
atggagagcggcgccctggacgacttcgacaaggccaagcccagccccgctcccccatcaaccaccaccgccccggacgcctcgggcccccagaagaggagccccggggacacggccaaggacgctctcttcgcctctcaggaaaagttttttcaggaactcttcgattccgagctggcatcacaggctaccgctgagttcgaaaaggccatgaaggaactggccgaagaggagcctcacctggtagagcagtttcagaaactgagcgaagctgccgggcgggtcggctccgacatgacatcccaacaggaatttacctcgtgtctgaaggagactctgtctggtctcgcgaagaacgctacagatctgcagaatagcagtatgagtgaagaagaactaaccaaagccatggagggcttggggatggacgaaggcgacggggaagggaacatcctccccataatgcagtctatcatgcaaaaccttctaagcaaagacgtgctgtacccgtctctgaaggaaatcacggagaagtacccggagtggctccaatctcaccgggagtccctgccccccgaacagtttgagaaataccaggagcagcatagcgtgatgtgtaaaatctgcgagcagtttgaggccgagactccaacagactcggaaacaacccagaaggctagatttgaaatggtgctggatctcatgcagcaactgcaggatctcgggcaccctccaaaggagctcgccggcgaaatgcctcccggcctgaactttgacctcgatgcccttaatctgtctggcccgcccggtgccagcggggagcaatgtttgattatgtag

SEQ ID NO: 199002 - DNA, 630 bp, Artificial Sequence
  Description of Artificial Sequence: Synthetic coding sequence
atgaaggagctggccgaggaggagccccacctggtggagcagttccagaaattgagcgaagcagctggacgggtgggttccgatatgacttcacagcaggaatttacatcttgtcttaaagaaaccttgagcggcctcgctaagaatgccacagacctccaaaatagttccatgagcgaggaagaactcaccaaggctatggagggtctcggtatggacgagggagatggggagggtaatattctgcctatcatgcaaagtatcatgcagaatctcttgtctaaggacgttctttacccatctctcaaggagatcaccgagaagtatccggagtggctccaatctcatcgtgagagtttaccccccgagcagttcgagaaatatcaggagcaacactccgttatgtgcaagatctgtgagcaatttgaggctgaaactcccacagactctgagaccactcaaaaggctcgatttgagatggtcctcgatcttatgcagcagctccaggatttaggacaccctccaaaggagttggcaggcgagatgccacccggcttgaattttgatctggatgctctgaatttgtcaggtccccctggggcatccggtgagcaatgcctgattatgtag

SEQ ID NO: 199003 - DNA, 561 bp, Artificial Sequence
  Description of Artificial Sequence: Synthetic coding sequence
atggccgccgccgaggagggctgcagcgtgggcgccgaggccgacagggaactcgaggaactgctggagtccgccctggacgactttgacaaggcgaaaccatcgcctgcgccaccaagtacgacgaccgcaccagacgcttctggccctcagaaacgaagccccggcgatacagccaaggatgcactcttcgcatcacaggagaagttcttccaggagctgtttgactccgaactggcatcccaggccaccgctgaatttgaaaaagccatgaaagaactggcagaggaagaaccgcacctagtggagcagttccagaagctttcagaggcagctgggcgggtggagctccagcacgtgggcagacgggccgaccaaggacatggcggcgccagacatgggcgtcggggatgggggcgcgagcatccaccccaccacgctgaatactacgcagagcccacgctgcaaggatgtgccgttccgattacagagggagaccaccgaaaggtaagcaggatggtcgctgaatccagcggaatcagtacttcccgtgcagtgtag

SEQ ID NO: 199004 - DNA, 918 bp, Artificial Sequence
  Description of Artificial Sequence: Synthetic coding sequence
atggccagccggaaggagaacgccaagagcgccaaccgggtgctgaggatttcccagctggatgccctggagctgaacaaggcactggaacagctcgtatggagtcaatttacgcagtgctttcacgggttcaagcccggtctcctggcccgatttgaacctgaagtaaaagcctgtctttgggtgttcctctggcgctttacaatctattccaagaacgcgactgttgggcagagcgtgcttaacattaagtacaaaaacgatttcagcccaaatctaagatatcaacctccctccaaaaaccagaagatatggtacgcagtgtgtacgataggcgggcgatggctggaagagaggtgttatgatttatttcgtaaccaccaccttgcctctttcggaaaggttaaacaatgtgtaaacttcgtgattggcctgctgaaactgggcgggttgatcaattttctcatatttctgcagagaggcaagtttgccacgctgacagaacgtctcctcggcatccactctgtcttttgtaagccccagaacatttgcgaggtgggcttcgagtatatgaaccgggaacttctgtggcacggatttgccgagttcttgattttcctgttgcctctaatcaatgttcagaagctgaaagccaagctaagctcctggtgcattcctctgaccggcgcaccaaatagcgataacaccctggccacttcaggaaaggagtgtgctttgtgtggggaatggcccacaatgccccatacgattgggtgcgaacacattttctgctatttctgcgcaaagtcctcttttctttttgatgtatatttcacctgtccaaaatgtggaactgaagtgcatagtctccagcctctcaaaagcggcatcgaaatgtcagaggtgaacgcactgtag

SEQ ID NO: 199005 - DNA, 918 bp, Artificial Sequence
  Description of Artificial Sequence: Synthetic coding sequence
atggccagccggaaggagaacgccaagagcgccaaccgggtgctgcggatttcacaactcgacgccctcgaactgaacaaagctctggagcagctggtttggtctcagttcacccagtgctttcatggcttcaaacccggcctgctcgctcggttcgagccagaggttaaggcttgcctgtgggtttttctatggaggttcaccatctacagtaaaaacgctaccgtcgggcagtctgtattgaacattaaatacaagaacgatttttcacctaacctgcgataccagcctccaagcaaaaatcagaagatctggtatgccgtgtgtacaatcggaggacgttggctggaagagaggtgctacgacctttttcggaatcatcaccttgcatctttcgggaaggtaaagcagtgcgtcaattttgtgattggcttgctcaagctgggtggcctgatcaattttttgatattcctgcagagaggtaagttcgcaacactgactgaaaggctacttgggatccacagtgtgttttgtaagcctcaaaacatctgtgaagtgggcttcgagtacatgaaccgagaactcttgtggcacgggtttgctgaatttctcatcttcctgctgcccctgatcaatgtgcagaaactcaaggcgaaacttagctcatggtgtattccactgacaggggcacccaactctgacaataccctagctacatcgggtaaggagtgcgcattgtgcggcgaatggcctacaatgcctcacaccatcggctgcgagcatatcttctgctatttctgcgctaagagttcatttctgttcgacgtctattttacctgtcccaagtgcgggacagaggtccacagcctccagcccttaaagtcgggaattgagatgtccgaagtcaacgccttgtag

SEQ ID NO: 199006 - DNA, 543 bp, Artificial Sequence
  Description of Artificial Sequence: Synthetic coding sequence
atggccagccggaaggagaacgccaagagcgccaaccgggtgctgcggataagtcagctggatgcactggagttgaacaaggctctcgagcaattggtttggagccagtttactcagtgctttcatgggttcaaaccaggcttgttggctaggtttgagcctgaagtaaaggcctgcctgtgggtgtttttgtggcggtttactatttacagcaagaacgctaccgtggggcagtccgtgctgaacattaaatacaagaatgacttctcacctaatctacggtatcagcccccttcgaaaaaccagaaaatttggtatgctgtgtgcacaataggcggcaggtggcttgaggaacgctgctatgatctctttagaaatcatcacttggctagctttggcaaagttaagcagtgcgtcaactttgtgattggcttattgaagctgggcggcctgattaattttcttatttttctgcaaaggggcaagttcgcaacactgaccgagcgcctgcttggcatccactcggtattttgtaagccttag

SEQ ID NO: 199007 - DNA, 12 bp, Artificial Sequence
  Description of Artificial Sequence: Synthetic coding sequence
atggccagctag

SEQ ID NO: 199008 - DNA, 918 bp, Artificial Sequence
  Description of Artificial Sequence: Synthetic coding sequence
atggccagccggaaggagaacgccaagagcgccaaccgggtgctgcggattagccaactcgacgccctggagctgaacaaagcactggaacagctggtgtggagccaattcacccaatgctttcacggcttcaaaccaggcctgctggcgcgttttgagcccgaagtgaaggcgtgtttatgggtcttcctctggcggtttacgatttatagcaagaacgctacagtcggacaaagtgttttgaatattaagtataagaatgacttttcacccaatctcagatatcagccgccctcaaaaaatcaaaaaatttggtatgcagtgtgcaccattgggggtagatggctagaagagcggtgttatgatctattccggaaccatcatctggcctcttttggtaaggtgaagcagtgtgtaaatttcgtgattggcctgttaaagttgggcggcctcattaacttcctgatttttctgcagagagggaagttcgccacgctgaccgaacgactgctggggattcatagcgtgttttgtaaaccacaaaacatttgcgaggtcggctttgaatacatgaatcgagaactgctgtggcacggattcgctgaatttttgattttcttactccctctgatcaatgtgcaaaagctcaaagccaaactgagctcctggtgcatccctctcactggcgctccgaacagtgacaacacactcgcaaccagcgggaaagaatgcgctttatgcggtgaatggccaaccatgcctcataccatcggatgcgaacatattttctgttatttttgtgctaagtcatcattcctctttgacgtgtattttacatgccctaaatgtggcaccgaagtgcattcactgcagccgctgaagtcaggcatcgagatgtcagaggtgaacgccctctag

SEQ ID NO: 199009 - DNA, 918 bp, Artificial Sequence
  Description of Artificial Sequence: Synthetic coding sequence
atggccagccggaaggagaacgccaagagcgccaaccgggtgctgagaataagccagctggatgcactggagctgaataaggcgctcgaacagctggtgtggagccagtttacacagtgttttcacggattcaagcccggcctcctagctcggttcgagcctgaagtgaaagcctgcctctgggtgtttctatggagatttactatttactctaagaacgccaccgtagggcagtctgtcctgaacatcaagtataaaaacgatttttcaccgaacctcaggtaccaacccccttccaagaatcagaaaatctggtatgccgtgtgtaccatcggaggcaggtggctcgaggagagatgctacgatttattcaggaatcaccatctcgctagcttcggtaaagtgaaacagtgcgtgaatttcgtcattggactactgaagctcggcgggcttattaatttcttgatcttcctgcagagagggaagtttgccacattaactgaaagactgctcgggatccattcggttttttgtaagcctcagaatatatgcgaggtggggttcgaatacatgaatcgcgagttactgtggcacgggtttgcagagtttttaatttttctgctgcctctgataaacgtacagaagctgaaggcgaagctgagcagctggtgcatacccctaactggggcacccaattcggacaacactctggctaccagcgggaaggagtgtgccttatgcggggagtggcccaccatgccacacacaatcggctgcgaacatatattctgttatttttgcgctaagtcatctttcctattcgatgtgtactttacatgccctaaatgcggcactgaagtgcattctctgcagcctcttaagtcaggaatcgagatgagcgaggtgaacgctctttag

SEQ ID NO: 199010 - DNA, 918 bp, Artificial Sequence
  Description of Artificial Sequence: Synthetic coding sequence
atgaagagcgacagcagcaccagcgccgcccccctgcggggcctgggaggccctttgagatcttctgagccagtccgagccgtgccagccagagccccagctgttgacttgttagaagaggctgctgatcttctcgtggtacatctggactttcgcgccgcccttgagacctgtgaacgcgcctggcagtccctcgccaaccacgctgtggccgaagaacccgccggaacaagtttagaggtcaaatgttccttatgtgttgtggggattcaagcccttgctgaaatggaccggtggcaggaagtgcttagctgggtgctgcagtactaccaggtgcctgagaagctgccgccaaaagtgctggagttgtgcattctgctgtatagtaagatgcaggaaccaggagccgtgcttgatgtggttggtgcatggctgcaagatcccgctaatcagaatttacccgaatacggcgctctggccgaatttcatgtacagcgtgtacttctgcctctgggctgtctcagcgaagccgaagagcttgtcgttggctcggccgccttcggagaagagaggcgactcgatgtattgcaggccattcacaccgcaagacagcaacagaagcaggagcactccggctcggaggaagcccagaagccgaacctggagggatctgtgagtcacaaatttttgagcctgcctatgctggtccgccaactgtgggactctgccgtctcacatttcttctctctgcccttcaagaagtccctcctagccgctctcattctatgtctattagtggtgagatttgatccagcatccccaagctcactccactttctgtacaaattagcccagctctttcgctggattaggaaagctgcatttagcagactgtaccagctgcgcatccgggactag

SEQ ID NO: 199011 - DNA, 918 bp, Artificial Sequence
  Description of Artificial Sequence: Synthetic coding sequence
atgaagagcgacagcagcaccagcgccgcccccctgcggggcctgggaggccctctgcgcagttccgaacccgtgcgcgcagtgcctgcaagggccccagctgtcgatttgctggaggaggccgcagacctcttggtagtacaccttgatttccgcgccgccttggagacctgcgagcgggcctggcaatccctcgcgaaccacgcagtggcggaagaaccagcaggcacctcacttgaggttaaatgctcattgtgtgtggtggggatacaggccctcgctgaaatggatagatggcaggaggtcttaagttgggtcctgcagtattaccaagtgccagagaaactgccccccaaagtgctggaactgtgcatccttctctacagtaagatgcaggaacctggcgcggtactcgacgttgttggcgcatggttacaggaccccgctaaccaaaacctgcccgaatacggcgctctggccgaattccatgtgcagcgcgtacttctgcctctcggctgccttagcgaagcggaggagctggtcgtggggagtgccgccttcggcgaggaacggcgactggacgtcctgcaggccatacacacggcaaggcagcagcaaaaacaggagcacagtggatccgaggaagcacagaagcctaatctggagggaagcgtgtcacataagttcctgtctctgcctatgctggtgcgacagctgtgggattcagctgtctctcacttcttttccttaccattcaaaaagtcgctcctcgcagctctaatactttgccttctggtggttaggtttgaccccgcatcaccctcatccctccacttcctatataagttggcacagctgtttaggtggattcggaaggccgcgttttcaaggctgtaccaactgagaattagggactag

SEQ ID NO: 199012 - DNA, 1098 bp, Artificial Sequence
  Description of Artificial Sequence: Synthetic coding sequence
atgaagagcgacagcagcaccagcgccgcccccctgcggggcctggggggccccctcagaagcagtgaaccagtgagagccgtacctgcccgggcccctgcagtggacctactggaggaagcagcagaccttctggttgtgcatttagactttagagccgcactggaaacctgcgaacgagcctggcaatccctggcgaatcacgcggtcgcagaggagcctgctggaactagtctcgaagtgaaatgcagcctgtgtgttgttggcatccaggccctggcagaaatggaccgctggcaggaagtattatcctgggttctccagtattaccaagtacccgaaaagctgccacctaaggttctggaactgtgcatactgctctatagtaagatgcaagaacccggcgctgtactcgacgttgtgggcgcctggctgcaagacccggcaaatcaaaacttgcccgagtatggggccctggccgaattccatgtgcaacgcgtgctgctgcccctgggatgtctgtctgaggccgaggaactcgttgtcgggagtgctgccttcggcgaggaacggcgccttgatgtcttgcaagccatacacaccgccaggcagcaacagaagcaagaacactcaggctccgaggaggcccagaagcctaacctcgagggcagcgttagtcataagttcttaagtctgcccatgttggtccggcagttgtgggactcggcagtgagtcacttcttttccttgcccttcaagaagtccctattggccgccctgatcctctgtctgctcgtagtgaggttcgacccagcttcacccagtagtctccacttcttgtacaaattggcccaattattcgctgggtctggccgccttcacttcttggcttctacctcatctgcttccgtcacagaaggcccatgcgccccccagcccctttgtagcagtcggccatggccacagaaacagtccgatcgtgccacacacccccaagcacccctgggcaagtgggaccaacctaatctggctgagtgtaccgtcagttgttgtttgggcgctcttagcttcgccccgtattttggttggagtagatag

SEQ ID NO: 199013 - DNA, 771 bp, Artificial Sequence
  Description of Artificial Sequence: Synthetic coding sequence
atgaagagcgacagcagcaccagcgccgcccccctgcggggcctgggaggaccactgcggagctcagaaccagtgagggcagtgcccgcccgagcacccgccgtggatctgctggaggaggcagctgatctcctcgttgtccacctagacttccgcgcagccctcgagacatgtgagcgcgcctggcagtcactggctaatcatgccgtggcagaagagccagctgggacaagtttggaggtgaagtgttctttgtgcgtggtggggattcaggcactcgccgagatggatcgatggcaggaggtcctatcttgggtgctccagtactatcaggtccccgaaaagttaccacctaaagtgctcgagctatgtatactgctttatagtaaaatgcaagaaccaggagccgttctcgacgtggtcggtgcgtggctacaggaccctgcaaatcagaatctaccagagtatggggctctcgccgaatttcacgtccagcgggtcctccttcctcttggctgtctttcagaagccgaagaactggttgtcggttccgccgcttttggcgaagaacggcgcctcgatgtgttgcaggcgatccacacagccaggcagcagcaaaaacaggagcattctggcagcgaagaagcgcagaagcctaatctcgaagcctctccctcgagtctgcatttcctctacaaactggcacaactcttccggtggatccggaaggctgctttctcacggctttaccaactgcgcatccgcgattag

SEQ ID NO: 199014 - DNA, 549 bp, Artificial Sequence
  Description of Artificial Sequence: Synthetic coding sequence
atgctgcggagcgtgtggaacttcctgaagcggcacaagaagaagtgcatttttttggggacggtgttgggcgtgctttctatgctgccaacccttagggaagctctgatgcagcaactgaatagtgaatccctcacggccctgctaaaaaatcggccatccaataaactggagatttgggaggaccttaaaatcatttcctttaccagatccacagtggctgtgtattccacctgcatgcttgtcgtccttttacgggtccagctcaatatcatcggcggatacatctaccttgacaacgcagcagtgggaaagaacggtaccacaatcctggcaccccctgatgtgcaacagcagtatttgtcatccatccagcacctcctcggcgacggcctaacggaattgattaccgtcattaagcaagcggtccagaaagtgcttggctcagtttctttaaagcattccttgtctctgctcgatctggaacaaaaactcaaggaaatcaggaatcttgtcgaacagcacaagtccagctcttggatcaattag

SEQ ID NO: 199015 - DNA, 1122 bp, Artificial Sequence
  Description of Artificial Sequence: Synthetic coding sequence
atgctgcggagcgtgtggaacttcctgaagcggcacaagaagaagtgcatctttctgggcaccgtgctgggtggtgtgtacatcctcggcaaatatgggcaaaaaaagattcgagagattcaagagagggaagccgccgaatacattgcccaggcgcgtaggcagtaccattttgagagtaaccaacgcacctgcaatatgacagtgttatctatgctccccacgctgagggaagccttaatgcagcagcttaatagcgagtctctgacagcactcctcaagaaccgaccttcaaataagctggaaatatgggaggatcttaagatcatcagcttcactcgcagtacggtcgccgtgtactctacctgtatgctggttgtgctactgcgagtgcagctgaacatcatcgggggatacatctacctagataatgccgcggtgggaaaaaacggtacaactattcttgcacctcccgacgtccaacaacagtacttgagtagcatccagcaccttctgggagacggccttactgagcttataactgtgatcaagcaagccgtgcaaaaggtgctcggctccgtgagcctcaaacactccctttctttgctggatctggaacaaaagttaaaagagattcggaacctcgttgagcagcataagtcttcaagctggattaacaaggatggctccaagccactgttatgtcactacatgatgccagacgaagaaacacccttggccgtgcaagcgtgtggattaagcccccgggacattaccacaatcaaattgctaaacgagacccgggatatgctagagtctccagacttcagtacagtgctgaacacttgtctgaaccgaggatttagccgccttttggataacatggccgaatttttccggccaaccgagcaggacctgcagcatggtaattcgatgaacagcctttccagcgtgagtcttccactcgccaagatcatccccattgttaatgggcagattcattctgtctgttctgagacaccgtcccatttcgtgcaagatctccttaccatggaacaggtcaaggactttgctgctaacgtgtacgaggctttctctacgccgcagcaactggagaagtag

SEQ ID NO: 199016 - DNA, 549 bp, Artificial Sequence
  Description of Artificial Sequence: Synthetic coding sequence
atgctgcggagcgtgtggaacttcctgaagcggcacaagaagaagtgtatattcctgggtacagtcttgggagttctgtcgatgctaccaacattacgggaggctctgatgcagcaactcaacagcgagtctcttaccgctctcctcaaaaatcgccctagcaacaagctggaaatttgggaggatctgaaaattatcagtttcacacggtctaccgttgcggtgtactcaacctgcatgctggtagtgctgttgcgcgtccaactaaatatcattggagggtacatttacctggacaatgccgccgtgggtaaaaatggcacgacgatcttagccccaccagatgtgcaacagcaatacctgtcatccattcaacatcttctgggggatggactgactgagctaattaccgttattaagcaggcagtgcaaaaggttttgggttccgtgtctttaaagcacagcctgagtctcctggacctggagcagaaactaaaggagattcggaacctagttgaacagcataagtcttcaagctggatcaattag

SEQ ID NO: 199017 - DNA, 1809 bp, Artificial Sequence
  Description of Artificial Sequence: Synthetic coding sequence
atggccatgcgggagctggtggaggccgagtgcggcggcgccaacccgttaatgaagctggccgggcacttcacacaggacaaggctctcagacaagagggactgaggcctggcccatggccaccaggcgcccctgcttctgaagctgcatccaagccactaggagtcgccagcgaggacgaactggttgcagaattcctgcaagatcagaacgcacccttggttagccgggcgccccagacctttaagatggatgatctcctggccgaaatgcaacagatcgaacaatccaatttccgacaggccccgcaacgtgccccgggggtggcggacctggcgctctcagagaactgggcccaagagttccttgccgctggtgacgcagtcgacgttacccaagactacaatgaaacagactggtctcaggaattcataagtgaggtaactgatcccctgtccgtttccccggccagatgggccgaagaatatttggagcagagtgaagagaagctatggttgggagaaccagaaggcacggccaccgacagatggtacgacgagtatcacccggaagaggatcttcagcacactgcatctgacttcgtggctaaggtagatgatccaaagctggccaacagcgagggtacttcagacgcgtgggttgatcaattcacaaggcctgtgaacacttccgctttggacatggagttcgagagggccaaaagcgctattgaatctgacgtggatttttgggataagctgcaagccgagctggaggaaatggcaaagcgcgatgcagaagcccacccctggctgtcggattatgacgacctgacctcagccacgtacgataagggatatcaatttgaggaggagaatccgttacgagaccaccctcagcctttcgaggagggtctccggcggctccaggagggggatcttccgaatgccgtgttgctgttcgaagccgcagtgcagcaagacccaaaacatatggaggcctggcaatacctgggcactacacaggctgagaatgagcaagaactgctggcaatatccgcacttagacgttgccttgagttgaaacctgacaaccaaacagctctcatggcgcttgccgtcagtttcacaaatgagtctctccagcgacaggcctgtgaaacgctgagagattggctgagatacacacccgcctacgctcacctggtcacgcctgccgaagagggggccgggggggccgggctcggcccgtcaaagcggattctaggttctctactaagtgacagccttttcctggaagtgaaggagctgtttttggcggcagttcggctggaccccaccagcatcgatcccgacgtacagtgtggcctgggcgttctatttaacctgagtggcgagtatgataaagccgtggactgcttcaccgccgccctgtctgtccgaccgaacgattaccttttatggaataagctgggtgctaccttggccaatggcaaccagagtgaagaggccgtcgccgcatatagacgggccctggagctacagccaggctacatcaggtcccggtataacctgggaataagttgcatcaatttgggcgcccatagagaagcagtagagcactttctggaagccctcaatatgcagcgaaagtccagaggaccacggggggagggtggggctatgtccgagaacatctggagcacactgcggctggccctgtcaatgctgggtcagtccgacgcatatggggctgctgacgccagagatctctccaccttgctcacgatgttcggcctgccacaatag

SEQ ID NO: 199018 - DNA, 1896 bp, Artificial Sequence
  Description of Artificial Sequence: Synthetic coding sequence
atggccatgcgggagctggtggaggccgagtgcggcggcgccaaccctcttatgaaactagctgggcactttactcaggacaaagctctacggcaagagggcctccgccccggcccttggccacccggagctccggcctctgaggccgccagtaagccactcggtgttgccagcgaggacgaacttgttgcagagttcttgcaggaccaaaacgccccactggtgtctcgggctcctcaaaccttcaaaatggatgatcttctggccgagatgcagcaaatcgaacaatccaattttagacaggccccccaaagagccccaggggtcgctgacttagcactgtccgagaactgggctcaggaatttttagcagccggcgacgccgttgacgttacccaggactataacgaaactgactggtctcaagagtttatctcagaagttaccgacccacttagcgtatccccagctcggtgggcagaagagtatttggaacagtccgaggagaagctttggttgggcgagccagaagggaccgctacagaccggtggtatgacgagtatcaccctgaggaagacttgcaacatactgcatctgacttcgtagccaaagtcgacgatccaaagcttgccaactccgaattcctaaaatttgtccgccagattggagaaggtcaggtgtccctcgaatccggagccgggagcggcagagctcaagctgagcaatgggctgctgagttcatccagcagcaggggacatccgacgcctgggtcgaccaatttacacggcctgttaatacctccgccctcgatatggagtttgagcgggcaaagtcggccatagagctccaggcagagctggaggagatggcgaagcgtgacgccgaggcacacccatggttatctgattatgacgacttgacatctgcaacttatgacaaaggctaccaatttgaggaagagaaccccctgagagaccaccctcagccattcgaagaggggctgaggagactgcaagagggcgatcttcctaacgccgtcctgctgttcgaggctgctgttcagcaagaccccaagcacatggaagcatggcagtacctcggaaccacccaggctgagaatgagcaggagctcttagccatcagcgccttgaggcgttgcctggaactgaaacctgataatcagactgcgctgatggctctggctgtgtctttcacgaacgagtctctgcaacggcaggcatgtgaaaccctcagagactggttgagatacacaccagcctacgcacatctggttacacccgccgaggaaggcgctggtggtgcaggccttggaccaagcaagcgcatcctcggttccctgctctcagacagcctgtttctagaagtgaaagagctcttcctggcagctgttagactcgacccaacgtcaattgaccctgacgttcagtgtgggctcggggtgctcttcaacttatctggagaatacgacaaggccgtcgactgctttaccgccgctctaagcgtacgacccaatgactacctgctatggaacaagctgggcgcgacactggccaatgggaaccagagtgaggaagcagtggctgcatataggcgggccctggagttgcagccaggatacatacgctcaagatacaatctggggatatcttgtatcaatcttggcgcccaccgcgaagcagttgaacacttccttgaggctttgaacatgcagcgtaagagcagagggcctagaggcgaaggcggtgctatgagcgaaaacatttggtctacactgaggctggccttgtcaatgcttggtcagtctgacgcctacggtgcggccgacgctcgcgacctcagtactttgctcacaatgtttggcctgccccagtag

SEQ ID NO: 199019 - DNA, 1233 bp, Artificial Sequence
  Description of Artificial Sequence: Synthetic coding sequence
atggccatgcgggagctggtggaggccgagtgcggcggcgccaacccacttatgaagcttgcagggcactttacccaagataaagcgttaaggcaagaggggttgcgaccaggaccttggccccctggggctccagcctccgaggctgttagcgtactggaagttgagtcacccggcgccgctagtgaagctgcctccaagcccctaggcgtggcgagcgaagacgagttagtggccgagtttctccaggatcaaaatgctcccctggtgtcaagggctccccaaacttttaagatggacgacctgctagccgagatgcagcagatagagcagtctaacttcagacaagctccacagcgtgcacctggggttgccgacctcgctctgtccgaaaattgggctcaggagttcctggccgccggtgacgctgttgatgttacacaggactataatgagacagactggagccaggaatttatcagtgaggtcacggatcccctctcagtttcaccagcaagatgggccgaagaatacctggaacagtcagaggagaagctttggttgggggaaccagagggtacagccactgacagatggtacgacgagtaccaccctgaggaggatctgcagcatacggccagcgattttgtggcaaaagtggatgaccctaagctggctaactcagaaggcacctccgacgcttgggtagaccaatttactcggcctgttaatacctcagcactcgacatggaattcgaaagagccaaatctgctatcgaacttcaagcagaattggaggagatggccaagcgagatgcagaggcccacccctggctaagtgactacgacgatctgacctccgccacctacgacaaaggataccagtttgaggaagaaaaccctctgcgagaccaccctcagccgttcgaagaaggcttaaggcgcctccaagaaggggacctgccgaacgcagtcctcttatttgaggccgctgtccagcaggatcctaagcatatggaagcatggcagtacttaggcacaactcaggcagagaatgagcaggagttacttgccatttccgccttgaggaggtgcctcgagctcaagccagataatcagaccgctcttatggcactggccgtctctttcacaaatgaatctctgcagagacaggcttgcgaaacactgagagattggctcaggtatacccccgcgtatgcacacctcgtatag

SEQ ID NO: 199020 - DNA, 1983 bp, Artificial Sequence
  Description of Artificial Sequence: Synthetic coding sequence
atgctgctgtgccgggcccaccgggtgctgggcctgcggggcgcccgagagctagcagtgaccatggcaatgagagaacttgttgaagccgagtgcggaggagcaaaccccttgatgaaattggctggacattttacccaggataaagcacttcgccaggagggtcttcgccccgggccatggcccccgggtgccccagcgtcagaagccgccagcaaacctctgggcgttgcttccgaagatgaactggttgccgagtttctgcaggatcagaacgcccctctcgtgtccagggccccgcagacgtttaagatggacgacttgctggccgagatgcagcagatcgaacagtcaaacttccggcaggccccccagcgtgccccaggcgttgccgatctggccttgtccgagaactgggctcaggagttcctggccgctggcgatgccgtagacgtgacgcaagattacaatgagacggactggtcccaggaatttatctctgaagtcaccgaccccctgagtgtgtctcctgcccgatgggccgaagaatacctcgaacagtcagaggaaaagttgtggctgggcgaaccggaggggactgcaactgatcgttggtacgatgagtatcacccggaggaggatctgcagcacacagcctccgattttgtggccaaagtggacgatccgaagctggccaattctgaatttcttaaatttgtgaggcagattggggagggccaggtgtccctggagtctggtgctggctcaggaagggctcaggcggagcaatgggccgctgagtttatccagcagcaaggcacaagtgacgcatgggttgatcagtttacgcggccagtcaacacgtctgccctggatatggagttcgaacgggcaaagtccgccatagagtcagacgtggatttctgggataagctccaggcagagctcgaggagatggctaagcgcgacgcagaggctcatccgtggctttccgactacgatgacttgacctcagcgacttatgacaagggataccagttcgaagaagaaaatccacttagggaccacccccagcccttcgaggaggggttacgtcgattgcaggaaggagatctgcccaacgctgttttgcttttcgaggccgctgtgcagcaggatccaaaacacatggaagcctggcagtatctcggcactacacaggctgaaaacgagcaggaattactggccatttctgcacttaggagatgcctcgaactcaaacccgataatcagacagccttaatggccctggctgttagttttacaaacgaatcccttcagcgccaggcctgcgaaacattacgggattggttgcgctatacgccggcatacgcacacctggtcaccccagcagaagagggcgctggcggcgctggcctcggtccatccaaacgcattctgggaagccttctctcggactcgctcttcctagaggtcaaagagctgtttctcgctgccgtccgactggaccccacgtcaatcgatccagatgtgcagtgtggtctgggggtgttgttcaacctgagcggcgaatacgataaagcggtggactgtttcacggcagcactctctgtccgcccaaatgactacctgctctggaataagctaggcgcaaccttggcgaacggaaatcagagcgaagaggctgtggcggcctaccgaagggccctggagctccagcctggatacatccggagccgatacaacctcggcatttcttgtattaatttaggtgcccaccgtgaggccgtcgaacattttctagaagcactcaacatgcagagaaagtccaggggccctcgtggtgaggggggcgccatgagcgagaatatttggtctaccttgaggcttgccctcagcatgctgggtcagagcgatgcatatggcgctgcggatgcacgggacctgtccacgctgctgaccatgtttggcttaccccaatag

SEQ ID NO: 199021 - DNA, 1920 bp, Artificial Sequence
  Description of Artificial Sequence: Synthetic coding sequence
atggccatgcgggagctggtggaggccgagtgcggcggcgccaaccccctgatgaaactcgccggacactttacacaggataaagcccttcggcaggaaggcctgcgccccgggccttggcctcctggcgccccagccagcgaagccgctagcaagcctttaggggtggcctctgaagacgagctcgtagcggaatttctccaagaccagaatgcccctctcgtctcacgcgcacctcagaccttcaagatggatgatttgctggccgaaatgcaacagatcgagcagtccaacttcagacaagcaccacaaagagccccaggtgtggcagatctggccttgagtgagaattgggcacaagagtttttggccgcaggagatgctgtagatgtaacacaggattataacgaaaccgactggagtcaggaatttatctcagaagtgaccgaccctctgtccgtttcccctgccaggtgggccgaggaatacctggagcagagcgaggaaaagctctggctgggcgaaccagaaggcactgccacagatcggtggtatgacgagtaccatcccgaggaagatctccagcatacagcatctgacttcgtggctaaggtcgatgatcccaagctagccaactcagagtttctgaaattcgtacggcagatcggcgaaggacaagtgtcactggagtccggagcgggtagcggtcgcgctcaggcggagcaatgggccgccgaattcatccaacagcaggggacatcagacgcctgggtcgaccagtttacccgtcccgtaaatacatcagctctagatatggagtttgaacgggctaagagtgcaatcgaatctgatgtggatttttgggataaacttcaggcagaactggaagagatggcgaaacgtgatgctgaggcccacccgtggctcagtgattacgacgatttaacatccgctacgtatgacaagggatatcagttcgaagaggagaaccctttacgtgaccaccctcagcctttcgaggaggggttacgccggttacaggaaggcgacctgcccaatgcagttctcttgtttgaggctgcggtgcaacaggatcccaagcacatggaagcctggcagtatcttgggacaacacaggccgaaaacgagcaagagttgctggccatcagcgctctcagaagatgcctggagctgaagcccgataaccagacagccctcatggctctggccgtgagtttcacaaacgagagtcttcaacgacaggcctgtgaaacgctgagagattggctccgttataccccagcatacgcccacttagtgactcctgccgaagagggcgcaggcggcgcaggattaggacctagtaaaaggattctgggctccctgctgagcgactcactattcctggaggtcaaggagttgtttcttgcagcagttaggctggatcctacaagcatagatccggatgtccagtgtggtctaggagtgcttttcaatctgagtggcgagtatgacaaagccgtggactgctttacggccgctctgagcgtcaggcctaacgactacctgctgtggaacaaattgggcgcgacgctggcaaacggcaatcagtctgaggaggctgtcgcagcatacaggcgcgccctggagcttcagcctggatacataaggagcaggtataacctgggcatcagctgcataaacctgggagctcaccgggaggctgtggagcactttctggaagcactcaacatgcagaggaaaagtagaggccctcgcggagagggcggcgctatgtcggagaatatttggtccacgcttagattggcgctgagcatgctgggacagagcgatgcttacggcgctgctgatgcaagagatctgtctaccctacttacaatgttcggccttccccaatag

SEQ ID NO: 199022 - DNA, 1965 bp, Artificial Sequence
  Description of Artificial Sequence: Synthetic coding sequence
atggccatgcgggagctggtggaggccgagtgcggcggcgccaacccactgatgaaactggctgggcatttcacacaagacaaagccctgaggcaagaaggccttaggcccggcccttggcctcccggtgcccctgctagcgaagccgtaagcgtcctggaggttgaatcgccaggcgcggcgagtgaagccgcatccaaaccgctcggggtcgcctctgaagacgaactggttgctgagttcctccaagaccaaaacgccccactcgtgtctagggccccacaaacattcaagatggacgacttgctggctgaaatgcagcagattgaacaatccaattttcgccaagctccgcagagagctcctggagtggccgatctggccctaagcgagaactgggcccaggagtttctggcagccggggatgcggtggacgtgacccaggactataatgaaactgattggagccaggaattcatcagtgaagtaactgaccccctttctgtgtcccccgcacggtgggccgaagagtacctcgagcagtccgaagaaaaattatggctcggtgaacctgaaggaaccgctaccgatagatggtatgacgaataccatcccgaggaagacctccagcatactgcgtcggattttgtggctaaggttgatgatcccaaacttgccaactccgagtttttgaaattcgttaggcagatcggtgaaggccaggtgtctctggagtcaggggccgggagcggacgcgctcaggcggaacagtgggctgccgaattcatccaacaacaggggacttctgacgcatgggttgatcaatttactaggcctgtgaatacctctgcactggacatggagttcgagcgcgcgaagtctgctatcgaaagcgacgtggacttctgggacaagttgcaggccgaactggaggagatggcaaagagggatgccgaggcacacccatggctgagcgactacgatgatctgacgagtgcgacttatgacaaagggtatcaatttgaggaagaaaacccgctgcgggaccatcctcagcccttcgaggaggggctccgccgtctacaggaaggtgatctccccaacgcggtcctcttgttcgaggcagctgtccaacaggatcccaagcacatggaggcgtggcaatatttgggcacaacgcaggccgagaacgagcaggagcttctggcaatcagcgctctgagacgctgtttagagttgaagcccgataaccagacggccctgatggctttagcggtaagtttcactaatgaaagccttcagaggcaagcatgcgagacactgcgagattggctcagatatactcctgcctatgcacacttagtaacacctgctgaggaaggggctgggggcgcaggcttgggaccttccaaaagaatcctgggaagcttactctcagactctctgtttttggaagttaaggagctcttccttgctgccgtaagattggaccccacatcaatcgacccagacgttcaatgtgggctgggcgtgctctttaatctgtctggagagtatgataaagctgttgattgcttcactgctgctttgtctgtgaggccaaatgattatcttctgtggaataagcttggagcaacactggcaaatgggaaccagagtgaggaagcagtagccgcctacaggagagccctggaactgcaacccggctacatcaggagccggtataacctcgggatctcatgtatcaatctgggtgctcatagggaagccgtcgaacacttcctcgaagctctgaacatgcagcgaaagtcaaggggccccaggggcgagggaggggctatgtctgagaatatttggtccactctccgactggcgctgagcatgctcggtcagagcgatgcctatggcgccgccgacgcgcgcgacctctccactctgttaacgatgtttggactgccacaatag

SEQ ID NO: 199023 - DNA, 1920 bp, Artificial Sequence
  Description of Artificial Sequence: Synthetic coding sequence
atggccatgcgggagctggtggaggccgagtgcggcggcgccaaccctctcatgaaactggcaggacatttcacacaagataaggcactgcggcaggagggactgcggccgggcccctggcctcccggcgcgccagccagcgaggccgctagtaaacccctgggggtcgcttctgaagatgaactggtcgcagagttcctccaggatcagaacgcacctttggtgtcgcgggccccacaaacattcaagatggacgatctcctggcggaaatgcagcagatcgagcagtctaattttaggcaggccccgcagagagccccaggagtcgccgatctggctttgtcggaaaattgggcccaggagtttctggccgcaggcgatgctgtcgacgtgacccaagactataatgagacagactggagccaagagtttatctccgaggtgaccgatccgctgtccgtaagccctgcccgatgggccgaagagtacctcgagcaaagtgaggaaaagctatggttgggggagcccgaaggcacggccaccgaccgctggtatgacgagtatcaccctgaggaggacctacagcacacagctagcgatttcgttgccaaagtggatgatccaaagctagctaactctgagttcctcaagttcgtgagacagatcggtgagggtcaggttagtttagaaagtggtgcaggaagtggcagggctcaggcagagcagtgggcagctgagttcattcagcagcagggaacttcagatgcatgggtagaccaattcacgcggccagtcaatacctccgccctggatatggagttcgagcgagctaaatctgcaatcgagtccgacgtcgatttttgggacaaattgcaggcagaactggaggaaatggccaaacgtgacgccgaggcacacccttggctgtcagactacgacgacctgacaagtgccacatacgataagggctatcagtttgaggaggagaacccacttcgggaccatccccagccttttgaagagggactgcggcggctgcaggaaggcgatctcccaaacgccgtcttactatttgaagccgcggtgcagcaggatccaaagcacatggaggcctggcaatacctgggaacaacacaagctgaaaatgagcaagagctgctggcaatatcagctctgcggagatgcttggaactgaaacccgataatcaaaccgctttaatggcgctcgctgtctccttcaccaatgaatctcttcaacgtcaggcctgtgagacgctccgggattggcttcggtataccccagcatacgctcatctcgtcactccagcggaggaaggagccgggggcgcagggctgggtcccagcaaaaggattttaggaagcctgctgtccgattccttgtttctggaggttaaagagctcttcttggcagccgtgcggctggaccctacatctattgaccctgacgtccagtgcggtctgggcgtcttgtttaacctctccggggaatatgacaaggcagtcgattgtttcactgctgccttatctgtcagacctaacgactacctgttgtggaataagctgggtgcaaccctggccaacggaaatcaatctgaagaagccgtcgctgcctaccgcagagccctcgaattacagcctggatatatccgaagtcgttacaacctgggcatttcttgtattaacttaggcgctcaccgcgaagctgtagagcatttcctcgaagccctgaatatgcagaggaaatcgagaggtcccaggggggagggcggcgctatgtctgaaaatatctggtcaaccctgagactggcactgtctatgttgggccaatctgacgcctacggagctgccgacgcccgtgacctttcaacgctgctgaccatgttcggccttccccagtag

SEQ ID NO: 199024 - DNA, 345 bp, Artificial Sequence
  Description of Artificial Sequence: Synthetic coding sequence
atggccatgcgggagctggtggaggccgagtgcggcggcgccaaccctctcatgaaacttgcgggacatttcacccaggacaaagcgttgcggcaggaagggctaagacctgggccctggccacctggggcgcctgcaagtgaggcagctagtaaacccttaggtgtagctagcgaagatgaacttgtcgccgagttcctgcaggaccagaacgcccccttggtgtctcgtgcccctcaaaccttcaagatggacgacctactggccgagatgcagcagatcgaacagtctaatttccgccaagcacctcagcgagcccccggggtcgccgacctggccttatag

SEQ ID NO: 199025 - DNA, 309 bp, Artificial Sequence
  Description of Artificial Sequence: Synthetic coding sequence
atggccatgcgggagctggtggaggccgagtgcggcggcgccaaccctcttatgaaattggcaggccacttcacacaggacaaagctctacggcaggaaggcttaaggccaggaccatggccacccggggcgccggctagtgaggccgcctctaagcccctgggggtggccagcgaggacgagttggtagcggagttcctgcaagatcagaacgctcccctcgtaagccgcgctccgcaaacgtttaagatggatgatctcctagctgaaatgcagcagatcgaacagtccaactttagacaggcctag

SEQ ID NO: 199026 - DNA, 747 bp, Artificial Sequence
  Description of Artificial Sequence: Synthetic coding sequence
atggccatgcgggagctggtggaggccgagtgcggcggcgccaaccccttgatgaagctagctgggcatttcacacaagacaaggctctccgccaggagggcctgcgccctgggccatggccccccggagcccctgctagcgaggcagcctctaagcccctgggagtggcaagcgaagacgagctggtggctgagttcctgcaggaccagaacgctcctctggtatccagagcaccccagacctttaaaatggacgacttgttggcggagatgcagcaaatcgagcaatcaaatttccgccaggcacctcaacgtgcccccggcgtggctgatttggccctgtccgagaattgggcacaagaatttttagcggctggcgatgcggtggatgttacacaggattacaatgagaccgactggtcgcaggagttcatcagcgaggtgactgaccctctgtcggtttcccctgcccgctgggcagaggagtacctggaacagagcgaagaaaaattatggttgggtgagccagagggcacggcgactgatagatggtacgatgagtatcatcctgaggaggacttgcagcataccgcaagtgacttcgtcgctaaagtggatgacccaaagctcgccaactctgaattcctcaaattcgttcgacagatcggtgaggggcaggtgagcttggagagcggagcaggcagcggccgcgcacaggcagagcaatgggcagccgagtttatttag

SEQ ID NO: 199027 - DNA, 315 bp, Artificial Sequence
  Description of Artificial Sequence: Synthetic coding sequence
atggccatgcgggagctggtggaggccgagtgcggcggcgccaacccgttaatgaagctggccggccatttcacgcaggacaaagccttacgtcaggagggccttagacctgggccatggccccctggagcccccgccagcgaggcggcttcgaagccactgggggttgccagtgaggacgagctggtggccgagtttctccaggaccagaatgctcccctggtgtcccgtgccccccagacctttaagatggatgaccttctggccgagatgcagcagatagaacaatctaacttccggcaagcaccacagtag

SEQ ID NO: 199028 - DNA, 1875 bp, Artificial Sequence
  Description of Artificial Sequence: Synthetic coding sequence
atgtaccagggccacatgcaggtggtgggcgtgaccctgaagaagaaatggcattgtctgcagaaaagcgatctcacactggccctgggcaaaggctctagagcagctgacaaggccgtagcaatggtgatgaaggaaatcccaagagaggagtccgcagaggagaagccactccttacaatgactagtcaactcgtgaatgagcagcaagaatccaggcctctgctgtccccaagcatcgatgatttcctttgtgaaactaagagcgaagcaatcgctcggcccgttacatcaaacacggcagtattgactactggcctggacctcctggacctctccgaacctgtgagtcaaacccagactaaagccaaaaaatctgaaccatcctcaaagacctcttctcttaagaagaaagcagatggctcagatctgataagcaccgatgcagagcagcgtggtcagccacttcgcgtccctgagacctcatcactggacttagatatccagacccagctggaaaaatgggatgatgtgaagttccacggtgatcgcaacaccaaggggcaccctatggccgagagaaaaagttcctcaagccggacggggtcaaaggaactcctgtggagttctgagcaccgctcccagccagagctatcaggggggaaaagtgcccttaattcagagtctgcgtctgagctcgaactcgtcgcaccgactcaggcacggctaaccaaggagcatcggtggggcagtgcacttttgtctcgcaatcacagcctcgaggaagaatttgaaagagccaaggcagccgtggagtctgacacagaattttgggataagatgcaggcggagtgggaggagatggcaaggcgaaattggattagcgagaaccaggaagcgcagaaccaggtgacgataagcgcatcagagaagggatactatttccataccgagaatccctttaaggactggcctggcgcattcgaggagggacttaagcggttgaaagagggcgatctccctgtgaccattctgttcatggaagctgcaattttacaggaccccggtgacgctgaggcttggcaatttcttgggataacacaagctgagaatgagaatgagcaagccgcaatcgttgccctccagaggtgccttgagctccagccaaataacctcaaggcactaatggcccttgctgtcagttacaccaatacggggcaccaacaggatgcttgcgacgcgcttaagaactggattaagcagaatccaaagtacaaatatctagtaaaaagtaagaaaggctctcctgggctgaccaggagaatgtccaagagtcctgtagacagctccgtgctcgagggggttaaggagctgtacctggaagcggcacatcagaacggcgatatgattgacccagacctgcagactggccttggtgtgctcttccacttatctggagagtttaatcgggccatagatgcttttaatgccgctttgacagtgcgtccagaggattattccctgtggaatcggctcggtgcaactcttgctaatggcgacagaagcgaggaagccgtggaggcctacaccagggcactggaaatccagccgggttttatccgtagccggtataatctgggtatttcctgtatcaatctaggtgcctaccgagaagccgtgtctaactttctaactgcgctgagccttcagcggaaatccagaaaccaacagcaagttcctcatccagccatcagcgggaacatttgggccgcgcttcgcattgctctgtccctgatggatcaacccgagctattccaggcagctaacttaggggatttggacgttctgttgcgcgccttcaacttggatccttag

SEQ ID NO: 199029 - DNA, 1875 bp, Artificial Sequence
  Description of Artificial Sequence: Synthetic coding sequence
atgcaccagaacggcagccaggtggtgggcgtgaccctgaagaagaaatggcactgcctgcagaagtcggatctcaccctcgccctgggcaaaggctctcgtgccgctgataaggcagttgcaatggtgatgaaagaaattcccagagaagagagcgcagaagaaaagcccctcttaactatgacaagccagctggtaaacgaacagcaggaatctcggcctcttctgagcccatctatagacgatttcttgtgcgagacaaagtctgaagccatcgcaagacctgttactagcaatacagctgtcctgaccacaggccttgatttgctagacctttcggagcctgtctcccagacacaaaccaaagcaaagaagtccgagcctagtagcaagacttcctcactgaaaaagaaggctgacggctcagacctgatcagtaccgatgctgaacagcggggtcaacctctccgggtccccgaaacttcttcccttgacctcgacatacagactcaactcgaaaagtgggacgacgtcaagttccatggggacaggaatactaagggtcacccgatggctgaaagaaaatccagctccagccggaccggctcgaaagaactgctgtggtcatcggagcaccgctcccagcctgagttgagcgggggaaagagtgccctgaactctgagagtgccagtgagctggagcttgtcgccccaacacaagcgagactcacaaaagagcatcgctgggggtccgcgctcttaagtcgaaaccacagtctcgaagaggagtttgagagagccaaggcggcagttgaaagcgacaccgagttttgggacaaaatgcaggccgagtgggaggaaatggccaggcgcaactggatatcagaaaaccaggaggcacagaaccaggtcactatatcagcttccgagaagggttactatttccatacagagaaccccttcaaggattggcctggcgcatttgaggagggtctaaagcgcctgaaagaaggcgatctacccgtcaccatactatttatggaagccgccatcctccaggacccgggagacgctgaagcgtggcagtttctgggcataacccaggcagagaacgaaaatgaacaagcggccattgtggccttgcagcggtgtctggaactccagccaaacaacctcaaagccctgatggccctggctgtgtcctatacaaacactgggcaccagcaggatgcctgtgacgcactgaaaaattggatcaagcaaaatcctaagtataaatatctggtgaagagcaaaaaaggctcaccaggccttactcggaggatgagtaaatctccggtagattcttctgtgctagagggagtaaaggagctttatctggaggcagcccaccagaatggcgatatgatcgatccggacctccagacgggcttgggtgtgttgttccacctgagcggcgagtttaacagggccatagacgcatttaacgccgcactgaccgtacgacccgaagattactctttgtggaatcggctaggcgctacactcgcaaatggagatcgcagtgaggaagctgtggaggcctacacacgagcactggagattcagccaggattcatacggtcccggtacaaccttggtattagttgtatcaacttgggggcctacagggaagccgtgtccaatttcttaactgcactgtccctgcagaggaaaagccgaaatcaacaacaggtgcctcaccccgcaatctcaggaaacatttgggccgcactcagaatcgcactgtcgttgatggaccaacccgaactgtttcaggctgctaatctgggggacctggatgtactactcagagcttttaacttagatccttag

SEQ ID NO: 199030 - DNA, 1557 bp, Artificial Sequence
  Description of Artificial Sequence: Synthetic coding sequence
atggtgatgaaggagatcccccgggaggagagcgccgaggagaagccactgctgacaatgaccagccagttggtaaacgagcagcaagaatcacgtcctcttctgtccccctcaatcgacgatttcttatgtgagaccaaaagcgaagcaatagcgcggcccgtcaccagcaatactgcagacatccaaacccagctggaaaagtgggacgatgtcaaatttcacggggaccgaaatactaagggacacccaatggcagaacgtaagtcgagctctagtaggactggatcgaaggagctcctgtggtcttccgagcatagatcccaacctgagctcagtggcgggaaaagcgccctcaacagtgagtctgcttcagagctggagctggtagcccccactcaggcgcgcctaaccaaggagcatcggtggggaagcgccctgctctcccgaaatcacagcctggaggaggagttcgaaagggccaaagctgccgtggaatccgacacagaattctgggacaaaatgcaggccgaatgggaggagatggcgagaaggaattggattagtgaaaatcaagaagcccagaaccaggtgaccattagcgcttctgagaagggctattattttcacaccgaaaaccctttcaaagattggccgggggctttcgaagaaggcctgaagcgtcttaaggagggtgatctccctgttactatcctgtttatggaagccgctattttgcaggatccaggcgacgctgaggcctggcagtttcttggcatcacccaggccgaaaacgagaatgagcaggcagcaatcgttgcattgcagcgctgcttggagctccagcctaacaacttgaaggcccttatggctttagctgtgtcttatactaataccgggcatcaacaagatgcatgcgacgccctaaagaattggatcaaacaaaacccaaaatacaagtaccttgttaaatctaaaaagggctcgccagggttgacaaggcgcatgtcaaaatccccagtcgactcttcagtactcgagggcgtgaaggaactgtacctggaggccgctcaccagaacggggacatgatcgatccagacctgcagactgggctgggagtcctttttcaccttagcggtgagttcaacagggcaattgatgctttcaacgctgcgctcactgtgcgccctgaggattattctctgtggaatcggctcggcgcaaccttggccaatggagatagaagcgaagaggccgtggaagcctatacacgggcactggaaattcagcccggcttcatacggagccggtacaacctgggtattagctgcattaacttaggcgcttacagggaagcagtctctaactttctgactgctctctcactccaaagaaagtcacggaatcagcagcaggtgccccatcccgccatttccgggaatatctgggctgctcttaggattgccctgagcctgatggaccaacctgagctgttccaagccgcgaacctcggcgatcttgacgtcctcctcagagccttcaacttggatccctag

SEQ ID NO: 199031 - DNA, 1809 bp, Artificial Sequence
  Description of Artificial Sequence: Synthetic coding sequence
atgtaccagggccacatgcagggcaagggcagccgggccgccgacaaggccgtggccatggttatgaaagaaattcctcgcgaagagagcgcagaagaaaagccccttctgaccatgacaagccagctggttaatgaacagcaggaaagcaggccccttttatctccgagtatcgacgactttctatgtgaaactaagagcgaggcaatcgcacggcccgtcaccagtaacaccgcagttctgacaactggattagaccttctggacctgagcgaacctgtctcccaaacccaaaccaaagcaaaaaaatccgagccctcctccaaaacaagcagcctcaaaaagaaggccgatggctcagacctgatttctaccgatgccgagcaacggggacaacctctgcgcgtacccgaaacctcgagcctggatctagacatccagactcaactggaaaaatgggatgatgttaaatttcacggcgacaggaacacaaaaggccacccaatggcagagaggaagtccagcagtagtcggaccggttcaaaggaactgctatggagctcagagcatcgaagtcagcctgagctgagtggtggaaagtccgcactcaactccgaatctgcatccgaactggaactggtcgctccgactcaagctaggctcaccaaggagcacaggtgggggtcagctttgttgagccgaaaccattccctggaagaggagtttgagcgtgccaaggctgctgtggagagtgacaccgaattctgggataaaatgcaggctgagtgggaggaaatggctagacgtaactggatctccgagaaccaggaagcacagaaccaggtcactatctccgctagcgagaaaggatactacttccatactgaaaacccatttaaagactggcctggagcctttgaagagggacttaagaggctcaaagagggggatctgcccgtgacgattctgtttatggaagcagccattttacaggacccgggtgatgcagaagcctggcagttcctgggtataacccaggctgagaacgaaaacgagcaggccgccatcgtggcactacagagatgcctcgaactgcagcctaataacctgaaggcattgatggccctcgctgtgtcatacactaacacaggacaccaacaggatgcttgtgacgccctcaaaaactggattaagcagaatccaaagtataaatacttggtgaaatcaaaaaagggaagtcccgggttgactagaagaatgagcaagagccctgttgatagcagtgtcctcgaaggcgtcaaggagctgtacttagaagctgcccatcagaacggcgatatgattgacccagacctgcagacaggtctgggcgtcctgtttcacttaagtggtgaatttaaccgggcgatcgacgctttcaatgctgcccttacagtgcgaccagaggactattcactgtggaaccggctcggggctactttagctaatggcgaccgcagtgaggaggccgttgaggcatataccagagcgttggaaattcaaccaggattcatccggtcccggtataatctggggatcagttgcataaacttaggtgcttaccgcgaagctgtgagcaacttcttaaccgcgcttagtctgcagagaaagagcaggaaccagcagcaagtgcctcatcccgcaattagcggaaacatctgggcggctctccgtatcgccctgtccctcatggatcagcctgagctgttccaggctgcgaacctaggtgatctggatgtgttgttgagggcctttaacctggacccttag

SEQ ID NO: 199032 - DNA, 1545 bp, Artificial Sequence
  Description of Artificial Sequence: Synthetic coding sequence
atgagcagcctgagcctgaagcccctggtgcaggtgagcgtgggcgcctttgttcagctggtcaacgaacagcaggaaagcaggccacttctgagccccagcatcgatgactttctgtgtgaaaccaagagtgaggccattgctcgaccagtcaccagcaatactgccgacatccagacacaactggagaaatgggatgatgttaaattccatggcgacaggaacaccaaaggtcatcccatggccgaacgcaagtcaagctcttctcgtactggaagtaaagaactgctgtggtcatctgaacatcggtcccagccggagctgagtggaggaaagtctgccctgaacagcgagagcgcgtctgagttagaacttgtagcaccgactcaagcacgtctgacaaaagagcacagatggggatctgccctcctttctagaaaccattccctcgaggaagagtttgaaagggccaaagctgccgtggaaagtgacaccgaattttgggacaaaatgcaagctgaatgggaagagatggccaggagaaactggattagcgaaaatcaggaagctcaaaatcaagtgaccatatctgcctctgaaaaagggtactattttcacactgagaaccccttcaaagactggcctggagctttcgaagaaggcctgaaaagacttaaagaaggagatctgcccgtgactattctgttcatggaagcagcgatcctccaagatcccggggacgcggaggcctggcagtttctcggtataacacaagctgagaacgagaatgaacaggcagccatcgtggcactgcaaagatgtctggaactgcagccaaataacctcaaggcccttatggccctcgccgtgtcatacaccaacactggtcatcaacaggacgcctgcgatgctctgaaaaactggataaaacagaatcccaagtacaagtatctggtgaaatccaaaaaaggatccccaggcctgacccgacgcatgtccaaatcccccgtggatagctctgtgctagaaggtgtgaaggaattgtacctggaggcagctcaccagaacggagatatgattgatcctgacttgcagacagggctcggtgtgctcttccatctttccggcgaatttaatagggctatagatgcattcaacgcagcacttaccgttcgacctgaagactattcgttgtggaacagactgggagcaactctagccaatggtgaccggagcgaggaggccgtggaagcttacacacgagcactggagattcagccgggatttattagaagcagatacaacttgggcattagttgcatcaaccttggcgcttatagagaggcggtgagcaacttcctcactgccctgtccctccagcgcaaatcccggaaccagcagcaggtaccacatccggcaatctcagggaacatctgggccgccctcaggattgcgctaagtcttatggaccagccggagctcttccaagctgcaaatttgggggacctcgatgtgttgctgagggcctttaacctggatccctag

SEQ ID NO: 199033 - DNA, 1881 bp, Artificial Sequence
  Description of Artificial Sequence: Synthetic coding sequence
atgtaccagggccacatgcagaagagcaaggagcagggctacggcaagctatcttccgacgaagacttagagattattgtagaccagaaacaggggaaaggctccagagcagccgataaagctgtggccatggtcatgaaagagatccctagggaagaatcggctgaggagaaacctctgttaacaatgacgagccagctggtcaatgagcaacaggaatctcgcccactactgtccccttccatcgatgatttcctctgtgaaaccaaaagcgaggctatcgcaagacctgtaactagcaatacggccgtgttaacaacaggactggacctattggaccttagcgaacctgtatctcagacacagaccaaggccaaaaagtcagaaccctcttctaagacctcctccctcaagaaaaaggcagacgggtctgatcttattagcaccgatgccgagcagcggggacagccattgagagtgcccgaaacttcgtctctggacctggatattcagacgcaattagagaagtgggacgacgtgaaattccatggagaccggaacactaaggggcaccccatggcagagcggaagagcagctcaagccggacaggatctaaggaattgctgtggtccagcgaacaccgtagtcaaccggagctcagtggaggtaagagcgctcttaattccgaatcggcttcagagcttgagctcgtcgcccccacacaggcccgcctcactaaagagcaccgctgggggagtgcacttctatcccgaaatcactccctagaagaggaattcgaaagagctaaggccgccgtagagtcagatactgaattctgggataagatgcaggccgaatgggaggaaatggcacgaagaaactggatctctgagaaccaggaggctcagaatcaagtgactatttctgccagtgagaagggttactatttccacaccgaaaacccgtttaaggattggccaggcgcctttgaggagggcctgaagagactgaaagagggcgacctgcctgtgacgatcctgtttatggaggcagccattctacaggaccctggggacgctgaggcatggcaatttttgggtattacacaggctgaaaatgagaacgaacaggccgccatcgtggctcttcagaggtgcctagagctccagccgaacaatcttaaggcactcatggccctagcagtctcatacacgaacacggggcatcaacaggacgcttgtgacgcactgaaaaactggattaagcaaaatccaaaatacaagtacctggtcaagagtaagaaggggagccccggattgacgcggcggatgagtaagtccccggttgactcctccgtcctggagggtgtaaaggagttgtacctggaggctgcacatcaaaacggggatatgatagaccccgacctacagactgggctcggtgttttattccatttatcaggcgaattcaacagggccatcgatgcgtttaacgctgctctcactgtccggcccgaggactacagcttgtggaatcgcctcggagctacactggcaaatggagaccgctccgaggaagcagtggaagcttatactcgtgccctggaaattcagcccggcttcattcggtctcgttacaacctcggaatctcgtgtatcaacctcggcgcctaccgggaagcagtctcaaattttcttaccgctctaagtctgcagagaaagtccaggaatcaacagcaggtgccacatcccgccatcagtgggaatatctgggccgccctgagaatcgccctctcactgatggaccagccagaattgtttcaggccgccaaccttggtgacctggatgtactgttgcgcgccttcaacctagacccatag

SEQ ID NO: 199034 - DNA, 1752 bp, Artificial Sequence
  Description of Artificial Sequence: Synthetic coding sequence
atggtgatgaaggagatcccccgggaggagagcgccgaggagaagcccctcctgactatgacatctcagctcgtgaacgaacaacaagaatcccgcccccttctcagccctagcatcgatgatttcctttgtgaaaccaagtccgaggctatagcccgccctgtgacctcaaacactgccgtgctgacaaccggcctcgatctcctggacctctcagaacccgtgagccaaactcagaccaaagctaaaaagtcggagccatcctcgaagacatcatctcttaaaaagaaggccgacggatccgacctgatttctacggacgcagaacagcgcggacagccattacgggtccccgaaacgagcagccttgatttagacatccagactcagcttgaaaaatgggatgatgtgaagttccatggagaccgaaatacgaaagggcatccgatggctgaaagaaaatcctctagttctcgaaccgggtcaaaggaattactttggtcgtcggagcacaggagccagccggagctgagtgggggcaaatcagccctgaattctgagtctgcctccgagctggaacttgtggccccaacacaggcccgcctcaccaaggagcatcggtggggatccgcccttcttagccgaaaccacagcctcgaggaggaatttgagagagcaaaggcagctgtcgaatcagacactgagttctgggacaaaatgcaggctgagtgggaggagatggcaagacgcaattggatctctgagaaccaggaagctcagaaccaagtgactattagcgccagcgaaaaggggtactactttcatacggaaaaccccttcaaagactggcccggggcgtttgaggaggggttgaagaggctgaaggagggtgatctgcctgtcacgattctttttatggaggcggcaattctccaggaccctggggacgccgaggcttggcagttcctgggtatcacgcaggctgagaatgaaaatgagcaggccgcaatcgtagctctgcaacgttgtcttgagctccaacccaacaacctgaaggcccttatggccctggctgtttcttatacaaacaccggccaccagcaagacgcctgcgatgccctgaagaattggatcaaacagaatcctaaatataaatacctagtgaagtccaagaaaggaagtcctggactcaccagacgaatgtctaagtcacccgtggactcatctgtactggaaggagtaaaggagctctaccttgaggctgctcatcagaacggggatatgattgacccagacctgcaaactggcctgggcgtcctgttccacctctctggcgagttcaacagggctatcgatgcctttaacgctgcccttacggtgagacccgaggattattctctatggaacaggctcggagctacactagccaatggtgacaggagcgaggaggcagtcgaggcatacacacgcgccctggaaatacaacctggattcattcgctctagatacaatttgggaatatcctgtatcaatctgggcgcttacagggaagccgtttctaattttcttactgcgctctctctgcaacgcaagagtagaaatcagcagcaagtaccacatcccgctatctccggaaacatatgggcggccctgagaatcgctctgagcctgatggaccagccagaactgttccaggctgcaaatctgggtgacctcgatgtgctgctgagggcctttaacctcgacccatag

SEQ ID NO: 199035 - DNA, 1776 bp, Artificial Sequence
  Description of Artificial Sequence: Synthetic coding sequence
atgtaccagggccacatgcagaagagcaaggagcagggctacggcaagctcagttccgacgaggatctggagatcatcgtggaccagaagcagctagtgaatgagcagcaagaatcaaggcccctgctctctccttccattgatgatttcttgtgtgagaccaagtctgaagcaattgcccgtccagtcacctctaatactgccgtcctgaccacagggctagacctgctagacctgtctgaaccagtgagccaaacacaaacaaaggccaaaaagagcgagccgtcatcgaaaacgagttctctaaaaaaaaaagccgatggctcagatttaatctcaacagatgcagagcagcgcgggcaacctttgagggtgccagagacaagcagcctggatcttgatattcagacgcagctggagaagtgggatgacgtgaagttccatggcgaccgaaacaccaaagggcatccaatggccgagcgaaaatcatccagctcacggacgggtagcaaagagttgctttggagctcagagcataggtcacagcccgagctgagtgggggcaagagcgccttgaacagcgagagtgcctcagaattggagctcgtggcgccaactcaggcacgtctaaccaaagagcacagatgggggtcggccctgttgtctcggaaccatagccttgaggaggaattcgagcgagccaaggccgcagtggaatctgacactgagttttgggacaaaatgcaggccgaatgggaggaaatggctcgcagaaactggatttccgagaaccaggaggctcaaaaccaggtcacgatctcagcgagcgaaaaaggttattatttccacacagaaaacccatttaaggactggcctggagcctttgaggaaggactgaaacggcttaaagagggcgatctgcccgtgaccatcttgtttatggaggccgcgattttgcaggaccctggtgacgccgaagcttggcaattcctggggatcacccaggcagaaaacgagaatgagcaggctgccatcgtggccctgcagaggtgcttggagctgcagcctaataacctcaaagccctgatggccttagcagttagttacacgaacactggccaccagcaagatgcatgtgatgctcttaaaaattggattaaacaaaaccctaaatataaatatctagttaagtctaaaaaagggagccccggcctgacgagacggatgagcaaatctccagtggactcctccgtactggaaggcgtgaaggagctctatctagaggcagctcatcagaacggcgatatgatcgaccccgatctgcaaactgggctcggggtgctgttccacctctccggcgagttcaatagagcgatagacgctttcaacgccgccctgacggtccgccccgaagattactccctctggaatcggttgggggcaacactcgctaacggcgacagatccgaggaggccgtcgaagcctacacacgcgcactggagatacaacccggctttataaggtctcgttacaacctcgggatttcctgcattaatttaggagcctaccgcgaagcagtaagtaacttcctaaccgccctgtcactgcagagaaaatccagaaatcagcagcaggttcctcacccggctataagcggcaacatctgggccgccctaaggattgctctgagcctgatggatcaaccggagctgttccaagccgccaatttaggcgatctggacgtcctactgcgcgccttcaacctcgacccttag

SEQ ID NO: 199036 - DNA, 2217 bp, Artificial Sequence
  Description of Artificial Sequence: Synthetic coding sequence
atggccctggccgtgctgcgggtgctggagcccttccccaccgagacaccaccactagctgtcctactgccccctggcggaccatggcccgcagcagagttgggcctggtgcttgctctgaggcccgcgggggagtcgccagcgggtcctgcgctgctcgtggccgccctggagggccccgatgcgggcaccgaagagcaaggcccgggacccccccagctcttggtatctcgcgctttgttgcggttactggctttaggaagtggcgcttgggtgagggcaagagcagtcagacggccccccgccctcggatgggctctactgggtacgtcccttgggccagggttggggcctagggtgggacctttgctggtgagaaggggcgagactctgccagtccccgggcccagggtgttggagacaagaccagccctgcagggactcctcggtccaggcacacgactggccgtcacggagttgcgcggacgcgctaggctgtgcccagagagtggggatagctccagacctcctcccccacccgtcgtttcttcttttgctgtctcaggaacggttaggcgactgcagggggtattgggagggaccggggactcgctcggcgtgtcacgcagctgtcttagaggacttggcctgtttcagggcgagtgggtttgggtggcccaagcacgggaaagttctaataccagtcagcctcatcttgcccgggtgcaggtgcttgagccccgttgggatctgtcagacaggttggggcctggcagtgggcctttaggggaacccctggccgatggcctcgctttggtgccagcgacactagcttttaatctggggtgtgacccattggagatgggtgaacttcgcatacagcgctacctggaaggatccattgcgcctgaggacaagggaagttgctccttattgccaggtcctccctttgctcgggagctgcacattgaaatcgtatcctctcctcactattcgaccaatgggaattatgatggggttttgtatagacactttcaaattccccgtgtggtgcaagagggcgacgtgctgtgtgttcctactattggacaggtcgagatcctggaaggcagcccggaaaaattgccgcgctggcgggaaatgtttttcaaggtgaaaaaaactgtgggagaagctccggatggtccagcatctgcctatctggccgataccacccacacttccctctacatggtcggctctacactgtctcctgtgccatggcttccaagtgaggagagcacactgtggtccagcctgagcccacccgggctggaggctttggtgtctgagctatgtgccgtactgaagccccgcctgcagcccggtggggcactcttaaccggcaccagctcagtgcttttgcgcggtccgcctggctgcgggaaaacgactgtggtggctgctgcatgctcccacttgggcctccatctgctgaaggtgccctgcagctctctatgtgccgagagctccggtgctgtcgagaccaaacttcaggcaatcttcagcagggcccgacggtgccgcccagccgtactcctactcacagccgtcgacctgttgggtcgggatcgagacgggcttggcgaggacgcaagggtgatggccgtgctgaggcatctcttactcaacgaggatcccctgaactcttgcccccctttgatggtggtggcaaccacttcacgggcccaggacctccccgctgacgtgcagacagcatttcctcacgagttagaagtgccagcactcagcgaagggcaaaggttatcaatcttgcgtgctctaaccgcgcacctgccactcggtcaagaggttaacctcgcacagctagcccggagatgcgcgggcttcgtggtgggggacctgtacgccctcctgactcactcgagcagagccgcttgtacacgcattaagaactccggccttgctggcggtctgacggaagaggatgagggcgaattgtgcgccgcgggattccctctgctggctgaggattttggacaagcattagagcagctgcagacagctcactcacaggcagtaggtgcacccaaagttgaaactaagtctctcgagtgcttgcccggtccaggtctccagctccatgccctttcctccctaatgaactggactctgtggcctcaagccggcggagaagttgaaatcctagaagaatag

SEQ ID NO: 199037 - DNA, 2943 bp, Artificial Sequence
  Description of Artificial Sequence: Synthetic coding sequence
atggccctggccgtgctgcgggtgctggagcccttccccaccgagacaccgccactcgcagtgctcctgcctcctggcgggccctggcccgcagcagagcttggcctcgtgctggcattacgtcccgctggagagagcccagccggcccagcgctgctggtcgccgctcttgaaggccctgacgctggcacggaagaacaaggcccaggcccccctcagttgctggtgtcccgagctctgctacggctcctggcccttggctcgggggcgtgggtcagggcacgcgctgtgaggcgcccccccgccctcggctgggccctgctggggacttctctagggccgggcttgggtccgcgggtcggaccactcttggtaaggcgcggagaaacactccccgtcccaggtcccagagtcctcgagactaggcccgctttgcagggcctcctcggccccggaactaggttggccgttactgagttacgaggccgcgcacggctgtgtcctgagtccggggacagctctagaccacctcccccgccagtggtctcatcatttgcagtatctgggacggtgaggagactacagggggtgctgggcggaaccggagactctttaggcgtgtctcggtcctgtttgagaggcctaggcctcttccagggcgagtgggtgtgggtcgcgcaggcccgtgagtcgagcaatacgtctcagccacacctggcacgcgtgcaggtgctagaacctcgctgggacctaagtgatcgcttgggcccggggtcaggacccctgggggaacctttggcagatggactggccctcgtgcccgctaccctggccttcaatctgggttgtgacccgctggaaatgggggaactgagaatccagaggtatctggaagggagtatagctccggaggataaaggcagctgctctctcttgcccggtcctccttttgctagagagttgcacatagaaatcgtcagcagtccacactatagcacaaacgggaattacgacggagtgctttacaggcactttcagattccccgggtggtgcaggagggagacgttctgtgtgtgcccactatcggacaggtcgagatcctcgagggaagcccagaaaagctgccccgttggagggaaatgttcttcaaggtgaagaaaacagtaggggaggctccggatggacctgcttctgcctatctggcagatacgacccatacaagtctgtatatggtcggctccactcttagtcccgtcccttggttgccctcagaagaatccactctctggtccagtctgagccctcctggtttggaggcattggtttcagagttatgtgcagtccttaaacctcgcttacaacccgggggcgcgcttctcactgggaccagctccgtactactcagaggcccgcctgggtgtgggaaaactacagttgtggcagctgcttgtagccacctgggactccacctccttaaggtgccctgctctagcttgtgcgccgagtcttccggagctgtcgaaaccaaactgcaggctatttttagccgagcccgtcgatgccgccctgctgtattactcctgaccgctgtagacctgctcgggcgggacagggatggactgggcgaggacgctcgagtcatggcagtgttgaggcacctgctattgaacgaagaccccctcaattcctgtccacctttgatggtggtcgctacaacctcaagggcccaagacctgccagctgacgtgcagaccgcttttccacacgagctcgaagtccctgccctcagtgagggtcaacgactctccattttgcgggccctgactgcacacctgcccctcgggcaggaggtgaacctggcccagttggcacgtcggtgtgctggctttgtggtgggagatctgtatgcgctactgacccactcttcccgcgccgcgtgcacccgtatcaaaaacagtgggttggccggcgggttaacggaggaggacgagggggagctatgtgccgccgggttccccttactagccgaggactttggacaggcacttgagcagctgcaaactgcacattcccaggcggtcggggccccaaagattccctcagtctcctggcatgacgtgggcggcctccaggaagtcaagaaagaaattctggaaactatccagttgccactggaacatcctgagctgctgtcactcggtctcaggagaagtggtctcctgctgcatgggccacccggaactgggaaaacactcctagctaaggccgtggccacggagtgctcacttaccttcttgtcagtgaagggccccgagttaataaacatgtatgttggccagtccgaggagaatgtgcgagaagtcttcgctagagccagagccgccgccccttgtatcattttctttgacgagttggactccttggccccgagcagaggacgctccggagatagcggcggtgtcatggatcgcgttgtgtcccagctgttggccgagctcgatggactgcactctacacaggacgtctttgtgatcggggccaccaatagacctgacctactggaccccgcattgcttaggccaggccgttttgacaagctagtttttgtgggggccaatgaggatcgcgcctctcaacttagggtcctgtctgcaatcactcgtaagtttaaactcgagccttcggtgtccctcgtaaacgtgctcgattgctgtccgccacagctgaccggcgcagacctgtacagtctttgcagtgatgccatgacagcagccttgaagagaagagtgcatgatctagaggaagggttggaacctggctcttctgcacttatgcttactatggaggacctgctccaggcagccgcccggcttcagcctagcgttagcgaacaggaacttttaaggtacaagcgaattcagaggaaattcgccgcgtgctag

SEQ ID NO: 199038 - DNA, 972 bp, Artificial Sequence
  Description of Artificial Sequence: Synthetic coding sequence
atgagcgccgtgtgcggcggcgccgcccggatgctgcggacccccggtcggcacggctatgccgctgagttttccccttatctacctggtcggctcgcctgcgctaccgctcagcactatggaatcgctggttgtggcactctgctgatactcgatccggatgaggccggactgcgactgtttcgtagctttgactggaacgatgggctgttcgatgtcacctggagcgagaacaatgaacacgttctgattacttgttccggggacggcagcctacaactgtgggacactgccaaagccgcaggtccgctccaagtgtacaaagaacacgcacaagaagtatacagtgtggactggagtcagacccggggggaacaactggtggtgtccggctcctgggaccagactgttaagctgtgggatcccaccgtgggaaaatctctctgcacattcaggggacatgaaagtattatctatagcacaatttggtctccgcacatcccaggttgtttcgcgtctgcaagtggcgatcagacgttgcggatttgggatgtgaaagccgctggcgtgcgaatagtaataccagcccatcaggcagaaattttgagctgcgactggtgcaaatataacgagaatcttcttgtcacaggcgccgtggattgtagcttaagaggctgggacctaaggaacgtgagacagccagtttttgagctgctgggtcatacctatgccatcaggagggtcaagtttagcccgtttcatgccagcgttcttgcctcgtgttcatacgatttcacagtgcggttttggaacttttctaaaccagacagtctactagagactgtcgagcaccacacggaattcacatgtgggttagacttttctctgcagagccctactcaagtagctgattgtagttgggacgaaaccatcaagatctatgaccccgcatgcctcactatacccgcctag

SEQ ID NO: 199039 - DNA, 369 bp, Artificial Sequence
  Description of Artificial Sequence: Synthetic coding sequence
atgagcgccgtgtgcggcggcgccgcccggatgctgcggacccccggaaggcacggatacgcggctgaattttctccttacctacctggcaggctagcgtgtgcaaccgcccagcactacggaattgctggctgcggtacactgctgattttggacccagatgaggccgggctcaggcttttccgctcctttgactggaatgacggcctgttcgatgtaacctggtctgagaataacgagcacgttctgataacctgtagcggtgatggctccctgcaactttgggatactgcaaaggccgctggccccctgcaagtctacaaagagcacgcacaggaatacgtgcaggggtcgtgtgtggtgaagtag

SEQ ID NO: 199040 - DNA, 843 bp, Artificial Sequence
  Description of Artificial Sequence: Synthetic coding sequence
atgagcgccgtgtgcggcggcgccgcccggatgctgcggacccccggccggcacggatatgcagctgagtttagcccttatctgcctggccgccttgcctgcgccaccgcccagcactacgggatcgcgggctgtggaaccctgttgatcctcgatcccgatgaagccggcttgcgcctattccgcagcttcgattggaatgacggcttgtttgatgtgacctggtctgaaaacaacgaacacgtcttaatcacatgcagcggcgacgggtccctccagctgtgggacaccgctaaggccgccggcccactgcaggtctacaaagaacacgcccaggaggtgtacagcgtggattggtctcagactcggggtgagcagcttgttgtgtctgggagctgggaccagactgtaaagctctgggatccaacagtgggcaagtccctctgcacgttcaggggacatgagagcatcatatactcaaccatttggtcccctcacatacctggatgctttgccagcgcttcaggggaccaaaccctgcggatatgggacgtgaaagccgcaggtgtgaggatcgtaatccccgcccatcaggctgagatcctaagctgtgactggtgcaagtacaacgaaaatcttctggtgaccggcgccgttgactgttccctccgtggttgggacctgcgcaacgttcgccaaccagtgtttgaactcctgggccatacttacgcaataagaagggtaaagatggagtcttgcccagtgacacaaacaaggagccagctgaccgcaacgagcgccttctgggtacaggccgtgttgcttccgcaacctactgaatag

SEQ ID NO: 199041 - DNA, 912 bp, Artificial Sequence
  Description of Artificial Sequence: Synthetic coding sequence
atggccagctgggccaagggccggagctacctggcccccggcctgctgcagggtcaagtcgccatcgtgaccggaggcgccaccggtatcggtaaggccatcgtgaaagaacttcttgaattgggtagcaacgtggtaatagcctcccggaagctcgaaaggctgaagtctgcagccgatgagctgcaggctaaccttcctcccactaagcaagcccgcgtgatccccatccagtgtaacatacgcaacgaagaagaggtcaacaacctggtgaaaagcaccctggatacttttgggaaaattaactttctggtcaataatggcggggggcagttcctgagtcctgctgagcatatttcttctaagggttggcacgcagtgttggaaaccaatctgaccggtaccttctacatgtgcaaagctgtctactcttcgtggatgaaagaacatggcgggtccattgtgaacattatagtgcccactaaagccggttttcctctggctgttcactccggggctgccagggccggtgtgtacaacctgaccaaatcactggccctggaatgggcctgctccggaattcgtatcaactgtgttgcaccaggcgtgatttactctcagaccgctgtcgagaattacggctcctggggacaatcgttcttcgagggtagctttcagaaaattccagccaaacggatcggagtgccagaggaagtgagcagtgtcgtatgtttcctcctgtcgccagcagccagtttcatcactggacagtcagtggatgttgatgggggccgttctctgtacacacattcctatgaggtacccgaccatgataattggcccaagggtgcaggggatctctcagtggtaaagaagatgaaagaaactttcaaggagaaggctaagctgtag

SEQ ID NO: 199042 - DNA, 1407 bp, Artificial Sequence
  Description of Artificial Sequence: Synthetic coding sequence
atggtggacaccgagagccccctgtgccccctgagccccctggaggccggggacctagagtcccccctttctgaggaatttcttcaagagatgggcaacatccaggagatctcacagagtatcggtgaggattctagcggaagcttcggctttacagaataccaatatttagggagctgcccaggaagcgatggatctgtgataaccgacaccctgtctcccgcgagtagtccgtcctccgtcacttaccccgtcgtccccgggtccgtcgacgaatccccctctggggccctcaacatagagtgtagaatctgcggagacaaagcctctgggtaccactacggagtgcacgcatgtgagggctgtaaaggtttctttcgccgcacaatccgtctgaagctggtttacgacaaatgcgacagaagctgcaaaattcagaaaaaaaatagaaataagtgccagtactgtcggtttcataagtgcctcagtgtgggtatgagtcacaatgcgatcagatttgggcgcatgccgcgatccgaaaaagccaaactcaaggccgagatcttgacatgtgaacacgatatcgaggactcagaaacagccgacctaaaaagcctggctaaaagaatttatgaggcatatctgaagaactttaatatgaataaagtgaaagcccgggtcattttgtctggaaaggcgtccaacaaccctcctttcgtaattcatgacatggaaacgctctgtatggcggagaagacattagttgctaagctggtagcgaacggaattcaaaacaaagaagcagaggtgcggatcttccattgctgtcagtgcacctctgtggaaacagtcacagagctcaccgagttcgcaaaggccattccaggcttcgcaaaccttgaccttaacgaccaggtgacactcttaaagtatggggtctatgaggcaatttttgcaatgttgagttccgttatgaacaaagacgggatgctcgttgcttatggcaacggatttatcacccgcgagttcttaaagtcacttcgaaagccattctgtgatattatggaacctaaattcgatttcgcaatgaaattcaacgcgctcgagttggacgactctgacatcagcctgtttgttgctgccatcatctgttgcggcgatcgtccaggcttacttaacgtgggtcatatcgagaaaatgcaggaggggatagtccacgtcctgaggcttcacctacagtccaaccatcctgatgacatattcctctttcccaagctcctgcagaaaatggccgatctgaggcagctcgtgacggaacatgcacagctggtgcagataataaagaaaacagagtcagatgcggcgttacacccactcctgcaggaaatctatagggatatgtactag

SEQ ID NO: 199043 - DNA, 1407 bp, Artificial Sequence
  Description of Artificial Sequence: Synthetic coding sequence
atggtggacaccgagagccccctgtgccccctgagccccctggaggctggtgacctggagtcacctctttcagaagagttcttacaggaaatgggcaacatccaggaaatatcgcagtccattggagaggatagtagtggttctttcgggtttacagagtaccaatatctgggtagctgtcccggcagcgacgggagtgtgattactgacactctgtcacctgcttctagcccgagcagcgttacctaccctgtcgtgcccgggagtgtcgacgagtcacccagcggcgccctcaacattgagtgtagaatctgcggtgacaaggcctcaggatatcattacggggtacatgcatgtgagggctgtaaggggttcttccgacgaaccatcagattaaagctggtttatgataagtgtgatagaagctgtaagattcagaagaagaatcgcaacaagtgccagtattgccggttccataaatgtctaagtgtcgggatgtcgcacaatgctataagattcgggcgtatgcctagatcagaaaaagcaaagctgaaggcagaaatcttaacatgtgaacatgacattgaggattcggagaccgccgatctgaagagtctggcaaaacgcatctacgaggcttatctcaagaatttcaatatgaataaggtgaaagcgcgggtgatcctgtctgggaaggcctccaacaatcccccgtttgtgattcacgacatggaaacattgtgcatggctgagaaaactctggtggccaaacttgtcgctaatggaattcagaataaagaggccgaggttcggatttttcattgttgtcagtgtacgagtgtggagaccgtgaccgagcttactgagttcgcaaaggccatccccggatttgccaatctggatcttaatgatcaggttacccttctcaagtacggcgtctacgaggccatattcgccatgttaagttcagtcatgaataaagatgggatgctagtggcctatgggaacggatttatcactcgtgagttcctgaaatccttgagaaagcctttctgtgatattatggagcctaaatttgattttgcaatgaaattcaatgctcttgagctggacgatagcgatatatcattgttcgttgcggccattatctgctgcggagatcgccctggcttactcaacgtgggccacattgagaagatgcaggagggcatagtgcatgtcctgagactgcacctgcagagtaaccatcccgatgacatctttctcttccccaaacttctacagaagatggctgatctgagacagttagtgacagagcacgcacagctggtgcagataatcaagaaaactgagtccgatgctgccctccaccccctgctccaggagatctatcgcgatatgtactag

SEQ ID NO: 199044 - DNA, 1407 bp, Artificial Sequence
  Description of Artificial Sequence: Synthetic coding sequence
atggtggacaccgagagccccctgtgccccctgagccccctggaggcgggggatctggagagtccgctctccgaggaatttctccaggaaatggggaatatacaggaaatttcccagtccatcggtgaagattcctcaggtagtttcggatttaccgagtatcagtacctgggctcttgtcccggttcagatggtagcgtgatcactgatacgttgagccccgccagctcgccctcttccgtcacgtatcctgtggtccctgggtcagtggatgagtcaccctcaggggccctaaatattgaatgtcgcatttgcggcgacaaggccagtgggtatcactacggagtgcacgcctgcgaggggtgtaagggcttcttcaggcgcaccattaggctgaagctagtgtatgacaaatgtgacagatcgtgcaagatccagaagaaaaataggaataaatgccaatattgccgcttccataagtgtttaagtgtgggcatgtctcacaatgcaattcgcttcggacgcatgcctcgatctgagaaagccaagctcaaggcggaaatcctgacatgcgagcatgatattgaagacagcgagaccgctgacttaaagtctctggcgaagcgaatttatgaagcctaccttaaaaactttaatatgaataaagttaaggctagagtgatccttagtggcaaggcttccaataacccccccttcgtgattcacgacatggaaacactgtgtatggcggagaagactttagtagccaagttggtcgctaatggcatacagaataaagaggcagaggtgcggattttccactgttgccaatgcacctcagtcgagaccgtcactgaactgaccgagtttgccaaagccattcccgggttcgctaatctggacctcaacgaccaggtaacgcttctgaagtacggagtgtatgaggccattttcgcgatgctatcttcggtgatgaataaggacgggatgctggtcgcctacggaaacggattcataactcgtgaatttcttaagtcgctcagaaaacccttttgtgacattatggaacctaaattcgacttcgctatgaaattcaatgctctggaattggatgacagtgacatctcactgttcgtcgcggcaatcatctgctgtggcgaccgacccggactactgaatgtggggcatatcgagaaaatgcaagagggcatcgtgcatgtgctgagattgcatctccagagtaaccatccagacgatatatttttgttcccaaaactgctccagaagatggcagacttgcgacagctcgtgaccgaacatgctcagttagtgcagatcattaaaaagaccgagagcgatgcagcccttcatcctctactgcaggaaatataccgtgatatgtactag

SEQ ID NO: 199045 - DNA, 1407 bp, Artificial Sequence
  Description of Artificial Sequence: Synthetic coding sequence
atggtggacaccgagagccccctgtgccccctgagccccctggaggcaggagatctggaatctcctctgagtgaggaatttcttcaagagatgggaaatatccaagagatatctcaatctattggtgaggattccagtgggagctttggatttaccgaatatcagtacttgggatcttgtccaggtagcgatggatccgtgattacagatacactctccccggcatcttcccccagctccgtgacctaccccgttgtgcccggctccgtagacgagagcccttcaggcgccttgaacattgagtgcaggatttgcggtgacaaagcatcgggatatcactatggcgtccacgcatgcgaggggtgcaaagggttcttcaggaggacgattaggctgaaactagtttatgacaagtgcgatcggagctgtaaaatccagaaaaaaaatcgcaataaatgtcaatactgtcgctttcataagtgcttatccgtgggaatgtcccataacgcgataaggttcgggcggatgcccagaagtgagaaggcgaagctcaaagcagaaatcctgacttgcgagcacgatattgaagacagcgagaccgcagacctaaaatctcttgccaagcggatttatgaggcctatctgaagaatttcaatatgaacaaagtgaaggcgcgggtcatcctgagcggtaaggcgagcaataatcctccctttgtcattcacgatatggagacactgtgtatggctgagaagacactggtagcgaagctggttgccaatggaatccagaacaaggaagcggaggtccgcatttttcactgctgccagtgtacaagtgtcgagactgtgaccgagcttacagaattcgccaaagccattccggggtttgcaaatctagacctgaacgaccaggttaccctgctaaaatatggggtctatgaggcgatcttcgctatgttgagctcagtcatgaataaagacgggatgttggttgcttatggcaacggtttcatcacacgcgaattcttgaaatcgctcaggaagcctttctgcgatattatggaacccaaatttgactttgcaatgaaattcaatgccttggaactcgatgattccgatataagcctgttcgtggcggcaatcatatgttgtggcgatcggcccggactgctgaacgttggacacattgaaaagatgcaagaaggaatagtacacgtactgcggttacatctgcagtctaatcaccccgacgacatcttccttttccctaagttactgcagaaaatggccgacctcaggcagctggtaacagaacatgcacagctcgtgcagataattaagaaaaccgagagtgacgcagccctacacccgcttttgcaggagatttaccgcgacatgtactag

SEQ ID NO: 199046 - DNA, 210 bp, Artificial Sequence
  Description of Artificial Sequence: Synthetic coding sequence
atggtggacaccgagagccccctgtgccccctgagccccctggaggcaggtgatctggagagtccattgagtgaagagtttctgcaggaaatgggcaacattcaggagatcagccagtccatcggtgaggactccagcggcagtttcgggtttaccgagtaccagtatcttggaagttgtccaggttctgacgggtcagtgattacttag

SEQ ID NO: 199047 - DNA, 402 bp, Artificial Sequence
  Description of Artificial Sequence: Synthetic coding sequence
atggtggacaccgagagccccctgtgccccctgagccccctggaggccggtgatctcgaatctccactgtcagaagagtttctacaggagatgggcaacatccaagagataagccagtctatcggcgaggactcaagcggctcattcggcttcaccgaataccagtacctgggctcttgcccaggttcagatgggagcgtgatcacagataccctgtctcctgcttctagcccgagcagcgtgacttaccctgtggtgcccggctcggtcgacgaaagcccatctggcgctctgaacatagagtgtcgcatttgcggagacaaagccagtgggtaccattacggtgtgcacgcctgtgaaggctgcaaggtcgaaggaagttggaacagagcctggtggtag

SEQ ID NO: 199048 - DNA, 525 bp, Artificial Sequence
  Description of Artificial Sequence: Synthetic coding sequence
atggtggacaccgagagccccctgtgccccctgagccccctggaggccggcgatctcgaatctcccctgtctgaagagtttcttcaggaaatgggcaatattcaagagattagccaaagcatcggtgaggattctagtgggtcttttggattcaccgaataccagtatttggggtcctgcccgggatcggatggcagcgtaattacagatacgttatccccggcctccagcccttcatctgtgacttatcccgtggtgccaggtagcgtcgacgagtccccctcaggcgccttgaatatcgagtgtcggatctgtggcgataaagcatcggggtaccattatggagtccacgcttgtgaaggctgtaaggggttcttcaggagaacaattcgattgaaactcgtctacgacaaatgtgaccggagctgcaagattcagaaaaagaacaggaataagtgccagtattgtcgatttcataagtgtctgtcagttggaatgtcacataatgccttttgtcatacgtag

SEQ ID NO: 199049 - DNA, 30 bp, Artificial Sequence; identical to SEQ ID NO: 92855
  Description of Artificial Sequence: Synthetic coding sequence

SEQ ID NO: 199050 - DNA, 489 bp, Artificial Sequence
  Description of Artificial Sequence: Synthetic coding sequence
atgaacaaggtgaaggcccgggtgatcctgagcggcaaggccagcaacaatccaccattcgtgatccacgatatggagacattgtgcatggcagaaaaaactctggttgccaagctcgttgccaacggcatccagaataaggaagcagaggtgaggattttccactgttgccagtgcaccagcgttgaaactgttacagagctgaccgaatttgccaaggcaataccagggtttgccaacctcgacctgaacgaccaggttacgcttctcaaatacggagtgtacgaggcgatcttcgccatgctgagctcagtgatgaacaaggatggcatgctggtggcctatggcaacggcttcataacccgtgagttcctgaagagcttaagaaagccattctgcgacataatggagcccaaattcgactttgcaatgaaatttaatgccttggaactggacgacagcgatattagcctctttgttgcagcctag

SEQ ID NO: 199051 - DNA, 1326 bp, Artificial Sequence
  Description of Artificial Sequence: Synthetic coding sequence
atggagcagccccaggaggaggcccccgaggtgcgggaggaggaggagaaggaggaggtggctgaggctgaaggggcaccagaactcaacggtggccctcaacatgcgctgcctagctcttcatatacggatctgtctaggtctagcagccccccatccctcctagaccagctgcagatgggctgtgatggggcttcatgcgggtccctgaatatggagtgcagagtatgtggtgacaaggcctctggattccactatggggtccacgcttgtgaaggctgtaaagggttcttcaggcgcaccatccgcatgaaacttgagtacgagaaatgcgagaggtcatgtaagatccaaaaaaagaataggaacaagtgtcagtactgcaggttccagaagtgcctcgccttgggaatgtctcataacgctattcggttcgggaggatgcctgaggcagagaaacgaaagctggtcgcaggacttacggccaacgaaggctcacagtataaccctcaagtcgcagatctaaaggccttttctaagcatatttataatgcctacctgaagaactttaacatgacaaagaaaaaggcgaggtctattctcacgggcaaggcaagtcacaccgcgccctttgtgattcatgatatcgaaaccctgtggcaggccgaaaaaggcctcgtctggaaacagctggtcaatggcctccccccatataaggagattagtgtccacgtattctaccggtgccagtgtactacagtggagactgtcagagaactcaccgagttcgcaaagtccatcccaagtttctccagcttatttctgaatgatcaggtgacactacttaagtacggcgttcacgaagctatctttgcaatgctggcgagcattgtcaataaagacggactcctggtggccaacggctccgggttcgtgaccagggaattcttgagatcattacgaaagcctttctcagacattattgaacctaagttcgagtttgccgtcaaatttaatgcccttgagttggatgattctgatctcgctctctttatagccgcaatcattctgtgcggggataggcccggacttatgaatgttccacgggtggaagccattcaggacactattcttcgggcattggagtttcatcttcaggcaaatcaccccgacgcccagtatttattccctaagttgctccaaaaaatggcggatctccgccagctagttaccgagcacgcgcaaatgatgcaacgaattaagaaaactgaaacagagacgtctctgcatccactcttgcaagagatctataaggacatgtattag

SEQ ID NO: 199052 - DNA, 1086 bp, Artificial Sequence
  Description of Artificial Sequence: Synthetic coding sequence
atggagcagccccaggaggaggcccccgaggtgcgggaggaggaggagaaagaagaggtcgcggaagccgaaggtgcaccagaactgaacggtgggcctcaacacgccctcccttcaagttcatacacagatcttagtagaagcagcagccctccgtccctgcttgatcagctgcagatggggtgcgacggggctagctgcgggagcctgaacatggaatgccgggtgtgcggtgataaagcatcaggctttcactatggagtgcacgcttgcgagggctgcaagggattttttagaagaaccataaggatgaagctcgagtatgaaaaatgcgagaggagctgcaagatccagaagaaaaacaggaataaatgtcagtattgccgttttcagaaatgtctcgccctgggaatgtctcataacgcaataagattcggtcgtatgccggaggccgagaaacgcaaacttgttgcgggacttacagccaacgaaggcagccaatataacccccaagtcgctgatctgaaggccttttctaaacacatatataacgcctacctgaagaactttaacatgacaaagaaaaaagcacggtcaattctgaccgggaaggcctcgcataccgccccgtttgtcattcacgatatcgaaaccttatggcaagcagaaaaaggattggtgtggaagcaattggtgaacgggctgccaccgtacaaagaaattagcgtccatgttttttatcgatgtcaatgtaccacggttgagaccgtcagagagctgaccgagtttgccaagtccattcccagtttcagctccctgtttctcaatgatcaggtcacgctcctaaagtatggcgtccacgaagccattttcgcaatgttagcctccatcgttaataaagatggcctgttagtggctaatggtagtggattcgttacaagggagttcctgcggtccttgagaaaacctttctctgatatcatcgaacctaaattcgagtttgcagtgaagttcaacgctctggagctggacgattccgacctggctctatttatagccgctatcatactgtgcggcggggaatag

SEQ ID NO: 199053 - DNA, 1326 bp, Artificial Sequence
  Description of Artificial Sequence: Synthetic coding sequence
atggagcagccccaggaggaggcccccgaggtgcgggaggaggaggagaaggaagaggtagcagaagctgagggtgcccctgagctgaacggcggtccacaacacgccttaccctccagctcttacaccgatctctctcggagttcatcgcctccaagtctcctcgatcaacttcagatgggttgtgatggagcctcgtgcggttccctgaacatggagtgcagagtctgtggcgacaaagcatccggattccattatggcgtccacgcctgcgagggatgcaaaggatttttcaggcgaaccatacggatgaaactggagtatgagaagtgcgagcgctcctgtaagatccaaaaaaagaatcgtaataagtgccagtactgccggttccagaagtgtctggctttgggtatgtcccacaatgccatccgcttcggtagaatgcctgaggcagaaaaacgcaaactggtcgcaggattgacagcaaacgagggatcccagtataacccccaggtcgctgacctcaaggctttttcaaaacatatttacaacgcttacctgaaaaacttcaacatgacaaagaaaaaggcaagatctatactaacaggtaaggcctctcataccgccccatttgttatccatgatattgaaactttatggcaggccgaaaagggacttgtgtggaaacagctggttaatgggctccccccctacaaggagatctccgttcatgtgttctatcgctgtcaatgcactactgtggagacagtgcgagaactgaccgagttcgcaaagtccataccatccttcagctcactcttcttgaacgatcaggttacgctcctgaaatatggcgtgcatgaagccatcttcgccatgctggcctccatcgtgaacaaggacgggctgctggtcgccaatggatccggatttgtcacgcgggaattcttgagatcactgcgaaagcccttctccgacatcatagaacccaagtttgaattcgctgttaagttcaatgccctcgagctggacgactccgatctggcactgttcattgcggctatcattctgtgtggcgacaggccagggttgatgaatgttcctcgtgtggaggcaattcaggatactattcttagggcactggaattccatctgcaggcaaatcatcctgatgcacagtatctgtttcccaagctcttgcagaaaatggctgaccttaggcaactggttactgaacatgcccagatgatgcaaagaattaagaaaacagagacggagactagcctgcaccctttattacaggagatctacaaagatatgtattag

SEQ ID NO: 199054 - DNA, 1032 bp, Artificial Sequence
  Description of Artificial Sequence: Synthetic coding sequence
atggagcagccccaggaggaggcccccgaggtgcgggaggaggaggaaaaggaggaagttgcagaggccgagggcgctccagagctaaacggaggtccccagcacgccttgccgagtagttcctacacagcaattcgctttggaaggatgccagaggctgagaagcgtaagctagttgccgggctgactgctaacgaggggagtcagtataacccacaagtggcggatctgaaggctttttccaaacacatctacaacgcatacttaaaaaattttaatatgacaaagaaaaaggctcgctcaattctgaccggaaaggcctctcataccgctccattcgtcatccatgacattgaaaccctatggcaggccgagaaggggctggtgtggaagcagctggtgaacgggctacccccttacaaggaaatcagcgtgcatgtgttctaccggtgccagtgcacaaccgtcgagactgtgagggaactgacagagtttgcaaagtcgattccttcctttagcagcctctttctgaatgaccaggttacactgctgaagtacggtgtccacgaggccatattcgccatgctggcgtcaatcgtaaataaagacgggctgctcgtagccaacggctccggatttgtgaccagagagtttctgcggtccctgaggaagcctttttctgacattatcgagcccaagtttgaatttgcggttaagtttaatgccctcgagctggacgatagcgacctggccctgttcatcgctgcaataatcctgtgtggcgaccgccccggattgatgaatgtgcctagagttgaggcgattcaagatacaattctgcgcgctctcgaatttcacctccaggcaaatcatcccgacgcccagtatttgtttcccaaactgctgcagaagatggcagatctcaggcagttggtcaccgagcatgcccaaatgatgcagcggatcaaaaaaaccgagacggaaaccagcctccaccctctgctccaagagatttataaggacatgtactag

SEQ ID NO: 199055 - DNA, 1086 bp, Artificial Sequence
  Description of Artificial Sequence: Synthetic coding sequence
atggagcagccccaggaggaggcccccgaggtgcgggaggaggaggagaaagaggaagtcgcagaggctgagggagctcccgaactgaacggtggtccacagcacgccctaccttcatctagttataccgacttatcaagatcatcgtcacctccatctctgctagaccagctgcaaatgggctgcgacggcgcttcctgtggaagccttaatatggagtgtcgggtttgtggcgataaagcgagcgggttccattacggagttcatgcgtgcgagggatgcaagggcttttttcgaaggacgattcggatgaagctcgaatacgagaagtgcgagagatcatgcaagatacagaagaaaaatcggaacaaatgccaatactgtaggttccagaagtgcctagccctcggtatgagccataacgccattaggttcggtcggatgccggaggcggaaaagcgcaagctggtggctgggttaacggcaaacgaaggaagccagtacaacccccaggtagctgacctaaaggccttcagcaaacatatctataatgcatatcttaaaaattttaacatgacaaaaaaaaaggcgagaagcatcctgaccggaaaggcctctcacacggctccctttgtgattcatgacatcgagaccctttggcaggctgagaagggcttagtttggaaacagctggtgaacggcctcccaccctataaagaaatcagcgtacacgtcttttatagatgccagtgtacgaccgtggagaccgttcgcgagttaaccgagttcgcaaagagcataccaagcttctcatctttattccttaacgaccaggtgacactgttaaagtacggtgtacatgaggcaatatttgcgatgctcgctagtattgtgaacaaggatggactgttggtggctaatggctcaggcttcgtgacgcgtgaattcctccggagcctcagaaaacccttttcagacataatagaaccgaagttcgagttcgcagtcaaattcaacgccctcgaactggatgactcagacctggcattgttcattgcggcaattatactgtgtggaggcgagtag

SEQ ID NO: 199056 - DNA, 1209 bp, Artificial Sequence
  Description of Artificial Sequence: Synthetic coding sequence
atgcaccagcgggacctgagccggagcagcagcccccccagcctgctggaccaactgcagatggggtgcgatggagctagctgcggaagccttaacatggagtgccgagtttgtggtgataaggcctctgggttccattacggagtccatgcatgtgagggatgtaagggattctttcggcgaacgattagaatgaagctagagtatgaaaagtgcgagaggtcctgcaagatccaaaagaaaaaccgaaacaaatgccagtactgtcggttccaaaaatgtctggcgttgggaatgtcacataatgctatccgctttgggcggatgcccgaagctgaaaagcgcaaactggtggccggcctaacagctaacgagggcagtcaatataacccccaagtagcggaccttaaagcgttctcgaagcatatttacaatgcctatctgaaaaactttaatatgacgaaaaagaaagcaaggtctatccttactggcaaggcctctcatactgcaccttttgtgattcatgatatagagacactgtggcaggcagaaaagggcctcgtctggaagcagctggtgaacggactacccccttataaagagatttcagttcatgtcttctatagatgccagtgcacaacggtggaaacggtgagagaactcaccgagttcgctaagagcattccttcattcagctccttattcttaaacgaccaggtgacactgttaaagtatggcgtacatgaggcgattttcgccatgctggcctcaatagtgaataaggacggcctgctggtagcgaacgggtctgggttcgtgacgagggagtttttgagaagtctgagaaagcctttttctgacattattgaaccgaagttcgagttcgctgtcaaatttaacgcgctcgaactcgatgacagtgacttggccctgtttatagccgccatcatcttgtgcggtgacaggcccggacttatgaatgtccccagggttgaagcaatccaggacacaattctgcgcgcactcgagtttcacctgcaggcgaaccaccctgacgcacagtatctgtttcctaagctgcttcagaaaatggctgatctgcgtcaattagtgaccgagcacgcgcagatgatgcagaggataaagaagacggagaccgagactagccttcatccccttctgcaggagatttacaaagacatgtactag

SEQ ID NO: 199057 - DNA, 1017 bp, Artificial Sequence
  Description of Artificial Sequence: Synthetic coding sequence
atgaagctggagtacgagaagtgcgagcggagctgcaagatccagaagaagaatcgtaacaaatgccagtattgtcgattccaaaagtgcctcgccttgggcatgtctcataatgcgattagatttggacgtatgcccgaggcggagaagcgaaaactagtcgccggtctcacggctaacgagggcagtcaatacaatccccaggtggcagatctgaaggcctttagcaagcatatttataatgcgtacctgaaaaacttcaatatgacaaagaagaaagcccgctccattctgacaggtaaggctagtcacacagctcctttcgtgatccacgacattgaaacactgtggcaagcagagaagggactggtgtggaagcaactggtgaatggcctcccaccctataaggaaatttctgtccatgtcttttaccgttgccagtgcacaacggtagagactgttcgggagctgaccgagtttgcaaaatccattccaagctttagcagcctgtttctgaacgaccaggttactctgctgaaatacggggtccacgaggcaatcttcgcgatgctcgcatcaatcgtgaataaagacgggctgttagtcgcgaacggctccgggttcgtaaccagggagttcttacggagcctgcggaagccattctcggatatcattgaaccaaagtttgagtttgcagtcaagttcaatgccctcgagctggacgacagcgacctggccctgttcatcgccgccattattctgtgcggagaccggcctggcctcatgaacgtacctcgagttgaagctatccaggatactatcctgagggcactggagttccacttgcaagccaatcaccccgacgcccagtatctgttccccaagctgctgcagaaaatggctgatctacggcaactcgtaacagagcacgcccaaatgatgcagaggattaagaaaacagaaacagagacgagtctacacccacttttgcaggaaatctataaagacatgtactag

SEQ ID NO: 199058 - DNA, 1518 bp, Artificial Sequence
  Description of Artificial Sequence: Synthetic coding sequence
atgggcgagaccctgggcgacagccccatcgaccccgagagcgactcctttacggacacactgtccgctaacatcagccaggagatgacaatggtggacacagaaatgcctttttggcctactaactttggcatctcatccgtcgaccttagcgtcatggaagatcattcacattctttcgatattaagccttttactacagtggatttttccagtatttctacaccacactatgaggacatacccttcaccaggacagatcctgttgtggccgactataaatatgatcttaaactccaagagtatcaatcagcaatcaaggtggaacccgcaagtcctccttattactctgagaagacgcaactatacaataaacctcacgaggagccatcaaactccttgatggcaattgagtgcagggtttgtggcgataaggccagtgggttccactatggcgtgcacgcgtgcgaaggctgtaagggatttttcaggcggaccatcaggctcaagttaatttatgatcggtgtgacctgaactgcaggatccacaaaaagagtcggaataagtgccagtactgcaggttccagaaatgccttgcggttggtatgtcacataacgccataaggttcggaagaatgccacaggcggagaaggaaaaacttctggctgagatttccagtgatattgaccagctgaacccggaatctgcagacctgcgcgcactcgccaagcacttgtacgatagctacattaagtccttccccttgaccaaagctaaggccagagccatccttaccgggaaaacaaccgataaatccccattcgtgatttacgatatgaattctctcatgatgggggaagataaaatcaagttcaagcacataacaccactgcaggaacagtctaaagaggttgccatacgcatatttcagggctgccagttccgtagtgttgaggctgtacaagagataacggaatacgctaagtccatccccggttttgtgaatctcgatctcaacgatcaggtgacccttctcaaatacggcgtccacgagataatttatacaatgctggcctctctgatgaacaaggatggcgtgctcatttcggaaggccagggcttcatgacccgggaatttctgaaatccctcagaaaaccctttggggattttatggagccaaaatttgagttcgccgtaaagtttaatgctcttgagctggatgactcagaccttgccatcttcattgctgttataatactgagtggagaccgccccgggctgctgaatgttaaaccgatcgaagacatccaggataatctgctccaggccttagaactgcagctgaagctgaatcaccccgagagttcccagctgtttgctaagctgctgcagaaaatgacagatctgcgccaaatcgtaacagagcacgtgcagttgctgcaggttattaagaaaaccgagaccgatatgtctctacaccctttattgcaggaaatatacaaggatctttattag

SEQ ID NO: 199059 - DNA, 1434 bp, Artificial Sequence
  Description of Artificial Sequence: Synthetic coding sequence
atgaccatggtggacaccgagatgcccttctggcccaccaacttcggtatttcttcagtagatctctccgtaatggaggatcattcacactcctttgatatcaagccatttacaaccgttgacttcagcagcatctcaacaccccactacgaagacatcccgttcactaggaccgacccggtcgtggccgattataagtatgatttgaagctgcaggaataccagtccgccatcaaggtggagccggcctcaccgccttactacagcgagaaaacacagctgtataataagccccacgaggaaccgagcaacagtctgatggcaattgaatgtcgcgtctgcggtgataaggctagtggattccattacggggtccacgcttgcgagggttgcaagggcttttttaggcgtacgatcaggttgaaactgatctatgaccgatgtgacctgaattgcaggatacacaaaaagtcacgtaacaaatgccagtactgccggttccagaagtgcctggccgtgggaatgtctcacaacgcaatacggttcgggcgcatgccccaggctgagaaagagaaattattggccgaaatcagcagcgacattgaccagctcaacccagagagcgcagacctccgcgcacttgccaaacacctgtatgacagctatataaagagtttccctcttacaaaggccaaggctagagccatcctcaccgggaagactacagacaaatcccccttcgtaatctacgacatgaacagcttgatgatgggcgaagataaaattaagttcaagcacatcactccactgcaggaacagagtaaggaggtggcaatacggatcttccagggatgtcagtttagaagcgtagaggctgtgcaggaaattacagagtacgcaaagagtatacccggtttcgtaaatcttgatctgaatgaccaggtgaccctgttgaagtacggggttcacgaaatcatttacacgatgttagcgtctcttatgaacaaagacggcgtgctcattagtgaggggcaaggctttatgaccagggagtttctcaagagcctaaggaagccctttggcgacttcatggagccaaagttcgagtttgctgtgaaatttaacgctctggaactggatgacagcgacctcgcgatctttatcgccgtgattatactctccggcgatagaccagggcttctgaatgtgaagcccattgaggacatccaggacaatctgctgcaggccctggagctgcagctaaaactgaatcaccccgagtcttctcagctctttgcaaagttactgcagaaaatgacagatctaaggcaaatcgtcacagaacacgtgcaactgctgcaggtgataaagaaaacagaaactgacatgagtttacaccccctacttcaggagatttacaaagatctgtattag

SEQ ID NO: 199060 - DNA, 753 bp, Artificial Sequence
  Description of Artificial Sequence: Synthetic coding sequence
atgaccatggtggacaccgagatgcccttctggcccaccaacttcggcattagttccgtggatctgtctgtgatggaagatcacagccattccttcgacatcaaaccatttaccacagtggacttcagcagtatttctacaccccactacgaggacatcccttttacaaggacagaccctgtcgtcgccgattacaaatacgacttgaagttgcaagaatatcagtctgccatcaaagtggaaccggccagccctccgtactattccgaaaagacccagctttataataagccgcatgaggaacccagtaattctctcatggctatcgagtgcagagtttgtggtgataaagcttcgggatttcattatggcgtgcacgcttgcgaagggtgtaaaggcttcttccgtcggactattcgactgaagctgatatacgacaggtgtgacttgaattgtaggattcataaaaagtccaggaataagtgccagtattgtaggtttcaaaagtgcctggcggtgggaatgagccataatgctatcaggtttggaaggatgccccaggccgagaaggagaaactgctggcggagataagctccgacattgatcagcttaatccggagtcagccgacctgcgggccctggccaagcacctgtacgactcctatattaagagcttcccactgactaaagccaaggcccgggcaatcttgaccggcaagactaccgataagtctactgcacaggtgtgttag

SEQ ID NO: 199061 - DNA, 1434 bp, Artificial Sequence
  Description of Artificial Sequence: Synthetic coding sequence
atgaccatggtggacaccgagatgcccttctggcccaccaacttcggaatttcctcggtcgatctgtctgtaatggaggaccacagccacagcttcgacattaagccctttaccacagttgatttctcaagcatctcaacaccgcactacgaagatatcccctttactcgtacagaccccgtggtagccgactataagtatgacctaaagctgcaagaataccagtccgccattaaggtagagccagcatcccctccttactactctgagaagacacagctgtacaataaaccacacgaggagccctccaactcgctgatggccatcgaatgcagagtgtgcggagacaaagcatccgggtttcactacggcgtgcacgcctgcgaagggtgcaagggcttcttccgccgtactatacggctgaagctcatctatgatcgatgcgacctcaactgtaggattcacaagaagtctcgaaacaagtgtcagtactgccgctttcagaagtgtctggcggtgggaatgagtcacaacgcgatacggttcggtcggatgcctcaagccgagaaggagaaactgctggctgagatctcatcagacatcgaccaactcaaccccgagtctgccgatctcagggccctagccaagcacctctatgatagctacatcaagtccttccctctgaccaaagctaaagcaagggcaatacttacaggaaagacaaccgacaaatccccatttgtaatttacgatatgaatagcttaatgatgggagaggataaaattaagttcaagcacattacaccactgcaagagcaatctaaagaggtggccatccggatctttcagggctgtcagtttcgaagcgtcgaagcagttcaggagatcactgagtacgctaaaagtattcctggtttcgtcaacctggatcttaacgaccaggttacactgctcaaatacggggttcatgaaataatctacaccatgcttgcttctctgatgaataaagacggggtgttgattagcgaaggccagggattcatgactcgggaattcctaaagagtctgagaaaaccattcggggatttcatggagccaaaattcgaattcgctgtgaaattcaacgccctggagctggacgacagtgatctggcaattttcattgcggtgattattctttcaggggaccggccaggactgctcaacgtaaagcctattgaagatatccaggacaacctactccaggcgctggagctgcagctgaaattgaatcatccagagagcagccagctgtttgccaagctcctgcagaagatgaccgatctgcgccagatcgtcactgagcacgtgcagctcctgcaggttataaaaaaaacagagacggacatgagtctgcatccattgctgcaagagatttacaaagatctctattag

SEQ ID NO: 199062 - DNA, 1434 bp, Artificial Sequence
  Description of Artificial Sequence: Synthetic coding sequence
atgaccatggtggacaccgagatgcccttctggcccaccaacttcggaataagctcggtcgatctgagtgttatggaggatcacagccactctttcgatattaagcccttcacaacggtagacttttcctcaatcagcacgccacattacgaagacatccccttcaccaggaccgacccggtggttgccgactataagtacgatctcaagttacaagagtaccagtccgccatcaaggtggaacccgcctcccctccatactactcagaaaaaacgcagttatacaataagccccatgaagagccaagcaacagcctgatggctatcgagtgtcgcgtttgtggggataaggccagcgggtttcattatggcgtccacgcctgcgagggttgcaaaggcttctttcgccgcacaattagacttaagctgatctatgacaggtgcgatttgaattgtagaatacataagaagtcccggaataagtgtcagtattgtagattccagaaatgtctggccgttgggatgagtcataatgccattcggtttggcagaatgcctcaggccgaaaaggaaaagttgttagcagagatatccagtgatatcgatcagttaaaccccgagtccgcggatcttcgggcgctcgcgaagcatctgtacgactcctacatcaaatcattccccctgacgaaggccaaagcacgggccattttgacaggcaaaacaacagacaaatcaccattcgtgatctacgacatgaatagcctgatgatgggtgaggataagatcaaatttaagcatatcacgccattgcaggagcagtccaaagaggtcgctattagaatattccagggatgtcagtttcgttccgtcgaggccgtgcaagaaatcacagagtacgccaagtccattccgggattcgtgaatcttgacctgaatgatcaagtcacccttctgaagtacggcgtgcacgaaattatttacaccatgcttgcttcccttatgaacaaggatggcgtcctgattagtgaaggccaaggcttcatgacccgtgaattcctgaagtctttgcggaaaccatttggcgatttcatggagcccaaattcgagttcgccgttaaattcaatgcattggagctggatgatagcgatttggctattttcatcgccgtgattatcctttctggcgataggccggggctcttgaatgtaaaaccgatcgaagatattcaagataacctgttacaagccctggaactgcagctcaaactgaatcaccctgagtcatctcagttatttgctaagctactgcagaagatgacggatctaagacagatcgtcacggaacacgtccaactgctgcaagtgattaaaaaaaccgaaactgacatgtctttgcatccgctgctgcaggagatctataaagatctttactag

SEQ ID NO: 199063 - DNA, 1434 bp, Artificial Sequence
  Description of Artificial Sequence: Synthetic coding sequence
atgaccatggtggacaccgagatgcccttctggcccaccaacttcggaatctcatcagtcgacttgtccgttatggaagaccactctcactccttcgacattaagccatttaccactgtggatttcagcagtatctcaactccccactatgaggacatcccttttacgcgaactgatcctgtggtcgctgactacaaatatgacctaaagctacaggagtaccagtccgccatcaaagtcgagcctgcctctcctccctactacagtgaaaagacccagctgtacaataaaccccacgaagaaccaagcaatagcctcatggccattgaatgtcgggtctgtggggacaaggcttcaggattccactacggagtgcacgcttgtgaggggtgcaagggcttcttccgtcggaccatccgcctgaagctcatttatgatcggtgcgatctgaactgccgtatccataagaaaagccgcaataagtgccagtactgtaggtttcaaaagtgtttagctgttggaatgtcccacaatgccattagatttggcaggatgcctcaggctgaaaaggagaagctgttggcagagatttcaagcgacattgaccagcttaatccagagagcgcagatctccgagccctcgccaagcacctctatgacagttacatcaaaagcttccctctgacaaaggccaaggctcgcgcaatcctaactggtaagacaactgataagtcaccatttgtgatctacgatatgaatagcctgatgatgggtgaggacaaaataaagttcaagcacataaccccattgcaagaacagtcgaaggaggttgccattaggattttccagggctgtcaattcaggtccgtggaagcagttcaggagattaccgagtacgctaaatcaatccccggcttcgtcaacctggatctgaacgaccaagtcacacttcttaagtacggcgtgcacgaaataatatataccatgttggcttccttaatgaacaaggacggcgtgcttattagtgagggccagggcttcatgacccgagagtttctcaaatctctgcggaagccgttcggcgatttcatggaacctaaattcgaattcgctgtgaagtttaacgcactggagctggacgactctgatttggccattttcatcgccgtaatcattttaagtggtgacagacccggcctcctgaatgtgaaacccatcgaggacatccaggataatctgctgcaggccctggaattacagctcaaactgaaccacccagaatcttctcagctattcgcaaagttgttacagaagatgactgatctgcggcaaatcgttacggaacacgttcagctcctccaagtcattaagaaaactgagacagacatgagcctacatcccctccttcaggaaatatacaaggacctctattag

SEQ ID NO: 199064 - DNA, 1452 bp, Artificial Sequence
  Description of Artificial Sequence: Synthetic coding sequence
atgaagggcttcagcgagatgaccatggtggacaccgagatgcccttttggcctacaaatttcggcatttcctctgtggatctcagcgtgatggaggaccattcccattcgtttgacatcaagccatttaccaccgtcgacttcagtagcatctcaacgccccactatgaagacattcctttcacccgaaccgaccccgtggttgccgactacaagtatgacctgaaacttcaggaataccagagcgctattaaagtggaacccgcctcccccccctactactcagaaaaaacccagctatacaataagccccacgaagagccctccaatagtttgatggccatcgaatgccgcgtctgtggcgacaaagcctcgggattccattacggggtgcatgcatgtgagggttgtaagggcttctttagaaggacaatacggctgaagctgatttatgacaggtgcgacctgaactgtcggattcacaaaaaaagcaggaacaaatgccagtactgcaggttccaaaagtgtctggcagtcggcatgtcccataacgctatcagatttggaagaatgcctcaggctgagaaggaaaaactgctcgctgagattagctccgacattgaccagctcaaccccgaatcagccgatctgagagccctggcaaagcacctttatgactcgtacatcaagtcgttccctctgactaaagcaaaagctagagccattctgaccggcaaaaccaccgacaaatcaccgtttgtgatatacgatatgaacagtttaatgatgggcgaagataagattaagtttaaacacattacaccgctacaggaacagtctaaggaggttgctatacgcatcttccaggggtgccagttccgaagcgtggaagctgttcaggagatcacagaatatgcgaagagcattcctgggtttgtgaacctagaccttaatgaccaagtcaccctacttaagtacggtgtccacgagatcatatacacgatgttggcaagtctgatgaacaaggatggagttctcatctccgagggacagggcttcatgacacgcgaattccttaagagccttcggaaaccatttggcgacttcatggagcctaagttcgagtttgcagtaaaattcaatgccttagagctggatgacagcgacctcgccatattcatcgcggttataattctgtctggcgacagacctggactgctcaatgtcaagccaatagaggacattcaggataatctgctccaggcactcgaactgcagctcaagctgaaccaccctgagagcagccagttattcgccaagctgctacagaaaatgacagacctcaggcaaattgttacggaacatgtacagcttctgcaggtcatcaaaaagactgagactgatatgagtcttcaccccctgctgcaggagatttataaagacctttattag

SEQ ID NO: 199065 - DNA, 399 bp, Artificial Sequence
  Description of Artificial Sequence: Synthetic coding sequence
atgaccatggtggacaccgagatgcccttctggcccaccaacttcggaattagcagcgtagacttgtccgtgatggaggatcactctcattctttcgatattaaacccttcactacggtggacttcagctccatttccaccccacactacgaagatattccatttacacgtaccgatccggtggtggccgactataagtacgacttgaaactgcaagagtatcaaagcgcgattaaggtggagcccgcctcgcctccgtactattccgagaagacccagctgtacaacaaaccccatgaagagcctagcaatagcctgatggcgattgaatgcagggtatgcggcgacaaggcaagcggctttcactacggagtgcacgcctgcgaaggttgtaagtag

SEQ ID NO: 199066 - DNA, 300 bp, Artificial Sequence
  Description of Artificial Sequence: Synthetic coding sequence
atgaccatggtggacaccgagatgcccttctggcccaccaacttcggcattagctcagtcgatctctcagttatggaggaccacagtcacagctttgacattaaacccttcacaacagttgattttagcagtattagcactccgcactacgaggacataccgttcactagaaccgacccagtggtagctgactataagtacgatcttaaactacaggagtatcagtctgcgataaaagtagagccagctagccctccatattacagcgaaaagacacaactttataacaaacctcactag

SEQ ID NO: 199067 - DNA, 132 bp, Artificial Sequence
  Description of Artificial Sequence: Synthetic coding sequence
atgaccatggtggacaccgagatgcccttctggcccaccaacttcggcatcagcagcgttgatctgagcgtgatggaagaccactctcattctttcgacataaagccattcacaacagtggattttagctag

SEQ ID NO: 199068 - DNA, 747 bp, Artificial Sequence
  Description of Artificial Sequence: Synthetic coding sequence
atggtggacaccgagatgcccttctggcccaccaacttcggcatcagttcagttgatttgtcagtcatggaagaccactcccactcttttgacattaaaccattcaccacagtggactttagttccatttccacccctcattacgaggatattcctttcactaggaccgaccccgttgttgccgactacaaatacgacctgaaactccaggagtaccagtcggctataaaggtggaacctgcctcccctccatactatagcgagaagactcagctgtacaacaaaccacacgaagagccaagtaactctctaatggctatagaatgtcgcgtgtgtggagataaagcttccggatttcactatggtgtgcatgcgtgcgagggctgtaaagggtttttcaggcgaacaatcagactgaaattgatttacgaccggtgcgaccttaattgtcgcattcacaaaaagtctaggaacaaatgtcagtactgccggttccagaagtgcctcgctgtggggatgagccataatgccatccgtttcgggagaatgcctcaggcagagaaggaaaagttgttggctgaaatttcctcggacatagatcagctaaatcccgagtcagcagacctgagggctctggcaaagcacctttacgatagctatatcaaatccttcccactgaccaaggccaaggcccgggctatcctcacaggaaaaacaactgacaaatcgactgctcaggtgtgttag

SEQ ID NO: 199069 - DNA, 2955 bp, Artificial Sequence
  Description of Artificial Sequence: Synthetic coding sequence
atggccggcaacgactgcggcgccctgctggacgaggagctgagctcctttttcctcaactatctggccgatacgcagggcgggggatccggtgaagaacagctctacgctgacttccccgaattagacttgtcacaattggacgcctcagatttcgacagcgctacttgttttggggagttacagtggtgccctgaaaattccgagactgaaccgaaccaatacagtcccgatgatagcgaactttttcagattgacagtgagaacgaggcactccttgcagagctgacaaaaactcttgacgatatacccgaagatgacgtgggattggccgccttccctgcattggacgggggggatgccctgtcctgcacttccgcctcaccagcccctagttcagctcctccctcccccgctcctgagaagcccagtgcccccgcgccagaagtggacgaactgtctctggccgattccacacaagataaaaaggcacccatgatgcagagtcagtcgaggtcatgcaccgaactgcacaaacatctgacttctgctcagtgttgcctgcaggataggggattacagccaccatgtctgcagtccccaagattaccggccaaagaggataaagagcccggcgaggactgtccaagcccgcaacctgccccagcctcccctagggactctctggcattgggacgcgccgaccccggcgccccagtcagtcaggaagacatgcaggccatggtgcaactaatcaggtatatgcacacctactgtctgccacagaggaagcttccaccccaaacccctgaacctctgcctaaggcctgttcaaacccctcccagcaggtcaggtccaggccgtggtctcgtcaccattcaaaagccagttgggctgaattcagtatcctgagagagctcctggcccaggatgtattgtgcgacgtatctaagccctatcggctggcaaccccggtgtacgccagtctgactccaaggagccgcccacggcctccaaaagattcccaggccagccccgggcggccatcttccgtcgaggaagtgagaatagctgcatccccaaagtcaaccgggcctaggccttccctcagaccactgcggctcgaagtaaaacgggaggtccggcgcccagccagacttcagcaacaggaggaagaggatgaggaggaggaagaagaagaggaagaggaagagaaggaagaagaggaggaatggggacggaagcggcccggtcggggattgccttggactaaattgggccggaagcttgagtcgtccgtatgccccgtgcgccgaagccgccgcctgaatccagagctgggaccctggttgacatttgcggatgagccactcgtgccttcagaaccccagggtgccctgccctccctgtgtctcgcgcccaaggcctatgacgtcgagcgtgagctcggttcccccaccgacgaggactctgggcaggatcagcagctgctacgcggtccacagattcccgccttagagtccccttgcgagtccgggtgtggagacatggatgaggaccccagctgcccccagctgccgcccagggactcaccaagatgtctcatgctggccctgtcacaatctgaccccaccttcggaaagaaatccttcgaacagacattgacagtagaactgtgcggcactgctggcctaactccccccactacccccccctacaagcccactgaggaagacccctttaagcctgacatcaaacatagtctcggcaaagagatcgcactatccctcccttcacccgagggtctaagcctgaaggccacacctggcgctgcccataagctgcctaagaagcatccggagcgcagtgagctgctgagccatctgagacacgccaccgctcagccggcttcacaggccggacaaaagcgcccattctcctgttcctttggcgatcacgactattgtcaggtgctcagacctgagggcgtgttacagcgcaaggtccttaggtcatgggaaccctctggtgtgcacctagaggactggccacagcagggggcgccttgggcagaagcccaagcacccggccgagaggaagacaggtcctgcgatgctggcgcccctccgaaggatagcaccctgctgcgggaccacgaaatccgcgcatctctgaccaaacacttcgggctccttgaaacggcgcttgaggaggaagatctcgcttcttgtaaaagtccagaatacgacaccgtcttcgaagacagtagttcaagctccggcgaatcctcctttctccctgaagaggaggaggaagaaggggaagaggaggaagaagatgacgaagaggaggactccggtgtttcccccacgtgcagcgatcactgtccataccaatctcccccttccaaggccaatcggcagctgtgcagccgctccagatcgagctccggaagctcaccctgtcactcgtggtctcccgccactcgtaggaatttcagatgtgagtcacgcggaccatgtagcgaccggacacctagtattcggcacgcccgcaaaaggcgtgaaaaggccatcggggaaggacgggttgtttatatccagaacttgtcctctgacatgtccagtcgagaactaaaacgccgttttgaggtctttggggagatcgaggagtgtgaagtgttaacacgcaacagacgaggcgaaaagtatggctttataacttataggtgcagcgagcacgccgccctcagtctgacgaaaggagccgcattgcgaaagaggaacgagcctagtttccagctgagctatggcggactgagacatttttgctggcctcgttacaccgattacgattccaattcagaggaggcactccccgcaagtgggaaatcaaagtatgaggcgatggactttgatagcctactcaaggaagcccagcagagccttcattag

SEQ ID NO: 199070 - DNA, 2880 bp, Artificial Sequence
  Description of Artificial Sequence: Synthetic coding sequence
atgggcggcggcagcggcgaggagcagctgtacgccgacttccccgagctcgatttatctcagcttgatgcgtctgacttcgatagcgccacctgttttggcgagttacagtggtgcccggaaaattccgagacagaaccgaaccagtattccccggacgatagtgaactgtttcaaatcgatagtgagaatgaggcactcctcgccgaattgactaagacgttggatgacattcctgaggatgacgtgggacttgccgcattccctgccctcgacgggggagacgccctctcttgtactagcgccagtcctgccccctcatctgctcctccatccccggcgccagaaaagccatccgctcccgcacctgaagtcgatgaattgtcactcgctgactctacacaggataagaaggcacctatgatgcagtcacaatccagaagttgcaccgagctgcacaagcacctgaccagtgctcagtgttgccttcaagacaggggcctccagcctccgtgtctgcagagtccaagactcccagcaaaggaggataaggagcctggcgaggactgtccgagccctcagcctgcgccggccagtccgagggattcacttgcactagggcgcgcagatcccggggccccagtgagccaggaagatatgcaggccatggtgcagctcattcgttatatgcacacttactgtctcccccaacgcaagctgccgccccaaaccccagaacccctcccaaaggcctgtagcaatccgtcccagcaagtgcgctcgcgcccttggtcccgccaccactcaaaagcctcgtgggccgagttttcaatactgcgagagctcctggcccaggatgtgctgtgcgatgtaagcaagccctatcgtctagccactccagtctacgcttccctgacccccagatccagaccacgaccacctaaggactcacaggcctcacctggccggccatcatctgtggaggaggtcagaatagctgcatcccctaaaagcactgggccacgcccgagcttgagaccgcttcggctggaagtgaagagagaagtgcgcaggcctgcacgcctgcagcagcaggaagaagaggatgaggaggaagaggaagaagaagaagaggaggaaaaagaagaagaggaagagtggggtcgaaagagaccagggcgaggcctcccctggaccaagttgggccgcaagctcgagtcatcggtctgcccagtgaggcgcagcaggagactaaatccagagctcggcccctggctcacattcgccgacgaaccgctcgtaccaagcgagccacagggcgcactgcccagtctgtgtttggccccaaaagcttacgatgtcgagagagaactgggttcacctacagatgaagactccggacaagaccagcagttactcagggggccacagatacccgcgctagagtccccctgcgagagcggctgtggtgacatggacgaagatccaagttgtcctcagctacctcctcgggatagccccagatgtcttatgctcgcactctcccaatccgatcccacttttgggaaaaagtcctttgagcagaccctcaccgttgaactatgtggaaccgctgggcttactccgcccaccacacccccttacaaacctactgaagaggatcccttcaagccagacattaaacacagccttggaaaggaaatcgccttaagcttgccttcccccgagggtctttcactaaaggccactccgggcgccgcccacaagctgcccaagaaacaccccgagagatcggagttgctgtctcacctcaggcacgccactgcccaaccagcaagtcaggccggccagaagagacctttctcatgctcatttggggatcatgattactgtcaggttctgcgaccggagggagtgttgcagcggaaggtcctgagatcctgggagccatcgggtgtacacctagaagactggccccaacaaggggctccgtgggcggaagcacaggcccctggaagggaagaggacagaagctgtgatgcaggtgcgcccccaaaagattcaactctgttacgagatcatgagattcgggccagcctcaccaaacatttcggcttactggagacagcactagaggaggaggatctcgcgtcatgcaagagtcccgagtacgacaccgtttttgaggactcatcctcatctagcggcgagagttccttcctgcctgaagaagaagaagaggaaggcgaggaagaggaggaggatgacgaagaagaagattctggggtaagccctacctgtagcgatcattgcccctaccagagccctccgtcaaaagccaaccgccaattgtgcagcagatctcggtctagtagcggaagttccccatgtcactcttggagccccgcaacacgtcggaatttccggtgtgaatcgcggggcccctgcagtgatagaacaccttccatccgacacgcccgcaagaggcgtgagaaagccataggggaggggcgggttgtatatatccagaacctctccagtgatatgtcttctcgtgagttaaagcgtagattcgaagtgttcggcgagatcgaagaatgtgaggttctgactaggaaccgcaggggcgagaaatatggattcattacgtacaggtgctctgagcacgctgccctttcactgacaaagggcgcggccctcagaaagcgcaacgagccttcttttcaattaagctatgggggacttagacatttttgttggccccgctataccgattacgacagtaattctgaggaagccctccccgcctcagggaaatcaaagtatgaagccatggatttcgatagtcttcttaaagaggcccagcagtccctgcattag

SEQ ID NO: 199071 - DNA, 2397 bp, Artificial Sequence
  Description of Artificial Sequence: Synthetic coding sequence
atggcctgggacatgtgcaaccaggacagcgagagcgtgtggagcgacatcgagtgcgcagccctcgtcggggaggaccaacctctttgtccagatttacctgagttagacttgtctgagctggacgtcaatgaccttgataccgactcgttcttagggggacttaagtggtgtagtgatcagagcgagatcatttccaaccagtataataatgaaccatcgaacatatttgaaaaaatagacgaagaaaacgaggctaatttactggcagtgcttacagaaacactggacagtcttcctgtcgatgaggacggactgccttcttttgacgccttaacagacggtgatgtaacaaccgacaacgaagcgtccccaagctccatgcccgatggtacacctcctcctcaagaagccgaggagccttccctgcttaaaaagctacttttggctccagcaaacactcaactgtcttacaacgagtgcagcggattgtccactcagaatcacgcaaaccataatcatcgcatcagaactaacccagccattgtcaaaaccgaaaattcctggtctaacaaagccaagagcatctgtcagcagcagaaacctcagcgaagaccttgctccgaattgctgaagtatttgaccactaacgatgacccccctcatactaaacctaccgaaaaccggaactcctctcgcgataaatgcacgtctaagaagaaatcccacacacagtctcaaagccagcacctccaggccaagccaactacactaagtctacccctgaccccagagtccccaaacgatccaaagggtagtccgtttgagaacaagacaatcgaacgcacactcagcgtggaattaagcgggactgctggtcttacaccaccaacaacacctcctcataaagccaatcaggacaatccgtttagggctagccccaaactaaaaagctcttgtaaaaccgtagttcctcccccgtcaaagaagccgcgctacagtgaatcatcaggcacacaaggcaacaacagtaccaaaaagggtcccgagcagtcagaactctacgcacagctatcaaagagctccgtgttaaccggaggacacgaggagcgtaagaccaagcgtcctagcctccgcctcttcggggatcacgactattgtcagagtatcaattccaaaacggaaatcctgatcaatatttctcaggaattgcaggactctcgccagctggaaaataaggacgtctcctcagactggcagggacagatctgtagtagcaccgacagtgaccagtgttacctcagagagaccctggaggcctccaaacaggtgtctccctgttctacccgcaagcagctgcaggatcaggaaatcagggctgaactgaacaagcactttggccacccgagccaggccgtgttcgatgacgaggccgacaaaactggggaactgagagactccgatttcagtaacgaacagttcagtaagcttcccatgtttatcaactcaggtctcgccatggacggactgtttgatgattccgaagatgagtctgataaattatcttacccttgggatgggacccagtcctactccctctttaacgtgagccctagttgcagttcgtttaattccccctgtagagatagtgtgagcccccctaagtccctcttttcacagcgcccgcaaagaatgcggtcccgatcccggtctttctctcgtcataggtcctgcagtagaagcccttatagccggagcagatcaagaagccccgggtcccggagcagctcccggtcttgctattattatgagtctagtcactataggcatcgcactcatagaaatagccccctgtacgtcagaagccgcagccggtctccatactctcgccgtccccgctacgactcatatgaggagtaccagcacgaacgcctgaagcgggaagagtaccggcgagaatacgagaaaagggagagtgagcgtgccaaacagcgggagcggcaacggcagaaggcaatcgaggaaagacgggtgatttatgtaggaaaaatcagaccggatacaactaggacggagctgagggacaggttcgaggtgttcggtgagatcgaggagtgcaccgtgaatctgagagacgacggcgattcctatggttttattacttaccggtacacatgtgacgccttcgctgcgctggagaatggatacactctgcgcaggtcaaacgaaaccgacttcgaactgtatttctgcgggagaaaacagtttttcaagtcgaactacgccgaccttgattcaaacagtgatgacttcgaccccgcttccacaaagtctaaatatgattcattggacttcgactctctgcttaaagaggcacaacggtccctgcggaggtag

SEQ ID NO: 199072 - DNA, 3072 bp, Artificial Sequence
  Description of Artificial Sequence: Synthetic coding sequence
atggccggcaacgactgcggcgccctgctggacgaggagctgagctcattcttcctgaactatcttgctgacacccaggggggcgggtctggcgaggagcagctgtacgccgatttccccgaactggacctaagccagttggatgcaagcgattttgactcagctacatgctttggggagcttcagtggtgccccgagaattccgagacggagcctaatcagtactctcccgacgattccgagctctttcaaatcgattctgagaatgaggctctcctggcggagctcaccaagacccttgacgacatcccggaagacgatgtaggcctggctgcatttcctgcactggatggaggcgacgcccttagctgcacgtccgcatcacccgctccttccagcgcaccaccatcacccgcccccgaaaagccaagcgctcccgccccagaggtagacgagctgtcactactgcagaaactgctgttagcgacatcataccccaccagtagttcagacactcaaaaggaggggacagcttggaggcaagctggactaagatccaagtctcagcgtccatgtgtgaaggccgactcaactcaggacaagaaagcgcccatgatgcaaagccagtcccggagctgtaccgagctgcataaacacctaacatctgcacagtgctgtctacaggacaggggtctgcagcctccatgtctgcagagtccacgattgcctgccaaagaggataaggagccgggagaggactgtcccagtcctcagccggcgcctgcatcaccacgggattctcttgccctgggacgagccgatcccggcgccccggtctcccaggaggatatgcaagctatggtgcagctaattcgctacatgcatacttactgcctgccccagcggaagttgccgcctcagactcctgaacctctacctaaggcatgctctaatccaagccagcaggtgcgcagtcggccctggagtagacatcatagcaaggcgtcctgggccgaattcagcatacttcgagaattactcgctcaagatgtgctgtgcgatgtgagcaagccgtaccggttggctacacctgtatacgcgtctttaacaccccgaagtcgaccgcggccccctaaggattcccaagccagccctggacgaccctctagcgtggaagaagttcggatcgcagcgtctcccaagagcactgggccaagaccaagcttgcgccccctgagattggaagtcaagcgagaggtgagaagacccgccagactgcagcagcaagaggaggaagatgaggaagaggaggaagaggaagaagaagaggagaaagaggaggaggaggagtggggtcgcaagcggcctggccgtggcttgccgtggacgaaattaggccgaaaactggagtcaagcgtgtgtcccgtgcggcgttctaggagactgaatcccgagctcggaccttggttgacatttgctgatgaacctctcgtaccctccgagcctcagggagctctgccatcactatgcctggctcctaaggcttacgacgttgagagagaacttggctcccccaccgatgaagactcaggacaagaccagcagcttctgagagggccccagattcctgctctggaatccccctgtgaaagtggctgcggagacatggatgaggacccttcctgcccacagctgcctcctagagactctccgcgctgcctgatgctggctctgtcgcaatccgatccaactttcggaaaaaaaagctttgaacagacattgaccgtggagctgtgcggcacagccggcctaactcctcccacaacccctccctacaagccgaccgaggaagacccatttaaaccagatataaagcatagcctgggaaaagagatcgctttgtccctaccttctccggagggactctcgctcaaggccactcccggtgcggcccataagctacccaaaaagcatccggaaaggtccgaactgctgtctcacctgcgccacgcaacagctcagcccgcttcccaggcagggcagaaacgccctttctcctgctcctttggtgaccatgactactgccaggtgctgagacccgagggggtgctccagcgcaaagtgctgcgctcatgggaacctagcggagtgcaccttgaggattggcctcagcagggtgctccctgggcggaagcacaagctccgggaagagaagaagaccggtcatgcgatgcaggggcaccacctaaggattcaactctccttcgggaccatgaaattcgcgcctcactaacgaagcactttggactgctggagaccgccctggaggaagaggacctcgcctcatgtaagtccccggagtacgacactgtgttcgaagacagcagttcctcatccggtgagagtagctttctgcccgaggaagaagaggaggagggagaagaggaggaggaggacgacgaggaagaagattctggagtatccccaacttgctccgatcactgtccataccagagtcctcccagcaaagccaacaggcaactctgcagcagaagtaggagttcgagcgggagttctccttgccattcctggagcccagccactcgccggaacttcagatgtgaaagcagaggcccgtgttctgacagaacaccttcaattcgacatgcccgcaaaagacgggaaaaggctataggagagggacgcgtcgtgtacatccagaatctcagtagtgatatgagctcgcgtgagctgaagcggagatttgaagtatttggagaaattgaggagtgtgaagtgctgaccaggaaccgaaggggcgagaaatacggtttcatcacttacaggtgctctgagcacgccgccctgagtctcacaaagggcgcggctctccgaaaaaggaacgagcctagttttcagttgagctacggcgggctgagacatttctgttggccacggtatacggactacgacagcaattcagaggaagcgctccccgccagcgggaaaagcaaatacgaagccatggatttcgattcattgttgaaagaggcgcagcagagcttgcactag

SEQ ID NO: 199073 - DNA, 3054 bp, Artificial Sequence
  Description of Artificial Sequence: Synthetic coding sequence
atggccggcaacgactgcggcgccctgctggacgaggagctgagcagcttttttctaaactatcttgccgatacacagggagggggaagtggtgaggaacagttgtatgccgatttcccagagttagacctcagccaacttgacgccagtgacttcgactcagctacctgcttcggggaacttcaatggtgcccagagaactcggagactgagccaaatcagtacagccccgacgacagcgagctgttccagatcgattctgagaatgaggccctcttggcagaactgaccaagacactggatgatattccagaggacgacgttggcttagctgcattccccgccttggatgggggcgacgccctgtcttgcaccagcgcttcaccggctccgtcttcagcaccaccatcgccagctcctgagaagcccagcgctccagctccagaggtagatgaactctccctgctccagaaattattgctggctacaagctatccaacttcaagttctgatacccagaaagaaggcaccgcttggagacaagccggattgcggtccaaaagtcagcgaccatgcgtgaaggctgatagcacccaggacaaaaaggcacccatgatgcagtctcagtctaggagctgtaccgaactgcataaacacctgacgagtgcccagtgttgtttacaggaccgcggtcttcagccgccttgcctgcaaagccccagactgccggccaaggaagacaaggagccgggcgaggactgcccctccccccagccggcccccgcctcccctagggatagcctagccctcgggagagctgatccaggcgctccagtgagtcaggaggatatgcaagctatggtgcagctcataaggtacatgcacacatactgtctgccccagaggaagctccccccccagaccccggaacccctccccaaagcgtgctctaacccttctcaacaagtccgatcaaggccttggagccggcatcactccaaggcctcatgggcggaattctccattcttcgggagctactggcccaggatgtcttgtgcgacgtgagtaaaccctacagactcgcgactcctgtctatgcaagcctgacccctaggtctcggccaaggccccccaaggactcccaggcatcaccaggcagacctagttcagttgaagaggtgcgaattgctgctagtccgaagagcaccgggcctcgaccatccctccgtcctctaagactggaggtgaagcgcgaggtgcggaggccagctagacttcaacaacaggaagaggaggacgaagaagaagaggaagaggaggaagaagaagagaaggaggaggaggaggagtgggggcggaagagacccggccgaggtctcccctggaccaagctggggaggaaactggagtcaagcgtttgcccggtaaggcggagcagaagactgaatccggaacttggtccttggttaacctttgcggatgagcctttagtaccaagcgaaccccagggagcattaccttcactgtgccttgcccccaaagcctacgatgtggagcgtgagctgggctctcccaccgacgaagacagcggccaggatcagcagctgctccgtggtcctcaaataccagcactagagagtccatgtgaatctggatgtggagacatggacgaggaccctagttgcccacagctcccccctagagatagtcccaggtgtctgatgctcgcactgtcccagtcagacccaacattcggaaagaagagcttcgagcagactctaaccgtggagttgtgcgggaccgctggactaaccccccccactaccccgccctacaagcccactgaggaagaccctttcaagcccgatataaagcattccttggggaaggaaatcgctctgagtctaccaagccctgagggcttgtcattgaaggcaacgcctggtgcagcccacaaactccccaagaaacaccccgagaggtctgagttactgtcacatctccggcacgctacagctcagcccgcttcccaggctgggcagaagcgaccattttcctgtagcttcggcgaccacgactattgtcaggtgctcaggcccgaaggcgtgctccagaggaaggtgctccgatcgtgggagccaagtggcgtccatctggaagattggccgcagcagggggcaccgtgggccgaggcccaggcacccggccgcgaagaggacaggtcatgcgatgctggcgccccacctaaggactcaactttgctccgagatcatgagatacgtgcatctttgactaagcactttgggcttctcgaaacagctttggaagaagaggatctggctagctgtaagagccccgagtacgacaccgtgttcgaagatagttccagctcaagcggggagtcttcctttctgcccgaggaggaagaagaagaaggggaggaggaagaagaagacgatgaagaggaggattctggtgtctcacctacctgtagcgatcattgtccctatcagtccccaccaagcaaagccaatagacagttgtgctcgcgcagccggagcagttcggggagctcaccgtgccactcctggtcccccgctacgcgaagaaacttccggtgtgagtccagaggaccctgcagcgacagaaccccctctatccgccacgctcgtaagagacgggagaaagctatcggtgagggaagggtcgtgtacatccagaatctgtcttccgatatgtcttcacgtgagctgaagaggcggttcgaggtgtttggggaaattgaggaatgcgaagttctgacaagaaaccgtcggggcgagaaatacggctttatcacataccggtgttccgaacacgcagcactatccctgaccaagggtgccgcattgagaaagagaaatgaaccaagctttcagctcagctacgggggccttcggcacttttgttggcctcgttatacagactatggaaaacctctgaagccttcccattcactagtcagactgaaagcctgggaggcggtgcctagtctgaataagactcagtcttag

SEQ ID NO: 199074 - DNA, 471 bp, Artificial Sequence
  Description of Artificial Sequence: Synthetic coding sequence
atggccgtgggcaagttcctgctgggcagcctgctgctgctgagccttcaactcggtcaggggtgggggcccgatgcccgaggcgtcccagtggccgacggcgaattcagctcagaacaggtcgctaaggctggcgggacttggctgggtacacatagaccactggcacgtttgcgtcgggctttatcagggccttgtcagctgtggtcattgacattgagtgttgcagagttgggcctcgggtacgcttccgaagaaaaagttattttcaggtattgtgccggatcctgccccaggggagcgagaactcagcatggcttggccctggcgaggctgcaaggccaggggagggcgcatggagggccctgttgccggcccaccagatatacagacgtggcatttttggatgacaggcatcgatggcagagactgccacagctctctgcagctgcttgcggatgcggggggtag

SEQ ID NO: 199075 - DNA, 1422 bp, Artificial Sequence
  Description of Artificial Sequence: Synthetic coding sequence
atgggccagagcggccggagccggcaccagaagcgggcccgggcccaagcacagttgcgcaacctggaagcatacgcagccaatcctcattcgttcgtgtttacccgcgggtgcacaggcaggaacatccgccagctctcgctggacgttcgacgcgtcatggagcccctgacggcctccaggctgcaggtccggaaaaagaatagcctgaaggattgcgtcgcggtagcaggcccgttgggtgtgacacacttcctgatcttgagcaagaccgagacgaatgtttacttcaaactgatgaggctgccagggggacccaccctcacctttcaagtgaagaagtactctttggtgcgcgatgtagtgtcaagcctgcggcggcaccgaatgcacgagcagcaatttgcccacccacctctgttggtgcttaactcttttggaccccacggcatgcacgtcaagctaatggcaactatgttccaaaacctctttccaagtatcaacgttcacaaggtcaacctaaacactataaaaaggtgtttgctgatcgactataaccccgattcgcaggaactcgactttcgtcactacagcattaaagtagtccccgtgggtgcgagtcgtggaatgaagaagcttctacaggaaaaatttccaaatatgagtcgtctgcaggatatcagcgaactgctggctaccggcgccggcttatctgagagcgaggccgagcctgatggcgatcataacatcacagaacttccacaggctgttgctgggcgcggtaacatgcgcgctcagcagtccgcagtgcggttgacggagatcggcccccggatgaccctgcagctgatcaaagttcaggaaggggtgggcgaagggaaggtaatgttccatagctttgtttcaaagacagaagaagaactgcaggccattctcgaagccaaggaaaagaagctgaggctgaaggcacagcgccaagcccaacaggcccagaacgttcagcgaaagcaggagcagcgtgaggcacaccgcaagaaatccctggaagggatgaagaaggcacgcgttggaggctccgatgaagaagccagcggcatcccatcaaggaccgcttcgttggagctcggcgaagacgacgacgaacaggaggatgacgatattgagtatttctgccaggcagtcggcgaggccccaagtgaggacttattcccagaggcaaagcagaagagactcgccaaaagcccgggacgcaaacggaaacggtgggagatggatagaggaagagggagactgtgtgatcagaagtttcccaagactaaggacaagtctcaaggggcacaggcgcggcgggggcccagaggcgcgagccgggatgggggccgcggtcgcgggaggggccggcccgggaagcgcgtcgcatag

SEQ ID NO: 199076 - DNA, 1383 bp, Artificial Sequence
  Description of Artificial Sequence: Synthetic coding sequence
atgggccagagcggccggagccggcaccagaagcgggcccgggcccaagcccagctacgaaacttggaagcctacgctgctaatccacactcattcgtgttcacccgcggctgcaccggcaggaacattcggcagctctcccttgatgtacgaagagtcatggaacccctgacggcgagtcgactgcaggtgcgtaaaaaaaactcccttaaggactgcgtcgctgtggctggcccactcggcgtcacccacttcctgatcttgtctaaaactgagacgaatgtctacttcaaactgatgcgcctgccaggaggacccactttgacatttcaggttaaaaagtatagcctggtacgtgacgtggtcagttctttacgacgtcaccgcatgcacgagcaacaatttgcgcaccctccattactagtgctgaacagtttcggtcctcacggtatgcatgtgaaactaatggcaaccatgttccaaaatctgtttccctctatcaatgtccataaagttaacctcaacaccattaaacgctgtttgctgattgattataacccagattcacaggagttagattttcgccattatagcatcaaggtggtaccagtaggcgcaagccgaggcatgaaaaaactccttcaggagaaatttccaaatatgagcagactccaagacatatcagaactactggctaccggagcaggattatccgaatcagaggccgaacctgatggggatcacaatatcactgagttgccccaggccgtggcagggagaggcaatatgagagcccagcaatctgctgtcaggctcacagaaataggtccgagaatgacgcttcagcttattaaggtgcaggagggcgtcggcgagggaaaagtgatgttccacagttttgtgagcaaaacagaggaagaactgcaggccattctggaggcgaaggagaaaaagctgaggctgaaggctcaaaggcaggctcaacaggcgcagaacgtacagcggaagcaggaacaaagggaggctcatagaaaaaaatccctggagggaatgaagaaagccagggtgggcggttccgacgaagaggccagcggcatcccatcccggacagcctctctggaattgggagaagatgacgatgaacaggaggacgatgacatagaatacttctgtcaggctgtcggagaggcaccctctgaggacctttttccagaggcaaaacagaagagactggctaagtcccctggacggaagcgaaagaggtgggaaatggatcgaggtaggggtcgcctgtgtgaccagaagttccccaagaccaaggacaagtcccaagacggaggacgaggccgcggaagaggcaggccgggtaaaagagtagcttag

SEQ ID NO: 199077 - DNA, 2385 bp, Artificial Sequence
  Description of Artificial Sequence: Synthetic coding sequence
atgggccagagcggccggagccggcaccagaagcgggcccgggcccaggcacagcttcggaatttggaggcctatgcagccaacccccactccttcgtgttcacaagaggatgcactggcaggaatatccggcagttgtcacttgatgtgcgcagagtgatggagcctctgactgccagccgccttcaggtgcggaaaaaaaacagtttaaaggattgcgtggcggtggctggacctctgggcgtgacccatttccttattctatccaagacagaaaccaatgtgtattttaagttgatgaggctgcctggaggccctacgctcactttccaggttaagaaatacagtctggtgcgggatgttgtttctagtcttaggagacaccgcatgcatgagcaacaatttgcacacccccccttattggtcctgaactcctttggtccacatgggatgcacgtgaagctgatggcaacaatgtttcagaacctgtttccatcaatcaatgtacataaagtgaacctcaacaccataaaacggtgcctgctgattgattataatccagactctcaggaactggactttagacactactcaataaaggtggtgcctgtgggggcttcacggggaatgaagaaactgctccaggagaagttcccgaatatgtcgcgactccaggacattagcgagctgctggctacaggggctggcttgagtgagtctgaagccgagccagatggcgaccacaatattaccgaattgccccaagcggttgccggccggggcaacatgagggcccagcagtccgctgtgcgactgactgagattggcccccgcatgactttacagctgattaaggtgcaggaaggagtgggcgagggcaaagtaatgtttcactccttcgtgtcaaagacagaggaagaattgcaggcaattctggaagccaaagagaagaaattgaggcttaaggcccaacgccaggcccagcaggcacaaaacgtccagcgaaagcaggaacagcgtgaggctcatcggaagaaaagcttggaaggtatgaagaaagcaagggtgggcggatcagatgaggaggcctccggcattccctcacggacggcaagcttggagctgggtgaagacgatgatgagcaggaagacgacgacatcgagtacttttgccaggcggtgggggaggctcctagtgaagacctatttcctgaggccaagcaaaagcggctcgccaagtctcctggacgtaaaaggaagaggtgggagatggatcgaggagccaagagctgtccagccaactttcttgctgccgcagacgataagctatctgggtttcagggcgacttcctgtggcccatactggtggtggagtttctggtagccgtggccagtaacggcctagccctgtacagattctctattcgcaaacaaagaccatggcacccagctgtggttttctcggtccagctcgctgtcagtgacctcctctgtgcactcacactgccacctctggccgcatatctatatccccctaaacattggagatatggagaggccgcgtgcaggctggaacggttcctgtttacctgtaatctcttgggctccgttatcttcattacttgtatatccctaaaccgatacttggggatcgttcaccctttcttcgcacgcagtcacttgcggcctaagcatgcctgggcagtatctgccgcaggctgggtcctcgccgccttacttgcaatgcccactctatcattttctcatctcaaacgcccccaacagggcgcaggcaattgcagtgtagcccgccccgaggcttgcatcaagtgtctggggaccgccgatcacggcctcgccgcgtaccgagcctactctctggtcctcgccggcctgggatgtggactccccctgttactgacactggccgcctatggtgctctaggccgagccgttctgcggagtcctggaatgacagtggcggagaagcttagagttgcggcgctagtggcctccggcgtcgccctctacgccagtagctatgtcccgtaccacataatgcgcgtgctgaatgtggacgcgagacgccggtggagcaccaggtgccccagtttcgctgatattgcacaggccaccgctgccctggagctggggccatatgttggttatcaggtgatgcgaggtctcatgccattggccttctgtgtgcatccattattatacatggctgcagttccgtccctgggctgctgttgtcgacactgtcccgggtatcgggattcctggaatccagaggatgccaagtccacgggccaggcactgcccctcaatgctacagccgcaccgaaaccctccgagccacaaagtagagaactgtcacagtag

SEQ ID NO: 199078 - DNA, 1374 bp, Artificial Sequence
  Description of Artificial Sequence: Synthetic coding sequence
atggcccagcccccccggctgagccggagcggcgccagcagcctgtgggaccccgcctcccccgcccccacttctggcccccggccacgactatgggaggggcaagacgtgctggccagatggaccgatggattgttatacttgggcaccatcaaaaaggtggactcggcacgcgaggtgtgcttggtgcaatttgaagatgatagtcaattcctcgtgctgtggaaagacattagccccgctgcgttgcccggagaagagctgttatgctgtgtgtgccgaagtgagacagttgttccgggtaataggctggtttcctgcgaaaaatgtagacatgcttatcaccaggactgccatgtgcctcgcgccccagctcccggggagggagagggcacttcctgggtatgcaggcagtgtgtttttgctatcgctactaagcgaggcggggccctcaagaagggcccatatgccagagccatgctcggcatgaagctgtccctaccttatggactgaaaggcctagattgggatgcaggacaccttagcaatcggcagcagtcttactgttattgtggaggtcctggcgagtggaatctcaagatgctccaatgtagaagctgtctgcaatggttccacgaggcttgcacccagtgtctttcaaagcctttactgtacggcgaccggttctacgaatttgagtgctgtgtgtgccggggagggcccgagaaggtgagacgcctccagctgagatgggtggacgtggcccacctcgtgctgtatcacctctcagtgtgctgcaaaaagaagtatttcgactttgatagagaaatcctgccattcacatcagagaattgggacagcctgctgcttggggagctctccgataccccaaagggtgaacgaagctcaaggttgcttagcgctttaaactcacataaggacagattcatttctgggcgagaaatcaagaagaggaaatgcttattcggtctgcacgccaggatgccccccccagttgaaccaccaaccggggatggtgccctgacaagagccggcccatggggccgggggctaacatcacccggagaggcacccgaggctggggcccgagcccccgaggaggaagccgagggcgaaagtgggggagccggggccactctgtcctccgcgcagagcgcccgagcacctggcgccgagggggcaggttcttctgccgaaggcacagcagcagcccctagcggatgcctcctgcctagcacgctgctgcccgcccctcagggccccctcgggacagtggacccgcagactggacatccgtggaacttcactcttgtatcaccccagaccagccttaaggttccccccacccgctag

SEQ ID NO: 199079 - DNA, 1704 bp, Artificial Sequence
  Description of Artificial Sequence: Synthetic coding sequence
atggcccagcccccccggctgagccggagcggcgccagcagcctgtgggatcccgcttctcccgccccaacctcaggacctcggcctaggttgtgggagggccaggatgtgctggccagatggaccgacggactgctctacctcggtaccatcaagaaggttgacagcgctcgcgaggtctgtctcgttcagttcgaggacgactcacagtttctggtactgtggaaagacatatctcccgccgccctgccgggagaggagcttctctgctgtgtgtgcaggagcgagacagtggtgccaggaaacaggctcgttagctgcgagaagtgcaggcacgcgtatcaccaggattgccatgtcccacgcgctcccgcaccaggggaaggagaaggtacctcctgggtctgtaggcagtgcgtatttgccatcgccacaaaacgtggaggcgcacttaagaagggcccttacgcgagagccatgcttggtatgaaacttagtctgccttatggtttgaagggactggattgggatgccgggcatctctcaaacagacagcaatcttactgttattgtggaggcccgggagagtggaacctcaagatgctgcaatgtagaagctgcctccaatggttccacgaggcgtgtacccaatgcctctccaaaccactgctatacggcgacagattctacgagtttgaatgctgtgtatgccggggtggaccagagaaggtcaggcggctgcagctgcgctgggtggatgtggcgcacctggtcctgtatcacttgagcgtgtgctgtaagaagaagtactttgactttgatagggagatcctccccttcacgtcggaaaattgggactccctgctgctcggcgagttatccgacactccgaaaggtgagcgttcgtccaggctcctgagcgccctgaactcacacaaggatcggttcatatctgggagagaaatcaagaagaggaagtgtctgttcggactgcatgcacggatgcctccccccgtggagcctcccaccggagacggggccctaacgagcttccctagtggccagggaccaggcggaggagtgtcgagacccctgggaaagcggaggcggccagagccagagcccctccggcgccgacagaagggaaaggttgaggaattgggccctccctctgccgtgcgcaaccagcctgagccacaggagcagcgggagagagcgcatctacagcgggctctgcaggccagcgtgtcacccccgagcccttcccccaaccagtcctaccagggctcttctggatataactttcggcctacagacgcaagatgtttgccctcgtctccaatcagaatgttcgccagcttccatccatcagcaagcacagccgggacatctggggatagcggtcctccagatagaagcccactggagctccacattgggttcccaaccgatataccaaaaagtgcacctcacagtatgacagccagttcctcctccgtgtcgtctccttcgccaggcctgcccagacgcagtgcaccccctagcccactgtgcagatccctcagcccaggaaccgggggcggcgtgcggggcggcgttgggtatctctctagaggcgaccctgtgagagttttggcccgcagggtccgccccgacggtagcgtacagtacctcgtggaatggggaggcggcgggattttctag

SEQ ID NO: 199080 - DNA, 732 bp, Artificial Sequence
  Description of Artificial Sequence: Synthetic coding sequence
tgaagcctgctgctgaccgccacccggaccgtgagcttccagggcgagcgccttaggcggggaaacgtgtgtctcgtgtctatgctcggatgcctacctctctggtcaccactgctggagatggagcattcacccggccaggggcccgggggtggggtatctaggcccctgggcaagcgccgccgtccagagccagagcccctgaggcggcgccagaaaggaaaagtcgaggagcttggccccccttcagccgtccgaaatcagccagagccacaggaacagcgggagagggcgcacttgcagagggccctgcaggccagtgtcagtcctccctcacccagccctaaccaatcctatcagggttcttccggttataattttcgcccgacagacgcgagatgccttccaagcccaatccggatgtttgcctccttccaccccagcgcttccacagcagggacctctggtgatagcggtccccccgatcgatccccgctagaactgcacatagggttcccgacagatatccccaagagtgcaccccacagcatgaccgcctcatcatcatctgtttcctcccctagccccggtctgccacgacggagtgctcccccatcaccactatgccggagtctgtcacccggaacaggcggaggcgtgcgagggggagtcggctacctgtcacggggcgacccagtgcgcgtcctcgcgcgcagagtccgacccgattag

SEQ ID NO: 199081 - DNA, 438 bp, Artificial Sequence
  Description of Artificial Sequence: Synthetic coding sequence
atggcccagcccccccggctgagccggagcggcgccagcagcctgtgggatcctgcttcccccgcaccgacatctgggccccggcctcggctgtgggagggacaggatgtactggcacggtggaccgatgggctcctgtacctgggcacgatcaaaaaagtggactccgcccgggaagtttgtctggtgcaatttgaggatgatagccagtttcttgtgctgtggaaggatatcagccctgccgcccttcctggggaggaactgctgtgctgcgtttgtcgtagcgagaccgtggttccaggtaaccgattggtgagctgcgagaagtgccgccacgcttatcaccaggattgccacgttcctagagcaccggctccgggtgagggcgagggaaccagctgggtctgccgccagtgtgtattcgcaatcgccacctag

SEQ ID NO: 199082 - DNA, 546 bp, Artificial Sequence
  Description of Artificial Sequence: Synthetic coding sequence
tggggccacccccagcagtgcgccatcagccccagcccccggagccggggatcgggccttatctgtcgtgggcactgtagacctcaatgcctgcaccaccctccagcgcttacaagggtgactagggctgctgccgccactacaagcgggccccagatgccagccgcctgccctggacatccaatccgcatgttcgcctcttttcatccctccgcctcaacagccgggacttccggtgatagtggtcctcctgacaggtccccactggagttgcatatcggctttcccacagacatccccaagtctgcaccccactctatgaccgcctcctcctcttctgtgtcaagtccgtccccaggactgccacgtcgatcggccccaccaagtcccctgtgcaggtccttgtcaccaggaacaggtggaggggttcgaggaggtgtgggttacctctctcgtggcgacccggtacgcgttttggccaggcgggttcggcccgacggctccgtgcagtatcttgtggaatggggtggcggcgggatcttttag

SEQ ID NO: 199083 - DNA, 438 bp, Artificial Sequence
  Description of Artificial Sequence: Synthetic coding sequence
atggcccagcccccccggctgagccggagcggcgccagcagcctgtgggaccccgccagccccgcccctacttcaggtcccaggcctaggctgtgggaaggccaggatgtgctggctcgctggaccgatgggctgttgtatctgggtactattaagaaggttgattcagcgagggaggtttgcctggtacagttcgaagacgatagtcagtttctggtactttggaaagatatttccccagccgcactgcctggcgaagaactgctgtgttgtgtgtgcagaagcgagacagtggtacccgggaatcggttagtttcctgtgagaagtgtagacacgcttatcaccaggactgtcacgtgccccgcgccccagccccgggcgagggtgagggtactagctgggtgtgccgtcagtgtgtttttgcgatagccacttag

SEQ ID NO: 199084 - DNA, 1704 bp, Artificial Sequence
  Description of Artificial Sequence: Synthetic coding sequence
atggcccagcccccccggctgagccggagcggcgccagcagcctgtgggatcccgcgtcgcctgcaccaacgagtggcccccgccccagactctgggaagggcaggatgtattggcccgatggacggatgggcttctgtacctgggcacaattaaaaaggtagattccgcaagggaggtgtgcttagtgcagttcgaagacgatagtcagttcttggttttgtggaaggacatttccccagctgcgctgcccggagaggaacttctgtgttgcgtgtgcagaagcgaaacggtagtgccaggcaacagactggtgagttgcgagaaatgccgacacgcctaccaccaagattgccatgtgccacgcgcacctgcacctggcgagggagagggaacaagttgggtctgtaggcagtgcgtattcgcaattgccactaagcgggggggagccttaaaaaaaggcccttatgccagagcgatgcttggaatgaagctgtcactcccttacgggctaaagggactggactgggatgctggccatctgtctaacagacagcagtcctactgctactgtggcggccccggtgagtggaacctcaaaatgcttcagtgccgcagctgccttcagtggttccatgaagcgtgtacccagtgcctgagcaagcctctcttgtatggcgacaggttctatgaatttgaatgttgcgtgtgtcgaggaggccctgagaaggtgaggaggctacagctgaggtgggtcgacgtagcacacctagtactgtaccatctgagcgtttgctgcaagaagaaatattttgattttgaccgggagatcctcccgtttacgagcgagaattgggactctttactactgggagagctctctgacacccctaaaggtgaacgatccagtaaacttctgtcggccttgaacagtcataaggacagattcatatctggccgggaaattaagaaaaggaagtgtctcttcggcttacatgcaaggatgcctccacctgttgaaccccctaccggcgatggcgcacttacgagctttccatcgggacaaggccccgggggcggtgtgtctcggccgctcggtaagcggaggagacccgagcccgaacccctccgacgaagacagaagggcaaagtggaggaactggggcctcctagtgcagtgcgcaaccagccggaaccacaggaacagcgggaaagagcacacctgcagcgtgccttacaggcctcggtgtcacctcctagtccgtccccaaaccaatcttatcagggatctagcggttacaattttcgacccacagacgccaggtgcctgccctcctcgcctatcagaatgttcgccagcttccatccctctgcatcgactgcaggaacaagtggagacagtgggccgcctgacaggtcccccctggagctccatatcgggtttcctaccgacatccccaaatctgctcctcattccatgacggcttcttcttcatccgtcagcagcccatctcctggcctgccacggcggtccgctcccccaagcccgctatgcagaagcctttcacccggcactggaggaggcgtgcgcggaggcgtaggctacctcagtagaggtgatcctgtgcgggtcttagcacgacgggtcagacccgatgggtctgtccagtatttggtagaatggggaggcgggggaattttttag

SEQ ID NO: 199085 - DNA, 684 bp, Artificial Sequence
  Description of Artificial Sequence: Synthetic coding sequence
atggcccagcccccccggctgagccggagcggcgccagcagcctgtgggaccccgcatcccctgctccaacctctgggccccgtcccaggttgtgggaaggccaggatgtgctggcacgctggaccgacggcctgctgtacctgggaactattaaaaaagtcgatagcgcccgagaagtctgtctcgttcagttcgaggacgactctcagtttcttgttctgtggaaggacatctcacccgccgccctgcctggtgaagaattactttgttgtgtgtgcagaagtgagaccgtggtgcccggcaaccgcctggtgtcctgtgaaaaatgtcggcatgcgtatcaccaagactgtcatgtccccagggcgccggcaccaggagaaggcgagggaacgagctgggtctgccgccagtgtgtgttcgcaatagctaccaagaggggtggggcgctcaagaaagggccctatgctcgggccatgctagggatgaagctgtctttgccctatggcctcaagggcctggattgggacgccgggcacttatcaaacaggcaacaatcatactgttattgcggaggcccgggtgagtggaaccttaagatgttacaatgtcgttcatgcctccagtggttccatgaggcctgcacacagtgcctgagcaagcccctcctgtatggcgattag

SEQ ID NO: 199086 - DNA, 684 bp, Artificial Sequence
  Description of Artificial Sequence: Synthetic coding sequence
atggcccagcccccccggctgagccggagcggcgccagcagcctgtgggaccctgccagcccagcaccaactagcgggccacgcccacggctgtgggagggacaggatgttctggcccggtggacagacggcttgctgtacctcggcactatcaagaaggtggatagcgcgcgagaagtctgtctggtacagttcgaggatgactcacagttcctggttttgtggaaagacatttccccagccgctttgcccggagaggaacttctgtgctgtgtctgtagaagcgagaccgtcgtgcccggtaacagactggtcagctgcgaaaagtgccgccacgcttaccaccaagattgccatgtgccacgggctccggcccctggggaaggagaaggcacctcttgggtctgccgacagtgcgtgttcgccatcgcgactaagcggggcggcgccctgaagaaaggcccctatgcgagagcaatgctaggcatgaaattgtcattgccgtacggacttaaagggttagattgggatgcaggtcacctctccaacagacagcagtcatactgctactgcggtgggcccggggaatggaatttgaagatgctgcagtgtcgctcttgccttcagtggttccacgaagcctgtacacagtgcttgtccaaacccctcctctacggagactag

SEQ ID NO: 199087 - DNA, 1374 bp, Artificial Sequence
  Description of Artificial Sequence: Synthetic coding sequence
atggcccagcccccccggctgagccggagcggcgccagcagcctgtgggatcccgccagtccggcgcccacatccggtccccggcctaggctttgggagggtcaggacgtgttggccaggtggaccgacgggctgttgtacctggggaccatcaagaaagtagactctgcccgggaagtgtgtctcgttcagttcgaagacgattctcagttccttgtgctttggaaggatatctcgcctgctgccctccctggagaagagcttttatgttgcgtatgtcggtccgagactgttgtgccaggtaatcggctcgtatcctgcgagaagtgtcggcacgcttaccaccaggattgccacgtccctcgggcccctgcgcctggggagggagaagggacttcttgggtatgcagacagtgtgtgttcgcgatcgccaccaaacgagggggcgcgctgaaaaagggtccctatgcgcgagctatgctggggatgaagctgtcactgccctatgggttaaagggattggactgggatgcaggacacctctccaataggcagcagtcatattgttattgtgggggcccgggcgagtggaacttaaaaatgctgcagtgccgtagctgcctgcaatggtttcacgaggcttgcacccagtgtttgagtaagcccctgttgtatggagacaggttttacgaatttgagtgctgtgtgtgcagaggtggcccagagaaggtacggcgactgcagctccggtgggtggatgtggcccacctggtgctctatcatctatctgtgtgttgtaaaaaaaagtattttgacttcgatcgagaaatccttccgttcacctctgagaactgggattcattactgttgggcgaactttctgacacacccaaaggcgagagaagcagcaagttgctgtcagctctgaactcacataaagacaggttcatcagcggcagagagattaaaaagaggaaatgtctttttggactgcatgccagaatgcctccacctgtggaaccgccaaccggagacggagccctcacaagagccggaccctgggggcggggactgacatccccaggagaagcgcccgaggccggagcacgggctccagaggaagaagcagagggagaaagcggcggcgcaggggcaactctgtcctctgcccagagtgctagagcacctggcgctgaaggtgctgggagtagcgctgaagggactgcggccgcaccctctggctgcctgctaccttcgaccctcctgcccgctccacagggaccgctcggaacagttgatccccagactgggcatccctggaatttcacgctggtgtccccgcagacgtccctcaaagttcctccaaccaggtag

SEQ ID NO: 199088 - DNA, 1497 bp, Artificial Sequence
  Description of Artificial Sequence: Synthetic coding sequence
atggccgccgccgccggccccggcgccgccctgagcccccggccctgcgatagtgatcccgcaacccctggcgcccagagccctaaggacgacaatgaagataattccaatgacgggactcaacctagcaaacggcggagaatggggagcggggacagtagtcgctcatgtgagacctctagccaagaccttggcttctcctactatcctgcagaaaacttaatcgagtataagtggcctcccgatgaaacaggtgagtattatatgctgcaagaacaagtttccgaatatctcggcgtgacatcgtttaaaaggaaatatccagatctggagcggcgagatctgagtcacaaggagaagttgtaccttcgggaactcaatgttatcaccgagacacaatgcactctgggcttgaccgctctgaggtccgatgaggtcatcgacctcatgatcaaagaatatcctgcgaagcatgccgaatattccgtgattcttcaggagaaggaaagacagcggatcaccgaccattataaggagtactcccagatgcagcagcagaatacacagaaggttgaggcctcaaaggtcccagagtacatcaaaaaggccgcaaaaaaggctgccgagttcaatagcaacctgaaccgagaacggatggaggagcgtcgggcatacttcgatctacaaacacatgtgatacaggtgccccaaggcaagtataaggtactccctaccgagcgcacaaaagtttctagctacccagtcgctttgattccagggcagtttcaggaatactataaacgctatagccctgacgagctaagatatctcccccttaataccgcgctctacgagccccccctggacccggagctgcccgcgctcgactccgacggtgactcagacgatggagaagacgggcgaggagacgagaagaggaaaaacaaaggcacttctgattccagtagtgggaacgtcagcgagggggaaagtccccccgacagccaggaagattcatttcagggcaggcagaagagtaaggacaaggctgcaactccccggaaggacgggcccaaacgctctgtcctgagcaagtccgtgcctggatataaaccaaaagttatccccaacgctatctgtggaatctgcctgaagggaaaagagtcaaacaaaaagggcaaggctgaaagcctaatccactgcagtcagtgtgaaaacagcggccaccccagttgcctcgacatgacaatggagcttgtctcaatgatcaagacatatccctggcagtgtatggaatgtaagacttgtatcatttgtggccagcctcaccatgaggaagaaatgatgttttgtgacatgtgcgataggggctaccatacattctgcgtgggcctcggagcaattcccagtggtcgatggatttgcgactgctgtcagcgggccccacccaccccaagaaaggttggccggaggggcaagaacagcaaagagggatag

SEQ ID NO: 199089 - DNA, 1491 bp, Artificial Sequence
  Description of Artificial Sequence: Synthetic coding sequence
atggccgccgccgccggccccggcgccgccctgagcccccggccctgcgatagtgatcctgctacccctggggcccaatcccctaaggacgacaatgaagacaattccaacgatggcacccagccctctaagcggcgaagaatgggcagcggcgattcctccaggagctgcgagacgagctctcaggacctgggcttttcttactacccagcagagaacctgatcgaatataaatggccccctgatgaaactggcgagtattacatgctgcaggaacaagtctcagagtatctgggcgtaacgagctttaagcggaagtatcctgaaaggagggatctaagtcataaagaaaagctataccttagggagctgaatgtcattactgagacccagtgcactcttggcctgactgcactgcgttctgatgaggtcatcgaccttatgataaaagaataccctgccaagcacgcagaatacagcgtcattctccaggaaaaagaacgacaaaggataacagaccattataaggaatattcccagatgcagcagcagaatactcagaaggtggaagcctcaaaagtgcctgagtatattaagaaagccgccaaaaaggccgctgagtttaacagtaatctcaacagggaaagaatggaggaaagacgggcttactttgaccttcagacgcatgtcatccaagtcccccaggggaagtacaaggttcttcctactgagcggacgaaggtgtctagttacccagtcgcactcatccctggccaattccaagaatactataagaggtacagtccagacgagcttcggtacctgccactcaacaccgctctgtacgagccccccctagatccagaattaccagcgctggactccgatggcgattccgacgatggtgaggacgggaggggcgatgagaagagaaaaaacaaagggaccagtgactctagctctgggaacgtaagtgagggagaatcccctccagacagccaggaggattcctttcagggacgtcagaaatcaaaagataaggcggctactcctaggaaggatgggcccaaacggtctgtgctgagcaaatctgtgcccggttacaaaccaaaggtgattccaaatgcgatctgcggtatctgcctcaagggcaaagaatcaaacaagaagggcaaagccgaatcattgatacactgttcgcagtgcgaaaattcgggacatccttcatgtctggacatgaccatggagttggtatcgatgatcaagacatacccctggcaatgcatggaatgtaagacatgcattatctgcgggcaacctcaccacgaggaggaaatgatgttctgtgacatgtgtgacaggggctatcacaccttctgcgttggacttggagcaatcccatccgggcgatggatatgcgattgttgtcagcgcgcgccacctactccgcgcaaggtggggcgacggggcaaaaattctaaggagggctag

SEQ ID NO: 199090 - DNA, 879 bp, Artificial Sequence
  Description of Artificial Sequence: Synthetic coding sequence
atggagaagcggacctgcgccctgtgccccaaggacgtggagtacaatgtgctctacttcgcacagtcagagaatatcgccgcccatgagaactgtctcctgtatagctctggactggttgagtgcgaggaccaggacccattgaacccagatcgttcattcgatgtcgaatccgtaaagaaggagattcagaggggcagaaagctgaaatgcaagttctgtcataagcgcggcgcaacagtcggatgcgacttgaagaactgtaacaagaattatcatttcttctgcgctaaaaaagacgacgcggtgcctcagtctgacggggttcgcggaatctacaaactgttatgtcaacaacacgcgcaatttcccattatcgcccaatccgccaaattctccggcgttaaaaggaagcggggccgaaagaaacccttgagcggcaaccacgttcaaccgcctgaaactatgaagtgtaacactttcattcgccaggtcaaggaggagcatggtagacataccgatgctacagtgaaagtcccatttctcaaaaagtgtaaagaagcagggctactcaactatctcctggaggaaatcctggacaaggtacactccatcccagagaagttgatggacgagaccacttccgaatcggattatgaagaaattggctcagcccttttcgattgtagactattcgaggatacgttcgtgaatttccaggctgcaatcgaaaagaagatccacgcaagtcagcagaggtggcagcagctcaaagaggaaatagagctgctgcaagaccttaagcagacactatgcagctttcaagagaacagggatttaatgagctcatctacttcgattagctccctcagctactag

SEQ ID NO: 199091 - DNA, 996 bp, Artificial Sequence
  Description of Artificial Sequence: Synthetic coding sequence
atggcccaggccagccccccccggcccgagcgggtgctgggcgcctcctctccagaggcgaggcccgcccaggaggccttgctactgcctaccggcgtttttcaggtggccgagaagatggaaaagcgcacgtgcgctctttgtcccaaagacgtagaatacaacgtcctgtattttgcacagagcgagaatattgccgctcatgaaaactgcttactgtactcctcgggcctggtggagtgtgaggatcaggatccactgaaccccgatcggagcttcgacgtggagtcagttaaaaaagagattcagagagggcgaaaactcaagtgtaagttttgtcacaaacggggggctacggtcggctgtgatctcaagaattgtaacaaaaattaccatttcttttgcgcaaagaaagatgatgctgtgccgcagagcgatggcgtccgtggaatttacaagctcttgtgtcaacagcacgcacagtttcccataatcgcccagtctgccaaatttagcggcgtgaaaagaaagcgcgggaggaagaaacctctctctggaaaccacgtgcaacctcccgagacaatgaagtgtaacaccttcattagacaggtcaaggaagaacatggtaggcatacagacgccactgtaaaggtgccctttctgaaaaaatgtaaggaagctggccttctgaactaccttctggaggagatcttagataaagtccactccattcccgaaaaactgatggacgagactacgtctgaatcagactacgaggaaattggtagcgccctctttgattgcaggctcttcgaagacacattcgtaaactttcaagcggctatcgagaagaaaatccacgcttcccagcaacgttggcagcaactgaaagaagagatcgaattgctgcaggatctgaagcagaccctgtgcagtttccaagagaatagagacctcatgtcgagctcaacaagcatatcctctctcagctactag

SEQ ID NO: 199092 - DNA, 861 bp, Artificial Sequence
  Description of Artificial Sequence: Synthetic coding sequence
tgacggcccggcccccggggctgcagcgcccccgccgcccggcggccagggcccaggcgacgccggtcgagctttccccccttgtactcctccggtctggtggagtgtgaggaccaggaccctctcaaccccgaccggtctttcgatgttgaatcagttaagaaggagatccaacgagggcgaaagctgaagtgcaagttttgccacaagcggggagcgacagtaggttgtgatttgaaaaactgcaacaaaaattatcactttttctgcgctaaaaaagacgacgcggtgccacagtcggacggtgtcagagggatctataagctcctgtgtcagcaacacgcacagttccccatcattgcccagagtgccaaattctccggggtgaagcggaagaggggaaggaaaaaacctctttctgggaaccatgtgcagcccccggaaaccatgaagtgtaatacttttatccgccaggtcaaggaagaacacggaagacacacagacgccacagtcaaggtgcccttcttgaaaaagtgcaaagaggctggattgttaaactaccttctcgaggagatattagataaggtccactccatcccagagaaacttatggacgagactactagcgaatccgactacgaagagatcggcagcgccttgttcgactgccgcttatttgaagatacctttgtaaatttccaggccgccattgaaaaaaagattcacgccagccagcagcgatggcagcagttaaaggaagagatcgaacttttacaggatctgaagcagacactgtgctcctttcaagagaacagggacctaatgtcttcctccacctcaatcagtagcctatcgtactag

SEQ ID NO: 199093 - DNA, 507 bp, Artificial Sequence
  Description of Artificial Sequence: Synthetic coding sequence
atggagaagcggacctgcgccctgtgccccaaggacgtggagtacaacgtgttatacttcgcgcagtctgaaaacatcgccgctcacgaaaactgtttgctgtattctagcggccttgtggaatgcgaggaccaggaccccctcaatcccgatcggtccttcgatgtcgaaagcgtgaaaaaggagatccagcgggggaggaagctcaaatgtaagttctgccacaagagaggcgccacggtgggctgcgaccttaagaactgcaacaaaaattaccacttcttttgcgccaagaaggatgacgctgttccacaaagcgatggcgtgaggggaatatacaagctgctatgtcagcagcacgctcaatttccgataattgcacagtcggcaaaattttcgggcgtgaaaagaaagcgcggcagaaaaaagccgctgtctggcaatcacgtgcaaccaccagagaccatgaagtgtaacacgtttatcagacaggtgaaggaagagtag

SEQ ID NO: 199094 - DNA, 297 bp, Artificial Sequence
  Description of Artificial Sequence: Synthetic coding sequence
atggagaagcggacctgcgccctgtgccccaaggacgtggagtacaacgtgctgtatttcgcccaatccgagaacattgccgcccacgagaattgtctgctgtactccagtggcctggtggaatgtgaggaccaggaccccctcaatccagatcggtccttcgacgtggagtcagtgaagaaggagatccagagaggcaggaagctcaagtgcaagttttgccataaacgcggagctacagtgggctgtgacttgaagaattgtaacaagaattatcattttttctgcgcaaagtag

SEQ ID NO: 199095 - DNA, 879 bp, Artificial Sequence
  Description of Artificial Sequence: Synthetic coding sequence
atggagaagcggacctgcgccctgtgccccaaggacgtggagtacaatgtgttgtacttcgctcagtctgagaacatcgcagcgcacgagaactgcttgctgtacagttctggactggttgaatgcgaggatcaggacccactcaatccagatcgcagcttcgacgtagagagtgtgaagaaggagatccaacgaggaaggaaactcaaatgtaaattctgtcataagcgaggagctaccgtggggtgcgacctcaagaattgtaataagaattaccatttcttttgtgcaaagaaggacgacgccgttccacagtcagacggagttagaggcatatataaactcttatgccaacagcacgcccaatttccaatcatcgcccagagcgctaagttttccggcgtaaaaagaaagagggggaggaaaaaaccactcagtgggaaccacgtacagccgccagagaccatgaagtgcaacactttcatacgacaggttaaagaagaacatggacggcatactgacgccacagtcaaagttcctttcctcaaaaagtgcaaggaggcaggtcttctcaactacctgctggaagagatcctggataaggtgcacagcattccagagaaactgatggacgagacaacgtcagaatctgattatgaggagatcggctcagctctgtttgattgtagattgttcgaggatacattcgtgaactttcaagctgccatagagaaaaagatacatgccagccaacagaggtggcagcaactcaaggaagaaatcgagctgctccaagacctgaaacaaactctctgttcctttcaggagaaccgtgatctcatgtcgtcctcaacttccatatcgagcctgagttactag

SEQ ID NO: 199096 - DNA, 624 bp, Artificial Sequence
  Description of Artificial Sequence: Synthetic coding sequence
atggagaaccgggccctggaccccggcacccgggacagctacggcgcgacttctcacctacctaataaaggcgcgctggcgaaggtgaagaataattttaaggaccttatgagcaagttaacagagggtcaatacgttctgtgtagatggacagatggtctttattatctcggtaagattaagcgagtaagtagtagcaaacaatcttgcctggtcaccttcgaagataattcgaagtactgggtactttggaaggacattcaacacgctggcgtgccaggtgaagaacccaaatgtaacatctgcctgggaaaaacatctggccccttgaacgaaattctcatctgcgggaagtgcggcctgggctaccaccagcagtgccatatacctatcgctggttctgctgaccagccactgctgactccctggttctgccggcgctgtattttcgcactggctgtgcgtgtttctctgcctagttcccctgtgcccgcctcccccgcctcaagctctggcgccgatcagagactgccatctcaatctctatcaagcaaacagaagggccatacctgggccctggagaccgactcagcatctgccacggtcctaggccaggacctgtag

SEQ ID NO: 199097 - DNA, 1743 bp, Artificial Sequence
  Description of Artificial Sequence: Synthetic coding sequence
atggagaaccgggccctggaccccggcacccgggacagctacggcgccacaagtcaccttcctaacaagggcgccttggctaaagtcaagaacaacttcaaagaccttatgtccaagctcacggagggccagtatgtgttatgccgttggaccgacggcttatactacctcggcaaaatcaaacgggtgtcttccagcaagcaatcatgcttggttacgttcgaagacaactccaaatactgggttctttggaaggacattcagcacgcgggggtgccaggggaggagcccaagtgcaatatctgcctgggcaagacatccggacctctcaatgaaatcctgatttgtggcaagtgcggtttaggataccaccagcagtgccacattcccattgcaggaagtgccgaccagccattacttaccccttggttctgtcggcgctgtatatttgccctggcagtgaggaaaggtggcgccctcaagaagggcgctatagccaggactctgcaggctgtgaagatggtcctgagctatcagccggaggagctagagtgggactcgccacatcgtaccaaccagcagcagtgttactgctactgcggcggcccgggggagtggtacctcagaatgcttcagtgttacaggtgtcgtcagtggttccatgaggcgtgtacccaatgcttgaacgaacctatgatgtttggcgaccgattttatttgttcttttgctcagtgtgtaatcaggggccagagtacatcgagaggctgcccctcagatgggtggacgtggtacatctggctctttacaacctaggggtgcaatctaagaaaaaatactttgacttcgaggagatactagccttcgtcaaccaccactgggaactgctccagctagggaaactgacgagcacccccgttacagatagggggccacatctgttgaacgccctcaactcctacaagtcccgattcctgtgtggcaaggagatcaagaaaaagaaatgtatcttcagactccggattagagtaccacccaatcctcctggcaaactcctccccgacaaaggcctgctgcctaatgagaatagcgcctcgtcagaactgcggaaacgcggcaaatccaagccggggctcctaccccacgagtttcagcagcagaagcgcagagtctaccgaagaaagagatcaaagtttctgcttgaggatgcaatcccaagtagtgatttcacatctgcctggagcacgaaccatcacttagcgtctattttcgacttcacgctcgatgagattcagtcactgaagagtgcaagctccggacagacattcttttccgatgtggattcaaccgatgcagccagtacaagtgggtccgccagcacgagcctgtcctatgactctaggtggaccgtgggctcacgcaagcgaaagctggccgccaaggcgtatatgcctctcagggcaaagcgctgggccgctgagctcgatggtagatgccccagcgattctagcgcggagggggcctccgtccctgagcgtcccgacgagggcatagattcacacacttttgagagcatttccgaggacgattccagcctgagccacctcaagagctcaataacaaattacttcggcgctgctggacgccttgcatgtggagaaaaataccaggtactggctagaagagtgacgccagaggggaaggttcagtatttagtcgagtgggagggcaccactccctactag

SEQ ID NO: 199098 - DNA, 1116 bp, Artificial Sequence
  Description of Artificial Sequence: Synthetic coding sequence
atgctgcagtgctaccggtgccggcagtggttccacgaggcctgcactcagtgtcttaacgagcccatgatgttcggtgatcgtttctacttgtttttttgcagtgtgtgtaatcagggtcctgagtacattgaaaggttgcccctgcggtgggtagatgtggtgcacctcgctctgtacaacctgggggtgcagagtaaaaaaaagtacttcgattttgaggaaatcctggcgtttgtgaaccaccattgggagctgcttcagctcggaaagttgacctcgacacccgttacagacaggggccctcacttgcttaacgctctcaatagttacaagagcaggtttctgtgcgggaaggaaatcaaaaaaaagaaatgtatctttaggctgcgtatccgtgtgccccctaatccacccggtaagttgcttcctgataagggcctcctccccaacgaaaacagcgcaagttcagagctgcgaaagaggggcaagagcaaacccggtcttctcccccatgagtttcagcaacaaaagagaagagtgtataggcggaagcgctctaaatttctgctggaggacgccatacctagctcagacttcaccagcgcctggtcaaccaatcatcacctcgctagtatctttgattttacacttgacgagattcaatccttgaagtccgcctcctctggccagaccttctttagcgacgtagattcaaccgatgctgcgtctacctctggctccgcttcaaccagcttgagttacgatagccgttggaccgtcggtagtcgcaagagaaaacttgccgcaaaggcttatatgccccttagggccaagcgatgggcagcagagctcgacggccggtgtccttccgacagctccgccgagggtgcctccgtaccggaaaggcctgacgaagggattgattcccatacgtttgagtctatatccgaagatgactcatcactgtctcaccttaaatcttcaattaccaactacttcggagcagccggtcgactggcatgcggagaaaagtaccaggtactagcacgccgagtcacaccagaaggtaaagtgcaatacctcgtcgagtgggagggaaccacgccctattag

SEQ ID NO: 199099 - DNA, 501 bp, Artificial Sequence
  Description of Artificial Sequence: Synthetic coding sequence
atggagaaccgggccctggaccccggcacccgggacagctacggcgccaccagccatctgccgaacaaaggggccctcgccaaggtcaagaataattttaaggatttgatgagtaagttgactgaaggccagtacgtgctctgtcggtggacggatggattgtattacctcggaaagatcaagcgtgtctcttcttctaagcaatcatgcctcgtgacctttgaggacaatagtaagtactgggtgctctggaaagacatccagcatgccggcgtcccgggggaagagcccaagtgcaatatttgtctggggaagaccagtggcccactgaatgaaattctgatatgtggcaaatgtgggctcggctaccatcagcaatgtcatattcccatcgccggaagcgctgaccagcctctgcttactccgtggttctgccgaagatgtatatttgccctagccgttcggaagggcggggcactaaagaagggtgcaatcgcctag

SEQ ID NO: 199100 - DNA, 324 bp, Artificial Sequence
  Description of Artificial Sequence: Synthetic coding sequence
atggagaaccgggccctggaccccggcacccgggacagctacggcgccactagccacctaccaaacaaaggcgcactggccaaagtgaaaaacaacttcaaggacctcatgtcaaagctgaccgagggacagtacgttctctgtcgctggacagatggactgtattatcttggtaaaataaagcgtgtctcttcaagcaagcaatcctgcctagtcaccttcgaggacaatagtaagtactgggtactgtggaaagacatacaacacgctggggtacccggggaagagccaaaatgcaacatatgtttaggtaagacatcctag

SEQ ID NO: 199101 - DNA, 1692 bp, Artificial Sequence
  Description of Artificial Sequence: Synthetic coding sequence
atggagaaccgggccctggaccccggcacccgggacagctacggcgccacctcccatttgcctaacaaaggggccctggctaaagttaagaataatttcaaagatctgatgagtaaactcactgagggacagtacgtgctttgcaggtggaccgatggcttgtattatctggggaaaataaaacgggtgtccagcagcaaacagtcatgtctggtgacatttgaggacaatagtaaatattgggtgctctggaaggatattcagcacgcgggagtgcctggggaggagccgaaatgtaatatttgtctgggcaagacatctggcccgctgaacgagatcttaatttgcgggaaatgtggattgggctaccatcagcagtgtcacatacccatcgctggatccgctgaccagccactgcttactccctggttctgtcgaagatgcatttttgctctggccgtgcggaagggcggagctttaaaaaagggagctattgcgagaaccctccaggccgtgaagatggttctcagctatcagccagaggaactggagtgggactccccccatcgcacgaaccagcaacagtgctactgctactgcggagggccaggcgagtggtatctgcgcatgcttcagtgctatcgatgtcgccagtggtttcacgaggcctgtacacagtgccttaatgagccaatgatgttcggggaccgcttttatctgtttttctgtagtgtctgcaatcaagggcctgagtatatcgagcggctgcccctgcgctgggtagatgtggttcacctggctttgtacaatcttggagtgcaatctaagaagaagtattttgactttgaggaaatcctggctttcgtgaaccaccattgggagctgcttcagttgggtaagttgactagcactccagtgacagatcgtgggccacatctgctgaacgccttgaattcctataagtcaaggtttttgtgcggaaaagagattaagaaaaaaaagtgcatattcaggcttcgcatcagggtgccccccaatccgccaggaaaactcctcccggataagggtcttctgccgaacgaaaatagtgctagcagtgaattgcgcaaacggggtaagtctaaacctggactcctgccccatgaatttcaacagcagaaaaggcgagtgtatcggcgaaagcgcagtaaattcctgttagaggatgctatcccttcttcagatttcacgtctgcgtggtcgaccaatcatcacctggcctcaatcttcgactttacactcgatgagatccaatcgctcaaaagcgcgagcagtggccaaacattcttctctgacgtggattcaactgatgccgcttcaactagtgggagcgcatccacaagtttgtcctatgacagtaggtggaccgtggggagccgtaagcgaaaacttgccgccaaggcatacatgcctttgcgggcaaagaggtgggcggcggaactggatggtaggtgtccctcggactcctccgccgaaggtgcctccgtgcccgaacgccccgacgaaggaatcgactcccacacattcgaatctatcagcgaggacgatagctccctatcacatcttaaatcatccattacgaattacttcggtgccgccggtcgcctcgcctggggggaagtgcccggagtgggatctgagggccacacttag

SEQ ID NO: 199102 - DNA, 3291 bp, Artificial Sequence
  Description of Artificial Sequence: Synthetic coding sequence
atggccaccgtgcccgtgtactgcgtgtgccggctgccctacgacgttacacgttttatgatagaatgcgatgcgtgtaaggattggtttcacgggtcctgcgtgggcgtggaagaggaggaggctccagacattgatatttatcactgtcccaactgtgagaaaacacacggaaaaagcaccctgaagaagaagcgaacctggcacaaacatggacctgggcaggcccccgacgtcaaacctgtccagaacggaagccagttattcataaaagaactgagaagtagaacctttccctcagcagaagatgttgtggcacgcgtccccggaagccagctcacactcggatacatggaagagcacggctttactgaaccaattttggtgcctaagaaggacggcttaggtctcgctgtgcccgcacctacgttttatgtttccgatgtggagaactacgtgggccctgagaggagcgtggacgtcactgacgtgacgaagcagaaggattgcaaaatgaagctaaaagaattcgtggattactactattcgactaataggaagcgtgtgctcaacgtcacgaatctggaattcagcgataccaggatgtcctcttttgtcgaaccgcctgatatcgtgaaaaagttgagctgggtggaaaattattggcctgatgatgcactgttagccaagcccaaagttacaaaatattgtctgatctgtgttaaagactcatacaccgatttccatatagatagcgggggggccagcgcctggtatcatgtgctgaagggcgaaaagacattctacctcattagacccgcttccgctaacatcagcctgtacgaacggtggcgaagcgcatctaatcacagcgagatgttctttgcggaccaagtagataagtgttacaagtgtatcgtgaagcaggggcagactttgttcatccctagtggctggatctacgctaccttaacaccggttgactgtttggcattcgccggccatttcttgcattcattgtctgtggaaatgcagatgcgggcatacgaagtggaacggaggctcaagctcgggtctcttacccaattccccaattttgagaccgcttgttggtacatgggaaaacacctattagaggcttttaaagggagccacaagagcgggaagcaactgccaccacatctggttcagggcgcgaaaatcctaaacggggccttccgtagttggacaaagaaacaagcactggcggaacacgaagacgaactgcctgagcacttcaagccttcacaactgatcaaagatcttgcaaaggagatcaggttatcggagaatgccagtaaagccgtgcgacctgaggtcaacacagtcgcttcaagtgatgaggtctgcgatggggaccgcgaaaaggaagaacccccctcgcccatcgaagcgaccccaccacagtccctcctcgaaaaggtcagtaaaaaaaagactcccaagaccgtgaaaatgccaaaacctagcaagattccaaaacctcctaagccaccgaagccccctcgaccccctaagactctgaaacttaaagatggcggtaaaaagaaggggaaaaaatctcgcgagagcgcaagtcccaccattccgaaccttgatctcttggaggcccataccaaggaggcactgaccaaaatggagccacccaaaaagggcaaagccaccaagtcagtcctctcagtgcctaacaaagacgtggttcacatgcagaatgacgtcgaaaggttggagatacgtgagcagaccaaatcaaaatccgaggctaagtggaagtataaaaattccaaaccagattcactgttgaaaatggaggaggagcaaaagctcgaaaagtcgcctcttgcaggtaataaggacaataaattcagctttagtttctccaacaagaagcttctgggtagcaaggcgttgcggccccctaccagcccgggtgtgttcggggcccttcagaattttaaagaagataagccaaaacccgtccgggacgagtatgagtatgttagcgacgatggggagctcaaaattgacgagtttccaattaggagaaaaaaaaatgcgccaaagcgtgatttatcctttctcctagataagaaggctgtcctacctaccccggtcactaaacccaagctggattcggctgcctataagtcagacgacagtagcgacgaaggttcccttcacatcgatacggacactaagcccgggcgcaatgctcgagtgaagaaagaaagcgggagctccgcggccgggattcttgacctactccaggctagcgaggaagtgggcgccctggaatataacccatcttctcagcctcctgcctctcctagtacccaggaggcgatccagggaatgttgtccatggccaatctgcaggccagtgattcatgcctacagaccacttggggcgcaggccaagcgaagggatcttctctggcggcacacggggctcgtaaaaatggtggcggaagtgggaaatcggccgggaaacgtctgcttaagagagcagcgaagaacagtgttgacctcgatgactatgaagaggaacaggaccacctcgacgcatgctttaaggacagcgactacgtgtacccttctcttgaaagtgacgaggataatccaatttttaaatccagaagcaagaaaaggaaaggatccgacgacgctccctatagtcccactgcccgggtgggaccctcggtgccccggcaagatagacccgtcagggaggggaccagggttgccagtatcgaaactgggctcgctgctgccgcagctaaattatcccagcaggaggagcagaagtcaaaaaaaaaaaaatctgcaaaacgaaaacttacacctaataccacatccccttctactagcaccagtatatctgcaggaaccacatctacatcaacgacaccagcttctacgacacccgccagtacaacccccgcctcaacaagcaccgcatcttcccaagcttcacaggaaggatcgtcacccgagcctcctcctgaaagtcacagcagttccctggcagaccacgaatatacggccgcagggacttttacgggcgcccaggctggtcgaacttcgcagcccatggcccccggagtcttccttacacagcggaggccatcggcttctagccccaacaacaatacagctgcaaagggcaaacgaactaagaagggtatggctaccgccaagcagagactaggtaaaatcctcaagatacacagaaacggcaaattattgttgtag

SEQ ID NO: 199103 - DNA, 984 bp, Artificial Sequence
  Description of Artificial Sequence: Synthetic coding sequence
atggccaccgtgcccgtgtactgcgtgtgccggctgccctacgacgtgacgagattcatgattgagtgcgacgcgtgcaaggactggttccatgggagctgcgtgggcgtggaggaagaagaagccccagacattgacatttatcactgtccgaattgcgaaaaaactcacggaaagtccactttaaaaaagaaacgcacctggcataaacacggccctgggcaggcaccagacgttaaaccaaagaacagtgtagatttggacgattacgaagaggaacaggaccacctggatgcctgctttaaggattctgactatgtctatccgtccctcgaatccgacgaagataacccaattttcaagagccgatctaagaaacgcaaagggtctgacgatgcgccgtactctccgacagcccgggttgggccgtctgtccctcggcaggaccggccagtgcgtgaaggaactcgcgtagcctccatcgaaaccggcctagctgcagccgccgccaagctgtcccagcaggaggaacagaaatctaaaaagaagaaaagtgctaagaggaagcttactcccaacaccacctccccttcgacaagcacctcaatatccgcgggcacaacctccacaagcaccacaccggcctctactactcccgcttcaactactccggcctctacctccacagcatcttcgcaggcatcccaggagggcagttctccggagcccccccctgagtcgcattcctccagccttgcagatcacgaatataccgcagctggtaccttcaccggggcgcaggcaggcaggacctcccagcccatggcgcccggggtcttcctaacacagagacggccctccgccagcagcccaaataataatacagccgccaagggcaaaagaacaaagaagggcatggctaccgccaaacagcgactggggaagattctcaaaattcatagaaacgggaagctcctgttgtag

SEQ ID NO: 199104 - DNA, 2046 bp, Artificial Sequence
  Description of Artificial Sequence: Synthetic coding sequence
atggagctgcagaccctgcaggaggccctgaaggtggagatccaggtgcaccagaaactggttgcccaaatgaagcaggaccctcagaatgcggaccttaagaagcaactgcatgagttacaggccaagattacagccctgagcgagaagcagaaacgcgttgtggaacagctaaggaagaaccttatcgttaaacaggaacagccagacaagtttcagattcaacccctacctcaatcagagaacaagctccagaccgcacagcagcagcctcttcagcagctgcagcagcagcagcagtaccaccaccatcacgcacagcagtcagcggccgcgtctcctaacctgactgcctctcagaagactgtgactaccgcttctatgatcaccacgaaaaccctgcccctggttctgaaagcggccacggccacgatgcccgcgtctgtcgtcggtcagcgcccaacaatcgccatggtcaccgcaattaacagtcagaaagcagtattgagtactgacgtgcagaacacccccgtgaacctgcagacctcttcaaaagtcaccggccccggcgccgaggctgttcagatcgttgcaaagaatacggtgacacttcaggtgcaggcgacaccgccacaaccaatcaaagttcctcagttcattccccctcctcgacttaccccccggccaaattttctgccccaagttcggcccaaaccggttgcacagaataatattccaattgcacccgctcccccccccatgctggccgccccgcaactcattcaaaggcctgtgatgctgaccaagtttactcccacaacgctgccgacctctcagaactcaatccaccccgtgcgggttgtgaatggccaaacagccacgattgccaagacgttccctatggcccagctcacctccatagttatagccaccccaggcactagactggccggcccacagacagttcagctctctaaacctagtctggagaagcagacagtgaagtcacatactgagactgacgagaagcaaactgaatctagaacaattacccctccggctgcgcccaaacccaaacgggaggaaaatcctcagaaactggcatttatggtgtctctcggtcttgtcactcatgaccacttggaggaaatccagtcaaagcgacaggagcggaaacgacgaacaaccgcgaacccagtgtattcaggtgccgtgtttgaacccgagaggaagaagagtgccgtgacttatctaaactctaccatgcacccaggaaccagaaagagaggtcgcccccctaaatacaacgctgttctgggattcggtgccctaacccccacctccccccagtccagtcacccagatagcccggagaacgaaaaaacagaaacaacctttacatttccagcccctgtgcaacctgtctcgctgccctccccaacgtcaacagacggcgatatccatgaggacttttgctccgtctgtagaaagagtggccaactcctgatgtgcgatacatgtagtcgggtgtaccacctcgactgcctggatccccctttaaagacgatccctaagggcatgtggatctgccccagatgccaagatcagatgctcaagaaagaggaggccattccatggccagggaccttagccattgtgcactcctacatcgcttacaaagctgctaaagaggaagaaaagcagaaactcctgaagtggagttctgatttgaaacaggaacgcgaacaattggagcagaaggtcaaacagctgtccaactctatcagcaaatgtatggaaatgaagaacactatcctggccagacagaaagagatgcactcttccttggagaaggtgaagcagctgatacggctaattcacgggatcgatctgagcaaacctgtggacagcgaagctactgtcggcgctatcagcaatgggcctgactgcaccccccctgctaacgccgcaacctctactcctgcaccctctccatcctctcaatcctgcacggccaattgcaaccagggagaggagaccaagtag

SEQ ID NO: 199105 - DNA, 1905 bp, Artificial Sequence
  Description of Artificial Sequence: Synthetic coding sequence
atggagctgcagaccctgcaggaggccctgaaggtggagatccaggtccatcagaagctggttgctcaaatgaaacaggacccccagaatgccgacctgaagaagcagctgcatgaactccaagctaagattacggctctcagcgagaagcagaagcgagtggttgagcagcttcgtaaaaatcttatcgtcaagcaagaacagccggataagttccagatacaaccgctgcctcagtccgagaacaagctccaaacagctcagcagcaaccgttgcagcagctgcagcagcagcagcagtaccaccaccaccacgctcagcaaagcgcggccgcaagtcctaatctaaccgcaagtcagaagacggtcaccaccgcgtccatgatcaccaccaaaacattgcccttggtgttgaaggcggcaaccgccactatgccggcaagcgtggtggggcaaagacccactattgctatggttacggccatcaactcccagaaggccgtcctgagcaccgacgtacagaatacacctgtcaacctacagacatccagtaaagttacaggtccaggtgctgaggccgtgcagatcgtggcaaaaaacaccgtaacgctgcaggtacaggccactcccccccagcctataaaagtaccccagttcatcccccctcctagattaacaccaaggcccaatttcctcccccaggtgagaccgaagcccgtggcccagaacaatataccaatagcccctgcacccccacccatgttggccgctccacaattgattcagagacctgtgatgctcacaaagtttacaccaactaccctaccaacttctcagaatagcatccatcccgtgagagttgtaaacgggcagacagccacaatcgctaaaactttccccatggctcaactcacctccatcgtgattgcgacccccggaacccgcctggccggaccacagaccgtccaacttagcaagccttcccttgaaaaacaaactgtgaagagccacacagagacggatgagaagcagaccgagagccgtactattactccgcctgctgcacctaagccaaagcgggaagagaatccacagaaactagcctttatggtgtcattagggctggttacccacgaccatctggaagagattcagtctaagaggcaagaacggaagagacgaactacagctaatcccgtgtactctggtgctgtgtttgaaccagaacggaaaaaaagcgccgtgacgtaccttaactcaactatgcaccccggtacccgcaagagagcgaacgaggagcattggcctaagggggacatccatgaggatttttgtagcgtgtgtcgtaagagtggtcagttgctgatgtgcgatacctgttccagagtctatcatttggactgcctggatccccctctcaagaccatccccaagggcatgtggatctgccccaggtgtcaagaccagatgttaaagaaagaggaggccatcccctggccaggcacgctggcaattgtacactcctacattgcttacaaggctgccaaagaagaagaaaaacaaaagcttctgaagtggtccagcgacttgaagcaggagagggagcaactggagcagaaggtcaagcaactgtctaattcaatctccaaatgtatggagatgaagaacactattcttgcgagacaaaaagagatgcattccagtctcgaaaaggtcaagcaattgataaggttgatccatggaatagatctttccaaacctgtggattctgaggctaccgtcggcgccatcagcaatgggcccgactgcacccccccagctaatgccgcaactagcacacctgccccctccccatccagccagtcttgtaccgcgaactgcaaccagggagaggaaaccaaatag

SEQ ID NO: 199106 - DNA, 2043 bp, Artificial Sequence
  Description of Artificial Sequence: Synthetic coding sequence
atggagctgcagaccctgcaggaggccctgaaggtggagatccaggtacaccagaagctagtggcacagatgaagcaggacccacagaacgccgatttgaagaagcagttgcacgaactccaggccaagattacagcgctcagtgagaagcagaaacgcgtcgttgaacaactgcggaaaaacctgatcgtgaagcaggagcagcccgacaaatttcagatccagccactacctcagtctgagaacaaactgcagacagcgcaacagcagcctctacagcagcttcagcaacagcagcagtatcaccatcaccacgcccagcaaagcgctgcagcgagcccaaatctgactgcaagccaaaaaacagtgacgacggcaagcatgataacgacgaagaccctcccattggtcctgaaggccgctaccgcaaccatgccagcttcagtggtgggacagcgaccaactatcgctatggtgaccgcaatcaacagtcaaaaggcggtgctgtctaccgacgtccagaatactccagtgaatctgcaaacctcaagcaaagttaccggacctggtgccgaggccgtgcaaatagtggcaaagaacactgtgactctggttcaggcaaccccccctcagcccattaaggtcccccagttcatcccccccccacggctaaccccaagacccaattttctgccccaagtccgcccgaagccggttgcacagaataacatccccatagctcccgcgcctcctccgatgcttgccgctccacaactgattcagcgccccgttatgttaacaaagttcacccctaccacgctccctacctcgcaaaattcaattcacccagtgcgcgtggtgaacgggcagacggctaccatcgcgaaaacttttccgatggctcaactgacctctattgtcatcgctactcctggtacaaggctagctggtcctcagactgtccagttgtctaagccttcacttgagaaacagactgtgaaatcccacacggagaccgatgagaaacaaacagagtcccgcaccataacaccccctgccgctcccaaacctaagagggaggagaacccccagaagctggcctttatggtgtctctagggctggtgacccatgatcacctggaggaaatccagtccaagcgccaggagagaaagaggcgaacaacagctaacccagtctactccggagctgtgttcgagcccgaacggaagaaatcagctgtcacctacctgaatagcacgatgcaccccgggacccgtaagaggggaagacctccaaagtacaatgcagtgctggggttcggggcactcacaccaacgtcgccacagtcctcgcacccagacagccccgagaatgaaaaaaccgagactacttttaccttccctgctccagtccagcccgtctctttgccatcacctacaagtaccgacggagatattcatgaggatttctgttccgtgtgcagaaaaagcgggcagctgctgatgtgtgatacgtgtagccgtgtataccatctggactgcctggaccctcctctaaagaccattcctaagggtatgtggatctgcccccggtgccaggatcagatgctgaagaaggaggaggctattccatggcccggaacactcgccattgtgcatagctacatcgcttacaaagcagccaaagaggaagaaaagcagaagctcctgaaatggtcttctgacttgaaacaggagcgcgaacagctcgaacagaaagtgaagcaactctcaaatagtatcagtaagtgtatggagatgaaaaacacgattttggcaagacagaaagagatgcacagcagcctcgagaaagtcaagcaactgatcagactgattcatgggattgatttaagcaagcctgttgactcagaagctacagtaggcgcaatcagcaatggaccagactgcacacctccggcaaatgcagccacgtccactccagcccctagcccatccagtcagagttgtaccgccaattgcaaccagggcgaagagacaaagtag

SEQ ID NO: 199107 - DNA, 81 bp, Artificial Sequence
  Description of Artificial Sequence: Synthetic coding sequence
atggagctgcagaccctgcaggaggccctgaaggtggagatccaggtccaccagaaactcgtggctcagatgaaacagtag

SEQ ID NO: 199108 - DNA, 36 bp, Artificial Sequence; identical to SEQ ID NO: 92914
  Description of Artificial Sequence: Synthetic coding sequence

SEQ ID NO: 199109 - DNA, 306 bp, Artificial Sequence
  Description of Artificial Sequence: Synthetic coding sequence
atggagctgcagaccctgcaggaggccctgaaggtggagatccaggttcatcaaaagcttgttgcgcagatgaaacaggatccccagaatgccgacctcaaaaagcagctccatgagttacaggccaagattactgccttatctgaaaaacaaaaacgggttgtggagcagctgcgcaaaaacttgatcgtgaaacaagaacagcctgataagttccaaatccagccgctgccacagagcgaaaacaaactccagaccgcccagcaacagccacttcagcagctgcagcagcaacagcagtattag

SEQ ID NO: 199110 - DNA, 30 bp, Artificial Sequence; identical to SEQ ID NO: 92916
  Description of Artificial Sequence: Synthetic coding sequence

SEQ ID NO: 199111 - DNA, 156 bp, Artificial Sequence
  Description of Artificial Sequence: Synthetic coding sequence
atggagctgcagaccctgcaggaggccctgaaggtggagatccaggtccaccagaagcttgtggcccaaatgaagcaggacccacagaacgctgatctgaaaaagcaacttcatgagctgcaggcaaaaatcaccgctctgtctgaaaaacagtag

SEQ ID NO: 199112 - DNA, 477 bp, Artificial Sequence
  Description of Artificial Sequence: Synthetic coding sequence
atgctggaggccatggccgagcccagccccgaggaccccccccccactctcaagccagaaacacagccccccgagaagcgcaggaggaccatcgaagactttaacaaattctgctcttttgttctggcctacgccggttacattccaccatccaaagaggaaagcgattggccagcatcaggttccagcagccctctgcgcggcgagtctgccgccgattccgatggctgggactctgcgccatcagacctgcggaccatacagacttttgtgaagaaggcaaagtcgagtaaaaggcgtgcggctcaagccggcccaacacagcctggtccccctcgaagtacctttagccgtcttcaagcgccagactccgcaaccctgctcgagaagatgaagctcaaggattccctgttcgacctcgacgggccaaaggtcgcatcgcctcttagccccccgtgcgccgccaacactccttag

SEQ ID NO: 199113 - DNA, 1212 bp, Artificial Sequence
  Description of Artificial Sequence: Synthetic coding sequence
atgctggaggccatggccgagcccagccccgaggaccccccccccaccctgaaacccgagactcagccacccgaaaagcgccggcggacaatcgaggattttaataagttttgcagtttcgttcttgcatacgcaggatacattcctcctagcaaagaggagtccgactggcctgcaagcggcagctcctccccacttaggggggagtccgctgcggactctgatggctgggattcagcgccatctgacttaagaaccattcagacctttgttaagaaggcaaagtcatcaaagcggcgggccgcacaggccgggccaacacagcccggacccccccgttcgaccttttctcgcctccaggcaccggactctgcgacccttctggaaaagatgaagctgaaggactccttatttgatttggatggtccaaaggtggcctctcccctttctcctacgtcccttacccatacttcaagaccaccggcggcgctgaccccagtgcctctcagccagggagatctgagccacccccctcggaaaaaggaccgcaagaacaggaagctcggcccaggcgccggcgctggattcggcgtcctgaggagacctcgcccgacccctggtgatggcgagaagagaagtcgaattaagaagtccaaaaagcgtaaactcaagaaagccgaacgcggtgatagactgcccccacctggaccacctcaggcccctccatctgacacagacagcgaggaggaagaagaggaggaagaggaagaagaggaggaagagatggcgactgtggtgggcggcgaggccccagtgcctgtgctccctactcccccagaagcaccaaggccaccagccaccgtacatcccgagggtgtgcccccagccgactccgaaagcaaagaagtcgggagcacggagacgtctcaggatggggacgccagcagcagtgagggagagatgagggtgatggacgaagatatcatggtagagtccggggacgatagctgggatttaatcacctgctattgcagaaaaccttttgctggaagaccaatgatagagtgttctctgtgtgggacctggattcacctaagctgcgccaaaataaaaaaaactaacgtgcccgattttttctattgccagaagtgcaaggaactgcggcctgaggccagacgcctgggaggaccccctaaatccggggagccttag

SEQ ID NO: 199114 - DNA, 1200 bp, Artificial Sequence
  Description of Artificial Sequence: Synthetic coding sequence
atgcccggcgactgccggcgggaccccccccccaccctgaagcccgagactcagcctcctgagaagcgccgcaggacaatcgaggattttaacaagttctgtagctttgtactggcgtacgccgggtacattccccccagcaaggaggagtccgactggcccgccagcgggagctcatcgcctctccgaggcgagagcgctgctgacagtgacggctgggatagcgccccctctgacctgagaaccattcaaacatttgtgaaaaaggctaagtcctccaagcgcagggctgcgcaggctgggcctactcagcctggacccccaagatctacctttagccggctccaagccccagactcggccacccttctcgagaaaatgaaactgaaggacagtttattcgatctggatggtcccaaagtggcaagtcccctgtcccccacgtcccttacacacaccagcagacctcctgcagcccttacacctgtccccctgagccagggtgacttatcccatccgccccggaaaaaagataggaagaatcgaaaactgggcccaggggccggcgctggctttggagtcctgaggcgacccaggcccaccccgggggatggcgagaagcgcagcagaatcaagaagtccaagaaacggaagttgaaaaaggcagagcgcggcgatagactgcccccacctgggccaccccaggccccgccttccgacacagattccgaggaggaggaggaagaggaggaagaggaggaggaagaggaaatggctacagtggtcgggggcgaggcccccgtgcctgtcctcccaacaccccccgaagctccaagaccccccgccacggttcaccccgagggcgtgcctcccgccgatagcgagtccaaagaggtaggcagcactgagacgtcacaggatggcgatgcgtcatcctcagagggggaaatgcgcgtgatggatgaagacatcatggtcgaatcaggggacgactcttgggatttgattacatgctactgccggaagccttttgcgggccggccaatgattgagtgcagtctgtgtgggacctggattcacctttcatgtgctaagattaagaagaccaacgtaccagacttcttttattgccagaaatgcaaggagctgcgaccagaagcccgcagactgggcggaccaccaaaatcgggagaaccttag

SEQ ID NO: 199115 - DNA, 6120 bp, Artificial Sequence
  Description of Artificial Sequence: Synthetic coding sequence
atggacatcgtggacaccttcaaccacctgatccccaccgagcacttagacgatgcgcttttcctggggagtaatctggagaatgaggtttgtgaggactttagcgcttcacagaacgtactggaagactctctgaagaacatgctatcagacaaagaccctatgctggggagcgcatctaatcaattctgcttacccgtgttggatagcaatgatcctaatttccagatgccgtgctccaccgttgtgggcttagacgacataatggatgagggagtagttaaagaaagtgggaacgacacgatcgatgaggaagaactcattctccctaaccgcaatctgcgcgataaggtggaagagaacagcgtgcgttcacctcgcaaatcgcctagattgatggcgcaggagcaggtgcgcagtctgcgccagagcacaatcgctaagaggtctaatgccgctccactgtcaaataccaaaaaagcctctggaaagacggtgtctactgcaaaggccggcgtgaagcagccagaacgctcccaggttaaagaagaagtgtgtatgagtctgaagccggagtaccacaaggagaatcgccgatgttctagaaatagtgggcagatcgaggtcgttcctgaagtgtctgtcagctcctctcacagcagcgtgagttcttgcttagagatgaaggacgaggatggcctcgattcaaagcacaagtgtaacaatcccggcgaaatagatgtgcccagtcacgagctgaactgctccctgctgagcgaaacgtgtgtgacgattggcgagaagaaaaacgaggccctgatggaatgcaaagcgaagccagttggatcgccgctgttcaagtttagcgacaaagaggaacacgaacagaacgattcaatctccggcaaaacaggtgagactgtcgtggaggaaatgattgccacgcgaaaagtggagcaggatagcaaggaaacagtgaagctctctcatgaggacgaccacatactggaggatgcagggagctccgacataagctccgacgccgcctgcactaaccccaacaaaactgagaactcacttgttggccttccctcctgcgttgacgaggtgacggagtgcaatctggagctcaaagatacgatgggcattgcagataaaactgaaaatacccttgaaagaaataagatagaacctctcgggtactgtgaggacgccgagtccaatcgtcagttagagagtacggaattcaataaatcaaatctggaggtcgtggatactagcactttcggtcccgaaagcaacatcctggagaatgctatttgcgacgtgcccgatcagaatagtaagcagcttaatgctattgaatcaactaaaatagagagccacgagactgccaacctccaggatgaccggaattcccagtcaagtagcgtttcatacctagagagcaaatctgtcaagtccaaacataccaagcccgtcattcactccaaacaaaacatgacgaccgatgcccctaagaaaattgtggcggcgaagtacgaagttatccactctaaaacaaaggtaaatgtgaagtctgtcaagagaaatacggatgtgcccgaatcacagcagaattttcaccgtcctgtaaaagtccgcaagaaacaaatagacaaagagcctaagatccaatcctgtaattccggggtaaagagcgtgaaaaatcaggcccactccgtactgaagaaaaccctacaggatcaaactttggtacagatcttcaaaccactcacacacagcctgtcagataaatcgcatgcccatccaggttgcctgaaggaacctcatcaccccgctcagacaggacacgtgagccactcatctcagaagcagtgtcacaagccccagcaacaggcacctgccatgaagaccaacagtcatgtgaaggaagaactggaacacccgggagtagaacacttcaaggaggaagataagttgaagctgaaaaagcctgagaagaatcttcagccccggcaaagacgttcctccaagagtttttccctcgacgaacctccattgttcatccccgataatatcgcgacgatccgccgggaggggtctgatcattcgagctcatttgagtctaagtatatgtggacaccttcaaagcagtgcggattctgcaagaaaccacacggcaatagatttatggtggggtgtggcagatgtgacgactggttccacggtgactgtgtaggactgtcactgtctcaggcccagcaaatgggggaggaggacaaggagtatgtgtgcgtgaagtgctgcgccgaagaggacaagaagaccgagatactggatccagacactctggaaaatcaggccaccgttgaattccactccggtgataaaaccatggagtgtgaaaagctcggcttatccaaacatacaaccaacgaccggacaaagtacattgacgataccgtgaagcataaggtgaagattctcaaaagagagtccggcgaggggaggaactcgtccgactgtagagataacgaaattaagaaatggcagctggccccactgagaaagatgggccagccggtgctgccaagacggtccagtgaggaaaagtctgaaaaaattccaaaagagtcgacaaccgtcacctgtaccggtgagaaggcctcgaaacccggtactcatgagaagcaggagatgaaaaaaaaaaaagttgaaaaaggagtcctaaatgtccacccggccgctagcgccagtaaacccagcgctgaccaaatccggcagtctgtcaggcacagcttaaaggacattctgatgaaacggttgaccgactcgaatctaaaagtgccagaggagaaggctgccaaggtcgctaccaaaatagaaaaggagcttttctcttttttcagggatacagatgcaaaatacaaaaacaagtataggagtctcatgtttaacctgaaagatcccaagaataacatcctgtttaagaaggtactgaagggagaggtcactcccgaccaccttattagaatgtcaccggaggaactagcaagtaaggagctggctgcatggagaaggcgcgagaacagacatacaatagaaatgattgagaaggaacagcgcgaggtggaaagaaggcctatcactaagataacccacaagggagaaatcgaaatcgagtctgatgcgccaatgaaagagcaggaagccgctatggaaattcaggagcctgcggccaataaatccctggaaaagcccgaaggatccgagaaacagaaggaggaggtggattcgatgagtaaggacactacttcccaacaccggcagcatctctttgacctgaactgcaaaatttgcattgggcgcatggctcctccagtggacgatctgtcgcccaaaaaggtcaaggttgtggtgggagtcgccagaaaacactccgataacgaggctgaatctattgccgatgccctctccagtacatccaacatattagctagcgaattctttgaggaagaaaaacaagagagccctaagagcacgttctcgcccgctccccggcctgagatgcctggaactgtcgaagtggaaagcacatttctagcgagactgaacttcatctggaaaggtttcataaacatgccttccgtcgccaaatttgtcacaaaagcttacccggtctcaggtagccctgagtacctcacggaagacctccccgacagtatacaagtggggggacgcatctcacctcaaacagtctgggactatgttgaaaagattaaggctagcggcacaaaggaaatctgtgtagtccgattcacccctgtgactgaggaggatcagatcagttacaccctcctctttgcgtacttctctagccggaagcgctacggcgtggcagccaataacatgaagcaggtcaaggatatgtacctcattcctctgggggccacagacaagattccccaccccctagtgccattcgacggtcccggtttagaactgcacaggcccaacctgttgctgggcctgataattcgccagaagctgaagcggcaacatagcgcttgcgcctctacttcccacatcgccgaaacccctgagtccgctcctcccattgcccttccccccgacaagaaatccaagatcgaagttagtactgaagaagcccctgaagaagagaacgactttttcaactcctttacaaccgtgttgcacaagcaacgcaataagcctcaacagaatctgcaggaagatctcccaactgccgttgagcccctgatggaggtcacaaaacaggagccccccaaaccactcaggtttctgcctggagtacttatcgggtgggaaaatcagccaacgaccctcgagctggccaacaagccattgccagtcgacgatatcctacagtcactgctggggaccacagggcaagtgtacgaccaggcccagagcgttatggagcagaataccgttaaggagataccattcctgaacgagcagaccaactctaaaatcgaaaaaactgataatgtcgaagtaactgatggggagaataaagaaataaaagttaaagttgataatattagtgaatcaacagataagagtgctgagattgagacctcagttgtcgggtcgtcttctatttccgcaggctcactgaccagcctatccctgcgtggaaagcctcctgatgtgtcaacagaagcctttttaacgaacctgagcattcaaagtaaacaggaggagaccgtcgagagtaaagaaaagaccctgaagcggcagctgcaggaagatcaggagaacaatttgcaggacaaccaaacatcaaattcatctccatgtagaagcaatgtgggcaaaggcaacatagatggaaacgtgtcctgctccgaaaacttggtggccaacactgctaggtcaccccaatttatcaacctgaagcgtgatcctcggcaggccgctggcagaagtcagccagttactacttcagaatcaaaggacggcgactcctgtcggaatggagaaaaacacatgctgcccggcctcagtcataacaaggagcatctgaccgagcagattaacgtcgaggaaaagctgtgtagtgcggaaaaaaactcctgcgtccagcagtccgacaatctgaaggttgcccaaaacagtccgagcgtcgagaatatccagacctctcaggcggagcaagcaaagcccctgcaagaggacattcttatgcagaatatagagaccgttcatcctttccgcagagggtccgccgtggcaacctcccattttgaagtaggtaatacatgtccgagcgaatttccctctaagtccattacctttactagccgctctacctctcctaggacgtcaactaatttctcacccatgagaccccaacagcccaatctgcagcatcttaaatcctctccgcctggcttcccattccccggtccaccgaacttccctcctcaatcgatgtttgggttccctccacacctgccccccccactgctgcctccaccgggattcggcttcgcacaaaatccaatggtcccctggcctcctgtggtgcaccttccgggtcagccccaacgcatgatgggcccgctcagccaagcctctagatatatcgggccccaaaatttttatcaggttaaggatattcgcaggccagagagacggcattctgacccctggggcagacaggaccagcagcagctggatcgccctttcaacagggggaagggagaccggcagcgtttctattctgacagtcaccacctgaagcgggagagacacgagaaagaatgggagcaggaatccgaacgacacagaagacgcgacaggtcccaggataaagaccgggataggaaaagtagagaggaaggtcataaggataaggagagagctcgcctgtcgcatggcgatcgcggtaccgatgggaaggcttccagggactcacgcaacgttgacaaaaagcctgataagcctaaatccgaagattatgagaaggataaagagagagaaaaaagcaaacacagggagggggagaaagacagggatcgttaccacaaggatagggaccacacggatagaaccaaaagtaaacgatag

SEQ ID NO: 199116 - DNA, 6120 bp, Artificial Sequence
  Description of Artificial Sequence: Synthetic coding sequence
atggacatcgtggacaccttcaaccacctgatccccaccgagcacctcgacgatgcccttttccttggtagtaatctggaaaacgaggtgtgtgaagatttctccgccagccagaacgttctggaggactccctgaaaaacatgctgagtgacaaggacccaatgctgggaagtgcttctaatcagttctgtctgcctgttctcgactccaacgaccctaatttccagatgccgtgcagtaccgtggtaggtctcgatgacatcatggatgaaggagtggtaaaagaatctggcaacgacaccattgatgaggaggaactaatcctgcccaatcgtaatctaagggacaaagtagaggaaaattcagtgcggtcaccgcggaagtccccgcggctgatggcacaagagcaagtgcggtctcttagacagtcaaccattgctaagaggtctaacgccgccccgcttagcaatacaaagaaggccagcggaaagacagtcagcacagctaaggctggggttaaacaaccagaaaggagccaagttaaagaggaggtgtgcatgagccttaagccagagtatcacaaggagaatcgtaggtgctcccgcaactcaggtcaaattgaagtggtccccgaggtttcagtgtcttcatctcacagctccgtgtcgtcatgtctggagatgaaagacgaagacggactagactctaagcacaaatgtaataatccgggtgagatcgacgttcccagtcatgagctgaactgttccttgctctctgagacatgtgtgactataggcgagaagaaaaacgaggctcttatggagtgtaaggcaaagcctgtcggatccccactttttaaattttctgacaaagaggagcatgagcagaacgacagcatttctggcaaaactggggaaaccgtggtggaggaaatgattgcgacaaggaaggtggagcaagattccaaggagacagtaaaacttagccacgaggacgaccacatactggaggacgccggctctagcgatattagttctgacgcagcctgtacaaatcctaataagacggaaaattcgcttgtgggactgccctcttgcgttgacgaggtgaccgaatgcaatttggaactgaaggacacaatgggcatcgcagataagactgagaataccctagaacgcaataagattgaaccactggggtattgtgaggacgctgagtctaatagacaacttgagtcaacggaatttaataagtccaatctggaggtggttgatacgtcgacttttggtccagagagtaatattctggaaaatgccatttgtgatgtccctgatcaaaatagcaaacagctgaacgcgatcgagtctaccaagatagagagccacgagaccgcaaacttacaggatgatcgcaatagccaaagttcaagcgtgtcatacctggaatctaagtccgtgaaatccaagcacacaaaaccagtcatccactccaagcagaacatgacaactgacgcccccaagaaaatcgtcgccgccaagtacgaggtgatacatagcaaaaccaaggttaatgtgaagtcagtcaagcgtaataccgacgtgcccgaatctcagcagaacttccataggccagtcaaagtccgtaagaagcagatagataaggaaccgaagatccaaagttgtaattctggcgttaagagcgttaagaaccaggcacattccgtcctcaagaaaacactgcaggaccagacgctggtgcagatcttcaagccccttacccattccttgtccgacaaaagtcacgctcaccccggatgcctgaaggaacctcatcaccccgcccaaacaggtcatgtgagtcacagcagtcagaaacagtgtcacaagccccagcagcaggcccctgctatgaagaccaatagtcatgtcaaggaggagctcgaacatcccggcgtggagcactttaaggaggaggataagctgaagctgaagaagccagagaaaaacctgcaaccgaggcagagaagatctagtaagagcttcagcctcgacgaaccgcccttgtttatacctgataacattgcaacaatcagaagagagggctctgaccatagctcttcctttgaatctaaatatatgtggacgccctcgaaacagtgcggattttgcaaaaagcctcatggaaacagattcatggtagggtgtgggaggtgtgacgactggtttcatggggattgcgtcggcctctctctgtcccaggcccagcagatgggtgaggaggacaaggagtacgtgtgcgtcaaatgttgtgcagaggaggacaagaagactgagatcctggaccccgatactttagagaaccaggcaaccgtggagttccattccggagataagacgatggagtgcgaaaagttggggttatccaaacacacaacgaacgatagaactaaatacatagacgacacagtgaaacacaaggtgaaaatccttaaacgagagtcgggggaggggcgtaactcaagcgattgtcgggacaacgagattaagaagtggcaactggcccccctccgaaagatgggtcagcctgtgctgcctaggaggagctccgaggagaagagcgaaaagatccccaaagagagcaccacagtcacttgcacaggcgagaaagcctcaaaaccaggaacccatgagaaacaggagatgaagaaaaagaaggtcgaaaagggtgttctgaacgttcacccagcggcctccgcctccaagccatcagccgatcagatacggcaaagcgtcaggcattccttaaaggatattctcatgaaaaggctcacggacagtaaccttaaagtacctgaggaaaaagcggccaaagtggcaactaagattgagaaggagctattttctttttttagagacaccgacgctaagtacaaaaacaaataccggtcgcttatgttcaatctgaaggaccctaagaataatattctgtttaagaaggttctgaaaggggaggtcacccccgaccacttgattcgaatgtcgccagaagagcttgccagcaaggagctcgcggcgtggaggaggagggaaaacagacacacaattgagatgatcgagaaggagcagcgggaggtcgagaggcgccccatcactaagatcacccacaagggcgaaatagagatcgagagcgatgccccaatgaaagagcaggaagcagccatggagattcaggaacctgcagcaaacaagtcactggaaaaacctgagggctccgaaaagcagaaggaagaagtggacagtatgagcaaggatacaactagccagcacaggcagcacttatttgacctgaactgtaaaatctgcatcggtagaatggcgcctccagtggacgacctctcacctaagaaagtcaaagtggttgtgggggtcgcgaggaagcatagcgacaacgaagccgaaagcattgctgatgctctgagttctacctccaacatacttgcctccgagttttttgaggaggaaaagcaggaatcacctaagtctaccttttctcctgctccccgacccgagatgcccgggacagtcgaagttgaatcaactttcctcgctaggctcaatttcatatggaagggctttattaacatgccctctgttgccaagtttgtcacaaaagcatatccagtgagcggaagccctgagtaccttactgaggacctacccgatagtatccaggtcggaggaaggatctcgcctcagaccgtttgggattatgttgagaaaatcaaagcctccggtacaaaggaaatttgcgtggtacgcttcactccagtcacagaagaagaccaaatctcatacacattgctgttcgcttacttttcgtctcggaaacgctacggagttgccgcaaacaacatgaaacaggtgaaagacatgtatttgatacctctgggcgccacagacaagatcccacatccactggtgccatttgacggtccaggactggagcttcaccgccctaatctgctcctcggattgatcatcagacagaagttgaagaggcagcacagcgcctgcgccagtacctctcacatcgcagaaacccctgagtccgccccacccatcgctctgccccctgataaaaagtctaagatagaagtgtcaacagaggaagcccccgaggaagagaacgatttctttaactccttcaccacggtgctgcataaacagcgcaacaaaccccagcagaacctacaggaagacctgcctacggcagtggaacccttgatggaggttacaaaacaggaacctccgaagcctcttagatttctgcccggggtgcttatcgggtgggaaaatcagccaacaacgctggagctcgccaacaagcctctgcctgtggatgatatcttgcagagcctgcttggcacaacgggccaggtgtacgatcaagctcaatccgttatggagcaaaacacagtaaaagagataccattccttaatgagcagaccaacagcaaaatcgaaaaaacggataacgtggaggtcactgacggtgaaaataaggaaatcaaagtaaaagtcgacaatattagtgagtccactgataagtcagccgagatagagacctccgtcgtcggatcttcttccatcagcgccgggagtctgacgtctctgtctctccgcggcaaacctcctgacgtgagcacggaagcattccttactaacctctctatccagtcaaagcaagaagaaaccgtcgagagcaaagaaaagacattaaagaggcagctccaagaggatcaagagaacaatctccaggataatcagacctccaattcttctccatgcaggtccaatgtgggcaagggcaacatcgatgggaacgtctcctgttcagaaaatctggtggccaacactgcccgctcccctcagtttattaaccttaagcgtgacccacggcaggcggcaggaagaagtcagcctgttaccacgagcgagagcaaagacggcgacagctgtcgcaatggagaaaagcacatgctgcccgggctgagccataataaggagcacttgacagagcagatcaacgtggaagagaagctgtgcagtgccgagaaaaatagctgcgtgcagcagtccgataatctgaaggtagcacaaaattcacctagcgtcgaaaatattcaaacctctcaggctgaacaagctaagccactgcaggaggatattcttatgcagaatattgagaccgttcacccctttaggcggggcagtgcggtggcgacaagccattttgaagtgggaaatacctgcccatccgaattccctagcaagtccatcacttttacgtcaagaagtacatccccccggaccagcacaaacttttcccctatgcggccccaacagccgaacctccaacatctcaaaagctctcctcccggttttccctttccgggtcccccaaacttcccaccgcagagcatgttcggtttcccaccccacctaccgccgcccttactgcccccccccggattcggtttcgcccaaaatcccatggtcccgtggccacccgtggtccacctgccaggccagccacagcgcatgatggggcctctatctcaagcctcacgttacatcggtccgcagaacttttatcaggtgaaagacatccggcgccctgaaagaagacatagcgacccttggggccggcaggatcagcagcaactcgacagaccttttaataggggcaaaggagaccggcagaggttctattccgactctcaccacctgaaacgtgagcgtcacgaaaaagagtgggagcaggagtccgagcggcacaggcggcgggataggtcacaggataaggatcgggaccgtaagagtcgggaagagggccacaaggacaaagaacgagccagactgtctcacggggaccggggcactgacgggaaagcatctcgcgacagccggaatgtcgacaaaaagcccgataaacctaaatcggaagattatgagaaagacaaggaacgagagaagagcaaacatcgagagggcgagaaggatagagatcggtatcacaaggacagggatcacacggatcgaaccaagagtaagaggtag

SEQ ID NO: 199117 - DNA, 1098 bp, Artificial Sequence
  Description of Artificial Sequence: Synthetic coding sequence
atgagcagcagcgtggagcagaagaagggccccacccggcagcggaaatgcgggttttgtaagagcaaccgcgacaaagaatgtggacagctcttgatttccgaaaaccaaaaggtggccgcacaccacaagtgcatgctcttcagttctgcgcttgtgagcagccacagtgataacgagtccctggggggattcagcattgaggatgtgcagaaagagatcaagcgaggaacaaaattgatgtgctccttgtgccactgcccgggcgctaccataggctgtgatgtcaagacatgtcatagaacttatcattaccattgcgccctgcatgataaagcccaaattagggagaaacctagccagggcatatatatggtctactgcagaaagcacaagaaaacagctcacaactccgaagctgaccttgaggagtcgttcaacgagcatgaattggagccttctagtccgaagtctaagaagaaatcacgcaagggaaggcctcggaaaaccaacttcaagggattgagtgaagacactcggtcaacatcatcacacggtactgatgagatggagtcctcttcttaccgagaccgaagcccacaccggtcctccccttccgacaccagacccaaatgcgggttttgtcatgtaggagaagaggaaaacgaagcgaggggcaaacttcacatcttcaacgcaaaaaaggctgctgctcactacaagtgtatgcttttcagcagtggaactgtgcagctgactaccacctcaagggccgagttcggcgatttcgatatcaagaccgtactgcaggagataaaaagaggaaaacggatgaagtgtactctctgtagccaaccaggcgcaactataggttgtgaaatcaaagcatgcgtaaaaacctatcattaccactgtggagttcaggacaaggctaaatatatcgagaatatgtctagaggaatttataagctgtactgcaagaatcactctgggaatgatgaaagagatgaagaggacgaagagagggaaagtaagtctcgcggtaaggttgagattgaccagcaacagctgacccaacagcagctgaacggaaattag

SEQ ID NO: 199118 - DNA, 975 bp, Artificial Sequence
  Description of Artificial Sequence: Synthetic coding sequence
atgagcagcagcgtggagcagaagaagggccccacccggcagcggaaatgcgggttctgtaagtcaaatcgcgataaggagtgcggccagctcctcatttccgagaaccagaaggtagcagctcaccacaaatgcatgctatttagcagcgctctggtctcctcccacagcgataacgagagcctcgggggcttttctattgaggacgttcagaaagagattaagagaggcacaaaactgatgtgctcactgtgccactgcccaggggccaccatcgggtgcgatgtgaagacatgtcaccgaacctaccattatcactgtgcccttcacgataaagctcagatcagagagaaaccttcacagggcatctacatggtgtattgccgcaagcacaaaaagacggcccacaattctgaggctgcggacctcgaggagtcttttaacgagcacgaattggagcctagttccccaaaatccaagaagaagtctagaaagggtagaccgaggaagacaaattttaaaggactgtccgaagatactagaagcacgtcatcacacggtactgacgaaatggaatctagctcttacagagaccgcagtcctcaccgctcgagccctagcgatacgcggcccaaatgcggattctgccatgtgggtgaagaggagaatgaggcgcgggggaaactccacatcttcaacgccaagaaggccgctgcccattacaagtgcatgctgttctcttctggcacggtgcagttgactactacaagcagagctgagttcggggacttcgatattaaaaccgttctgcaggagattaaacgcgggaagcgcatgaaatgtacactctgttcacaaccaggcgcaacaattggctgcgagattaaggcctgcgtaaaaacttaccactaccattgcggtgtgcaggacaaggccaagtacattgagaacatgtcccgcggtatctataagtag

SEQ ID NO: 199119 - DNA, 939 bp, Artificial Sequence
  Description of Artificial Sequence: Synthetic coding sequence
atgagcagcagcgtggagcagaagaagggccccacccggcagcggaagtgtggcttttgtaagagcaatagggacaaggagtgcggccagctgctgattagcgaaaatcagaaagtagctgcacatcataaatgcatgctgttctcgtcggccctggtatcttcgcacagcgacaatgaatctctgggcggcttctcaatcgaagacgtgcagaaggagattaagaggggtacgaagctaatgtgctcattgtgccactgtccgggggccaccatcggctgtgatgtgaaaacctgtcatcgaacctatcattaccattgcgctctccatgataaggcccaaatccgtgaaaagccgtcgcagggaatctacatggtatactgtcggaaacacaagaagactgctcacaattccgaagccgccgacttagaagaatcgttcaatgagcacgagctggaaccctcctcgccaaaatccaagaaaaaatcccgaaaaggtcggccacgaaaaactaattttaagggccttagtgaggatactagaagcacatcatcacacggcaccgacgagatggagtcctcctcctaccgggaccgttcaccgcacagaagtagcccatccgacaccaggcccaagtgcggcttttgtcacgtcggcgaagaagagaacgaggcaaggggtaagttacacattttcaatgcgaaaaaggcggctgctcactataagtgcatgctgttttcatcgggcactgtacagttgaccacgactagtcgtgccgaatttggagacttcgacataaaaacagtgctgcaggagatcaaaagaggcaaaaggatggtttgctcattctacatctgttatgccacgctgcaccttatctgctgttttaagttccgtgtacacccaaagttcattcaaagctctgagaacctgaagtag

SEQ ID NO: 199120 - DNA, 1098 bp, Artificial Sequence
  Description of Artificial Sequence: Synthetic coding sequence
atgagcagcagcgtggagcagaagaagggccccacccggcagcggaagtgcggcttttgcaagagtaacagagacaaggaatgtggccagctcctcatttctgaaaatcagaaggtggctgcccaccacaagtgcatgctttttagctctgccctggtctcatcccacagcgataacgagtctttgggcggcttcagtattgaagacgttcagaaagaaatcaaaaggggaaccaagctaatgtgttcattgtgccactgtcccggggctactatcgggtgtgatgtgaaaacctgtcataggacgtaccactatcactgcgcactgcatgataaggcccagatacgtgaaaaaccaagccaaggaatctacatggtatattgccgaaagcataagaaaaccgcacataactccgaggcggatctggaggaaagcttcaatgaacacgaactggagcccagttcacccaaatcaaaaaaaaagagccgcaagggaagaccaagaaagaccaatttcaaaggtctaagcgaggatacccgatctacctctagccatgggaccgacgaaatggaatcatcttcgtatcgagacaggtctccccatcgatcctccccttccgatacaaggcctaagtgtgggttctgccatgtgggagaagaggagaacgaggctcggggaaaacttcatatatttaacgccaagaaggccgcggcccactataagtgtatgctcttttcctccggcacagtgcaactgaccacgactagtcgcgcagagttcggagactttgacatcaaaacagtacttcaggaaattaagcgcggaaagaggatgaagtgcactctttgtagccagcccggagcaacaataggatgcgaaataaaagcctgcgtgaagacctaccactatcactgtggtgtccaagacaaagctaaatacattgagaatatgtctcgaggcatttataagctatactgtaaaaatcactccggtaatgacgagcgcgacgaggaggacgaggagcgcgaatctaagagccgcggaaaagtggagattgatcaacagcaactcactcaacaacagctgaacgggaattag

SEQ ID NO: 199121 - DNA, 1101 bp, Artificial Sequence
  Description of Artificial Sequence: Synthetic coding sequence
atgagcagcagcgtggagcagaagaagggccccacccggcagcggaagtgcggattctgtaaaagtaacagggacaaggaatgcgggcagttattgattagcgagaatcagaaagtggcggctcatcacaaatgcatgctctttagttcggccctagtttctagccactcagacaacgagtccctgggaggcttctcaatcgaggacgtgcagaaagagatcaagcggggcacgaaactaatgtgtagtctgtgtcactgtcctggagcaacgatcgggtgcgacgttaaaacctgtcaccgtacgtatcactaccattgcgctcttcatgacaaagctcaaatccgggaaaaaccctcccaagggatttacatggtgtactgcagaaagcacaagaagaccgcccacaatagtgaagcagcggatcttgaagagagcttcaacgaacatgaacttgagcctagtagccccaagtccaagaagaaaagcagaaaaggcaggcccaggaagaccaatttcaaaggcctttcagaagacactcggtcgacaagtagtcatgggacagatgaaatggaaagttcttcatacagagaccgctccccgcaccgaagctcaccctctgacacacggcccaagtgcgggttctgccacgttggagaagaggaaaacgaagctaggggaaagctgcacatctttaacgccaagaaggccgccgcacactataagtgcatgctgttttcatccgggactgttcagttaactactactagtcgagccgaatttggcgactttgatatcaaaaccgtgctgcaagagatcaagcgcggaaaacgcatgaaatgcaccttgtgttcccagccaggcgccacaataggatgtgagatcaaggcttgtgtgaaaacgtaccactaccattgtggcgttcaggataaagctaagtacatcgaaaatatgagcagagggatctataagctgtactgcaagaatcacagtggaaacgatgaaagagacgaagaggacgaagagcgggagtctaagagccgcggtaaggttgaaatcgaccagcagcagttgacccagcaacaactgaacggaaattag

SEQ ID NO: 199122 - DNA, 996 bp, Artificial Sequence
  Description of Artificial Sequence: Synthetic coding sequence
atgagcagcagcgtggagcagaagaagggccccacccggcagcggaagtgcggattctgtaaatcgaatcgcgataaggaatgtggtcagctgttaatctctgagaatcagaaggtggccgcccatcataaatgcatgatgtgctcactgtgccactgccctggcgccacaattggctgtgacgtcaagacttgccacagaacatatcattatcattgcgcccttcacgacaaggcacagatccgagagaagccttcacaagggatatacatggtgtactgccgaaagcacaagaagactgctcataatagcgaggccgacctcgaggaatcatttaacgaacatgagttggagccttcctccccaaagagcaagaaaaagtccaggaaggggcgtcctcggaagacgaactttaagggtctgtcagaggacacacgaagcacttctagtcacggaacagacgaaatggaatcctcctcttacagggatcggtctcctcatagaagttccccatcagatacccgacccaagtgcggtttctgtcacgtgggcgaggaggaaaatgaggctcggggaaaactgcacatctttaacgcgaaaaaagccgctgctcattacaagtgtatgctgtttagctctgggacggtgcagctgaccacaacctcccgcgccgagtttggggattttgatatcaagactgtgctccaggagattaagcggggtaagcgcatgaaatgcacactctgttcacagccaggggcgacgattgggtgtgagatcaaagcctgcgttaagacctaccactatcattgtggggtgcaggacaaagccaaatatattgagaacatgtcacgcgggatctataagctgtattgcaagaaccattccgggaatgacgaacgcgacgaggaagatgaggaacgcgagtcaaaaagtcgcggaaaagttgagatcgaccagcagcagttaacccaacaacagctgaacggaaactag

SEQ ID NO: 199123 - DNA, 3075 bp, Artificial Sequence
  Description of Artificial Sequence: Synthetic coding sequence
atggccagcgtgcccgtgtactgcctgtgccggctgccctacgacgtgacccgtttcatgatcgagtgtgacatgtgtcaggactggtttcacggctcatgcgtgggggtggaggaggagaaggctgcggacattgatctctaccattgtccaaactgcgaagtgctacacggtccatctatcatgaaaaagaggcgaggttcttcaaagggacacgatacccataagggcaagcccgttaaaacgggctctcctaccttcgtgcgggagctccgcagtagaactttcgactccagcgacgaggttattctgaaacccaccggaaaccaactgacagttgaattcctggaagaaaattccttttcagtccccattctggtactgaaaaaggacggcctcggcatgactcttccgtcccctagtttcacggttcgcgatgtcgagcactatgtggggagcgacaaggaaattgacgtgatcgatgtcacacgccaggcagattgcaaaatgaagctgggcgactttgtcaagtattattattctggcaaaagggagaaagtgctcaacgttatttccctggaattcagcgatactcggctgtcaaacctcgtggagactcccaagattgtccgcaagctctcctgggttgaaaacttgtggcccgaggagtgtgtgttcgaaaggccgaatgtgcaaaaatattgcttgatgagtgtgcgtgactcctataccgacttccacattgacttcggcggtaccagcgtgtggtatcatgtgctgaaaggcgagaagatcttttacctgattcgcccaaccaacgcgaatttgacattgttcgagtgctggtctagttcatcaaaccagaacgagatgttcttcggggaccaagtggataaatgttataaatgctctgttaaacaggggcagactctttttatccctacagggtggatacacgctgtactgaccccggtggactgtctggccttcggtggaaattttcttcactctctgaatatagaaatgcagctaaaggcatacgaaatcgagaagagactatccacagccgacctgtttaggtttccaaatttcgaaactatatgctggtacgttgggaagcacatactggacatctttcgaggtctcagggaaaaccggcgccatccagccagttacctggtccatggggggaaggccctgaatttggcttttagagcatggacccgaaaggaggctcttcccgaccacgaagacgagatccctgagacagtgaggacagttcagttgatcaaagatctcgcaagggagatccgcctggttgaagatattttccagcaaaatgtcgggaagacaagcaacatattcggattacagaggatcttcccagcaggtagcatccccttgactcggccggcacattctacttctgtttcaatgtctcggctgtcactgccaagcaaaaacgggtccaagaagaaggggttaaaaccgaaggaattattcaaaaaggcagagcgaaagggcaaagaaagcagcgccctgggacctgccggacagctgtcttacaatctgatggatacatactcccatcaggcactgaaaactggatcgtttcagaaagctaagttcaatatcacaggtgcctgccttaacgactctgatgatgactccccagacctggatctggatgggaacgagagccctctggctttgttaatgtctaacggtagcaccaagcgggtcaaatcactatcaaagagtaggagaaccaaaattgccaagaaagtggacaaagcaagactcatggccgagcaagtgatggaggacgagtttgacctggattctgacgatgagttgcagatagacgagagactcggtaaggaaaaggccaccctgattattcgtccaaaattccccaggaagctcccccgggcaaagccttgcagcgacccaaacagagttagagaacccggagaagttgagttcgatattgaggaggattacaccactgatgaagatatggtcgaaggggtggagggaaagctcggtaacggtagtggtgcaggtgggatcctggacctccttaaagcttcaagacaggttggtggtcctgactacgccgccctcacagaggcaccggcgagcccttcaacacaagaggctatccagggcatgctgtgtatggccaacctgcagagcagtagttcctcccctgctacctccagcctgcaggcttggtggactggaggacaagatcgcagctccggaagctcctcgagtggtctcgggactgtcagcaatagcccggcctcccagcggaccccgggtaagcgacccatcaagaggccagcatattggagaaccgaatcagaggaggaggaggagaatgcatcactggatgagcaagattcacttggcgcgtgcttcaaggacgctgagtacatctaccccagcctagaatcagatgatgacgaccctgctctgaagtcccgtcccaaaaaaaagaagaactccgacgatgcaccatggtccccaaaagcacgtgtgacacccacccttcccaaacaggatagacctgtgagagaggggacccgcgttgcgtctattgagaccggactggcagcagcagcggccaagcttgcccagcaggagttgcaaaaagcccaaaagaagaaatacataaaaaagaagcccctcctgaaggaggtggaacaaccacggcctcaggactcgaatttatctttaacagtgccagctcccacagtagccgccactccacagctcgtgacaagcagcagtccattgccccctccggagcctaaacaggaggcactgagtggctccctggctgatcacgagtacaccgcacgccccaacgcgtttggtatggcccaagccaaccgaagcacaactccaatggcacctggagtttttctgacacaacgtaggccgtctgttggatcgcagagcaatcaagcgggacaggggaagaggcccaagaaaggcttagccacagctaagcagaggctgggtcgtattctgaaaattcaccggaacggcaagcttctattatag

SEQ ID NO: 199124 - DNA, 2847 bp, Artificial Sequence
  Description of Artificial Sequence: Synthetic coding sequence
atggccagcgtgcccgtgtactgcctgtgccggctgccctacgacgtgacacgcttcatgatcgaatgtgacatgtgtcaggactggtttcacggcagctgtgtgggtgtggaagaggaaaaggccgccgacatcgatttgtatcactgccctaactgtgaagtactacacgggccatcaattatgaagaagcgccgaggatcctccaaggggcatgacactcacaaggggaaacctgtgaaaacaggcagccccaccttcgtgagagaactgaggagccgcacttttgatagtagtgatgaggtgatccttaaaccaacggggaaccagctgaccgtggaatttcttgaggagaacagcttttctgtgcctattctggtgttgaaaaaagatggcctgggaatgaccctgcctagccctagtttcacagtaagagacgtcgagcattacgtcggctcagataaggaaatcgacgtgattgatgtcacacgacaggctgattgcaaaatgaaactcggcgattttgtcaaatactactacagtggcaagagagagaaggtgctgaacgttatttccctcgaatttagcgacactcggctgtccaacctggttgaaacccctaaaatcgtcagaaagctttcgtgggtggaaaacctgtggcccgaagagtgtgtatttgaacggcccaatgtgcaaaagtactgcctgatgtccgtgagggactcctatactgatttccatattgacttcggcggtactagtgtctggtaccacgtgctcaagggtgagaagatcttttatcttattcggcccaccaacgcaaacctgaccctgttcgaatgctggagcagcagttcaaatcagaatgagatgttctttggggaccaggtcgacaagtgctataaatgttccgttaagcagggtcagaccctcttcatccccaccgggtggattcatgcagtgttgacaccggtggactgcctcgcatttggagggaatttcttacactctctaaacatcgagatgcaactgaaggcctatgagatagaaaagcggcttagcacagccgacctcttccgcttcccaaacttcgagaccatttgttggtacgtagggaaacacattcttgacatcttcaggggtttgcgcgaaaatcggcgtcaccctgcatcctacctggtgcatgggggaaaagccttgaacctcgcctttagagcttggactaggaaagaagcactcccagaccatgaagatgagatacccgagacggttcggacagtgcagttgattaaggacctcgctagagaaatcaggcttgtcgagttcaacataacaggagcctgcctgaacgattccgacgacgactcccccgacctcgacttagacggcaatgaatcaccactggctctcctgatgtctaatggttccacgaagagggtgaaaagtctcagcaagtcacggcggactaagatcgccaaaaaagttgacaaggcacggctgatggcggagcaagtcatggaagacgagttcgacctggattctgacgacgagcttcagatcgacgagagactcggtaaggaaaaggccactctgatcatacgccccaagttcccgagaaagctgcctcgcgccaaaccatgttcggacccgaaccgcgtgagggaaccaggggaggttgagtttgacatcgaggaagattatacaacggacgaagacatggttgagggcgttgaggggaagttggggaacgggagtggcgccggtgggatcctagatcttctaaaggcctccagacaagttgggggccccgactatgccgcacttacagaggctcccgcttcacctagtactcaagaagctatccagggcatgctttgtatggccaacctacagagctcatcctctagtccagccacaagctcccttcaagcctggtggacaggggggcaggaccgttcctcgggttccagctcctcggggctaggcacagtttcgaacagccctgcaagtcagcggacccctgggaaacgccctattaagaggcccgcatactggagaacagagagtgaagaggaggaagaaaatgcaagtttggatgagcaagactccctgggtgcctgttttaaagacgcagagtatatatacccaagtctggaatctgatgacgacgacccagctcttaagagccggccgaaaaagaagaaaaacagcgacgacgctccttggtccccgaaagcccgcgttacccccactttacccaagcaggaccggcctgtgcgggaaggtacccgtgtcgctagcatcgagactggtctggctgctgccgctgctaagttggctcaacaggagctgcaaaaggcccagaaaaagaagtacattaagaaaaaaccgctgttgaaggaggtggagcagcctagaccacaggactctaacctgtcgcttacagttccggctcctacagtggccgcaacccctcagctggtcacatcatcttccccccttccccctcccgaaccaaagcaggaagccctttctggcagcctcgctgatcacgaatataccgcccggcctaatgcatttggtatggcccaggccaaccggagcacaaccccaatggcccctggcgtcttcctgacccaacggcgccccagtgtgggctctcaaagcaaccaggcgggccaggggaagcggcccaagaaagggctggcaaccgccaagcagcgtctgggtcggatcttgaaaatccatcgaaacgggaaactcctcctgagacaagttatcgtgcaggccgagtgtcgccaggctatccacgaacccaagctgaagaggagggacgctcacccctag

SEQ ID NO: 199125 - DNA, 3183 bp, Artificial Sequence
  Description of Artificial Sequence: Synthetic coding sequence
atgaaccggagccgggccatcgtgcagcggggccgggtgctgccccccccagcgcctctggacactactaatctggcaggacggcgtaccctccagggacgcgccaagatggcttcagtgcccgtttactgtctgtgtcgcctaccatacgacgttacgaggttcatgatcgagtgtgacatgtgccaggattggttccatgggtcctgtgttggcgtggaggaggaaaaggccgcagacatcgacttatatcattgtcccaattgtgaggtactgcacggcccttcgattatgaagaagagaagaggttccagcaaaggacatgatactcacaagggtaagcctgtcaaaaccggctcccccacatttgtgcgcgaactgaggagccggacctttgatagtagtgatgaggtcatcctcaaacctaccggcaaccagctgaccgtcgagtttctagaagagaattcatttagcgtgcccattctggttctcaagaaagatgggctgggcatgacattgccctcgcccagttttaccgtgcgagacgttgaacactatgtcgggagcgacaaagaaattgatgtgattgatgttacccgtcaggcggactgtaagatgaagctgggtgattttgtcaaatattattactctgggaagagagagaaggtcctgaacgtgatctcacttgagttctcagatacccgattatccaacctggtcgagactcccaagatcgtgagaaaactgagttgggtggagaacctgtggccagaggaatgcgtgttcgagaggccaaatgtgcagaagtattgcctcatgagtgtccgggactcttataccgacttccatattgatttcggaggtacgtccgtgtggtaccacgtgcttaagggggagaaaatattctatctgatccgccccactaacgccaatctcaccctcttcgagtgttggtccagttctagcaaccagaatgaaatgttcttcggagatcaggtggacaaatgttacaagtgtagtgtgaagcagggacaaacgctctttatcccaacaggctggattcatgcagtgctaaccccagtcgactgccttgcatttggaggcaacttcctccactctctgaatatcgagatgcagctgaaagcctacgagatcgagaagcgcctttctacagcagatctgttccgcttcccaaacttcgagaccatctgctggtacgtgggcaagcatatcctcgacatcttccgcggcctcagggagaacaggcggcaccccgcctcctatttagtccatggggggaaagcccttaacctggcctttagagcatggacgcgaaaggaggcactccccgatcacgaagacgagataccggaaacagtgcgaaccgtccaattgatcaaagacttggcgcgggaaattagactcgtcgaggacatttttcagcagaacgtggggaaaacctccaatatcttcggcttgcaaaggattttcccagcaggaagcatcccgttgacacgacccgcgcattccacctccgtgtctatgtccagactctccctgcccagtaaaaacggctccaagaaaaagggcctgaaacccaaggagctgttcaagaaagcagagagaaaagggaaggagtcttccgccctcggcccagccggccagctaagctataatctgatggacacctatagtcaccaggctttaaaaacaggctcctttcaaaaggcgaagtttaatataaccggagcttgccttaatgattccgacgatgattctcccgacctcgatctggatgggaacgagagcccgctggcactgctcatgtccaatggtagtaccaaacgggtgaaatctctcagcaaatccaggaggacaaagatcgctaaaaaggtggacaaagcaaggctgatggcagagcaagtgatggaagacgagtttgacctcgattcggatgacgaactccagattgacgagcgtcttggtaaggagaaggccaccctgatcatccggccgaagttcccacgcaaactgcctagagcaaagccgtgcagtgatcctaaccgcgtccgcgagccaggcgaggtagagttcgatatcgaggaggattatactaccgatgaagacatggtagaaggcgtagagggaaaactcggtaacggctccggggcaggcggaatcctggaccttttaaaagcatctcgccaggtgggcggccctgactatgcagccttaacggaagctccagctagcccctccacacaggaagctatccaggggatgttgtgtatggcaaatttgcagagctcatcaagcagccccgccacatcgagcctgcaggcctggtggaccgggggccaggatagatcctcaggttcttcgtcgtcagggctgggaacagttagcaatagccccgcaagccaacggacaccaggcaaaaggccaatcaaacggcctgcctattggcggaccgaaagtgaggaagaagaggagaacgcttctttggacgagcaggacagtctgggcgcctgtttcaaagatgccgagtacatttatccgtctctggagagtgatgacgatgatcctgccctgaagtctaggcccaaaaagaagaaaaatagtgatgacgctccttggagtcccaaggcccgcgttacccccactcttcctaagcaggacagacctgttcgagagggcactagagttgcttccatcgagactggcctcgcagctgctgccgctaaattagcacagcaagaattgcagaaggctcagaaaaagaaatatattaagaagaagcccctcctaaaggaggtggaacaacctcgtccccaagactcaaacctcagcctcacagtaccggctcctactgtggccgccacaccgcaattggtgactagcagcagcccgctcccgccaccagaacctaagcaggaggcattatccggctccctcgctgatcatgagtataccgcaaggcccaatgcgttcggcatggcccaagccaaccgatccaccacacccatggctccaggagtgttcttgacccagagacggccatctgtgggctcccagtcgaaccaggccgggcagggcaagaggccaaaaaaaggcctggcaacagcaaagcaacggctcggccggatactcaagatacacagaaacggaaagctgctgctgtag

SEQ ID NO: 199126 - DNA, 912 bp, Artificial Sequence
  Description of Artificial Sequence: Synthetic coding sequence
atggacacctacagccaccaggccctgaagaccggcagcttccagaaggccaagttcaatatcactggcgcatgtctgaatgactctgacgatgattctcccgatttggatttagatggaaatgagtctcctcttgcgctgctaatgtcgaacggctctacaaaacgtgtgaagtctctgagtaagagccgacgaacaaagatcgcaaagaaagttgataaagcccgcttaatggctgagcaagttatggaagatgaattcgatttggattcagacgatgagctacagattgatgaacggcttggcaaagagaaagctaccctcatcattaggcccaagttcccacggaagttgccgcgggcttcactggctctgaccccaaccgagttcgtgaaccaggagaaactcagtctgacattgcggcgaactattcagcagatgaggacttggtggaaagggctgaaagcaagcctggggatggtggtggccctggtcgcttttctgatctgttcccgacctgctgggagatggggtgatctgacaatgctcccttctcctaggccccagctgttgcccgctctaagacgaccaagccgtgcttgctgcgcttggcccacttgttctccacacaggccacaccgactgcctctcgcatgtcggccaggcgggttaggagaccggatcgaagccgttggcgccccagccgtggggtgggcacagtgtctgaccgtgctgcttccctccgcaccacaggggtcgggcccttcatccggccagcacacaggagaaccacgcgcccgcaggcgccgaagaactcccgtgtggatgaataggacagcttgggaaagggcgagccgaatgcagtctatctctatcttacactggtcactgatgatgatgacgctcctgtag

SEQ ID NO: 199127 - DNA, 2862 bp, Artificial Sequence
  Description of Artificial Sequence: Synthetic coding sequence
atcgtgcagcggggccgggtgctgcccccccccgcccccctggacaccacaaacctggccggccgtcgcactttacaagggagagctaagatggcaagtgttcccgtctattgtctttgcaggttaccctatgatgtgaccagatttatgatagagtgtgatatgtgtcaggactggtttcatggttcctgtgtgggagttgaagaggagaaggccgccgatatagacctgtatcattgcccaaattgcgaggtgctacacggtccttccataatgaaaaagagaaggggtagttctaagggccatgatacgcacaagggtaagccagtcaagactggcagccctactttcgtgagggagcttcgcagtaggaccttcgatagttcagacgaagtaatcctgaaacctactgggaatcaactgactgtggagtttctcgaggaaaatagtttttcggtgccgatcctggtgttaaagaaagatggactgggtatgacactgcccagtcccagcttcacagtgagggacgtggagcactatgtgggaagcgataaggagattgatgtaatagatgtgactagacaggcagattgcaagatgaaactaggcgacttcgtcaagtactattatagcggtaagcgagaaaaagttctgaacgtcatctcccttgaattttccgatactcgtctgtcaaacttggtagaaactcctaagatagtgaggaaactatcttgggtcgaaaatctctggccggaagaatgtgtgtttgagcgccctaacgttcagaagtactgtttgatgagcgtgcgggactcatataccgacttccatattgactttggcggtacttctgtttggtatcacgtgctgaaaggggagaagattttttatttaatccggccgacaaatgccaatcttacccttttcgagtgctggagctcctccagtaatcagaacgagatgttcttcggcgatcaagtcgataagtgctataagtgttccgtgaagcagggtcaaaccctgtttatccctacagggtggatccatgccgtactaactcctgttgactgtctcgctttcgggggcaactttctccattccctgaacatcgagatgcaactgaaggcctacgaaattgagaagcgtctgtcaacagccgacctttttaggttcccgaacttcgaaacaatctgctggtacgtgggcaagcatatactggacatctttcgcggcctgagagagaatcggagacatcccgcttcctatctggtccacgggggaaaggcactgaatctggcatttcgcgcgtggacacggaaggaagccttgcccgatcacgaagatgagatacctgagaccgtgaggacagtgcagctgatcaaggacttagcacgcgaaattcgactagtcgagtttaacattacaggcgcttgccttaacgactctgacgatgattccccggatctggatctagatggcaatgaaagccctctggccctgctaatgagtaacggatccaccaagcgcgtaaagtccctgtcgaagtccaggcggaccaaaatcgccaaaaaggtcgacaaagcaaggcttatggctgaacaagtgatggaagatgaattcgatcttgacagtgacgacgagctgcagattgatgaacggctgggcaaagaaaaggcaactttgataattcggccgaagtttcctcggaagctcccaagggcaaagccttgctctgaccctaatagagtccgggaaccgggcgaggtggaattcgacatcgaggaggattataccaccgacgaggacatggttgagggagttgagggcaaacttggaaatggcagcggggccggcggtatcctcgatctgttaaaagctagcagacaggtaggcggcccagactatgccgctctaaccgaggccccggccagcccgagcactcaagaggcaattcagggtatgctatgcatggccaacctgcagtcttcatcttcttcccctgccaccagtagcctgcaggcttggtggaccggggggcaggatagatctagcggatcgtcctcaagtggtttgggaactgtgagcaatagccctgcttctcagagaacccctggcaagcggcccatcaagcgtccagcttactggcgtacagaaagtgaggaagaagaggaaaacgcgagcctcgacgagcaggacagtctcggcgcatgttttaaggatgctgaatacatatatccgtctttggaatctgacgatgatgaccccgcacttaagagcaggcccaagaaaaagaagaatagcgatgacgcgccatggtcgcctaaggcacgggtgacacccaccctccctaaacaggatcgacctgtgcgcgaaggtactagggtggcgtctattgagaccggcctcgctgccgctgccgccaagctggcccagcaggaactgcaaaaggcccagaaaaagaaatacatcaagaagaaacctcttctgaaagaagtggaacagccccgaccacaggactctaacctgagcctgacggttcccgccccgaccgtcgctgccacgcctcaattggtgacaagttcctctccgcttcctcccccggagcctaaacaggaagctctttcagggtctttagccgatcacgagtacaccgcccgcccgaacgcttttggaatggcacaggctaatcggagcacaacaccaatggccccaggagtattcctgacgcagaggagaccctcagtcggatcacagagcaaccaggcagggcagggaaaaagacctaaaaaaggcttagcgaccgccaagcagcgcctgggacgcatcttgaagatccatagaaatgggaagctcctcctgtag

SEQ ID NO: 199128 - DNA, 345 bp, Artificial Sequence
  Description of Artificial Sequence: Synthetic coding sequence
atggccagcgtgcccgtgtactgcctgtgccggctgccctacgacgtgactaggttcatgatcgagtgcgatatgtgccaggactggtttcacgggtcatgtgttggggtggaggaagagaaggcagccgacatcgatctgtaccactgccccaactgcgaggtgctgcacggccccagcattatgaagaagcggaggggatcttccaagggccacgacacgcataaagggaaaccggtgaagactggctctccgacctttgttagggagctgcgcagtcggacctttgactcctccgatgaggttatcctcaagcccaccggtaatcaactgacagtggagtag

SEQ ID NO: 199129 - DNA, 381 bp, Artificial Sequence
  Description of Artificial Sequence: Synthetic coding sequence
atggccagcgtgcccgtgtactgcctgtgccggctgccctacgacgtgactcgttttatgatagagtgcgatatgtgtcaggactggttccatggctcttgtgtcggtgtcgaagaggaaaaggctgcagacattgacttataccattgcccaaactgcgaagtgctgcacggtccgagtattatgaagaaacggcgaggaagcagtaagggtcacgatacgcataaaggaaagccggttaaaaccggttcaccaacattcgtgcgagagctcaggagccggacattcgattccagtgatgaagtgattttgaaaccgactggcaaccaacttaccgtagaattcctggaagaaaattccttctccgtgcctatattatag

SEQ ID NO: 199130 - DNA, 294 bp, Artificial Sequence
  Description of Artificial Sequence: Synthetic coding sequence
atggccagcgtgcccgtgtactgcctgtgccggctgccctacgacgtgactcggttcatgattgagtgcgacatgtgtcaggactggttccatgggagctgcgttggcgtagaggaggagaaagccgcggatattgatttgtatcactgtcctaactgcgaggtgttgcacggcccgtccataatgaaaaagagacgaggttcctctaaaggacatgatactcacaaggggaagcctgtaaaaaccggcagccccactttcgtcagggagttgcgtagcagaacttttgattag

SEQ ID NO: 199131 - DNA, 348 bp, Artificial Sequence
  Description of Artificial Sequence: Synthetic coding sequence
atggccagcgtgcccgtgtactgcctgtgccggctgccctacgacgtcactcgttttatgatcgaatgtgatatgtgtcaagactggtttcatgggtcttgcgtgggcgtggaagaagaaaaggcggcagacattgatctgtaccactgccccaattgtgaagtgctgcatggtccgtccatcatgaaaaagcggcgcggaagcagcaagggacatgatacacacaaaggtaagcccgtgaaaaccggttcacccaccttcgtaagggaactgcggtcacgtacttttgactctagcgatgaagtgattctgaagcccaccgggaatcagcttacggtcgagttttag

SEQ ID NO: 199132 - DNA, 294 bp, Artificial Sequence
  Description of Artificial Sequence: Synthetic coding sequence
atggccagcgtgcccgtgtactgcctgtgccggctgccctacgacgttacacgtttcatgattgagtgtgatatgtgtcaggactggtttcatggctcgtgcgttggagtagaagaggagaaagcagcagacattgatctgtatcattgcccaaactgcgaggttttacatggacctagtattatgaaaaagaggagagggtcctccaagggccatgacactcataagggcaagccggtgaagactggctcccctaccttcgtgagagagctcagaagccggaccttcgactag

SEQ ID NO: 199133 - DNA, 447 bp, Artificial Sequence
  Description of Artificial Sequence: Synthetic coding sequence
atgaaccggagccgggccatcgtgcagcggggccgggtgctgcccccgcccgccccccttgacactacaaatctggcaggccggagaactctgcagggccgcgccaagatggccagcgtccccgtttattgtctctgtcggctgccttatgatgtcaccaggttcatgatcgagtgcgatatgtgccaggactggttccacggatcctgtgtcggggtggaggaagagaaggccgctgacatcgatttatatcattgccctaattgcgaagtgctgcacggccctagcatcatgaagaaacggagaggatcttctaagggacacgatactcacaagggtaaaccagtcaaaacgggctccccaacctttgtgagggaactccggagcaggacctttgatagcagtgatgaagtcatcctgaaacctactgggaaccagctgacttag

SEQ ID NO: 199134 - DNA, 2637 bp, Artificial Sequence
  Description of Artificial Sequence: Synthetic coding sequence
atggccagcgtgcccgtgtactgcctgtgccggctgccctacgacgtcacacgcttcatgattgagtgcgacatgtgtcaagattggttccatgggagctgtgtgggagtggaggaggaaaaggccgccgacatcgacctatatcactgcccaaactgcgaggtgcttcacggaccttcgataatgaagaaaaggcgaggtagtagcaagggccatgatacacataaagggaaaccggtcaagaccggatccccaactttcgttcgggagctgaggtcaagaacgttcgattccagcgacgaagtgatcctcaaacctaccgggaaccaactgactgtagagttcctcgaagagaatagcttcagcgtccccatcctggtcctgaagaaggatgggctgggcatgacacttcccagcccatcttttactgtccgggatgtagaacattacgtagggtcagacaaagagattgacgtgatcgacgtcacacgccaggccgactgcaagatgaagctcggggactttgtgaaatactactattccgggaaacgtgaaaaagtgttaaatgttatctctctggagttttccgacacccgattgtcaaacctagtggaaaccccgaagatcgtcaggaagttgagctgggttgaaaacctgtggccagaagagtgcgtctttgagaggcccaatgttcagaagtactgcttgatgtctgttcgcgacagctataccgattttcatattgactttgggggcactagcgtatggtaccacgttctaaagggggagaaaatcttctacttgatacggccaacaaacgccaacttaaccctgttcgagtgctggtcgagctcttcgaaccaaaatgagatgtttttcggtgaccaggtagacaagtgttataagtgctctgtcaagcagggccaaactctatttatacctacgggttggatccatgccgtgctaactccagtagactgtctagcttttggtggcaacttcctgcatagccttaacattgaaatgcagctcaaagcttacgaaatcgaaaaaaggctgagcacggccgatctgtttcgttttccaaattttgagacaatttgttggtacgtgggcaaacacattcttgatatcttccggggcctccgtgagaaccgccggcatcccgctagctatctagtgcacggtggaaaagctcttaatctggcattcagagcctggacacggaaagaggccttgcccgatcacgaagacgagataccggagacagtgaggaccgttcagttaatcaaggaccttgcgagggaaattcggctggtcgaggacatattccaacaaaacgtgggtaaaaccagcaatatcttcggtctgcagcgtatctttccagctggctcaattcctctcacccggccagcacattccacatccgtctctatgtccagactcagtctcccatcaaagaacggaagcaaaaagaaaggtctgaagcccaaagagctctttaaaaaagccgagcgaaaaggaaaagaatccagtgcgctgggaccggccgggcagctcagttacaatcttatggatacttacagccatcaggcgcttaaaacagggagcttccagaaggccaaatttaatataacaggtgcatgtcttaacgactccgatgatgacagccccgatctggacttagacggaaatgaaagccccttagcactactcatgagcaatggctcaacgaaaagagtcaagagtttgtccaagtccaggcgtacaaagatcgccaaaaaggtagataaagctagactgatggctgagcaggtgatggaggatgaatttgacctggattccgatgacgaactacagattgatgagagactgggtaaagagaaggcaactctcataatccgacccaaattccccagaaagctcccgagggccaagccctgtagtgatccgaatcgagtgagggaaccgggcgaggtggaatttgacattgaggaggattatacgacagatgaggatatggtggagggcgttgaagggtaccagacagctacccccgcaccagcacaaggggcctctgaggcgccagcctctccaagcactcaggaagctatccaggggatgctttgtatggccaacctgcagtcttcttcatcttctcccgcgactagctccctgcaagcctggtggactggaggtcaagaccggtcttcaggaagttcttcatccgggctcggcaccgtgagcaacagccctgcctcccagcgaactcccggcaagaggccaatcaagcgccctgcctactggaggaccgagtccgaggaagaggaggagaacgcctcgctggatgagcaggatagcctgggcgcctgcttcaaggatgcggagtacatttaccccagtttggaaagcgacgacgatgacccagcactaaaaagtaggcctaagaagaaaaaaaactctgacgatgctccctggtcccctaaggctcgagtaacgcctacgctgccaaagcaagatcgacctgtgagagaaggtacgcgagtggccagcatcgaaaccggcctcgcggcggccgccgccaaactcgctcagcaagtgaaaaagatgaaactctcactgaccgattccggctag

SEQ ID NO: 199135 - DNA, 417 bp, Artificial Sequence
  Description of Artificial Sequence: Synthetic coding sequence
atgaagctgcccatcttcatcgccgacgccttcaccgcccgggccttcaggggcaacccagccgcagtctgcctcctcgagaacgagctggacgaggacatgcaccagaagatcgctcgggaaatgaatttgtccgaaacagctttcatccgcaagctccatcctaccgataatttcgcccaaaaaaacatgaactctacacttaccttcgtgactctcagtggtgaattgagggctaggcgcgcagaggacggtatcgttctggacctgcccttgtaccctgcccacccacaggatttccatgaggtggaagacctcattaagaccgccattgggaacacattggtgcaagatatctgctacagcccggatacccagaaattgctcgttcgcctttctgacgtctacaacagatag

SEQ ID NO: 199136 - DNA, 867 bp, Artificial Sequence
  Description of Artificial Sequence: Synthetic coding sequence
atgaagctgcccatcttcatcgccgacgccttcaccgcccgggcctttcggggaaatcccgccgctgtgtgtttgttggagaacgagctggatgaagacatgcaccagaagattgctagggagatgaacctgagcgagaccgcctttatccgcaagcttcaccccaccgataactttgcccagagcagctgctttgggcttcgctggtttacacccgcaagtgaggtaccgttatgtgggcatgccaccctagcctccgccgcagtcttgtttcacaagatcaaaaatatgaactccacactgacctttgtgacgctgtcaggggaactgagggctcgccgcgctgaggatgggatcgtgctggatcttcccctgtatcctgctcacccacaagattttcatgaagtggaagacttgattaagactgccattgggaatacgttggtgcaggacatctgctattcccccgatacacagaaactccttgtccgcctttccgacgtgtacaaccgatcgttcttggagaacttgaaagttaacacagaaaatcttttacaggttgagaatacagggaaggtgaagggcttgattttgacattaaagggggagcctggggggcagacacaagcttttgacttctactcacggtatttcgctccttgggtcggggtcgctgaggatcccgtaacagggagcgcccacgccgtgttaagcagctactggagccagcatttgggcaaaaaagaaatgcacgcatttcagtgcagccacaggggcggcgaattaggtatcagcctgcgacccgatggtcgagtcgacattagagggggagccgcagtcgtccttgaagggacactgactgcttag

SEQ ID NO: 199137 - DNA, 768 bp, Artificial Sequence
  Description of Artificial Sequence: Synthetic coding sequence
atgcaccagaagatcgcccgggagatgaacctgagcgagaccgcctttattcggaagctgcatccgactgataactttgcgcaatcatcttgcttcggcctcagatggttcacacccgcctcagaggtgccactctgtgggcatgcaaccctcgcaagcgcagccgttctcttccataaaattaagaatatgaactcaactcttacattcgtaactttgtctggcgagctgcgagccaggcgtgccgaggatggtattgtgcttgacctgccgctttaccccgcccatccgcaggattttcatgaagtcgaggatttaataaagaccgccattgggaatactctggtacaggacatatgctattcccctgacacacagaagctcctggtgaggctgtctgacgtgtataaccgatccttcctggagaacctgaaggttaacacagagaacctgctccaggtcgagaacaccggcaaggtcaaggggctgatcctcactctgaagggagagcccgggggacagacccaggctttcgatttttactcccgatattttgccccctgggttggagtagcagaggaccccgttactgggagtgctcacgctgtcttatcctcctattggagccaacacttgggcaagaaagaaatgcatgctttccaatgctcccaccggggtggggagctaggcattagcctgcgccccgacggacgcgttgatattcgagggggggccgctgtcgtcttggagggcactctgaccgcctag

SEQ ID NO: 199138 - DNA, 867 bp, Artificial Sequence
  Description of Artificial Sequence: Synthetic coding sequence
atgaagctgcccatcttcatcgccgacgccttcaccgcccgggcctttcgggggaatcccgcggcagtgtgtctgcttgaaaatgagttagatgaggatatgcatcagaagattgcaagggaaatgaaccttagcgagacagctttcatccgcaaactgcatccgactgacaattttgcacagtcatcctgctttggtctgcggtggtttacccctgcctccgaggtgcctctctgtgggcatgcaaccctcgcctccgcggccgttctcttccacaagataaaaaacatgaactcgactctaacatttgtcacattatcaggcgaattgcgcgcacgccgagccgaagacggcatcgtgcttgatctgcctttgtacccggcccatccgcaagatttccacgaggttgaggatttaattaaaaccgctattggcaatacactggtgcaggacatctgctattccccagacactcaaaaactactggtgcgcctgtccgacgtttacaaccggtcctttctggagaacctcaaggtgaatacggaaaatttactgcaggtggagaataccggcaaggttaagggtctgattctcacactcaaaggggagccaggaggccaaacccaggcctttgatttttactctcgctacttcgctccctgggtgggggtcgccgaggaccctgtgacgggcagcgcgcacgcggtcctctcttcatattggtctcagcaccttgggaagaaggagatgcatgcattccagtgcagccaccgtgggggggaactgggcatatcactgcggccagatggccgggtggacatcagaggtggagccgccgttgtgcttgagggtacgttaaccgcatag

SEQ ID NO: 199139 - DNA, 843 bp, Artificial Sequence
  Description of Artificial Sequence: Synthetic coding sequence
atgaagctgcccatcttcatcgccgacgccttcaccgcccgggcctttcgggggaatcctgcagctgtctgcctgctggagaacgagctggatgaggacatgcaccagaagatagcaagagaaatgaatttatcggagacggccttcattagaaagcttcatccgacggacaatttcgcccagtcttcttgtttcggactgcggtggttcacccccgcctccgaagtgcccctgtgtggacacgctacgctagcttctgccgcagtgcttttccacaagatcaagaacatgaacagtacactaacttttgtcacactgagtggagaactccgcgcaaggcgggccgaggatgggattgtgctcgacttgcctctgtatcctgcccacccgcaggattttcacgaagttgaagatctaattaagaccgctattggcaataccctagttcaggacatctgctactcccctgacactcaaaaactgctcgtcaggttgagtgacgtttataatcgcagtttcctggaaaacctcaaagtcaacactgaaaatctgctgcaggtggaaaatactggaaaagttaagggcttaattctcacactgaaaggagaacctgggggtcagactcaggcatttgatttctactcaagatactttgctccctgggtgggggtggctgaggatcccgtcactggttctgcgcatgctgtccttagcagctactggtctcagcacctgggcaaaaaagaaatgcatggaaggacagctctttaccagtttctgttctatttgcccaattctaagctggtgtttctgctaatatgtaccattcctctcaagatgtag

SEQ ID NO: 199140 - DNA, 1356 bp, Artificial Sequence
  Description of Artificial Sequence: Synthetic coding sequence
atggtgggcagcgccctgcggcggggcgcccacgcctacgtgtacctcgtgagcaaggcttcccacatctcgcgcggtcaccagcatcaagcttggggctccaggccccccgcagccgagtgcgctacccagcgcgcccctggctccgtggtcgaacttcttggcaagagctatccacaagatgatcactccaacctgactcgaaaagtattaacccgcgtaggccgcaatctgcataaccagcagcaccacccattgtggctgattaaagagcgcgtaaaggagcacttttataagcagtacgtgggtcggttcggcactcccctctttagcgtgtatgataatctctctccagttgtaactacctggcagaatttcgactctttactgattccggccgaccatcccagcaggaaaaaaggggacaattactatttgaataggacacacatgctgagggcgcacacttccgcacatcagtgggacctcctgcacgccggcttggacgctttcctggtcgtcggggatgtatatcggcgggatcagatagatagccagcattatccgatttttcatcagctggaggcggtcagattatttagtaagcatgagctgttcgctggcattaaggatggtgaatccctgcagttgttcgagcagtctagcagaagcgctcacaagcaggaaacacacaccatggaagctgtaaaactggtcgaattcgacctgaagcagacgctgacccgcctgatggcacatttatttggcgacgagctcgagataagatgggtggattgttatttcccatttactcatccatcatttgagatggaaatcaattttcacggagagtggctggaggtcttgggatgtggcgtcatggagcagcagctggttaactctgctggggcccaggaccgtattgggtgggcgtttggtctcgggcttgaacgcttagcgatgattttgtacgatattcccgacataaggctcttttggtgcgaagatgaaagattcttaaagcagttctgtgtcagcaatatcaaccagaaggtgaagtttcaacctttatcgaaataccctgcagtaattaatgatatcagcttttggctcccaagcgaaaactatgccgagaacgacttttatgatctggtgagaactattggcggagatttagtcgaaaaagtggacctaatcgacaaatttgtccacccaaaaacccacaagacctcccactgttaccgcatcacctatagacacatggagagaaccctgtctcaaagggaagtgaggcatatccaccaggctcttcaggaggccgccgtgcagttgcttggagtggaagggagattttag

SEQ ID NO: 199141 - DNA, 1356 bp, Artificial Sequence
  Description of Artificial Sequence: Synthetic coding sequence
atggtgggcagcgccctgcggcggggcgcccacgcctacgtgtacctggtgagcaaagccagtcacatatctcggggccaccaacaccaagcctggggaagcaggccgcctgccgctgagtgcgcaactcaacgggcgcccggaagtgtagtcgaactactcggcaaatcatatccccaagatgatcactctaatctgactcggaaggtgctgacaagagtagggcggaacctccacaatcagcaacaccatcccttatggttgattaaggaaagggtcaaagaacacttttacaaacagtatgttgggcggttcggcacacctctttttagcgtgtatgacaacctctccccagtcgttaccacatggcagaattttgactctctcttgataccggccgatcacccttctcggaagaagggagacaactactatcttaataggacgcacatgctgagggcgcacacgtctgcgcatcagtgggatctgttgcacgccggcctggacgcgtttctcgtggtgggagatgtctaccgaagggatcaaattgactctcagcactacccaattttccaccagctggaagcggtgcggcttttttctaagcacgagcttttcgctggaataaaagacggggagtccctgcagctgttcgagcagagttctaggagtgctcataagcaggagacccacaccatggaggcagtaaaattagtagagtttgacttgaagcagaccctcactaggcttatggcccatctgtttggggacgaactggaaatcaggtgggtagattgttatttcccctttacgcatccctctttcgaaatggagatcaattttcacggcgagtggctggaggtcctcggctgcggagtgatggagcagcaactagtgaatagtgcgggggctcaagataggatcggatgggccttcgggttaggactggagcggctggctatgattctgtacgatatcccagatatcagactgttttggtgtgaagatgagcggttccttaaacaattctgcgtttcgaatattaatcaaaaagtgaaatttcagccattgtctaaatatccagctgtgatcaacgacatctccttctggttaccctccgagaactatgctgaaaacgacttttatgacttggtgagaaccataggaggggatctcgtggagaaggtggacctcatcgataaattcgtgcatcctaagacccataaaactagccactgctaccgcatcacctataggcatatggagcgcacattgtctcagcgggaagttagacacatccaccaagctctgcaggaggcagcagtccagttgctgggcgtggagggacgtttctag

SEQ ID NO: 199142 - DNA, 468 bp, Artificial Sequence
  Description of Artificial Sequence: Synthetic coding sequence
atgctgcgggcccacaccagcgcccaccagtgggacctgctgcacgccggactcgacgctttcctcgtggtcggcgatgtgtaccgacgggatcagattgactcacagcactaccccatcttccaccagctcgaagccgtgaggttgttttccaaacacgagctgtttgccgggatcaaagacggcgagtcactacagctgtttgagcagtcatcccgctcggcccataagcaagaaacacacactatggaagcagtgaagctggtggaatttgatctgaaacagactcttacgcgcctgatggctcacctatttggggacgaactggagattcgctgggtggattgttatttcccctttacccacccgagttttgagatggagatcaatttccatggggagtggctggaagtcctgggatgcggagtcatggagcaacagctcgttaattctggaggggctacttag

SEQ ID NO: 199143 - DNA, 306 bp, Artificial Sequence
  Description of Artificial Sequence: Synthetic coding sequence
ctgttcgccggcatcaaggacggcgagagcctgcagctgttcgagcagtcttcgagatctgcacataaacaagaaactcatacaatggaggcagtcaaactggttgagttcgacctgaagcaaaccctgactagactgatggcccacctgttcggtgacgagctggagatccggtgggtggattgttactttcccttcacacatcccagtttcgaaatggagatcaacttccacggagagtggttggaggtcctgggttgcggcgtcatggaacagcagctcgtaaatagcggaggagccacgtag

SEQ ID NO: 199144 - DNA, 849 bp, Artificial Sequence
  Description of Artificial Sequence: Synthetic coding sequence
atgagcggcgccgaccggagccccaacgccggcgccgcccccgacagcgctcctggccaggccgctgtcgccagcgcttaccagagattcgagcccagagcctacctcaggaacaactacgcgccccctagaggcgacctgtgcaaccccaatggcgtgggcccatggaagctgcgttgtctggcccagaccttcgctaccggagaagtctctgggcgcacgctcatcgacatcggtagcgggcctaccgtctatcagctgctgagcgcatgctcgcatttcgaggacattaccatgaccgacttccttgaggtcaatcgccaggaactcggccggtggctgcaagaagaaccaggggcctttaactggtccatgtacagccaacacgcctgcttgatcgaagggaagggcgagtgctggcaggacaaggaacgccagctgcgagcgcgtgtcaaaagagtgctgccgatagatgtgcatcaaccacagccattaggggcaggctcaccagctccactgcccgcagacgcattggtatctgcattctgcttggaggctgttagccccgacctcgcttcctttcagcgggcactcgatcacattactacgctgttgcgcccaggaggtcatcttctccttattggtgccctggaggagagctggtatctggctggcgaggcacggctaacagttgtgccagtgagcgaagaagaagtccgagaggcgctggtcaggagtggatacaaagtgcgcgaccttcgcacctacataatgcctgctcatcttcaaactggagttgacgacgtgaagggggtttttttcgcctgggctcagaaagttggtctgtag

SEQ ID NO: 199145 - DNA, 555 bp, Artificial Sequence
  Description of Artificial Sequence: Synthetic coding sequence
atgaccgacttcctggaggtgaaccggcaggagctgggccggtggctgcaggaagaacctggcgcattcaactggtctatgtattcccaacacgcctgcctgatagagggaaagggtgaatgctggcaggacaaggagcggcagctgagggcccgagtcaaaagggtgctgcctatcgatgttcaccagcctcaacccctgggcgcgggctcaccagctcctctccccgcagatgccctggtgtctgccttttgcttggaagcagtttccccggacctcgcctctttccagagggccctggaccacatcactacactgctgaggccagggggccatttgttgctgattggggccctggaggaaagctggtacctggctggagaagcacgattgaccgtcgtgcctgttagcgaagaggaggtgcgagaggctctcgtacgcagtggttacaaggtgagggacttacgaacatatattatgccagcacacttgcagactggggttgatgacgtgaagggagtgtttttcgcatgggcccagaaggtgggactgtag

SEQ ID NO: 199146 - DNA, 741 bp, Artificial Sequence
  Description of Artificial Sequence: Synthetic coding sequence
atggaggaggccaagagccagagcctggaggaggacttcgagggccaggcaacgcacactgggcctaaaggggtgataaatgattggcgaaagttcaaacttgagagccaggactctgattccatccccccctccaaaaaggagatcctccgacagatgtcaagtccacagagcaggaatggcaaagactctaaggagcgcgtatccaggaaaatgtcaatccaggaatatgagctgatccataaggagaaggaggatgagaattgcctgaggaagtaccggcggcagtgtatgcaggatatgcatcagaagctcagctttggccctcggtacgggttcgtgtacgagctcgagaccggcaagcaattcctggaaaccatagaaaaggagctcaagattacaacaatcgtcgttcacatctacgaagacggtatcaagggctgtgacgctttgaactccagcctgacctgtcttgccgccgagtatcccatcgtgaagttttgtaaaatcaaggctagtaacaccggcgccggggacaggttctccctcgacgtactacccacccttttgatttacaagggtggggagttgatttccaattttatctcggtggctgagcagttcgccgaagaattctttgccggggatgtggagtcctttctgaacgaatatgggctactgcctgagcgcgaagtgcacgtcctcgaacacaccaaaatcgaagaggaggacgttgaatag

SEQ ID NO: 199147 - DNA, 741 bp, Artificial Sequence
  Description of Artificial Sequence: Synthetic coding sequence
atggaggaggccaagagccagagcctggaggaggacttcgagggccaggccactcacactgggcccaaaggggtgataaatgactggcgtaagtttaagctggaaagtcaggactccgattcgataccacccagtaaaaaggagattctacgccagatgtctagtccgcagtcccggaacggcaaggattctaaagagagagtgtctcggaagatgtctattcaggagtatgaactaatacataaagagaaagaagacgagaactgtctccggaagtaccggcgacagtgcatgcaggatatgcaccagaagctgtcctttggcccccgctacgggttcgtttatgaactggaaacagggaaacaatttcttgaaacaatcgaaaaggagttaaaaatcacaactattgtagttcacatctatgaggacgggataaagggatgtgatgccctcaacagcagcctgacttgcctagccgcggagtaccctattgtgaagttttgtaagatcaaagcctccaatacaggagccggggatagattctctttagatgttttgcctacgctcctgatctacaaagggggagaactgatcagcaactttatctcggtggccgaacagtttgctgaagaattttttgctggagatgtggaatcattcctgaacgagtacggcctgcttccagagagagaagtgcatgtattagagcatacgaaaatagaagaggaagacgtcgaatag

SEQ ID NO: 199148 - DNA, 585 bp, Artificial Sequence
  Description of Artificial Sequence: Synthetic coding sequence
atgagcagcccccagagccggaacggcaaggacagcaaggagcgggtcagcaggaaaatgtctattcaggaatacgaactgatccataaggagaaggaagatgagaactgtttgaggaaatacagacggcagtgcatgcaggatatgcaccagaagctgagcttcggcccccggtacgggtttgtctatgaattagagactgggaaacaattcttagagaccatcgaaaaggaactcaaaataaccactatcgtggtgcatatctacgaggacggcattaaagggtgcgatgccctgaatagtagtctgacttgcctcgccgcggagtatcccattgttaagttctgcaagatcaaggccagtaatactggagccggggacagatttagtcttgatgtcctccctaccttgctcatttataaggggggagaactgatctcaaactttatttccgtggctgagcagttcgccgaagaattctttgctggcgacgtggaaagcttcttgaacgagtacggattgctcccggaaagagaagtgcacgtgctggagcacacaaagattgaggaggaggatgttgagtag

SEQ ID NO: 199149 - DNA, 585 bp, Artificial Sequence
  Description of Artificial Sequence: Synthetic coding sequence
atgagcagcccccagagccggaacggcaaggacagcaaggagcgggtgtctaggaaaatgagcattcaggagtacgagttaatacataaggaaaaagaggacgagaattgtctccgcaagtatagaaggcaatgcatgcaggatatgcatcaaaaactcagctttgggcctaggtacgggtttgtgtatgaactggagaccgggaagcagtttctggagacgatcgaaaaggagcttaagatcactacaattgtcgtacacatctacgaggatggaattaaggggtgcgacgccctcaattccagcttgacatgtttagccgccgagtatcccattgtgaaattctgtaagatcaaagcctctaacacaggcgccggagatcgtttctcgcttgatgtcctccctaccttgctcatctataagggcggggagcttattagcaatttcattagcgtggccgaacagttcgcagaagagtttttcgccggggatgtggaatcatttctgaacgaatatggtttactcccagagagagaggtgcacgtgttggagcacacaaaaatcgaagaggaggatgtggaatag

SEQ ID NO: 199150 - DNA, 906 bp, Artificial Sequence
  Description of Artificial Sequence: Synthetic coding sequence
atgaccaccctggacgacaagctgctgggcgagaagctgcagtactattacagctcaagcgaagatgaggattctgaccacgaagacaaggatagaggcagatgcgcccctgccagttcgtccgtccctgcggaggcggagcttgccggtgagggcatctctgttaacaccggcccaaaaggtgtcatcaacgactggcgacgcttcaagcagttagagaccgagcagcgcgaggagcaatgtcgggagatggaaagactgattaagaaattaagcatgacttgcaggtcccacttagatgaggaggaagagcagcagaaacaaaaagacttgcaagaaaagatttcaggtaaaatgaccctgaaagaatttgcaatcatgaatgaggatcaagatgacgaagagtttctgcagcagtacagaaaacagcggatggaggagatgcgtcaacagctgcataagggaccccagttcaaacaggtgttcgagatctcatctggcgaggggttcctagacatgatcgataaggaacagaaaagtatcgtcattatggtccacatctacgaagacggtatcccgggaacagaggctatgaatggatgcatgatttgcctggccgctgagtatccagccgtcaagttttgcaaagtaaaaagctcggtgattggggccagttcccagttcaccaggaatgcgcttccggccctgttgatttataaagggggtgaattgattgggaactttgtgagagtgaccgaccaactgggtgacgacttcttcgctgtcgatttggaggctttccttcaggagtttggacttctgcctgagaaggaggtgcttgtgctgacgtccgttaggaactccgcaacctgccacagcgaagattcggaccttgaaatagattag

SEQ ID NO: 199151 - DNA, 330 bp, Artificial Sequence
  Description of Artificial Sequence: Synthetic coding sequence
tgactgcagtactactacagcagcagcgaggacgaggacagcgaccacgaagacaaagacaggggccggtgtgcccctgcttcctcgtctgtccctgccgaggctgaattggccggtgagggcattagcgtcaacacaggaccgaaaggcgtgatcaacgactggagaagattcaagcagttagagaccgagcagagagaggaacaatgtagagaaatggaacgtctcattaaaaagctttccatgacttgccgctcgcatctggatgaggaggaggagcagcagaaacagaaggacttacaggaaaagattagcgggaaggaacgctag

SEQ ID NO: 199152 - DNA, 276 bp, Artificial Sequence
  Description of Artificial Sequence: Synthetic coding sequence
tgatgcgcccccgccagcagcagcgtgcccgccgaggccgagctggccggggaaggcatttccgtaaacactgggccgaagggggttatcaacgattggcgcaggtttaaacagctcgagacagagcaaagggaagagcagtgtagggagatggaaagactgatcaaaaaactgagcatgacttgtagatcacatctggatgaggaggaggagcagcagaaacagaaggacctccaggagaaaatcagcggaaaaaaaagctgggctattttgtag

SEQ ID NO: 199153 - DNA, 726 bp, Artificial Sequence
  Description of Artificial Sequence: Synthetic coding sequence
atgcaggaccccaacgaggacaccgagtggaacgacatcctgcgggattttggaattctgccgcccaaagaggaatcaaaagatgaaattgaggagatggtcttaagactacagaaagaggcgatggtgaagccctttgagaagatgacactggcacagttgaaggaggcggaagatgagtttgatgaggaagacatgcaggccgtcgaaacatacagaaagaaacggttgcaggaatggaaggccttaaaaaagaagcagaagtttggtgagcttcgcgagatttcagggaaccagtacgtgaacgaggtcaccaacgccgaagaggacgtttgggtgatcatccatttgtatcgttcatccattccgatgtgtctcctggtgaaccaacatctgagcctcctggcgcgcaagttcccagaaaccaaattcgtgaaggctatcgtcaactcatgtatccagcattaccacgacaactgtctaccgaccatttttgtctacaaaaacggccaaatcgaggctaagttcattggcataatagaatgcggtgggattaatctgaagctcgaggagcttgagtggaagttggctgaagttggggcgattcaaacggacctcgaagagaatccccggaaagatatggtggacatgatggtgtcctccattcggaacaccagcattcacgatgattccgactccagcaatagcgataacgacacaaaatag

SEQ ID NO: 199154 - DNA, 720 bp, Artificial Sequence
  Description of Artificial Sequence: Synthetic coding sequence
atgcaggaccccaacgccgacaccgagtggaacgacatcctgcggaagaaagggatcctgcctcccaaagagagtttgaaggaactcgaggaagaagctgaggaggagcagcggatccttcaacaaagtgtggttaagacctacgaagatatgactctggaagaattggaggaccatgaggacgagttcaatgaagaggatgagagagctattgagatgtaccgccgccgtcgactagcagaatggaaggccactaagctcaaaaataagtttggggaagtgttggagatcagcggtaaagactatgtccaggaggtgacaaaggcaggagagggcctgtgggttatcctgcatctatataagcagggcatccctctgtgtgccctgattaaccagcatctctctggtctggcgcgtaagttccccgacgtgaagttcataaaggcgattagtacaacttgtatacccaactaccctgatcgcaacttaccaaccatatttgtgtatctagagggagatatcaaagcccagttcatcgggccgctggtgtttggcggcatgaatttgacccgagatgagctcgaatggaagctatctgaaagcggagccattatgacagacctggaagagaacccaaagaagcccattgaagacgtgctcctgtcctcagtaaggcggagcgtcttgatgaagcgcgactcagatagcgaaggcgactag

SEQ ID NO: 199155 - DNA, 1104 bp, Artificial Sequence
  Description of Artificial Sequence: Synthetic coding sequence
atggacgcccagtgcagcgccaaggtgaacgcccggaagcggcggaaggaagctcccggccccaacggagccactgaagaagatggcgtccccagcaaagttcagcgctgcgccgtgggtcttcggcagccagcgcccttttccgacgaaatcgaagtcgactttagtaagccttatgttcgggttacaatggaagaggcatcccgcggtacaccttgcgagagacccgtgcgtgtttatgccgacggcatttttgacctctttcactccggtcacgcacgagctctgatgcaagcaaagaatctttttccaaacacttacctgatcgtgggggtgtgttccgacgagttgactcacaatttcaaaggttttaccgtgatgaacgaaaacgagcggtatgacgccgttcagcattgtcgctacgttgacgaggtggtccggaatgctccatggaccctcacacccgagtttctggccgagcaccgcattgattttgtcgctcatgacgatatcccatattctagtgccggatctgacgatgtgtacaagcacatcaaagaagctgggatgttcgcccctacgcaacgcactgaggggatctcaaccagcgacattattaccagaatcgttcgggactacgatgtctacgccagacgaaacctgcaaagagggtacacagctaaagaactgaacgtgtcattcatcaacgaaaagaagtatcacctccaggaaagagtcgacaaagtgaaaaaaaaggtgaaggatgtggaggagaagtctaaggagtttgtgcagaaggtggaagagaaatccatcgatctcattcagaagtgggaagagaaaagcagagagtttatcgggagcttcctggagatgttcggcccagagggggctctgaaacatatgttgaaagagggaaaggggcggatgctgcaggccatttcccctaaacagagcccatcctcttctccaaccagagagaggtctcctagcccttcattccgctggcctttttccggaaagacctctcccccatgctcacctgctaatctcagtcggcacaaggcggcggcttacgatatttccgaggacgaggaggattag

SEQ ID NO: 199156 - DNA, 882 bp, Artificial Sequence
  Description of Artificial Sequence: Synthetic coding sequence
atggacgcccagtgcagcgccaaggtgaacgcccggaagcggcggaaggaagcccctggcccgaacggcgcaacagaggaagatggcgtgccatccaaagttcaaagatgcgccgtgggattgcgtcaacccgcgccattttctgatgagatcgaggttgatttcagcaaaccatacgtccgagttactatggaggaggcctcccgaggcaccccatgtgagcgccccgtgcgcgtctacgccgatgggatttttgacctgtttcactccggtcatgcccgtgcgctaatgcaagctaaaaacctctttcctaacacatacctaatagtaggggtatgcagcgatgagctcacccacaacttcaaaggtttcaccgtgatgaacgaaaacgagcggtatgacgctgtgcaacattgccggtatgtagacgaggtagtcaggaatgccccatggacactcactcctgagttcctggccgaacacagaattgactttgtggcccatgacgatattccctactcgtctgctgggtctgacgatgtctacaagcacatcaaggaagcgggtatgttcgccccgacccagcggactgagggtatcagcacatcagatatcatcactcggatagtgcgggactacgacgtctatgcacgtaggaacctgcagcgcgggtacaccgccaaggagcttaatgtgtcctttatcaatgagaaaaaataccacctgcaagagagagtggataaggtcaagaagaaggttaaagatgtggaggagaagtctaaagaattcgtccagaaggtggaagaaaagtccattgatctgatccagaagtgggaggaaaagtccagggaattcataggctccttcctggagatgttttag

SEQ ID NO: 199157 - DNA, 402 bp, Artificial Sequence
  Description of Artificial Sequence: Synthetic coding sequence
atggacgcccagtgcagcgccaaggtgaacgcccggaagcggcggaaagaggcccccggcccaaatggggctactgaggaggatggagtgccctctaaagtgcaacgatgcgccgtagggctaaggcagccggctcctttcagcgacgagatcgaggtcgatttctcaaaaccttacgttcgtgtaaccatggaagaggccagtagggggaccccctgtgaacggcccgtgcgggtgtatgccgacggtatttttgacctgttccattctggtcacgctcgagctctcatgcaggctaaaaatctttttccgaacacctatctgattgtcggagtgtgcagtgacgagctgacccacaattttaaagggtttacagtcatgaacgaaaacgaaaggtattag

SEQ ID NO: 199158 - DNA, 987 bp, Artificial Sequence
  Description of Artificial Sequence: Synthetic coding sequence
atggacgcccagtgcagcgccaaggtgaacgcccggaagcggcggaaagaagcgcccggccctaatggagccaccgaggaggcttccagaggaaccccttgcgagagacctgtcagagtgtacgccgacggcatcttcgacctgtttcactccggccatgcccgagccctgatgcaggctaaaaatctgttcccaaacacctatctaatcgtcggggtgtgttccgacgagctgacccacaattttaaaggatttacggtcatgaacgagaacgagcggtacgatgccgtgcaacactgcaggtacgtggatgaggtcgtacggaacgctccatggactttaaccccggagtttcttgcggagcatagaattgacttcgtggctcatgacgatattccatattcaagtgcaggcagtgacgacgtctacaagcatattaaagaagccggtatgttcgcccctacccagcgaactgaaggcatcagtacttctgatatcattacgaggatagtcagagactatgacgtttacgcacgaagaaacctccagcggggatacacggcaaaggagcttaatgtctctttcatcaatgagaagaagtaccatcttcaggagagagtagataaggtgaagaagaaagtcaaggacgtggaggagaagagtaaagagttcgttcaaaaggtagaagagaaatctattgacctcatacagaagtgggaagaaaaaagccgcgagttcattggctccttcctcgaaatgttcggccccgagggtgcgctgaagcacatgcttaaggagggtaagggccgcatgttgcaggctattagcccaaaacagagcccctcctcctcaccgacacgcgagagatctccaagcccatcattccgctggcccttttccggcaaaacgagccctccctgctctcccgcgaaccttagtagacataaagcagccgcctacgacataagcgaagatgaagaagactag

SEQ ID NO: 199159 - DNA, 1104 bp, Artificial Sequence
  Description of Artificial Sequence: Synthetic coding sequence
atggacgcccagtgcagcgccaaggtgaacgcccggaagcggcggaaagaggctccagggccaaatggcgcaactgaggaagacggtgtaccttccaaggtacagaggtgcgccgttgggttacggcagcctgctccattctctgatgaaatcgaagtggacttctcaaagccgtacgtgcgggtgaccatggaagaggccagccgggggaccccgtgcgaaagacccgtgagggtgtacgccgatggcatcttcgacttattccactctggtcacgccagagctttgatgcaggcaaaaaatttgtttcctaacacctatctcatcgtcggcgtctgttcggatgaactgacccataacttcaaggggttcaccgtgatgaacgaaaatgagcgatacgacgcagtgcagcattgtcgctacgtggatgaggtggtacgaaacgccccctggactcttacgcctgaatttctggctgaacacaggattgactttgtagcacatgacgatattccatactccagtgcaggtagcgacgacgtttacaagcatatcaaggaagccggaatgttcgctcccacacagagaactgaaggaatctctacaagcgacatcatcactcgtattgtgagagactacgacgtatatgcaaggagaaatttgcagcgaggatatactgccaaagagctaaacgtgagcttcattaacgagaagaagtatcatcttcaagaacgcgtggacaaggtgaagaaaaaagtgaaagatgtagaagagaagagcaaggaattcgtgcaaaaggtggaagagaagtctattgatctgatacagaagtgggaggagaagagccgggaattcatcggtagttttttggagatgtttggccctgaaggggccctcaagcacatgctgaaagagggcaaagggcgaatgttacaagctatcagcccgaagcagagccccagtagttccccaactcgagaacggtctccgtcccccagcttcaggtggcctttttccgggaagacatcacccccgtgcagccccgccaatctgtctcgccataaggccgccgcctacgacatctccgaggacgaagaagattag

SEQ ID NO: 199160 - DNA, 348 bp, Artificial Sequence
  Description of Artificial Sequence: Synthetic coding sequence
atggacgcccagtgcagcgccaaggtgaacgcccggaagcggcggaaagaggcaccaggtcctaacggggcaacagaggaggacggcgttccttcaaaggtgcagcggtgtgccgtggggctaaggcagccagcaccctttagcgatgagatcgaggtcgactttagcaagccctacgtgcgcgtcacaatggaggaagcctccagaggcaccccttgcgaaaggcccgttcgggtgtacgctgacggaatttttgatttgtttcactcaggacacgctagggccctgatgcaggccaagaacctgttcccaaacacatatttaatcgttggtgtatgcagtgactag

SEQ ID NO: 199161 - DNA, 2250 bp, Artificial Sequence
  Description of Artificial Sequence: Synthetic coding sequence
atggaggccgagaccggcagcagcgtggagaccggcaagaaggccaatcggggtactaggattgccttggtagtgttcgtgggcggcactctcgttctgggcaccatactgtttctggtgtctcaggggctccttagcttgcaggctaagcaggagtattgtctgaaaccggagtgcatcgaggcggcagccgccatcctcagtaaggtcaatctttccgtagatccctgtgacaattttttccgcttcgcatgcgacggatggatttccaacaatccaatccctgaggatatgccttcttacggcgtgtatccctggttaaggcacaacgtggatttaaaactgaaggagttgctggagaagtccataagcaggagaagggacacagaagccattcaaaaggcgaagattctgtatagctcctgtatgaatgaaaaggcgattgagaaagctgacgctaagccgctgctccatattctgaggcactcaccgtttagatggcccgtcctagagtccaacattgggcccgagggagtctggtcagagcggaagttctccttgcttcagacgctggccactttcaggggacaatattctaatagtgttttcatccgcctgtacgtgagtcccgacgataaggcctcaaacgagcatatcctgaaactggaccaggcgacattaagtttagctgttcgggaagactacctggacaattcgactgaagcaaaatcatatcgcgatgcattgtataaatttatggttgataccgcggtcctgctgggcgcaaacagcagccgagctgaacatgatatgaagtccgtgctgaggcttgagattaaaatagcagagataatgatcccacatgagaatagaacgtcggaggccatgtacaacaagatgaatatctcagagctgagtgccatgatccctcagtttgattggctgggctacatcaagaaggtgatcgatacccggctctacccccaccttaaggatatttccccctcagagaacgtggtggtcagggttccacaatacttcaaggacctgttcaggattctgggttccgaaaggaaaaaaaccattgccaactatctagtatggcggatggtctactccaggatccctaatcttagcagacgcttccagtatcggtggctcgagttcagcagggtgattcagggcactaccaccctcttgccacagtgggataaatgcgtgaacttcattgaatctgcgcttccctacgttgtcggcaagatgtttgtggatgtgtatttccaggaggataagaaggagatgatggaagaactggttgagggagtgcggtgggccttcatcgatatgttagaaaaggaaaacgagtggatggacgctggcaccaagaggaaagccaaggagaaggcacgcgcagtgcttgccaaagtcgggtatccagaattcattatgaatgatactcacgtgaatgaagatttaaaggcgatcaagttctctgaggctgattattttggcaacgtactgcaaactcggaaatatttagctcagagtgactttttttggcttagaaaggctgtcccgaaaactgaatggttcaccaatcccaccaccgtgaatgccttctacagcgcttccaccaaccagattaggttcccagcaggggaattgcaaaaaccctttttttgggggaccgagtaccctagatccttgagctatggtgccatcggtgtaatagtgggccacgagtttacgcatggtttcgacaataacggtcgcaagtatgataaaaatggcaatctcgatccctggtggagcactgagtcagaagagaaattcaaagagaagaccaaatgcatgattaaccagtatagtaattactattggaagaaggctggtctgaacgtgaaagggaagcgcacactgggagaaaacatcgccgataacggcgggctcagagaggcctttcgcgcgtaccgaaagtggataaacgatcgtcgccagggcctggaagagccattactgcctggcatcactttcactaataaccagctgttcttcttatcatacgcacacgtgcgctgcaacagttacagaccagaggccgccagagagcaagtgcagatcggcgctcactccccgccacagttcagagtgaatggggcaattagcaatttcgaagagtttcaaaaggcctttaactgcccgcctaattccactatgaatcggggcatggattcttgtcggctgtggtag

SEQ ID NO: 199162 - DNA, 1359 bp, Artificial Sequence
  Description of Artificial Sequence: Synthetic coding sequence
atgatccacctgccccggccccccaaggtgctgggcctgcagttcgactggctgggttacatcaagaaggtaattgatacgcgcctttacccacatcttaaggacatctcaccatctgagaatgtggtcgtacgtgtcccacagtactttaaagacctttttaggattctgggctccgaacgtaaaaaaaccattgctaattatctggtgtggcgaatggtgtactctcgcatcccaaatctgtcgaggaggttccagtataggtggttggaatttagtagggttatccaggggacgaccacgctgttgcctcaatgggataagtgcgttaattttatagaatccgcattgccctacgtggtgggaaagatgttcgtggacgtctacttccaggaagacaagaaagagatgatggaagagctggtggagggggttcggtgggcttttattgacatgctcgagaaggagaatgagtggatggacgctggcaccaagagaaaagccaaggagaaagcaagagccgtgctagcaaaggtcggctacccagaattcataatgaatgacacccacgtgaacgaagatcttaaagccataaagttctctgaggccgactatttcgggaatgttttgcaaactaggaaatatctcgcccagagcgacttcttctggttacgtaaagccgtgcccaagacagagtggtttacaaatcctacgaccgtgaacgccttctattctgcaagtacgaaccagattcggttcccagccggagaattgcaaaagcccttcttctgggggaccgagtacccccgctcactctcttatggcgctatcggagtgatcgtcggacacgagttcacacacggctttgacaataatggcaggaaatatgataagaatggcaacctggatccttggtggtccacagagtctgaagaaaaattcaaggagaagactaaatgcatgattaaccaatactccaactattactggaagaaagccggtctgaatgtcaagggcaaacggacattgggagagaacatcgcggacaacggggggcttcgggaggcctttcgtgcctaccggaaatggattaacgataggcggcagggactcgaggagccactgctgccagggattactttcacgaataaccaactgttttttctaagctacgcccatgttcgctgtaattcctaccgacccgaggcggccagggaacaggtccagattggtgctcacagccctcctcagttccgtgtgaacggcgccatttctaatttcgaagagtttcagaaagcctttaactgtcctcccaatagcaccatgaatagaggcatggatagttgcagactttggtag

SEQ ID NO: 199163 - DNA, 1959 bp, Artificial Sequence
  Description of Artificial Sequence: Synthetic coding sequence
atgcccagctacggcgtgtacccctggctgcggcacaacgtggacttaaagctcaaggaactcctggagaagagtattagccggcggcgagatacggaggcgattcaaaaggccaagatcctgtactcctcttgcatgaatgaaaaagccatcgaaaaggccgatgccaagcctctgctgcacatattgcgccactctccattcaggtggccagtgttggagagcaatattgggccggagggggtttggtctgaacgtaaattcagcctgctacagaccctggctactttccgcggacagtactctaatagtgtcttcatccgcctctacgtgtcccccgacgataaagcctctaatgaacacattctaaagttggaccaggcaacacttagtctcgcagtgcgcgaggattacctggataatagcacagaggcaaagtcatatagggacgcactttacaagtttatggtggatacagccgtgcttctgggagcgaacagcagccgagccgaacatgatatgaaatctgtgctgagactggagattaaaatagcagagatcatgattccccacgagaatcggacaagtgaggcaatgtataacaagatgaacattagcgaactgagtgccatgatcccccagtttgactggctagggtacatcaaaaaagtcattgatacccgtctctatccccaccttaaggacattagcccttctgaaaacgtcgtcgtccgggtaccacagtactttaaggacctcttcagaattctaggaagcgaaagaaagaagactatcgccaactatctggtttggagaatggtgtatagtagaattccgaacttgtccagaagatttcagtatagatggctggaattctccagggtgatccaaggaactacaacactgctcccacagtgggacaagtgtgtcaactttattgaatctgcccttccctacgttgtggggaagatgtttgtcgatgtctacttccaggaggataagaaggagatgatggaggagctggtggaaggagtaaggtgggcattcattgacatgttggagaaggaaaatgaatggatggacgcagggacaaagaggaaagccaaagaaaaagcgagggccgtactggcaaaagtgggatacccggagttcatcatgaacgacacccacgtaaatgaagatctgaaggccattaagttctcggaagccgattattttggaaatgtgttacagactagaaagtatttagctcagtccgacttcttctggcttcgtaaggccgtacctaagaccgagtggttcacaaatcccacgaccgttaacgctttttattccgcatccaccaatcagattcgatttccggccggcgagcttcagaagccgttcttctgggggactgaatacccccgcagcctaagctatggggctatcggagtgattgtgggacatgagtttacccacggattcgataacaacggacgtaagtacgataagaatggaaacctggacccatggtggagtacagagagcgaggaaaaatttaaagagaaaactaaatgtatgatcaaccagtattctaactactattggaagaaagcaggcctcaatgtaaagggcaaaaggaccttaggcgaaaatatcgcagacaatggaggcctcagagaggcctttcgggcgtaccgtaagtggattaatgacaggcggcaggggctcgaggagccccttctgccgggcatcacttttactaataaccagctcttttttctctcttatgcccacgtgaggtgcaatagctatcgccctgaagccgccagagagcaggtccagatcggagctcactcgccaccccagtttcgcgtcaatggagcaatttccaacttcgaggagtttcagaaagcctttaattgcccgccgaactctactatgaaccgaggcatggactcctgtcgcttatggtag

SEQ ID NO: 199164 - DNA, 2088 bp, Artificial Sequence
  Description of Artificial Sequence: Synthetic coding sequence
atggaggccgagaccggcagcagcgtggagaccggcaagaaggccaatcgcggaactaggatcgcacttgtagtctttgttggcggtaccctcgtgttgggtacaatattgttcttggtgagtcagggactcttgagtctccaggccaaacaagagtattgtctcaaacccgagtgcatagaagccgctgccgccattctgtccaaggtgaatctgagcgtcgatccttgtgacaatttcttcagattcgcctgtgatggctggataagcaacaatccaattccagaggatatgcctagttacggggtgtatccatggctgcgtcacaacgtggatcttaagttaaaggaactgcttgaaaaatcaattagccgccgacgggacactgaagccattcagaaagcaaaaatattgtactcctcttgcatgaatgagaaagctatagagaaggccgatgccaaaccattgctacacatcttacggcatagtcctttccgatggcccgtactggaatcaaatattggaccagagggggtctggtcagaaaggaagttttctttgctgcagaccctcgccacatttcggggacagtatagcaatagtgtgtttatccggctgtatgtttcaccagatgacaaagctagcaatgaacatatcctgaaattggaccaggcaaccctgagtctggctgtccgagaggactatctggataattctactgaggcaaagagttaccgcgacgccctgtacaagtttatggtggacacggctgttctcctgggtgccaactcatccagggccgagcatgatatgaaatcagtcctccggctggagatcaagattgcagaaattatgatcccccacgaaaatcggacgagcgaggcaatgtacaacaaaatgaacatttccgaactgagtgctatgattccacagtttgactggttgggatatatcaaaaaggtcatcgacactagactatacccccatctgaaagatatttcaccaagtgagaatgtcgtcgtcagggtacctcagtatttcaaggacttatttaggatccttggatccgagcggaagaagacaattgcaaactatctggtgtggcggatggtttactctaggatcccaaatctgagtcgaagatttcagtaccgatggctggagttttcccgcgtgatccaaggaacaactactctgttacctcagtgggataaatgtgtaaacttcattgagtcagcactgccttatgtcgtgggcaagatgtttgtcgacgtctatttccaggaggataagaaagaaatgatggaggaactggtcgagggcgtgcgctgggcttttattgatatgctggagaaggaaaatgagtggatggacgccggtaccaagcgaaaagccaaggagaaagccagggcggtgttggccaaagtcgggtacccagaatttatcatgaacgacacacacgtgaatgaggacctgaaggcaatcaagtttagcgaggctgactatttcggcaatgttctgcagactcggaaatacctggcccagagcgactttttttggttaaggaaggcggttccaaaaacagagtggttcactaaccccaccacagtcaatgcattctattcagcctcaaccaatcagattaggttccccgcaggcgagcttcaaaaaccatttttttgggggacagagtacccaagaagcctgtcgtacggcgctataggcgtgattgtgggtcacgagttcactcacggatttgacaacaacggcaggaagtatgacaagaatggcaacctggacccctggtggagcaccgagtcagaggagaaattcaaggaaaaaaccaagtgcatgatcaatcagtattcaaactactattggaaaaaggctggactcaatgtgaagggaaagcgcacgcttggggaaaatattgctgacaacgggggtctgagagaggcttttcgcgcctaccgcaagtggattaatgacaggaggcagggactggaagagcctctgctccccgggattacattcacaaacaaccagctgtttttcctgagctacgcccacggccagtggtgcaactag

SEQ ID NO: 199165 - DNA, 888 bp, Artificial Sequence
  Description of Artificial Sequence: Synthetic coding sequence
atgcccagcccccggcggagcatggagggccggcccctgggcgtgagcgcatcatcttcttcttcgtccccaggatcccctgctcatgggggtggcggagggggctctcggttcgaattccagagcctcctgtcaagtagggccacagccgtggacccaacgtgcgcgcgcctccgggcctcagaatcccctgttcacaggcgcggttcttttccactggcagctgcagggccctcccaatctcctgcccctccgcttcctgaggaagatcgaatggacctgaatccctcgttccttggtatcgctcttcggtcccttctggcgattgatctgtggttatctaaaaaattgggggtctgcgccggggagtctagttcgtggggttccgttcgccccctcatgaaattattagagattagtggtcacgggattccatggttgcttggcacattgtactgcctgtgccgtagtgatagctgggcaggaagagaagtcctgatgaatttactgttcgcgctgctcttagatctgttgctggtggccctcattaagggactggtgcggcggcggcggccagcccataaccagatggatatgttcgtgaccctgtcagtggacaagtacagctttccaagtggtcatgcgacacgggcagcactcatgagtaggttcatcttaaatcatctggtgctcgcaatccctctgcgcgtattggttgtattgtgggctttcgtactggggctgtccagagttatgttaggccgtcacaatgttacggatgtggcttttgggttcttcctgggttatatgcagtattcaatcgttgattactgctggcttagtccccacaacgccccagttctctttctcctgtggagccaaaggtag

SEQ ID NO: 199166 - DNA, 615 bp, Artificial Sequence
  Description of Artificial Sequence: Synthetic coding sequence
atggacctgaaccccagcttcctgggcatcgccctgcggagcctgctagctatcgatctgtggctgtctaagaaactgggagtgtgcgccggcgagtcctcatcatggggttcggtgcggccacttatgaaactgctggagatttcaggacacggtataccatggctgctgggaaccctctattgcctgtgtagatcggatagctgggcaggcagggaggtgctcatgaacttgttgtttgccctgctgctggacctccttctggtagcattaattaagggcctcgtacgccgccggcgacctgcccacaaccagatggatatgtttgtgaccctcagtgttgacaaatactcctttccaagcgggcacgccacgagagcagccttaatgtccaggttcatcctgaaccacctggtgctcgccattccactgagggtgctggtcgttctgtgggcctttgtccttggtctgtcccgggttatgctgggacgacacaacgtcacagacgtggcattcggctttttcctaggttacatgcaatactccatcgtcgactactgctggctttctccccacaatgcacccgttctgttcctgctctggagccagcggtag

SEQ ID NO: 199167 - DNA, 645 bp, Artificial Sequence
  Description of Artificial Sequence: Synthetic coding sequence
atggagctggccgccggcagcttcagcgaggagcagttctgggaggcctgcgcagaattgcagcagccggccttagcaggcgccgactggcaactccttgttgagacatctggaatatccatatatcgcctcctggacaagaaaacaggcctgtacgagtacaaagtgttcggtgtgcttgaagattgttcacctacactcctggccgatatctacatggatagcgattacagaaaacagtgggaccagtacgtcaaagagctttacgaacaagaatgcaacggggagacagttgtttactgggaagtgaaatacccgttcccaatgtccaatcgagactacgtttatttacggcagagacgcgacctggatatggagggccgtaagatccacgttattctagccagatcaactagcatgcctcagctaggagagcggtctggtgtgatccgcgtgaagcaatataagcaatcacttgctattgaatcggacgggaagaagggatcaaaagtgtttatgtactatttcgataatcccggagggcagattccctcatggttgattaattgggctgctaagaatggtgtgcctaacttcctcaaagacatggctcgcgcatgccagaattatctgaagaagacatag

SEQ ID NO: 199168 - DNA, 582 bp, Artificial Sequence
  Description of Artificial Sequence: Synthetic coding sequence
ctggcccagggccggtgcctgcaggtgaccgccgtgcagatccagggatcttggaaggtgaccggtgtccagcctcagaaaacaggtctctatgagtacaaagtttttggggtgctggaggattgttccccaacactcctcgctgacatttacatggatagcgattatcgcaaacagtgggaccaatatgttaaagaactctatgagcaggagtgcaacggagagaccgtggtctattgggaggtgaagtaccccttcccaatgtccaatagggactacgtgtacctgagacagcgccgggacctcgacatggaagggagaaaaatccatgttattctcgcacgcagtacatcaatgcctcagctcggtgagcgctccggtgtgatacgagttaagcagtacaaacagagtctggcgatagagtctgatgggaaaaaaggtagcaaagtgttcatgtactactttgataatcccggtggtcagataccatcctggttgatcaattgggccgcgaagaatggagtgcccaattttctgaaggatatggccagagcttgccaaaactacttaaagaagacttag

SEQ ID NO: 199169 - DNA, 429 bp, Artificial Sequence
  Description of Artificial Sequence: Synthetic coding sequence
atggacagcgactaccggaagcagtgggaccagtacgtgaaggagttatatgagcaggaatgcaatggagaaactgttgtgtactgggaagtgaaatatccttttcccatgagtaacagagactatgtgtatctccgtcagcgaagggatctcgacatggagggcaggaaaatccatgtgattttggcaaggtccacatctatgccacaacttggtgaacgcagtggtgtaatcagagtgaaacaatacaagcaatccctcgctatcgagtcggatggcaagaagggcagtaaagtctttatgtattactttgataatcccgggggtcaaatcccttcatggctcatcaattgggccgccaaaaatggcgtccccaacttcctgaaggatatggccagagcctgtcagaactatctcaagaagacttag

SEQ ID NO: 199170 - DNA, 564 bp, Artificial Sequence
  Description of Artificial Sequence: Synthetic coding sequence
atgcccgtggacctgagcaagtggagcggccccctgagcctgcaggaggtcgatgagcagccacagcaccctctgcacgtgacgtacgctggtgcagcagttgacgagctcggcaaggttttgacaccaacacaagttaagaatcgaccaacgtcaatcagctgggacggcctcgatagcggcaagttatacaccctcgttcttacagatcccgatgcccctagccgtaaggaccctaaatatagggagtggcaccacttccttgtggtcaatatgaagggaaatgatatctcatcaggcacggtcctgtccgattatgtcggctcggggcccccaaaaggaactgggcttcatcgatacgtgtggctggtgtacgaacaagatcgacccctcaagtgtgatgagcctatcctcagtaaccgaagtggcgatcatcgaggaaaattcaaagttgcaagcttccgcaaaaagtacgaactacgagcacccgtggcaggcacgtgctatcaagccgaatgggatgactacgtccccaagttgtacgagcaattgtctgggaaatag

SEQ ID NO: 199171 - DNA, 468 bp, Artificial Sequence
  Description of Artificial Sequence: Synthetic coding sequence
atgcccgtggacctgagcaagtggagcggccccctgagcctgcaggaggtggacgagcagccacaacatccccttcatgtgacctacgcgggcgctgccgtagatgaactggggaaagttctgaccccaacacaagtgaagaacaggcctactagtatctcctgggatgggctggatagcggcaaattatatacgttggttctgaccgatcccgatgccccttcaaggaaggatcctaaataccgggagtggcatcactttcttgtcgtgaatatgaaagggaatgatatcagttccggcaccgtactgagcgattatgtcgggtctggcccccctaagggcactggtctgcatagatacgtgtggctggtatacgaacaggatcgtccactcaaatgcgacttttcctgctgtctagcgtttattattctgttaactcacagcgacctgtgtttcgaccagatctag

SEQ ID NO: 199172 - DNA, 6135 bp, Artificial Sequence
  Description of Artificial Sequence: Synthetic coding sequence
atgtgccccgtggacttccacggcatcttccagctggacgagcggcgccgcgacgcagtgatcgctctgggaatcttcctgattgagtccgacctgcagcataaggactgcgtggtgccctatctgctgagactcttgaagggtctccctaaggtttactgggtcgaagaaagtaccgccagaaaggggaggggtgcattgcctgtagcggaatcgttcagcttctgtctggtcactcttctgtccgatgttgcataccgggatccctccctcagagacgaaatactagaggtgttgctgcaggtattacatgttttgctaggaatgtgtcaggcgctagagatccaggacaaggaatacttatgcaaatatgccatcccatgcttaattgggatctctcgcgccttcggtcgatattctaacatggaggaatcacttctgagcaagctcttccccaaaattccgcctcacagtttacgtgttttggaggagctggagggtgtgcgtcggagatcgttcaatgattttagatcaatcttgcctagtaatttgcttaccgtgtgccaagagggcacccttaaaagaaagacctctagcgtgtcttctattagccaggtgtctcccgagcggggaatgccccccccgtctagcccagggggatctgccttccactactttgaagcctcctgtttaccagatggcacagcgcttgaacctgaatactacttctctactatatcgagcagcttctcagtctcccctctgttcaacggagtgacttacaaggagttcaacattcctctggaaatgctgcgagagttattaaacctggtgaagaagatcgtcgaggaagccgtcctcaagtcactggatgccatcgtggccagtgtgatggaggccaatccatctgccgacctatactacaccagctttagtgaccccctctacctgaccatgttcaagatgttgagagacaccctctactatatgaaagacctgcccacctccttcgtgaaagagatacatgatttcgtcctagaacagttcaacaccagccagggcgaactccagaaaattctccatgacgccgacagaatccacaacgagttgtcgcctctgaaattgaggtgccaggccaatgcggcttgtgttgatttaatggtttgggccgtcaaggatgaacagggggccgagaatctttgcatcaagttaagtgagaagctccagtccaaaacatccagcaaagtcattatcgcccacttgcccctgcttatctgctgtttgcaaggcctgggtagattgtgcgaaaggttccccgtggtggtgcacagtgtgactccttctctgcgggattttcttgtgattccctccccagtgttggtcaagctatacaaataccactcccagtaccataccgtcgccggaaatgatattaaaattagcgtgacaaacgagcactcagaatccacattgaacgtgatgtccggtaagaaatcacagcccagcatgtatgaacagctcagagatattgctattgacaatatatgtcggtgtctgaaggcagggctcacggtggaccctgtgatcgtggaggcttttcttgcgtcattgtcgaacagactgtatatctcacaggaatccgataaagatgctcatttgattccagatcatactatccgggcgctggggcatatcgcggtagcgttgagggacacacctaaggtgatggaacctatcctccaaatattacagcagaaattttgtcaacccccaagtcccctggatgtcctcataattgatcaactggggtgcctggttataaccggtaaccagtatatctaccaggaggtctggaatctgtttcaacagatctcagtgaaggcctcaagcgtcgtgtattccgctaccaaagattacaaggaccatggatataggcattgctcattggccgttattaatgctctggccaacatcgctgctaacatacaggacgaacatctggtcgacgaactcctgatgaatcttttagagctgtttgtgcagcttggtctggaggggaagagggcctctgaacgtgcctcagagaagggacccgcgctcaaggccagttcatcagctgggaatctgggcgtgttaattccagtcattgccgtcctgacccggaggctccccccgatcaaggaggctaaaccccggctgcagaagttgtttcgagacttctggttgtattccgtactgatgggtttcgccgtcgaaggatccggcctttggcctgaggaatggtatgagggggtgtgtgagatagctacgaagtcacctttgctcacttttccctccaaagaaccgttacggagtgtgctgcaatacaacagcgccatgaaaaacgacaccgttacacctgctgagctgagcgagttaaggtcaaccataattaatctgctcgatcccccccccgaggtgtctgctcttatcaataagcttgattttgctatgtcaacttacttgctttctgtgtatagactggaatacatgagggttctgcgatctacagatcctgaccgattccaggtgatgttctgttacttcgaagacaaagccatacaaaaggacaagtcaggaatgatgcagtgcgtcatagctgtggccgacaaagtgttcgacgcattcctgaacatgatggccgataaagcgaagaccaaggagaacgaggaggagctggaaaggcacgctcaattcctgctggtgaatttcaaccacattcataagaggatacgaagagtcgctgacaagtacctgtcaggcctggtagataagttcccgcatctgctctggagtgggactgtgctcaagacaatgctagacatcctgcaaacgctcagtttaagtctttccgcagacatacataaggaccagccttattacgatattcccgatgcaccataccgcattacagtgccagacacctatgaagctcgcgaaagtatcgtcaaagacttcgctgcacggtgcggcatgatccttcaggaggctatgaagtgggcccctacagtgaccaaatctcatctgcaagagtatttgaacaagcaccagaactgggtcagcggcttgtcacagcacacaggcctggccatggctaccgagtcaattttgcacttcgcaggatataacaaacagaacaccacccttggcgccacccagttgtcggaacgacccgcctgcgtaaaaaaggactattctaattttatggcaagcctcaacttgcggaataggtatgctggcgaagtctatggtatgatccgcttttcgggaacaaccgggcagatgtccgacctaaataagatgatggtacaagatctccactccgctctcgacagaagccaccctcaacactacactcaggccatgtttaaattgacagctatgctgatcagtagcaaggactgcgatccccagctgctccatcatttgtgctggggacccctgcggatgttcaacgagcacggcatggaaacagcattggcttgttgggagtggctcttggctggtaaagatggtgtggaggtgccctttatgagagagatggccggtgcttggcacatgaccgtcgagcaaaaattcggtctcttttcggccgagatcaaggaggccgaccccctggctgctagcgaggccagccagccaaaaccctgtcccccagaagtgactcctcactatatctggattgacttccttgtgcagcggttcgagatagcgaaatattgttctagcgatcaggtggaaatattttctagcctcttgcagcggagcatgagcctgaacatcggcggtgcaaagggcagtatgaaccgacacgtggctgccataggtcccagattcaagctgcttaccttaggcttgtctctgctgcacgctgatgtagttcctaatgctaccatacgaaacgtgttgcgagaaaagatatactcaactgcattcgactattttagctgcccccctaagttccctacacagggagagaagcgtctgcgtgaagacatttctattatgattaagttttggactgctatgttcagtgataaaaaatacttaacagcctctcagctcgtgccccccgacaaccaggataccagatctaatctggatatcaccgtgggtagccggcagcaggctacccaaggctggatcaacacataccccctctcttccgggatgtcaaccatctcaaagaaaagtgggatgagtaagaagacgaacagggggagtcagttacacaagtactacatgaagagacgcactctcctgctgtccctgctcgctacagaaatcgagcgcttgataacttggtacaaccctctgagtgctccagaattggagcttgatcaggccggagagaattccgtggctaactggcgctccaaatatataagcctgtccgaaaaacagtggaaggacaacgtgaatttagcctggagcatctctccctaccttgcagtgcaactgccagctcgcttcaaaaacaccgaggccattggcaacgaagtgactaggctcgtgcggctggaccctggggcagtgagcgacgtgccagaggccatcaagttcttggtgacatggcacaccattgatgcggacgcccccgagctttcccatgtgctgtgctgggcacctacagacccgcccactggtcttagttacttcagcagcatgtacccgccacaccccttgacagcacagtatggagtcaaagtactgcggtcatttccccctgatgccattctattttacattcctcaaattgtacaggctctcagatacgacaaaatggggtatgtgcgagagtacattctgtgggcggcttctaaatcccagctgctcgctcaccagtttatatggaacatgaaaactaatatttatttagacgaggaaggccatcagaaggatcctgacataggcgacctcctggatcaattagtcgaggagataacaggcagcttgagcggtccagcaaaggatttctaccaacgcgaatttgacttctttaataagattacgaacgttagtgcaatcattaagccatacccaaagggtgacgagcgcaagaaagcctgtctgtccgccctgtccgaagtcaaggtacagcccggctgctacttaccaagcaaccccgaggcgatagtattggatatcgattacaaatcggggacaccaatgcagagcgcagcgaaagccccatatttagcgaagtttaaggtcaaaaggtgtggcgtttctgaactggaaaaggagggccttcgctgtcggtctgacagcgaggacgagtgctctacacaagaggcagacgggcagaaaatcagttggcaagccgccatctttaaggtgggtgatgactgcagacaagatatgctggccttgcagatcattgaccttttcaaaaatattttccaactggttggacttgatttgttcgtcttcccttatcgtgttgtggccacagccccagggtgtggggtgattgagtgcataccggattgcacctcacgagatcagctgggtcgccagaccgacttcggtatgtatgattactttacaaggcagtacggagacgagtcaactctcgcgttccagcaggctcggtataacttcatccggtctatggccgcatacagcttgctgctgttcttactgcagattaaggacagacacaatggaaacattatgctcgacaaaaaagggcatataatacacatagacttcgggttcatgtttgaatcttccccagggggcaatctgggctgggagcccgacatcaagctaactgatgagatggtcatgattatgggtggtaagatggaggccacaccctttaaatggttcatggaaatgtgtgtgagggggtacttggcagttaggccttacatggacgccgttgtgtcccttgtgacactcatgttggacaccggcttgccctgtttcaggggtcagactatcaagctattgaagcatcggttcagtcctaacatgactgaacgtgaggccgctaattttataatgaaagtgatacaatcatgtttcctgagcaaccggagcaggacctacgacatgatccagtattatcagaacgatataccttactag

SEQ ID NO: 199173 - DNA, 1440 bp, Artificial Sequence
  Description of Artificial Sequence: Synthetic coding sequence
atggacgagaccagccccctggtgagccccgagcgggcccagcccccggattatacatttccaagcggcagcggcgctcatttccctcaggtacctggcggagccgtacgggtcgcagctgctgccggatctggaccgtccccaccaggatcaccgggacatgatcgagaacgccagcccttgctcgatagagcacggggagctgctgcccagggccagacacaaacagtggcagcacaggcccaggcccttgcggcccaggccgctgccgccgcacacgccgcccaggcacatagagagagaaatgaatttcccgaggaccccgaatttgaagcagtggtccgacaggccgagctggctatagagcgctgcatattccctgagcgtatctatcaaggcagtagcggatcctatttcgtgaaagacccacagggacgaatcatcgccgtgttcaagcctaaaaacgaggagccatacggccatcttaatccaaaatggaccaagtggctgcagaaactctgttgcccatgttgcttcggtagggactgcctggtgctaaatcaaggatatctgtccgaggcgggcgcgtccttagtggatcagaagctagagctcaacattgtgccccgcacaaaagtcgtttatctggcctctgagactttcaattattccgcgattgaccgtgtgaagtccagaggaaagcggctggcactggaaaaagtgccaaaagtggggcaacggtttaatagaattggactgcccccaaaagttggatctttccagctctttgttgagggttacaaggatgccgactactggctgcgaagatttgaggcggagcccttgcccgaaaacacgaaccggcagctgctacttcagttcgagagactggtcgtcctagactacattatcagaaacactgataggggaaacgacaactggttgattaagtacgactgtcccatggatagcagcagcagccgtgatactgactgggtcgtggttaaggagcccgtcatcaaagtggcggctatcgacaacgggctggctttcccgcttaaacatccggactcatggcgcgcgtatcctttctactgggcatggctcccccaggcaaaggtccctttttcccaggagattaaggatctgatcctgcccaaaatttctgacccaaacttcgtgaaggacctcgaggaggacctttatgagctgttcaaaaaggaccctggctttgaccggggccagtttcataagcagatagccgtgatgagggggcagatccttaatctgacccaggccctgaaggacaacaaaagccccctgcacttggtccagatgcctcccgtgatcgtggagaccgccagaagtcatcaacggagcagcagtgaatcttacacacagagctttcaaagcaggaagccattcttcagctggtggtag

SEQ ID NO: 199174 - DNA, 1350 bp, Artificial Sequence
  Description of Artificial Sequence: Synthetic coding sequence
atgctgggcccccaggtgtggagcagcgtgcggcagggcctgagccgttctctgagtcgcaacgtgggagtgtgggcctcaggagaaggcaaaaaggttgatatcgctggtatataccctcccgtaaccacccccttcaccgcaacggcggaggtcgactacggaaagttagaagagaacttacacaagcttggaacttttccctttcgtggggctgtcgggggcgtatgcgcgctcgcaaacgtgctgggcgcccaggtgtgtcagcttgagcggctttgctgcaccgggcagtgggaggacgcccagaaacttcaacatagattaattgagcctaacgctgccagaattattgctgtgtttaaacccaagaacgaggaaccctatggacatctgaatcctaagtggacgaagtggctgcaaaaattgtgttgtccttgttgctttggccgggactgcctcgtgctcaaccaggggtatctatccgaggccggcgcttccctggtggaccagaagctggagttgaatattgttccccgcacaaaggtggtgtacctagccagtgagacgttcaactacagcgccatcgacagagtaaagtcacgcggtaaacgtctcgctctcgagaaagtcccaaaggtcgggcaacgctttaatcgcatcggcttgcccccaaaggtcggaagttttcagctctttgttgagggatacaaggacgccgattactggctgagacggttcgaggcggagccactaccggaaaatacgaaccggcagttgttgctccagttcgagaggctggtggtgctcgactacatcattcggaacacagacagggggaacgataattggctcataaagtacgactgccctatggattctagtagctcgcgtgacaccgactgggtagttgtgaaggaacctgtgataaaggttgctgcaattgataacggacttgcctttcctctgaagcaccccgattcgtggagagcctaccctttctattgggcctggctgccgcaagccaaagtcccgttcagccaggaaatcaaagatctcatactgcctaagatctccgatcccaattttgtcaaggacctggaggaagatctctacgagttatttaagaaggatcccggctttgaccgcggacagttccacaagcagattgcagtgatgcggggccagattctcaacctcacacaggcccttaaggataacaaatcccctttacacttagtgcagatgcccccagtgattgtggagacagcgagaagccaccagcgaagcagctctgaatcatatactcagagtttccagtccaggaagccctttttctcgtggtggtag

SEQ ID NO: 199175 - DNA, 1446 bp, Artificial Sequence
  Description of Artificial Sequence: Synthetic coding sequence
atggaggaccccagcgagcccgaccggctggccagcgccgacggcggaagccctgaagaggaggaagacggtgagcgagagccattgctgccccggatcgcttgggcacacccccgacggggcgctcccggaagcgcagtcaggctacttgatgccgcgggtgaggagggagaagctggggatgaggaattgcccctaccccccggggacgtaggggtgtctagaagcagctctgccgaactggacagatctcggcctgcggtgtcggtgacaattggtacctctgaaatgaatgcatttctggatgaccctgagtttgctgatattatgctcagagcggaacaggccatagaagttggaattttccctgaaagaatctctcaggggtcgagcggctcctactttgtcaaggaccctaaacggaagattatcggcgtcttcaagccaaagtctgaggaaccttatggtcagttgaatcccaaatggacaaaatatgtgcataaggtgtgctgtccatgttgctttgggcgaggatgtttgatccctaaccagggatatctgtccgaggccggggcctacctcgtggacaataagttacacttgagcatcgtacccaagacgaaagtggtgtggctggtgtcagagactttcaattataatgcaattgatagggccaagtcccgcggcaaaaaatacgctctagaaaaggttccaaaggtcggccgcaaatttcaccgtatcggactaccacccaagattggctctttccagctgttcgtagaagggtacaaagaagccgagtattggctccgtaagttcgaggcggaccctcttccagaaaatatccgtaagcagttccagtcacagtttgaaagattggtgattctcgactacataattagaaacaccgaccgaggaaatgacaactggctcgtacgttacgagaagcagaagtgtgagaaggaaatcgatcataaagagtccaagtggatcgatgatgaggaatttctgataaagatcgctgctatagataatggtctggcgttccctttcaaacatcctgatgaatggagagcctatcccttccattgggcttggctgccacaggcaaaggtccctttctcagaggaaattcgtaacctgattcttccatatatatcagacatgaattttgtgcaagatctgtgtgaagacctatacgagcttttcaaaacagacaaggggtttgacaaggcgacctttgaaagccagatgtccgtgatgaggggccagattcttaacttgacacaggccttgcgagatggtaagagcccatttcagctcgtccaaattccctgtgttattgtcgagaggtcgcagggagggtcccagggtcgtatcgtccatctcagtaatagtttcacccagacagttaactgtaggaaaccttttttctcctcatggtag

SEQ ID NO: 199176 - DNA, 1353 bp, Artificial Sequence
  Description of Artificial Sequence: Synthetic coding sequence
atggaggaccccagcgagcccgaccggctggccagcgccgacggcggctccccagaggaggaagaagacggggagcgcgaaccactgttgccaagaatagcatgggcgcatccccggcggggggcccccgggtccgccgttaggctgctggatagatcccggccagccgtctctgttaccattggaaccagcgagatgaacgcctttctggatgacccggagtttgcagatatcatgctccgtgcagagcaggccattgaggtgggcatattccctgagcgtatctcacagggctcttccggaagctattttgtcaaggaccccaagagaaaaattatcggcgtgtttaaacccaagtcagaagaaccctacgggcagctgaacccaaaatggacaaaatacgttcacaaagtttgctgtccatgctgcttcggaagaggatgcttaattccaaatcaaggatatctgtctgaggctggtgcatatctggtagacaataagcttcacttatctatcgtgccgaagactaaggttgtttggctggtaagcgagacatttaactataatgccatcgatcgcgccaaaagccgcggaaagaaatacgctctcgaaaaggtgcccaaggtggggcgaaaattccaccggatcggtctcccaccaaagatcgggagcttccagctctttgtggaagggtacaaagaagctgaatattggcttcgcaaattcgaggctgaccctctcccagagaacattcggaagcagttccagtcccagttcgagagactcgttattctggattatataattagaaatactgatagaggaaacgacaattggctggtgaggtatgaaaagcagaagtgtgagaaggaaatcgatcataaagaaagtaaatggattgatgatgaagagttcctgattaagattgcagccattgataacggcctcgcctttcctttcaaacatccagatgaatggagagcgtatccattccactgggcctggctgcctcaggctaaggtacccttcagcgaggagattagaaacctcatccttccttacatttccgacatgaacttcgtgcaggacctttgcgaggatctttacgaactgttcaagacagataaaggcttcgacaaggccacattcgagtctcagatgagcgtgatgcgcgggcaaatactgaatctaacacaggcattaagagacggaaagtctcctttccagttggtgcagataccatgcgttatcgtggagaggagtcaggggggcagtcagggccgaattgtccatctgtccaattccttcactcaaaccgtgaactgcagaaagcccttcttctcaagctggtag

SEQ ID NO: 199177 - DNA, 6135 bp, Artificial Sequence
  Description of Artificial Sequence: Synthetic coding sequence
atgtgccccgtggacttccacggcatcttccagctggacgagcggagaagagatgctgttatagctctgggaatattcttaattgaatccgacctgcagcacaaggattgcgtggttccctatctgttgaggctgcttaaaggcttgcctaaagtctactgggtcgaagaatccactgcccgtaaggggcggggtgccttgcctgtggcagagtcgttcagcttctgtctggtaaccctgctcagtgacgtggcttaccgggatccttcactccgcgatgaaatcctggaagtactgctgcaggtgctccatgtgcttcttggcatgtgccaggcactagagattcaggataaagaatacctctgtaaatatgccatcccatgtttgattgggatcagtagggcatttggtcgatacagtaatatggaggagagcctgctctctaaactgttcccgaaaataccaccccactccctccgcgtcctggaagaattggaaggtgtgcgcagacggtcctttaatgactttagatccatcctgcccagcaacctccttacggtctgccaggagggaacgcttaagaggaagacctctagcgtttccagtatttcccaggtgtctcccgaacgcggcatgcccccaccatctagccctgggggcagcgcctttcactattttgaagcttcatgcttgcccgacggcaccgccctggagccagaatattacttctctaccatcagcagctctttctctgtgagccccctcttcaatggtgtgacatataaggaattcaacatacccctcgaaatgctaagagagcttctgaacctggtgaagaaaattgttgaagaagctgtgctgaagagcctggatgcgattgtcgctagcgttatggaagccaatcctagcgccgacctttattatacaagcttctcagacccgctgtatctcacaatgtttaagatgctgagggacactttatattacatgaaggatttacctacatcattcgtcaaagagatacacgacttcgttttggaacagttcaacaccagtcagggagaactccaaaaaattttacacgatgctgatcgtattcataacgagctgtccccactgaaactcagatgccaagctaacgcagcctgcgtcgacctgatggtgtgggccgtcaaggatgaacagggggctgaaaatctatgcattaagctgtcagaaaaattgcagagcaaaaccagcagcaaggtaattattgcgcatctacccctgctgatctgctgcctgcaggggttaggccgcctttgcgaacgattccccgtggtcgtgcatagcgtgaccccaagcctgagggatttcttggtgatcccttcccctgtgttagtcaagttatacaaataccacagccagtatcacactgttgccgggaacgatataaaaatctccgtcacaaacgaacactccgaatcaacactcaatgtcatgtcaggtaagaaatcccagccttcgatgtacgagcagctgcgagacatagccatcgataatatttgccggtgcctcaaggccggacttaccgttgatccagttattgtggaggccttcctggcctccctgagcaacaggctgtacatatctcaggagtccgataaagatgcgcacttgattcctgaccataccatccgtgccttaggtcatatagctgtggccctcagagatacaccgaaagtgatggaacctattctccagatactgcagcagaagttttgccaaccaccttctccacttgacgtccttatcattgatcaattagggtgcctcgtgatcaccggtaaccaatacatctaccaagaagtctggaatctatttcagcagatttctgtgaaagcttcctccgttgtgtatagcgctaccaaggactacaaggaccacgggtatcgccattgcagtctagccgtgattaatgctctggccaatatagccgctaatattcaggatgagcacctagtggatgaacttttaatgaaccttctggagcttttcgttcaactcggcctggaaggaaaacgcgcctcagagcgcgcatcggaaaaaggccctgccctcaaggcaagcagctctgccgggaatctgggagtgctgatcccagtgatcgccgttctgacgcgtcgcctgccccccatcaaggaagcgaagccacgccttcaaaagctcttccgtgatttttggctgtatagcgtgttaatgggcttcgcagtggaaggctccgggctatggccagaagagtggtacgagggcgtctgcgaaatcgcaactaagtcacctttactgactttccccagcaaagaacccttgaggagtgtcctgcagtacaactctgctatgaaaaatgacacggtgacaccggcagaactgagcgaactaaggagtactatcattaatctgctggaccccccgcccgaggttagtgcgttgataaacaagttagattttgcaatgagcacttacttgctcagtgtttatcgtctggagtatatgcgagttctaaggtcaacagatcctgacaggttccaagtgatgttttgttatttcgaagataaggcaatccagaaggacaaatccggcatgatgcagtgtgtaatcgcagtcgccgacaaagtgttcgatgcgttcctcaacatgatggcagataaggccaaaaccaaggagaatgaggaagaattagagcgtcacgcccagttcctgctcgtcaactttaatcacatccacaaacggatcaggagggtggcggacaaatacttgagcggcctggtggataaatttccacacctcctctggtctggtacagtgctgaaaaccatgctggatatcctgcaaaccctgtcactttctttatccgccgacatacataaagatcagccgtactatgacatccccgacgctccctataggatcacggtccctgatacatatgaggctagagaaagcattgtcaaggatttcgcggctcggtgtgggatgattttgcaggaagccatgaaatgggcaccaaccgttacaaagtcacacctgcaagagtaccttaataagcatcagaattgggttagcggtctctcccaacacactgggcttgctatggctactgagtctattcttcattttgccggttataacaaacagaacactacactgggtgctacacagctgtcagagcgtcccgcctgtgtgaagaaggattattctaacttcatggcctcgctcaacctgcgcaatcgctatgccggagaggtgtatggtatgatccgtttttcaggtaccaccggccagatgtctgacctcaataaaatgatggtccaggacctgcacagcgcgctggatcgcagccacccgcagcactacacccaggccatgtttaagttgaccgcaatgctaataagttcaaaagattgcgacccacagttgttacatcacctttgttggggtcctctgaggatgttcaatgagcacggcatggagaccgctctcgcctgctgggagtggctgctggctgggaaggacggggtcgaagttcccttcatgcgggagatggcgggagcttggcacatgacagtggagcaaaaattcggtctattctcagccgagattaaggaggcagacccattggcagcgagtgaagcctcccaacctaagccttgcccacccgaagtgacaccccactacatctggatagatttcctggtccagcggtttgagattgctaagtactgctccagtgatcaagtcgagattttcagcagccttctgcagcgctcaatgtccctcaatatcggcggagctaaggggagtatgaatagacatgttgccgccattggtcctcggtttaaattattgaccctgggtcttagcctgctgcacgctgatgtcgtgcccaacgctaccatccgaaacgttctgagagaaaaaatttactcaaccgcgttcgattacttctcttgccctccaaagtttccaactcagggtgaaaagcgtctccgcgaagacatctccataatgatcaaattttggaccgctatgttttccgacaaaaagtacctgaccgcctcacagctggtcccgcctgataaccaagatacacggtccaaccttgacatcaccgtcggctcgaggcagcaggcaacccagggttggattaacacctacccattgagcagcgggatgagcacaataagcaagaaatctggcatgtcaaagaaaactaatcggggttcccagctgcataagtattacatgaagcgacgcactctgctgctgagtctcctggccaccgaaatcgagcggttaattacgtggtacaatccgctgtcagctcccgaattagagctggaccaggcaggcgagaactcggtagccaattggcgcagtaaatacatcagcctctccgaaaaacagtggaaagataacgtcaacttggcatggtccatttccccatatcttgcagtgcagctgcccgcgagatttaaaaataccgaagcaatcggcaacgaagtgaccaggctggttcgactcgatcccggtgctgttagtgacgtgcctgaagccatcaagtttctagtgacgtggcacactattgatgctgatgctcctgaacttagccacgtcctgtgctgggcacccacggatccacctacagggctgtcgtatttcagctccatgtatcctcctcacccacttacagctcagtatggggtaaaggtgctgcggtctttccctcctgatgctatcctgttttatattccacagattgttcaggcactgagatacgacaaaatgggatacgtccgagagtacatcctgtgggccgcttctaaatcgcagctgctggcccaccagtttatctggaacatgaagacaaatatatatctagacgaggaaggacaccaaaaggatccagatatcggggacctgctggatcagctggtagaagagattactggcagcctttccgggccagctaaggacttttaccagagagagtttgattttttcaataagattacaaatgtctctgcaatcattaagccatacccaaaaggggacgagagaaagaaagcatgcctctcagcactgtccgaggtcaaggttcagcctggctgctatctaccatccaatcccgaggcaatcgtcctggatattgactataagtctgggacgcccatgcagagtgcggctaaggccccatacctggcgaagttcaaagtcaagcgttgcggtgtgtcggagctggagaaggaaggactcagatgccgctctgacagcgaggatgagtgctccactcaggaggccgacggtcagaagattagctggcaggccgctattttcaaagtgggagatgattgccggcaggacatgctcgctctccagatcattgacctgttcaaaaatatattccagctcgttggcctggatctcttcgtctttccttacagggtagtcgcgacagctcctggttgtggtgtgatagaatgcattcccgattgcacgagtcgcgatcagcttgggcgacagacggactttggaatgtacgactattttactcgccaatacggtgacgagtcaacgctggcatttcagcaggcaagatataactttatccggagtatggccgcctatagtcttttactcttcttactccagattaaggatcgccataatgggaatatcatgcttgataagaaaggacacataatccacatcgacttcggctttatgtttgagagttccccgggcggcaatctcgggtgggagccggatataaagcttacagacgagatggtcatgatcatggggggaaagatggaggctactcctttcaagtggtttatggagatgtgcgtcaggggttatctcgcagtacgaccatatatggatgccgtcgtgtctttggtgaccctgatgttggatacgggactcccatgctttcgcggacagacaatcaagctgctgaagcatcgatttagcccaaacatgactgagcgggaagccgctaatttcatcatgaaagtgatacaaagctgcttcctttccaatcgctctcggacatatgatatgatacagtattatcaaaatgatatcccctattag

SEQ ID NO: 199178 - DNA, 2565 bp, Artificial Sequence
  Description of Artificial Sequence: Synthetic coding sequence
atgcgggagatggccggcgcctggcacatgaccgtggagcagaagttcgggctctttagcgccgaaataaaagaggcagaccctcttgccgcatcagaggcttcccagcctaagccctgccctccagaagtgaccccccattacatctggatcgactttttggttcaaagattcgagattgcaaagtactgttcctcagatcaagttgagatcttcagcagtctcttgcagcgttctatgagtctaaatataggtggtgctaagggatcaatgaacaggcacgtggccgcaatcggcccacgctttaagttactgacgctggggctgtccctgctgcacgccgatgtggtgcccaatgccacgatacgcaacgtgctgcgagagaagatctatagcaccgcttttgactacttttcctgccctcctaagtttccaacacaaggcgagaaaagactgagagaggatatcagcatcatgataaagttttggaccgccatgttctcagacaaaaaatatctgactgcctcacagctggtgccacctgacaaccaggatactcggtcaaatctggacataaccgtgggatccaggcagcaggctactcaggggtggattaatacatatcctcttagtagcggtatgagcaccatctctaagaagagcggaatgtccaaaaagacaaaccgcggatcccaactgcacaagtattacatgaagcgacgcacactgctcttgagcctgttagccacggagatcgagcgtctcattacatggtacaacccactgtccgcccctgaactggaactggatcaagccggcgaaaatagcgttgcaaactggcggagtaagtacatttcactgtccgagaagcagtggaaagacaatgtcaatctggcttggagtatttcaccgtatctagccgtgcaactccccgcccgcttcaagaacactgaggccattggcaacgaagtcacgagattggttagactggatcccggggcagtatcagacgttcctgaagccattaaatttctggtgacatggcatactatcgatgccgatgctcctgaattgtcacacgtgctctgttgggcacccaccgatccgcctacaggcctatcctatttctcgtccatgtacccccctcacccactcacggcacagtatggggtgaaggttctgagatcctttcccccggacgccatcctgttttatatcccgcaaatcgtgcaggcattacgatatgacaagatgggatatgtaagggaatatatcctttgggctgcgtctaaatctcagttgctggctcaccagtttatttggaacatgaaaaccaatatctatctagatgaggaaggtcatcagaaggaccctgacatcggggacctgctcgatcaattggtcgaagagataacgggcagtctgagcggtcccgcgaaagacttttatcagagggagttcgacttttttaacaaaatcacaaacgtgtccgcaatcattaagccttaccctaagggcgacgaaaggaaaaaggcttgcctttcggccctatctgaagtgaaggtgcagccaggctgctacttaccaagcaaccccgaggccattgtcctcgatattgattacaagtctggtacgccaatgcagagcgctgccaaagccccctacctggccaagttcaaggtgaaacggtgtggagtatcagaattggagaaagaggggctgagatgtagatccgatagtgaggacgagtgctccacccaggaggctgacggtcagaagatttcgtggcaggccgcaatattcaaggtgggcgatgactgtcgccaagatatgctggctctgcagataattgacttgtttaagaacatctttcagctggtgggattggacctgttcgtgtttccgtacagagtggtggccaccgcgcccggttgtggggtgattgaatgcattcctgattgtacttctcgcgaccagctggggcgacaaaccgactttggaatgtatgactatttcaccaggcaatatggggacgagtccacacttgcattccaacaagctaggtacaattttattcggtcaatggctgcctatagcttgcttctgtttcttctgcagatcaaagacagacacaacggaaacataatgctggataagaagggtcatattatccacattgacttcgggtttatgttcgaaagctcccccgggggcaacctcgggtgggagcccgacattaagctgacagatgagatggtgatgataatgggaggaaaaatggaagccactccctttaaatggttcatggaaatgtgtgtgaggggctacctggcggtccgcccatatatggacgctgtggtgtccctcgtcactctcatgctggataccggcctgccttgctttcgcggccagaccattaagctcctgaagcatcgcttcagtcctaatatgactgaaagggaagcagccaatttcattatgaaggtgatccagtcttgcttcttgagcaataggagccgaacctatgacatgatacagtactatcagaatgatatcccatattag

SEQ ID NO: 199179 - DNA, 264 bp, Artificial Sequence
  Description of Artificial Sequence: Synthetic coding sequence
atgtgccccgtggacttccacggcatcttccagctggacgagcggcgacgcgacgcggtgatcgcgctcgggatcttccttattgagagtgacctgcagcacaaggactgtgtggtgccatatctgctccgactgcttaagggtctgcctaaggtatactgggtcgaggagtcgactgccagaaaaggtcgcggcgcccttccagtagctgagtcattcagtttctgcctggttactttactgtccgatgtggcctaccgctag

SEQ ID NO: 199180 - DNA, 1959 bp, Artificial Sequence
  Description of Artificial Sequence: Synthetic coding sequence
atgagcggccagagcctgaccgaccggatcaccgccgcccagcactccgtgaccggatcagcggtcagtaagaccgtgtgtaaagctaccacacatgagattatgggacccaaaaagaagcatctggattacctcattcagtgtaccaatgagatgaatgtgaacattccacagttggcagactccctgttcgaacggacaacaaattccagttgggtggtagttttcaaaagtctcattacaactcaccacttaatggtttacggaaacgaaagatttatacagtatctggcttcaagaaatactctgtttaacctgagcaactttctggacaaatccggcctccagggctacgacatgtctacgtttatccgcagatactccaggtatttaaacgagaaggccgtgagttatcggcaggtcgcttttgacttcactaaggttaaaaggggcgccgatggcgtgatgaggaccatgaatacggagaaactgctgaagaccgtgcctatcatccagaaccaaatggacgccctcctggactttaacgtgaacagtaacgagttaactaatggggtgataaatgccgccttcatgctacttttcaaagatgcaattcggctatttgctgcctataacgaggggatcattaaccttctggagaagtattttgatatgaaaaaaaatcagtgtaaagaaggcctggacatctacaagaagttcctgacccggatgactcgaatatcagaatttctcaaagtagccgagcaagtgggcatcgaccggggagatatcccagaccttagccaggctcctagcagtctgttagatgcgctggagcagcacctcgccagccttgagggaaagaagatcaaagactctactgccgctagcagagccacaaccctgagtaatgcggtgtcgtccctggcaagcacagggctttcgttgactaaggttgatgagcgtgaaaagcaagcagccctcgaggaagagcaggctcgtctcaaggccctaaaagagcagagattgaaggaactagcaaagaagcctcacacatcgctgacaaccgctgcttcaccagtctcgacttccgccggcggcattatgaccgcacccgcaatcgacatcttttctacaccatcatcttccaattccacgtctaagttacccaatgacctcctggaccttcagcagccgaccttccaccccagtgtacaccctatgagtacggccagccaggtcgctagtacatggggggatcccttttcagcgacagttgatgccgtcgatgatgctataccctccctaaaccccttccttacgaaaagctccggggacgtgcacttatctatttcgtccgacgtgtctacattcacaactcgcactccaacacacgaaatgttcgtgggatttactccttcccctgtggcacagccgcacccctccgccggactcaacgttgacttcgaaagcgtgtttggaaacaaatcaaccaacgtgatagtcgatagcggcgggttcgacgaacttggcgggctgctaaaacccaccgtcgcttctcagaatcagaacctcccagtggccaagctgccccccagtaaattggtgtccgacgaccttgactcctccctcgccaacctggtggggaacttgggaatcggtaatggcacaactaaaaacgatgtgaactggtctcaacctggagagaaaaagctgacagggggcagcaactggcagccaaaggtcgcccccactactgcctggaatgctgctacaatggctcctcccgtcatggcatatcctgctaccacccctacaggaatgataggctatggaattcctccacagatgggcagcgtccccgtaatgacccaacctacattaatctattctcagccggtcatgcgccctcccaatccatttggtccagtatccggggcccagatccagtttatgtag

SEQ ID NO: 199181 - DNA, 1959 bp, Artificial Sequence
  Description of Artificial Sequence: Synthetic coding sequence
atgagcggccagagcctgaccgaccggatcaccgccgcccagcactccgtgacaggcagtgccgtctcaaagacagtgtgtaaagccacaactcacgaaatcatgggacccaagaaaaaacacttggattacctaatccagtgcactaacgaaatgaatgtgaatattcctcagttggcagattcactcttcgagcgaacgaccaactccagctgggttgtggtctttaaatctctaatcactacgcatcacctgatggtgtacggcaacgagcgattcatccaatacctggcatcccggaacactctgttcaatctgtcaaattttctcgataagagtggactgcagggctatgatatgtcaacatttattagacggtattcccgctacctgaacgagaaggccgtgtcctaccgccaggttgcatttgactttaccaaggtcaaaaggggggcagacggtgtcatgcgcactatgaatacagaaaaacttctgaagactgtgccaatcattcagaaccagatggatgctctgcttgacttcaacgtgaattctaacgaactcactaacggagtgattaatgctgcttttatgctcctgtttaaggacgcaatacgcctgttcgctgcgtataacgaaggaatcattaacctacttgagaagtacttcgacatgaagaaaaatcagtgcaaagaagggttggacatctataaaaaattcctgacgagaatgacaaggatctcagaattcttgaaagtcgcagaacaggtagggattgacagaggcgatattcccgacctcagccaggccccgtcctctttgctggacgctcttgagcagcacctagcctcattagagggtaagaaaattaaggattctactgccgcgtcacgagcgacaacactcagcaacgccgtgagctccctggcaagtacaggcttgtctctgactaaggtggatgagagagaaaagcaggccgctctcgaggaagagcaagctaggcttaaagctttgaaagagcagagactgaaggagttggctaaaaagccgcacacctcgttgaccactgctgccagtcctgtgagcacctctgccggcgggattatgaccgcaccggccattgacatattttccacaccatcttcctcaaacagcacaagcaagctgcctaacgatctgctggaccttcagcaaccaacatttcatccatctgtccatccaatgtccacagcatcacaggtggccagtacatggggagatcccttttcagctactgtggacgccgtcgacgatgccatccccagcttgaacccattcctgactaaatcttctggcgatgtacacctatcgatttcgagcgatgtgagcaccttcactactcgcaccccaactcatgaaatgttcgttgggttcacgcctagcccagtcgcccagccccatccatccgctgggctgaatgtggatttcgagagcgtatttggcaacaagtccaccaatgtgatcgtggattcaggggggtttgatgaactaggcggtctcttgaagcctacagtggctagtcagaaccaaaacctgccagtagctaagctccccccctcgaaactggttagcgatgacttggacagcagtttagccaatctcgtgggcaacctagggatcggaaacgggaccacgaagaatgatgtgaattggagtcagcccggggaaaagaagctgaccggcggctctaactggcagccaaaggtggcccccaccacggcgtggaatgccgccactatggctcctcccgtcatggcatatccagccaccacacccactggaatgatcggctacgggataccaccacagatggggagtgtgcctgtgatgacccaaccaacgctgatctattcgcaacccgtcatgagaccccctaatccctttggccccgtctccggagcgcagatccagtttatgtag

SEQ ID NO: 199182 - DNA, 1938 bp, Artificial Sequence
  Description of Artificial Sequence: Synthetic coding sequence
atgagcggccagagcctgaccgaccggatcaccgccgcccagcacagcgtgaccgggtctgcagttagtaagactgtgtgtaaggccacgacccatgagatcatgggacccaaaaagaaacacctcgactatctgattcagtgcacaaatgagatgaacgtgaatattcctcagctcgccgatagtctctttgagcggactactaacagttcttgggttgtcgtattcaaaagtctcattacaacccatcacctgatggtgtatggcaacgaaaggtttattcagtacctcgcgtcaagaaacacacttttcaatctctctaattttctggataagtctggtttacagggttatgatatgagtacgtttatccgacggtactctcggtacctgaatgaaaaggctgttagttataggcaggtggcttttgatttcaccaaagtcaagcgcggggccgacggggttatgaggaccatgaataccgagaaactcctcaaaacagtgcctattattcagaatcagatggacgccctgctggatttcaatgttaattccaacgaactcaccaacggagtaattaatgccgctttcatgttattattcaaggacgcaatcagattatttgccgcctacaacgagggcataatcaatttactggagaagtattttgatatgaagaaaaatcaatgcaaagagggcctggatatttataagaagtttctcacaaggatgacacgaatttcagagtttctcaaggtcgccgagcaggttgggatagataggggagacattccagacctcagtcaggcacctagctccctgttggacgcgttggaacagcaccttgctagcctggaaggcaagaagatcaaagattcaaccgcagcttccagggctacgacactcagcaacgccgtttcatcactggcgtcaactgggctgtctctcactaaagtggacgagcgagagaagcaggccgcactcgaagaagaacaagctagactgaaggcccttaaggagcagcggttgaaagagctggccaagaaaccccatacatccctgacgaccgctgccagcccagtcagcacctctgctggcggcatcatgaccgccccagcaatcgatattttcagcaccccatcctcgtccaacagtactagcaagctgccaaacgatttgttggacttacagcagcccacgtttcacccttccgtgcaccctatgagcactgcatctcaggtggccagtacatggggcgatgcggtggacgacgccatcccgagccttaatcctttccttaccaagtcctctggagatgtgcatctgtctatttccagcgatgtaagtaccttcactacaaggacgcctacgcacgaaatgttcgtcggcttcaccccgagccctgtggcacagccccacccttccgccggcctcaacgtcgactttgaatccgtcttcggcaataagagcaccaatgtcatagtggatagtggcggatttgacgagctcggcgggctgttaaagccaactgtggcctcccagaaccaaaacctgcccgtggccaagctccctccctcaaaactggtgtccgatgatttagattcatccctggctaatctggtaggtaacctgggtattgggaatggcaccacaaaaaacgacgtgaactggagtcagccaggtgaaaaaaaactcactggaggtagtaattggcaaccaaaggtggcaccaactacagcctggaatgccgctaccatggccccccccgtcatggcatatcccgccacaactcctactggaatgatcggatacgggattccgccccagatggggtctgttccggttatgacacagcctacactgatctattcgcagcccgtgatgcgaccaccaaatccattcggtccggtttccggagctcagatccaattcatgtag

SEQ ID NO: 199183 - DNA, 1833 bp, Artificial Sequence
  Description of Artificial Sequence: Synthetic coding sequence
atgagcggccagagcctgaccgaccggatcaccgccgcccagcacagtgtgacaggctcagcggtctcgaaaacggtctgcaaggccacaacccacgagatcatgggccctaagaaaaagcatcttgactacttgattcagtgtaccaatgaaatgaatgttaatataccacagctcgcagattcactgttcgagcgaactacgaatagctcatgggtagtggtcttcaaatcgcttatcaccactcaccaccttatggtctacggcaacgaaaggttcattcagtacctcgccagcaggaatacgcttttcaacctaagcaactttttggataagagcggactgcagggctatgatatgtctacctttatacgtcggtactctaggtacctgaacgagaaggcggtgagttacaggcaggtggcctttgatttcacaaaagtaaaacggggagcagacggcgtgatgcgaacgatgaatacagagaaattgctcaaaaccgtgcccatcatccagaaccagatggacgcattactcgacttcaacgtaaattcaaatgaattgacaaatggggtaatcaatgctgcctttatgctgttattcaaggatgcaatccgtttatttgccgcctacaacgagggcattattaacctcctggaaaaatatttcgatatgaagaagaatcaatgtaaagaaggtttagatatctacaagaagttcttgactcggatgacaaggatctctgaattcttgaaggtagcagaacaagtaggtatcgaccgaggcgacataccagatctgtcacaggctccctctagcttacttgacgcactagagcagcacctcgcctctctagaaggaaagaaaatcaaggattccacggccgcatctagagccaccacgttgtctaatgccgtgtcaagcctcgcatccactgggctgtccctgaccaaagtagacgaaagggaaaaacaggcagcacttgaagaggagcaggcacggcttaaagctctgaaggaacagcgcctgaaagagctcgcaaagaaacctcacacttctctgaccacagctgccagtcctgtttctacgagtgccgggggcataatgaccgcccctgcgatcgacatcttctctacaccttcctcttctaatagcacctccaagctgcctaacgatttgcttgatctccagcagcccacatttcacccgtcagtccaccccatgtcaacagcaagccaggtggcctctacttgggggggttttaccccctctcccgtagcgcagcctcatccatcagctggcttgaatgtcgactttgagagcgtattcggtaacaaaagtacgaatgtgatagttgattctggcggattcgacgaactgggtggcttactgaaaccaacggtggccagtcagaaccagaatctccctgtcgctaaactccccccttccaaactagtgagcgatgacctcgacagcagtctggccaacctggtagggaacctggggatagggaacggaaccactaaaaatgacgtgaactggtctcaacccggcgaaaaaaagcttaccggtggaagcaactggcagccaaaagtcgcccccaccactgcctggaacgccgcgaccatgaatggcatgcactttcctcagtacgccccccccgtcatggcatacccagccacaacacccaccggcatgatcggttacggaatccctccccagatggggtcagtgccagtcatgacacagccaacactcatctatagccagcccgtgatgcgacctcctaacccattcggtccagtcagcggagcacagatccagttcatgtag

SEQ ID NO: 199184 - DNA, 1656 bp, Artificial Sequence
  Description of Artificial Sequence: Synthetic coding sequence
atgaacgtgaacatcccccagctggccgacagcctgttcgagcggactactaacagcagctgggtcgtggtgtttaaatccctaatcacaacccaccaccttatggtatacggcaatgaaagatttatccagtatctggcatcacgaaatactctgtttaatcttagcaacttcctggataagtcaggcctacaaggctacgacatgtccacattcatcagacggtactctcgctacttgaacgaaaaagccgttagctacaggcaggtggccttcgactttacgaaggttaaacggggcgcagatggcgtaatgagaacaatgaataccgagaaactcctaaaaactgtcccaataatacagaatcagatggacgccttgctagacttcaatgtaaacagtaacgagctgactaatggggttattaatgctgcctttatgctgctgtttaaggacgctatccgcctatttgcagcgtataacgagggcatcattaacctgctggagaaatactttgacatgaaaaagaatcagtgcaaagagggtttggatatctataaaaagtttctgactcgcatgaccagaatatccgagttcctcaaggtggccgagcaggttggtattgacagaggtgacattccagatctgtctcaggcaccatccagtctgctggacgctcttgaacagcacctcgcgtcactagagggcaagaagatcaaggacagcacagccgcttcgagagctactactctttcaaatgctgtgtcgtccctcgcttccacagggctgagcttgacaaaggtggatgagcgggagaagcaagccgccttggaggaggagcaggcccgcctgaaagccttaaaggaacaaaggctcaaggagctggccaaaaagcctcacacgtctctgaccactgctgcatccccagtgtctacttcggcaggcgggatcatgactgcaccagctatcgatatcttttccacgcctagctctagcaacagtacctccaagctgcccaacgacctgttagacctgcagcagcctacgtttcaccctagcgttcatcctatgtctaccgcatcccaggttgcttctacttgggggggattcactcctagtccagtggcccagccccaccctagtgccggcctgaacgtggatttcgagagcgttttcggaaataagtctacaaacgtgatcgttgattcaggtgggttcgatgagttaggcggcctgctgaaaccaactgtggcgtcccagaatcagaatctcccggtcgccaagctacctccttccaagctggtgagtgatgacttggactctagtctcgccaatctggtcggcaatttagggatcggcaatggcactacgaaaaatgatgttaactggtcacaacctggcgaaaagaaactgacaggcggttccaactggcagccaaaagtggccccgaccacagcctggaatgcagccacaatggctccccctgtgatggcttacccagccacaacccccacggggatgatcgggtatggcattccccctcagatgggttccgtccctgtgatgactcagccaactctaatttactcccagcctgttatgagaccgccaaacccgttcgggcctgtgagcggtgcacagatacaatttatgtag

SEQ ID NO: 199185 - DNA, 1455 bp, Artificial Sequence
  Description of Artificial Sequence: Synthetic coding sequence
atggcctgccggggcggcgccggcaacggccaccgggccagcgccaccctgtcacgtgtgtcccctggttctctgtacacctgccgaacccgaacacataacatttgcatggtgtctgatttcttctatcccaacatgggcggagtcgagtctcacatttaccagctgagtcaatgcctgatagagcgtgggcacaaggtgataattgtgacccatgcatacggcaaccgtaagggcatacggtatctgactagcggtctcaaagtctattacctgccactaaaggtgatgtataatcagtctacagctaccacactcttccatagcctgcccctgctccggtacatatttgtgcgggaacgcgtgacaataatccattcccatagctcgtttagcgcaatggcccatgatgcattattccatgcaaagaccatggggctccaaaccgtatttacagatcactccttgtttggtttcgccgatgttagttctgtcctcactaacaagttgctaactgtctcactttgcgatacgaaccatattatatgcgtgtcatatacctccaaggagaacactgttctcagggccgcccttaacccagagatcgtgtccgtgattcctaacgcagtagatcccactgattttacccctgacccatttagacgccatgactccataacaatcgtggtggtttctcgcctggtgtacaggaaaggaatcgatttactctccggcattataccagaactctgccagaagtatcccgacctaaattttatcatcggtggtgagggcccaaagcgaatcattctggaggaggtgagggagcgttaccagctgcatgatagagttaggctcctgggcgccctcgagcacaaagatgttagaaatgtgctggttcagggccacatcttccttaacacaagcctcaccgaggccttttgtatggcaattgtggaggcagcctcatgcggtctgcaggttgtgagtacaagggtgggagggattccagaggtgctccctgaaaatctaatcatcctgtgtgaaccttccgtcaaaagtctctgcgagggtctggagaaggcaatctttcagctcaaatctggcaccctgccggcgcctgaaaatatacacaatatcgttaaaactttctatacttggcgtaatgtagcggagaggacggaaaaagtatacgaccgagtgagtgtcgaagcagtattgccaatggacaagcggttggaccggctaatatcgcattgcggtcctgtgacgggatatatctttgcgctgttagccgtgtttaattttctgtttctgatttttctccgctggatgacacctgatagcatcatcgatgtcgccattgacgctaccggtcctagaggtgcctggaccaataactattctcacagtaaaagaggaggggaaaacaacgaaatctctgaaaccagatag

SEQ ID NO: 199186 - DNA, 510 bp, Artificial Sequence
  Description of Artificial Sequence: Synthetic coding sequence
atggccatcgtggaggccgccagctgcggcctgcaggtggtgagcactcgcgtcggcgggataccagaggtcctccctgaaaatctcatcattctgtgcgaacccagtgtgaagtcactgtgtgagggattggagaaggcaattttccagttgaaaagtggcaccctccctgctccggagaacatccacaacatcgtcaagacattttacacctggagaaatgtggcggaacgtacagaaaaagtatacgatcgggtcagcgtggaagccgttctcccgatggacaagaggctggacagactgatctcacattgcgggccagttaccggctacatttttgccctgctagccgtgtttaacttcctgttcctcatctttttgcggtggatgacgccggattcgatcattgatgtggctatcgacgccaccgggcccaggggggcctggaccaataactactcccatagtaagagaggaggcgaaaataacgaaattagcgaaacccgttag

SEQ ID NO: 199187 - DNA, 753 bp, Artificial Sequence
  Description of Artificial Sequence: Synthetic coding sequence
atggagctgaccggcatcgacctgctgagcggcatcatccccgagctgtgccagaaatatccagatcttaactttattattggcggtgagggacctaagaggatcattctcgaagaggtgagggagagataccaactgcatgacagagtgcgcctgctgggcgccctggagcataaggatgtgaggaacgtgctggtgcaagggcacatcttcctgaacaccagtttaaccgaggccttttgcatggccattgtcgaggccgcgagttgtggtctgcaggttgtatcaactagagtgggtgggatccccgaggtgctacctgagaacctgattatcctttgtgagccaagtgtcaaaagtctctgcgagggtctggaaaaggccatttttcagttaaaaagcggcacccttcccgcacccgagaacatccacaacatcgtgaagacattttacacctggcgcaacgtggccgaacgcactgagaaagtctatgaccgggtgtccgtcgaggcagtgctcccaatggacaaaagactcgatagattgatttcacactgcggcccagttacgggatatatctttgcactcttagccgtgtttaattttctgttcctgattttcctgcgttggatgactcccgattcaatcattgatgtggccattgacgccactggacccagaggcgcttggactaacaattacagccacagcaagaggggaggcgaaaacaatgaaattagcgaaacaagatag

SEQ ID NO: 199188 - DNA, 1665 bp, Artificial Sequence
  Description of Artificial Sequence: Synthetic coding sequence
atgcggcggcccctgagcaagtgcggcatggagcccggcggcggcgacgcatccctcacgttacacggactccagaacaggtcacacggaaagattaagctgagaaaacgtaagtcgaccctgtactttaatacgcaggaaaaatccgccagaaggaggggagacctcttaggggagaatatctatctgttgctatttaccatagctctacgcattctcaactgtttcctggttcagacctcctttgtgcccgacgagtactggcagtcgcttgaagtatcccatcacatggtcttcaattacggctatctcacgtgggaatggacggaaaggctcagatcctatacgtacccactgatctttgctagcatttataaaattctgcacctcctgggaaaagacagcgtgcagctcctcatatggatcccacggttagcgcaggcactgctgagtgcagtggccgacgtgagactgtacagcctgatgaagcaattggaaaaccaagaggtggcccggtgggtgttcttttgtcaactctgttcatggttcacttggtactgttgtactaggactctcactaatacaatggaaacggtcctaacgataattgccttgttctactaccctttggagggcagcaagagcatgaatagtgtgaagtattcctccctggtggcgctcgctttcattataaggccaacagctgtaattctctggacacccctcctgttcaggcacttctgccaggaacctagaaagctggatctgatcttgcaccactttctacctgtgggatttgtgaccttgtcactatccctgatgatcgacaggattttcttcggacagtggaccttggtacagtttaacttccttaagtttaatgtccttcagaactgggggaccttctatgggagccacccatggcactggtatttctcgcagggattcccagtcattttggggacccacctgccgttttttatccatggctgttacctcgcacctaaaagataccggattctgttggtgacagtgttgtggacactcttggtgtactctatgctcagccacaaggaattccgatttatctacccggtgttgccattctgtatggtgttctgcggctactccctgacccatctgaagacctggaaaaaaccagcactgtcttttttgttcctgtctaatttgttccttgcactctacacaggacttgtgcaccagagaggaactctggacgttatgtctcatatccagaaggtgtgctataacaatcctaacaagagtagtgcatccatcttcatcatgatgccctgccactccacaccctactactcccacgtccactgtcctctgccaatgagattcctccagtgtccaccggatttaaccgggaaatctcattatctggatgaggccgacgttttttatttaaatcccttgaattggttacatcgggagttccacgacgatgcatctctgccaacacacctgattacattttcaatcctggaggaggaaatctctgcttttttgattagctctaactataagcggactgctgttttcttccacacccatctgccagaggggcgcatagggtcacatatctatgtatacgagagaaaattgaagggcaagttcaacatgaaaatgaagttttag

SEQ ID NO: 199189 - DNA, 1080 bp, Artificial Sequence
  Description of Artificial Sequence: Synthetic coding sequence
atggagaccgtgctgaccatcatcgccctgttctactaccccctggaggggagcaaatctatgaatagtgtaaagtattcttccttagtcgctctggcatttattatccgacccacagccgtgattctgtggacacccctcttgttcagacacttctgccaggagcctagaaaactcgacctgattctacaccatttcctccctgtgggttttgttaccctaagcctctctttgatgatcgacagaatcttctttggccagtggacacttgtgcagtttaatttccttaagtttaacgttctgcagaactggggaaccttctacgggagtcacccttggcactggtacttttctcagggcttcccggttattctggggacccacctgcccttcttcatccacggatgctatctcgcacccaagaggtataggatcttgctggtcaccgtgctctggaccctgcttgtgtacagcatgcttagccacaaggagtttcgctttatatatcccgtactgccgttttgcatggttttctgcggatacagcttgacccatctaaagacctggaagaagcctgctctcagcttcttgtttctgtcaaatctgttccttgccctgtacactggcttagtgcaccagcgcggcaccttagacgtgatgtctcatattcaaaaggtctgttataataaccctaataagtcttcagcgtccattttcatcatgatgccatgccactccaccccctattactcacacgtgcactgcccgctcccgatgagattcttacagtgtcctccggatctgactggtaagtctcactacctggatgaagccgacgttttttatctcaatcctcttaattggctccacagagaattccacgatgatgccagtctgccgacccatctgataaccttctccatactcgaagaggaaattagcgctttccttatcagctctaactataagcgaaccgccgttttcttccatactcaccttccggagggacggattgggagccacatttacgtgtacgaaaggaaactgaaagggaagttcaatatgaaaatgaagttctag

SEQ ID NO: 199190 - DNA, 894 bp, Artificial Sequence
  Description of Artificial Sequence: Synthetic coding sequence
atgtacgcccagcccgtgaccaacaccaaggaggtgaagtggcagaaggtgttgtacgaaagacagccttttccagacaactacgttgatagacgctttctcgaggagctgcgcaagaatatccatgcgagaaagtaccagtattgggcagtggtgttcgaaagttccgttgtaattcaacagttatgctcagtctgtgttttcgtcgtgatttggtggtatatggatgagggcctgcttgcgccccactggctactgggcacaggtcttgcgtcatcgctgatcggttacgttctatttgacctaatagatggaggggaagggaggaagaaatctggccaaacaagatgggcggacctgaaaagcgctctggtgttcattacattcacctacggatttagtccggtgcttaagactctgactgaatccgtttcaacagacactatatacgcgatgtccgtgttcatgctgctcggccatctgatctttttcgactatggagctaatgcagctatcgtctcatcgactctctctttgaatatggccatcttcgcttccgtttgcctggcaagcaggctgcctaggtccctccacgcattcataatggtaaccttcgccattcaaatttttgctttatggccaatgttacagaagaagctgaaagcatgtacaccgcggtcttatgtgggagtcactctgcttttcgctttcagtgctgtaggggggctactctccatcagcgccgtgggtgctgtgttatttgccctcctcttgatgagtatctcctgcttgtgtcctttctatttaatccggctgcagctcttcaaggagaatatccatggtccgtgggacgaagccgaaatcaaggaggacctgtcgcgatttctctcgtag

SEQ ID NO: 199191 - DNA, 894 bp, Artificial Sequence
  Description of Artificial Sequence: Synthetic coding sequence
atgtacgcccagcccgtgaccaacaccaaggaggtgaagtggcagaaggttttgtatgaaaggcagcctttcccggacaactatgtagatcgaagatttctcgaggaactacgcaagaatattcatgcccggaaataccagtactgggcagtggtgtttgagtccagcgtcgttattcagcagctttgctctgtttgcgtatttgtcgtgatctggtggtacatggacgaggggcttttggctcctcattggctgttggggacgggcctcgcaagcagcttgatcggttatgtattatttgacttaattgatggtggggagggccgaaaaaagtcaggccagacacgatgggcagatctcaagtccgccctcgtattcattacattcacgtatggcttcagccctgtgctgaaaactctgacggagagtgttagtactgatactatctacgctatgtcagtttttatgctcctaggacacctcatcttctttgactacggagccaacgccgccatcgtgagcagtaccttatccctgaatatggctatcttcgcctcagtgtgcctagccagtcgactccctaggagtctccatgcttttattatggtgactttcgccatccagatttttgccctgtggcccatgttgcaaaaaaaactgaaggcctgcaccccacgaagctatgtcggtgtgactttattgtttgcattctctgccgtgggcggactgctgagcatatccgcagtgggggcagtgctgtttgctttgctgctgatgagcataagctgcttgtgtcctttttacctcatccggctccagctgttcaaggaaaacattcatggcccatgggatgaggccgagataaaggaagatctttcacggttcctgtcctag

SEQ ID NO: 199192 - DNA, 894 bp, Artificial Sequence
  Description of Artificial Sequence: Synthetic coding sequence
atgtacgcccagcccgtgaccaacaccaaggaggtgaagtggcagaaagtcctttacgagaggcagcctttccctgacaattacgtggatagaagatttttggaggagctgcgtaagaacattcacgctcgcaagtatcagtactgggccgtcgtttttgaatcatcggtggtgatacagcagttgtgctcagtgtgcgtctttgtggttatctggtggtatatggacgagggcctgctcgccccacattggctgctgggtactgggttagcgtcttcgctcatcggctacgtgctgttcgatctgatagatggcggagagggccgcaaaaagagcggccagacaaggtgggccgacctgaaatctgccctagtgttcattacatttacctacggcttcagtcctgtcctcaagactctcaccgaaagtgtctcgacggacaccatttacgcaatgagcgtttttatgttgcttggccatctgatctttttcgattatggggcaaacgcggcgatcgtatcatctactctttcattaaatatggcgattttcgcttctgtgtgtttagcatcacggctacctcgctccctgcacgcattcatcatggtgacctttgcgatacagatctttgcgctctggcccatgttgcagaaaaaattgaaggcttgcacgccccggtcttatgtgggggtcacactcctcttcgccttctctgcagtgggaggactcctttctattagtgccgtgggagcagtcctctttgcccttctccttatgtcaatctcttgtctgtgtccattttacctaattagacttcagctattcaaagagaatattcatggcccgtgggacgaggcagagataaaagaagatctaagccggttcctgtcctag

SEQ ID NO: 199193 - DNA, 660 bp, Artificial Sequence
  Description of Artificial Sequence: Synthetic coding sequence
atgaaggacaacgacatcaagcggctgctgtacacccacctgctgtgtatattcagtataattttgtcagtgtttataccatcactgtttctagaaaactttagcattctcgagacgcacttaacctggctctgtatatgtagcgggttcgtgacagctgttaacctggtcctttacctcgtcgtcaagccaaataccagttctaaaagatctagcctctctcataaggttacagggttcttgaaatgctgtatatatttcctgatgtcgtgtttttccttccacgttatcttcgtcctgtatggagctcctctgatcgagctggcacttgaaacattcttatttgccgtaattttatccacgttcacaacagtcccttgcctgtgtctgctgggtccaaacctcaaggcttggctccgagtcttctcccggaatggggtgacctctatttgggagaattctctgcagattacaacaataagcagctttgttggcgcatggttaggcgccttacccatcccgcttgactgggagcgtccatggcaagtatggcccatcagctgtaccctgggggctacgtttggatacgtcgcaggactcgtaatcagccctctgtggatctactggaaccggaaacagctaacctacaagaacaactag

SEQ ID NO: 199194 - DNA, 621 bp, Artificial Sequence
  Description of Artificial Sequence: Synthetic coding sequence
atgaaggacaacgacatcaagcggctgctgtacacccacctgctgtgcatcttttctataatcttgtcagtgtttatcccatcactctttttggaaaacttctctatactggagacccacttgacgtggctctgcatatgttcaggtttcgtcaccgctgtgaatttggttctctacttggtggtgaagcccaatacatccagcaaaaggagctccctctcgcacaaagtaacgggttttttgaaatgttgtatctattttctcatgagttgcttttcatttcacgtgatcttcgtgctatacggtgcccccttgattgaactggccctcgagacctttctgttcgcggttatattatccacctttactacagtgccttgcctttgcctactcggacccaatttgaaggcttggctcagagttttctctcgcaacggcgtaaccagtatttgggagaacagcttgcagataaccacaatcagctccttcgtcggcgcctggctgggcgcactccctatccctctcgactgggaaaggccttggcaaatgacagtggagcgaaaacgttccacataccgcagtctccacgtcccttgtagaggcctgggaactgtgaagtag

SEQ ID NO: 199195 - DNA, 150 bp, Artificial Sequence
  Description of Artificial Sequence: Synthetic coding sequence
atgaaggacaacgacatcaagcggctgctgtacacccacctgctgtgtatatttagcatcattctgagcgtgttcatcccttcgctgtttctggaaaacttttccattctagaaacccacttaacttggttgtgtatttgctccggttag

SEQ ID NO: 199196 - DNA, 999 bp, Artificial Sequence
  Description of Artificial Sequence: Synthetic coding sequence
atggccgtgaccgacagcctgagccgggccgccaccgtgctggccaccgtgctcctgctgagtttcggcagcgtggcagccagccatatcgaggatcaagccgagcaattctttaggagcggtcacaccaataattgggcagtgttagtatgcactagccgtttctggttcaattatagacacgtcgccaataccctgagcgtttaccgcagtgtcaagcgtctcggaattcccgacagtcacatcgtgctgatgttggcagacgatatggcctgtaacccacggaaccccaagcccgccaccgtgttctcccacaagaacatggaactaaacgtgtacggcgatgatgtggaagtggactatagaagctatgaagtcacagtggagaactttttgcgtgtgcttactggtaggattcccccgagcacgccccgcagcaaacggctcctgagcgacgatcgaagtaatatactgatctacatgactgggcacggaggcaacggattccttaagttccaagattcggaagagattaccaatattgagctggctgatgctttcgagcagatgtggcagaaacgaagatataatgaactgttgtttataattgatacgtgccaaggggccagcatgtacgagcgcttttatagtccgaatatcatggcattggcaagctcccaggtcggagaggattctctgtcccatcaaccagacccagccataggcgtgcatctgatggatcggtacaccttttatgtgctggagtttttagaagagattaatcccgccagccaaaccaacatgaacgacctgttccaagtgtgcccgaagagcctctgcgtatcgacccccgggcaccgtacggacctctttcaacgggaccctaagaacgttctgattacggacttcttcggatctgtgagaaaggtggaaataactacagagactataaagctgcagcaagacagcgagattatggaatccaggtattcctcatag

SEQ ID NO: 199197 - DNA, 1188 bp, Artificial Sequence
  Description of Artificial Sequence: Synthetic coding sequence
atggccgtgaccgacagcctgagccgggccgccaccgtgctggccactgttctgctgctgagctttggctctgtggcagcctctcatatcgaagaccaggccgagcagttcttcaggagtggccacacaaacaactgggctgtgcttgtttgcacttcacgattctggttcaattatcggcacgtcgcgaacacgctgagtgtgtaccggtcagtaaagagacttggaatacctgatagccacattgtcctgatgttggcagacgacatggcatgcaatccaagaaacccgaagcctgccacagtattttcgcacaaaaacatggagctgaatgtctacggggacgatgtggaggttgattaccgtagttatgaggtaactgttgagaattttctgagagttctgaccggtagaatccccccgagcacaccccggtctaaacgactgctgtctgacgacagatccaacatcctgatttatatgacagggcacggtggcaacgggtttctgaagttccaggactctgaagaaattaccaatattgaattggccgatgcgttcgagcagatgtggcagaaaaggcgctataacgaactacttttcattattgatacctgccagggcgcgtccatgtacgaacggttctacagcccgaatatcatggccttagcatcttcccaggttggggaagactccttgtcccaccaacccgatccagcaattggtgtccacctgatggaccgatataccttctatgtgctggaattcctcgaggaaattaatcccgcatctcagaccaacatgaacgacctgttccaggtttgtccgaaatctctgtgcgtttctactcccggacacaggactgacctatttcagagagaccctaaaaacgtcctcatcacagatttctttggtagcgttcgtaaagtggagatcacgacagaaactatcaagctacagcaggactctgaaatcatggagtcgtcatacaaggaggaccagatggatgaaaagcttatggagcccctaaagtacgccgaacagctgccagtggcccagataattcaccagaagcctaagttgaaagattggcatccgccaggcggattcatcttaggcttgtgggcactgatcataatggtcttcttcaaaacctacggaatcaaacacatgaagttcattttttag

SEQ ID NO: 199198 - DNA, 960 bp, Artificial Sequence
  Description of Artificial Sequence: Synthetic coding sequence
atggccgtgaccgacagcctgagccgggccgccaccgtgctggccaccgttctgttgctgtcttttggctccgttgctgcaagccacattgaggaccaagccgagcagttctttcgctccggccacacaaataactgggccgtgctggtgacagtggagaacttcctgagagtgttaaccggccgaattccacctagtactcccaggtctaagcgcctgttgtccgatgaccgttctaatattctaatttatatgaccggccacggggggaacggctttctgaagttccaagatagcgaggaaataaccaacattgaacttgccgatgcatttgagcagatgtggcagaagcgacggtataatgaactgttgtttattatcgatacatgtcagggcgcgtctatgtatgagcggttttactctcctaatatcatggctctcgctagtagccaggtaggcgaggacagcttgtcccatcaaccggatcccgcaataggagtgcatcttatggacaggtacactttttatgttctggaattcttggaagagattaaccctgcctcccagaccaacatgaatgacctattccaggtgtgtcccaaatcactctgcgtaagtacccctggccaccgcacagacctgttccagagagacccaaaaaacgtcctgattaccgacttcttcggcagtgtgcgcaaggtcgaaattaccaccgaaacaattaaactccagcaggacagcgagatcatggaaagctcctacaaagaagatcaaatggatgaaaaacttatggagccacttaaatatgccgagcagctcccagtcgcgcagatcattcatcagaaacctaaactgaaagactggcatcctccaggtggatttattctaggcctatgggcgctcatcataatggtgttcttcaagacttatggcatcaaacacatgaagtttattttctag

SEQ ID NO: 199199 - DNA, 906 bp, Artificial Sequence
  Description of Artificial Sequence: Synthetic coding sequence
atggccgtgaccgacagcctgagccgggccgccaccgtgctggccaccgtgttgctgctgagcttcggttccgtggccgctagccacatcgaggtcactgtcgagaactttctgcgcgtgctgacggggaggataccaccaagtaccccccgctcaaagcgtctgttgtccgacgaccgatctaatatactgatttatatgacgggtcacggcggcaatgggttccttaagtttcaggacagcgaggaaattacaaacatcgagctcgctgatgcatttgagcagatgtggcagaaacgtcgctataacgaattactatttataatcgatacctgccaaggcgccagcatgtacgagcgcttttatagccctaacatcatggcccttgcttcatcccaggtgggcgaggactctctcagtcaccagccggaccctgccatcggtgtgcacctgatggataggtacactttctacgttctggagttccttgaagaaatcaaccccgcgagccagacaaatatgaacgacctgtttcaagtgtgtcctaagagtctatgtgtaagtacacctggacaccggacagatttgttccagcgggatcccaaaaatgtgctgatcaccgattttttcggttcagttcgcaaggtggaaattaccacagagactatcaagctgcagcaggatagtgagattatggagtcctcctacaaggaggatcagatggatgaaaagctgatggaacccctcaagtacgctgagcagttgcctgttgcccagattattcatcagaaacctaaacttaaggactggcatcctccgggagggtttattcttgggctgtgggcacttattatcatggtattttttaagacctacggaatcaaacatatgaagttcatcttttag

SEQ ID NO: 199200 - DNA, 558 bp, Artificial Sequence
  Description of Artificial Sequence: Synthetic coding sequence
atgggcaagaagcagaacaagaagaaggtggaggaggtgctggaggaagaagaggaagaatacgttgtggaaaaggtgctcgaccgcagggtcgtcaagggcaaagtggagtacctcttgaaatggaaaggtttctccgatgaagacaacacatgggaacccgaagaaaatctggactgtccagacctgatcgccgagttccttcagtcccagaaaaccgcccatgaaacagacaaatccgaaggtgggaaacggaaggccgacagtgattcggaagataagggggaagaaagcaagccaaaaaaaaagaaagaggaaagtgagaagcccagagggttcgcccggggcctggagcctgagcgcattatcggtgcaaccgattcctccggggaactcatgtttttaatgaagtggaagaatagcgacgaggccgatctggtgccagccaaggaagccaacgtcaagtgtcctcaggtagtcatatctttctacgaggagaggctcacatggcattcctatcctagcgaagatgacgacaaaaaggatgataagaattag

SEQ ID NO: 199201 - DNA, 735 bp, Artificial Sequence
  Description of Artificial Sequence: Synthetic coding sequence
atggaggccatgtggctgctgtgcgtggccctggccgtgctggcctggggattcctgtgggtctgggacagctctgagagaatgaagtctagggagcaggggggacgtcttggcgcagaatctcgcactctgctggttatcgcccatcctgatgacgaggcgatgttcttcgcacccactgtgctaggactggcgcgcctccggcattgggtctatctactctgcttttctgccggtaactattacaaccaaggagagacgaggaagaaggaactgcttcagtcttgtgacgtactaggtattcctctgtcaagcgtgatgattatagacaatagggactttccagacgatcccggaatgcagtgggacaccgaacatgtggccagagtgctgctgcagcatatcgaggtgaacgggattaatctcgttgtgaccttcgacgccgggggcgtttccggccactccaatcacatcgctctttacgcagccgtacgtgttctgtgcgcccatgcatcagtgtgtgagtgtgctgcacaagtacacctgccctctggcagtgcacttgtctctgcctcatacgcaggttgcccgctgcgtgctcagcagcaacggagcgggactggccaggagtcacatgtccttccgccccaacctgctcccctggtgcccccaccgctgcattatttgctaccagtacacgaaaaccagcttacagagctgcccctcaagccctag

SEQ ID NO: 199202 - DNA, 1272 bp, Artificial Sequence
  Description of Artificial Sequence: Synthetic coding sequence
atgggcagcaccaagcactggggcgagtggctgctgaacctgaaggttgcccctgccggagtcttcggggttgcctttctggcgcgagtggccttggtattttacggggtgtttcaagatcgaacccttcacgtgcggtacacagacatcgactatcaggtcttcacagatgccgcacgatttgtgaccgagggtagaagtccttatctccgcgcgacttacagatatactcctttgcttgggtggttactgacaccgaatatttacctgagtgaacttttcgggaaattcctgttcattagctgtgacttattaacagccttcctattgtaccgtctgctcctcctgaaaggactgggccgaaggcaggcatgcggctattgtgtgttctggctcctcaaccccctccccatggctgtgtcaagcaggggcaatgccgactctatagtggcgtcattggtgctgatggtgctgtacctgattaaaaaacgattggttgcctgcgcagccgtattctatggtttcgccgtgcacatgaagatatacccagtgacatacatattgcccatcaccctgcacctgctgccagacagggataatgataaatctctcaggcaatttaggtacacttttcaggcctgcctttatgagctcctcaagagactctgcaatcgagcggtattactgtttgtggccgttgcggggctcactttcttcgccctgagcttcgggttttactacgaatacggctgggaatttttagaacacacctatttttaccatctgacgcgcagggatataaggcataatttctctccttacttttatatgttgtacctcacggccgagagcaagtggagttttagcctcggcatcgccgcattcctaccgcaactgatcctgctgagcgccgtctcattcgcgtattaccgggatctcgtgttctgctgtttcctgcacacttcgatcttcgtaacatttaacaaagtgtgtacctcccaatattttctgtggtacttgtgtctactgccactcgtgatgcccttagtgaggatgccttggaagagggctgtcgtcctgctgatgctgtggtttatcggacaagcgatgtggctggctcccgcgtacgtcctggagttccaggggaagaatacattcctgttcatctggctcgcaggcctattcttcctgcttattaattgtagcattcttatccaaattatctctcattataaggaagagcccttgactgagagaatcaagtacgactag

SEQ ID NO: 199203 - DNA, 2796 bp, Artificial Sequence
  Description of Artificial Sequence: Synthetic coding sequence
atgctgctgttcttcaccctgggcctgctgatccacttcgtgttcttcgcaagtattttcgacatttattttacttctccgctagtccacggcatgacccctcagttcacacctctgcccccccccgcacgccggcttgttctcttcgttgcagatggtctgcgcgcagacgcactttacgagctggatgagaatggcaactcgcgcgctcctttcatacgcaatatcatcatgcatgagggttcttggggaatctcgcatactagagtgccaactgaaagcagacctgggcacgtcgcactcatagcaggcttctatgaagacgtttccgccgtggccaaaggctggaaagagaatccagtggaattcgacagtctctttaacgagagtaaatacacctggagctgggggagcccagacattctgcccatgttcgcgaaaggcgctagcggtgatcacgtctacacttacagttacgacgctaaaagagaggattttggtgcacaggacgccactaaattggatacctgggtcttcgacaatgtgaaagatttctttcatcacgctcgcaataaccaatccctgttcagtaagatcaacgaagagaagatagtatttttcctgcacctcctcggtattgacacgaatggccatgcccatcggccttctagtcgcgattacaaacataatatcaagaaagttgacgatggggtgaaggagatagtgagcatgttcaatcacttttacggcaacgacggtaaaacaacatttatatttactagcgatcacggtatgacagactggggctcccacggcgctggacacccaagcgagaccttaaccccactggttacttggggggccgggattaagtaccctcagagggtttctgctcagcagtttgacgatgccttcctaaaagagtggaggttggagaactggaagcgcctcgatgtaaatcaggctgatatcgccccgttaatgaccagtttgattggggtcccttttcctctaaattcagtgggaatcctgcccgtcgattacctaaacaacacggatctttttaaagcagaatcgatgttcactaacgctgttcaaatcttggaacagtttaaggtgaagatgactcagaaaaaagaggtcacactcccgtttctgttcactccttttaaactcctatctgacagcaagcagttcaatattctgcgcaaagcacgatcctacatcaagcatagaaagttcgacgaagttgtgtctctgtgtaaggagctaattcacctggcactgaaaggactgtcttactaccatacctacgataggttctttctgggcgtgaatgtggtgatcgggttcgtgggctggatcagttatgcatctctactcataatcaaatctcattccaatcttataaaaggcgtgtccaaggaagttaagaagccgagccacctgctgccatgctcattcgttgctatcggcattctagtcgctttcttcctgctgatccaggcatgtccgtggacttactatgtgtacgggttgcttccactgcccatttggtacgcagttctgcgggaattccaggtgattcaggatctggtcgtgtctgtgttgacatatcctctctcccactttgtcggctacctgcttgcctttactcttggaatcgaagtcttagtgttatcctttttttacaggtacatgctcacagcagggttaacagcatttgccgcctggccattcttgacacgattgtggactcgggctaaaatgacctctttgagctggaccttctttagtctgctcttggccgtctttccacttatgccggtagtgggccggaaaccagatattagcctcgtcatgggcgcaggcttactcgtgttacttctgtctctctgtgtcgtcacctccctcatgaagcggaaggattcttttattaaagaggagctactggtccatctcctccaggttctgagcacagtcctctccatgtacgtcgtgtacagcacccaatcatctctgttaagaaagcagggactgccattaatgaaccaaattatctcctgggctactctcgcttccagcttagtggttccactactgtcgtcacccgtactgttccagcgactgttctccattttgctttctctgatgtcaacttatctgctccttagcaccggttacgaagccctctttccattggttttaagttgcctgatgtttgtgtggataaacatcgagcaggagactcttcaacagtccggagtgtgctgcaagcagaagctgaccagtattcagttctcctacaatacggatatcacacaatttaggcaattgtacttggatgatataaggagagccttcttcctggtattctttctggtcactgcgttctttggtacaggtaacatcgcttctatcaactcattcgacttggcctccgtgtactgttttttaactgtcttttccccatttatgatgggagcactaatgatgtggaagattttaatccccttcgtgctagtgatgtgtgctttcgaagctgtgcagcttaccacccaattgtccagtaagtctcttttcctgattgtgctggttatatccgacattatggctctccattttttttttttggtcaaggactatggctcatggttggatatcggcacatccatcagccattacgttattgtcatgtccatgactattttcttagtgtttcttaatgggctcgcacagctgctaaccaccaagaagttgcggctgtgcgggaaacctaagagccactttatgtag

SEQ ID NO: 199204 - DNA, 2796 bp, Artificial Sequence
  Description of Artificial Sequence: Synthetic coding sequence
atgctgctgttcttcaccctgggcctgctgatccacttcgtgttctttgctagtatatttgatatatatttcacaagccctctcgtgcacgggatgacccctcagttcacccctttgcctccaccagcgcgccggctggtgctgtttgtcgctgacggactccgtgccgacgctctatatgagttggatgaaaacggaaactcaagggcgccttttattagaaatatcattatgcatgaggggagctgggggataagccataccagggttccgacagagtcgcgtcccgggcacgtggcgctgatcgctgggttttatgaggatgtcagcgccgtcgccaaaggatggaaggagaatccggtggagttcgatagcctgtttaacgagtccaagtacacatggagctggggcagccccgatatcctcccaatgtttgctaaaggtgccagcggtgaccatgtgtatacctactcttacgatgctaagcgcgaagactttggcgcacaagacgccaccaaattggacacatgggtatttgataacgtcaaagacttttttcaccacgcacgaaataatcagtcactgttctccaaaatcaacgaagagaaaattgtctttttcctgcatcttctgggaatcgataccaacggacacgcacaccggcctagctcaagggattataagcataatattaagaaagtagacgacggtgtgaaggagattgtctccatgtttaaccacttttatgggaacgacggtaagaccacctttatttttacctccgaccacggcatgactgactggggttcccatggagcgggacacccaagtgaaacgctcacgccattagtgacttggggtgcaggaatcaagtacccacagcgcgtctccgcccagcagtttgacgatgcttttcttaaagagtggcgactggagaattggaagcggttggacgtaaatcaggccgacatagcaccactaatgactagcctgattggggtgccgtttcccctcaatagcgttggaatcctaccagtggactaccttaataacaccgatctgtttaaagctgagtcaatgttcacgaatgctgtccagatcttagagcaatttaaggtgaagatgacgcagaagaaggaggtgacacttccattcctcttcacgcccttcaaactattgtccgactctaaacagttcaacatcctccgaaaagctagatcgtatattaaacaccggaaatttgacgaggtggtgagcctgtgtaaggagctaattcacctggcccttaaggggcttagctactaccacacttatgatcgatttttcctgggcgtgaacgtggttataggattcgtgggatggataagttatgcatccttactcatcataaagtcacatagtaacttgataaagggcgtctccaaggaggtgaagaagccgtcccatctgttgccctgtagtttcgttgcaattggaatactcgttgctttcttcctcctgatccaggcgtgtccctggacctactacgtatacgggctgctccctctgccaatctggtatgccgtattgagggagttccaggtgatccaggacctcgtcgtgagcgtcctgacttacccattgtcccactttgtcggctaccttctggcttttacactcggcatcgaagtgctagtgctgtccttcttctatagatatatgttgaccgccggcctgacagcgttcgccgcctggccatttctcacccggctgtggacacgggctaaaatgacatccctgtcttggacttttttttccttgctgctggccgtgtttcctctgatgccagtggtgggtcgcaagcctgatatctccctggtgatgggagctggcctactggtactgttgctctcgttgtgtgtagtgacttctctcatgaaaagaaaagatagctttatcaaggaggagttactcgtgcatctgctccaggtgctgtcaaccgttttgtccatgtacgtggtgtattccacacagtcttcactcctgcggaagcaaggcttacccctgatgaatcaaataatatcttgggccaccctggctagctcactggtggtaccgctgctatcctctcctgtcctgttccagaggctattttccattctgctgtccctgatgtcaacctacctgctcctcagtacggggtacgaggccctgttcccattagtgctgtcctgtctgatgtttgtctggataaacatcgaacaagaaaccctgcagcagtcaggagtatgctgtaagcagaaactgactagcattcaattctcatacaatacagatattacacagttcaggcagctctacctggatgacatacgcagggccttttttcttgtgttcttcctggtgaccgcgttttttggcaccggaaatatagcctctatcaatagtttcgatctggccagcgtgtattgctttctgacggtgttcagcccatttatgatgggcgccctgatgatgtggaaaattttgatccctttcgtcctggtaatgtgcgcttttgaagcagtgcagctcaccactcagttgagctcaaaatctctgtttttgattgttctcgtgatatccgacatcatggccctgcatttttttttcttagttaaggactacggctcctggctggacatcggaacgagcattagtcactacgttattgtcatgtcaatgactatctttctggtttttctgaacggcctcgcacaactactaacaacaaagaaactccggctctgcggtaagccaaagagtcattttatgtag

SEQ ID NO: 199205 - DNA, 405 bp, Artificial Sequence
  Description of Artificial Sequence: Synthetic coding sequence
atggtggagaacagccccagccccctgcccgagcgggccatctacggctttgtgctttttttaagttctcagtttgggtttattctttacctggtatgggccttcattccagaaagctggctcaacagtctgggcttaacttactggccgcagaaatactgggccgtggctctgcctgtgtatctactcattgccattgtgataggttacgtgctgttgtttggtattaatatgatgagcacgagtccattagactcgatccatacgatcacagacaattatgccaagaaccagcagcaaaagaagtatcaggaggaagctattccagctctacgcgatatctccattagcgaggtgaatcaaatgttcttcttagccgcgaaggagctttataccaagaactag

SEQ ID NO: 199206 - DNA, 327 bp, Artificial Sequence
  Description of Artificial Sequence: Synthetic coding sequence
atggtgctgtacctggtgtgggccttcatccccgagagctggctgaacagtctgggtctgacctactggccccagaagtattgggccgtcgctctgccggtttacttgctgatcgcgatcgtgatcggctacgttctcctttttggcattaatatgatgtcaaccagtcctctggatagcatccatactataacagataactacgctaagaaccagcagcaaaaaaagtaccaggaggaagctattccagcattgagggatatctccattagcgaagtaaatcagatgttcttccttgctgccaaggaactctacactaagaactag

SEQ ID NO: 199207 - DNA, 405 bp, Artificial Sequence
  Description of Artificial Sequence: Synthetic coding sequence
atggtggagaacagccccagccccctgcccgagcgggccatctacgggttcgtgctgttcctgtctagtcagttcggtttcattctgtaccttgtgtgggcattcatacccgaatcgtggctcaattctctgggtttaacatattggccgcaaaagtattgggccgtggccctgcccgtgtatcttttgatagcaatcgttatcggctatgtgctgttgttcggaattaacatgatgtctacaagtccattggacagtattcacaccatcaccgacaattatgccaagaatcagcagcaaaagaagtatcaagaagaagcaataccagccctacgcgatattagcatatccgaagttaaccagatgttcttcctagctgcaaaggagctatacactaagaattag

SEQ ID NO: 199208 - DNA, 405 bp, Artificial Sequence
  Description of Artificial Sequence: Synthetic coding sequence
atggtggagaacagccccagccccctgcccgagcgggccatctacggcttcgtgctttttcttagcagccagttcgggtttattctttatctcgtgtgggcctttatcccagaaagctggctcaatagtcttggcctcacatactggcctcagaaatactgggctgtggcactccctgtgtacctgctgatcgccatcgtgattgggtacgtcctgctgtttggtattaacatgatgtccacctcaccacttgactctatccacaccattacagataattatgccaagaaccaacagcagaaaaaataccaagaggaggccatccctgctctgcgcgacatttcaatcagcgaagtgaatcagatgttcttcttagccgccaaagagctgtataccaagaattag

SEQ ID NO: 199209 - DNA, 78 bp, Artificial Sequence
  Description of Artificial Sequence: Synthetic coding sequence
atggtgctgtacctggtgtgggccttcatccccgagagctggctgaatagcttgggtctgacctattggccccagtag

SEQ ID NO: 199210 - DNA, 477 bp, Artificial Sequence
  Description of Artificial Sequence: Synthetic coding sequence
atggtgccccggagcaccagcctggccctgatcgtgttcctgttccaccgactcagcaaggcaccaggtaagatggtagagaattctccatcaccacttcccgaaagagcaatctacggtttcgttctgttcctgtccagccaatttggcttcattctgtatctggtctgggcattcattcccgagagctggttgaattccctcggtcttacctactggccgcagaagtattgggctgttgctctccccgtgtacctgcttatagctatcgtgatcggttatgttctattgtttgggatcaacatgatgagcacgagccccctagattcgattcacaccattacagacaactatgccaaaaaccagcagcaaaagaaataccaggaggaggccattcctgcgctgcgagacatttctatatccgaagtcaaccagatgttttttctggctgcgaaagagctgtataccaagaattag

SEQ ID NO: 199211 - DNA, 1848 bp, Artificial Sequence
  Description of Artificial Sequence: Synthetic coding sequence
atggcccgggcctgcctgatccagcggctgcccatcaagcgggactgtactcccgtttttgtgcgcggcttatccagcccgagtgctgccatggcactgttgagcgaggggctcgatgaagtgcctgctgcctgtctctccccttgcggcccccctaatcccaccgagctcttcagtgaaagccgacggttggctttggaggagctggttgcaggaggccccgaggccttcgccgcctttttacgaagagagaggctggccaggtttctcaaccctgacgaggttcacgctatccttcgcgcagcggaaaggccaggagaggaaggcgccgccgctgccgccgcagccgaagacagtttcgggagctcacatgactgctcttcgggcacctacttcccagagcagagcgacttagagcccccactcctcgaactcgggtggcccgcgttctaccagggtgcttacagaggagccactagggtagagacacattttcagccgaggggcgctggtgagggcggcccctatggttgtaaggatgccctgcggcagcagctgcgcagcgctcgcgaggttattgcagtggtgatggatgtttttaccgatattgacatatttcgggatttgcaggagatctgccgaaagcagggcgtggccgtgtatatccttttagaccaggccttactgagccagttccttgacatgtgtatggacctgaaagtgcaccctgaacaagaaaaactcatgactgtgagaaccatcactggaaatatctactacgcaagaagtggtacgaagatcattggcaaggtacacgaaaagttcactctaatcgacgggatcagggtggccacagggtcctacagcttcacgtggacggacggtaaacttaattcctctaatcttgttatcttgagtggacaggtggtcgagcactttgacctcgagttcagaatcctgtacgcacagtccaaaccaattagtcctaagcttttgagccactttcagtccagcaataaattcgaccacctaactaatcgaaagccccaaagtaaagagcttacgttaggcaatctccttaggatgaggctggcacgactgtccagcactcccaggaaagcagatctcgatcccgagatgccagctgaggggaaggccgagcggaaaccccacgattgtgagagctccaccgtctccgaagaggattacttcagttctcatagggacgagctgcaatccagaaaggcaattgatgctgccacacagactgagcccggagaagagatgcctggcctttctgtatctgaagttggtacacaaacttctattacaacagcctgtgccggcacccaaacagccgttatcacccgtattgcctcaagccagaccaccatctggagcagatcaacaactacccagaccgacatggacgaaaatattcttttccctcggggaacgcaaagcacggaggggtctccagtgagtaaaatgagcgtgtcccgaagttctagtctgaagtccagctcttccgtgtccagtcagggctctgtggcctcttcaactggaagtccagcttccattaggaccacggatttccataaccccggatacccaaagtacttaggaacacctcacctcgagctgtacttatctgactcccttcggaatctcaacaaagaaagacaatttcactttgcaggcattaggtctagacttaatcatatgctcgccatgctctcgcggcgcacacttttcactgaaaatcacctgggcctgcactctggaaatttctctcgggtgaacttactagctgtgcgagacgtggctttatatccttcatatcaatag

SEQ ID NO: 199212 - DNA, 1248 bp, Artificial Sequence
  Description of Artificial Sequence: Synthetic coding sequence
atggccgcccccctggtgctggtgctggtggtggccgtgaccgtgcgcgctgccctctttcgttcatcccttgccgagttcatctccgaaagggtagaagtggtttccccattgagttcttggaagagagtggtagagggtttgtccttactggatctcggagtctcgccctacagtggcgctgtgttccacgaaatcaccgacgcactaactgccatcgccttgtactttgccatccaggacttcaataaggtggtgttcaaaaaacagaagctcttgttagaactcgatcagtatgcacccgatgtggccgaactgatccggactcccatggaaatgaggtacataccactgaaggtggcattgttctatctactgaatccttacacgattctgtcctgcgtcgcaaagtcaacatgcgccatcaacaatacactcatcgcattctttattctcacgaccatcaagggttctgctttcctgtccgcaatttttcttgcgctggccacttaccagtcactgtaccccttaaccctgttcgtgcccggcctgctgtatctgctgcagcgccagtatatacccgtgaaaatgaagagcaaggccttctggatttttagctgggagtacgccatgatgtacgtcggcagcctggtcgtaattatctgtctgtccttcttcttgctgagctcttgggatttcatccccgccgtttatggttttattctgagtgttcccgatctgacaccgaacatcggactgttctggtactttttcgctgaaatgttcgagcacttcagtctcttcttcgtgtgcgtctttcaaattaacgtcttcttttatacgattcctctggccataaagctgaaagagcaccccattttcttcatgttcatccagatcgctgtcatcgctatctttaagtcctaccctacagtcggagatgtggcgctgtatatggccttctttcctgtgtggaaccacctgtacaggttcctccgtaacatctttgtgctgacgtgcattatcatcgtgtgtagcctgctgttccccgtgttgtggcatctgtggatttacgcaggaagcgccaacagtaatttcttctatgcgatcactctgacttttaacgtgggacagatcctgcttatttcagactatttttacgcttttctaaggagagagtactacctcacccacggtctatatctgactgccaaagacggcacagaggcaatgttggtgctcaagtag

SEQ ID NO: 199213 - DNA, 513 bp, Artificial Sequence
  Description of Artificial Sequence: Synthetic coding sequence
gtgagcgtgcccacccacctggtgtgcccccggacccccctgagcccaccggccgccgtccacacctgcgaaaatgaagagcagagtttgctcgacctgttcctcggcgtgtgtcacgacatcaacgtgttcttttatacgatacctctcgccataaagctgaaggaacacccaatcttcttcatgttcatccagatcgctgttattgcaatctttaaatcctatcccaccgtgggcgatgtcgccttgtatatggcttttttcccagtctggaaccacctgtatcgcttcctacgtaacattttcgttctgacttgtattataattgtatgcagcttgctgtttcccgtgttatggcatttatggatctacgcagggtccgctaactccaacttcttttatgcgatcacccttacctttaacgtgggtcagattctgctcatctcagactacttctatgccttcctgcggcgagaatattatctcacgcatgggttgtatcttacagcctag

SEQ ID NO: 199214 - DNA, 1272 bp, Artificial Sequence
  Description of Artificial Sequence: Synthetic coding sequence
atggccgcccccctggtgctggtgctggtggtggccgtgaccgtgcgcgccgctctgttcaggtcttcactggcagagtttattagcgagagagtggaagtcgttagtccactctcgagttggaaacgcgtcgtggaaggcctctcactgctggatctcggagtgtccccatacagcggtgcagtctttcatgagacgcccctgataatctatctgtttcactttctgatcgactacgcagagctcgtatttatgattactgatgcccttacggccattgcactgtattttgctatacaggattttaacaaagtggtctttaaaaagcagaagcttctccttgagcttgaccaatatgctcccgacgtggcggaactcatcagaacacccatggagatgaggtacatacccctgaaagttgcactgttttatttgctgaacccatacaccatactgtcttgtgttgccaagagcacgtgcgcaatcaataacactctgattgccttcttcatcttaaccacaattaagggcagtgccttcctctctgcgatatttctggctctcgctacataccagtctctgtaccctttgacattgtttgtgccgggactcttgtacctgctgcaaagacaatatatccccgtcaaaatgaaaagcaaagcgttctggattttctcctgggaatacgctatgatgtacgtgggtagtctcgtggtgattatctgcctatcgtttttcctcctgtcatcatgggattttatcccggcggtgtatggatttatacttagcgttcctgaccttaccccaaacattggccttttctggtacttctttgcagagatgttcgagcattttagtctttttttcgtgtgtgtatttcagatcaacgtgttcttctatactattccgctcgccatcaaacttaaagaacaccctatatttttcatgtttattcaaatagccgttatagctatcttcaagtcctaccctacagtgggagatgtcgcactgtatatggccttttttccagtctggaatcatctctatcgctttttacgtaatatcttcgtgctaacctgtataattattgtctgcagcctcctctttccggtcctttggcatctgtggatctatgctggcagcgctaatagcaacttcttctatgccatcacactgacgtttaacgtaggacaaatgggattttgcggcgataggatggctggcacctgccccgaggcgataagagcagccggcgacaggaccccctcctag

SEQ ID NO: 199215 - DNA, 1482 bp, Artificial Sequence
  Description of Artificial Sequence: Synthetic coding sequence
atgtggccccaggaccccagccggaaggaggtgctgcggttcgccgtcagctgccgaattttgaccttgatgcttcaggccctgttcaacgcaatcattccagaccatcacgcagaggcttttagccctcctaggctagctcctagcggcttcgtcgaccagttagtcgagggcctactcggtggtctatcgcactgggatgcagagcattttctgtttatcgctgagcatggatatctatacgaacacaactttgctttcttcccagggttcccgcttgccttacttgtcggcacagaactgctgaggccattgagaggtctgttaagcctccgctcttgcctattaatcagcgttgcttcattaaattttctgttctttatgctagcggcagttgcactccacgacctgggctgcctcgtcctccattgcccccaccagagcttttatgcggccttacttttctgcctgtcacctgctaacgtttttcttgccgccggatattcagaggcactgtttgccctgttaaccttcagcgcaatgggccagctggaacggggacgggtctggacatccgtgttgctgtttgcgtttgctactggagtccgcagcaacggtcttgtttctgtcggtttcctaatgcattcccagtgtcaaggctttttctcttccttgacgatgcttaatccactgcggcaactttttaaactcatggcctctcttttcctctctgtttttacactggggcttccattcgccctattccagtactacgcctacacccaattctgcttgccgggctctgcacgtcctataccagaacctcttgtccagctggcggtggataagggatacaggatcgctgagggcaacgaaccgccgtggtgcttctgggatgtgccccttatatacagctacatccaggacgtgtattggaacgtcgggtttctgaaatattatgaactaaagcaggtccccaactttctgctggctgctcccgtggctatacttgtcgcatgggccacttggacctacgtgactacccatccttggctgtgtttgactttaggactgcagaggtcaaagaataacaaaactctcgagaaaccagatctgggtttcctaagccctcaggtgtttgtgtatgttgttcacgcggcagtgctgctgctcttcggcggactttgtatgcatgtccaggtcctcacaaggtttctgggctcctccacaccaatcatgtattggttcccagcccacctgctacaggaccaggagccactgctgagaagcctgaagacagttccctggaagcctctagccgaggattcgccgcctggtcaaaaggtaccccgaaatcctattatgggtctgctctaccactggaaaacctgcagcccagtgacaagatatatccttggatactttttgacctactggttgctcggactactgctgcattgtaacttccttccatggacctag

SEQ ID NO: 199216 - DNA, 1482 bp, Artificial Sequence
  Description of Artificial Sequence: Synthetic coding sequence
atgtggccccaggaccccagccggaaggaggtgctgcggttcgccgtgagctgtaggattctgactcttatgctgcaggcattgtttaatgcaattatcccggaccaccacgccgaagcctttagcccacctagactcgcacctagcggatttgttgaccaattggtggaaggacttctcggaggacttagccattgggatgccgaacacttcctgtttatcgctgaacacggctacctatacgaacataacttcgcgtttttcccagggtttcctctggctctccttgttggtacagaactcctacgtcctctccgaggactgctctctctgaggtcttgtctgctgatcagcgtggcaagcctgaactttctcttcttcatgctggctgctgtcgctctccatgatctagggtgtctggtactacattgcccacatcagtcattttatgctgccctcctgttctgtctatcgccggccaatgtctttctggccgcaggatactccgaggcgctcttcgcactcctaaccttttccgctatgggtcagctggaaagagggcgggtgtggacgtcagtcttgctgttcgcattcgctacaggagtgaggagtaatggcttggtctccgtcgggtttctgatgcactcacagtgccaaggcttttttagttcactgacaatgctaaacccgctcaggcagctgttcaaattgatggcgtcactattcttaagcgttttcactctcggactgccatttgcactctttcagtattacgcctatactcagttttgtctccctgggagcgctcgacccattcccgagccattggttcagctggccgtcgataaaggctaccggatcgctgaaggaaatgaacccccttggtgtttctgggatgtgccgttgatttatagttacattcaggatgtgtattggaacgtcggcttcctcaaatactatgagctgaaacaagtgccaaattttcttctggccgccccggttgcaatcctggttgcctgggctacctggacttatgttacaacccacccttggctctgtctcaccctgggactgcagcggtcgaagaacaacaaaaccctggaaaagcccgacctggggtttctgagcccccaggtgttcgtctatgttgtgcacgcggctgtgctgctcctgttcggtgggctgtgcatgcacgtgcaagtgttgactagatttctcggaagttctacccctatcatgtactggttccctgcacaccttctccaagaccaggagcccttacttcgaagcttgaagactgttccctggaaaccgctggccgaggacagtccaccaggacaaaaggttccgaggaatcccatcatgggtttactatatcactggaagacttgcagtcctgttacccgatacattcttggctattttctgacttattggctactggggctgctccttcactgtaactttttaccctggacttag

SEQ ID NO: 199217 - DNA, 219 bp, Artificial Sequence
  Description of Artificial Sequence: Synthetic coding sequence
atgtggccccaggaccccagccggaaggaggtgctgcggttcgccgtgtcttgtcgaatacttactcttatgcttcaagccttattcaatgcaatcattcctgaccaccatgccgaagccttctccccccctaggctggcccctagtggtttcgtggaccaactggttgaaggactgttaggaggcctgagccactgggacgctgagcacttcttatag

SEQ ID NO: 199218 - DNA, 366 bp, Artificial Sequence
  Description of Artificial Sequence: Synthetic coding sequence
atgtggccccaggaccccagccggaaggaggtgctgcggttcgccgtatcctgccggatcttgaccttaatgctacaggctctgttcaacgccattatacctgaccatcacgcggaggctttttcccctccacgcttagcccccagtgggtttgtagaccaactggtcgagggtttgttgggcggcttgagccactgggacgctgagcattttctgttcatcgcagaacacgggtatctctatgaacataactttgctttttttcccggctttcccctcgcactgctggttggaacagagctcctgcggcccctccgaggactgctcagcctgagatcttgcctgctgatcagtgtggcctcctag

SEQ ID NO: 199219 - DNA, 798 bp, Artificial Sequence
  Description of Artificial Sequence: Synthetic coding sequence
atgcccagcagccagatcaccatgcagaagcccagcctgctgctggcttggccgccccaggccctgtggacaaattcttggaagtattatgcttacacccagttctgtcttcctgggagcgcccgcccaatccccgaacctttggtccagcttgccgtggataagggctaccgcattgctgaaggtaatgagccaccctggtgtttttgggacgttcccctgatttattcctacatccaggatgtatactggaacgttgggtttctgaagtattacgagctgaagcaggtgccgaacttcttactggccgctcctgtggccattctggttgcgtgggccacctggacttatgtgacgacacatccatggctatgcctgactctgggcctccagcgctccaaaaacaacaagacactggaaaagccggacctcggattcctgagccctcaagtgtttgtgtacgtcgttcacgctgctgtccttcttctgttcggtggactgtgcatgcatgtgcaggtgctgactcgttttctcggaagcagcacccccatcatgtactggtttcctgctcacctgttgcaggaccaggaacccttgctgagatctttgaaaaccgtgccttggaaaccactggccgaagattcccctcccgggcagaaggtgcctcgaaaccctatcatggggctgctctatcattggaaaacctgcagtcccgtgacccggtacatccttgggtacttcttgacctactggttgcttggcttgctgctccactgcaatttcctgccatggacttag

SEQ ID NO: 199220 - DNA, 549 bp, Artificial Sequence
  Description of Artificial Sequence: Synthetic coding sequence
atgtggccccaggaccccagccggaaggaggtgctgcggttcgccgtaagctgcagaatcctcaccctcatgctccaggccctcttcaacgcaatcatccccgatcaccacgcagaggctttttcccccccaaggctggcgccgagtggttttgtcgatcagctagtggaaggactgctgggaggactttcccactgggatgcagagcacttcctttttattgccgagcacggttacttatatgaacacaatttcgccttctttcctggctttccgctcgccttgctcgtaggtacagagcttcttaggcccctgcgtggactcctaagtttgaggtcctgtctgctcatttccgttgcatcgctaaacttcctgttttttatgctggccgctgtcgctttgcacgatctgggatgcctcgtgctgcactgtccccaccagtcattttatgccgccctgttgttctgcctgagtccggctaatgtcttcctggccgcaggttactctgaagcactatttgccctcctcactttcagcgccatgggctag

SEQ ID NO: 199221 - DNA, 1515 bp, Artificial Sequence
  Description of Artificial Sequence: Synthetic coding sequence
atgagcgagaagcagatgaaggaggccttcgtgagcaacctgaacggcacgacagtgcttgagataactcagggactctgcttccctgcattctgcatactctgtcgtgggttcctcatcatattttcacagtatctttgctcctttagcccgacatggaaaactcgcttcctgaccgactttgtggtcctgatcgtgcccatggtagctacccttacgatatgggcttcgtttatcctgctcgaactgcttggtgttatcatatttggagcaggcctgctctatcagatctataggcgaaggacctgttatgcacgacttcctttcctcaagattctcgaaaaatttttgaacatatcattagagtcagaatataatcccgcaattagctgcttccgcgtaattacatcagctttcactgctatcgctattctggctgttgactttcccctgtttcctagacgatttgcaaaaacagagctctacggcaccggagccatggatttcggcgtcggcggtttcgtctttggttctgccatggtctgcctagaagttcgccgtagaaaatatatggaggggagtaagcttcactattttaccaatagcctgtacagcgtgtggccactcgtgtttctggggatcggccgcctggcgatcattaagtctattggttatcaagagcatttaacagagtatggtgtgcactggaatttctttttcacaataatcgtggttaaacttatcacccctctgctgctgatcatctttccactgaacaagtcctggatcatcgccttggggattacagtgctgtatcagctggccttggactttacaagcctgaaaaggctgatcctatacggtactgatggaagtggaacccgtgtgggcctgctaaatgctaatagagagggcattatcagtacccttggatacgtcgccatccacatggccggagtccagaccggactctacatgcacaagaaccgctcacacatcaaggatctcataaaggtcgcttgttttcttcttctcgccgccataagtctgtttatcagcttatacgtggtccaggttaatgtggaggccgtgtcccggcggatggccaacctggcgttttgcatctggattgtggcttccagcttgatcctgctttccagtctgctgcttggcgatattatattgtcttttgcaaagttcctaataaaaggggccctggtgccatgttcatggaagctgatacagagccccgttacgaacaaaaaacatagcgaaagcctcgttcctgaagctgaacggatggagccgagcctctgcttgataacggcattaaaccggaagcaactgatcttttttctgctcagcaacataaccaccgggcttatcaatcttatggtagatactctgcatagcagtactctttgggcactttttgtggttaatctttacatgttctcgaactgcttaatcgtatatgtgctttacctgcaggacaagaccgtacagttttggtag

SEQ ID NO: 199222 - DNA, 318 bp, Artificial Sequence
  Description of Artificial Sequence: Synthetic coding sequence
atgagcgagaagcagatgaaggaggccttcgtgagcaacctgaacgggacaacagttctggagatcacccaggggctgtgcttccccgctttttgtattctgtgtcgcggctttctgattatttttagccagtacttatgttctttctcgcccacctggaagaccagatttttaacagatttcgtcgtgctgattgtacccatggttgctactctgactatttgggctagttttatcctcttggaactgttaggggtgataatcttcggcgccggccttttgtatcaaatttacagacggcggacctgctacgcgtag

SEQ ID NO: 199223 - DNA, 831 bp, Artificial Sequence
  Description of Artificial Sequence: Synthetic coding sequence
ctggccgcccgggtggccgccgtgcgggccgccgcctggctgctgctgggtgccgccaccgggttgaccagagggcctgctgctgccttcacagcagcccgcagtgacgctggcataagggccatgtgctcagagattattctccgacaagaggttctaaaggacgggttccaccgggatcttctcataaaggtaaaatttggcgaaagcatcgaggacctgcatacctgcaggttacttattaagcaggatatacccgcgggtctctacgtcgacccctatgaattagcttcacttcgagagcggaatataaccgaggcggttatggtttcagagaattttgacatagaagccccaaactacctcagcaaagaaagcgaagtgcttatttatgcaagacgggattcccagtgcattgattgctttcaggctttccttccggtccactgtcgctatcatcggccccattccgaggatggtgaggcgagcatcgtcgttaataaccccgatctgctcatgttctgcgaccaggctggctccaggcgtatgatccgatttagatttgattcatttgataaaaccattgagttccctatactgaagtgctgggctcattcagaggtggccgctccatgtgccctggagaacgaagatatatgccagtggaataagatgaagtacaaatccgtgtacaaaaatgtaattctccaggtacctgtggggctgacagtgcacacaagtcttgtatgttctgtgaccctactcatcacaatcctgtgtagcaccctcattctggtggccgtgttcaagtacggccacttctcactttag

SEQ ID NO: 199224 - DNA, 654 bp, Artificial Sequence
  Description of Artificial Sequence: Synthetic coding sequence
atgtgcagcgagatcatcctgcggcaggaggtgctgaaggacggcttccaccgggacttactgattaaggtgaagtttggcgaatccatcgaagacttacacacttgcagactactgataaaacaggatatacccgcagggctttacgtggatccttatgagctggcttccctcagggagcggaatatcactgaagccgttatggtctcagagaattttgatatagaagccccgaattatctgtctaaagaatcagaagtcctgatctacgctcgcagggacagccaatgcatcgactgtttccaggcattcctgccggtacattgcaggtatcaccgccctcactccgaggacggcgaggccagcattgtcgtgaacaacccggacctattaatgttctgcgatcaggaattcccgattcttaaatgctgggcccatagcgaggttgccgctccctgtgctttggagaatgaagatatttgccaatggaacaagatgaagtacaaaagtgtgtacaagaatgtcatccttcaagtgccagtgggtcttacagtccacaccagcctggtctgttccgttacacttttgatcacaatcctctgctcaacccttattctcgtagctgtgtttaagtacgggcacttttcgctctag

SEQ ID NO: 199225 - DNA, 777 bp, Artificial Sequence
  Description of Artificial Sequence: Synthetic coding sequence
ctggccgcccgggtggccgccgtgcgggccgccgcctggctgctgctaggtgctgcaactggcctgacccgtggccccgcagccgccttcacagccgcacggtcagatgccggcatccgggcaatgtgtagcgagattatcctacggcaggaggtgttgaaagatggtttccatagagatttactcatcaaggtaaagttcggagagtccatcgaggatctgcacacttgtagacttttaattaagcaggacatccccgctggattgtatgtcgacccatacgaactggcgagtctgagagagcgcaatatcaccgaggccgtgatggtcagcgaaaattttgatattgaagccccaaactatctttcaaaggagtctgaagttctcatttatgcgaggagagatagccagtgcatcgactgttttcaggcgttcctgcctgtgcactgccggtatcacaggccccatagcgaggacggcgaagcctcaatcgtcgtgaacaaccccgatctcctgatgttctgcgaccaggagttccctatcttgaagtgttgggcccattctgaggtcgcggccccttgcgctctggagaatgaagacatttgccagtggaacaaaatgaaatataaatctgtgtataaaaatgtgatcctccaagttccagttggactgaccgtacacacctccctggtatgcagtgtaacacttctcatcacaatcctttgctcaactctaattctggtggcggttttcaaatatggccatttctccttgtag

SEQ ID NO: 199226 - DNA, 507 bp, Artificial Sequence
  Description of Artificial Sequence: Synthetic coding sequence
atggtgagcgagaacttcgacatcgaggcccccaactacctgagcaaggagtccgaggtactgatttacgccaggagggactcccagtgcattgactgctttcaggcattcctgcccgtgcattgccgctaccaccggccacatagtgaggatggcgaggcatccatagtggtgaacaacccagacctgctgatgttctgtgatcaggcaggatctaggcgcatgatcagatttcgattcgattcctttgataagacgatcgagtttcccattctcaagtgctgggcccattccgaagttgccgctccttgcgctctggagaatgaggacatttgccaatggaacaagatgaaatataaaagcgtgtacaagaatgttatcctgcaggtgcctgtcggattgaccgtccacacctccctggtatgttccgtcaccctgcttataaccatcctttgctctaccctaatcctggtggccgtgttcaagtatggccatttcagcctctag

SEQ ID NO: 199227 - DNA, 1740 bp, Artificial Sequence
  Description of Artificial Sequence: Synthetic coding sequence
atgcagatctgcggcagcagcgtggccagcgtggccgccggcaccagcttccaggtcttggggcccgtctgttggcaacagcttgatctgaagatggcggtgcgggtgttatggggtggactgtcactcctccgagtgctctggtgccttctcccccaaacgggctacgtgcacccagacgaatttttccaaagtcccgaggtgatggccgaggacatcttaggggtgcaagctgcaaggccttgggagttctacccttcatccagttgcagatccgttctgttcccgctgctgatctctggtagtacattttggctgctgcgcctctgggaggaattgggcccctggccggggctggtctcaggatacgccctgctcgtgggaccaagacttttgcttacagcactaagctttgccttggatggcgcggtttatcatcttgctccccctatgggtgctgatcggtggaatgctctagctctgctttcggggagctacgttacgctcgtgttttatacacgcaccttctcaaacactatagaggggttgttgtttacctggcttcttgtcctcgtctcaagtcacgtaacatggggacccactcgcaaagagcctgccccgggcccccgctggaggtcttggctcctgggagggatcgtggccgcaggctttttcaatcgccccacttttctcgcatttgccgtagtgccactgtatctatggggtaccaggggagccaccaatcccgggctgaagagtcttacccgggaagcactggtccttctgccaggggccgctctgaccgctgccgtctttgtcgcgactgattcatggtacttctctagccccgctacatcacgaaatctggtactaacacccgtcaacttcctgcattacaacctgaatccacaaaatctcgcacgacacggtacacatgcacgcttgacccatttagccgtgaacggcttcctgttgtttggcgtgctgcatgctcaggcactgcaggccgcatggcaaagactccaggttgggctgcaggccagcgctcaaatgggattgttgcgcgccctaggagcacgaagccttctttcatcccccagaagctatttgttgctcttgtattttatgccactggctttgctatctgccttcagccaccaggaagcgcgctttctgattccattgctggtgccactggtgctcctgtgctctccccagacacaaccagttccatggaaaggcaccgtagtcctgtttaacgcactgggggctcttttgtttgggtgcctgcatcagggtggcctggtccccggtctagaatatctcgagcaagttgtgcacgcccccgtgttgccaagcacccctacgcactataccctgctgtttactcacacgtatatgccccctcgccatctcctgcacctgcctggcttgggcgcaccagtggaagtagtagatatgggcgggacagaggactgggcgctgtgccagaccctgaaaagctttacccgccagcccgcatgccaggtggctggtggaccgtggctgtgccgtctgttcgtggtcactcccgggactaccaggagagccgtagaaaagtgctcgttccccttcaaaaacgagacacttctgtttccacaccttacgcttgaagatcctccggccctgagttccctgctcagcggtgcttggcgggatcacttatcccttcacatagtggagttaggagaggagacttag

SEQ ID NO: 199228 - DNA, 813 bp, Artificial Sequence
  Description of Artificial Sequence: Synthetic coding sequence
atggtgctgctgaaggagtaccgggtgatcctgcccgtgagcgtggacgaataccaggttggccaactctacagcgtggccgaggcttctaaaaatgagacaggggggggagagggagtggaggtgctggtgaacgaaccatatgaaaaagatggcgaaaaaggccagtatactcacaagatctaccatctgcagtccaaggttccaacatttgttagaatgctggcgccggagggagcgctgaacatccatgaaaaggcgtggaatgcgtacccgtactgtcggactgtcatcacaaacgagtacatgaaagaggacttcctgattaagattgagacgtggcacaaaccggacctcggcacacaggagaatgtacacaagttggagccagaggcctggaaacacgttgaagccgtgtatatcgatatagctgacaggagtcaagttctgtctaaagattacaaagccgaggaagacccagcaaagttcaagtctattaagacaggccgtggcccccttgggccgaactggaagcaggagctcgtgaatcaaaaagattgcccatatatgtgcgcgtataaactggtcaccgtcaagtttaagtggtggggactacaaaataaagtggagaatttcatccacaagcaagaaagaagactcttcacaaattttcacagacagctgttttgttggctagataagtgggttgacctgacaatggacgacatccggcgaatggaagaggagacgaagcgacagcttgacgaaatgcggcagaaggaccctgtcaaaggcatgactgcagacgactag

SEQ ID NO: 199229 - DNA, 813 bp, Artificial Sequence
  Description of Artificial Sequence: Synthetic coding sequence
atggtgctgctgaaggagtaccgggtgatcctgcccgtgagcgtggatgagtaccaagtgggccagctgtactctgtggctgaggcgtcaaagaacgaaaccggagggggcgagggcgtggaagtgctggtgaatgagccatacgaaaaggacggcgagaaagggcagtacactcacaaaatctaccacctccagagcaaagtccctacatttgttcgcatgctggctccagaaggagcccttaatatccatgagaaagcatggaatgcctatccgtattgccgcacagtcctgccaaacgagtacatgaaggaggattttctgattaaaatagaaacgtggcacaagccagacctgggcacccaagaaaatgtccataagctggagcccgaggcctggaaacacgtcgaggcggtgtatatcgacattgccgatcgctctcaagtgctcagtaaggactacaaagcggaagaggacccagctaaattcaagagtattaagacggggcgtggcccactggggccaaattggaagcaggagctcgtaaaccagaaggattgcccctacatgtgtgcatataagctggtaactgtgaaattcaagtggtggggcctccagaataaggtcgagaattttatccacaaacaagagcgaaggctcttcacaaatttccacagacagctcttctgctggctggataaatgggtcgatctcactatggacgacatcaggcgaatggaagaggaaactaaaaggcaacttgatgagatgcggcagaaagaccccgtcaagggcatgaccgcggatgactag

SEQ ID NO: 199230 - DNA, 594 bp, Artificial Sequence
  Description of Artificial Sequence: Synthetic coding sequence
atgctggcccccgagggcgccctgaacatccacgagaaggcctggaatgcatatccctactgccgtactgtgttgcctaatgaatatatgaaagaggatttcctcatcaagattgagacctggcataagcctgatcttggcacacaggaaaatgtacacaaactggaaccggaagcctggaagcacgtggaagccgtatatatcgacatcgccgatcgatcccaggttctgtctaaggactataaggcagaagaggaccctgcaaaatttaaatcaataaagaccgggaggggtccgctgggccctaattggaaacaggaactggtgaaccagaaagactgtccctacatgtgcgcctacaaactcgtaaccgtaaagttcaaatggtgggggctgcagaataaggtcgagaactttatccacaaacaggagcgaaggttgtttactaattttcatcggcaactgttttgctggctcgacaagtgggtggacctgaccatggatgatattagacggatggaagaggagaccaagcgacagctggacgagatgaggcagaaagatcctgtcaaggggatgactgcagacgattag

SEQ ID NO: 199231 - DNA, 819 bp, Artificial Sequence
  Description of Artificial Sequence: Synthetic coding sequence
atggtgctgatcaaggagttccgggtggtgctgccctgcagcgtgcaggaatatcaggtggggcaactttattccgtggcggaggccagcaaaaatgagaccggtggaggagagggcatcgaagtgctcaaaaacgagccctacgaaaaggatggggaaaagggtcagtatacgcacaagatctaccacctgaaaagtaaagtccccgcctttgttaggatgattgctccagagggctctctcgtgtttcatgagaaggcttggaatgcttacccctactgtaggactatcgtgacaaacgagtacatgaaggatgacttctttatcaagatagagacctggcacaagcccgacttgggcacgttggagaacgtgcatggactggatccgaatacctggaagaccgtggaaattgttcatatcgatatcgcagatcggagccaggtcgagccagccgattacaaagcagatgaggatcctgctctgtttcagtccgtcaagaccaaaagggggcccctgggtccaaattggaagaaggaacttgcaaattcacccgactgccctcagatgtgtgcttataagctggtgaccatcaaatttaaatggtggggcttgcagagcaaagtggaaaacttcatacagaagcaggagaagaggatcttcaccaactttcaccgacagctattctgttggattgacaagtggattgacctcactatggaggacatccgccgcatggaagatgagacacaaaaagagcttgagacactgcggaaccagggccaggtcagaggcacaagcgcggcctccgacgaatag

SEQ ID NO: 199232 - DNA, 816 bp, Artificial Sequence
  Description of Artificial Sequence: Synthetic coding sequence
atggtgctgatcaaggagttccgggtggtgctgccctgcagcgtgcaggagtaccaagttggtcagctgtactccgttgcagaggcttctaagaacgaaacaggggggggggaaggcatagaggtgttaaaaaacgagccgtacgagaaggatggtgagaagggccagtacacccacaagatataccatctgaaatccaaggtcccagcttttgtccgcatgattgctccggaaggctccctggtgtttcacgagaaggcatggaacgcctatccatactgtcgtaccattgttacaaacgaatacatgaaagatgacttttttataaaaatcgaaacctggcataagcccgatttaggtaccttggagaacgttcatgggctagaccctaacacctggaaaactgtggaaattgttcacattgatatcgcagatcgtagtcaggtagaacctgctgattacaaagcagatgaagatccagcccttttccaaagcgtcaagaccaagaggggcccactcggtcccaattggaagaaagaactggccaatagtccggactgtccacagatgtgtgcctataaacttgttacaattaagtttaaatggtggggcctgcagtctaaagtggaaaactttatccaaaagcaggagaagcgaatattcactaactttcatagacagctcttctgttggatagacaaatggattgatctgactatggaagatatcagacggatggaggacgagacccagaaggaactggagacaatgagaaaaagaggctcggtgcgcggaaccagtgctgccgatgtatag

SEQ ID NO: 199233 - DNA, 363 bp, Artificial Sequence
  Description of Artificial Sequence: Synthetic coding sequence
atgatcgcccccgagggcagcctggtgttccacgagaaggcctggaacgcctacccatactgccggacgattgtcacaaatgaatacatgaaagatgacttcttcattaaaatcgagacgtggcacaaacccgatcttggaacacttgaaaatgtgcacggactcgatcctaatacttggaaaaccgttgagatcgtgcatatcgacatcgcggacaggagccaggtggagcctgccgattacaaagcggatgaggaccctgcattgttccagagcgtgaagacaaaaagggggccccttggacccaactggaagaaggagcttgccaattcccccgattgcccccagatgtgtgcatactag

SEQ ID NO: 199234 - DNA, 507 bp, Artificial Sequence
  Description of Artificial Sequence: Synthetic coding sequence
atgggcgacctgctgatggagaagtgccgggtggtgctgccctgctccgtccaggagtatcaggttggacaactctattccgtggccgaagcctctaagaacgagactggtgggggcgaaggcattgaagttctcaaaaatgaaccctacgaaaaggacggcgaaaaaggccagtacacccacaagatttaccacttgaaatctaaagtgcccgctttcgtgaggatgatcgcacccgagggcagtcttgtgtttcacgagaaagcttggaacgcctatccatactgtcggacaatcgtgaccaatgagtatatgaaggacgactttttcattaagattgagacttggcacaaacccgacttggggaccctggaaaatgtgcacggcctggaccccaatacctggaagacggtggaaatcgttcatatcgacatcgctgatcgcagccaggtcgaacctgcggattataaagccgacgaggatccggcgctcttccagtcagtgtag

SEQ ID NO: 199235 - DNA, 822 bp, Artificial Sequence
  Description of Artificial Sequence: Synthetic coding sequence
atgggcgacctgctgatggagaagtgccgggtggtgctgccctgcagcgtacaagaataccaagtcggccaactctatagtgtcgcagaggcttctaaaaatgaaactggtggtggagaaggcattgaggttttgaaaaatgaaccttacgaaaaggacggcgaaaagggccagtacacccataagatctaccatctgaaaagcaaagtacccgcattcgtgaggatgatagccccggaaggctctctcgttttccatgagaaggcttggaacgcgtatccatactgtcgaaccatcgtgaccaacgaatatatgaaagatgatttctttattaaaatcgagacatggcataaaccggacctggggactttggaaaatgtacacgggctcgaccccaacacatggaagactgtagaaatagtgcacatcgatatcgcagaccgaagccaagtggaacctgctgattataaggctgacgaagaccccgcactgttccaatctgttaagacaaagagaggccctctgggcccaaattggaaaaaggagctcgcaaatagccctgactgcccgcagatgtgtgcctacaagctggttactattaagtttaagtggtggggtttacagagtaaggtggaaaatttcattcagaaacaggagaagaggatttttacaaacttccaccgccagttattctgctggattgataagtggatcgacctgacaatggaggatatacgtagaatggaggatgagactcaaaaagagctggagactatgagaaaaaggggctcagtgcgcggaaccagtgctgcagacgtatag

SEQ ID NO: 199236 - DNA, 4980 bp, Artificial Sequence
  Description of Artificial Sequence: Synthetic coding sequence
atggaggcccccagcggcagcgagcccggcggcgacggcgccggcgattgtgcgcaccctgatccaagggccccaggtgccgccgccccatcctcaggccctggaccctgtgcagcagcacgggaatcagagagacagctcaggttgagattgtgcgtgctgaatgagattctgggaacagaacgcgactatgtgggaacacttcgtttcttacagagtgcttttctgcacagaatccgacagaatgttgcagattcagtagaaaagggtctcaccgaagaaaatgttaaggtgctcttctcgaatatcgaggatattctcgaagtgcacaaggacttcctggcggctttagaatactgcctccatccagagccccagtcccagcacgaactcgggaatgtgttcctcaagttcaaggataagttttgtgtctacgaggaatactgtagcaaccacgaaaaagctctcaggctgctggtggaactgaataaaattcccacagttcgcgcgttcctgcttagctgcatgctgttaggtggtcgcaaaactacggacattcctctggagggctatttattgagccctatccagcgaatctgtaaatatcccctgcttttgaaagagctggctaaaagaacccccggcaagcacccggaccaccccgccgtccagtctgcccttcaagcgatgaagacagtgtgttctaacattaacgaaactaaacgacaaatggagaaactcgaagcccttgagcagctgcagtcccatatcgagggctgggaaggaagtaaccttacagatatttgtacccagctcttgttgcagggtaccctactcaaaatcagcgccggaaacattcaggagcgggcgttttttctgtttgataatctcctcgtgtactgcaaaaggaagagtagggtgaccggctcaaagaagtctacaaaacgcactaagagcattaacggttcactgtacattttccgaggtcgaattaataccgaagtgatggaggtcgaaaatgtcgaggatggaaccgcagactaccacagcaatggctataccgtgacaaatggatggaagatacacaatacagctaaaaataagtggttcgtttgtatggccaaaaccgcggaggagaaacagaaatggctggatgccataattcgggaaagggagcaaagggaaagcctcaagctgggaatggaacgagatgcctacgtcatgattgctgaaaagggtgagaagctgtaccacatgatgatgaataaaaaggtcaaccttatcaaggatcgacgacgaaaactctctacggtgcctaaatgtttcttggggaacgagtttgttgcatggctgctggagattggggagatcagcaaaacggaggagggtgttaacctggggcaagccctattggagaatggcattattcaccatgttagcgacaagcatcagtttaaaaacgagcaagtgatgtatcgattccgctatgatgacggcacttataaagcccgcagcgaactagaagacataatgtctaagggcgttcggctctattgccgcctgcatagcctctacacgcccgtgataaaagatcgtgactaccacttaaagacctacaaaagtgtcctgccaggctcgaagttggtggactggcttctggcacaaggtgactgtcagacacgggaggaggctgtggctctcggcgtaggcctctgcaacaatggatttatgcaccatgttctggagaagtctgaattcagagacgagtcccagtatttccgcttccacgccgacgaggaaatggagggcacttctagtaagaacaaacaactgagaaacgactttaaacttgttgagaacatcctggccaaacgactgcttatactgccacaggaagaggattacggcttcgatatcgaggagaagaacaaggccgtggtggtcaagagtgtgcagcgcggcagtctggctgaagtggctggcttacaagtagggcggaaaatctactccatcaacgaagatctggtgtttctgagacccttctctgaagtggaatcaatacttaatcagagcttctgctctcgtcgacccctgaggctgttggttgctactaaagccaaagaaatcatcaagatccccgaccagccagatacactctgctttcaaattaggggcgccgcaccaccatatgtctacgcggttggcagaggatccgaagccatggcagccggcctgtgcgcaggacagtgcatcctgaaggtgaacggatctaatgtcatgaatgacggggcccccgaagtcttagaacattttcaggcattccggagtcgtagggaggaggccctcggcctgtatcagtggatctatcatacgcacgaagatgcccaggaggctagagcgagtcaggaggctagtacagaagacccaagtggagaacaggcccaagaagaggaccaggccgactcggcattccctctgttgtccctcggcccgaggctgtcgctgtgtgaggattccccaatggtgaccctgactgtggataacgtgcatctggagcacggcgtggtctatgaatacgtgtctaccgcgggggtaaggtgtcatgttttagaaaagatcgtggaaccccgtggatgcttcggactgactgccaaaatcctggaggccttcgccgccaatgactctgtcttcgtggaaaactgtagaaggcttatggccctgagttctgccatcgtaactatgccgcactttgagttcaggaacatctgtgacacaaagctcgagagcataggccaaagaatcgcttgctaccaagaatttgcagctcaactcaagagccgagtgtctccgccatttaagcaggcaccacttgagccacaccctctgtgcggcctagatttctgcccaacaaactgccacatcaacctgatggaagtgtcatatccaaagaccacacccagtgtcggccgctctttctcaatcaggtttgggcgcaaaccaagccttatcggcctggaccctgaacaaggccacctaaatcccatgtcctacacccagcactgcattacgaccatggccgcgccatcgtggaagtgcttaccagctgcagagggcgaccctcaaggccagggtctacatgatggcagctttgggccggccagcgggactttggggcaggaagatagaggccttagctttttgctgaagcaggaggatcgcgaaatccaggacgcctatctgcagctattcactaagcttgatgtggccctcaaggagatgaagcaatatgtcactcagattaatcgtctgctgagcacaatcacggagccaacttcgggcgggagctgcgatgcatcgctggctgaggaagcatcttccctgccactggtttcagaggagagcgagatggaccgtagcgaccatggaggcatcaagaaagtctgctttaaggtggcagaagaggatcaagaggactctggccacgatacaatgtcctaccgggactcatacagcgaatgcaatagcaaccgggattcggtccttagctacactagtgtgagatccaattcctcataccttgggtctgatgaaatgggaagtggagacgaactgccttgcgacatgcgcatccccagtgacaagcaggataagctgcacggctgtctagagcaccttttcaaccaagtggatagtatcaacgcccttttaaaagggcccgtgatgagccgcgccttcgaagagactaagcactttccaatgaatcacagtttacaggaatttaaacagaaggaggaatgtactattagaggccggtccctgatccagatttccattcaggaggacccatggaatttaccaaactctataaaaacactggtagacaacatacagcgatacgttgaagatgggaagaatcaactgcttctagcccttctcaaatgtactgataccgagctccagcttaggagggacgctatattttgtcaggcactggttgccgctgtgtgtacttttagtaagcaattactagcagcactcggttatcgctacaataataatggggagtacgaagagtcctcacgggacgcctcccgcaagtggttggaacaggtcgctgcgacgggcgtgttgctgcactgccagtcactgctgtcgcccgccaccgtgaaggaagagcgtaccatgttggaagacatttgggtgacactgagcgaattagataatgtgacattttccttcaaacagctggatgaaaattacgtcgcaaacaccaacgtgttctaccatattgaaggcagcaggcaggctttaaaggtgatcttctatctggactcataccacttcagcaagttaccaagcaggctggagggtggggcctctctgaggttgcatacagcactgtttacgaaggtactggaaaatgtcgaggggctcccaagtcctggcagtcaggccgccgaggacctccagcaggacatcaacgcacagagtctggaaaaagtccagcagtattatcgcaaactgcgggctttctatttggagaggtctaacctccccactgacgcctccaccactgctgtgaagatagatcagcttatccgccccatcaacgcacttgacgaactgtgtcgtctgatgaagtcatttgtgcaccctaaacctggagccgcgggaagtgtgggcgcaggcctcattccaataagttcagagttgtgctatcgactgggagcctgccagatggtcatgtgtggtactggaatgcagcgtagtacactctctgtgagcttggagcaggcagctatcttggccaggtctcacggattgctacccaagtgtatcatgcaagcaacagatatcatgcgaaagcagggcccccgcgtggagattttggccaaaaatctcagggtgaaagatcaaatgccccagggagcaccgcgtctctacagattgtgccagccaccagtggacggcgatctctag

SEQ ID NO: 199237 - DNA, 4686 bp, Artificial Sequence
  Description of Artificial Sequence: Synthetic coding sequence
atggaggcccccagcggcagcgagcccggcggcgacggcgccggcgattgcgcccaccctgatcccagggcacccggcgccgctgctccgagcagtggaccaggaccctgtgcggctgcaagagagtccgagcggcaactgagactcagactgtgtgttctgaatgagattctgggcactgagagagattatgtgggcaccctccggttcctgcagagtgcctttctgcaccgaatcagacagaacgtcgcagactccgtggagaaaggcctcacggaggagaatgtcaaagtgctcttctctaacatcgaggacatcctcgaagttcacaaggatttcctggccgccctagagtattgcctgcatccagagccccagtctcaacatgagttgggaaatgttttccttaaatttaaagataagttttgcgtctatgaggagtattgtagcaatcacgagaaggcgctgcggctactggtggaactgaacaaaatacccactgtccgggccttcttattgtcttgtatgcttctcggggggcgaaagacaaccgatatccccctggaagggtacctcttgtctcccatccaaagaatttgtaagtaccctctgctcctgaaagagctggccaagagaactccgggaaagcatccggaccaccctgcagtccagagtgctctgcaggctatgaagaccgtgtgctccaatataaacgagacaaaacggcagatggaaaagctcgaagcactcgagcagttgcagtcccacattgaaggatgggagggtagtaatttgaccgacatctgcactcaactcttgctccaaggcacccttctgaaaatatctgccgggaatattcaggagcgtgcctttttcctgtttgacaacttactggtgtattgcaagcggaaatcaagggtgaccggtagtaagaagtcaactaaaagaacaaaatcgattaatgggtctctgtacattttccgcggccggataaacacggaagtgatggaggtcgaaaatgttgaggatggcactgcagattatcactctaacgggtatacagtcacaaacggttggaagattcacaacacggccaagaacaagtggttcgtatgcatggcaaaaacagctgaggaaaaacagaaatggctggacgcaatcatccgcgagcgtgagcagcgtgaaagcctaaaacttggaatggaacgggacgcatacgtgatgatcgccgagaagggtgaaaagctgtaccacatgatgatgaataagaaggtgaacctcatcaaagaccgacggaggaagctttccaccgtccctaagtgctttctgggaaatgagtttgttgcttggctattagaaataggtgaaatttccaaaaccgaagaaggcgtcaatctcggccaggctctgttggagaatggaataatccatcatgtgagtgataaacaccagttcaagaatgagcaggtaatgtacaggttcagatatgacgatggtacatacaaagccagatccgagctggaggacataatgtcaaaaggcgtcaggctttactgtcgtcttcatagcctgtacaccccagtgatcaaggatagagattaccacttgaagacgtataagtcggtgctcccaggctcaaaattggttgactggctgctggcccagggtgactgtcagaccagggaagaggcggtggcactgggcgtgggactgtgcaataacggctttatgcaccacgtccttgaaaagtctgagtttcgagatgagtcccagtatttccgctttcacgccgacgaggagatggaagggacatcaagtaagaacaaacaactgagaaatgacttcaaactcgtggaaaacattctggctaagcggctgctgatcctgccccaggaggaggactacggatttgacattgaagagaaaaataaggccgtggtggttaagtccgtccaaagaggctccttggctgaagtggcaggcctgcaggtcggtcggaaaatttacagtatcaacgaggacctggtttttctgaggccgttcagcgaagtagaatctattttaaatcagtcattttgctctcggagacctctcaggttactcgtagccactaaagctaaggaaattattaaaatacccgatcaaccagacactctttgcttccagattaggggggcagcccccccttacgtctacgccgtaggacggggatccgaagctatggcagcagggttgtgcgctggacagtgtatcctgaaggttaatgggagtaatgtgatgaatgatggagctcccgaggtgctggaacacttccaggccttccgcagcagacgcgaggaggctctcgggctgtaccagtggatttaccacacccatgaggacgcacaagaagcacgcgccagtcaggaagctagcactgaggaccccagcggagagcaggctcaggaagaggatcaagcagatagcgcattcccactccttagtctcggccctcgactcagtttgtgcgaggattcgcctatggtgaccctcactgtggacaacgtgcacttggagcacggagtggtatacgaatacgtaagcactgctggcgtcagatgccatgtgcttgagaagatcgtggaacccagggggtgttttggcttaaccgccaagatactggaggccttcgccgctaacgactctgttttcgtagagaactgtcgacgcttgatggccctctcttcggctatcgtgaccatgcctcacttcgaattccgcaacatctgcgacactaagctggaaagcatcgggcagcgcatcgcatgctaccaggaatttgctgctcagcttaagagccgggtttcacccccttttaaacaggctccactagaacctcatcccctgtgcggtctcgacttttgcccaaccaactgccacatcaacctgatggaagtctcttatcccaagacgactccgtcggtgggacggtccttttctattaggtttgggagaaaaccttccttgatcggcctcgatccagaacagggacacctaaacccaatgagctacacccagcattgtattacgactatggccgctccatcatggaagtgtctgccggcggccgagggcgatcctcaggggcaggggctccacgacggcagttttggcccagctagtggaactctggggcaggaggaccgcggcctgtcttttctgctcaagcaagaggatagagagattcaggacgcctacctacagcttttcaccaaacttgacgtggcccttaaagagatgaaacagtacgtgacacaaattaaccgccttctctcaacaatcacagaacccacttcgggaggatcttgcgatgctagtttagccgaggaagcttcctccctcccattagtcagtgaggagagcgaaatggaccgatcagatcacggcggaatcaaaaaggtttgctttaaggtcgctgaagaggatcaagaggattcgggtcacgataccatgtcttatagggactcttattccgaatgtaactccaaccgcgattcagtcttgagctacacaagcgttcggtcaaactctagttacctgggatctgatgagatgggcagtggggatgagctgccttgtgacatgagaatcccgtctgataagcaggataaactacacggatgcttagaacatttgtttaatcaggtggattcgatcaacgccctgctgaagggccccgtcatgagccgcgcattcgaagaaacaaagcattttccaatgaatcacagtctgcaggaatttaagcagaaagaggaatgcactatccggggacggtctctgattcaaatctcaattcaggaagacccctggaatctaccaaattcaataaagacactcgtggacaacattcagcgctacgtcgaggatgggaagaatcaattgttgctggcgctactgaagtgtaccgacaccgaactccaactaagaagggatgctatcttctgccaagccttagtagccgctgtgtgcactttttctaagcagctgctcgccgccctcgggtatagatataacaacaatggagaatacgaggagtcgagtcgcgatgcatctaggaagtggctggagcaggtagcagcgacaggggtcctgctacactgccagtcattactgtcccctgccactgtgaaggaagagaggaccatgcttgaggatatttgggtgaccttatctgaactggataatgtaacgttctcttttaaacagctggacgaaaattacgttgcaaacacaaacgtgttttaccacatcgaaggctctcgccaagcattgaaagttatattctacctggactcataccacttttccaaattgcctagcaggctggagggaggtgcgtccctccggcttcacacagctctgtttactaagggggaactacaggcctggggaagagaagaccatgggggaagggccaaggctactaagcataccggaagtcagcctccagctagaccgaggcacctgcctagccagtgctggagaacgtggcgagggtgtctgttgcaggctgcacgcccgaggcgcatttgttcccgcacaagcacaaggtctccatggcgaaagttcagttcaataaccgccaattctggacacttcacctggtctggattgacatgcccacgcatgccagctcctaggcgttag

SEQ ID NO: 199238 - DNA, 4821 bp, Artificial Sequence
  Description of Artificial Sequence: Synthetic coding sequence
atgagcgaggacagccggggcgacagccgggccgagagcgccaaggacctcgaaaagcagctccgcctcagagtgtgtgtactgtcagagcttcagaaaacggagcgagactacgtgggcacattggagttccttgtgtccgcgttcctgcatagaatgaatcagtgtgctgctagcaaggtagataagaacgtgacggaggaaacagtaaaaatgctcttctccaatatcgaagatatcctggcagtgcacaaggaatttttgaaggtggtcgaggaatgcttgcacccggaaccaaacgctcagcaagaggttggcacctgcttcctccacttcaaggataagtttcgcatctacgatgaatattgtagcaatcacgaaaaggcacagaagctgctgctggaacttaataaaatcaggactatccgcaccttcctattaaattgcatgctactcggtggacggaagaataccgacgtccccctggaagggtacctggtaacacccattcagcggatctgcaaatatcccctgattctgaaggagctcttgaaacggaccccacgcaaacattcggattacgccgcagtgatggaagcactgcaggctatgaaggccgtgtgcagcaatataaatgaagcaaagaggcagatggagaaacttgaagttctggaagagtggcaatctcatatcgagggttgggagggaagtaacattaccgatacttgtacagaaatgctaatgtgtggggtgttgctgaagatttcgtccggcaatatccaagagcgtgtcttcttcttgtttgataacctgttagtctactgtaagcggaagcatcggcgcctgaaaaattccaaggccagtactgacggacaccgttatctctttagaggtaggattaacaccgaagtgatggaagtggaaaacgtggatgacggaaccgctgacttccattcctccggtcacatcgtggttaacgggtggaaaattcataacactgctaagaacaaatggttcgtctgtatggcaaagaccccggaagagaaacacgagtggttcgaagctatcctaaaggaacgggagcgtaggaaagggctcaaactaggaatggaacaggacacctgggtcatgatcagcgaacagggcgagaagctgtacaagatgatgtgccgtcaaggaaacctcattaaagataggaaaagaaagttgaccacctttcccaagtgtttcctgggctcggagtttgttagttggttgctggagatcggggagatccatagaccagaagagggggttcatctgggccaggctctgcttgagaatggaattatccaccacgtaacagataaacaccagtttaaaccagagcagatgttatatcgattcaggtacgatgacggaacattctaccctcgcaacgaaatgcaggatgttatctctaaaggggtgagactgtactgccgacttcacagcctgtttactccagtgatcagagataaagactaccacctgaggacctataagagcgtggttatggccaacaagctcatcgactggctaatcgcccagggggactgccgcaccagagaagaagctatgatctttggagtagggctttgcgataacggcttcatgcaccacgtcctcgaaaagtctgaattcaaggacgaacccctcctgttcagattcttcagtgatgaggagatggaggggtcaaatatgaaacacagactgatgaaacacgacctgaaggtggtggaaaatgtaatcgcgaaatccctgttgattaaatcaaatgaaggtagctatggctttggtttggaagacaagaataaagtccccataattaaactggtggagaaaggttcaaatgcggaaatggcaggtatggaggtcggaaaaaagatattcgcgatcaatggagatttggtcttcatgcgacctttcaacgaggtcgactgttttttgaaatcatgtctgaactccagaaagccacttcgcgtcctcgtgtcaactaaaccccgcgagacagtgaaaatccctgactctgctgatgggcttggattccagatccgaggatttggcccctccgtcgtgcatgcagtgggcaggggaacagtagccgccgctgccggacttcatcccggccagtgcatcattaaggtgaacggcattaacgtgtctaaggagacccacgccagtgtgatcgcccacgttacagcctgtcgcaaatatcgccggcctacaaaacaagactccattcagtgggtctacaactctatcgagagtgcccaggaagacctgcagaagagtcattccaagccaccaggagacgaggctggcgacgcttttgattgcaaggtagaggaagtaatagacaaattcaacaccatggctatcatcgacggcaagaaagagcacgtgtctctaacagttgacaatgttcatttggaatatggggtggtgtatgagtatgacagcacggctggcattaaatgcaacgtggtggagaaaatgatagaacctaaaggtttctttagcttgaccgccaagatcctggaggcgctggctaagagcgacgaacactttgtgcagaattgtactagtttgaactccctgaacgaggtcatcccaacggaccttcaatccaaattttctgccttatgtagtgaaagaattgagcacctctgtcagcgcatatctagctataagaaattttctcgtgtcctcaagaatagagcatggcctacgtttaagcaagccaaatctaaaatctctccactacacagttccgatttttgccctaccaattgtcatgtgaacgtgatggaggtaagctacccaaagacatcaacctcactaggctctgcattcggagttcagctggattcgcggaagcacaactcacatgacaaagaaaataagtccagcgaacagggtaagctgtctcccatggtttatatccagcatactatcaccacgatggctgctccctccgggctgtccctcgggcaacaggacggacacggcctccggtatctgcttaaagaagaggaccttgagacgcaggacatttaccagaaacttctcggcaagctgcagaccgcgcttaaggaggtggagatgtgcgtatgccagatcgacgacctactttcaagcattacgtacagcccgaagctcgaaagaaaaacatcagagggaatcatcccgaccgacagtgataacgagaagggggagaggaattctaaacgcgtttgcttcaatgtggctggggatgaacaggaggactccggccacgataccatctctaatagggacagctacagtgactgtaactccaaccggaattctattgcctccttcacctcaatctgttcttctcagtgctccagctactttcactccgatgagatggactctggcgacgaactgcccctatctgtacgcatatcgcacgacaagcaagacaagattcatagctgcctggagcacctgtttagccaggtggacagcatcaccaatttacttaagggccaggcggtagtaagggccttcgaccaaacaaaatacctgacccccggaaggggtctgcaggaattccaacaagaaatggaaccaaagctctcgtgtcctaagagactccgtctgcatatcaaacaggatccttggaatttgcccagcagtgtacggaccctcgctcagaatattaggaaattcgtggaagaagtgaagtgtcgactgctgctggccttattggaatatagcgattctgagacccagctacggcgcgacatggtattttgtcaaacactagttgcgactgtgtgtgcgttttccgagcagcttatggctgctctcaatcagatgttcgacaatagcaaagagaacgaaatggagacctgggaagcaagtaggcgctggcttgaccagatcgccaatgcaggtgttttgtttcacttccaaagtctgctcagtccgaatcttactgacgaacaggcaatgctcgaggataccctggtcgcactcttcgacctggagaaggtctctttttactttaaaccttccgaagaggagcccttggtggctaacgttcccctgacataccaggccgagggatcaagacaagcactgaaggtgtacttttatatagactcgtaccatttcgagcagttaccacaacgtctcaagaacgggggcgggttcaagatacatcccgttcttttcgcacaggcactggagagtatggaggggtattactacagagataacgtttctgtcgaagagttccaggctcagatcaacgccgcttcgctggagaaggtaaaacagtacaatcaaaagctcagagctttctatctcgataagtcaaactcaccccctaatagtactagtaaggccgcttatgtggataagttgatgagacctttgaatgcactggacgagctgtataggctggtcgctagcttcatcaggagcaaacgcaccgctgcctgtgccaatactgcctgttcagccagcggggttggccttctgagtgtgagttctgagctatgcaatcgccttggggcttgtcacatcattatgtgcagcagtggagtgcatcggtgcacactctccgtgactcttgagcaggccattatccttgcaagaagccacggcttaccacctaggtacattatgcaggcaactgacgtaatgaggaaacagggagctcgcgtgcaaaacactgccaagaacttgggggtgcgggaccgtacacctcagtcagcgcctcgactttacaagctgtgcgaaccgcccccccccgcaggtgaggagtag

SEQ ID NO: 199239 - DNA, 3525 bp, Artificial Sequence
  Description of Artificial Sequence: Synthetic coding sequence
atgagcgaggacagccggggcgacagccgggccgagagcgccaaggacctggaaaaacagcttaggcttcgggtctgtgtgcttagtgaactacagaagacagaacgcgactatgtgggtactctggagtttttggtgtcagcgttcctgcaccggatgaaccaatgcgcggcaagcaaggtcgacaagaacgtcaccgaggaaacggtcaaaatgttattcagcaacatcgaagacatactagctgtgcataaagaattcttgaaagtcgtagaggaatgcctgcacccagaacccaacgcccagcaagaggttggaacatgcttccttcacttcaaagacaaattccgaatatatgatgaatactgctccaatcatgagaaggctcagaagctgctgctggaactgaacaagattcgcacaatacgaacctttctgttaaattgtatgttgctgggtgggaggaagaacacagacgttccactagaggggtatctggtcactccaatccaacggatctgtaaatatccactcatcctcaaggagctgctgaaacgaacccctaggaaacatagcgattacgccgctgtcatggaagcccttcaagccatgaaagctgtatgttccaacatcaacgaggctaaacggcagatggaaaaattggaagtattagaagagtggcaatcacatatcgaggggtgggagggcagcaatatcaccgatacttgcactgagatgcttatgtgcggtgtgctgctcaaaatatcatcaggtaacattcaggagcgcgtctttttcttgtttgataacctgctggtgtattgtaaacgcaagcaccggagacttaagaatagtaaagcttcaactgacggccatcggtatttatttcgcggccgaattaacaccgaggtaatggaggtggaaaatgtcgatgacggcactgcggacttccattcctccggccatatcgtagtgaatggttggaagattcacaataccgccaagaacaagtggtttgtctgcatggctaagacaccagaagaaaagcatgagtggtttgaggcaatccttaaggagcgggagcggaggaaaggacttaaactcgggatggagcaggacacttgggtgatgataagcgaacagggagaaaagctgtacaagatgatgtgccggcaggggaacctcatcaaggacaggaaacgaaagctgactacgttcccaaagtgctttttgggcagtgagtttgtttcctggctcctggagattggagagatccatcgcccagaggagggcgtgcacctggggcaggctcttttggagaacggcatcatacaccacgttactgataaacaccagttcaagccggagcaaatgctgtaccgctttcggtatgacgacggaaccttttatccccggaatgagatgcaggacgtcataagcaaaggcgtgaggttatactgccgccttcattcccttttcactcctgttatcagagacaaggactaccaccttcgcacctacaagtcagtcgtaatggcaaataaactgattgattggctgattgctcaaggcgattgcaggacaagagaggaggctatgatattcggtgttggactgtgtgacaacggcttcatgcatcacgtgttggaaaagtctgaatttaaagatgaacccctgttgtttaggttttttagcgatgaagagatggaaggcagtaatatgaaacatcggctgatgaaacacgatttaaaggttgttgaaaatgtcattgccaaatcccttctgatcaagtcaaacgagggctcatacgggtttggtcttgaagataaaaacaaagtgccaataatcaagctggtcgagaagggatccaacgccgagatggcgggcatggaggtgggtaagaaaatcttcgccattaacggcgatcttgtattcatgaggccttttaatgaagtggattgcttcctgaagagttgcctgaattcgaggaaacccttgagagttcttgtatctactaagccaagggagaccgtgaaaatccccgatagtgccgacggacttggcttccagattcgtgggttcggtcccagcgtcgtacatgctgtgggccgaggtactgtcgctgcggcagctggactccacccaggccaatgtataatcaaagtgaacggcattaatgtgtccaaggaaacgcacgcctctgtcattgcacacgtgaccgcatgtaggaagtacagacgaccaactaagcaggactcaatccagtgggtgtataactccatcgaatctgctcaggaggacctccagaagtcccatagcaagccccctggagatgaggctggggatgctttcgactgtaaggtggaggaagtcatagacaagttcaacaccatggccataattgatggaaagaaagagcacgtgagcctgacagttgataatgttcaccttgaatatggggtggtgtatgagtacgactccactgcaggcatcaagtgcaacgttgtcgagaagatgatcgaacctaaggggtttttctctctcactgctaaaatcctggaggccctcgcaaagtccgatgagcacttcgttcagaattgcacctctctcaattcactcaatgaggtgatcccaacagatctgcaatccaaattttcagcactgtgtagcgagcggatcgagcacctttgtcagcgcatcagctcatacaagaaggtgtctgtgttgctgattttgtacactatcatcgtggagatgtatcactttaccgagatgatcaccctgtacaatatcttagaactcgtcaggcctcccaacagcgagtttttttttagtttcctgcctactaaacgaatgaagaccctgaaccagaaaaaggtgacccacatgaaaaaaaccaacatccagctgcagttctccagggtgctcaaaaatcgagcctggccaacctttaaacaggctaaaagcaaaatatccccactccacagcagcgatttttgccctaccaattgccatgtcaacgtcatggaagtgagctatcccaagacctctacatctctgggttctgcctttggtgtccaatggaagctatctcctatggtgtacatccagcacactatcaccactatggccgcacctagtgggctatctctgggtcagcaggatggccacggtcttcgttacctgcttgagagaaagacgagcgagggaataattccgacggattccgacaatgaaaagggggaaaggaacagcaagcgggtctgcttcaacgtggctggcgatgagcaagaagacagtggtcacgacactatcagtaatagggactcctactcatttagtgactgtaacagcaaccgcaattctatcgcatctttcacctcaatatgcagtagccagtgcagctcttatttccactcagatgagatggattctggctcagacgagctaccgctgtccgttagaatttctcacgacaagcaggacaaaatccattcctgtctggagcatctcttttcccaatag

SEQ ID NO: 199240 - DNA, 1650 bp, Artificial Sequence
  Description of Artificial Sequence: Synthetic coding sequence
atggccagcgccagcagcggccccagcagcagcgtgggcttcagcagctttgatcctgctgtacctagctgtaccctatccagcgcctccggcatcaaacggcccatggcctccgaggtgccctatgcttctgggatgccaatcaagaagatcggacacaggtccgtggactcctctggcgaaactacatacaagaagactacaagctctgcccttaagggagccatccagctgggcattactcacactgtgggcagcctcagcacaaagcccgagcgggacgtcctgatgcaggatttctacgtggtcgaaagtatcttctttcctagcgagggtagcaatttgactccggcacaccattacaacgattttagattcaagacttatgcccctgtcgcttttcggtattttcgagagctgtttggaattcgcccagatgattatctgtactcgctttgtagcgagcccctcatagagttatgcagttccggagccagcggatccctattttatgtctcttctgatgatgagttcattatcaaaaccgtacagcacaaggaggccgagtttctccagaaactcctccccggctactatatgaatctaaatcagaatccacggactctgcttccgaagttctatggattgtattgcgtgcaggcaggaggtaagaatatacgcatcgtggtgatgaacaacttattgccccggtcagttaaaatgcacatcaagtacgacttaaagggcagcacatataagagacgggccagtcagaaagaaagagaaaagccactccctacatttaaggatcttgacttcctgcaggacatccctgacggactgttcttggacgccgacatgtacaatgcactgtgcaagactctacaacgggactgcctggtccttcaatctttcaaaataatggactacagcttgttaatgagtatacacaacatcgaccacgcacagcgggaaccactctcaagtgaaacccagtatagcgttgataccagaagacctgctccccaaaaagctctctactcaacagcaatggagtccattcagggggaggccagacggggaggtaccatggagaccgatgatcacatgggtggaataccggcccgaaatagcaagggagaacggctgctcctgtacataggcatcatcgacattcttcaatcttatcgattcgttaagaagctggaacactcttggaaggcactggtccacgatggcgacaccgttagtgtacaccgacctggattctacgccgagagattccagaggttcatgtgtaacaccgtatttaaaaagatcccactgaaaccctccccaagcaagaaattcaggtccgggagctcattcagccgccgcgcaggctcttccggaaattcatgcattacctatcagccctcagtaagtggggagcataaggcccaggtaacaacaaaagcagaggtcgagccaggtgtccatctgggccgtcctgatgtgttgccgcagactccacccttggaggagatttctgaaggctcccccatccctgacccatccttctctccactggtgggggagaccctgcaaatgcttaccacatctactactttggagaaactagaagtagcggaatccgagttcactcactag

SEQ ID NO: 199241 - DNA, 1689 bp, Artificial Sequence
  Description of Artificial Sequence: Synthetic coding sequence
atggccagcgccagcagcggccccagcagcagcgtgggcttcagctccttcgacccagctgtcccgagctgtacactctcttctgctgcttcagggatcaaacggccgatggcctctgaagtgctggaagctcgtcaagactcgtacatctctttggtcccttacgcaagcgggatgccaatcaaaaagattggccataggtcggtcgactcttctggtgagacaacgtacaaaaagactacttcatctgccttgaagggagctatccagttaggaatcactcacacggtgggaagtctttccactaaacccgagcgagatgtcctcatgcaggacttttatgtggttgaaagtatttttttcccatctgagggatcgaacctgactccagctcatcattataatgattttagatttaagacttacgcgccagtagcctttaggtacttcagagaattatttgggatccgaccggatgactatctgtactcgctgtgtagcgaacccctgatcgaactgtgcagttctggagctagcggttccctcttctacgtttcctccgacgatgagtttatcataaagacagtccagcataaggaagccgagttcctgcagaaactcctacctgggtattacatgaacctgaaccaaaacccgagaacactgcttcctaagttctacggtttatactgcgtccaggcgggtggaaagaacataaggatcgtagtgatgaataacctgcttccacgaagcgtaaagatgcacatcaaatacgacctaaagggttcaacctataagagaagggcttcccagaaagaaagggaaaagcccctgcctaccttcaaggatcttgatttcctgcaggacatacccgacggcttgttcctggatgctgacatgtataacgcattatgcaagacactccaaagagactgccttgtgcttcagagcttcaagataatggattatagcttgctgatgtccatccacaatatagatcacgcgcaaagggaacctctgagtagtgagacacagtattctgttgacacaaggagacctgctccgcagaaagccctgtatagtacagccatggagtccattcaaggcgaagcaaggcggggaggcacaatggagacagacgatcacatgggcggcatacctgccagaaattcaaagggggagagattgctactgtacatagggattatagacattctgcagagctaccgtttcgttaagaagttggagcactcctggaaagccctggtgcacgatggcgacaccgtctcagtccaccgtcccggattctatgccgagaggttccagcgattcatgtgtaacaccgttttcaaaaaaattcccctgaaaccttccccctctaaaaaattccggtccggtagtagtttcagtagaagagcagggtccagcggaaactcctgtatcacttaccagccttccgtgtcaggcgaacataaggctcaagtgacaacaaaagcagaggttgaacctggcgtgcatcttggccgcccggacgttctgccccagacaccaccccttgaagagatatctgagggctcaccaatccctgacccctctttttccccactcgtcggagaaaccctgcagatgctaaccacaagcacaactctggagaagctggaagtggcagagtcagaattcacacactag

SEQ ID NO: 199242 - DNA, 1503 bp, Artificial Sequence
  Description of Artificial Sequence: Synthetic coding sequence
atggccagcgccagcagcggccccagcagcagcgtgggcttcagcagcttcgaccccgccgtcccttcctgcacactttcgtctgccagcggcataaaacggccgatggccagcgaagttccttatgcatccggcatgccaattaagaaaatcggacaccggagtgtggacagctctggggaaacaacctacaagaaaacaacttcatccgcactgaagggggctattcagctcggcatcacgcacaccgtggggagcctctccaccaaacccgagcgggatgtgctcatgcaagacttctacgtcgtcgagtcaatcttctttccttctgaaggctcgaatttaactccagcgcaccactacaatgacttccgctttaagacatatgcaccggtggctttccgttacttcagagaactgtttggcataagaccagacgattacttgtactcactgtgttcagagcctctcatcgagttatgtagctcaggagcatccggctcgctgttctacgtgagctccgacgatgagttcattattaaaaccgtgcagcacaaggaagctgagttcttgcagaaactacttccaggctactatatgaatttaaatcaaaatccccgtactctcctacccaagttctacggactctattgcgtccaggcagggggaaaaaatatccggattgtggtgatgaacaacctcctgcctagatcagtgaagatgcacatcaagtacgacctgaaaggcagtacatacaaaagacgcgcatctcagaaagagagagagaagcccctccccacctttaaagatttagacttcctgcaggatatccccgacggtctgttcttggatgcggatatgtataatgcactctgcaagacccttcagagagactgcctggtcctccaatcgttcaaaattatggactactcgcttcttatgtctatccataacatcgaccacgctcagcgcgagccactcagttctgagacacaatattctgtggacactcggagacccgccccgcagaaagcactgtacagtactgctatggaatccatccaaggcgaagccagacgtggcggcactatggaaacggatgaccacatgggggggatccccgctagaaactctaaaggcgagcgcttattactctatattgggatcattgatattctccaatcgtaccggttcgtaaaaaaacttgagcattcctggaaggccctggtacatgatggggacaccgtcagtgtacacaggcctgggttctatgcggagagattccagcgctttatgtgtaatacagtatttaaaaaaataccatgtgttcacctgggacggcctgatgtcctcccacagactccacccttagaggagatcagcgaagggtctccaatcccagatccttcattttctcctctggtgggagagaccctccagatgctaacgacctcaacgacactagagaaactcgaagtggcggaaagcgagttcacccattag

SEQ ID NO: 199243 - DNA, 1653 bp, Artificial Sequence
  Description of Artificial Sequence: Synthetic coding sequence
atggccagcgccagcagcggccccagcagcagcgtgggcttcagcagcttcgatccagcggtgcctagctgcacactcagtagcgccgcctccgggattaagaggccaatggccagcgaggtcccctacgcatcaggcatgccaatcaagaagatcgggcaccgaagcgtagactcctccggggagaccacatacaagaagaccacaagttctgccttaaagggtgccattcagctaggtattacacatactgtcggctcactgtccacgaagcccgagagggacgtgctcatgcaggatttctatgttgtcgagtccatattctttccaagcgaaggaagcaacctaactcccgcccatcactacaacgattttcgatttaagacctacgcacctgtggccttccggtattttcgggagctcttcggaattcgtcccgatgactatttgtattctctttgcagcgaacccctaattgaactgtgttcaagtggcgccagtggcagcctgttttacgtgagcagtgacgatgaatttatcatcaaaacagtgcagcataaagaagccgagtttctgcaaaagctcctcccaggctactatatgaacctcaaccaaaaccctcggaccctgctgcccaagttctatggcctctactgtgtccaggccggcgggaagaacattaggatcgtcgtcatgaataatctcttaccaagaagcgtaaagatgcatattaaatatgatctgaagggcagtacctacaaacggcgggcatcacaaaaagagcgggagaaacctctgcctacgtttaaggacctggacttcctgcaagatatccccgacgggctctttctggacgccgacatgtataacgctctgtgcaagactttgcagagagactgccttgtcctacagagtttcaaaattatggattacagcctcctgatgtcaatacataacattgatcatgcacaaagagaaccactgtcctctgaaactcagtattccgttgatacacgccggcccgcgcctcagaaggcactgtattccaccgccatggaatccatccagggagaggctcgacgaggaggcacaatggaaactgacgaccatatgggtgggataccagctagaaattccaagggcgagaggctgcttttgtacattggaatcattgacattctccagtcctatagatttgtgaagaagctggagcattcgtggaaggccctggtgcacgacggggacactgtgtcagtgcatagacctggcttctatgctgaaaggttccaacgatttatgtgtaataccgtcttcaagaagattccgctgaagccaagtccctccaagaaatttagatctggctcatccttctctaggcgtgcaggctcttcaggcaatagctgcatcacatatcagcccagtgtcagtggcgaacataaggcccaggtgacaaccaaggcagaggtagaacccggggtgcatctgggacgccccgacgtgctgccccagaccccccccctggaagaaatctcagagggctcgccaattccagatccatcattcagtcccctggtgggagagaccctgcagatgctgactacttcaacaacattggagaagctcgaggtcgctgaaagtgaattcacacactag

SEQ ID NO: 199244 - DNA, 597 bp, Artificial Sequence
  Description of Artificial Sequence: Synthetic coding sequence
atgtacaacgccctgtgcaagaccctgcagcgggactgcctggtgctacagtccttcaagattatggactacagcctgctaatgagtatccacaatattgatcacgcccaacgtgagccgctgagctctgagacgcagtacagtgtggacacccgtaggcccgcccctcagaaggctctctacagcacggcaatggagagtatccagggtgaggctcggagaggtggaaccatggaaactgatgaccacatgggcggaatcccggccagaaattctaaaggagaacggctgttgctatacattggaatcatcgacatcctccaatcttatcgcttcgttaagaaactggaacattcttggaaggcccttgtgcatgacggagacaccgtctctgttcacagacccggattttacgccgagcgtttccagagattcatgtgcaacacagtctttaagaagatccctcttcagccttggaaaagtctgaagctccagagccagtcctcacctataaagcgcaaagcaagtgaggacttggagcaagacagtgctatctccgtgatcccccggtgccaacctctcccccaacagtgctag

SEQ ID NO: 199245 - DNA, 261 bp, Artificial Sequence
  Description of Artificial Sequence: Synthetic coding sequence
atggccagcgaggtgctggaggcccggcaggacagctacatcagcctggtaccttacgcctccggaatgccaatcaaaaaaatcggacaccgatccgttgactctagtggagagacgacttataagaagaccaccagtagcgcactgaagggtgctattcagctcgggattacccatactgtcgggtctcttagtacaaagccagaaagggacgtacttatgcaggatttctatgttgttgaatcgatatttttcccctag

SEQ ID NO: 199246 - DNA, 1569 bp, Artificial Sequence
  Description of Artificial Sequence: Synthetic coding sequence
atggccagcgccagcagcggccccagcagcagcgtgggcttcagctcattcgatccagcagttccttcctgtaccctaagctccgcagcctctgggataaagaggcctatggcctctgaggtcccctatgccagcggcatgccaattaaaaagatcggccaccggtccgttgattctagcggagagaccacatacaagaagaccactagtagcgcgttgaaaggcgctattcagcttggtatcacccatactgtcggatctctttctacaaaacccgagcgggatgtgctgatgcaggatttttacgtcgtcgagtctattttctttccttccgaaggatctaacctgaccccagcacaccactacaacgattttaggttcaagacttatgctcctgtcgctttccgctattttagagaactgttcgggatccggccagatgactacctgtatagtctttgtagcgaacctctgattgaactatgttccagcggcgccagtgggtctctgttttacgtgtcctccgacgacgaatttatcatcaagacggttcaacacaaggaagccgagtttctgcagaagttgctgcctgggtattacatgaatctgaaccagaatcccagaacactgctaccaaaattttacgggctgtactgtgtgcaggccggcggtaaaaatattcggattgtcgtcatgaacaacctgctgcctcgctcagtgaagatgcatattaagtacgacctgaaaggctccacctataagagacgggctagccagaaagagcgagagaaaccattgcctactttcaaagatctagatttcttacaggacatcccggatggactgttcctggacgcagatatgtataatgccctttgtaaaacacttcaacgggattgtctggtgctccagagttttaaaattatggactactccctcttgatgagtattcataacattgatcacgcccagcgtgagccattgtcatccgaaacccagtattccgttgatactcgaaggccagcgccacagaaggccctttactccacagccatggagagtattcagggagaagccagacgaggaggcacaatggagacagatgaccagttcgttaaaaagctcgagcattcgtggaaagccctggttcatgatggtgacacggtctcagtccaccggcccggcttttacgccgagcgcttccagcgattcatgtgtaataccgtatttaagaagatacctctgaaacccagtccatccaaaaagttccggtcgggttcgtcattctccagaagggccggcagcagcggaaacagctgcattacgtatcagccatccgtaagcggtgagcacaaggcccaggtgaccacaaaagccgaagtagagcccggagtgcacctggggcggcccgatgttctgccacagaccccccccttggaggaaattagtgaaggcagcccaatccccgacccatcttttagcccactagtgggcgagactctgcaaatgttaacaacgtcaactacactcgaaaaactcgaagtagccgagtcggagttcacacactag

SEQ ID NO: 199247 - DNA, 1623 bp, Artificial Sequence
  Description of Artificial Sequence: Synthetic coding sequence
atgagcagcgccgccgagaacggcgaggccgcccccggcaagcagaacgaagagaagacctacaagaaaaccgccagcagcgcgattaaaggagcaatccagcttgggatcgggtataccgtgggaaatttgaccagtaaacctgagcgggatgtgcttatgcaggatttttacgtggtggaatcagtcttcctgccaagtgagggctccaatctaaccccagcgcaccattaccccgactttagattcaagacttatgctcccctagcctttaggtattttcgcgaactcttcggtatcaagccagacgactatctgtattccatctgtagcgaacccttgatcgagctgtccaaccccggggcaagcgggtccctcttctttgttacttccgacgatgaattcatcattaaaaccgttcagcacaaggaagccgagttccttcagaagctactgcccggatactatatgaacttgaatcagaatccaagaaccctgctgccaaaattttacggcctctactgtatgcagtctggcgggattaatatcagaatcgtagtcatgaacaacgtgctccccagaagcatgcgaatgcattttacttacgacttaaaaggatcaacttacaagcggcgcgccagccgaaaggagagagagaaatctaaccccaccttcaaggaccttgactttctgcaggacatgcatgaggggctgtattttgatactgagacttataatgccctcatgaagaccctccagagagattgcagagtgttagaatcattcaaaatcatggattattcacttctgctcggtatccacttcctcgaccattctctaaaagagaaggaggaagaaaccccacaaaacgttcccgatgccaaacgcacagggatgcagaaggttctgtacagcacggcaatggaaagcatccaggggccaggtaaatctggggacggaattatcacagaaaaccccgataccatgggtgggatccctgctaagagtcaccgcggcgagaaactcctgttgttcatgggtattattgacatcctccagagttataggttaatgaagaaactagaacattcttggaaggccctcgtttatgacggtgacaccgtgtctgtccacagaccaagtttttatgccgaccggttcctcaagttcatgaattcacgggtgttcaaaaagatacaggctctgaaggcaagccctagtaaaaaaaggtgtaatagcatcgccgccctgaaggccacgtctcaggaaatcgtgtcctccataagccaagaatggaaggatgagaaacgtgacctcctcaccgagggacagagttttagctccctcgacgaagaagctcttggatcccgccaccggcctgatctggtccctagcacaccttcactcttcgaggcagcttcactcgctacaaccattagctcatcctcgctgtacgtgaatgagcattatccacatgaccgccctacattgtatagtaactcaaaaggccttccatcttcatctactttcaccctggaggagggaaccatctatcttactgcagaaccaaataccttggaggtgcaggacgataacgcaagcgtgctcgatgtgtatctgtag

SEQ ID NO: 199248 - DNA, 312 bp, Artificial Sequence
  Description of Artificial Sequence: Synthetic coding sequence
atgagcagcgccgccgagaacggcgaggccgcccccggcaagcagaacgaggaaaaaacatataaaaagacagcatctagtgcaatcaagggcgcaatccagctggggatagggtatacggtggggaatctcacaagcaaacccgaacgggatgtactaatgcaggatttttatgtggtagagtccgtgttcctgccctctgaggggagcaatctcactcctgctcaccactatcctgactttcgattcaaaacttacgcccccctcgcattcagatatttccgagagctcttcggaattaagcccgactag

SEQ ID NO: 199249 - DNA, 1623 bp, Artificial Sequence
  Description of Artificial Sequence: Synthetic coding sequence
atgagcagcgccgccgagaacggcgaggccgcccccggcaagcagaacgaggagaaaacatataagaagacggctagcagtgccattaaaggagcgattcagctgggcatcggttatacagttggcaatctgacttccaaacccgaaagagatgtgctgatgcaggacttctatgtggtagagtccgtgttcctgccttcagagggtagtaacctcaccccagcccatcattaccccgattttagattcaaaacatacgcacctttagcctttaggtattttcgggaattattcggaatcaaacctgacgattacctctacagcatttgttctgaacctcttatcgagttaagcaacccgggggcctcaggtagtcttttcttcgtaacatcagatgacgaattcattattaagacagttcagcataaggaggccgaatttctgcaaaaattgctgcctggatactacatgaatctcaaccagaatcccagaacattgctgcctaagttctacggattatactgcatgcagtccggggggatcaacattaggattgtggtcatgaacaacgtcctacctcggtcaatgagaatgcattttacctacgacttgaaaggctccacatataagcgaagggccagcagaaaagagcgtgaaaaaagcaacccgaccttcaaagacttggacttcctccaggacatgcacgagggactctacttcgacacggaaacatataatgcactgatgaaaactttacagcgggactgcagagtcctcgaatctttcaaaattatggactatagtttactgctgggcattcactttctcgatcattctttgaaggagaaagaggaggagactcctcagaacgtccccgacgcaaaaagaacaggcatgcagaaagtcctctattctacagctatggaaagtatccagggtccgggaaagtcaggagacggcattatcacagaaaatcccgataccatgggaggaatccctgctaagtcgcaccgcggggagaagttgctcctatttatgggcattatcgacatactccagtcctaccgcctaatgaagaaactggagcatagttggaaggccttagtgtatgatggagacaccgtctctgtccaccgcccgtccttctacgccgatcgcttcctgaaatttatgaatagcagggtgttcaagaagatacaggcgctgaaagcgagcccgagcaagaaaagatgcaactcaatcgctgcgctgaaagccacgagccaggaaattgtatccagcatcagccaggaatggaaagacgaaaaaagggatctgctcacagaaggacagtcctttagcagcctggatgaagaagccctgggctcaaggcatcggcctgacctggtgccctccaccccaagcctcttcgaagccgcctcccttgccaccacaatctccagctcttctctctacgttaatgagcattacccacacgacaggcccacactatattcaaactccaaagggcttccttcttcatcgacatttaccctggaggagggtaccatctacctgacagctgaacccaataccttggaagttcaggatgacaacgcgagtgtgttggatgtatacctatag

SEQ ID NO: 199250 - DNA, 1350 bp, Artificial Sequence
  Description of Artificial Sequence: Synthetic coding sequence
atgcaggacttctacgtggtggagagcgtgttcctgcccagcgaggggtcaaatctcacccctgcccaccactacccagatttcaggtttaaaacctatgctccgctggcatttagatactttagggaactgtttggtatcaaacccgacgactatctgtactccatctgctcagagcccttaatcgagctttcgaacccaggagctagcggttccctctttttcgtgacaagcgacgatgagttcatcattaaaaccgttcagcacaaggaggctgagtttctgcagaagttgttgccaggttactatatgaacctgaaccagaatccacgcacactgctgccaaagttctatgggctgtactgcatgcagtccggaggtatcaacattagaatcgtggtgatgaataacgttctgccacgtagcatgcggatgcacttcacttacgatcttaaagggtcaacttacaagaggagagcctctcggaaagagagggagaagtccaaccctacctttaaagacctcgacttcttgcaggacatgcatgaaggcctctatttcgacacagagacatacaatgccttaatgaagacactccagagggactgtcgggtcctggaatcatttaaaattatggattactctctattgctcggtatccactttctcgaccactcactcaaggagaaagaggaagaaacaccacagaatgtacccgacgccaagcgaacaggaatgcagaaagtgctctattcaacagccatggagagcattcagggaccgggtaaatccggcgacggcattatcacggagaacccggatacaatgggcggtatccccgcaaaatcccaccggggggagaagctgctgctgttcatgggtattatcgacattctgcaatcgtaccggctaatgaagaagctcgaacacagctggaaggccctggtctacgatggggacacggttagtgtccacagaccaagcttctacgctgaccgctttttgaagttcatgaatagtagagtcttcaaaaaaattcaggcactgaaggccagtccttctaagaaacggtgcaacagtatcgctgccctcaaggctacctcgcaagaaattgtgtcctcaatcagtcaagaatggaaagatgagaagagagatctgctcacagaaggacagagcttttctagcctagatgaggaggccctcggatcccgccacagacctgacctggtgccttccacaccaagcctctttgaggctgcttctttagccacaactatctcatcgtcaagcctttatgtgaacgagcattacccacacgacaggcctactctctactcgaatagcaagtag

SEQ ID NO: 199251 - DNA, 489 bp, Artificial Sequence
  Description of Artificial Sequence: Synthetic coding sequence
atgagcagcgccgccgagaacggcgaggccgcccccggcaagcagaacgaagaaaagacttacaaaaagactgcttctagcgccattaaaggagcgattcaattgggcatcggatacactgtcgggaatctcacaagcaagcctgaacgggacgtgctgatgcaggatttttatgtggtggaatcggtgttcctgccttcagagggcagcaacttgacccccgcacatcactacccagactttcgctttaagacttatgcccctcttgctttcaggtacttccgtgaactgttcggcattaaacctgacgattacctgtactccatctgcagcgagcctcttatcgagctctccaatcctggcgcctccggctccctcttctttgtgactagtgacgacgagtttataatcaagacggtccagcacaaggaagccgagttccttcagaaactcctgccagggtattacatgaatcttaatcagaactag

SEQ ID NO: 199252 - DNA, 474 bp, Artificial Sequence
  Description of Artificial Sequence: Synthetic coding sequence
atgagcagcgccgccgagaacggcgaggccgcccccggcaagcagaatgaagagaaaacttataaaaaaactgcgtcctccgccatcaaaggtgctatccagctcggtatcggctataccgtcggaaatttgacaagcaaacccgaacgtgacgtgctcatgcaggatttctatgtagtggaaagtgtgttcctacctagcgagggcagtaacctcactcctgctcatcactacccggactttaggtttaagacatacgcgccactcgccttccgctattttcgagagctctttggcatcaaacccgacgactacctgtactctatttgttcagagccacttatcgaactgtccaaccccggcgctagtggctccctgtttttcgtgacaagcgacgatgagttcatcatcaagacagttcaacacaaggaagccgaattcttgcagaagctcctgccagggtattatatgtag

SEQ ID NO: 199253 - DNA, 1509 bp, Artificial Sequence
  Description of Artificial Sequence: Synthetic coding sequence
atgagcagcgccgccgagaacggcgaggccgcccccggcaagcagaatgaagagaagacttacaagaaaaccgcaagcagcgcaattaagggggctatccagctgggcatcggctataccgtggggaacttaacctctaaacctgaacgggacgtgctaatgcaggacttttacgtcgttgagagtgttttcctgccatccgagggctccaacttgacaccagcgcatcattaccccgattttagatttaaaacctacgcacctctggctttcagatattttagagaactgttcggcatcaaaccggacgactacctctactctatatgctcggagccccttatcgaactctccaatccaggcgcctcaggatctctgttcttcgtgacatctgatgacgaattcattattaaaacagttcagcataaggaggctgaatttcttcagaaactcttacccgggtattacatgaaccttaaccagaatccaaggactcttttacctaagttctatggattgtattgtatgcagtccggagggattaatatccgaatagtggtcatgaataacgtgcttccaagatccatgcgtatgcactttacctacgatctgaagggctctacctacaagcgcagagcgtcacgaaaggaacgggagaagtcaaacccaacgttcaaggatttggatttcctacaggatatgcacgaggggctttactttgacacagagacatataacgcgctgatgaaaacactgcagcgcgattgcagggtgctcgaatctttcaagataatggactatagcctcctgctcggaatccattttctggaccacagtctcaaggaaaaggaagaggaaactccgcagaacgttccggacgccaaacgaaccggcatgcagaaggttttgtatagcactgcaatggaatctatccaaggtcccggcaaatcaggtgacggcattatcaccgaaaatcctgacacgatgggaggcattcctgccaagtcccacaggggggagaaactgctgctgttcatgggcattattgatattttacagtcatatcggctcatgaagaagttggagcatagctggaaggccctcgtatatgatggagacacagtgagcgtccatcgcccctctttctacgcggatcgtttcctcaagtttatgaactctcgggtgttcaagaagatccaggccttgaaggccagccctagcaagaaacggtgtaactctatcgctgctctgaaggcaaccagccaggagatcgtgtcctctatctcacaagaatggaaagacgaaaagagggatctccttactgaagggcagagtttcagcagcctggacgaagaggctctgggctccaggcaccgacccgacctagtcccaagtacccccagtctctttgaggctgcaagtttagctacaaccatcagcagttcttccctatacgtgaatgagcattatccgcacgatcggccaaccctctattccaactccaagtag

SEQ ID NO: 199254 - DNA, 2007 bp, Artificial Sequence
  Description of Artificial Sequence: Synthetic coding sequence
atggagctggaggtgcccgacgaggccgagagcgccgaggccggcgccgtcccctcagaggccgcctgggctgcagagtccggagcagctgcagggttagcccagaagaaggccgccccaaccgaggtgctgagtatgaccgcacaaccaggccccgggcatggcaagaaactggggcatcgcggcgtggacgcctccggagaaactacatataagaaaaccacgagtagcaccttgaagggcgccatccagctgggcataggatacacggttggacacctgagctctaagcccgaacgagatgtgctaatgcaggatttttacgtagtcgagtccatcttcttccccagcgaaggctccaatctcacacctgctcaccactttcaggacttccgcttcaagacttacgcaccagtggcctttcgctatttccgcgaactcttcggcatcagaccggatgactacttatattccctgtgtaatgagcccctgatcgagctctcaaatcccggtgcaagcggctcattgttctacgtgacctcagacgacgaatttatcatcaaaactgttatgcataaggaggctgaattcttgcagaagcttctgcccgggtattatatgaacctgaaccagaacccacgcaccttattgccaaagttttatggactgtactgtgtccagagcggggggaaaaacatcagggttgtggtgatgaataacatcctacctcgagtagtgaagatgcatttgaagtttgatctcaagggctcaacatataaacgcagggcatctaagaaggaaaaagaaaaatcctttcctacttacaaggacctggactttatgcaggatatgccagagggcctcttgctggatgcggacaccttctccgctctcgtgaaaaccctgcagagagactgtctggtgctggagagttttaagatcatggattactctctcctcctaggcgtgcacaatattgaccagcacgagcgcgagaggcaggcgcagggagctcagtccacatcggatgagaagcggcccgtgggccaaaaggcactttactcaactgcaatggagagtatccaaggcggtgccgcgcgcggggaggcaatcgagagcgacgacacaatgggaggtatcccagctgttaatggacgtggggaacggctccttttacacatcgggataatcgacatcctgcagtcctaccgtttcatcaagaaattggaacacacatggaaggccttggttcatgacggggacacagtgtctgttcatagaccttcgttttacgccgagagattttttaaattcatgtcgaacaccgtattcaggaaaaattcctcattgaagagctctccttccaagaaaggcagaggcggtgcccttctggccgtgaagcccctggggccaacagcagcgttctccgcttctcaaattccctcagagcgggaagaagctcaatacgatctaaggggagctaggtcatatcccacactggaagacgagggccgacctgatttgttgccttgcactccacccagcttcgaggaggccacaacggcctcaatcgctacaacgctcagtagcacgtctctgagtatcccggaacgctcaccctccgaaaccagcgaacagcccaggtatcgcaggcgaactcaatcgtccggacaggacggacgcccccaggaagaaccgcctgcagaggaagatttgcagcagatcacggttcaggtcgagccagcttgtagtgtcgagatcgtcgtacctaaggaagaagacgcaggggttgaggcctcccccgccggcgcctccgctgcggtcgaagtcgaaaccgcatcccaggcgagcgatgaggaaggagctccagctagtcaagcttcagatgaggaagatgccccggcgaccgacatctacttcccaacagacgagcgtagctgggtttactcaccactccactactccgcccaagctcctcccgccagcgatggcgagagcgacacctag

SEQ ID NO: 199255 - DNA, 2103 bp, Artificial Sequence
  Description of Artificial Sequence: Synthetic coding sequence
atggagctggaggtgcccgacgaggccgagagcgccgaggccggcgccgtgccttccgaggccgcttgggcagcggagagtggcgccgcggctgggttggcacagaaaaaagctgctccaacagaggtgttgagcatgacagcgcagcctggccctggccatggtaagaagctgggccaccgaggagttgacgcatccggcgagacaacctacaagaagacaacctcatcaaccttgaaaggtgcaatccagctgggtatcggctacactgtgggacatctctcgtccaagcctgagagggatgtcttgatgcaggacttctacgtggtggagtcaatcttcttccccagcgaagggagcaatttaacccctgcccaccacttccaggatttcaggtttaaaacctacgcacctgtggcatttcggtacttcagagagctgttcggaattcggccagatgattacctgtacagcctgtgcaatgaaccgcttatagagctgtcaaaccctggcgctagcgggagcttgttttatgtgacctctgatgacgaattcatcatcaagacagtgatgcacaaggaagccgagttccttcagaaactgttaccaggctattacatgaacttgaatcaaaatccacgcacccttttgcccaaattctatggactttactgtgtacaatctggggggaagaatataagggtggtggtaatgaataatatactgcctcgggtcgtgaagatgcatctaaagttcgatcttaagggcagcacatataagcgccgggccagcaagaaagagaaagagaagtctttccctacttacaaagatcttgactttatgcaggatatgcccgaagggctcctgcttgatgctgatacgttctctgcgctagtgaaaacccttcagagagattgtcttgtactggagtctttcaaaattatggactacagcttattgctgggcgtacataatatagatcagcacgagagggagaggcaggcacagggcgcacaatccactagcgatgagaagcggcctgtgggtcaaaaggccctatactctacagcgatggagtctatacaggggggcgcggccagaggcgaagcaatcgaaagcgacgatactatggggggaatccccgccgttaatggcagaggcgaacgccttcttttgcacattggcataatcgatatcttgcaaagctaccggttcatcaaaaagctggagcacacctggaaggccctggtgcacgatggggacacagtgtctgtacaccgtccgagcttttatgccgaacgcttcttcaaattcatgtctaataccgtgttccgcaaaaacagttcccttaagtcatctcccagtaagaaaggtcggggcggggcactcctggctgttaagcccttaggtcccactgccgccttttccgcctcccaaatcccgtccgaaagagaggaggcccagtatgacttaaggggggctagatcctatcctacattggaggacgaaggccgacctgaccttctgccctgcacgcctccgtctttcgaagaagctactacggctagtatcgcgacaacccttagttccacaagcctctccataccggagcgctctccttctgaaacgtctgaacagcctagatacaggcgacggacccaatcttccgggcaggacggcagacctcaggaggaacccccggccgaggaagacctgcagcagattacggtacaggtcgaaccagcttgctctgtcgaaattgtcgtccccaaggaggaagacgcaggcgtggaagcctctcctgccggggcctcagcggccgtcgaagttgaaacagcttctcaagcctcagatgaggaaggagccccggcaagccaagctagtgatgaagaggacgcccctgctacagacatttacttttggcggctgtggggaccacacgctcccacgtggccctggcgccgggagggccgtgccgcctgtctgtgtccttatccacctcacgtcgtcacaccgttcccgggaacaggactgtgtgcctcatggagcccagacggtaccggcggcctcggagcaatgtcgtgctgcgtcagtgtaagctag

SEQ ID NO: 199256 - DNA, 1923 bp, Artificial Sequence
  Description of Artificial Sequence: Synthetic coding sequence
atggagctggaggtgcccgacgaggccgagagcgccgaggccggcgccgtcccctccgaggcagcttgggcagccgagtcaggcgccgcagctggccttgcccagaaaaaggccgctccaactgaggttttgtcgatgacggcccagcccgggccaggacacggcaagaagttggggcacagaggcgtggacgcttcaggagagacgacctacaaaaaaactaccagttcaacgctcaaaggtgccattcagttaggcattggttataccgtgggacatctttcaagcaagccagagcgagacgtgcttatgcaggacttctacgttgttgagtccattttctttcccagcgaaggtagcaacctgacaccagcccaccattttcaggattttcgtttcaagacctacgcccctgtcgccttccggtacttcagagagctcttcggaattcgccccgatgattacctttactctctgtgcaacgaacccctgatcgaactaagtaaccctggggctagcggatctcttttctatgtcacatctgacgatgaatttatcatcaagaccgtcatgcacaaagaggctgagtttctgcagaaactactcccaggatattatatgaacctgaatcagaatccaaggacattgctgcctaaattctacgggctgtattgtgtgcagagcggaggcaaaaatattagggttgtcgtcatgaacaacattctgccgcgagtggtgaaaatgcacttgaagtttgacttaaagggttctacgtacaagaggagagccagcaaaaaggagaaagaaaaatccttcccaacctacaaagatctggactttatgcaagacatgccagaaggacttctgctcgacgcagacacctttagcgcccttgtgaagacccttcaacgggactgtctggtactcgaaagttttaaaattatggattactccctgctgctcggcgtgcacaatatcgatcagcacgaaagagaaaggcaagcacagggggctcagagcacaagcgatgaaaagcggcccgtggggcagaaagctctgtactctactgcgatggagtccatccaggggggggccgccagaggcgaagccatcgaaagtgatgacacaatgggaggaatccctgcggtgaacggccgcggggaaaggcttctgctgcatattgggattatcgacatcctccaatcatacagattcataaaaaaattagaacatacctggaaggctctagtccatgacggagataccgtgtctgtccatcggccatccttttacgccgaacgcttcttcaaattcatgtcaaataccgtgttcaggaagaactcgtcccttaagtcctctccttctaagaaaggccgcggaggagccctactggccgtgaaacctctgggccctactgctgctttcagcgcttcacagatacctagcgaaagggaagaagcccaatacgatcttaggggagccaggagttaccccacactcgaggatgagggaaggcccgacttgttaccctgcactccaccctcctttgaggaagccacaaccgctagcatcgctacaactcttagctccaccagcctctctatacctgaacgttccccttccgagaccagtgagcagcccagatatcgccgccgtacccagtcctctggacaggacggacgcccccaagaagaacctcccgcggaggaggacctacagcaaatcaccgttcaggtggagcccgcttgtagtgttgagatagtggttcctaaggaggaggacgccggggttgaagcctccccggctggcgcaagcgccgccgtcgaggtggagaccgcctcacaggcttccgacgaggagggcgctcctgcttcccaagctagtgacgaggaggacgccccagccaccgacatttatttttag

SEQ ID NO: 199257 - DNA, 576 bp, Artificial Sequence
  Description of Artificial Sequence: Synthetic coding sequence
atgcagagcgtgttctaccccgccggccggatcagcgagcggtacgacattaagggttgtgaagtaagccgttgggtggaccccgcccccgaaggcagcccactggtactagtgctgaaggatctgaacttccaggggaagacaataaacctcgggccccagaggagttggttccttagacaaatggagctcgacactacctttctcagggagctgaacgtgctggattactccctgctcattgcctttcagagacttcacgaagacgaaaggggcccgggatcttccctgatcttccgcacggcaaggagtgtacagggggcccaatcacccgaagagtccagagcccagaatcgcagactgttgcctgatgcacctaatgcactccatatcctggatggacccgagcaacgctatttcctaggggtcgtggatctggctactgtatatggcctgcgtaagaggctggaacacttgtggaagactctccgatatcctgggaggactttcagtaccgtgagtccagcccgctacgcccggcgcctgtgtcaatgggttgaggcccataccgaatag

SEQ ID NO: 199258 - DNA, 1185 bp, Artificial Sequence
  Description of Artificial Sequence: Synthetic coding sequence
atggccgcccccagccccggcccccgggaggtgctggcccccagccccgaggcaggttgcagggctgtcaccagctctagacgcggtctactctggcggttgagggacaagcagtcgcgattggggctgtttgagattagcccagggcatgaactccatggaatgacgtgtatgatgcaggccggtctttgggccgctactcaggttagtatggaccaccctcccaccggacccccttctagggatgatttttcagaggtcctgacacaagtccacgaggggttcgagttgggcaccttggcaggccccgcatttgcctggttgcgcagatccttagggctggcagaggaggactaccaggctgcgcttgggccaggcggcccctatctgcagttcctgtctactagcaagtccaaagcatccttcttcctctctcacgatcagaggttctttctgaagacgcagggcaggcgtgaagtgcaggctttgctcgcgcacctgcctaggtacgtccagcacctccagaggcacccgcattccctgcttgcccgactgttgggcgtgcattcgctgcgggtagaccgcggtaaaaagacttacttcatagtcatgcaatctgtgttctaccccgccggcaggatctccgagcgctacgatatcaagggctgcgaagtgagtcgatgggtagacccagcccccgaaggatctccgctcgttctggtcctgaaagatctgaacttccagggcaaaaccatcaatttggggccacagagatcttggtttctacggcagatggagctggatacgactttccttagagagttaaatgtgctggactactctctgctgatcgctttccagcgtcttcacgaggatgaaagaggccctgggagcagcctgatatttcgaactgccaggagtgttcagggagctcaaagccctgaagagagccgcgcacagaataggcgcttgcttcctgacgccccaaacgcccttcacatcctagatgggcccgaacagaggtatttcctgggagtggtcgaccttgctacggtgtacggcctcagaaaaaggcttgagcatctgtggaaaacgctgcggtacccaggacggaccttctcaaccgtctcccccgctcgatacgctcggcgtctgtgccagtgggtcgaggcacatactgagtag

SEQ ID NO: 199259 - DNA, 1128 bp, Artificial Sequence
  Description of Artificial Sequence: Synthetic coding sequence
atgatgtgccagagcgaggcccggcagggccccgagctgcgggccgctaagtggctgcacttcccacagctcgctttgcgacgtaggctaggccagttgagctgcatgagtagacccgccttaaagttgcggtcatggcctctcaccgtactgtactacctgctaccctttggtgcactgcgccccttgtctcgtgtagggtggcggccagtgtcacgcgtggcactgtacaaaagcgttcccacaagacttctctcaagggcctggggacgcctcaaccaagttgagttgccccattggttgaggcgcccagtctactccctctatatctggacgttcggagttaatatgaaggaggctgctgtggaggatctccaccactatagaaacctgagtgagttttttcgtaggaagttgaagcctcaggccaggccagtctgtggtctccacagtgttatcagtcctagtgatggccggatcctcaactttggccaagtaaaaaactgtgaagtggagcaagtcaagggcgtcacttacagccttgaatcctttctcgggccccgcatgtgcacagaggacttacccttcccgcccgcagcctcttgcgattcctttaagaatcagttggtaaccagagagggtaacgaactttaccactgtgtcatttacctagctcctggggattaccattgctttcatagccctaccgactggacggtcagccaccgccgacatttccctggctccctgatgtctgttaaccccgggatggcccgctggatcaaagagctgttttgtcataatgaaagagtggtgctcaccggagactggaaacatggcttcttttcgctcactgccgtgggggcaacaaatgtgggtagcattcgcatttactttgaccgcgatctacacacaaattctcctcgacattccaaagggtcgtataacgattttagcttcgtgactcacaccaatagagagggcgtccctatgcgtaaaggcgaacatctgggggagtttaacctaggctctacgattgtcttaattttcgaggcaccaaaagatttcaatttccaactaaaaactggccagaagatcaggttcggcgaagcactgggctccttgtag

SEQ ID NO: 199260 - DNA, 1227 bp, Artificial Sequence
  Description of Artificial Sequence: Synthetic coding sequence
atggccaccagcgtgggccaccggtgcctgggcctgctgcacggcgtggccccatggaggtcgagtcttcacccctgcgagattactgcgctttctcagagtctacaaccccttcgcaagcttccttttagagcattccgcacagatgcccggaaaattcatactgctcccgccagaactatgttcctcctcagacccttgcccatcttactagtgacaggtgggggctacgccgggtaccggcagtacgagaagtacagagaacgggagctggaaaagctgggactggaaattcctcccaagttagccggacactgggaagtcgcactttataagagcgtgccaacaagattacttagtagggcctggggaaggctgaaccaggttgagctgcctcattggctgcgccgccccgtgtattctctgtacatttggacgttcggggttaatatgaaggaagcagctgtcgaggaccttcaccactatcggaacctcagtgaattttttcggcgcaaattgaaaccacaagctaggccagtgtgcggactgcactctatatctcccagcgatgggcgcatcctgaactttggccaggttaaaaattgtgaggtcgagcaggtgaaaggggtgacctattctttagaatcatttctgggacctcggatgtgtaccgaggacctgcccttcccccctgccgctagttgtgactctttcaagaaccagctggtgacacgggagggcaacgaattgtatcattgcgttatttacctcgcaccgggtgattaccactgttttcattcacctactgactggaccgtgagccatcgacggcattttccaggctctcttatgtctgttaaccctgggatggctcgttggatcaaagagctgttttgtcacaacgaaagggtggtgttgactggagattggaagcacgggtttttttctctcaccgccgttggggctaccaacgtggggagcataagaatctatttcgaccgagacctgcacaccaactcaccccgccatagcaagggtagctacaatgacttttctttcgtcacccacacgaaccgggaaggggtgccaatgcggaagggcgagcaccttggggaatttaatttagggagcacaatagtgctcatatttgaggcccccaaagactttaacttccagcttaagaccggtcagaagatccggttcggagaggccctaggcagtctgtag

SEQ ID NO: 199261 - DNA, 1128 bp, Artificial Sequence
  Description of Artificial Sequence: Synthetic coding sequence
atgatgtgccagagcgaggcccggcagggccccgagctgcgggccgccaagtggctgcacttcccccagttggcactgaggaggaggcttggccaacttagctgcatgtcgagaccagcacttaagctacggtcgtggcccctaactgtactttattacctgttgccttttggagccctcaggccgctgtccagagtgggatggagaccagtcagccgagtggcactgtataagagcgtacctacaaggctcctcagtcgcgcatggggcagattgaaccaggtagaacttccccactggctgcggcggccagtgtacagtctctacatctggacgttcggcgttaatatgaaggaagcagctgtggaggaccttcaccactatcgcaacctgtcagagtttttcaggcggaagttgaaaccacaagccaggcccgtatgcggtctacattccgttatctccccatcggacggtaggatcctgaattttggacaggtgaaaaattgtgaggtggaacaggtgaagggcgtcacttactcactggaatctttcctcggcccgagaatgtgcactgaggacctcccattcccgccagccgcaagttgcgactcatttaagaaccagctggtgacccgcgaggggaatgagttgtatcactgcgttatctatctcgctccaggcgattaccattgcttccatagccccactgactggaccgtttcacatcggcgacacttccctggcagtcttatgtctgtgaatccaggcatggcacggtggattaaggaactgttttgtcataacgaaagagtcgttctgacgggggactggaaacacggattcttctccttgacggcagttggcgcaactaacgttggctcaattagaatttactttgatagggacctgcacacaaacagcccacggcatagtaaaggctcgtataatgacttttccttcgtgacgcacacaaaccgtgagggcgtacctatgcgaaaaggcgagcacctgggagagtttaatctgggcagtacaatcgtccttatcttcgaggcacccaaggattttaactttcaactcaagaccgggcagaaaatccgcttcggagaagcacttgggtccctgtag

SEQ ID NO: 199262 - DNA, 789 bp, Artificial Sequence
  Description of Artificial Sequence: Synthetic coding sequence
atgatgtgccagagcgaggcccggcagggccccgagctgcgggccgcgaaatggctacactttccacagcttgctctcagacgacggctgggccaactgagctgcatgagcaggccagcactgaagctccggtcttggcctttgacggtcctgtactacctgcttccttttggggctctgcgacccctgagccgagtcggctggaggcccgttagccgtgtggctctgtataaaagcgtgcccacacggttactttccagggcttggggacgactgaatcaggtggagctcccccactggttaagaagacctgtatacagcttgtacatttggacgtttggcgttaatatgaaagaagctgctgtggaggacttacaccattacagaaacctgagcgagtttttccggcggaagctgaagccacaggctcggcctgtctgtggactacacagcgtgatttcaccaagcgacggccggattctgaacttcggccaagtgaaaaattgcgaggttgagcaggtgaaaggggtcacttacagcctcgaatctttcctcggtccaagaatgtgcaccgaggaccttccctttcccccagccgccagctgcgattccttcaaaaatcaactggtcacacgcgaggggaacgagctgtatcactgcgtgatctatctggccccgggcgattaccattgctttcatagccctaccgactggaccgtatcacacaggcggcactttccagggcccgcccataaacagccgaaagcccagcagggtctcctgcagtag

SEQ ID NO: 199263 - DNA, 687 bp, Artificial Sequence
  Description of Artificial Sequence: Synthetic coding sequence
atgatgtgccagagcgaggcccggcagggccccgagctgcgggccgcaaagtggctccatttccctcagctcgctctgagacgcagactcgggcagctctcgtgtatgtcacgcccagccctgaaactccggagttggccactgactgtcttgtactacctactcccctttggagcgcttcgacccttatcccgggttggttggcggcccgtgagtagggtggccctgtacaaatctgtgcctaccagactcttgtcccgagcatggggcaggctgaatcaggtagaattaccccattggctgagacgcccggtttactctctgtacatctggacatttggggtgaatatgaaggaagctgccgttgaagacttacaccactacagaaatctctccgaattttttcgacggaaactcaagcctcaagcccgtcctgtatgcggcctccactctgttattagcccatctgacggccgaattcttaatttcggacaggtgaaaaattgcgaagtggagcaagtgaagggagtgacctacagtctggaatcttttctggggcctcgcatgtgcactgaagatctgccctttccccctgctgctagctgtgatagttttaaaaaccagttggtgaccagggagggcaacgagctctaccactgtgtgatttatctcgcccccggcgactag

SEQ ID NO: 199264 - DNA, 222 bp, Artificial Sequence
  Description of Artificial Sequence: Synthetic coding sequence
atgatgtgccagagcgaggcccggcagggccccgagctgcgggccgccaaatggctgcatttcccacagttagctcttcgacggcgcctcggacagctgagctgtatgtctaggcccgcgttgaaactgcgcagttggcccctgacggttctgtactaccttctccccttcggcgcgcttaggcctcttagtcgtgtgggctggcggccagtgagccgatag

SEQ ID NO: 199265 - DNA, 222 bp, Artificial Sequence
  Description of Artificial Sequence: Synthetic coding sequence
atgatgtgccagagcgaggcccggcagggccccgagctgcgggccgccaagtggctgcactttcctcaactcgccctgaggcggaggctggggcagttatcctgtatgagccggcccgcgttgaagttacgctcttggccacttacggttctttactatctgcttccgtttggggcgttgcggccactctcacgcgtagggtggaggcctgtgtcaaggtag

SEQ ID NO: 199266 - DNA, 1230 bp, Artificial Sequence
  Description of Artificial Sequence: Synthetic coding sequence
atggccaccagcgtgggccaccggtgcctgggcctgctgcacggcgtagccccctggcgctcgagtctgcatccatgtgagatcactgcactttcacaatccctgcagcctctgcgtaaattgcccttccgcgcctttcgcaccgacgccaggaaaatccacaccgcccccgcacgaacaatgttcctgctcagacccctgcctattttgctggtgaccgggggcggatacgccggctaccgacagtatgaaaaatatcgcgaaagagagctggagaaacttggactggaaattcctcctaagctcgccggtcactgggaagtggcattatataaatcagtgcctacccgattgctgtcacgcgcttggggcagactcaatcaggtcgaactacctcattggctcaggagaccagtatatagcctgtacatttggacgtttggcgtcaacatgaaagaagctgctgtcgaggaccttcatcactatagaaatttgtctgagttctttaggcgaaaattgaagccccaggctagacccgtctgtggcctgcattccgtgattagtccgtctgacggacgcatccttaactttggacaggtcaagaattgtgaggtcgaacaagttaaaggcgttacctactccctggagagctttctgggcccccgcatgtgcacagaagatctgcctttcccccctgctgctagttgcgactccttcaagaaccagttggtaactagggagggtaacgaactctatcattgtgttatctacctggcacctggggattatcattgcttccactcacccacagattggacagtgtctcaccgtagacatttcccgggaagtctgatgagcgtaaatcccgggatggcgcgctggataaaagaattattctgtcataatgagagagtggttctaacaggagactggaagcatggcttttttagtctgactgctgttggcgcaaccaacgtcgggagtatccgaatttactttgatcgagatctgcataccaactcgccaaggcactctaagggtagttacaacgatttctcatttgtgacacataccaatagggagggcgtacctatgcgaaagggcgagcatctgggagagttcaatctcggctctacaatcgtgctcatatttgaagccccaaaggattttaacttccagctcaagactggccaaaagatccgattcggagaagccctcggatcactgtag

SEQ ID NO: 199267 - DNA, 246 bp, Artificial Sequence
  Description of Artificial Sequence: Synthetic coding sequence
atgatgtgccagagcgaggcccggcagggccccgagctgcgggccgcgaaatggctgcacttcccacagcttgccttaagacgacgactgggtcagctgagctgtatgtccaggcccgctttgaagctgcgctcctggcctctgactgtgttgtactacctactgcccttcggtgccctcagaccactatctagggtgggctggagacctgtgtcgcgagtggccctgtataaaagcgtaccctag

SEQ ID NO: 199268 - DNA, 981 bp, Artificial Sequence
  Description of Artificial Sequence: Synthetic coding sequence
atgatgtgccagagcgaggcccggcagggccccgagctgcgggccgccaagtggctacattttccacaactggcccttcgaagacggctcggccagctgtcttgcatgagccggcctgccctgaagctgagatcctggcctctgaccgtgctgtactatctgttgcccttcggcgctttgaggcctttgagtcgcgtggggtggcggccagtctctagagttgccctctataaaagtgttccaacccgtctgctgagccgggcttgggggaggctcaaccaagtagagcttccacactggctccgacgcccagtttattccctgtacatctggacgtttggcgtgaacatgaaggaggctgcagtggaggatttgcaccattatcgcaatctgagcgagttctttaggcgtaagctaaagccccaggcccggcctgtgtgcggactccattcggtgattagtccatccgatggcaggattttgaatttcggccaagtgaaaaattgcgaagtagaacaggtgaagggcgtgacctatagccttgaaagctttctgggcccaagaatgtgtactgaagacttgccattcccaccagcagcaagctgcgattcttttaagaaccaactagtcacccgcgaggggaatgagctctaccactgcgtgatttacctcgcccccggagactaccactgctttcatagtccgactgactggaccgtctcacatagacgacacttcccagggagtctcatgtccgtgaaccccggaatggcgagatggatcaaagagcttttctgtcataacgaacgagttgtactaactggtgactggaagcacggctttttcagcttgaccgccgtcggcgcaaccaacgtagggagcatcaggatctacttcgacagagatctccacacaaactccccccggcactccaaaggaagctacaatgacttttcagttgtaggaagtctcactcgatag

SEQ ID NO: 199269 - DNA, 984 bp, Artificial Sequence
  Description of Artificial Sequence: Synthetic coding sequence
atggagtacgccgtgaactgccacgtgatcacctgggagcggatcatctctcatttcgatatattcgccttcgggcacttttgggggtgggcgatgaaggccttgcttatcagatcctatggactctgttggacaatctctattacttgggagttgacagaactcttcttcatgcacctgcttcctaacttcgccgagtgctggtgggaccaggtgatcctggatatcctcctgtgtaacggcggcggaatctggctcggcatggtcgtgtgcaggtttctggaaatgaggacctaccactgggcttctttcaaagatatccatacaactacgggcaagataaaaagagctgtactccaattcacccctgcatcctggacgtacgtgcggtggtttgaccccaagtcatctttccagagagttgctggcgtatacctcttcatgataatctggcagctgacagagctgaataccttcttcctcaaacacatctttgtttttcaggctagccaccccctcagttggggtagaatactgtttattggcggcattacagctccaacggtgcgccagtactatgcctatctcaccgacacacagtgcaaaagagtgggcacacagtgctgggtctttggcgtcatcggcttcctggaggccattgtatgcataaaattcgggcaggatctgttcagtaagactcagatcctgtacgttgtgctgtggctgttgtgtgttgcattcaccacattcctgtgcctgtatggtatgatttggtacgccgagcattacgggcaccgggagaaaacatatagtgagtgcgaagacggaacttactcccccgagatatcatggcaccaccggaaaggcacaaaaggcagtgaagacagtccccccaaacacgccggaaacaacgagtcacattcgtcacgacgaagaaatcggcattctaagagtaaagtgacaaatggcgtgggtaaaaaatag

SEQ ID NO: 199270 - DNA, 1422 bp, Artificial Sequence
  Description of Artificial Sequence: Synthetic coding sequence
atggccagctgcgtgggcagccggaccctgagcaaggacgacgtgaattataagatgcacttccgtatgataaatgagcaacaggttgaggatataacaattgactttttttacagaccacatacaatcaccctgttgtctttcaccattgtcagcttgatgtacttcgcctttacccgggacgattcggtgccagaagacaacatctggcgagggattttaagtgtcatttttttcttcttaatcatcagcgtgctggccttccctaacggaccattcaccagaccccatccagccctgtggaggatggtctttggactctccgtgctttacttcttatttctggtgtttctgctgtttctgaatttcgagcaggtcaagagtttgatgtactggttagacccaaatcttcgctacgcaacccgcgaggcggacgtgatggagtacgccgttaattgccacgtaatcacttgggaacgcattatctctcacttcgacatattcgctttcggccacttttggggttgggccatgaaagcactgctaataagatcatatggcctctgttggactattagtataacatgggagttgacagagttattcttcatgcatttgctgccaaacttcgcagagtgctggtgggatcaggtcatcttggacattctcctgtgcaacggcgggggcatctggctggggatggtcgtgtgccgtttcctggagatgagaacataccattgggctagcttcaaagacatacatactaccaccggcaaaatcaagcgcgccgtcctccagttcacacccgcatcatggacctatgttcgctggttcgatcccaagtcatcatttcagagggttgctggcgtttacctctttatgatcatctggcagcttacagagcttaatacattttttcttaagcacatcttcgtctttcaagccagtcatcccttatcctggggccgtatcctcttcattggtggtatcactgcacctaccgtgaggcagtactacgcctaccttactgacacccaatgcaaacgagtaggaacacagtgctgggtgtttggagtcatcggatttctggaggcaattgtatgtatcaaatttggacaagatctgttcagcaaaacccagattttgtacgtagtgctttggctgctgtgtgtggcctttaccacgttcctgtgtctctatgggatgatatggtatgctgagcattatggccatagggaaaagacttacagtgaatgtgaagatgggacctactcccctgaaatctcttggcaccataggaaagggaccaaaggttctgaggacagccccccaaagcacgccggtaacaatgagtcacactcaagtcgtcgcaggaacagacatagtaagagtaaagtgacaaacggcgtcggaaagaaatag

SEQ ID NO: 199271 - DNA, 1464 bp, Artificial Sequence
  Description of Artificial Sequence: Synthetic coding sequence
atgcggcggggcgagcggcgggacgccggcggcccccggcccgagtctccagtgccggcaggccgcgcttcattggaggaaccccccgatgggccctccgccgggcaagccacgggcccgggcgaaggaaggagatctaccgagagcgaggtatatgatgatggaacaaacacgttcttttggagagcgcacacactgaccgtgctgttcatacttacttgtacactaggctacgtgacactgctagaagagacgccccaggatactgcctacaacactaaacgaggtatcgttgccagtatcctcgtgtttctttgtttcggcgtgacccaggccaaggacggcccgttcagccgaccccacccagcttactggaggttttggctgtgtgtctcagtcgtgtacgagttgtttctgatctttattctgttccagaccgtgcaggacggaaggcagttcctcaagtatgttgatcctaaattaggagtacccctgccagagcgggattacgggggaaattgtctaatttatgaccccgataatgagacagacccttttcacaacatctgggataagctcgacggcttcgtgcctgcccacttcctggggtggtatcttaagaccttaatgattagagattggtggatgtgcatgatcatttccgtaatgttcgagtttcttgagtatagtctggaacatcagttacccaacttctcagagtgctggtgggaccactggattatggatgtccttgtgtgcaacggtctggggatctactgcggtatgaaaaccctcgagtggctgagcctgaaaacctacaaatggcagggactatggaatattccaacatacaaggggaagatgaagcggattgcgttccagttcacaccgtattcctgggtgcgtttcgagtggaagcctgccagctcgcttcggcggtggctggcagtctgcggaataattttggtctttctactcgcggagctgaatacattttatctcaaatttgtgttgtggatgccgcctgagcactaccttgtcctgctgcgactggttttttttgtcaatgtcggaggcgtagccatgagagagatttatgacttcatggacgatcctaagccacacaagaagttggggccgcaggcttggctcgtggcagccataacagctactgaactgctcatagtggttaagtacgaccctcatacacttaccctctccctcccattttacatttctcagtgttggacactggggtctgtgctcgccctcacctggacagtgtggcggtttttccttcgcgacatcaccctgcgctacaaggagaccagatggcaaaaatggcagaataaggatgatcaaggctccaccgtcggcaatggcgaccaacaccccctgggtttggatgaggacctgctaggtcctggcgttgccgaaggagaaggcgctccgacaccaaattag

SEQ ID NO: 199272 - DNA, 2802 bp, Artificial Sequence
  Description of Artificial Sequence: Synthetic coding sequence
atggccgccagccggctggacttcggcgaggtggagaccttcctggatcggcaccctgaactgtttgaagattatctcatgagaaagggcaagcaggaaatggtcgaaaagtggctccagcggcattcacaaggtcagggggcgctggggcccaggccaagccttgccggaacatcttccctcgcccactcaacttgccgaggaggcagctcagtagggggtggaaccgggcctaatgggtcagctcattcacagccacttcccggtgggggggattgtggcggtgtccccctaagcccctcatgggccggcggaagccgcggggacggtaacttacaaaggcgcgcctctcagaaagagctgaggaagtctttcgccagaagcaaggcgatccatgtcaatagaacatacgatgagcaagtcacatccagagcccaggaacctttaagttcagtgaggcggagagccctgctgcgtaaagcctcttcgctgccccctaccactgcacatatactttccgcactcctcgagtctcgggtcaacctgcctcggtatccacctacagcaatagattacaagtgccaccttaaaaagcataacgaacggcagttctttttggagttagttaaagacatatcgaacgatttggatcttacatcgctctcctacaagattctgatattcgtgtgtctgatggtcgacgctgaccggtgttccctgtttttagtggaaggtgctgcagctggcaagaagacactggtatctaaatttttcgatgtccacgccggaacccccttgctgccctgttcctctacagaaaactcaaatgaggtccaggtcccttggggaaagggcatcatcggctacgtaggagagcacggagaaacagtgaatatacccgacgcctatcaggatcggcgcttcaacgacgaaatcgataagctgacaggctataaaactaaatcactcctgtgcatgcccattagaagcagtgatggcgagataataggagtcgcacaagccattaacaagatcccagagggcgcaccttttactgaggacgatgagaaagttatgcagatgtacttacctttttgcggcattgccatctctaacgctcagctgtttgcagccagccgcaaagaatatgagcgttccagggctcttctcgaagtggtaaacgacctgttcgaagagcaaaccgacctcgagaaaatcgtgaaaaaaatcatgcatcgcgcccagaccttgctcaagtgcgagagatgcagcgtcttactgttggaagacatagaaagtccggtggtgaagtttacgaaatcctttgagctgatgagtccgaaatgttctgcggatgccgagaacagcttcaaagaaagcatggagaagagttcctacagcgattggttgataaataacagcatagctgagctggtggcctctacgggcctgccggtaaatatctccgacgcatatcaggacccacgattcgacgctgaggctgaccagatttccggttttcacatacgaagtgtgctgtgtgtaccgatatggaattcgaaccaccagattataggagtggcccaggtcctgaaccgactcgatggcaaacctttcgacgatgccgatcagcgcttgttcgaagcattcgtgatattttgtgggctcggcataaacaacaccataatgtatgatcaagtgaaaaagtcttgggctaagcagtctgtggcgctggacgtgctgtcataccatgctacatgttcaaaggccgaggtagacaagttcaaagccgcgaacatccccctggtatcagaactagcaatcgacgatatccactttgacgatttcagcctggatgtggatgccatgattaccgctgcactgagaatgttcatggagctgggcatggtgcagaagttcaagattgactacgagactctgtgccgctggcttcttaccgtgcggaaaaattacagaatggtgctgtaccacaattggcgacacgcattcaatgtctgccagcttatgtttgccatgctaacaacagcgggattccaagatatcctgacagaagtagagattctggccgtgatagtgggatgcctctgccacgacctggaccacagaggaaccaataacgccttccaggctaagagcgggtctgcattagcccagctgtatggcacgtcagccacactcgagcaccaccactttaatcacgccgttatgatactacagagtgagggccacaatatcttcgcgaatttgtctagcaaggaatattccgatctcatgcagctgctgaaacaatccatccttgccaccgacctaacactgtatttcgagcggcgaacagaatttttcgagttggtgtccaaaggcgagtacgactggaatatcaagaatcatcgggatatcttccggtcaatgttaatgaccgcttgtgacctgggggctgtaaccaaaccgtgggaaatatcgcgccaggtagccgagctggtgacaagcgagtttttcgaacagggtgaccgcgaaagactggaacttaagcttactccttcagccatttttgataggaatcgcaaagatgaactgccccgcctccaactcgaatggatagattccatctgtatgcctttataccaggcccttgtgaaggtgaacgttaagcttaaaccaatgctggactccgttgcgaccaaccgttccaaatgggaggagctgcaccagaagcggctgttagcgtccactgcgtcctccagccctgcatccgtgatggtcgcaaaagaagatcgtaattag

SEQ ID NO: 199273 - DNA, 2052 bp, Artificial Sequence
  Description of Artificial Sequence: Synthetic coding sequence
atgctgaagcaggcccggcggcccctgttccggaacgtgctgagcgccacacaatggaagaaagtcaaaatcacaaggctggtgcagattagcggcgccagcctggccgagaagcaggagaaacaccaagactttctgatacagaggcagaccaagacaaaagaccgccggttcaacgatgaaatagacaaactcacggggtacaagactaagagcctgctgtgtatgcctattcggagcagcgacggggaaataatcggcgtagcccaagcgattaacaagatccccgagggtgccccatttactgaggatgacgaaaaagtgatgcaaatgtacctccctttttgtggaatagcaatctcaaatgcccagctgttcgccgcaagcaggaaagagtacgaacgctccagggccctgctggaagtagtcaacgacttgttcgaagagcagaccgacttagagaagattgtgaaaaaaatcatgcacagggcacagaccttactcaagtgcgagcgctgctctgtactcctactagaggatatcgaatctcctgtggtgaagttcacgaaatcatttgagctcatgagtccaaagtgctcagccgatgccgagaactccttcaaggagagcatggagaagagttcctattccgactggttgattaataacagcatcgcggaattggtagccagcacagggttgcctgtgaacatttccgatgcctatcaggatccccgtttcgacgctgaagccgaccaaatatcagggttccacatccgttcggtcctgtgtgtgcccatatggaacagcaatcaccagataatcggcgtagcccaggttctaaatcgactggacggaaagccttttgacgatgcagatcaaaggctgtttgaagcttttgtgatcttttgtggtttaggaataaacaataccatcatgtacgaccaggtcaaaaagtcgtgggccaagcagagcgtggcgctggacgtgctcagctatcacgctacatgctccaaggccgaagtggacaagtttaaggctgccaatatcccattggtgagtgagctcgcaatcgatgatatccactttgacgatttttcactggacgtggatgcgatgatcaccgctgccctgcgcatgtttatggagctggggatggtccaaaagtttaagattgattacgagactttgtgtaggtggctactcacagtgcgcaagaactatcggatggtactttatcacaactggagacacgcctttaatgtctgccagttaatgtttgcaatgttgactactgctggttttcaggacatcctgaccgaagtggagatcctcgcagtcattgtgggttgtctttgccacgacctggatcatcgggggacaaacaatgcttttcaggcaaaaagcggatccgccctggctcagctgtacggcacctctgctactctggagcatcatcacttcaaccacgctgtgatgatactacaatctgaggggcataatatatttgccaacctttccagtaaggagtactctgatctgatgcagctcctcaaacagtcaatactggcaaccgacctgacactgtatttcgaacgcaggaccgaattcttcgaactcgtgtccaagggcgagtatgattggaatataaaaaatcaccgcgatattttcagaagtatgcttatgacggcctgcgacctgggagccgtaacgaagccttgggagatctcccgacaggtggccgaactagttactagtgagtttttcgagcaaggggatcgggagcggctagaactgaagctaaccccctctgcaatcttcgaccggaaccggaaagatgaactgcctagattacaactcgaatggatcgatagtatatgcatgcccctctaccaggcactggtcaaggtgaatgtgaagctgaaacccatgttggacagtgttgccactaatcggtcgaagtgggaagagttacaccagaagcgccttctagccagcacggctagctcttcccctgcaagcgtgatggtcgcgaaggaagacaggaattag

SEQ ID NO: 199274 - DNA, 1470 bp, Artificial Sequence
  Description of Artificial Sequence: Synthetic coding sequence
atgagccccaagtgcagcgccgacgccgagaacagcttcaaggagagcatggagaaatcctcctacagtgactggttgattaataacagcatcgccgagctggtagccagcactggcctgcccgtcaatatatccgacgcgtatcaggatcctcgatttgatgccgaggctgaccagattagcgggttccacataagaagcgtgctgtgtgtgcctatctggaattcaaaccatcaaattattggagttgcccaggtgctgaacagactggacggcaagccctttgacgatgccgaccagcgcttatttgaggcctttgttattttctgcggtcttggtattaacaacaccattatgtacgatcaggtcaagaaaagttgggctaagcagtccgttgccctcgacgtgctgtcttaccacgctacctgctctaaggcagaggtggacaagttcaaggccgcaaacatccctttggtgagtgagctcgctatagatgacatccattttgacgacttttcccttgatgtcgacgcaatgattaccgcagctctgcgcatgtttatggaattagggatggtacagaaattcaaaatagattacgagaccctgtgccgatggctgctcactgtgcggaaaaactacaggatggtactataccataattggcgtcacgccttcaatgtgtgccagttgatgtttgccatgctgaccacagccggattccaggatatcctaacagaggtggagatattggctgtgatagtagggtgtctctgccacgacttggaccataggggtactaataacgccttccaggccaagtctgggagcgcgctggctcagttgtacggcacatccgccactctggagcaccatcatttcaaccatgccgtgatgatcctgcaatctgaaggccataatatctttgcgaatctgagcagtaaggagtacagtgatttgatgcaactcctgaaacagagcatcttggcaactgacctgacgctgtatttcgagcgtcgtaccgaattttttgaactggtgtcgaaaggagaatacgactggaatatcaagaatcatcgcgacattttccgttcaatgctgatgactgcctgcgatttaggcgccgtgaccaaaccttgggaaatcagtcgtcaggtagcagagctggtgacaagtgagttttttgaacagggggacagagaaagactggagctcaagctcaccccgtctgctatatttgatcggaatcggaaagacgaattgcccagactccagctggaatggatcgactctatttgtatgccactttatcaggccctcgtgaaggtaaacgtgaaactcaagcccatgctggactccgtcgctactaacagatcgaaatgggaagagctgcatcagaaacggttattagcaagcaccgcctcgtcctcgccagccagtgttatggtggcaaaagaggataggaattag

SEQ ID NO: 199275 - DNA, 1728 bp, Artificial Sequence
  Description of Artificial Sequence: Synthetic coding sequence
atgcagatgtacctgcccttctgcggcatcgccatcagcaacgcccagctttttgctgcatccagaaaggagtacgaaaggtcaagggcacttcttgaggtggtcaatgacttatttgaggaacagaccgacctggagaaaatagtgaagaagatcatgcatagagcacaaacactgctgaagtgtgagaggtgttctgttctgctattggaggacatagagtctccagtggtgaagtttaccaagagctttgaactcatgagcccaaagtgttctgcagatgcggagaactctttcaaggaatccatggaaaaatcaagttattctgattggctgatcaataactcaatcgctgagttggtcgccagtacaggccttcccgttaatatttccgatgcatatcaagatccaagatttgatgcagaagctgatcagattagcgggttccacatccgttccgtgttgtgcgtgcctatctggaattctaaccatcagatcattggcgtagcccaggtcctgaatcgcctagatgggaagccattcgacgacgctgatcaaaggttgttcgaggctttcgtcattttttgtgggctggggattaataataccattatgtacgaccaggtgaagaaaagctgggctaaacagtcagtggcacttgatgtgctgtcctaccatgcaacttgttccaaggccgaggttgacaagttcaaagcggccaacatccccctcgtttcggaactagctattgacgatattcattttgacgacttctctctggacgtggacgccatgattaccgcagcgctccgaatgttcatggagctcggcatggtgcagaagtttaagattgattatgaaaccctttgccgctggttgctcacggtacggaagaattaccggatggtgctgtaccacaattggaggcatgccttcaacgtgtgccagttgatgttcgccatgcttaccaccgctggctttcaggatattctgaccgaggtggagatcctggctgtcatcgtaggctgtctatgtcatgatctcgaccatagaggcactaacaacgccttccaagccaagtccgggtcagccctggcccagctgtatgggacttccgcaactctcgaacaccatcacttcaatcatgctgtcatgatcctccagagcgagggccacaatattttcgctaacctttctagtaaagagtacagcgacttaatgcagctgctcaagcagtcaatactagctacagatcttacactctactttgaacgacgtacagaattttttgagttggtttctaagggcgaatatgactggaacatcaaaaaccacagggacattttccgaagtatgctgatgaccgcttgcgatctgggtgcagttaccaagccctgggagatttccaggcaggtcgccgagctggtgacctcagaatttttcgagcaaggagatcgcgagcgccttgaattgaagctgactccttccgccatttttgatagaaatcggaaggatgagctgcctagactgcagctggaatggatcgacagtatctgcatgccgttataccaggctctggtcaaggtcaacgtgaagttaaagcccatgcttgacagtgtagccactaatagatccaagtgggaagagttacatcagaaacggctccttgctagtacggcctcttcgtcccctgcttcagtgatggttgcaaaggaagatagaaactag

SEQ ID NO: 199276 - DNA, 393 bp, Artificial Sequence
  Description of Artificial Sequence: Synthetic coding sequence
atgcccatccggagcagcgacggcgagatcatcggcgtggcccaggcaatcaataagattccggaaggagcaccttttacggaggatgatgaaaaggtaatgcagatgtatctgcctttttgtggcattgccatctcaaatgcccagctctttgctgcatcccggaaagaatatgaacgtagccgggctctgctggaagtggtaaatgacctcttcgaagaacagacagatctcgagaaaatcgttaagaagattatgcaccgggcacagacattgctgaagtgcgaaaggtgcagtgttctactgctggaggatatcgagtctccagttgtcaaattcaccaagagctttgaacttatgtcaccaaagtgctccgcagatgctgaaaactag

SEQ ID NO: 199277 - DNA, 1728 bp, Artificial Sequence
  Description of Artificial Sequence: Synthetic coding sequence
atgcagatgtacctgcccttctgcggcatcgccatcagcaacgcccagttgtttgccgcaagtcggaaagaatacgaacgaagcagggcgctgctggaggttgttaatgacctgttcgaagaacagaccgacctcgagaaaattgtgaaaaaaattatgcatagagcccagaccttgctaaagtgcgaaagatgttccgtgcttctgctggaggatatcgagtctccagtggtgaaatttacaaagtccttcgaattaatgtcccctaagtgttctgccgacgcagaaaacagtttcaaagagagcatggaaaagtctagctactctgactggttaatcaataattccatcgctgagctggtcgccagcaccgggctgccagttaatatctccgatgcctatcaggaccccagattcgacgcagaggctgatcaaatttccggattccacatccgatcagtcctttgtgttccaatatggaactcgaatcaccagatcatcggagtggcgcaggtgttgaacagactcgatggcaagcctttcgacgacgctgaccagcgcctgttcgaggctttcgtgatcttctgtgggcttgggattaacaacactattatgtacgatcaggtgaagaaatcatgggccaagcagagcgttgccctcgatgttctcagctatcacgctacctgtagcaaagcagaggtagataaattcaaggcagccaatatccccctcgtgtcagaactggccatcgacgatattcactttgacgacttttctctggacgtggatgcaatgattacggccgccctacgaatgtttatggaacttggaatggtccagaagtttaaaatagactacgagaccctctgtagatggttgttaacagtgcgcaaaaattataggatggtgctctatcacaattggcgtcatgcctttaacgtttgccagctgatgttcgcgatgttaactacggcaggttttcaggacatactgaccgaagtggaaatactggcagttatcgttggatgcctttgtcacgacctcgaccatcgcggtaccaataatgccttccaggctaaaagtggcagtgccttagcccaactgtatggtacatccgcaacacttgagcaccaccacttcaaccacgctgttatgatactccagagtgaagggcacaatatttttgccaatctctcatctaaggagtactccgacttaatgcagctattaaagcaatcaatccttgccaccgacctcacgctctacttcgagcggcggacagaattttttgagttggtgtctaaaggcgaatacgattggaatatcaagaaccacagagacatatttagatcaatgctgatgacagcctgtgaccttggggccgtgaccaaaccttgggagatttcccggcaggtagccgagcttgtaacatccgagttcttcgagcaaggtgacagggaacggctggagttaaaattgacccccagcgcaatttttgacaggaaccgtaaagacgagttgccaagacttcaactggagtggatagactcgatttgcatgcctctgtaccaagctctggtgaaggtgaatgttaaacttaagccaatgttggactccgtagccactaacaggagcaaatgggaggaattgcaccagaagagattgctggcaagtacagcttcctcttcccccgcatccgtcatggtggcaaaagaggaccggaactag

SEQ ID NO: 199278 - DNA, 375 bp, Artificial Sequence
  Description of Artificial Sequence: Synthetic coding sequence
atgctgatgaccgcctgcgacctgggcgccgtgaccaagccctgggagatctccagacaggtcgcagagctcgtaacatccgaattcttcgagcagggcgacagagaaagacttgagctgaagttgacgccaagtgctatcttcgacagaaaccggaaagacgagctacctcggctgcagctagaatggattgattctatatgcatgccactgtatcaagctctggttaaggtcaatgttaagttgaagccaatgcttgattccgtggccaccaacaggagtaagtgggaagaactgcaccaaaagcggctactggccagcactgcctccagtagtcccgcatcagtcatggtcgcaaaggaggaccggaattag

SEQ ID NO: 199279 - DNA, 1638 bp, Artificial Sequence
  Description of Artificial Sequence: Synthetic coding sequence
atgggcagcagcgccaccgagatcgaggagctggagaacaccaccttcaagtatcttactggtgagcaaaccgagaagatgtggcagcggcttaagggcattctccgctgcctggtgaagcagctcgaacgaggcgacgtaaacgttgtcgacttgaaaaaaaatatcgaatacgcagcctccgtgctggaggccgtgtatatagacgaaacgcgaaggttacttgacacagaagatgaactctctgacatccagactgattccgtgccttccgaggtgagagattggcttgcctccactttcacgcgcaagatgggtatgactaaaaagaaaccagaggaaaaacctaagttccgctcaattgtccacgccgtgcaggcgggcatattcgtggaaagaatgtataggaaaacctatcacatggtgggactcgcgtaccctgccgctgtgatcgtcactctaaaagatgttgacaaatggagttttgatgtgtttgcccttaatgaggcgtccggtgagcactctctcaaatttatgatatatgaactgttcacaaggtatgacctgatcaaccggttcaaaatcccggtctcttgcttaattacctttgcggaggcgctggaagtgggctactcaaaatacaagaacccctaccataatctcattcacgcggccgatgttacgcagaccgtacattacataatgctgcacactggcatcatgcactggttaaccgagctggaaattttggcaatggtttttgccgccgcgatccacgactatgaacatacgggaacaacaaataactttcatatacaaacccgtagtgatgtggccatcctgtataatgatagaagcgtattggagaatcaccacgtctccgctgcttatcgtctcatgcaggaagaagaaatgaatatcctgattaatctgagcaaggatgattggagggacctcagaaaccttgtgatcgagatggtgctgtccaccgatatgtctggccacttccagcaaatcaagaatatccgaaattccctgcaacagccagagggaattgaccgggccaaaaccatgtctttgatcttacacgctgccgatatcagtcatcctgccaagtcttggaaactccattacagatggacaatggccctcatggaagaatttttcctccaaggcgacaaggaagcagagttggggcttcccttttctcccctctgcgatagaaaatccacaatggtggctcaatctcagatcggattcatcgattttattgtggaaccgaccttctcattgcttactgattctaccgagaaaatagtgatcccccttatcgaagaggcaagtaaagcagaaacctcctcgtacgtggccagctcctctactaccatcgtgggtctgcacattgccgatgcactccggcgctcaaatactaagggctctatgagcgacggaagttacagtcccgattactcactggccgcagtcgacctgaagtctttcaagaacaacctggttgacatcatccaacaaaataaagagagatggaaggaactggccgcacagggggagtctgatctgcacaagaatagcgaagacctggtgaatgccgaagaaaaacacgacgaaacccactcctag

SEQ ID NO: 199280 - DNA, 1536 bp, Artificial Sequence
  Description of Artificial Sequence: Synthetic coding sequence
atgggcaagaagatcaacaagctgttctgcttcaacttcctggtgcaatgttttaggggaaagagcaagcctagcaaatgtcagattagaaaaaaagtgaaaaaccatatcgaaagacttctcgacacagaagacgaactgagcgacatccagacagatagtgtgccgtcagaggttagggattggctggctagcacctttaccagaaagatggggatgaccaagaagaagcctgaagaaaagcccaagttcaggagcatcgtgcacgcagtccaggcaggtatctttgtggagcggatgtatcgcaaaacataccacatggtgggattggcctaccccgccgccgttattgtgactctgaaagacgtagacaagtggtctttcgatgtctttgccctcaatgaagcctcaggagaacattctctgaagttcatgatctatgaactgttcacaagatacgatttaataaaccgttttaagattcctgtgtcttgtttgatcacatttgcagaggccctggaggtgggatactccaagtacaagaacccttaccataacctaatccatgctgccgacgtgacacaaacagtgcattacattatgctgcatactggaattatgcactggctgacagaactcgagatactggccatggtttttgcagccgctattcatgactatgagcatacaggcactaccaataacttccacatccagacccggtcggatgtggcaatcctgtataacgacaggagcgttctcgagaaccaccatgtgtccgcagcctacaggttgatgcaggaggaggagatgaatattctcattaacctgagtaaggatgattggcgcgacctgcggaatcttgtgattgagatggtgctgtctaccgatatgagtgggcactttcagcaaatcaaaaacattcgcaacagtctccagcagccagaaggcatagatcgagctaaaacaatgagtcttattctgcatgcggctgacatttcccaccctgctaagtcctggaagctgcactatcgctggacgatggccctgatggaggagttttttctccagggagacaaggaagcagaactgggactgccattcagtcccctttgtgacaggaagtccactatggtggcgcaatctcagattggttttatagattttatcgtagagcctacattcagcctgttaacggactcaaccgaaaaaatcgttatcccgcttatcgaagaggcgtcgaaagctgagacttccagttacgtggcctcaagcagcactaccatcgtcggcctacacatcgccgacgcactccggagaagcaacaccaaaggttctatgtctgacggaagttacagccccgattactctttggctgccgttgacctcaagagctttaaaaataacctcgtagacattattcagcagaataaggagaggtggaaggagctggccgcgcagggagagtccgatctacacaagaatagcgaggacttggtaaatgcagaagaaaaacatgatgaaacacatagttag

SEQ ID NO: 199281 - DNA, 1560 bp, Artificial Sequence
  Description of Artificial Sequence: Synthetic coding sequence
atggacgaccacgtgaccatccggaagaagcacctgcagcggcccattttccgtctgcggtgtctggtaaagcagctagaacgtggagacgtgaatgtcgtcgatttaaaaaagaacattgagtacgcagcctccgtgctagaagccgtgtacattgatgagacccgcaggttactggacacagaagatgagctttccgatatacaaacagactcagtaccatctgaagtgagggattggttagcctccaccttcaccaggaaaatgggtatgacgaagaagaaacccgaggaaaaacctaagttcagaagtatcgttcacgcagtgcaggcgggcatttttgtcgaacgcatgtatcgaaagacctatcacatggtaggactggcatatcccgctgccgtcattgtgacattaaaggacgttgacaagtggtcgttcgacgtctttgctctgaatgaagcatccggtgagcacagtctaaagtttatgatctacgaactgttcacaaggtatgacttaattaaccgatttaaaatcccagtgagttgcctgatcactttcgccgaagctttggaggtgggttattcaaagtacaaaaacccttatcataacttgattcacgcagctgatgttacacagaccgtgcattacattatgctgcacaccgggattatgcactggctgacagagctcgaaatcctcgcaatggtgtttgccgctgccatccacgactatgagcacactggtaccactaataatttccacatccagacacggagcgatgtagccattctgtataacgacagatctgtgctggaaaaccaccacgtcagtgctgcctataggctcatgcaagaagaggagatgaacatcctgatcaatctgtctaaagatgattggagggacctccggaatcttgtgattgaaatggtactcagtacggacatgagtggtcactttcagcagatcaagaacatccgcaatagccttcagcagccagagggtatcgacagagccaagacaatgtccctgattctacatgccgcagacatctctcaccccgcaaaatcttggaagctccattacaggtggacaatggcattgatggaagaattcttcctgcagggtgacaaagaagctgaacttggactgccattctcccctctgtgcgatagaaaatctacgatggttgctcaatcccagattggctttatcgatttcatcgtggagcccacatttagtttactgacggacagcacagaaaaaatcgttatacctctaattgaggaggcttcgaaagcggaaacgagttcctacgttgcttcctccagcacaaccattgtaggtctgcacatcgctgatgccctaagacggtccaacactaagggaagcatgtccgatgggtcatattcgccagattattctttggcggcagtggatctgaaatctttcaaaaacaatctggttgacatcatccagcagaataaagagcgctggaaggagctggctgcccaggaggctcggacatcatcacaaaagtgcgagttcatccaccagtag

SEQ ID NO: 199282 - DNA, 1608 bp, Artificial Sequence
  Description of Artificial Sequence: Synthetic coding sequence
atgggcagcagcgccaccgagatcgaggagctggagaacaccacctttaagtacttgacaggcgaacagacagagaaaatgtggcaacgactcaaaggaatcctgcgctgcctggttaagcagttagaacgtggggacgtgaatgttgtagatttaaagaaaaatatcgagtacgccgctagcgttcttgaggccgtgtacatcgatgagacacgacgcctcctcgacaccgaagacgaattgtcagacatacagactgatagcgttccctccgaggtacgagactggctcgcttcaactttcactcggaaaatgggcatgaccaagaaaaaaccagaggagaaaccgaaattccgcagcatcgtccacgccgtccaggctggtatcttcgttgagaggatgtatagaaaaacttatcacatggtaggattagcctaccctgcggctgtcattgtgacgctgaaggatgtcgacaagtggtcatttgatgtattcgctctgaacgaagcgagcggcgaacacagtcttaaatttatgatatacgagctcttcacccgctacgacctgattaaccggttcaaaattcctgtgagctgcctgattacattcgctgaagctctggaggttggttattccaaatataagaacccttatcacaacctgattcacgccgccgatgtcacacagaccgtacattatatcatgctccacacaggcatcatgcattggcttactgaactcgagattctggctatggtttttgccgctgccatccacgactacgagcatacagggacgacaaacaacttccatatccaaacacgatcagacgtcgcaatcttatacaatgacaggtccgtgcttgagaatcatcacgtgagcgcagcctaccgcttgatgcaagaggaagagatgaacattctcattaatctgtccaaggacgactggcgggacctacgaaatttagtgatcgaaatggtattgagcaccgacatgagtggccactttcagcagatcaagaacattcggaattcgttgcagcagcctgagggcatcgatagagctaagactatgtccttaatcctacacgcggcagacattagccaccccgcgaagtcctggaagctccattatcgatggactatggcccttatggaggagttttttctgcagggagacaaggaggccgagctcggattgcctttcagcccactctgtgacaggaagagtacgatggtcgcacaatcacagattggcttcatagattttattgtcgagccaacattctccctgctgactgactcaaccgaaaaaattgtgatacctcttattgaagaggcctcgaaggccgagaccagcagctacgttgctagttctagcacaaccatcgtgggactgcatattgctgatgctttacgaagaagcaataccaaagggtctatgagtgatggctcatatagtccggattactccctggcagcagtcgaccttaagagcttcaaaaacaacctggtggatatcattcagcagaacaaagagcgttggaaggaactggcagcccaggaggcccggaccagctcacagaagtgtgaatttatacatcaatag

SEQ ID NO: 199283 - DNA, 1590 bp, Artificial Sequence
  Description of Artificial Sequence: Synthetic coding sequence
atggacgaccacgtgaccatccggaagaagcacctgcagcggcccatctttagactccgctgcctagtgaagcaactcgagcggggagacgtgaacgtggtggatttaaaaaagaatatagagtacgcggctagcgtcctggaagctgtctacatcgacgagactcggagactgttggatacagaagacgagctctcagatattcaaactgatagtgtgccctctgaagtgcgggactggctcgccagcacattcacccgcaagatgggtatgaccaagaaaaagcccgaggagaaaccaaagtttcgtagtatcgtccatgctgtccaggctggcatttttgtcgagcgaatgtacaggaagacctatcatatggtcggcctggcctacccagctgcggtgatcgtcaccttaaaggatgtggacaaatggagctttgacgtattcgcactgaacgaggcctccggggagcactccctcaaatttatgatctatgagctgttcacacgttacgacctgataaataggttcaagatcccggtcagctgcctcatcacttttgctgaggcattggaggtcggctactcgaagtacaagaatccttaccacaacttaatccatgccgctgacgtgacacaaacagtacactacataatgctccacacaggtataatgcactggttaacagaattagagatcctagcgatggtctttgctgccgcgatccatgactacgaacataccggcactaccaataactttcatattcagactcgctctgatgtggctattttgtataatgatcggtccgtgctggaaaatcatcatgtgagtgcagcgtataggttaatgcaggaggaggagatgaacatcctgattaacttatcaaaggatgattggcgcgacctccggaacctggtgattgagatggtactgtccaccgacatgagcgggcacttccagcagattaagaacattcgcaacagcttacaacagcctgaaggcatcgatcgtgcaaaaaccatgtcattaatactgcacgccgcagacatctcccatccggcaaagtcttggaaacttcactatagatggacgatggctttgatggaagaattcttccttcaaggggacaaagaggctgagctaggcctgccgttttcgcccctgtgcgatagaaaaagtaccatggtagcccagagccagattggcttcatcgactttatagtcgaaccaactttttccttattgaccgacagcacggaaaaaatagtcatcccgctgatcgaggaggcctctaaggccgagacaagcagctacgtggcgagctcttccacaacaatcgtagggttacacatagccgatgcacttcgccggtcaaacacgaaggggagcatgagcgacggttcctactccccagactactcactcgcggccgtggaccttaagtcgtttaaaaacaatttagtggacatcattcagcagaacaaagagcggtggaaggaactggcggctcagggcgagagcgatctgcataagaattcggaagatctggtcaatgccgaagagaagcacgatgagacgcattcctag

SEQ ID NO: 199284 - DNA, 1608 bp, Artificial Sequence
  Description of Artificial Sequence: Synthetic coding sequence
atgggcagcagcgccaccgagatcgaggagctggagaacaccaccttcaaatatctcactggcgaacagactgagaaaatgtggcagcgtctaaagggcattttgagatgcctggtgaagcagctcgaacgcggggacgtgaatgtcgttgatttaaaaaagaatatcgaatacgcagctagcgtgctcgaggcagtgtacatagacgaaacaaggcgactgctcgacaccgaggatgagctgtccgacatccaaacagacagcgtgcccagtgaagtccgcgattggctcgctagcacctttactaggaagatgggcatgacaaagaagaagcccgaagaaaagccgaagttcagatcgattgttcatgccgtgcaggcggggatctttgtggaacggatgtataggaaaacttatcacatggttggcttggcctatcccgcagccgtgattgtgacactgaaggacgtggacaaatggtcttttgatgtcttcgcactgaacgaggcaagtggcgagcattctctcaagtttatgatttacgagctgtttacaagatacgacctaatcaatagatttaagattcccgtcagctgcctgattacatttgccgaagcactggaggtgggatacagtaagtataagaatccatatcataaccttattcatgccgctgatgtgacccagaccgtgcactatatcatgctacacactgggataatgcactggctcacagagctggaaatcttggctatggtttttgccgccgcgattcacgattatgaacacacaggtacaacaaataatttccacatccagaccaggagtgacgtggcaattctctataacgatcggagcgtgttagaaaatcaccatgtgtcagccgcttatcggctgatgcaggaagaggaaatgaatatcttaatcaatcttagcaaggatgactggagggatttgaggaatttggtcatcgagatggtcctttcgacagatatgagtgggcactttcagcagatcaagaatataagaaattcactccagcaacctgagggtatagaccgcgccaagaccatgtccctaatcctgcatgccgccgacatctcccatccagccaagtcctggaaattgcattatcggtggacaatggccctaatggaggagtttttccttcaaggggacaaggaagccgaactgggacttcctttcagcccattgtgtgacaggaagtctaccatggttgctcagagccagatcgggttcatcgatttcatcgtagagccgacctttagtcttctgacagactccacggagaaaattgttatacctttaatcgaggaggcatctaaagcagagactagctcttatgtcgccagttcctcaacaactattgtcggccttcacatcgccgacgctctgcgtcgatcaaatactaaggggtctatgagcgacggctcgtatagtcctgactactctctcgccgctgtcgacctgaaaagcttcaagaacaacctggtggacattattcaacaaaataaggaacggtggaaagagctggctgcccaggaagctcggacaagctcccagaagtgtgaattcatccatcaatag

SEQ ID NO: 199285 - DNA, 1638 bp, Artificial Sequence
  Description of Artificial Sequence: Synthetic coding sequence
atgggcagcagcgccaccgagatcgaggagctggagaacaccaccttcaagtatctgactggagagcaaacagagaagatgtggcagaggcttaaaggaattctgaggtgtttagtgaaacagttagaacgcggggatgtaaatgtggttgatctgaaaaaaaatatcgaatatgccgccagcgtcttggaagcagtctatattgatgaaacgcgccggttgctggatacagaggatgagcttagcgatatacagaccgattctgtgcccagcgaagtcagagactggttagcctcaacctttactaggaagatggggatgaccaagaaaaaacctgaagagaaacctaagttccgcagtatcgtgcatgcagtacaggctggtatcttcgtcgagagaatgtatcggaaaacttaccatatggtcgggcttgcctatcccgccgctgtgatagtgaccctcaaagacgtagataagtggtctttcgatgttttcgctctgaacgaggcgtccggcgagcactctcttaaattcatgatctacgagctgtttactagatatgatctcatcaaccgctttaaaatacctgtgagctgccttatcacttttgctgaggctcttgaggttggctacagtaaatacaagaacccatatcacaatctcatacacgctgctgacgtgacccagactgtgcattacatcatgctgcacactgggatcatgcactggctaacagaactggaaattctggctatggtgttcgctgccgctatccacgattatgaacataccggcactacaaacaatttccatattcagacccgttcagacgtggctatcctgtataacgacagaagcgtcttggagaatcatcatgtctcagcagcgtaccgtctaatgcaggaggaggaaatgaatattttaattaatctttcaaaagatgattggcgggacctcaggaacctggtaatcgagatggtgcttagcacagacatgtcggggcatttccagcagatcaagaacatcaggaacagtcttcagcagcctgagggcatcgaccgcgccaagactatgtccctcatactacatgcggccgacattagccaccctgctaaatcttggaaactgcactataggtggacaatggccctgatggaagagttctttttgcagggcgacaaagaagctgagctgggattacctttctctcccctgtgcgatcggaaatcgacaatggttgcacagagtcagatcggctttatcgacttcatcgtcgagcccacattttctctgttaaccgatagtaccgagaagattgtcattccactcattgaagaggctagtaaagctgaaacgagctcctatgtggctagcagctcaaccacgatcgtgggactgcacatcgctgatgccttaagacgcagcaacacaaagggctctatgtcagatgggagttattctccagattattccctggccgccgtcgacctgaagagcttcaagaacaatctggtggacatcattcaacagaacaaggaacgctggaaggaactggccgctcaaggggaatccgacctccacaagaatagcgaagatctcgtcaatgctgaggagaagcacgacgaaactcatagttag

SEQ ID NO: 199286 - DNA, 1659 bp, Artificial Sequence
  Description of Artificial Sequence: Synthetic coding sequence
atgggcagcagcgccaccgagatcgaggagctggagaacaccacctttaagtacctcactggcgagcagactgaaaagatgtggcagcggctaaaagggattctccgctgtttggtgaaacaactcgagcgtggtgatgttaacgtagtcgacctgaagaaaaacatcgaatatgcggcctcagttctcgaggcggtctatatcgatgaaacaagaaggctgctcgacactgaagatgagctgtcggatatacagactgacagcgtgcctagcgaggtgcgcgactggctggccagcacatttactcgaaaaatgggcatgaccaagaaaaaaccagaggagaaacccaagtttcgctccatcgtgcatgccgtgcaagccggtatattcgtggaaagaatgtaccgcaaaacttatcacatggtaggccttgcatatcccgcagccgtgatcgtgactcttaaagacgtggacaagtggtcattcgatgtgttcgcattaaatgaggcctctggcgaacattccctcaaatttatgatctacgagctgttcacccgttatgatttgataaatagattcaaaattcccgtgagttgcttgatcacgtttgctgaggcactggaggtgggctactctaagtataaaaatccataccataacttgatccatgccgccgacgtgacccagaccgtgcattacattatgcttcacaccggcattatgcactggttgacagagttagaaatattggcaatggtcttcgcggcagcaatccacgattatgagcatactgggaccactaacaactttcacatccaaacgcggagcgacgtcgctatcctctacaacgacagatccgtactggagaaccaccacgtatccgcagcctaccggcttatgcaggaggaggagatgaacatccttatcaatctatccaaagatgattggcgtgatctacgtaatctcgtcattgaaatggttctttccacagatatgtcaggccactttcagcagattaagaacattcgcaactccttgcagcagcctgagggaattgatcgggcaaagaccatgagcctcatactgcacgcagccgacatatctcatcccgccaaaagctggaaactgcactaccgatggaccatggccctcatggaggaattttttctgcaaggcgacaaggaagcggaacttggactgcctttctccccactgtgtgaccgcaagtctacgatggtcgcccaatcccagattggattcattgacttcatagtggagcccacattcagcttactcactgacagcacggagaaaatagtgatacctctaatcgaggaggccagtaaagccgagacgagttcttacgttgccagcagtagcacaacgatcgtgggcctgcacatcgccgacgctctccggagaagtaacaccaaaggcagcatgtcggacggctcatattctcctgattacagtctggccgcggtagacctgaagagcttcaaaaacaatttggttgacattattcaacagaataaagagaggtggaaagaacttgccgcacagggctccgtggtatatgaggcactgcttccaagtctgtcagtgtttaccagccccctacgggtatggatcacaagcagtagatttttgctgttatag

SEQ ID NO: 199287 - DNA, 1326 bp, Artificial Sequence
  Description of Artificial Sequence: Synthetic coding sequence
atgggcatgaccaagaagaagcccgaggagaagcccaagttccggtccattgtgcacgccgtgcaggccgggatctttgtggaaaggatgtacagaaagacatatcatatggttggcctggcctacccagccgctgtgatcgtgacactcaaagacgtggacaagtggagctttgatgtgttcgcactcaacgaggcctctggcgagcattccctgaagttcatgatctacgagttgttcacaaggtatgacttgataaaccggttcaaaattccagtatcttgcttaatcacttttgcagaggccctcgaggttgggtactccaagtacaagaatccctaccacaatctaattcacgccgcagatgtcacccaaaccgtccactatatcatgttgcacacagggattatgcactggctgactgaactcgaaattcttgctatggtttttgcggccgcaattcacgactatgagcatacggggaccaccaataatttccatatacaaaccaggtccgatgtcgcaatcctgtataacgatcgatcagttcttgagaaccaccatgtgtccgccgcataccggttgatgcaagaagaggaaatgaatatcctgatcaatctgtccaaagatgactggcgcgatctgcgcaatctggtaatagagatggtcttgagcacggacatgagtggacattttcagcaaattaagaacattcggaactcgctgcagcaacccgagggcattgatcgggccaaaaccatgtccctcatcttgcatgccgctgatataagccacccggccaagagctggaaacttcattatcgctggacgatggctctgatggaggagttctttctgcagggggataaagaggcagaactcggcctgcctttttcccccctgtgtgatcgtaagtcaaccatggtcgcccagtctcagattggcttcatcgatttcattgtagaaccaactttttcattactgactgacagcacggagaaaatcgtgatacctctgatagaagaggcttccaaggcagaaacttctagctacgtcgctagctcctctaccacaattgtggggctgcacatcgctgacgcgctccgtaggagcaacacaaaagggtcgatgagcgacggcagctactctcctgactactcactcgcagcagtggatctcaagtcctttaaaaacaatctggttgatatcattcaacagaacaaagaaaggtggaaggagctcgcagcccagggagagagcgacctgcataagaactccgaagatcttgtgaacgctgaggaaaagcacgacgaaacacattcctag

SEQ ID NO: 199288 - DNA, 1611 bp, Artificial Sequence
  Description of Artificial Sequence: Synthetic coding sequence
atggagctgagcccccggagcccccccgagatgctggaggagagcgactgtccaagccccttggagctcaaatctgccccaagcaagaaaatgtggattaagctgagaagcttgttgcgatatatggtaaagcagctggagaacggggagatcaatatcgaagaattgaaaaagaatcttgaatacacagcctccctactggaagctgtgtatatcgatgagacacgacaaattctggacaccgaggatgagctccaagaattgcggtcagacgccgtgccatctgaagtccgggattggctcgcttccacatttacacagcaagcacgagccaaggggcggagggctgaagaaaaacctaagtttcgctcaattgtgcacgctgtccaagcaggaatcttcgtggaaaggatgtttagacgcacctacactagtgtgggccctacgtactcaacagctgtccttaactgccttaagaaccttgacttatggtgttttgacgtgttttccctgaatcaggcagccgacgatcatgccctacgcaccatcgtctttgagctgctgaccagacacaacctgatatcaaggtttaaaattcctaccgtctttctgatgtcttttttagatgccctggaaacaggatatgggaagtacaagaatccatatcataaccaaatccacgcagccgatgtgacacagaccgtccactgcttcctcctgcgcacgggaatggtgcattgcttgtccgaaatcgagctcctggccatcatcttcgcggccgctatccacgactacgagcacacaggcacaaccaactccttccacatacagactaaaagcgagtgtgctatcgtctataatgatcgcagcgttcttgagaatcaccacatctcctcagtcttcaggctgatgcaagatgacgagatgaatatcttcataaatctgaccaaagacgagtttgtcgagcttcgcgctctcgtcattgaaatggtcctggccacggacatgtcatgccattttcaacaggtaaagactatgaagacagcccttcagcaactcgaacgcatcgacaagcctaaggctctctcacttctactgcacgcggccgacatttcacatcccacaaagcaatggctggtccacagccgctggacgaaggccctgatggaggaatttttccgacagggcgataaggaagccgagctgggcctgcccttcagtcctttgtgtgacagaaccagcactctcgtagcacagagtcagatcggttttatcgattttatagtggagcctaccttttccgttctgaccgacgtagctgagaagagtgtgcagcctcttgctgatgaggattctaaatctaagaaccaacccagcttccaatggcggcagccctccctggatgtcgaggttggcgatcctaatcctgatgtggtctcgttcagaagcacttgggtgaagcgaatccaagagaataaacagaagtggaaagaacgagcggcttcaggcatcacaaaccagatgtccatcgacgaactctctccctgcgaagaagaagcacctccgtctcctgcggaagatgagcacaaccaaaacggcaacctggactag

SEQ ID NO: 199289 - DNA, 1488 bp, Artificial Sequence
  Description of Artificial Sequence: Synthetic coding sequence
atggtgaagcagctggagaacggcgagatcaacatcgaggagctgaaaaagaacctggagtatacagcctccttgcttgaggcagtgtacattgatgaaacgcgccaaatcctggacaccgaggacgagttacaggaactgcggagtgatgcagtgccatccgaagtgagagattggctagcctctacatttacccagcaggcccgcgccaaaggaagaagagcagaggagaaaccaaagtttcgctcgattgtgcatgctgtgcaggcaggcatatttgttgagcggatgtttcgccgcacgtatacctccgtgggaccaacatacagcactgcagtgctgaattgcctgaagaacctcgacctgtggtgttttgacgtgttcagcttgaaccaggccgcagatgaccacgccctgaggacaatagtgtttgagctgctgacaagacataacctcatttctcgattcaagatccctacggtgtttttaatgtctttcctggacgcgttagagacaggttacggcaaatacaagaatccctatcacaatcagatccacgccgctgatgtgacccagacggttcactgcttcctgttacggactggtatggtccactgcctttccgaaatcgagctccttgctattatcttcgctgccgcgattcacgattatgaacacactggtacaacgaacagcttccacatccaaaccaaaagtgaatgcgctattgtgtacaacgaccgctccgttctcgagaaccaccatatcagtagcgtctttcgcttaatgcaggacgacgaaatgaacatcttcattaacctaacaaaagacgaatttgtggagcttcgggcactcgtcattgaaatggtgctagcaaccgatatgagctgccatttccagcaagtgaaaacaatgaaaactgctctgcagcagctggagaggatcgacaagcccaaggccctctcccttctgctgcacgctgccgacatttcccaccccactaagcaatggctggtacactcccgctggacaaaagctctgatggaggagttcttccggcaaggggataaagaggccgagttggggctacccttcagcccgctctgtgacagaacgtccacacttgtcgcccagagtcaaattggattcatcgacttcattgttgaacccaccttctctgtattgaccgatgttgcagagaagtcagtacagcctctggctgatgaagacagcaagtccaaaaaccagccttctttccagtggagacagccgtcacttgatgtggaggtgggagacccaaatccggacgtggtttcctttagaagcacatgggtcaagcgaattcaggagaacaaacagaagtggaaggaacgggctgcctctggtatcacaaaccaaatgtcaattgacgagcttagcccttgcgaagaagaggctccgccatctcccgcagaagacgagcataatcaaaatggcaatctggactag

SEQ ID NO: 199290 - DNA, 1551 bp, Artificial Sequence
  Description of Artificial Sequence: Synthetic coding sequence
atggccaaccccgtgcccgtgcagcggagccacctgcagggccccattttacgcctgaggtacatggtcaagcaactggagaatggagaaatcaatatcgaggaactgaagaagaacttagagtatactgcatcacttttggaagccgtttatatcgacgaaacccggcaaatcctggacacagaggacgaactgcaggaattacgctctgacgccgtgccctctgaagtgagggattggctagccagcacatttactcagcaggccagagcgaagggccgccgcgccgaggagaagcctaagtttcgctctatcgtgcatgccgtgcaggccggcatcttcgtggaaagaatgtttcggaggacctatacatccgtcggacccacatatagtactgccgtactaaattgccttaagaacctcgacctttggtgcttcgacgtcttttcccttaaccaggccgcagatgatcatgctctgagaacgatcgtgttcgaactgctcactagacataatctcatttcacgattcaagatccctacggtgttcctgatgtctttccttgatgcactcgaaacaggttatggcaaatacaagaacccttaccacaaccagatacacgctgccgatgttactcagacagtgcattgcttcctgctccgcacaggtatggttcactgcctgtccgagatcgagctgctggccatcatcttcgccgccgccatacacgattatgaacacaccgggactaccaacagcttccatattcagaccaagtctgaatgcgctatcgtgtacaacgaccgctccgtgcttgaaaatcaccacatcagctcagtcttcagactgatgcaggacgacgaaatgaatatctttattaatctgactaaagacgaatttgtcgaactgagggctcttgtgatcgaaatggtactggcaactgatatgagctgtcacttccagcaggtgaagaccatgaagactgccctgcagcagttggaacggatcgacaagcccaaggctctctctctattactacatgccgccgacatatctcacccaacaaaacagtggctggtacattcccgctggacaaaagccctcatggaggagttcttcagacaaggcgataaggaggcagaactcggcctgccattttccccattatgcgaccgcacctcaaccttggtggcgcaatcgcagatcgggtttatagacttcatcgtagaaccaaccttctccgtcctgaccgacgtcgcggagaagagcgtgcaacccctggccgacgaggactccaaatcaaagaaccaaccctcattccagtggcggcaaccctctctggatgttgaagtcggggacccaaatcccgacgtggtaagctttcggagcacttgggtaaagaggatccaggagaacaaacaaaagtggaaggaaagagcggcgtcaggcattacgaatcagatgtctatcgatgagcttagtccctgtgaggaagaagcacccccaagtccagctgaagatgagcacaatcagaatgggaatctggattag

SEQ ID NO: 199291 - DNA, 2310 bp, Artificial Sequence
  Description of Artificial Sequence: Synthetic coding sequence
atgaccgacgccggcaaccggaaggagggcttcaagaagtgccggagtgcaacattttctatcgacggatactcatttactatcgtggctaatgaggctggagacaaaaacgcccggccactcgctcgcttctcccgatctaaaagccagaactgcctgtggaattctctgatcgacgggttaacgggaaacgtcaaggagaagccccgaccaactattgtccacgatccccgccccccagaagagatcctcgccgacgaactcccccaactcgattcatcagaggtacttgtgaagaccagctttagattgcgctcattagtgaagcagctggagcgcggagaagcttccgtggtggaccttaaaaaaaacttagaatatgctgccacggtcctggaatcggtgtatatcgatgagacacgacgactcctggacacagaggatgaactatccgatatccagagcgatgctgttccgtcagaggtcagggactggctggctagtacattcacacgtcaaatgggaatgatgctcaggcgcagtgacgagaagcccagattcaaatccatcgttcacgccgtgcaggccggtattttcgtcgagaggatgtaccgacggacatccaatatggtgggtttatcttaccccccagcagtgattgaggctctgaaggatgtcgacaaatggtcattcgacgtgttctctttgaatgaagcaagcggcgaccacgcgctcaagttcattttttatgagctgctgacacgttatgatcttatctctagattcaagatccctatttccgcactcgtctcatttgttgaagctctcgaggtgggctactccaagcacaagaacccatatcacaacctcatgcatgctgccgatgtgacacagaccgtccactatctcctctataagaccggagtcgctaattggcttacggagctcgagatcttcgcaataattttctctgcagctattcacgattacgagcataccgggacgaccaacaatttccatatccagactagaagcgacccggctattctgtataatgaccggtcagtgttggaaaaccaccatttgagcgcagcctacagactgctccaggatgatgaagagatgaatattctaatcaatctcagtaaagatgactggcgggagtttaggacgcttgtgatcgagatggtcatggccactgacatgtcatgtcactttcagcagatcaaggctatgaaaactgcactgcaacaacccgaagcgatagagaaaccaaaagctctgtctctcatgctccacaccgcagatatttcccacccagccaaagcgtgggatctgcatcatcggtggactatgagcctcttggaggagttttttagacagggcgaccgtgaggcagagctgggtctgccattctcccccctgtgcgatcggaagagtaccatggtggcccagtcgcaagtgggcttcatcgatttcatcgtggaacctaccttcacagtccttaccgatatgaccgaaaaaatcgtttcccccctgatagacgaaacgtcgcagactggcggcacgggccagcgccggagcagcctgaattccatatcttcctccgacgccaagaggagcggcgtgaaaacctcagggtctgaggggtccgcgcccataaacaattctgtaatatctgtcgattacaagagtttcaaagccacgtggactgaggtggttcacatcaatagagagaggtggagagctaaggtcccgaaagaggagaaagccaagaaagaggccgaagaaaaagctcgcctagctgcagaagaacagcagaaggagatggaggcgaaaagtcaggctgaagagggcgcttccggaaaggccgagaagaagacatcaggcgagaccaagaaccaggtcaacgggacaagagctaacaagtcagacaaccctcggggtaagaacagcaaggcggagaagtccagcggagagcagcaacagaacggcgactttaaggatggtaagaataagaccgacaagaaagaccacagcaacatcgggaatgattccaagaagaccgatggtacaaagcagagatcacatgggagtcccgctcctagtacatcgtctacctgcaggctcacactccctgtaattaaaccacctctacgacacttcaaaagacctgcatacgccagctcatcctacgcccctagcgtgtcaaaaaaaacagacgaacacccagctaggtacaaaatgctagatcagagaataaagatgaaaaagatccagaacatttcccacaattggaataggaagtag

SEQ ID NO: 199292 - DNA, 2130 bp, Artificial Sequence
  Description of Artificial Sequence: Synthetic coding sequence
atggagagccccaccaaggagatcgaggagttcgagagcaacagcctgaagtaccttcaacccgaacaaatcgaaaaaatctggctcagattgcggggcctacgcaagtataaaaaaacctcccagcgccttagaagtttggtaaagcaactggagcggggcgaagcatcggtagtggatttaaagaagaatttggaatatgccgccacagtactcgagtcggtttatattgacgagacgcgcagactgcttgacacagaggacgaactctcagacatccaatcagatgcggtgcccagtgaagtcagggactggttggccagtacattcactcggcagatgggaatgatgctgagacgttcagatgagaagccccgctttaagagtattgtgcacgccgtgcaggccggcatcttcgtagaaagaatgtaccgaaggacctcaaacatggtaggtctgtcatatccacctgccgtgatagaggccctgaaagacgtagataagtggagctttgatgtcttctccctgaatgaagcaagcggcgaccacgccttaaaattcatcttctacgagctgttgacccgatatgatctgatcagccgctttaagatccctatcagcgcccttgtgtcattcgtggaagcgcttgaagttgggtatagtaaacataaaaacccatatcataacctgatgcatgccgccgacgtgacacagaccgtccattacctgctgtacaaaaccggagtcgcgaattggctgacggaacttgaaattttcgcaattattttctctgctgctattcatgactatgaacatacagggaccacaaataatttccacattcagactaggagcgatcctgccattttatacaatgacagatcggtgctggaaaatcatcacctgagtgccgcctacaggcttctgcaggacgatgaagaaatgaatattctgataaacctgtcaaaggatgattggcgggagtttcgcacactcgtaatcgaaatggtcatggctactgatatgagttgtcatttccagcagattaaagctatgaaaacagctcttcagcagcccgaggctatcgaaaagccgaaggcgctgtccttaatgcttcatacagccgacatctcccatcctgcaaaggcgtgggacctgcatcatagatggacaatgtctctgttagaggagttttttagacagggcgatcgcgaggcagagctcggcctcccattcagccctttgtgcgacaggaaatctactatggttgcacagagccaggtgggttttatcgattttatagtggaacctacttttacagtcttgaccgacatgaccgagaaaatcgtgagccctctcatcgatgaaacctcacagaccggtgggaccgggcagcgccgcagttccctcaatagcatcagttctagtgacgctaaacgtagtggcgtcaaaacgagtggcagtgaggggtctgcacccataaacaacagcgtgatttccgttgactacaaatcttttaaggcaacgtggacagaggttgtccacatcaatcgggaacggtggcgggcaaaagttccaaaggaagagaaggcaaaaaaggaagcggaagaaaaagctcgtctcgcggccgaggagcagcaaaaggaaatggaggctaaaagtcaggctgaagaaggtgcctcaggaaaagctgaaaaaaaaacgagcggcgaaaccaagaatcaggttaatggcactcgcgccaacaaaagtgataatccacgaggtaagaacagtaaagcagagaagtcatcaggcgagcaacaacagaacggggacttcaaagatggaaagaacaaaactgacaagaaggaccatagcaatatcgggaacgactcgaagaagactgacggaacgaagcagagatcacacggatcgcctgcaccatctacatcttcaacatgtcgcctcactctgcccgtgatcaagccgccactcagacattttaagcgtcctgcatatgcgtcctcctcctatgcacccagcgtttctaagaaaactgacgagcacccagcgcgctacaagatgcttgaccagagaatcaaaatgaagaagattcagaacatttctcataactggaaccgaaaatag

SEQ ID NO: 199293 - DNA, 1905 bp, Artificial Sequence
  Description of Artificial Sequence: Synthetic coding sequence
atggagagccccaccaaggagatcgaggagttcgagagcaacagcctgaagtacctgcagcccgaacaaattgagaagatctggcttagactgcgcggcctgcggaagtataaaaagacatcgcagagactgcgcagcctcgtgaaacaacttgagcggggggaggcttctgtggtggacctcaaaaagaacctcgagtacgccgctacggttctggaatctgtttacatcgacgagacaagacggctgctggatactgaggacgagctctctgatatacagtcggacgccgtcccctctgaggtgagggattggctcgctagcacatttacgagacagatgggcatgatgctgagacggtctgacgaaaagccgagatttaaatccatagtgcacgccgttcaggcaggcatattcgtcgagcggatgtacagacggacctcgaacatggtcgggctgtcttacccacccgccgtgatcgaggctctcaaggacgtggacaaatggtccttcgatgtgttttccctcaacgaagccagcggagaccacgccctgaagttcatcttttatgagctcctcacgcgctacgacctcattagcagattcaagatcccaatttccgccttagtatcattcgtggaagctctcgaggttggctactcaaagcataagaatccttatcacaatctcatgcacgctgctgatgtcacacagacagtccactaccttctgtataaaacaggcgtggctaactggctcacggagctggaaattttcgctattattttttcagccgctatacacgactacgagcacactgggacgactaataatttccacattcagacccgaagcgacccagccattctgtataatgaccgtagcgtgctcgagaaccaccatttgtccgctgcctaccggctgttgcaggacgatgaggagatgaacattctcataaacctcagtaaggatgattggcgtgagtttaggactctggtgatagaaatggtgatggctacggatatgtcatgtcacttccagcagatcaaagccatgaaaacagcactacagcagcctgaagcgatcgagaagccaaaggctctgagtctgatgctgcatactgccgacattagccatcccgcgaaagcgtgggacctgcatcaccggtggacaatgtcccttctggaagaattctttaggcagggcgatcgcgaggcagagcttggattgccattctctcccctttgcgatcggaagtcgaccatggtggctcagagccaagttgggttcatcgatttcatcgtggagcctacattcaccgtcctcacagatatgaccgagaaaatagtgtccccactgattgacgagaccagtcagaccggtggcacaggccaacgaaggtcctctctgaactctataagttccagcgacgcaaagcggtccggcgtgaaaacaagcggaagcgagggatcagcgcctatcaacaactctgtgatcagtgtcgactacaaatccttcaaagctacttggactgaagtggtacatattaaccgcgagcgctggagggccaaagtccccaaggaggagaaagcgaagaaggaggcagaggagaaagcccgcctggccgcagaagagcaacagaaggaaatggaggcaaaaagtcaggccgaagagggagctagcggtaaggctgagaagaagacaagtggcgaaaccaagaaccaggtgaatgggaccagggctaataaatctgacaacccaaggggcaagaactctaaagccgaaaaaagtagcggggagcagcagcagaatggagatttcaaggatggcaagaataagacggataaaaaggatcattcaaatatcgggaatgatagcaagaagacggatgactcccaggaatag

SEQ ID NO: 199294 - DNA, 1905 bp, Artificial Sequence
  Description of Artificial Sequence: Synthetic coding sequence
atggagagccccaccaaggagatcgaggagttcgagagcaacagccttaagtacctacagccagaacaaattgaaaagatatggctgcgactgcggggccttcgcaaatacaagaaaacaagccagaggctccgttccctggtgaaacagttagaacggggggaggctagtgtggtcgatctgaagaagaaccttgagtacgcggccaccgtcctggaatccgtctacatcgacgagaccagacgattgcttgacacagaagacgaattgagcgacatccagtctgacgctgtgccgtcagaagtgcgggattggttggcttccacctttacacgtcagatgggtatgatgctccggaggagcgatgaaaaaccccggtttaagagcatcgtccacgccgtgcaggccgggatttttgtggaaaggatgtacaggaggacatcaaatatggtgggcctcagttatccccctgctgttattgaagcactgaaagatgtggataaatggtctttcgacgtgttctcgctaaatgaagcttctggcgatcatgccctcaagtttattttctatgaactgcttaccaggtatgaccttatctctaggtttaaaatcccgatctccgctttggtgtccttcgtggaggccttggaggttgggtacagcaagcataagaacccctaccataatctgatgcacgccgcggatgtaacccagactgtacattatctgttgtacaaaacgggggtggccaattggctgaccgagctggaaatctttgcaataattttcagcgccgctatccacgattacgagcataccgggactacaaataattttcacatccagactcgaagcgaccctgcaatcctgtacaatgaccgcagcgttctggaaaatcaccacctttctgctgcttataggttattacaggacgacgaagaaatgaacattctcataaatctgtctaaggatgactggcgcgaatttagaacacttgtgattgagatggttatggccacggatatgtcctgccactttcagcagataaaggccatgaagactgcactgcagcagccagaggcgattgaaaagcccaaggccttgagtcttatgctccacacagccgatatttcccacccagccaaagcctgggatttgcaccacaggtggaccatgagcctgttggaggagtttttccggcagggagaccgtgaagcagagctcgggttacctttctctcctctgtgtgaccggaagtcgacaatggtggcccagtctcaggtcggctttatcgatttcattgtggaacctacctttacagtactcaccgatatgaccgaaaaaatcgtctctccactcattgatgaaacttcccaaaccggcgggaccggtcaacgccgttctagcctgaacagtatcagtagctcagacgcaaagaggagcggggtaaagaccagcggctccgaaggctccgcgccgatcaataacagtgttatctctgtggactacaaaagctttaaggctacctggacagaagtagtacacattaacagggagaggtggagagcaaaggtccccaaggaggagaaggcgaagaaagaggccgaagaaaaagcccgcctcgcagcagaggagcagcaaaaggagatggaagcaaagagtcaagcagaagaaggggctagcggcaaggcggaaaagaaaacctcgggtgagacgaaaaaccaggttaatggaacccgggcaaacaagtctgacaatccccgcggcaaaaattcaaaggcggagaagagttctggagagcagcagcagaacggcgattttaaggacggaaagaacaaaacagacaagaaggatcattcgaatataggaaacgattcgaaaaagaccgacgatagccaggaatag

SEQ ID NO: 199295 - DNA, 141 bp, Artificial Sequence
  Description of Artificial Sequence: Synthetic coding sequence
atggagagccccaccaaggagatcgaggagttcgagagcaacagcctaaaatatctccagccagagcagattgaaaagatctggttgcgcctgaggggtctccggaaatacaagaagaccagccaaaggctccgctcgtag

SEQ ID NO: 199296 - DNA, 2130 bp, Artificial Sequence
  Description of Artificial Sequence: Synthetic coding sequence
atggagagccccaccaaggagatcgaggagttcgagagcaacagcctcaagtatctccaacctgaacagattgagaagatatggctgcggctgcgaggcttgaggaagtataaaaagacttcccagaggttacggagccttgtcaagcagcttgaaagaggagaagctagcgtggtggacctcaagaagaatctggaatatgccgcaactgtgctggagagtgtgtacatcgatgaaactcgcaggcttctggatacagaggacgagttgtctgacattcagtcggacgcagtgccttctgaggttcgcgactggctggcgtctaccttcacaagacagatgggtatgatgctgcgccggtccgacgagaaaccaagatttaaatccatagtacacgccgtccaagcaggaatttttgtagagcgtatgtaccgccgaaccagtaacatggtaggcctttcatatccccctgcagttatcgaggccctcaaggatgtggacaagtggtccttcgacgtcttctccctaaatgaggccagcggcgaccatgccttgaagtttattttctacgaactgcttacccggtacgatctcatcagcagatttaaaattcccatttctgctttagttagctttgtagaggctttggaggtaggttattccaagcataagaacccctatcacaacttaatgcacgcagccgatgtcacccaaaccgttcactacttactctataagaccggcgtggcaaattggctgacagagttagaaatattcgccatcattttcagcgcggcaatacacgactacgagcacacagggacgactaacaatttccacatacagacacggtcggatccagcaattctgtacaatgaccgatccgtcctggaaaatcatcatttaagcgcggcctatcgcttacttcaggacgacgaagagatgaatattctcattaacttatccaaggatgactggcgcgagtttcgcacgttagtaatcgaaatggtgatggcaacagacatgagctgccattttcagcaaatcaaggccatgaaaaccgcgctccagcagcctgaggccatcgaaaaacccaaggctctgtcgttgatgttacatacagccgatatttcacacccagcaaaggcatgggatctgcaccaccggtggaccatgagccttctcgaggagtttttcaggcaaggcgatagggaggccgaacttggactgcctttttccccgctttgcgatcggaaatccactatggtggctcagtcccaggtagggttcatagacttcatcgttgagcctaccttcactgtgttgacagacatgacagaaaagatcgtctctccactgattgacgagacctcccagacaggagggacagggcagcggcggagctctcttaattccatttctagttcggatgccaagcgctctggggtcaagaccagcggctccgaggggtccgcccctataaacaatagtgtgatcagcgtggattataagtcttttaaagcgacttggactgaggtcgtgcatattaatagagagcgctggcgagcaaaggttcccaaggaggagaaggctaaaaaggaagctgaggagaaagcacggttagccgcagaggagcagcagaaggagatggaggcaaagtcacaggctgaggagggcgcctctgggaaagcagaaaaaaagacgagtggcgagacaaagaaccaggtaaatgggactcgcgcaaataagtctgataatccccgtggcaagaattccaaggccgagaagagttctggggagcagcagcagaatggtgatttcaaagacgggaaaaacaagacagataaaaaggatcactccaacatcggcaacgatagcaaaaaaaccgatggcaccaaacagcggagccatggttctcctgctccctccacctcatccacgtgccgtttaactttgcctgttatcaaacccccgcttcgtcacttcaaaagaccagcgtacgcttcctcctcatacgcacctagcgtgtcaaagaaaaccgatgagcaccccgcccgctataagatgttagatcaacgcataaagatgaagaagatccaaaatatttcacataactggaaccggaaatag

SEQ ID NO: 199297 - DNA, 3339 bp, Artificial Sequence
  Description of Artificial Sequence: Synthetic coding sequence
atgcggcgggacgagcgggacgccaaggccatgcggagcctgcagccccccgatggcgccggttcaccccctgagtcccttcggaatgggtacgtcaagagttgcgtgtctcccctacgccaggatccccctaggggctttttttttcatctgtgccggttctgcaatgtggaactgcgccctccccccgcgagtccccaacagccaagaaggtgttcacccttctgtagggcgagactctcattgggagccctcgccgccttcgtgctagcactgctgctgggagcagagcctgaatcctgggctgccggcgctgcatggctccgcacactgctatctgtgtgctcccactctttgtcaccacttttctcaatagcctgcgccttcttctttctgacttgtttcctcactagaactaaaagggggccaggtcccggcagatcctgcggatcctggtggcttttggcactgcccgcttgctgctacttaggagatttcctcgtgtggcagtggtggtcctggccatggggagatggtgatgctgggagcgctgctccacatacccccccagaagcagcagccggtcggctgctgctggtgctctcttgcgttggacttttattgactctcgcacatcctctgagattaaggcactgcgttcttgtgttgctgttagcctctttcgtatggtgggtcagcttcaccagcctcgggtccttgccatccgcccttcggccattgctctcaggtctggtaggcggagccggttgcctgctagcactgggtctcgaccactttttccagatacgcgaagctccgctgcatcccaggctgtcaagcgccgctgaagagaaagtgccggtaattagaccccggcgccgaagctcatgtgtcagcctaggggagacagcggcctcatactacggcagctgcaagatcttcagaaggccctccctcccatgcatctcaagagaacagatgatcttgtgggattgggacctgaagcaatggtacaagccacactatcagaactctggcggtggcaacggagttgatctttcggtgttaaacgaagccagaaacatggtttcagacctgttaactgacccctcactccccccacaggtgatttcatccctgaggtcgatttcatccttgatgggagcgttctcaggctcctgtcgaccaaagatcaatcccctgaccccatttcctggcttttatccctgtagtgaaatcgaagaccctgcagaaaaaggcgacagaaaattaaacaaggggttgaacaggaattcgcttcctacaccacagctgaggcgtagttcaggcacgtccgggctgctgcccgttgagcagtcttctcggtgggatcgtaacaacggcaagcggcctcaccaggaattcggaatctcctcccagggctgctacctgaacggacctttcaactctaacctcctgaccattcctaaacagagatcttcatctgtctctctgactcaccatgtgggcctccgtcgcgctggtgttctgagctccttaagccctgtgaactcatccaatcacggaccagtatctaccgggagcctgactaatcggtcacctatagaattccccgacaccgcagatttccttaacaaacccagtgttatactacaacggtcactgggtaacgcccctaacacaccagacttctaccagcaactgcgaaacagtgactcaaacctatgcaatagctgcggtcaccagatgctgaagtacgtgagcacctcggaaagtgatggaaccgactgctgctcgggcaagagcggggaagaggaaaacattttttcgaaagagtctttcaagctgatggaaactcagcaggaggaggagaccgaaaagaaagattcaaggaaacttttccaggaaggggacaagtggcttactgaggaggcccagagtgaacagcaaaccaatatcgagcaagaagtgtcattagacttaatcttggtggaagaatatgactctcttatcgaaaaaatgagtaattggaatttccccatcttcgagctggtagagaaaatgggcgaaaagtcgggcagaatcctaagtcaggtgatgtacaccctgtttcaggacacgggcctgttagaaattttcaagattccaacacaacagtttatgaattactttcgggcactagagaacggctacagagacatcccttaccataataggattcatgcaaccgacgtgttacatgcagtttggtacctaaccacacgcccggttccaggcctacaacagattcacaatggttgcgggactgggaatgaaactgacagcgatgggcgaatcaatcacggccgcatcgcctatatctcgtcaaaatcttgctctaacccagacgagagctacggctgtctgtcctccaacatcccagctttggagcttatggctttgtacgtcgctgctgccatgcacgactatgatcacccaggccggacaaacgctttccttgttgctaccaatgctcctcaggctgttctatacaacgacagatctgtgcttgagaaccaccatgctgcctcggcctggaacctgtacctgtccagacccgagtacaacttcctgttacatctggaccacgtcgagttcaagagatttaggttccttgtgatcgaggctatcctggccacagatttaaaaaagcacttcgattttctggccgaatttaatgcgaaagccaacgatgtaaattctaatgggatagagtggtcgaacgagaatgatagactcctggtctgccaggtttgcatcaagctcgcagatataaacggacccgcaaaggtgcgggacctccatctcaagtggactgagggcatagtcaacgagttttacgaacagggggacgaggaggccaacttagggctgcccatctccccttttatggaccgctcttcgccacaactcgcaaaattacaggagagctttatcacacacatcgttggccccctatgtaactcctacgatgcagctggtttattacctgggcagtggctagaggcggaggaggataatgacacggagtcgggcgatgacgaggatggtgaggagttggacaccgaggatgaggagatggaaaataacctgaatccaaagcccccgagaagaaagagccggaggcggatcttttgtcagctgatgcaccatctcaccgagaatcataaaatctggaaggaaatcgtcgaggaggaggagaagtgtaaggccgatggcaacaagttgcaagtcgagaatagctctttgcctcaggctgatgaaattcaggtaatagaggaggccgacgaggaagagtag

SEQ ID NO: 199298 - DNA, 3186 bp, Artificial Sequence
  Description of Artificial Sequence: Synthetic coding sequence
atgcggcgggacgagcgggacgccaaggccatgcggagcctgcagccaccggatggagccggctcaccccccgaatccctcaggaacggttacgtgaagagctgtgtgagtcctctgagacaggaccctccaagagggttcttcttccatctttgtagattctgcaacgtcgagcttcgaccacccccagcatctccacagcaacctcggcggtgcagtccgttttgtcgtgcccggctatcactcggcgcgctggccgcctttgtccttgctctgctgttgggtgccgaacccgagtcttgggctgccggtgccgcctggctcaggacactactatccgtatgttcccacagcttgtctccactctttagtatcgcttgcgcctttttcttcttaacttgctttctgacccgaaccaaacgagggcctggcccaggcaggtcctgtggttcatggtggttactggccctaccagcgtgctgctatttgggagatttcctggtatggcagtggtggtcctggccatggggggacggtgacgctggtagcgcagcccctcacacaccaccagaggccgccgctgggaggcttttgcttgttctgtcttgcgtgggactgctgcttacgttagcacatcccctccgcttacggcattgtgtgcttgtgctcctgcttgcctctttcgtctggtgggtgtcgttcactagtctgggcagcttgccctctgccctgcgtccactgctgtccgggctcgtcgggggtgcaggatgcctgctggctctgggactggaccacttttttcagattagggaggctccactacaccccaggctgagcagtgctgcagaagaaaaagtgcccgtcattcgtcctcggagacggagttcttgtgtcagcctaggtgaaactgcagcctcctactatggcagctgcaagatcttccggcgacccagtctgccatgcatttcccgggagcagatgatcctttgggactgggatctcaagcaatggtacaaacctcattatcagaatagcggaggaggtaacggcgtcgatctgagtgtgctcaacgaggctcgtaacatggtctccgacctcttgaccgacccatccctcccacctcaaggactcaaccgcaactccctgcccacacctcaactgaggcgcagttcaggaacctccggtctccttccggtggagcagtccagccggtgggacaggaacaacgggaagcggccgcaccaggagttcgggattagctcccagggttgttaccttaatggaccatttaactccaacctcctgactatccccaaacagaggtcctccagcgtgtcgctgactcatcacgtcggtttgcgccgagctggagttctgtcctctttatcccccgtgaactcatccaatcacggaccagtgtctacggggagcctcactaatcgctcaccaatagagtttccagataccgccgactttttgaataagcccagcgtgatactccagagaagcttaggcaacgccccaaacacccccgacttttaccagcaacttcggaactccgattcaaacctatgcaatagttgcgggcatcagatgctgaaatatgtgtccacttcagaatccgacggtaccgactgttgcagtggaaaaagtggagaagaggaaaatatcttttcaaaagagtcctttaaactgatggagacccagcaggaagaggaaaccgagaagaaggacagcaggaagctgtttcaggaaggcgacaagtggttaacagaggaggctcagagcgaacagcagacgaatatcgaacaagaagtcagtctggatttgatactggtcgaagaatacgactccctgattgagaagatgtccaactggaactttccaatcttcgaactcgtagaaaaaatgggggaaaaatcaggccgcatactctcccaagtcatgtacacgttatttcaggataccggattactagagatctttaaaattcccactcagcagtttatgaattactttagagccctcgaaaacggctaccgggacataccttatcataataggatccatgctacagatgttttacacgccgtgtggtacttgaccaccaggccagtgcctgggttacagcaaatccacaatggatgcggtactggtaacgagacagactcagacgggaggatcaatcatggaaggattgcctacatcagctctaagtcgtgctccaacccagacgaatcttacggttgcctgagttccaacataccagcactcgaattgatggccttgtacgtcgccgccgcaatgcacgattacgatcatcctggcaggacaaatgctttcctggttgccacaaacgcccctcaggccgttctgtacaatgatcggtccgtgctggaaaatcaccatgctgcctcagcgtggaacctctatttaagcaggcccgagtacaacttcttgctccacttagaccatgttgaatttaaaaggttccggttcctggtgatcgaggccatcttggctaccgacctgaagaagcactttgatttcctagccgaattcaatgcgaaagcaaacgatgtgaactcgaacggtatcgaatggtctaatgagaacgacaggctactggtgtgtcaggtgtgcattaaattggccgatattaacgggcccgccaaggttagagacctgcacctgaaatggaccgaaggaattgttaatgagttctacgagcagggggacgaggaagccaatttgggattgcctatctcacccttcatggataggagcagcccccagttggcaaagcttcaggagtcctttattacccacattgtcggtccactatgtaatagttatgatgcagccgggctgctgcccggtcagtggctagaagcagaggaggacaatgatactgagtctggagacgacgaggatggcgaggaacttgacactgaggatgaggaaatggaaaataatctcaaccctaagccaccccggaggaaatcccgaaggcgcattttttgtcaactaatgcaccacctgacagaaaaccacaaaatctggaaggagatcgtggaggaggaggagaaatgcaaagccgatggaaacaaactgcaggtcgaaaactcaagtctgccccaagcggacgaaattcaggtgatagaggaagccgatgaggaggaatag

SEQ ID NO: 199299 - DNA, 2583 bp, Artificial Sequence
  Description of Artificial Sequence: Synthetic coding sequence
atggcccggccccggggcctgggccggatccccgagctgcagctggtggcctttcctgtggccgtagctgccgaagacgaagcttttctaccagagcctctggcacctcgcgctccacggcgacccaggtctccccccagcagtcccgtcttttttgcctccccgtctcccacattccgacggcgacttcgacttctgcgctcatgtcaggatctcggccggcaagcgtgggcaggcgcagggttcgaggctgaaaatggcccaaccccatcgccagggcgaagcccacttgatagtcaggcatctccaggactcgtcctacacgccggggctgctaccagccagaggcgggagtcgtttctctaccggtctgattccgactacgacatgtccccaaagactatgtcacgcaacagtagcgtaacatctgaagcacacgcagaggacttgattgtcaccccctttgcacaggttctagcctctcttagatccgtgcgttcaaatttttcactgctgacgaacgtgcccgtgcccagtaataaacggagcccactgggcggacccacccctgtgtgcaaagccacattaagcgaggaaacatgtcagcagctggcacgcgagactttggaggaacttgactggtgtctggagcagctagagactatgcagacatatcggtccgtgtctgagatggcctctcataaattcaagagaatgctgaatagggagctcactcacttgagtgagatgagcagatccggtaatcaggtgtcagagtatatctccaccaccttcctggacaaacagaatgaggtggaaatccctagccccacaatgaaggagcgggagaagcagcaggcaccaagaccacggccatcacagccaccgcccccacctgtgccacacctccagccaatgtctcaaatcaccggcctgaagaagctcatgcacagcaactctctcaataattctaatatccccagatttggtgttaagaccgaccaggaggagttactggctcaggagcttgaaaaccttaataagtggggcttaaatattttctgtgtcagtgattacgcaggaggccgatccctgacttgcattatgtacatgatcttccaggaacgggatcttctaaaaaagttcaggattcctgttgacacaatggtgacatatatgcttacattggaggatcactaccacgccgatgtggcttatcataactccctccacgcggctgacgtgctccagagcacccacgtcttgttagcaacgcccgcgctcgacgctgtatttacagacctggagatcctagccgccctgtttgccgccgctatccacgatgtagatcatcctggtgtcagcaaccagttcctaattaatactaactctgagctggcactcatgtataacgatgagtcggtactggaaaaccaccatctagcggtaggtttcaaactcctacaggaggacaattgcgatatctttcaaaatctgagcaaaaggcagcgccagtcccttcgaaaaatggtgatagatatggtgcttgctacagacatgtctaagcacatgaccttgttggctgacctgaagacaatggttgaaactaagaaggtgaccagttcaggagtgctgctcctggataattatagcgaccgcattcaggtgctgagaaacatggtgcactgtgccgatctgtctaatcccaccaaacctctggagctgtaccgccagtggaccgataggattatggccgaattttttcagcaaggagacagggagagggagcgaggcatggaaattagtcctatgtgcgacaaacataccgcctcagtagagaaaagccaggtgggtttcatcgactacatcgtgcacccactttgggaaacctgggctgacctcgtgcacccggatgcccaggagatattagacaccctcgaagataatcgggattggtattactctgccattagacagtctcctagcccccccccggaggaggaatcacgcgggcctggtcaccctcctctccctgataagtttcagttcgagctgaccctcgaagaggaggaagaggaggagatctccatggctcagataccatgtaccgcacaagaggcccttacagcacaagggctttccggagtggaggaagctttggacgccactattgcctgggaggccagccccgcccaagaatcactcgaggtcatggctcaggaggcaagcctggaggctgaactggaggctgtgtacctcacccagcaggcgcagagcactgggtccgcccctgttgccccagacgaattctcctcaagagaggaattcgtcgtggctgtgagccactcctcccctagcgcgctggccctgcaatcccctctgctacctgcctggcgcactctgtcagtgagtgaacatgcacctggtctgcctgggcttccgagtacagctgcggaggtcgaagcccagcgagagcatcaggctgccaaacgcgcatgcagcgcctgcgccggcaccttcggggaggatacaagcgctctgcctgccccgggtgggggtgggtctggaggagaccctacgtag

SEQ ID NO: 199300 - DNA, 1944 bp, Artificial Sequence
  Description of Artificial Sequence: Synthetic coding sequence
atgcccctggtggacttcttctgcgagacctgcagcaagccctggctggtgggctggtgggaccagttcaaacgcatgctgaacagggagctaactcacttgtcagagatgagcagatcaggcaaccaggtctctgagtatatctccactacttttctggacaagcagaatgaagtggagatcccgtctccgaccatgaaggagagggagaagcaacaggctccccgccctagaccctcccagccccccccccctccagttccccacctgcagcccatgagtcaaatcactgggttaaaaaagctcatgcatagcaattccctgaataatagtaacattccccgcttcggggttaagacggatcaggaggagctgttggcccaggagcttgaaaaccttaacaagtggggattgaatattttttgtgtgtctgactacgccggaggccggtcactcacttgcattatgtacatgatttttcaggagagggacttgcttaagaaatttcggatccccgtggacaccatggtaacgtatatgctcacccttgaggatcattaccacgcagacgttgcttaccataactctttacacgctgctgatgtgctccaatccactcatgtgttgctggccacccctgctctcgatgctgtgtttacagatctcgaaatcctggccgccctctttgccgcagctattcatgatgtggaccatccaggtgtatcaaatcagttccttatcaatactaattccgaactggcactcatgtacaacgatgagtctgtactggagaaccaccacctggcggtcggatttaagcttcttcaggaagacaactgcgacatattccagaatctttcaaaacggcagcgccaatccttgcggaagatggttatcgacatggtgctggccacggatatgtccaagcatatgaccctcctggctgacttaaaaactatggtcgagaccaaaaaagtcacatcctctggagtgctgctactagataactatagcgatcggattcaagtcctgaggaacatggttcactgcgcagacctgtcaaaccccaccaagcctctggagttgtacagacaatggacggacagaattatggcagaattctttcagcagggcgaccgggaacgcgagcggggaatggaaatctcaccgatgtgcgacaagcacaccgcctctgtcgaaaagagtcaggtaggcttcatcgattacatcgtacaccccctgtgggaaacctgggctgacttagtgcacccggacgcacaggagattttagatactctcgaggataaccgcgattggtattacagcgcgattcgccagtcgcccagcccaccacctgaggaggagagtcgcggtcctggacacccccctctgccggacaagtttcagttcgagctgacgttggaggaggaggaagaagaggaaatcagcatggcccaaattccttgcacagcccaagaggcactcactgcccagggtttaagtggtgttgaggaggccttggatgccaccattgcttgggaggcctctcccgctcaggaaagcctagaagtgatggcccaggaggcttccctggaggctgagctcgaagcggtgtatctcactcagcaggcccagagtacagggagcgccccagtggctcccgatgagtttagctcccgagaggagttcgtggtcgctgtcagccatagcagcccttccgcgctcgccctgcaaagtccactgcttccagcctggcggaccctttcagtgagcgagcacgcccctggacttcccggtctgccaagtacggccgccgaggttgaagcgcaacgggaacaccaggcggctaaacgtgcttgctcagcctgcgccggtacttttggtgaagatactagcgcactcccggctcccggcggggggggatctggtggagacccaacatag

SEQ ID NO: 199301 - DNA, 2661 bp, Artificial Sequence
  Description of Artificial Sequence: Synthetic coding sequence
atggagccccccaccgtgcccagcgagcggagcctgagcctgagcttaccaggtcctcgggaggggcaagccacattgaagcctccaccacagcatctctggaggcagcctagaactcctattcgtatccagcagcgtggatatagcgacagcgctgagcgggctgagagagagaggcagccccatagacctatcgaaagggccgacgccatggacacctcagaccggccaggactgcgcacaactagaatgagttggccttcatcttttcatgggactgggactggctccgggggcgcaggcggcggttcctctcgccgattcgaggccgagaatggcccaaccccatctccagggcggtctccattggattcacaagcttccccggggctggtcctgcacgcaggggccgccacctcgcaaagacgtgagtcttttctgtacagatcagattctgactacgacatgtccccaaaaacgatgtcccgcaattcaagtgttacatcagaagcccacgcagaggacctaatcgtaaccccctttgcccaagttctagcttcactacgctcagtgaggagcaatttttcgctcttgaccaatgtacctgtgcctagcaacaagagatctccactggggggccctactcccgtctgcaaagcaaccttatccgaggaaacttgtcaacagctagctcgggaaaccctcgaggaactggattggtgtctcgagcagcttgaaaccatgcagacgtaccgttctgtgagcgaaatggcctctcataaatttaaacgaatgttgaaccgagagctaacccacctgtccgaaatgtcacgaagtgggaaccaagtatctgagtacatttccacaacatttttggacaaacagaacgaggttgaaatcccttcgccgaccatgaaggagagggaaaagcaacaggctccacgccctcggccttcccagcctccaccaccacccgtgccccacttacagcccatgagccagattacagggctcaaaaaacttatgcattcaaacagcctgaacaactcaaatatacctcgcttcggcgttaagacagatcaggaagagctgctggctcaggaactcgagaatttaaacaagtggggattgaatattttttgtgtgagcgactacgccggcgggcgatccctgacatgcatcatgtatatgattttccaagaaagggatttgctaaaaaaattccggatcccagtagacaccatggtgacctatatgctcactctcgaagaccattatcatgcagatgtggcttatcacaacagtttacatgctgctgatgtcctgcagtctacacatgttcttctggccactcctgccctggatgccgtgttcaccgatcttgaaatccttgccgctcttttcgctgccgctattcacgacgtcgatcacccaggcgtgtcaaaccagttcctgattaataccaattcagagcttgccttgatgtataacgatgagtccgtgctggaaaaccatcacctggcagtgggcttcaagctcctccaggaagataattgcgatatctttcagaatttatcgaagcgacagcgtcagtccttaagaaaaatggtgatagatatggtcttagctacagatatgagcaaacacatgaccctgctcgctgacctgaagactatggtggagactaagaaggtcactagctctggggtcctgttactcgataattactcagaccgaattcaagtgttgcgtaatatggttcactgtgccgacctgtctaaccccacaaagccgctcgagctgtaccgccagtggacagaccgcataatggcggagtttttccagcagggggaccgggagcgggagaggggcatggaaattagccctatgtgcgacaagcatactgcgtccgttgagaaaagccaggtgggtttcattgattatattgtgcatccactctgggagacctgggccgatctcgtacatccagatgcccaggaaatactcgacaccctcgaagataaccgcgattggtactattccgctattcgtcaaagcccgagtcctcccccagaggaagagtctcgtgggcctggacaccctccacttccagacaaattccagtttgagttgaccctggaagaagaagaagaggaggagatctccatggcacagatcccatgtacagcccaggaagctctaacagcgcaggggctcagtggagtggaggaggccctggacgccaccatcgcctgggaggcctcacctgcacaagaatcactcgaagtgatggctcaagaggcctcccttgaggccgagctggaagccgtgtatctgacacagcaggcgcagagtaccggctccgcccctgtggctcctgacgagttctctagccgggaagagttcgtggtcgcggtcagccatagctccccatctgctctcgctctccaatctccactgctgcctgcctggagaacactgagtgtgtcagagcacgctccaggcctgccaggacttccttctaccgctgctgaagtggaggcccaaagagaacaccaggctgccaaaagggcctgctctgcctgcgcaggcacatttggggaggacacttctgcgttgcctgcaccaggaggcggtggatctgggggggatcccacgtag

SEQ ID NO: 199302 - DNA, 972 bp, Artificial Sequence
  Description of Artificial Sequence: Synthetic coding sequence
atggtgctgcccagcgaccagggcttcaagctgctgggcaacgtgctccagggtccagagccttatcgactacttaccagcggtttgcggctccaccaggagctcgaaaatctaaacaagtggggtctgaacatcttctgtgtcagcgactacgcagggggtcgtagcctgacctgtatcatgtacatgattttccaggagagggatctgctgaagaaatttagaataccagtcgataccatggtgacttacatgctgacactggaagaccactatcacgccgatgtcgcttaccataatagcctccatgcagcggacgttcttcagagtacacatgtgctgttggcgacgccagctctcgatgccgtgttcacagacctggaaatcctcgctgcgttgtttgccgccgctatccacgacgtcgaccatcccggagtgtctaatcagttcctgatcaatacaaatagcgagctggcattgatgtacaacgacgagtccgtgctcgaaaaccatcacctcgcggtcggattcaaactactacaggaggacaattgcgacatattccaaaatctgtctaaacggcagaggcaaagtctccgaaagatggtcatcgacatggtgcttgcaacggatatgtctaaacatatgaccttgctggccgacctaaagacaatggtggagactaagaaagtcactagcagcggagtcctattactcgacaactactccgataggatacaggtccttcgaaatatggtgcactgcgcagatttatccaaccctactaaaccccttgagctgtaccgacagtggacggacagaattatggcagaattctttcaacagggagatcgggaaagagagcgtggaatggagatctctcccatgtgtgataagcacaccgcctcggtggaaaaatcccaggtgcaggcacggggcattgatgggcgggcgcagggggagttttactag

SEQ ID NO: 199303 - DNA, 2595 bp, Artificial Sequence
  Description of Artificial Sequence: Synthetic coding sequence
atgaagcggagccggagcgccctgagcgtggccggcaccggcgacgagaggtcacgcgaaacaccggagagtgatcgagcaaacatgctcggcgccgatctcagaaggcctcggaggaggttatctagtggtcccggactgggttgggcccagccagaaccctcggatcctggcgtgcctctgccgccgagacccacaaccctccccctcttgattcctccacgcattagtattacgcgggccgagaatgactcattcgaagctgagaacggcccaacgccttctccgggcagatcccctctggactcccaggcgtctcctggtctagtgctccatgcaggagctgcaacttctcaacgaagagaaagcttcctgtatagatctgactccgactacgatatgtcccctaaaacgatgagcaggaatagctcggtgaccagcgaagcccatgccgaagacttgatcgttacaccgttcgcccaggtcctggcatccctcaggtcggttaggagcaatttttcccttctgaccaatgtgcccgtcccctcaaataagcggtctccattgggcggtcctacacctgtgtgtaaagctactttaagtgaggagacatgtcagcaattggcaagagaaactctggaggagctcgattggtgtctggaacaactcgagacaatgcagacataccggtccgtgtcagaaatggcttctcacaaatttaagagaatgctgaacagagagctgacacatctctcagagatgtcaaggtccgggaaccaggtcagtgagtacattagtacaacttttctggataagcaaaacgaggttgagatcccatccccgactatgaaggaacgagagaaacagcaggctccacgacccaggccttctcagcctccacctcctcccgtgccccatctccaacctatgtctcagattacaggcctgaagaagctcatgcattccaattctcttaacaattccaacatcccgcggttcggagtcaaaacggaccaagaggaactgctggcccaggagctggagaatcttaataaatgggggcttaatatcttttgcgtatctgattatgccggtggccggtcacttacctgcatcatgtacatgatattccaggaacgggacttgctcaaaaaattcaggattcccgttgacactatggttacatacatgcttacgttagaggaccattatcatgcagacgtggcctaccataactccctgcatgcagccgacgtgttgcaatctacccacgtgttacttgcaacccctgcactggatgctgtgttcactgatcttgagattctggccgcattgtttgccgcagccattcatgatgttgaccatcctggtgtgtccaatcagtttctcatcaacaccaattctgagcttgccttgatgtacaatgacgagtctgtgttagagaatcaccaccttgctgtgggattcaaattactccaagaggataactgtgacattttccaaaatctctcaaagaggcagagacagtccctgcggaaaatggtgatcgacatggtccttgctaccgacatgagtaagcacatgacactactagctgatcttaagaccatggtggagacgaaaaaggtgacttcttctggagtgctcttgctagataattactctgaccgaattcaagttctgcggaacatggtgcactgcgccgatttgtccaatcctaccaaacccctggagctttacaggcagtggacagatagaattatggccgaattctttcagcagggtgatcgggagcgggagcgggggatggaaatttcccccatgtgcgacaaacatactgcatctgtggagaaaagccaggtcggctttatcgattatatcgtacatcccttgtgggaaacctgggccgatctcgtccatccagacgcacaggaaatcctggataccctcgaagacaaccgcgactggtactattcagcaatcagacagtctccgtcacctcctcccgaggaggagtctcgcggccccggccacccacccctgcccgacaaattccagtttgaacttactttggaagaagaagaggaggaggaaatcagcatggcacagatcccctgtacagcacaagaagccctcacagcccagggtctaagcggcgtggaggaggccctggacgctacaatcgcctgggaggcttctccagcgcaagaaagcctcgaagtcatggcccaggaggccagccttgaggctgagctcgaggctgtgtatttgacccaacaggcccagtccaccggctcagcccccgtcgccccagatgagttttccagcagagaagaattcgtggtggccgtgtcacattctagcccctccgctttggctctgcagagtccactgctgcccgcttggcggaccctgagtgtgagcgagcacgcgcccggactgccaggccttccttctactgctgctgaagtggaggcacagagagaacaccaggccgccaagcgtgcctgcagtgcttgcgcaggaacgttcggcgaagacacctctgccctacccgcacccggcggcggggggagcgggggcgatcccacctag

SEQ ID NO: 199304 - DNA, 309 bp, Artificial Sequence
  Description of Artificial Sequence: Synthetic coding sequence
atggtggagaccaagaaggtgaccagcagcggcgtgctgctgctggataattatagtgataggatccaggtgctgcgtaacatggttcactgcgctgacctgtcaaatccaaccaagccactagagttgtataggcagtggacggataggatcatggcagaattctttcagcagggtgatagagagagagaacgcggcatggaaatcagccccatgtgtgacaagcatacagcctcggtggagaagtcgcaggttggattcatcgattatattgttcaccccctgtgggaaacgtgggccgacctctag

SEQ ID NO: 199305 - DNA, 2478 bp, Artificial Sequence
  Description of Artificial Sequence: Synthetic coding sequence
atgcggagcggcgccgccccccgggcccggccccggccccccgcccttgccctgccgccaaccggcccagagtccctgactcacttcccatttagcgacgaggacacccgtaggcatcctccgggtcgatcagtatcctttgaggcggagaatgggcctactcctagccccgggcgaagtcctctcgactcccaggcctcacccggattggtgctacacgccggggccgcgacttcccagcggagggagagctttctctatcggtccgactccgactacgatatgtcgcctaaaactatgagtaggaactcgtctgtgacgagcgaggctcacgcggaggacctcattgttactccttttgcccaggtgctggcatccctgcgttcggtccgttccaatttctctctgctaacgaacgtacctgtgccatccaacaagaggagtccactcggggggccaacccctgtatgtaaggccacgctgtctgaggagacttgtcagcagctggctcgagaaaccctggaggagttggactggtgcctcgaacagctagaaaccatgcagacatataggtctgtctctgagatggcctcacacaaattcaagaggatgctgaaccgggaacttacacacttaagtgagatgagtcgcagtggcaaccaggtgagcgaatatatttccacaaccttcctggacaagcaaaatgaggtagagatcccttcccctaccatgaaagagagggaaaagcagcaggccccacgcccacgcccatctcagcctcccccacctcctgtaccccatctgcagccaatgagtcaaataaccgggctgaaaaaactaatgcatagtaacagtctaaataacagcaacatcccccgcttcggcgtgaagactgatcaggaggagttgctggcacaagaacttgagaatttaaacaagtggggtctgaacatattctgtgtgtcggattacgcaggcggcaggagcctgacctgcataatgtacatgattttccaggagagggacctgctgaagaaattccgaattcctgtggataccatggtcacgtacatgctgaccctagaggaccattaccacgccgacgtggcctaccataatagtcttcatgctgctgatgttttacagtcgactcatgtattattggccaccccagccctcgacgccgttttcacagatcttgaaattctggcagcgctatttgctgcagctatacacgacgtggatcacccgggtgtgagcaaccagtttttgatcaataccaacagtgagctcgctctaatgtacaatgacgaatctgtgctggaaaaccaccatctggccgtgggctttaaactgctccaagaagacaattgtgatatctttcagaatctctctaagaggcagcgccaatccctacggaaaatggtcatcgatatggttctcgccacagacatgtctaaacacatgacgcttctagccgacttaaagactatggtggaaacaaaaaaagtgacctccagcggggtcctgctgctggacaattactccgatagaattcaagtcctgcgaaacatggtccattgcgcagacctgtccaacccaaccaagccactcgaactgtatcgacaatggaccgatagaatcatggccgaattcttccagcagggtgatcgggaacgtgaacggggcatggaaatctcgcctatgtgcgataagcacactgccagtgtagagaaatcccaggtggggttcatagactatatcgtacatccgctctgggaaacctgggccgatcttgttcatcccgacgctcaggaaatactggatacactagaagataatcgggattggtattactcagctataagacagtctcccagtcccccgcccgaggaggagagcaggggcccaggacatccgcctttgccggataaattccagttcgagcttaccctggaagaggaagaggaagaggagatttccatggcccagatcccctgcaccgctcaagaggcactgacagcccagggactgtcaggcgtggaagaggctttggacgcaactattgcctgggaggcttcgccagcccaggagtctctagaagtcatggctcaggaagcctctctggaagccgaactggaagctgtatatctgacccagcaggcccagagcacaggctcggctcctgtggctcctgatgaattcagcagtagagaggaatttgtcgtagcggtgtctcatagctccccaagcgcactggcactgcagtccccgctgctgccagcttggcgaacgttgtcagtctccgagcacgcccccggtctcccggggctcccatcaacagccgccgaagtggaagcccagagagaacaccaagctgctaagagggcctgttcagcatgcgcaggcaccttcggtgaggacaccagtgcgttaccggccccgggcgggggaggctctggtggagatcctacttag

SEQ ID NO: 199306 - DNA, 2211 bp, Artificial Sequence
  Description of Artificial Sequence: Synthetic coding sequence
atgaagaagagccggagcgtgatgaccgtgatggccgacgacaacgtcaaagattatttcgagtgctctctgtccaagagttacagctcctcctcaaatactcttggcatcgatctttggcgcgggaggagatgctgttcagggaatcttcaactgccgccattgtctcagcggcagtctgagcgcgcccggactccagagggtgacggcatctctaggccgaccaccctgcccttgaccacacttccatctattgctattaccaccgttagccaggaatgttttgatgtcgagaatggacccagtccggggaggtcgcctctcgacccacaggcctcctcttcagccggactagttctgcacgctactttcccggggcattcacagaggagagagtctttcctgtacagatcagactctgactacgaccttagtccaaaggccatgagccgcaactcatctttgcccagcgaacagcacggcgatgaccttatcgtgactcccttcgcacaagtcctggctagtctacgctccgtacgcaacaactttaccatcctgacaaatttgcatggcacttctaataaaaggtcacccgccgcttcacagccacctgtctcacgggtgaacccacaggaagagtcgtatcaaaaactggcgatggagaccctggaggaattagactggtgccttgaccagctcgaaaccatccagacctaccggtctgtgtcagagatggcctccaataaattcaaacggatgctcaatcgcgagctgacccacctctctgaaatgtctagaagcggcaaccaggtctccgaatacatttccaatacatttctggataagcagaacgacgttgaaattccaagccccacgcagaaagaccgggaaaaaaagaaaaaacagcagcttatgacacaaattagtggcgttaaaaaattgatgcactcgagttcactcaacaatacttctattagtcgatttggtgtgaacactgagaacgaagatcacctggctaaggagttggaggatctgaacaagtggggattaaacattttcaacgtggcagggtacagtcacaatcgtcccctaacttgtattatgtatgcaatctttcaagaacgtgacctactcaagacctttcgaattagctccgacacattcataacctacatgatgactctggaggaccattaccactccgacgtggcataccacaattctctgcacgcggcagatgtggcccagagcacacacgtcctcttgtctactcctgctctggatgctgtgtttacagacctcgaaatcctggccgcaatttttgccgccgccatccacgacgttgaccatcctggtgtttctaaccagtttctgattaacactaatagtgagctggcactgatgtataatgatgagtcggtgcttgaaaaccaccatctagcagtgggttttaaattgctccaggaagaacactgcgatatctttatgaacctgaccaaaaagcaaaggcagacattgcggaaaatggtgatagacatggtcctggcaaccgatatgtccaaacatatgagcctgttagctgacctgaagactatggtcgaaactaaaaaagtcacctcatcgggggtcttgctactagataactacacggaccgtattcaggtgctgcgtaatatggtgcattgcgctgatttgagtaacccaactaaatcgctagagctctatcgacagtggaccgatcgcattatggaagagttcttccaacaaggagacaaggaaagagagcgggggatggagatcagccccatgtgcgataagcataccgcgagcgtggagaagtctcaagtgggcttcatcgactatatcgtgcaccctctgtgggaaacttgggctgatcttgtccagccggacgcccaggatattctcgacacgttggaagacaacaggaattggtaccagagtatgattccacagtctccctcgcctccacttgatgagcagaaccgggattgccagggcctgatggaaaaattccagtttgagttaaccctagacgaggaagactccgaaggccccgaaaaggagggtgagggacatagctatttctcaagcaccaagactctgtgcgtgatcgacccggaaaacagggacagcctgggggagaccgacatcgatatagccacggaggacaaatctcccgtcgacacatag

SEQ ID NO: 199307 - DNA, 2211 bp, Artificial Sequence
  Description of Artificial Sequence: Synthetic coding sequence
atgaagaagagccggagcgtgatgaccgtgatggccgacgacaacgtcaaggattatttcgaatgttccctgagcaaaagctattctagtagcagtaataccctcgggatcgacctgtggcggggtcgcaggtgctgtagcggtaaccttcagctgccccccttaagccaacggcagtctgagagggcaagaacgcccgagggcgatgggattagccgccctaccacactccctctcactactctgcctagcattgccataaccacggtttctcaagaatgtttcgacgtggagaacggtccatcccccgggaggtctccactcgatccccaagcttcatcttcagcaggccttgtattgcatgccaccttcccaggacattctcagagacgggagagctttttgtaccgctccgacagcgattatgatctgtccccgaaggcaatgagcagaaacagttctctcccctccgagcaacacggggatgatttaattgtgaccccttttgcacaggtccttgcttctttgcgcagcgtccggaacaatttcacgatcctcactaatttacacggaacctctaataaaaggtctccagctgccagccagccaccggttagcagagtgaatccccaggaagaaagctaccagaagctcgctatggagacccttgaggagctcgattggtgccttgatcagctggagactatccagacctatcgcagtgtgagcgaaatggcaagtaacaagttcaaacgcatgctgaaccgcgagctcacccacctcagcgaaatgtcacgctctggtaaccaggtcagcgagtatatctccaacacttttttagacaagcaaaacgacgtggaaatccctagtcctactcagaaggacagggaaaagaaaaaaaaacagcagctgatgacacagatcagcggggttaaaaaactcatgcattcctcatcattgaacaatacatcaatctcacgctttggggtcaatacagagaacgaagatcatctggccaaggaattggaggatctcaataagtggggactgaacatctttaatgtcgcaggatatagccataacagacctctgacctgtataatgtacgccatcttccaggaacgggacctgctgaaaacatttcgcatttcttcggacacctttattacgtacatgatgacgctcgaggaccattatcatagcgatgtggcctatcataactccttacacgccgctgatgtcgcacagtccacccatgtgttgctgtcgactccggcactagacgcggtcttcacggacttggaaatacttgcggctattttcgccgctgccattcatgacgtggaccatcctggggtctccaatcagtttctcatcaacaccaattctgagctcgctcttatgtataacgacgaaagtgtactggaaaatcaccacttagccgttggattcaagcttctgcaggaagagcactgtgacatttttatgaacctgacgaagaagcagaggcagacgctccgcaagatggtcattgacatggtgctggcaaccgatatgtcaaaacacatgtcccttctcgcagacttgaagacaatggtcgagactaagaaggtaaccagttcaggtgtcctgttactggacaattacaccgatcgcatccaggtgttgaggaatatggtccactgtgcagacctgagcaatccaacaaagagcctcgagctctatcgccaatggacagaccgaatcatggaggagttcttccagcagggcgataaagaacgtgaaagggggatggagattagccctatgtgcgacaagcatacagcctccgtggaaaagagccaggtcggctttatcgattatattgtgcatcctctgtgggaaacgtgggctgatttggtgcagccagacgcccaggacatactggatactctggaagataacagaaactggtaccaaagcatgatcccacagagcccctctcccccactggacgaacagaaccgagactgtcagggtcttatggagaagttccagttcgagttgaccttggatgaggaggactcagagggcccagagaaggagggtgagggtcactcctacttctcgtccaccaaaactctgtgtgtgattgacccagagaacagggacagtctgggggagacagatatcgatatagccacggaagacaagtcccccgtagacacgtag

SEQ ID NO: 199308 - DNA, 1695 bp, Artificial Sequence
  Description of Artificial Sequence: Synthetic coding sequence
atgaaggagcacggcggcaccttcagcagcaccggcatcagcggcggtagtggcgactcagccatggactcattgcagccgctacagccaaactatatgccagtgtgcttgtttgcagaagagtcgtaccaaaagttggcaatggaaacactcgaggagttggattggtgccttgatcagctcgagacaatccagacctatagatcagtatcagagatggcatcaaataagtttaagcggatgctcaaccgggagctgacccacttatccgagatgtcacgcagcggtaatcaggtgtccgaatatatttccaatacctttctggacaaacaaaacgacgttgaaatcccaagtcccacccagaaagatagggaaaaaaagaagaagcagcagttgatgacccagatctcaggagtgaaaaagcttatgcattcttccagcttaaataacacaagcatttccaggtttggcgttaatacggagaatgaggatcacctcgccaaggaactggaggacctcaataaatggggccttaatattttcaatgttgctgggtactcccacaaccgtcccctgacgtgcattatgtacgccatctttcaggaacgggacctgctgaagactttcagaatatcgtcagatactttcatcacctacatgatgactttagaagaccattaccactctgacgtggcctaccataattctctacatgccgccgacgtcgcccaatccactcacgtactactatccaccccggccctggacgccgtgttcacggatctcgaaatcctggccgctatctttgccgccgccatacacgatgtggaccacccaggagtgagtaaccaatttctcatcaataccaattcggagcttgcccttatgtacaatgatgagtcagtcttggaaaaccatcacctggcagtcgggttcaagcttttacaggaagaacattgtgacatctttatgaaccttaccaaaaagcagcgccagacactcagaaagatggtcatagacatggtcttggctaccgacatgtctaagcacatgtctctgctcgccgacctgaagactatggtagaaactaaaaaggtcacatcatctggggtattgttgctcgacaactataccgatagaatccaagtactcagaaatatggtccactgcgccgatctctcaaatcccacgaaaagcttggaactgtatcgacagtggactgataggatcatggaagagttttttcaacagggtgataaagagagagaaaggggcatggagatcagccccatgtgcgataagcacaccgcgtcagtggagaaaagccaggtcgggttcatcgattatattgtgcaccccctgtgggagacatgggccgatctggtccagccggacgcacaggatatactggataccctggaagataaccggaactggtaccagagcatgatcccacaaagtccgagcccccctctggatgagcagaatcgcgattgccagggcctgatggaaaaattccagtttgagttaactcttgacgaggaggacagtgaaggccctgaaaaagagggagagggacatagctacttctcatctactaaaaccctgtgcgtgattgatcccgagaaccgggatagtctaggcgaaaccgacattgacatcgccacagaagacaagtcacccgttgatacttag

SEQ ID NO: 199309 - DNA, 2211 bp, Artificial Sequence
  Description of Artificial Sequence: Synthetic coding sequence
atgaagaagagccggagcgtgatgaccgtgatggccgacgacaacgtgaaggattattttgaatgttctctgtctaagagttatagtagctccagcaacacactggggatcgacctctggaggggacgcaggtgttgctcgggtaatctgcagctgcctccattgtcccaaagacaaagtgaaagggcccgaacaccggagggcgacggcattagccgcccaacaacgttgccgcttaccacccttcctagtatagctatcaccaccgtgtcacaagaatgcttcgatgtggaaaatgggcccagcccaggccgaagccctctcgacccgcaggcatcttctagcgcgggcctggtcctgcatgccacctttccgggtcattcccagcgcagggagtcctttctgtatcgaagtgattcagattatgatctttcccccaaagccatgagtaggaattcaagcctgccctcagaacaacacggagatgatctcattgtgacaccttttgcccaagtgttggcctcactgagatccgtgaggaacaacttcacaatactaactaatctgcacggtacgtcaaataaacgctcccctgccgctagccagcctcctgtgagccgggtgaatccacaggaagaatcctaccagaagctggctatggaaacactggaagaattggactggtgcctggaccagttggaaaccattcagacatacaggtccgtgagcgagatggcgtcgaacaaattcaagcggatgttaaaccgggagctcacacacctctctgagatgagtaggtccggtaaccaggtttctgagtatattagcaatacgtttctagataaacagaacgacgttgagataccatccccaactcaaaaggatagagagaagaagaaaaaacagcaactgatgacccaaatcagcggtgtgaaaaagctgatgcatagctcttccctgaacaatacctctatttctagattcggagtgaataccgagaatgaagatcacctagccaaggaactggaagacctgaataagtggggactcaatatttttaacgtggctggctacagccacaataggccactgacatgtatcatgtatgccatcttccaggagcgcgacctcttgaagaccttccgaatttcttctgacacatttatcacctatatgatgaccctggaagatcactatcatagcgatgtggcttaccacaattccctgcacgccgctgacgtggcacagtctactcatgtgctactcagtactcctgctcttgatgccgtattcacagatctggagattttggccgccatcttcgccgccgccattcatgatgtagaccaccccggcgtttccaatcagttcctgatcaacacaaatagtgaactggcccttatgtataacgacgagtccgtccttgaaaaccaccatctcgccgttggattcaagcttttgcaggaagaacactgcgacatcttcatgaatctgaccaagaagcaaagacagaccttacgaaagatggtgatcgacatggttctggctacagacatgtccaaacacatgagcctgcttgctgacctaaagaccatggttgaaaccaagaaagttacgtccagtggcgtgcttcttcttgacaactacaccgaccgcatccaggtgctgcgaaacatggtgcattgcgcggatttgagcaaccccacaaagtcgctcgaactctatcgacagtggactgacagaatcatggaagaattttttcaacagggggacaaggaaagggaaagaggaatggaaatctctccaatgtgtgacaaacatacggcctccgtggagaagtcacaggtgggattcatcgattacattgtccacccgctctgggaaacctgggccgatctagtccagcccgacgcacaggatattcttgatacacttgaggacaaccgtaattggtaccagtcaatgataccacaatcaccatctcctcctctagatgaacagaaccgagactgccagggattgatggagaaatttcagttcgagctaaccctggacgaagaagattccgagggtcctgagaaggaaggggagggacactcctactttagctcaacgaaaactctgtgtgtgatcgacccagaaaacagagatagcctgggagaaaccgatatcgatattgcaaccgaggacaaaagccctgtcgatacctag

SEQ ID NO: 199310 - DNA, 2166 bp, Artificial Sequence
  Description of Artificial Sequence: Synthetic coding sequence
atgaccgccaaggacagcagcaaggagctgaccgccagcgagcccgaggtctgcatcaagaccttcaaggagcagatgcatctggaattggaactgcctcgactgccaggtaacaggcccacatctccgaagatttccccgagatctagcccccgcaatagtccctgcttcttccgcaagctgttggttaacaaatccatccgccaacggcggagattcactgttgctcatacgtgttttgacgtggaaaacggaccaagtccaggcaggtcccccctcgatccgcaggcatcaagcagcgccggtttggtactgcatgctacttttcctggccacagtcagcggcgggagtcatttctctataggtccgattctgattatgatctatcccctaaggctatgtcaaggaactccagtttgccaagcgagcagcacggtgatgacctgattgtgaccccatttgcgcaggtcctggcctcacttcgttcagtaaggaataatttcacgatcctgactaatctgcacggcacttctaacaaaagaagcccagcagccagccagcctcctgtaagtcgagtgaatccccaggaggagagctaccaaaagctcgcgatggagactttggaggagctcgattggtgcctagatcagctggagacgatccaaacttacagaagtgtcagcgaaatggcctctaacaagttcaagcgtatgctcaatagggaacttacccatctgtccgaaatgagtagatcggggaaccaggtgtcggagtatatctccaatacatttcttgataaacaaaatgacgtggaaattccctccccgacccaaaaagacagggagaagaagaaaaagcaacaactgatgacccagatcagtggggttaagaagctaatgcacagcagcagcctgaataacacctccatctcacggtttggtgtgaacacagagaacgaggatcacctggccaaagagctcgaagacctaaacaaatgggggcttaacatctttaacgtcgctggatattcccataataggcccctgacgtgcattatgtacgcgatcttccaggaaagagacttactgaagacgttccggatttccagcgacaccttcataacatacatgatgaccctggaagaccattaccactctgatgtcgcttaccacaacagtctgcacgctgccgacgtcgcacagtccactcacgtgctgttgtccaccccagcactagatgccgtttttacagatcttgagatcctggccgctatctttgccgccgccatacatgatgtggatcatcccggtgtctccaatcagtttctgatcaacacaaacagcgagttggctctaatgtacaatgatgagtctgtgctggagaaccatcatctcgccgtgggatttaagcttcttcaggaagaacactgcgacattttcatgaatctgacaaagaagcagcggcaaactctgcgcaaaatggtaatcgacatggtgcttgcgaccgacatgagcaaacatatgagtctgctcgccgatctcaaaactatggtggagaccaagaaagttacaagtagtggtgttttgttgctcgataattacacggacaggatccaagtattacggaacatggtgcactgcgcagacttgagcaacccaactaagagtctggagctgtacagacagtggactgatagaataatggaagaattcttccagcagggtgataaggagcgcgaaagggggatggagatcagtcctatgtgcgataagcataccgcgtctgtcgagaagtctcaagtgggctttatcgactatatagtccaccccctgtgggagacctgggccgacctcgtgcagcccgacgctcaggatatcttggatacgctggaggacaaccggaactggtaccagtctatgatcccccagtctccgtccccacctctggatgaacaaaaccgtgattgtcaggggctgatggaaaagttccagtttgaactcaccctggacgaggaggactcagaggggccagagaaggagggagaaggccacagttacttcagcagcactaaaacactgtgcgtcatcgatccggagaatcgggacagtctgggcgagacagacatcgacatcgccaccgaagacaagtcaccagtcgacacgtag

SEQ ID NO: 199311 - DNA, 2043 bp, Artificial Sequence
  Description of Artificial Sequence: Synthetic coding sequence
atgcagggcccccccgcccccgcccccgtgcccggccccggcagccctagaggatctccccggggttcaccaggcctcttccgcaaattacttgtgaatcagtctataaggctgcagaggagattcacagttgcccaccccttgtgtttcgatctcgaaaacggcctttcttgtggaaggcgagctctcgatccccagtcgtcacccggactaggtcggattatgcaggccccagtgcctcacagccaacgtcgggagtcctttctctaccggagcgattccgactatgagctgagccccaaggccatgagtcggaactcgagtgtggcttctgatttgcatggagaagacatgatcgtcaccccgttcgcccaggtcctggcttctctgcgtactgtgcgatcgaatgtggctgctctagccaggcaacagtgtctgggagcagccaaacagggacctgtggggaacccttcaagttcaaatcagcttccaccggctgaagacaccggacagaaacttgcgctcgaaacactggatgagctcgattggtgcctggaccagttggagaccctgcagaccaggcactctgttggagagatggcttccaataaattcaaacgcatactgaacagggagctgacacatctgagtgagacaagtagatcagggaaccaggtgtccgagtatatatctaggaccttcttggatcagcagactgaagtcgagctgcctaaggtgacagccgaggaggccccccaacctatgtcgcgcatatcaggacttcatggcctctgtcacagcgccagtctctcttcagctactgtgccacgattcggagttcagacagatcaggaggaacagttagccaaagaacttgaggacactaataagtggggcctggacgtctttaaagtggccgaactcagcggaaatagacctcttaccgctattatcttttcgattttccaggaacgtgatctcttaaaaacatttcaaattcctgctgacaccctcgccacatatctcctgatgctcgaggggcactaccatgccaatgtggcataccacaacagcttacacgcagccgacgtagctcaaagcacacatgtactgctagctacacctgccttggaggctgtttttacggacctggagatcttggctgctctgtttgcgagcgctatacacgatgtggatcaccctggtgtttccaatcagttccttatcaatacaaactcggaacttgctctcatgtataatgatgccagtgtgctcgaaaatcatcatcttgctgttgggtttaaactactgcaagccgaaaactgcgacattttccagaatctgtcagccaaacagaggctctcacttcgaagaatggtcatcgacatggttctggccaccgacatgtcaaaacatatgaacttactggccgatttgaaaacaatggtagagaccaaaaaagtcacttctctgggcgtccttctgctggataactacagcgatagaatccaggtgctgcagaatctcgttcactgcgccgatttgtcaaacccgactaaacccttacctctgtacaggcagtggacagatagaattatggctgagttctttcagcagggtgatagagaacgagagtctggactagatatcagccccatgtgtgataagcatacagccagcgtggagaaaagccaagtaggcttcattgattacatcgcacatcccctgtgggagacctgggcagatctggtgcatccggatgctcaggacctgctcgacactttggaagacaacagggagtggtaccagtctaaaataccaagaagtccaagtgacctcacaaaccctgagagggatgggcccgacagattccaattcgagcttactcttgaagaagccgaggaagaggatgaggaagaagaggaagagggagaagaaaccgcgctggcaaaagaggcgcttgagctaccagacacagagttgctgtctcccgaggcgggaccagatccaggagaccttcccctggacaatcagcgaacctag

SEQ ID NO: 199312 - DNA, 1281 bp, Artificial Sequence
  Description of Artificial Sequence: Synthetic coding sequence
atggccagcaacaagttcaagcggatcctgaaccgggagctgacccacctatccgaaacttcaagatcaggcaatcaggtgtccgaatacatcagcagaacattcttagatcagcagacagaagtggagctccctaaagtaacagcggaggaggccccccagccaatgtcccgtattagtggacttcatggactctgccactcagcctcgctgagctctgctacggttccaagatttggagttcaaaccgatcaagaagagcagcttgccaaggaattggaggacaccaacaaatggggtttagacgtgtttaaggtcgcagaactctccggaaatcggcctctgactgcaatcatcttcagtatctttcaggccgtgttcaccgacctcgaaatcctggccgccctttttgcctctgctatacacgacgtagaccatcctggggtcagtaatcagtttctgattaacactaacagcgagctcgccctcatgtacaatgacgcaagtgtgttagagaaccaccacctcgccgtgggatttaaactgttacaggccgaaaattgcgatatttttcagaatctgtccgctaagcaaaggctttccctgaggagaatggtaatcgatatggttctggccactgacatgagcaagcacatgaacctgctggctgaccttaaaaccatggtggagactaagaaggtgacgtcattaggcgtactcctgttggacaattactccgatagaatccaggtacttcagaatctggtacattgtgccgatcttagcaacccaaccaaaccattacctctttaccgacaatggacagatcgaattatggctgagtttttccagcagggcgatcgagagcgcgaaagtggactggatatatctcctatgtgcgataaacacactgctagcgtcgaaaagagccaagtggggttcatcgactacatcgcccatcctttgtgggagacttgggccgacctcgtacaccctgatgctcaagacttacttgataccctggaggataaccgagagtggtatcagtctaagatccccagatccccctccgatctgactaacccagagcgcgacggcccggaccggttccaatttgaactcactctcgaggaggcggaggaagaggatgaggaagaagaggaagaaggagaagagacagcactggctaaggaggccctggagctgcccgacacggagctgttgtccccagaggccggaccggatccaggagatttgccattggacaatcaacggacatag

SEQ ID NO: 199313 - DNA, 2139 bp, Artificial Sequence
  Description of Artificial Sequence: Synthetic coding sequence
atggagaacctgggcgtgggcgagggcgccgaggcctgcagccggctgtcccgcagcaggggccggcactcaatgactcgcgctccaaagcacctgtggaggcagcccagacgtcccatacgcattcaacagaggttctatagcgatcccgacaagtctgcagggtgcagggaaagggaccttagtccgagacctgagctgcgaaagtcaaggctgtcctggcctgtctcgagctgcaggcgttttgacctcgaaaatgggctcagctgtggccgtagggccctcgacccacagagctcgccgggactaggtaggattatgcaggctccggtgccacattcccagcgcagggaatctttcctctacagatccgactctgattacgagctgtcacctaaagcaatgtcacggaacagttctgtagcgtcagacctgcacggggaggacatgatagtgacgcccttcgcccaggttttagcctcactgagaactgttcggtcaaacgttgccgcgttggcgagacagcagtgcctcggggctgccaagcaggggcctgtagggaatccctcctcttcaaatcagctccctcctgccgaagacacaggacagaaactggctctcgagactctcgacgagttggattggtgcctggaccagctggagaccctgcagaccaggcattcagtgggagaaatggcctccaacaagtttaagagaatactcaatcgggagttgacccatctgtctgagacatcaaggtcaggtaaccaggtgtccgagtatatctctagaacctttctggaccaacaaactgaggtggagttgcccaaagtaactgccgaagaggcaccccaaccaatgagccgaatttctggcttacacgggctgtgtcacagtgcttctttgtcgtcggcaacggtccctagattcggcgttcagactgatcaagaggagcagttagccaaggaacttgaagataccaataaatggggtctggatgttttcaaagtggccgagttatctgggaaccgaccactcaccgccatcattttcagtattttccaggaacgcgacctgctgaagacctttcagatccctgcagatacgctggccacctacctacttatgctcgaaggacattaccacgctaacgtcgcataccacaatagcttgcatgctgccgatgtggctcaatcaacacacgtgttgctggcaacgccagcgttggaagccgtgttcactgatctggagattctggctgccctgtttgcaagtgcaattcatgatgttgaccaccctggggtgtcgaatcaatttctgattaacacaaactctgaattggcactgatgtacaatgatgcatccgtcctggaaaatcaccatctagctgtgggttttaaactgctacaggcagagaactgcgatatttttcagaacctgtcagccaaacaaaggttgagcctccggcgtatggtgattgatatggttctagctaccgatatgtccaagcatatgaacctgcttgctgatctgaaaactatggttgaaaccaagaaagtgacctctttaggcgttctcctcctagacaactactctgatcggattcaggtgcttcaaaacttggtccattgtgctgacctatccaacccaacaaagcctctcccactgtatcgtcagtggaccgatcgcataatggccgagttcttccagcaaggcgatagggaacgggagagtggcctggacatttccccaatgtgtgataagcacaccgcttctgtagagaagagccaggtgggtttcattgactatatcgcacaccccctctgggagacctgggcagatctggtccacccagacgcccaggatctgctggatactctggaggataatcgtgagtggtatcagtcaaagatccccagaagtccatctgacctgaccaaccctgagcgagatggaccagatcgatttcagttcgaattgacacttgaggaggctgaagaagaggacgaagaggaggaggaggagggcgaagaaaccgcgcttgctaaggaggcgctcgaacttccagatacagaactcctgtccccagaggcaggacctgaccctggggacctccctctagacaaccagcggacctag

SEQ ID NO: 199314 - DNA, 1821 bp, Artificial Sequence
  Description of Artificial Sequence: Synthetic coding sequence
atgcaggcccccgtgccccacagccagcggcgggagagcttcctgtacaggagcgacagcgactatgagttatcgccaaaggccatgtctcggaatagttccgtggcatccgacttgcacggggaagatatgatagttacaccatttgcccaggtgctggcaagccttaggactgtccgttctaatgtagccgctctcgctaggcagcagtgtttaggggctgccaaacaaggccctgtagggaacccttccagcagcaaccagttacctccagcggaggacaccgggcagaagctggccctggaaacgctggacgaattggattggtgcttggatcaattggaaaccctccagacccgtcactcagtgggagaaatggcatccaataagttcaagcggatcctcaacagggagttgacacacttatctgagaccagtcgttccggtaatcaggtgtctgagtacatctcccggacctttctcgaccagcagaccgaagtggaattaccgaaggtgaccgcagaggaagctccgcagcctatgtctaggatctctggtctgcatggcctgtgtcatagcgccagcctgagcagcgctacggtccctcgttttggagtacagacagatcaggaagagcagcttgctaaggaactcgaggacacaaataagtggggacttgatgtttttaaagtcgcagagctgagtggcaacagaccgctcaccgcaattattttttcaatcttccaggagcgggaccttctgaaaactttccagattcccgcagatactctggctacctatctcctcatgctggaaggacactaccacgctaatgtggcctatcacaacagcctgcacgccgccgatgtcgctcagagtacacatgtcctgcttgctacccccgctctggaagcggtttttactgatctggagatattggccgccctgttcgcatctgcaatacacgacgtcgaccatcctggcgttagcaatcaatttttaatcaacacaaactctgagctggccttaatgtacaacgacgctagcgtcctggagaaccatcacctggccgtgggcttcaagttgcttcaggccgagaattgtgacatattccagaacctgtccgcgaaacaaagacttagcctgcggcgcatggtgattgacatggtattagcgaccgatatgtccaagcatatgaacttactggccgatctgaagacaatggtcgagacaaaaaaggtgacgtccttaggggtacttttgctcgataactattctgaccgtatccaggttctacagaacttggtgcactgtgctgacctgtccaaccctacaaaaccgctgccactgtaccgccagtggaccgatcggattatggcagagttttttcagcagggggacagagagcgtgagtctggactagacatttctcccatgtgcgataagcatacagcttcggtggaaaagagtcaagtgggtttcatcgactatatcgctcaccccctgtgggagacatgggccgacctagtgcaccccgatgctcaggacctccttgatactctggaagataaccgcgagtggtatcagagcaagatccctcgaagcccgtctgatcttaccaaccccgagagagacggccctgatagattccaatttgagctaactttggaagaggccgaggaggaagacgaggaggaggaggaagagggagaagagactgcactggccaaggaagctctagaattgccagacacagaactgctgtcgccggaggcaggcccagacccaggtgacttgcccctggataatcaacgcacatag

SEQ ID NO: 199315 - DNA, 2376 bp, Artificial Sequence
  Description of Artificial Sequence: Synthetic coding sequence
ggcacccaggccggcctgcggagcggcgcccccagcggccaccggcaactgcttggagttgggcctactctgagtccttcatccaccttttatagattttccacttccggggccgactcctctagcctgtcaccaccccttcctgccctgggcaggacacgggaacaaacactcctgggagcgaggtcacgggggagagttctcctccctgctattcccgacccgtttttgtggaggatggaaaatttgggagtaggagaaggagccgaggcctgcagtcgactgagtagatcaagagggagacattccatgactcgggcacccaaacacctctggaggcagcccagacggcccatcaggatccagcagaggttctacagcgatccggataagtctgcaggctgccgagaacgcgatctgagcccacggcccgagctcagaaaatccagactcagctggccggtgtcttcctgtcgccgatttgatctggagaatggattgagttgtgggagaagagcgttggacccacagagcagccccggactcggccgtatcatgcaagcgcccgtgcctcacagccagcggcgggagtcttttctctaccgctccgattccgactacgaattgtcaccaaaggccatgtctagaaactcctctgtggcatcagatttacatggcgaagatatgatcgtaacaccttttgcccaggtgcttgcaagcctcagaactgtgcggtcaaacgtggctgcgctggcgagacaacagtgcctaggcgctgcaaaacagggtcctgtaggcaatccttcatcaagtaaccaactccctcctgctgaagatacagggcagaagctggcactggagactctggacgaactggattggtgcctcgaccagctcgaaacattgcagaccagacacagcgtgggcgagatggcatcgaataaattcaagcgcattctgaatagggagctcacacacctgagtgagacaagccgtagtggcaaccaggtgagcgagtacatttctcggacatttctcgaccagcagacagaggttgagctgcccaaggtaaccgctgaggaggcaccacaacctatgagcaggattagcgggctccatggcctgtgccactccgcatcactttcaagcgccactgtccctcgcttcggtgtccaaacggaccaagaggagcaactcgccaaagagttggaggacactaacaagtggggtcttgacgtgttcaaagtggcagaactgtctggaaaccggccccttaccgctatcattttcagcatttttcaggagcgcgatctattgaaaacgtttcagattccagccgacaccttggccacataccttctgatgcttgaaggccactaccatgcaaatgttgcctaccacaactctctccatgcagccgacgtggctcagtcgacacacgtcctgctggcaacacccgctctggaggccgtctttactgatttagaaatcctggcagcgctgtttgccagcgccattcatgatgtggaccatcccggcgtctccaaccagtttctcataaacaccaattccgaactggctctgatgtacaatgatgcgagcgttttggagaaccatcatttggccgtcggctttaagctgctgcaggcagagaattgcgatattttccaaaatctctcagctaagcagcgcctttcgttaaggcgcatggtgatcgatatggtgctggctactgatatgagtaaacatatgaatctcctggcagatctcaaaactatggtcgaaacaaaaaaggtgaccagcctgggcgtgctgctcctcgataattactccgataggattcaggtgctgcaaaatttggtccattgcgctgatctgtctaacccgactaaacctttaccactgtatcggcaatggacggatagaatcatggccgagttctttcagcagggtgaccgggaacgggagagcggcctggatattagcccaatgtgcgataaacataccgcttcggttgaaaaatcgcaggtgggattcatcgactatattgcacaccccttgtgggagacatgggctgatctggtccatccagacgcccaggatctcctcgatacattggaagataatcgcgagtggtatcaaagcaaaatccccaggtctccctcagacttgactaatcctgagcgcgatggtcctgatcggtttcagttcgagctgactttggaagaggccgaggaagaggacgaggaagaggaagaggagggcgaggaaacggcattagctaaggaagctctggaattgcccgatactgagctgctgtcaccagaagccggcccagacccaggcgatttaccactggataaccagcgcacatag

SEQ ID NO: 199316 - DNA, 2103 bp, Artificial Sequence
  Description of Artificial Sequence: Synthetic coding sequence
gccgtgcagaagcggagccgggccgccggcgcccggagcagcctgcacgcagtgcttgccatgcagggtcctccagctcccgctccagtgcccgggcctggttcaccgcggggatcgccccgcgggagcccaggtctattccggaagctcctcgtgaaccagtctatccgcctacagaggaggtttacagtggctcatcctctttgtttcgatctggagaatggactcagttgcggcagaagagccctagacccccagtcatcacctggcctcggccggatcatgcaggctcctgtgccgcattctcaacggcgggaatctttcctgtaccgctccgactctgattacgagctgtccccaaaagcaatgtccagaaattcctcagtcgcatctgacctgcacggagaggacatgatcgtgaccccgtttgcgcaagtactggcatctctgagaactgtgcggagcaacgtcgctgcgttggctaggcagcagtgcctcggagctgccaagcaggggccggtgggcaatccctctagcagcaaccagctcccaccagccgaggacactggccaaaagcttgcactggagactctggatgagctcgattggtgcttggatcagctggaaacattgcagactaggcattccgttggagaaatggcctccaacaagttcaaacgaattctaaacagggagctgacacatctttcagaaaccagtcgtagcggcaatcaggtaagtgagtatatttcaaggacctttttagatcagcagaccgaggtcgagctgcccaaggtcaccgctgaagaggctccacagcctatgagtcggatatcgggcctccatggactgtgccattcagctagtctctcatcggcaacggtaccaaggtttggggtgcagactgaccaggaggaacaactcgccaaagaactggaggacaccaacaaatggggcttggatgtgtttaaggtggctgaactatccggcaaccggccactgactgctatcatcttctcaattttccaggagcgcgacctcctcaagacattccagattccggccgataccctggctacctacctgctaatgctcgaaggacattaccacgccaacgtggcctaccacaactcactgcacgcagcagacgtggcccagtctactcatgtcttgctcgcgacacccgccctggaggcagtattcaccgacctggagattctcgccgctctcttcgcctccgccattcatgatgttgaccatccgggagtaagcaaccagttccttattaacaccaactctgagctcgctctgatgtacaacgatgcaagcgtcttagagaatcatcacctcgctgttggatttaagctgctgcaggccgaaaactgcgacatttttcagaacctttccgcaaaacagcggctatcactccgcagaatggtgatcgacatggtcctggccacggatatgagtaaacatatgaacttgctcgctgatctcaaaacaatggtggagacaaagaaggtgacaagcctcggcgtgctgctgctcgacaactacagcgatcgaattcaggtcttacagaatttagtgcattgcgctgatctgtccaaccccacgaagcctctccctctctatcgacagtggacagaccggataatggccgagttctttcagcagggcgatcgggaaagggaatctggattagatatctctcccatgtgtgataaacacacagcttcggtggagaagagtcaagtgggctttatcgactatatagcacatcctttatgggagacgtgggctgatctggtgcatccagacgcccaagatctactggataccctggaggataatagggaatggtatcagagtaaaatccccagaagtccatccgatctgaccaaccccgagcgcgacgggcctgatcgattccagtttgagctgaccctggaggaagccgaggaagaagacgaagaagaagaggaagagggcgaagaaactgctctggcaaaggaagctctcgagctccccgacacagaactcctttcaccagaagctggtccagaccctggtgacttgccgttagacaatcagcgcacatag

SEQ ID NO: 199317 - DNA, 1446 bp, Artificial Sequence
  Description of Artificial Sequence: Synthetic coding sequence
atggccagcaacaagttcaagcggatcctgaaccgggagctgacccacctctcggaaacaagccggtcagggaaccaggtcagcgagtacatttcccggacctttttagaccagcagaccgaggtggagctaccgaaagtgaccgccgaggaggccccccagcctatgagccggatctcagggcttcatgggctatgccacagtgcctctctgagtagcgccaccgtgcccaggtttggcgtacaaaccgatcaggaggaacagctggccaaggagcttgaggataccaataaatgggggctagacgtgttcaaggtggccgaactgtcagggaaccgacctttgacagcaatcattttcagcattttccaagaacgcgacctcttgaagacatttcagattcccgccgataccttggccacgtacttactgatgctggagggacactaccacgctaatgttgcctatcacaattccctgcatgccgcagatgtggctcagagcactcatgttctgcttgccacacccgccctggaggctgtatttactgatttggagatcctggccgcgctcttcgcatctgctatccatgatgtggaccatcccggcgtgtccaatcaattccttattaacactaatagcgagcttgccctgatgtacaacgacgcttcagtcctggagaatcatcacttggccgtagggttcaagctgttgcaggccgagaactgcgacatcttccagaatcttagtgctaagcagcgcctttccttgagacggatggtcatagatatggtccttgctaccgatatgagcaaacacatgaatctgctggccgatctgaagactatggtagagactaaaaaggttacttctctgggggttctcctgctcgacaactattccgacagaatccaagtgctgcaaaatttagttcattgtgccgacctgtcaaaccccaccaagcctcttcccctgtaccgacagtggacggatcgaatcatggcggaattttttcagcagggtgatcgagagcgcgagtctggtttagacataagtcctatgtgcgataaacacaccgcaagtgtggaaaagagtcaggttggctttattgactacatagcccaccccctgtgggagacctgggccgacctagttcaccctgacgctcaagatctcctagacacactggaagacaaccgcgaatggtatcagtccaaaataccccgaagcccctcagatctaaccaaccccgaacgggacggcccggatcgatttcagttcgagctcacactggaggaggccgaagaagaggacgaggaggaggaggaggaaggggaggaaaccgctctggcaaaagaggccctagagttgccagacacagaactcctgagcccagaagccgggccagaccccggcgacctgcctctggacaaccagagaacctag

SEQ ID NO: 199318 - DNA, 2466 bp, Artificial Sequence
  Description of Artificial Sequence: Synthetic coding sequence
atgcagcggtaccggggccggcagaccgtgttcggcgccggcgtgttgggaggggtgagctctgcaccctctttcaatacgcccagtccaaggtcttcccccctcttctacccttctgccccttcagggcaccgccaactgttgggggtgggcccaacccttagtcctagtagcactttctaccggttctccaccagcggcgctgactcctcctccctatcaccccccttgcctgccctggggcgaacaagagagcagaccttgcttggcgcaaggtcaagaggccgggtgttactgcccgctattcccgatccattcttgtggcgtatggagaatctcggagtgggcgaaggagcagaagcctgctcgagattgtccagatctagggggaggcattctatgactagagcccccaagcacctgtggagacagccacggcgcccaattagaattcagcagcgattctacagcgacccggataaaagtgcaggttgtcgagagagagatctctccccgaggcccgaattaagaaagtcacggttgtcttggcccgtgtcttcttgtcgccgattcgacctggagaacggcctgagctgtggcagacgcgctctggacccccagagcagcccaggactgggacgcatcatgcaagccccagtgccacattctcagaggcgagagagctttctgtataggtcagactctgactacgagctgagccctaaggccatgagtcggaacagttccgttgccagcgatttgcacggggaagatatgatcgttacacccttcgctcaggttctggcatccctgaggaccgtgagaagcaatgtcgctgccctggccagacagcagtgcctcggggcggctaaacaaggccccgtcggcaacccttcttcttcgaatcaacttcctcccgcagaagataccggacagaagctggcactggaaactctggacgagttggattggtgcttagatcagctggaaaccctccaaactcgtcacagcgtgggcgagatggcatctaacaagtttaaacgaattctgaaccgcgaactgactcacctgagtgaaactagccgatctgggaaccaggtgtccgagtacatttctcggacattcctagaccagcagaccgaagtggagcttcctaaggttactgccgaggaggctcctcagcctatgtcgaggatcagcggactgcatggtctttgccacagtgcctcactgagttcagccaccgtgccccgtttcggcgttcagacagatcaagaggagcaattagctaaagaactggaggacacaaacaagtgggggttagatgtgttcaaggttgccgagctctcaggcaacagaccactcaccgccatcattttttccatttttcaggagcgcgacctgcttaagacttttcagatccctgctgacaccttagctacctatctccttatgctcgaggggcattaccatgccaatgttgcctaccacaatagccttcatgccgccgacgtcgcacaaagtacccacgtcctccttgcaacacccgctctggaagccgtctttactgatctggagattctggcagcattgttcgcttcagccattcacgacgtggaccatccaggcgtttcaaatcagtttttgatcaatactaactccgagctggcgctgatgtataacgatgccagcgtgctggaaaatcaccacctggcggttgggtttaagctgctgcaggcagaaaactgcgatatcttccagaatctgtcagccaagcaaaggttatctttgcgtcgcatggttattgacatggtattggcaaccgacatgtctaagcacatgaatctcctagctgatctcaagaccatggtagaaaccaaaaaggtcacttctcttggggtcctgctcctggacaattactcagacaggattcaagtccttcagaacctggtgcactgtgctgacctctcaaatcccactaagcccttaccgctgtacagacaatggacggatcgaataatggccgaattcttccagcagggggatagagagagggagtctggactagacatcagcccgatgtgcgacaaacacacggcatctgtggaaaagtcccaggtcggttttatcgattatatcgcccacccactttgggagacctgggcggatctcgtacatccagatgcccaggacttattggatacattggaggataaccgcgagtggtaccagtctaaaatcccgaggtccccctcagatctgaccaatccggagagggatggacccgatagatttcagtttgagcttaccctggaagaggccgaggaggaagatgaggaagaagaggaagagggagaggagactgccctcgccaaagaggccctggagctcccggacacagaactgctctcacctgaggccggacccgatcctggcgacctgcccctggacaaccaacggacctag

SEQ ID NO: 199319 - DNA, 1557 bp, Artificial Sequence
  Description of Artificial Sequence: Synthetic coding sequence
cccctgcggatccggcccctgctgcccaccgcctaccacctgctgcccacgggacccggtcagagtgcagatagatccgaacagaggggtggtccatgtcctccagctatgccccgctcttcacagtttaaacgcatcctcaatagagagttgacccacctgagtgaaactagtaggtctggtaaccaagttagcgaatatatctctcgaacgttcttggaccaacagaccgaagtggaacttcccaaagtcacggccgaagaggctccccaaccgatgtcaaggatctcagggctgcatggactttgtcatagcgcttcacttagttccgcgactgtcccccggttcggcgtccagaccgatcaggaggaacaactcgccaaggagctggaagacactaacaaatggggtctggatgtgtttaaagtcgcggaactgtctgggaaccgccccttgactgccattatcttctctatctttcaggagagggacctactgaagaccttccagatccccgctgatactcttgctacatatctgctgatgctcgagggacactatcatgctaacgtggcttatcacaattctttacacgctgctgacgtcgcccagtctacacacgttttattggctacgcccgcccttgaggcggtgtttaccgatctggaaatcctggccgcactcttcgcaagcgcaattcatgacgttgatcaccccggcgtcagtaaccagttcctcataaatacaaacagtgaactggccctgatgtacaatgatgcctccgtgctcgaaaaccatcatctggcagtggggtttaagctgctccaggcagaaaactgtgatattttccaaaatctgtctgccaaacaaagacttagcttacggcggatggtgatagacatggtgctggctacggacatgtctaaacatatgaacctcttggccgaccttaaaacgatggtggaaacaaagaaagtgacgtctcttggtgtcctcctcctggataattatagtgatagaatccaggtcttgcaaaacctggtgcattgcgctgatctgagcaatcccaccaaacctctgcccctgtataggcaatggaccgacaggattatggctgagttcttccagcaaggagatagagagcgcgaatcgggactggacatcagcccgatgtgtgacaaacatacagcatcagtagagaaaagccaggtcggctttattgattacattgcacatcccctgtgggagacttgggctgacttagtgcacccagatgcacaggatctcttggacactctagaggacaatagagagtggtaccagagcaagattccgcgttcaccgagcgaccttaccaacccggagcgcgacggaccggataggtttcagttcgagctaactctggaagaggccgaagaagaagacgaggaagaggaagaagaaggagaggagacagccttggccaaagaggcgttagagctgcccgacacggagctgctttcaccagaagccgggcccgatccaggcgacctgcctctcgacaaccagcgaacatag

SEQ ID NO: 199320 - DNA, 6723 bp, Artificial Sequence
  Description of Artificial Sequence: Synthetic coding sequence
atggagcagacctggacccgggactacttcgccgaggacgacggcgaaatggtgcctcggaccagccacacagctgcctttctatccgataccaaagatcgtgggcccccagtacagtctcagatttggcgtagtggcgagaaggtgccgttcgttcagacctatagcctgagggcgttcgaaaagcctccccaggtccagactcaggcactgagagattttgagaagcatctgaacgacctcaaaaaggagaatttctccttgaagttgcgtatctacttcctggaggagcgcatgcaacagaaatacgaagcatcccgcgaggatatctacaagcgaaatatcgagttgaaagtggaagtggaatccctgaaacgggagttacaggataagaagcagcacctcgacaagacctgggccgacgtagagaacctgaatagtcagaacgaggcagaactgagacgccaattcgaggagcgacagcaagaaaccgaacacgtgtacgaactgctggagaacaagattcagttacttcaggaagaatcaagactggccaaaaacgaagccgcgagaatggccgctcttgtagaggctgaaaaggagtgcaatcttgagctctcagaaaaactcaaaggcgtgaccaaaaattgggaggacgtcccgggggaccaagttaagcccgaccagtacaccgaggccctagcccaacgtgataagcgaatcgaagaactgaaccagtcgctggccgcccaggagcgcttagtcgaacagttgagtcgggaaaaacagcagcttttgcacctgctggaggagccgaccagcatggaagtccaaccaatgaccgaggagcttcttaaacaacagaagctgaattcccacgagacaactattacccagcagtctgtaagcgattctcatctggctgaactgcaggaaaagatacagcaaaccgaggcaacaaacaagatcctgcaggaaaaactgaacgagatgtcttacgagctgaagtgtgcacaggaaagttcacaaaagcaggacgggaccatacaaaatctgaaggagaccttaaagtcaagagagagggaaaccgaagagctttatcaggtgattgagggacaaaatgatactatggctaagttacgtgagatgctgcatcagagccagttgggacaattgcacagctctgaaggcacctccccggcccaacagcaagttgcccttctcgacctccaatctgccctgttctgttctcagttagagattcaaaaactgcaacgcgtggtccgacaaaaagagcgccagttagccgatgccaaacaatgtgttcagtttgttgaggccgcagcacatgaatcagaacagcaaaaggaagcttcctggaagcataaccaagagctcagaaaagccctgcagcagctgcaggaagagcttcagaataagagccagcaacttcgggcctgggaagcggagaaatacaatgagattcgcactcaggagcagaacattcagcacctaaatcatagcttgagccataaagagcagctgctccaggagttccgcgaactgttgcagtacagggacaacagcgataagactctcgaggctaatgaaatgctgctagaaaagttgcggcagcgcattcatgacaaagcagtggctctggaaagggcaatcgacgagaagttttcggccctcgaggaaaaggagaaggagctcaggcagttgcgcctcgcagttcgagagcgggatcacgacctggagcggctccgtgacgtcctgtccagtaatgaggccacaatgcaatctatggagtccctgttacgtgccaagggcctggaagtagaacaacttagcacaacctgtcaaaacctacagtggttaaaggaggagatggaaacgaaattttccaggtggcagaaagaacaagaatccatcatacagcagctccaaaccagcctccatgaccgcaataaagaggtcgaagatctctcagcaaccctgttgtgtaaacttggacccggtcagagtgaaatagccgaggaactctgccagagactgcaacggaaggaacgcatgttgcaagacctgttgtcagaccggaacaagcaagttctagaacacgaaatggaaatccagggcctcctacagtccgtgtcaactcgagagcaggaatcacaggccgctgccgagaaactggtgcaggcactcatggaaaggaacagcgaactacaggccctgcggcaatatctaggcggtagagatagtctcatgtctcaagctcccatttccaatcagcaggctgaggtgacccctacgggctgtctggggaagcagacggatcaggggagcatgcagatccccagtcgtgacgattccacatctctgacagccaaggaggatgtatccattccccgtagtaccctgggcgacctcgatacagtcgccggtctcgagaaggagctgtcgaacgccaaggaggagctcgagctgatggccaagaaagaacgcgaatcgcagatggagctgtcagctttgcagtctatgatggccgtgcaggaagaagagctgcaggtccaagctgccgacatggaaagcctaactcgcaatatccagatcaaggaggacttgatcaaggacctgcagatgcaactggtcgatcctgaagatatccctgctatggagcggctgactcaggaggtacttttgttaagagaaaaggtggcctccgtggaatcacagggacaggagatttctggaaatcgtaggcagcaactgctcctgatgctggagggattggtcgacgagcggtccaggttgaacgaggccttgcaggctgagagacaactctatagctccctggtgaagtttcatgcccaccctgaaagttctgaacgggatcgaaccctccaggtggaacttgagggcgctcaggtgctgagaagtcggctcgaggaggtgctgggtcgctcattggaacgtcttaatcgtcttgaaactctggccgcaattggcggagctgccgcgggggacgatacagaagacacatctaccgagttcaccgacagtatcgaggaggaagccgctcaccatagccatcagcagctcgttaaggtggctctggaaaagtccctggccacggtcgagacacagaacccctcattctctcctccgtctcctatgggaggcgactcaaaccgatgcttgcaagaagagatgttgcatcttcgcgccgagtttcatcagcatctggaagaaaagcgcaaggctgaagaagaactgaaagaactcaaggcacaaatagaagaggccggattttccagcgtcagccacatccgaaatacaatgctctccttgtgcctggagaacgctgagctcaaggagcagatgggggaggctatgagcgacggctgggagatcgaggaagacaaggagaagggggaacttgataatcaaagccagccccgagacccaggccctcagtcagcgttctccctgccgggcagcacacagcacctgcgttctcagttaagccagtgcaagcagcgctaccaggatcttcaggaaaaactgttgttgagtgaggctaccgtctttgcgcaggcgaacgagctcgagaaataccgcgtaatgctgactggggagtctttggttaagcaggattccaaacaaatacaggtagatcttcaggatctggggtacgagacatgcgggagaagtgagaatgaggctgaaagagaggagaccacctcccctgagtgcgaagaacacaacagcctaaaagagatggtcctgatggaaggcttatgcagcgaacagggccggaggggctctactctggcttcatcttccgagagaaaacccctagaaaatcagctgggaaagcaagaagaatttcgagtgtatggtaaatccgagaatattttggttctgagaaaggacatcaaagatctgaaagcacagctgcagaacgccaacaaagtgattcagaacctgaagtctcgggtcaggagcctcagcgtcacatcagactacagctcatcactggaacgcccttggaaactccgggccgttggtacactggagggatcaagcccacactcggtgccagatgaggacgaaggttggctctccgacgggaccggcgccttttattcaccagggttgcaggcaaaaaaggatctagaatctctcatacagcgggttagtcagctggaagcccagcttccgaagaatggcctggaagaaaagctggctgaggagctcagatcagcctcctggccaggcaaatacgatagtctgatacaggaccaggcgcgcgaactcagttatttgcgccagaaaattcgggagggcagagggatctgttacctgattaccaggcacgccaaagatacggtgaaaagcttcgaggacttgctgagaagtaacgatattgattactatctcgggcagtcattccgggagcagctggcccaaggatcccagctcactgagcgcctgacgagcaaattgtctacaaaggaccacaaatcggagaaggatcaggccggcttagaaccgctggcgctgcggctgtccagagaactgcaggagaaagaaaaggtgatcgaagtgctgcaggcaaaactcgacgcgcggagtctgactcccagctcctcacatgcgctgtccgacagccacaggtccccaagctctaccagctttttgagcgatgagctcgaagcttgcagtgacatggatattgtaagtgagtatacccactacgaggagaagaaggccagtccttcccactccgattcaattcatcactcttcacacagcgccgtcctgtcttctaagccctccagcaccagcgcctcacaaggcgcgaaagccgaaagcaactcgaaccccatcagcctgcccacaccacaaaacactccaaaggaggccaatcaggcacattctggggcatctacagtgccgccagcatccactgcaactctgctgagcaacgacctggaggctgattcatcctactacttgaattccgcacagccccactctccaccaaggggaacgatcgaactggggagaatattagagcctgggtatctcgggagcagtggcaagtgggacgtaatgagaccgcagaagggctctgttagtggggacttgtcctctgggtccagtgtctaccaactcaatagcaagccaaccggagccgatctgctcgaagagcacttgggagaaattcggaacctcaggcagaggctagaagagagcatttgtatcaacgacagacttagggaacaattggaacatcggctaactagcactgctcgtggccgaggctccaccagcaacttctacagccaaggtttagagtccattccgcaactgtgtaacgagaatagggtactgcgggaggataaccgtcggttgcaagcccagctcagtcacgtctcccgagagcactcccaggagactgagtcgctgcgggaggctctgctcagctcccggtcccacctgcaagaactggaaaaggagttagagcaccagaaagtggaacgccagcaactcctggaggacctgcgcgagaagcaacaggaagtgctgcacttcagagaggaaaggctgtctttacaggaaaacgactccagactgcagcataagctggtcctcctacagcagcaatgtgaggagaaacagcagttgttcgagtccctgcagagtgagctgcaaatctatgaggcactgtacgggaacagcaagaagggactgaaggcctacagtctggatgcatgccatcagatcccactgtcctccgatttgtcacacctcgtggcggaggttagagcgctgcgcgggcagctagaacagtccatccagggaaataactgcctgaggctgcagctgcagcagcagctcgaatcgggagccggaaaggcctcactgtccccttctagcatcaaccagaatttcccagcatcgaccgaccccgggaacaaacagctgttgctgcaggactccgcggttagcccgcctgtacgagacgtagggatgaatagcccggcgttagtatttccatctagcgcgtcttctaccccaggatcagaaacccccattatcaaccgggccaatggccttggcttagatactagcccagtgatgaagacaccacctaaactcgaaggcgacgcaacagatggatcctttgcgaataagcacggcaggcatgtaatcgggcacattgacgactattccgccctgcgtcaacaaatcgccgagggcaaactgctcgttaaaaaaattgtgagcttggtgagatccgcatgtagcttccccggactggaggcccaaggaaccgaggtcttaggcagtaagggaattcatgagctgcgatcaagtacctctgcactgcatcacgctctggaggaatcggccagtctcctgaccatgttctggcgcgccgcccttccctccacccacataccagtgctccctggaaaggttggcgaatccacagaacgggagctgcttgagctgagaacgaaagtgtctaagcaggagaggctgctacagagcactactgagcatctgaaaaacgcaaaccaacagaaagaatccatggaacagtttatcgttagtcagctgaccagaactcacgacgtactgaagaaggcaaggacaaacctggaagttaagagtcttcgtgcgctgccttgcaccccagccctgtag

SEQ ID NO: 199321 - DNA, 3399 bp, Artificial Sequence
  Description of Artificial Sequence: Synthetic coding sequence
atgaaggagatctgccggatctgcgcccgggagctgtgcggcaaccaacgaagatggatcttccacactgcttcaaaactaaatctgcaggttttactttcccacgtgttgggcaaggatgtgccaagagatggaaaggccgagtttgcatgctccaagtgtgcttttatgcttgaccggatatataggttcgacaccgtgattgctcgaatcgaagccctgtctatcgaacggttgcagaagctcctcttggaaaaggatcgtctcaaattctgtatcgcttctatgtaccgcaagaacaatgacgactccggggcggaaatcaaagctggcaacgggacggtggacatgtccgtactgcctgacgcccggtacagcgccttactccaagaggattttgcttacagcggttttgagtgttgggttgagaacgaggaccagatccaggagccccattcctgccacggttccgaggggcctggcaatcgcccacgaagatgtcgcggttgtgctgcgctcagggttgccgactccgattacgaggccatttgcaaagtgcctcgcaaggtcgctcgcagcatcagttgcggtccgagctctcgctggtccacaagtatttgcactgaggagcctgccctgtcagaagtaggtcctcccgatttggcttctaccaaggtgccaccggacggcgagagcatggaggaggagacaccagggtcctcagtggaatctctggacgccagtgttcaagcttcacctccccagcagaaggatgaagagaccgaaagatccgccaaggaactcgggaagtgtgactgttgctccgatgatcaggcaccgcagcacggctgcaatcataaattagagttggccttgagcatgattaagggcctggattataagcctatacagtccccccgcggctctaggctgcctattccagtcaagtcctcactgcctggagccaagcccggccctagcatgaccgatggtgtgtcctccggcttcttgaacagatctctgaagccattgtacaagactcctgtgtcttatccccttgagctttcggatctgcaggaactttgggatgatctgtgtgaagattacttgcctcttcgggttcagcccatgacagaagagctcctcaagcaacagaaactcaattcacacgagaccaccatcacacagcagagcgtctctgactcccatttggccgagctgcaggagaagattcaacaaacagaagctactaataagatccttcaggaaaaacttaatgagatgagctacgagcttaaatgcgctcaagagagtagccagaagcaggatggaaccattcagaatttaaaggagactcttaagtcgcgtgagagggagaccgaggagctgtaccaggtgatcgaaggtcaaaacgatacgatggctaaactccgtgaaatgttgcatcaatctcagctgggacaacttcatagctccgaggggactagtcctgcacagcagcaggtcgcactgctggatcttcagagcgctcttttttgcagccagctggagatccagaaactgcagcgagtcgtccggcaaaaggaacggcagctcgccgacgctaaacagtgcgtgcagttcgtagaggccgcagcccacgagagcgagcagcaaaaagaagcgagttggaagcacaaccaggagctgcggaaagccctgcagcagctgcaggaggaattgcagaataaaagccagcaactgcgggcatgggaggctgagaaatacaacgaaatccgcacacaggagcagaacatccagcatttgaaccactctctgagccacaaagagcaactcctccaagaatttcgggaactccttcagtaccgggacaatagcgacaaaactctcgaggcaaacgaaatgctacttgagaaactaaggcagcgcatccacgacaaagccgtcgccctggagcgtgcaatcgatgaaaagtttagcgctttggaggaaaaagagaaggagcttaggcagttacgtctggccgtgcgcgaacgcgaccacgatctggagcgcctccgggacgtgctttcgagtaacgaggcaaccatgcaaagcatggagtcccttctgagggccaaggggctggaagtggagcagctgagcactacctgccagaacctccagtggctaaaagaggaaatggagaccaaattttcgcgctggcagaaggaacaggagagtattattcagcaactgcaaacgtcattgcacgatcgcaacaaagaggtagaggaccttagcgccacactgctgtgcaagctcgggcctgggcagtctgaaatagctgaggagctttgccaacgtttacagcgcaaagaacgaatgctacaggacctcctgtcggatcggaacaaacaggtactagagcacgagatggagattcaggggctgctccaaagtgtttccacacgcgagcaggaaagtcaggcggctgcagaaaagcttgtacaggccctgatggagcgaaattctgaactgcaggcactccgacaatatctgggaggacgggattctctgatgagccaagcaccaattagtaaccagcaggcagaggtgacacccacgggttgcctcggcaagcagacagaccaaggctcaatgcagatcccgtcccgggacgattccacgagtctgactgctaaagaggatgtatctatccctaggtcgacgctgggggaccttgatacagtggcgggcctggaaaaggagctctccaacgccaaggaagagttagaacttatggcaaaaaaggagcgcgaaagccagatggagctttcagcgctccagtctatgatggccgtacaagaagaggagctccaagttcaagcagctgacatggagagcctgacacggaatattcagataaaagaggatctaatcaaggatttgcagatgcagctggttgaccccgaggatatacctgcaatggagagacttacccaagaggtgctgctactgcgcgaaaaggtggcgtccgtagaaagtcaggggcaggaaataagtgggaacaggaggcagcagttactgctgatgctggaaggcctagtggatgaacgatccaggctcaacgaggcactccaagctgagcggcagctgtattcctcactcgttaaattccatgctcaccccgagtcctccgagcgggatagaacactacaggtagagctggagggagcccaggtcctcaggtcacgcctggaagaagtgcttggaaggagtctggaaaggctcaaccggctagagacgctggcagcaataggcggtgcagcagcaggcgatgacacagaggacacatcgacagagttcaccgactctattgaggaggaagcagcccaccatagccaccaacaattgtag

SEQ ID NO: 199322 - DNA, 522 bp, Artificial Sequence
  Description of Artificial Sequence: Synthetic coding sequence
atgagcaacggctaccggaccctgagccagcacctgaacgacctgaaaaaagagaacttcagtctgaaactccgcatttacttcctggaggagcgtatgcagcaaaagtacgaagcgtcacgggaggacatttataagcgcaatatcgagttaaaagtggaagtcgagagcctgaaacgggagctgcaggataagaaacagcacctcgacaagacatgggccgacgttgaaaacttgaactcacagaatgaggccgagctgcgacgacagttcgaggagagacagcaagaaacagaacatgtctacgaactgctggaaaataaaattcagctgctgcaggaagaaagcagactggccaaaaacgaggccgccagaatggccgctctagtggaggcagagaaggagtgcaaccttgagctcagcgagaaattgaagggtgtaacaaaaaactgggaggacgtgccaggagaccaggtaaaacccgaccagtacactgaggcactggcccaaagggataagtag

SEQ ID NO: 199323 - DNA, 933 bp, Artificial Sequence
  Description of Artificial Sequence: Synthetic coding sequence
atgaagggcaccgacagcggcagctgctgccggcggcggtgcgacttcgggtgttgctgtagagcttcaagaagagcacattacaccccctacagaagcggggacgcaacacggacaccccagtcccccagacaaacaccttcacgtgagaggcgccggcctgaaccagccggctcttgggcagcggctgcggaggaggaggaagctgcagcggcagcgactccatggatgcgcgattatttcgccgaggatgatggcgagatggtgccccgcacatcacacacggctgcatttctgtccgacaccaaggacagaggcccccccgtccaatcccagatttggcgcagcggagaaaaggtcccctttgtgcaaacctatagcctgagagcattcgaaaagccaccccaggtgcaaacacaagcactgagggacttcgagaaacacttgaatgacctgaaaaaggagaacttcagcctgaagctgcgtatttattttctggaggagcggatgcagcagaaatacgaggcctcccgggaggatatatacaagcgaaacatcgagctgaaagtcgaggttgagtcactgaaacgtgaactacaggacaaaaagcaacatctcgacaaaacatgggccgatgtcgaaaatctgaattcacagaacgaagctgaactgcgtcggcagttcgaagagcgtcagcaagaaactgagcatgtgtacgagttgctggagaacaaaatacaattgctgcaagaagagtctcggttagcaaaaaacgaagccgcccgtatggccgctctcgtcgaggctgagaaagaatgtaacctggagctgtccgagaaactaaaaggggtgactaaaaactgggaggacgttccaggcgaccaagtcaaaccagatcagtacactgaagcactggcccagcgcgataagtag

SEQ ID NO: 199324 - DNA, 2910 bp, Artificial Sequence
  Description of Artificial Sequence: Synthetic coding sequence
atgagcaacggctaccggaccctgagccagcacctgaacgacctgaaaaaggagaacttctctctcaaacttcgcatctattttctcgaagaaagaatgcaacaaaagtacgaggcctcccgcgaagatatctataaaaggaatatcgaattgaaggtcgaggtggaatcactaaagagggagctccaggataagaaacaacatctcgacaagacttgggcagatgtagaaaacctgaatagccaaaacgaagctgagctgcggagacagtttgaggaacgtcagcaggaaaccgagcatgtctacgagctgctggaaaacaaaattcaactcttacaggaagaatccaggttggccaaaaatgaggctgcacgcatggccgctctggttgaagcagagaaggagtgtaatctggagctgtccgagaagttgaagggcgtcaccaaaaattgggaagacgtgccgggggaccaggtgaaacctgatcagtataccgaggccctcgcccagagggacaagaggatcgaggaattgaatcagtctttggctgcccaggaacgactcgtggaacagctctctagagaaaagcagcaactgctccacctcttagaggaacctacctctatggaggtgcagccaatgactgaggaactcttgaaacagcagaaactgaacagccacgaaacaaccatcacccaacagtcagtcagtgatagtcacttggcagagcttcaggaaaagattcagcagacagaagctaccaacaagattctccaggagaaattgaatgagatgtcatacgagcttaagtgtgctcaggagagtagccagaaacaggatggcacaatccagaacctgaaggaaactctgaagagccgagagcgtgaaactgaggagctgtatcaagtgattgagggccagaacgacaccatggccaagctgcgggaaatgttgcaccagtcccagcttgggcagctacattcttccgagggcacatcccctgctcagcaacaagtcgccctactggacttgcagagcgcccttttctgctctcaactcgaaattcagaagctgcagcgtgttgtaaggcagaaggaacggcagttggcggacgctaaacagtgtgtgcagttcgtcgaggcggctgctcacgaaagtgagcaacagaaagaagcttcttggaagcataatcaggagctaagaaaggccctgcagcaattgcaagaagagctgcagaataagtcccagcagctcagggcctgggaagccgagaagtacaatgagattagaacccaggaacagaacatccagcacttgaaccacagcctgagtcataaggagcagcttctccaggagtttcgggaacttcttcagtaccgcgacaactccgataagactctggaggctaacgagatgttactggaaaagttgaggcagcggatccacgacaaggccgtggctctggagagggccattgacgagaagtttagcgcgctcgaggaaaaggagaaagaactgcgccaactccgattagccgtccgagaaagagaccatgatctggagcggcttcgcgatgtgctgtctagcaacgaggctactatgcagagcatggagtcactgctgcgcgcaaagggactagaggttgagcagctttccacgacttgtcaaaacctacagtggctgaaagaggagatggagaccaagttctctcgttggcagaaggaacaggagtctattatacaacaactgcagacttcactgcacgataggaacaaggaagtggaagacctgtccgcaactttgttgtgtaaactcggacccgggcagagcgagattgcagaagaactctgccagcggctgcagagaaaggaacggatgctgcaagatcttttatctgaccgcaataagcaagttctggaacatgaaatggagattcaaggactgctgcagagcgtttccactcgagaacaggaaagtcaggcggctgcggaaaaactggtccaggcacttatggagcggaactccgaattgcaggcattgcgacaatatctcggcggtagagacagcttgatgagccaggcgcctatttcaaatcagcaggctgaagtcactccaacaggatgtctcggcaagcagacggaccaggggagcatgcagatcccatcaagagacgactcaactagcctgacagcaaaagaagatgtcagcattcccaggtcgaccctgggcgatcttgacaccgtggctgggctagaaaaagaactgtccaacgccaaagaggaactcgagcttatggcgaagaaggaacgcgagtcccagatggagctaagcgccttacagagcatgatggccgttcaggaagaggaactgcaggtccaagctgccgacatggagagcttaactaggaatatccaaataaaggaggacctgataaaagatctccagatgcagttggtagacccagaagacattcctgccatggagcgcctgacacaggaagtgctgttgctgagggagaaggtggctagtgttgagtcacagggccaggaaatttcaggaaacaggagacagcagttgttgttaatgttggaaggcctggtggatgaaagaagcagactgaacgaggccttgcaggccgaacggcagctgtactcttccctggtgaaattccacgctcatccggagagtagcgagcgagatcgtactctacaggtggagctggaaggtgcccaggtactgaggtctaggttggaggaggtgctcgggcgctccttggagcgactcaacagactcgagactttggctgctattgggggagccgcggcaggcgatgacactgaagatacctccaccgagtttaccgattccattgaagaagaagcagctcatcatagccaccagcaactgtag

SEQ ID NO: 199325 - DNA, 2967 bp, Artificial Sequence
  Description of Artificial Sequence: Synthetic coding sequence
atgagcaacggctaccggaccctgagccagcacctgaacgacctgaaaaaggagaatttttccttgaagttgaggatttacttcttagaggagcggatgcagcagaaatacgaggcctccagggaagatatttataaaagaaacattgagctgaaagtggaagtagagtcactgaaacgtgaacttcaggacaagaaacaacatctggacaaaacctgggccgatgtggaaaatctgaattcacagaatgaggccgagcttaggaggcagtttgaagagagacagcaagagacagagcacgtttatgagttgttggagaacaagatccagcttctgcaagaggaaagcaggctcgctaagaatgaggctgcccgcatggccgctctcgtggaggcagagaaggagtgcaacctggaactgtctgaaaaacttaaaggagtcacaaagaattgggaagacgtacctggtgatcaagtgaagccagatcaatacacagaagctctggcacagcgggacaagcgcatcgaggaattgaaccagtctcttgccgctcaggagcgcctggtcgagcaactgtctagggagaaacagcagctgctgcatctccttgaagaacccacgagcatggaggtgcagcctatgactgaggaactgctgaaacagcagaaactcaattcgcacgagaccaccattactcagcagtcagtgtccgacagtcacctggccgaacttcaggagaaaattcaacagacagaagccacaaacaaaattctgcaagaaaagttaaatgaaatgtcatatgagctgaagtgcgcacaggagtcttcacagaagcaggatggtaccatccagaatctgaaagagaccctgaaatcaagggaacgcgaaacggaggagctgtaccaggttatcgaaggtcagaatgatacaatggcaaaattgcgcgaaatgctgcatcagagccagctcggccaactgcacagctccgaggggacaagccccgctcagcagcaggtcgccttacttgatcttcagtcagctctgttctgttcacagctggagatacagaagttacaaagagtggtcagacaaaaggagcgccagttggcggatgccaagcagtgcgttcagttcgtcgaagccgcggctcacgaatcggagcagcagaaggaagcatcctggaaacataatcaggagctgcggaaggctctgcagcagctgcaagaagagcttcagaataagtcacagcagctcagagcatgggaggccgagaaatacaacgaaataaggacacaggagcaaaacattcagcatctgaatcactctctctcacacaaagagcagcttctgcaggagttcagagagctgctccaatatcgcgacaactctgacaaaaccttggaggccaacgaaatgctgctagagaagctaagacagcgtatacatgataaggctgtcgcccttgaaagggcaattgacgaaaagttttccgccctggaggaaaaggaaaaagaactaaggcagctacggctggctgttcgggaacgagaccatgacttggagcggctacgggacgtgctgtcttcaaatgaggccaccatgcagagcatggagtccctcctgagggccaagggactggaagtggaacagttatcaacaacttgccaaaatctgcagtggctaaaagaagagatggaaaccaaattctcacgctggcagaaagagcaggaaagtatcattcagcagctccaaacatccctgcatgacaggaataaagaagtggaggacctcagcgctaccctactctgtaaactcggcccagggcagtccgaaattgctgaggaattatgtcaaaggctgcagcggaaggaaaggatgctacaggatctgctgtccgaccgcaataagcaggtgttggagcacgagatggagatccaaggcctacttcagtcagtctctacaagagaacaagagagccaggctgccgcagaaaaactggtgcaggctttgatggagcggaattcagaactccaggctctgaggcagtacctgggggggagagatagtcttatgtcccaggcccctattagcaatcaacaggcagaagtgacccctaccggctgcctaggcaaacagaccgatcagggcagcatgcagattcctagccgggacgactcgaccagccttactgcgaaagaagacgtaagcattccaagatctacactgggggatctggatacggtcgcaggcttggagaaggaactctccaacgcgaaggaggaacttgagcttatggccaaaaaagaacgcgaaagccagatggagctgtctgccctccagtcgatgatggccgtgcaggaggaagaactccaggtccaggccgccgatatggaaagcttaactcgaaacattcagataaaagaggatttgataaaagacttgcagatgcagctggttgacccggaggatatccccgccatggagcgactcacacaggaagtgctgctactgagagagaaagtagcaagtgtggagtctcagggccaggagattagcggaaaccgtcgtcagcaactcctgttaatgctagaggggctggtggatgagcgttctcggctaaacgaagcactccaggctgagaggcagttgtactcctcactggttaagttccatgctcacccagagtcttctgagcgtgataggaccctccaggtggagctggaaggcgcacaggtgctgcgcagccgactagaagaggtgctggggagatccctggaaagactgaacaggctcgaaaccctggcagccataggaggtgccgccgcgggtgacgacacagaggacacctccacggaattcaccgacagcatcgaagaagaggccgctcaccactcacaccagcaggtgtcccagtgccagggactggggctgccgggctggaccgcacattctccgtctgaggtctag

SEQ ID NO: 199326 - DNA, 3396 bp, Artificial Sequence
  Description of Artificial Sequence: Synthetic coding sequence
atgaaggagatctgccggatctgcgcccgggagctgtgcggcaaccagcgacgctggatatttcacaccgccagtaaactcaacctacaggtcttgctgagccacgttctcggaaaagatgttccaagagacggtaaggctgaattcgcttgcagcaagtgcgctttcatgctcgatcgaatttatcgctttgatacggttattgcacgcattgaagctttgtcaattgaaagactgcagaaactccttttggaaaaggatcggctgaaattttgcatcgccagcatgtacagaaaaaacaacgatgattctggagccgagattaaagcagggaatggcactgtggacatgagtgtgctcccagacgcgcgatatagtgcgttgcttcaggaagattttgcatattcagggttcgaatgttgggtggagaacgaggatcagatccaagagcctcactcatgtcacggcagcgaaggtcctggtaaccgcccacggaggtgccgagggtgcgcagccttgcgggtggcagattctgactacgaggccatatgcaaggtgccacgcaaagtggctcgctcaattagctgcggcccatcatctcgttggtccaccagcatctgcacagaagagccagctctgtcagaggtcggtcctccagacctggccagcacaaaggtgcctccagacggggaatcaatggaggaggagacgcccggcagctcagtcgagtctctggacgcctctgttcaggcaagcccccctcagcagaaggacgaggaaactgagcgttctgccaaagagctgggaaagtgtgactgctgttccgatgatcaggcgcctcagcacggatgtaatcacaaattagaacttgccctgtcaatgattaagggtctggactacaaacccatccaatctccgcgcggctctcgcctcccgataccggttaagtcctcactacctggagcgaagcccgggccaagcatgaccgacggtgtgtccagtggttttttgaaccggtccctaaagccactctacaagacaccagtctcctatcctctggagctatccgatctgcaagagctgtgggatgacctttgcgaagactacctgcccctacgcgtgcaacccatgacagaggaacttttgaagcagcaaaaactaaacagccacgagaccacaatcacgcaacaaagcgtgagtgacagccacttagcagagctccaggaaaaaatccagcaaaccgaggcaaccaacaaaatcctacaagagaaactgaatgaaatgtcatatgaactgaagtgtgcacaggagtcgtcccagaagcaagacggaaccatacagaaccttaaggagaccctcaaatcccgggagcgggaaaccgaggagctatatcaagttattgaaggtcagaacgatacgatggccaagctaagagaaatgctgcaccagtctcagctggggcaactgcatagtagcgagggaacaagccctgctcaacagcaggtcgctttactggacttgcagtcggcgttgttttgcagccaattggaaatccagaagctgcagcgtgtggtgaggcagaaggagcgacaactggctgatgcaaaacagtgcgtgcagtttgtggaagccgcagcccatgagagcgaacaacagaaagaggctagctggaagcacaaccaggaactaaggaaggctctccagcagcttcaggaagagctccaaaacaagtcacagcagttgcgcgcttgggaagctgagaaatataacgagatacgcacacaggaacagaatatacagcacctgaatcacagcctgtctcacaaggaacagttgttacaggagttcagagaactgctgcagtaccgagacaactcagacaaaacattggaagccaacgagatgctgctagaaaaactccggcaaagaattcatgacaaggcagtcgccctggagcgtgccatcgacgaaaagttctccgcgctcgaggaaaaggaaaaggagcttcggcaactaagactggctgtaagggaacgggatcacgatttggagcgcctgcgggatgtgctatcttcgaacgaggccaccatgcagtctatggaaagtctcttgcgggccaaggggctggaagtagagcagctgtccaccacgtgtcagaaccttcaatggctcaaagaagaaatggagaccaagttctcaagatggcagaaggaacaggaaagcattatccagcagttacagaccagcctccacgacagaaataaagaagttgaagaccttagtgccacactactttgcaaattaggtccaggccaatctgagatcgcggaggaactctgccaacgattacaacgcaaagagcgcatgcttcaagatctgcttagtgatcgcaacaagcaggtgctagagcacgaaatggaaatccagggcctgctccagtccgtctcaacacgcgagcaggaaagtcaagccgccgcggaaaaattagtgcaggccttgatggaaaggaactccgaattacaggctttacgccagtacctgggcggacgcgactccttaatgagccaagccccgatcagcaatcagcaggccgaagtaacccctacaggctgtcttggcaagcaaactgatcaggggagcatgcagattcccagccgcgacgattctacctctttaactgctaaagaggatgtttcaattcctcgatccaccctgggcgatctggacacagttgccggcttagagaaagaactgtctaacgccaaagaggaattggagttgatggctaagaaagagcgtgagagtcagatggagttgtccgcactccaatccatgatggctgttcaggaggaagaactccaagttcaggccgcggatatggagtcactgacaaggaacatacagattaaagaggatctgattaaagatctgcagatgcagcttgtggatccagaagacattcccgccatggaaagactgacccaagaggtcttactgctgagggagaaagtggcatctgtcgagagccagggccaggagattagtggcaatagacgacagcagttgttactgatgctggaaggcctggtcgatgaacgctcaaggctgaacgaggctctccaggccgagcgtcagctctacagttcgctggtgaagtttcatgcccaccctgagtccagtgaacgcgatcgtaccctgcaggtggaactcgaaggagcccaggtacttaggagtaggcttgaagaagtgttggggcggtctctcgaacgcctgaaccgcttagagacgcttgcagcaatcggcggtgcagcggctggagatgacactgaggacaccagcaccgagttcactgatagtatcgaagaagaggccgcacaccactcccatcagcagtag

SEQ ID NO: 199327 - DNA, 7041 bp, Artificial Sequence
  Description of Artificial Sequence: Synthetic coding sequence
atgagcaacggctaccggaccctgagccagcacctgaacgacctgaagaaggaaaacttcagtctgaagctgagaatttatttcctggaggagagaatgcagcagaagtacgaagcaagtcgcgaggacatctacaagcggaatatcgagttgaaagtcgaggttgagagcctgaaacgggagttacaggacaaaaagcagcatctggacaagacatgggccgacgtggagaatctgaattcccaaaacgaggcggaactgagacgacaattcgaggaacggcagcaggaaactgagcatgtgtatgagctgcttgagaacaagatccagttactgcaagaggaatctcggcttgcaaaaaacgaggccgctcggatggccgcattagttgaggccgagaaggaatgtaatctagagttatccgaaaagctcaaaggcgtcacgaagaattgggaagacgtgcctggcgatcaagtcaagccggatcagtacactgaggctttagcccagcgggacaagcgaatcgaagagctaaatcagtctcttgctgctcaggaaagactggttgaacagctctcccgcgaaaagcaacagctgctccacttgttggaggagcccacatcgatggaggtacagccgatgaccgaggagctgcttaaacaacagaaactgaactcacatgagacgactatcacacaacagtcagtgtccgactctcatctggctgagctccaggagaagattcaacagacagaggccaccaataagatattgcaggaaaaactgaatgaaatgtcatatgagcttaaatgcgcccaggagtccagccaaaagcaggacggcacaatccagaacctcaaagagacactgaaatcacgcgaaagggaaactgaggagctgtaccaggtcattgagggacagaatgacaccatggccaaactccgcgagatgctgcatcaatctcagctgggacaactgcactcctccgaaggaacatctcctgcacagcagcaggtggccctcctcgacttgcagagcgcactgttttgttcacagctcgagatacagaagttgcagagagtcgtgcgccagaaggagcgccagctggcggatgccaagcagtgcgtgcagtttgtggaagccgccgcccacgagagtgaacagcaaaaggaagcgtcgtggaagcataatcaggaactcagaaaggccctgcaacagctccaggaggaacttcagaacaagagtcagcagctgagggcctgggaagccgagaagtacaatgagatcaggacacaagagcagaatattcagcacctgaatcactcactttcccacaaagaacagcttcttcaggaatttcgagagcttctccagtacagggataattctgataaaacactcgaggctaacgaaatgctgctcgaaaaactaagacaaaggattcacgataaagcggtagctctggaaagggcaatcgatgagaaattttcggcgcttgaggagaaggagaaagaattgcggcagctcaggctggcagtgcgggaacgggatcacgatctcgaaagactcagggacgttttatccagcaatgaggctaccatgcagtctatggaaagtctgctgagagccaaaggtctggaggtggagcagctgagcacaacgtgtcagaatcttcaatggcttaaggaagaaatggagactaaattctcacggtggcaaaaagagcaggagagtatcattcaacaacttcagacttccctgcatgaccgaaacaaggaagtagaggacctcagtgccacattgttatgtaagctaggtccgggtcagtcggaaatagctgaggagttatgccagcggctccaaaggaaggagcggatgctgcaagatctgctgtctgatagaaataagcaggtgctcgaacacgagatggaaatacaaggcctgctgcaatccgtctctaccagggagcaggagagccaggccgcggccgaaaaattggtgcaggctctgatggaacgcaacagtgagcttcaggctctgagacaatatctcggaggtagggatagtcttatgagccaagcccctattagtaatcagcaggcagaggtgacccccaccggatgtctcggaaagcagaccgaccaaggcagcatgcagatcccgtcccgagatgactccacaagcctcactgccaaggaggacgtttcaatacccagatctaccctcggagacctggacaccgtggcagggctggaaaaggagctttcaaacgctaaggaggagctggagctaatggctaaaaaagaaagggagtcccaaatggagttgtccgccttacagagcatgatggccgtacaggaggaggaactgcaagtacaagccgccgatatggagtcattaactcgcaatattcagatcaaggaagatttaattaaagatctgcaaatgcaattggtagaccctgaggatatacccgctatggaaaggctcacacaagaggtgctgctgcttcgcgaaaaagtggcgtctgtggagtcacaggggcaagagatttcaggaaatcgtcggcagcagctcctcttgatgctggaggggctcgttgatgaacgctcccgcttaaacgaagccctgcaagccgaaagacaattgtacagtagcctggtgaagtttcacgctcacccagagagctccgagcgggatagaacccttcaagtcgaactggaaggagctcaagttctacgcagtcggcttgaagaggtgcttggtaggagcttggagcgcctaaatcggcttgaaacgcttgccgccatcgggggcgcagcggccggtgacgatactgaggacacttcaactgagttcactgatagcatcgaggaagaagctgcacaccacagccatcagcagctcgtgaaggtggccctcgaaaagtcccttgctacagttgaaacgcaaaatccttctttctctccgcctagccctatggggggggacagcaatcgctgcttgcaagaggagatgctccacctgcgggccgaattccaccagcatcttgaggagaaacgtaaggccgaagaggaactaaaagaactcaaagcgcagatcgaagaggcaggcttttcttccgtgtctcacattcgtaatacaatgctcagcttgtgtttggaaaatgcagaactgaaagaacagatgggggaggccatgtcggacggatgggagatagaggaagacaaagaaaagggggaggtgatggtggagactgttgtgaccaaggagggcctctccgaatcttccctgcaagccgaattcagaaagctacagggcaagctgaaaaatgcccacaatattatcaacctgctgaaggagcagttagttctttccagtaaggagggtaacagtaagctgacccctgagctgttggtccatctaacctcgaccatagagcgaataaacacggaattggtgggtagcccagggaaacaccagcaccaggaagaagggaacgttactgtgaggccatttccccgcccgcagtccttggacctaggggcaacctttactgtagacgcacaccagctggataaccagtctcagccgcgggacccagggccccagagcgcctttagtctgcctggcagcacccagcacctaagatctcagctgtctcagtgcaaacagcggtaccaggacttgcaggagaagctcctcctgtcggaagcaactgtcttcgcgcaagccaatgagttggagaaataccgagtgatgttgactggggaatccctggtgaaacaggatagtaagcaaattcaggtggatttgcaggatctcggctatgagacttgtggcagaagcgagaatgaagcagaaagggaggagaccacttcccctgagtgcgaagagcataactctctgaaggaaatggtgctgatggagggtctgtgtagcgagcaaggacgaagaggtagcaccttggccagcagctctgaaagaaaacccctagagaaccagctgggaaaacaagaagagttccgtgtttatgggaaatcggagaacattcttgtgctaagaaaagacatcaaagacctaaaggcgcagctccagaacgccaataaagtaatccaaaatttgaagtccagggtgaggagcctgagcgtaacctcagactactcaagctccctggagcggccctggaagttaagagctgtgggaaccctggagggctctagtccacactcagtccccgatgaggatgagggctggctttccgacgggactggcgctttttactcccccgggctacaggcaaagaaagaccttgaatctctgatccagagagtgagtcagctagaagcacaactgcctaagaatggtctggaagaaaagttggctgaagaactaagatctgcttcctggccgggaaagtatgactcactgattcaggaccaggcacgcgaattgagttatctgaggcagaagattcgggagggccgcggcatttgctacctcataacccggcacgcaaaggacacagttaaatcttttgaggatctcttgcggagtaacgacattgactactatctgggacaatccttccgcgaacagcttgctcagggatcccaactgactgaaagactgacttccaagctcagcactaaagatcacaaaagcgaaaaggaccaggccggattggaaccactcgccctcagactgtcccgcgagctccaggaaaaagaaaaggtgattgaagtgctccaagccaaattagacgcaaggtccctcactccttcttcttcccacgcccttagtgactcccaccggtcgccctccagtacctcctttttatccgacgaactggaggcatgctctgacatggatatcgtttcggaatacacccactatgaagaaaagaaagccagcccaagtcacagcgatagcatccaccacagtagccactccgctgttctgtctagtaaacccagttccacatcagcctcccagggggccaaggctgagagtaattctaatccgattagcctgccaacccctcagaacactcctaaggaggcaaatcaggcccattctggcttccactttcatagcatccctaaactcgcaagtctgcctcaagcgcccctgccctctgcaccaagttccttcctcccattttcccccacgggaccccttttgctcggttgctgcgaaacgcccgtagtgagtctggccgaagcccagcaggagctgcagatgctgcaaaagcagctgggggagagcgcgtccactgtgccccccgcatctacagcaaccctgttaagcaacgaccttgaagctgactcatcatactacctgaacagcgcccaacctcattcaccaccacgtggcaccatcgagttgggaagaatccttgagccaggttacctgggatcatctggaaaatgggatgtgatgcgcccccagaaaggaagtgtctctggtgacttgtcctccggctcttccgtgtatcagctcaattcaaagccaaccggagccgatttattggaggaacatctgggagaaatccgcaatctgagacaacggctggaagagtcaatctgtattaacgatcggctccgggaacagctcgagcatagactcacttccacagcccggggacggggctcgacctcaaacttttacagccagggtctggagtcgatcccccagctctgcaacgagaatagggtcctgagagaagataacaggcggttgcaagcccagctctcacacgtctccagggagcatagccaggaaacggagtccctacgagaggcgctgctctccagccgcagccatttgcaagagctcgagaaagaactggaacaccagaaggtcgaacggcagcagctgttagaagatctacgtgagaagcagcaggaggttctgcattttcgggaagagcggctttccctccaggagaatgactcaagactgcagcacaaattagtgttgctccagcagcagtgtgaagagaagcagcagcttttcgaaagcctgcagagcgagctgcaaatctacgaagccctgtatgggaactctaagaaaggcttgaaggcctacagcctggatgcatgtcaccagattcccctctcctctgatctgtctcacctggtggccgaagtaagggccttgcgggggcaactcgagcaatctatacaagggaataactgtttgagactacagctgcagcaacaactggagagcggagctggcaaggcaagcctgtcaccaagtagcattaatcaaaacttccccgcctcaacagacccaggtaataaacaactcttgctccaggatagtgccgtgtcacctcccgtgagggatgtgggcatgaactcacccgctctcgtatttcccagctccgccagctccacccctggctccgagaccccgatcatcaatcgtgcaaacggcctcggcctggatacctcacctgtgatgaagacaccacccaaactcgagggtgatgcgaccgatggctcattcgcaaataaacatggaagacatgtaatcggtcacatcgatgactactcagcattgcggcaacagattgctgaaggcaagctgctggtgaagaaaatcgtctcccttgtgagatctgcttgcagtttccctgggttggaagcacaaggcacagaggtgcttggttctaagggtatccatgagttgaggtccagtacgtctgctctgcaccatgcgcttgaggagagtgcctccttgttgactatgttttggagagccgccctgcccagtacccacatccctgtactgccgggcaaagtcggcgaaagcactgagcgtgaattgttagagctcaggacaaaagtctccaaacaagaacggcttcttcagtccactacggagcatttgaagaacgccaaccagcagaaggagagcatggagcagtttatcgtttcccaactaacccgaactcacgacgtattgaaaaaggcccggacgaatcttgaagtcaaatctctgcgagccctgccgtgtacacccgccctctag

SEQ ID NO: 199328 - DNA, 7089 bp, Artificial Sequence
  Description of Artificial Sequence: Synthetic coding sequence
atgagcaacggctaccggaccctgagccagcacctgaacgacctgaagaaagaaaacttcagcctgaaactgcggatctatttcctcgaagagcgaatgcagcagaagtatgaagcctcgcgcgaagatatttataaaaggaatattgaactgaaagttgaggtggaaagccttaaacgcgagctccaggataagaagcagcacctcgacaaaacatgggcagacgtcgaaaacctgaactcacagaatgaagctgagttacgacggcagtttgaggaacgacagcaggagacggaacatgtctacgaactgctggaaaataagatccagctcctgcaggaggaatcccgcctggccaagaacgaggccgcaagaatggccgcattggtcgaagcagagaaagagtgtaatctcgagcttagcgagaagcttaagggcgtgaccaagaactgggaggatgtgcctggagaccaggttaaacccgatcaatacacagaggcgctggctcaaagagataagcgtattgaagagttgaatcagagccttgctgcccaggaaagactcgtggaacaattatcaagggaaaagcagcagctcctgcacttacttgaagagcccaccagcatggaagttcaacctatgacagaagaacttctaaagcagcagaaactgaacagccatgaaaccactattacacagcagtctgtgagtgacagtcatctcgcagagttacaggaaaagatccagcagactgaggccacgaacaagattttgcaagagaaactcaatgaaatgtcatatgagcttaagtgtgcccaggaatcatctcagaaacaggacggtaccatccagaacctgaaagagactctgaagagccgcgagagggagactgaagagctttatcaagtcatagagggacagaacgacacaatggctaaactgagggaaatgctgcaccagagccagctggggcaactgcactcaagcgagggcacctcccctgcccagcagcaggtggccttgctcgacctgcagtcggcactgttttgttctcagctggaaattcagaaactgcagcgcgtcgttcgccagaaggaaaggcagcttgctgacgccaaacagtgtgtgcagtttgtagaagccgctgcgcacgaatccgaacagcaaaaagaggcgtcctggaaacacaatcaggaacttagaaaggctctccagcaattgcaggaagagctgcagaacaaatcccaacagctgcgggcttgggaagccgaaaagtacaatgagatccggacgcaggagcaaaatattcaacatttaaatcatagcctttcccataaggagcagcttctacaagaatttcgggagctcctccagtaccgtgacaactcagataagacactcgaagcaaatgagatgctcttggagaaattgcgacagaggatccatgataaggccgtggcacttgagcgagcaattgacgaaaagttctctgcccttgaagagaaagaaaaggaactccggcagttgcgcctggctgtgcgagaacgtgatcatgacctggagaggcttcgcgacgtcttatcgagcaacgaagctactatgcagtctatggaaagtctgttaagggctaaaggcctggaagttgagcagctgagtacaacatgccagaacctacagtggctcaaggaagaaatggaaacgaagttttcaaggtggcagaaggagcaggagtcaataatccagcagctgcaaacttccctccatgaccgcaacaaagaagtggaggatttaagcgccacacttctctgtaagttgggtcccggtcagagcgagatcgccgaggagctgtgccagcggttgcagagaaaagaacgaatgctgcaagatctgctttctgataggaataagcaggtgctagagcatgagatggaaatccagggcttactacagtccgtgagcacaagagagcaggaaagccaggccgccgccgagaagcttgtgcaggcgctgatggagcggaactcggagctccaggcgctgcgccagtacttaggtgggcgggatagcctgatgtcccaggcacccatctccaaccaacaagcagaagtgaccccaaccgggtgtttgggaaagcagaccgaccaggggtcaatgcagatcccatctcgggacgacagtaccagcctgaccgccaaggaggacgtgtccattccgcgctccaccctgggggatctagacacagtggccggcctagagaaagaactctcaaacgcgaaggaggagctagagcttatggcaaagaaagagagggagtctcaaatggagttgtcggctctccagtctatgatggcagtgcaggaggaagaattgcaagtgcaagccgcggatatggagagcctgacacggaacatacagatcaaggaggacctgataaaagacctgcagatgcaattagtggacccagaagacattcctgctatggagcggctgactcaggaagtcttattactccgcgaaaaagtcgctagcgtggagagccagggacaggagatctctggtaaccggcggcagcagctattgttgatgctagagggtctagttgacgaacggagtagactcaatgaagccttgcaggccgaaaggcagttatactcttcactcgtgaagtttcacgctcaccccgagagcagcgagagagaccgcaccctgcaggtagagcttgagggcgcacaggtgctgcggtcgcgcctagaggaggtgctgggacgctcccttgagaggcttaaccgtctcgaaactttagccgccatcggaggggcagccgcgggcgacgacactgaagatacctccactgagttcacagactccatcgaggaagaagctgctcatcatagccatcagcagctggttaaggtggctcttgaaaagtctttagcgacagttgagactcagaatccttccttcagtccgccctcgccgatggggggcgactcgaaccggtgtttgcaggaggaaatgctacatttgcgcgctgagttccaccagcatctggaagagaagaggaaagccgaggaggaactgaaggaactgaaggctcagatcgaagaagccggattctcatccgtttctcacatccgaaacactatgctgtcactctgtctggaaaacgccgagcttaaagagcagatgggcgaagccatgtccgacgggtgggagattgaggaggataaagaaaaaggcgaggtgatggtggaaaccgtcgtgactaaggaaggcttatcagagtcatcactgcaggcagaattcaggaagctgcagggcaagctaaagaatgctcataatataattaacttactgaaagagcaactggttctcagcagtaaagagggaaattcgaagctgaccccggaactactggtgcaccttacttctaccatagagaggatcaacactgaactcgtggggtccccggggaaacaccagcaccaggaggagggaaatgtgaccgtacgccctttccctcggcctcaatccttagatttgggcgccacatttacagtcgacgcccatcagctggacaaccagagccagcctcgtgaccccgggccacagtctgctttcagcttgcctggaagcacgcagcatcttcgctcacagctctcacaatgtaaacagcgctaccaggatctacaggagaagctgttgttgtctgaggcgaccgtgtttgcgcaggccaatgaattagagaagtacagagtaatgttgaccggggaaagtctcgtgaagcaggattccaagcagattcaggtagatctgcaggacctcggctacgaaacctgcggcaggagtgagaacgaggccgaacgggaggagacgacttccccagaatgtgaggaacataactccctgaaagagatggttctgatggagggactctgctccgagcagggacggcggggatccaccctggcatcctcatcagaaagaaaaccgctggagaaccagctcggcaagcaggaggagtttcgagtgtacggaaagagcgagaacattctggtcctgagaaaagacattaaggaccttaaggcccagctccagaatgccaacaaggtgatccaaaatctgaagagccgcgtaagaagcctgagtgtgacctctgattacagcagttccttggaaagaccatggaagctacgtgcagtaggtacgttggaggggagttctccacattcagttcctgatgaagacgagggctggctcagtgatggcactggagccttttatagcccaggactgcaagccaaaaaagacctggaaagcctgattcagagggtttcacagttggaggcgcagctgcccaagaatgggctcgaagaaaaactggctgaggagctgaggtctgcatcctggcccgggaagtatgactcactcatacaagatcaagcacgagagctgagttacctgcgccagaagattcgcgagggaagaggaatctgttacctcatcactaggcatgccaaagataccgtgaagtccttcgaggatcttctgagatcaaacgacatcgattattacttgggccagtcttttagggagcagctggcacagggttcccagctgacagagaggctcactagtaagctcagtacaaaggatcataagtcggagaaggaccaagccggattagagccactggctctccgtctgtcacgcgagctgcaggaaaaggagaaagtgattgaagtgctgcaggctaaacttgacgcacggtccctaacgcctagttcaagccacgccctgtcagattcacacagatcccctagctcaacatccttcctgtccgacgaactggaggcttgcagtgacatggatatcgtgagcgaatacactcattatgaggagaagaaggcctccccttcgcattcagactcgattcaccactcttcccacagtgcagtgctgtcaagtaagcccagctccacatccgcctcccagggagcaaaggcagaatcaaacagcaatcctatctccttgcctacacctcagaatacacctaaggaggccaatcaagcccactccgggtttcactttcacagcattcctaagctggcaagcttgccccaagcaccattgccttccgccccatcatcgtttctgccttttagcccaactgggccactgctgctcgggtgctgtgaaacaccagtcgtgtctctagccgaggcacaacaggaattgcagatgcttcagaagcaactgggcgaaagtgccagcaccgtgccccccgccagtacagcgacactcctgtcaaacgacctggaggcagactctagttactatctgaattccgcccagcctcacagtccaccacgtggtaccatcgaactagggcggattcttgaaccaggatatcttggttctagtggaaagtgggacgtgatgaggccccaaaaaggtagcgttagtggcgacctttccagtgggtcgagcgtgtaccaactaaatagtaaaccgaccggagcggatctcctggaagaacatctgggcgagattaggaatcttagacaacgactcgaagagagtatctgtattaacgatcggctccgcgagcagctcgaacacagactgacaagcactgctcgtggacggggctccacatccaacttctattcacagggactcgaaagcataccacaactgtgtaacgagaatagggtactgagagaggacaaccgacggctgcaggcacagctcagtcacgtgagcagggaacactcacaggagaccgagagcttgagggaggccctgctgtcttccagatcgcacctgcaggaactcgagaaagaactggagcaccagaaggtcgaaaggcagcagcttttggaagatctgcgcgaaaaacagcaagaggtgttacacttcagagaggagagactatctttgcaggagaacgattctcgtcttcagcacaaactagtgctcctgcaacagcagtgtgaggaaaaacagcagctcttcgagagcttgcagagtgagctgcagatttacgaggccctttatgggaattctaaaaaggggctcaaagcctattccctggatgcctgtcatcagattcccctgagtagtgatctgagccacttagtagccgaagtcagagccctgcggggacagctcgagcagagcattcaggggaataactgtctacggttgcagctacagcagcaactcgagagtggagcaggaaaggcatccttgtctccaagttctatcaatcaaaacttccctgcttcaaccgaccccggcaacaaacaactcctcctgcaagattctgccgtgagcccaccggtcagagacgtaggtatgaacagtcctgccctggtctttccaagcagtgccagctccacccccggaagtgaaacacctataataaatcgtgcgaacggcctcggcctggacacatcaccagtaatgaagacgcctcctaagctggaaggcgatgctaccgatggatccttcgcgaacaagcacggccggcatgtgatcggccacatcgacgattactccgccctgcggcaacagattgcagagggtaagctactggtgaagaagatcgtgtccctggttcggtctgcctgttcgtttccgggcttagaggcccagggcacagaggttttgggctccaagggtatccatgaacttcgaagctccactagcgctctccaccatgcgctggaggaaagcgcgagcctcctgacaatgttttggcgggccgcactgcccagcacacatattccagtactccctggaaaagttggcgagagtacagagagagagctactagagctgcggacaaaagttagcaagcaggagagactactgcaaagtaccactgagcacctgaagaacgccaaccagcagaaggaatcaatggagcaatttatagtgtcccagctgacacgcactcatgatgtgctcaagaaggcaaggaccaacctggaagaaccgtgcaagaaaagatctcaccagaaatcactcaaacaacaggagaggtgggcctgccctccttttgtccagttacccatctgttag

SEQ ID NO: 199329 - DNA, 1557 bp, Artificial Sequence
  Description of Artificial Sequence: Synthetic coding sequence
atgcccgaggccaactacctgctgagcgtgagctggggctacatcaaatttaaacgtatgctaaaccgggagttgacacatctctccgagatgtcccgcagcggtaaccaggtgagcgagtttattagcaacaccttcctggataaacagcacgaggttgagatcccatccccaactcagaaggagaaggaaaagaagaaaagacccatgagtcaaatctctggggtcaagaaattgatgcactcctccagtctcaccaattcttcaattccccgatttggcgtgaagactgagcaggaggacgtcctggccaaagaactggaggatgtcaataaatggggcttacatgtattccgaattgctgaactgtctggaaacagaccccttacggtgattatgcataccattttccaggaacgggacctacttaaaacttttaagatacctgtcgacaccctgatcacttacttaatgacactcgaggatcattaccacgccgacgtcgcctatcacaacaacatacacgctgcggatgtggtgcagagcactcatgtgctcttgtccacccctgccctcgaagccgtttttactgatctggagatattggccgctatcttcgcaagcgccatccatgatgtggaccaccccggggtcagcaaccaatttctgataaataccaactctgagctcgcacttatgtataacgactccagcgttcttgagaaccatcatctggcagtgggcttcaagctgctgcaggaagagaattgcgatatcttccaaaacctgaccaaaaagcagaggcagagcctccgcaaaatggtcattgacattgtcttagccacggatatgtcaaagcacatgaatcttttggcggatcttaagaccatggttgagacaaagaaagtaacttcatctggggtgttgctactcgacaactatagtgacaggattcaggtcctgcaaaacatggtgcactgcgcagacctaagtaatcctacaaagcctctgcagctgtatagacaatggacagatcgcattatggaggagttttttagacagggcgacagagaaagagagagggggatggaaatcagcccaatgtgcgacaaacataacgccagcgtcgaaaagagtcaagtgggatttatcgattatatcgtacacccactgtgggaaacctgggccgatctcgttcatcctgacgctcaggatatactggacactctggaggacaaccgggagtggtaccagagtacaattccacagtcccccagccctgcgcccgatgacccagaggagggacgacagggccagaccgaaaagtttcaatttgaactgacgttggaggaggatggcgagagcgataccgagaaggactctggctcacaagtggaagaagacacttcgtgtagcgatagtaaaacgctgtgtacgcaggattcggaatctactgagattccgctagacgaacaggttgaagaggaggccgttggcgaggaagaggaaagtcagcccgaagcctgtgtaattgatgatagatcgcccgacacttag

SEQ ID NO: 199330 - DNA, 2430 bp, Artificial Sequence
  Description of Artificial Sequence: Synthetic coding sequence
atggaggccgagggcagcagcgcccccgcccgggccggcagcggcgaaggaagcgattccgccggtggggcgacactcaaagctccaaagcatttatggaggcacgagcagcaccatcagtaccctctacgccagccacaatttaggctgctgcatcctcatcaccatctgccaccccccccaccgcccagtccgcagcctcagccacaatgccccctccagccaccgcccccccctcccttgcccccgcctcctcctcctccaggcgcggctaggggtcgctacgcctcaagtggggccaccgggcgagtgcgtcatagaggttactccgacactgaacgctacctctattgcagagctatggaccgcacatcatatgctgttgagaccggccaccgtccgggactaaaaaaaagtcgcatgagctggcccagcagtttccaaggcctgcgccggtttgatgttgacaatggaactagcgccggacgaagcccgctggatcccatgacttctcccggctcaggtcttatcctccaggccaattttgtgcattcacagcgacgggagtcatttctgtaccggtctgactccgactatgacctgtctcccaagtcgatgagtcgtaacagttccattgcaagcgacatccatggagatgacctgatagtgacccctttcgcacaagttctagcgtctttgcggacagtgaggaacaattttgctgccctgacaaatctccaggacagggctcctagcaagaggtccccgatgtgtaatcagcctagtattaacaaggctaccatcacagaagaggcttaccagaaattggcatctgagacgctcgaagagctggactggtgtctcgaccagctggagacattgcagacgcgccatagtgttagcgagatggctagcaacaagttcaagcggatgttaaacagggagttaactcacctctcagagatgagtagatcaggaaaccaggtgagtgagttcatctccaacacattcctggacaaacaacatgaggtggagatcccgagccccacccaaaaggagaaggaaaagaagaagcgccccatgtcacagataagcggcgtgaaaaaactgatgcatagctcttccctgaccaatagcagcataccacggttcggagtaaaaacggaacaggaggacgtgctggccaaggagctggaggacgttaataagtgggggctgcatgtatttagaatcgctgaactatctgggaaccggcccctgaccgtcataatgcacactatctttcaggagcgcgacctcctaaagacattcaagatcccagtagacacgcttattacatacctgatgacactagaggaccactatcacgccgatgtggcttaccacaataacatacacgcagccgatgtggtccagagcacacacgttctcctctctacacccgccctcgaggccgtgtttaccgaccttgaaattctggccgccatctttgcgtcagccattcacgatgtggatcaccctggggtgtctaatcagtttttgatcaatactaattctgagttggccttaatgtacaacgacagttctgttctggaaaaccaccacctggctgtggggtttaaattgttgcaggaggagaactgcgacattttccagaacctcacaaagaagcaacgccagtccttacgaaagatggtgattgacattgttctagccacggatatgtctaagcatatgaatctgcttgccgacctcaaaactatggtcgagacaaagaaggtgacaagctctggcgtattgctgctggataattacagtgataggatccaggtgctgcagaacatggtgcactgtgccgatttgagcaatccgaccaaacccttgcagctgtatcgacagtggacagacaggattatggaggagttctttcgtcagggcgaccgtgagagagagcgtggtatggagataagccccatgtgcgataagcataatgcttcagtggagaaatcacaggttggctttatcgactacatcgtccacccactttgggaaacatgggcggatttggtgcatcccgatgcacaagacatcttagacaccttggaagacaacagggaatggtatcagtctaccattcctcagagcccctctcccgcccccgacgatcccgaagaagggaggcagggccagacagaaaagtttcagtttgaacttactctggaagaggacggtgaatcggacactgaaaaagattccgggagccaagtggaggaggatacatcttgctcagactctaagactctttgtacacaggattctgaaagcacagagatcccacttgacgagcaggtggaggaagaggccgttggggaagaagaggaatcccagccggaggcttgtgtcatcgatgaccggagcccagacacatag

SEQ ID NO: 199331 - DNA, 2037 bp, Artificial Sequence
  Description of Artificial Sequence: Synthetic coding sequence
atgttcatctacagcttcaacaagttcttcttcaagaccacccactgctgggcaataattagttttgacgtggataacggcacatcggccggccgttcgcctcttgaccccatgactagcccgggttccgggttgatcttacaggcaaatttcgtccattcacagcggcgggaatcttttctctacagatcagactccgattacgacctgagccctaaatcaatgtcccgtaacagttccatagcaagtgacattcatggcgatgaccttattgtgactcccttcgctcaagtcttagctagcctgaggaccgttagaaacaattttgccgcgctgacaaaccttcaggaccgcgcaccctcgaagaggagcccaatgtgcaatcagcctagcatcaataaagcgacaattaccgaagaagcctaccagaagctggccagcgaaactctcgaggaattagattggtgcctggatcaactggaaaccctacagacccgccatagcgtgtccgagatggctagcaataaatttaaaagaatgctgaatcgagagctcactcacctatcagagatgagccgctccggaaaccaggtgagcgaattcatctcgaacactttcctagacaaacagcatgaggtcgagatcccaagtccaacacaaaaggaaaaagagaaaaagaaacggccaatgtcacagatctccggggtgaagaagctcatgcattcttctagtttgaccaactcatccatacctcgattcggagtcaaaacagagcaagaagacgtcctggcaaaggaattggaagatgtgaacaaatggggtctgcacgtgtttcgcattgctgagctgtctggcaaccggccccttaccgtcataatgcatacgatttttcaagaaagggacctcttgaaaacattcaagatccccgtggacacgttgatcacctacctgatgactctcgaggaccactaccatgccgatgtggcttaccacaacaacatccacgctgctgacgttgtgcagtccactcacgtgctgctgagcaccccagccctagaagccgtgttcacggatttagagatattagccgccatatttgccagcgccatccatgatgtcgaccacccaggcgtatcaaaccagtttctcattaacacaaatagtgaattagcccttatgtacaacgacagctcggtgctagagaaccaccatcttgctgtcggcttcaagctcttacaggaagagaattgtgatatattccagaatctaaccaaaaagcaacggcagagtctccggaaaatggttattgatattgtcctggctaccgacatgagcaagcatatgaatcttctggccgacctcaagacaatggtagaaacaaagaaggtgacctcatcaggcgtgctcctgctcgacaactacagcgatcggatccaagttctacaaaatatggtccattgcgcagatctgagcaacccaaccaaacccctccagctgtatcggcagtggaccgacaggatcatggaggagttcttccggcaaggggatcgcgagcgggaaaggggcatggagatcagcccaatgtgtgacaaacacaatgcaagcgtcgaaaagagccaggtgggatttatagattacattgtgcatcctctgtgggaaacctgggccgatctggtgcaccccgatgcccaggacatcctggacacactagaggacaaccgggagtggtatcagtccaccattcctcagtccccgtcgccagcccccgacgatcctgaagagggtcgacaggggcagaccgagaagtttcaattcgagttgactcttgaagaagatggagagtcagacaccgaaaaagactccgggtcccaagtggaagaggacacgagttgctcagattcaaagaccctgtgtactcaggacagcgagtcaaccgagatcccactggacgaacaggtggaggaggaggccgtcggcgaggaggaggaaagccaacctgaggcctgtgtgatagacgacaggtctcccgatacctag

SEQ ID NO: 199332 - DNA, 1524 bp, Artificial Sequence
  Description of Artificial Sequence: Synthetic coding sequence
atggccagcaacaagttcaagcggatgctgaaccgggagctgacccacctttcagagatgtctcggagcggaaaccaggtctccgagttcatttccaatacgtttctcgataaacagcacgaagtggagatcccatcgccaactcagaaggaaaaggaaaagaaaaagcggccgatgtctcagatttctggagtgaagaagctgatgcactcatcatccctgacaaacagcagcataccccggttcggcgtgaaaaccgagcaggaggacgtgctggccaaggaacttgaagacgtgaacaaatggggcctgcacgtgttcagaattgctgaactcagcgggaaccggccactgaccgtcattatgcacacaatatttcaggaacgggacctcttaaagaccttcaaaatccccgttgacacccttatcacctacctgatgacactcgaagatcattatcatgcagacgtagcctatcacaacaatattcatgctgctgacgtcgtccagtctactcatgtgttgttatctaccccggcactggaagctgtgttcaccgacctggaaattctcgcagctatctttgcctccgctatccatgacgtggaccatcctggagtcagtaaccagttcttgattaacaccaatagtgaacttgctctgatgtacaatgacagttcagtgttagagaaccaccatctggctgttggtttcaagctgcttcaggaagagaattgtgatatatttcaaaatctcactaagaagcagaggcagtccttgcgcaaaatggtcatcgacatcgtgctggccaccgacatgagtaaacacatgaaccttctcgcagatctgaagactatggtggagaccaagaaggtgacttccagtggcgtgctcctgctggacaattactcagacagaatacaggtactccagaatatggtgcactgtgccgatctgtcaaaccctaccaaacctctacaactatatagacaatggactgacagaataatggaggagttcttccggcagggagatcgggaacgcgaacgggggatggaaatttcgcccatgtgtgataagcacaacgcgagtgttgaaaaatcccaggttgggttcatcgactacatcgttcatcccctgtgggaaacctgggcggatctggttcatcctgacgcacaggacattctggatacactggaggataacagggaatggtaccagtcgaccatcccgcagtcacccagcccggcacccgatgatcctgaagaaggccgccagggtcagaccgagaaattccagttcgagttgaccctggaggaagacggcgagtctgataccgaaaaggattcaggctcccaggtggaagaggacacttcatgctcagactctaagactctgtgtacacaggacagtgagtccaccgagattcctctggatgagcaggtcgaagaagaagcagttggcgaggaggaggagagccagccggaagcttgtgtaatagacgacaggtcccctgacacttag

SEQ ID NO: 199333 - DNA, 2022 bp, Artificial Sequence
  Description of Artificial Sequence: Synthetic coding sequence
atgatgcacgtgaacaacttccccttccggcggcacagctggatctgcttcgatgtcgacaacgggacctccgcaggacgaagcccacttgaccctatgacttcccccggctctggcctgattctgcaggcaaatttcgtgcacagccagcggcgggaaagctttctgtacaggtctgattctgattacgatctgagtcctaagagcatgtctcgcaactctagtatcgctagcgatatccatggggacgacctaattgttactccattcgcgcaggttttggccagtcttaggaccgtccggaacaattttgcggcccttaccaatctgcaggatcgtgctccttcaaagcgctcacccatgtgtaatcagccatctatcaacaaggccaccattaccgaggaagcttatcagaaactagccagcgagacactcgaagaattggactggtgtctcgaccagctggagactctgcagacaagacacagtgtctctgaaatggcgtctaataagttcaagcggatgctgaaccgggaactcactcacttaagtgagatgagcaggtcgggtaatcaggtcagtgaatttattagtaacacctttctggataagcagcacgaagtggaaatcccctcaccaactcaaaaagaaaaggagaagaagaagcgtccaatgagtcagattagtggcgttaaaaagctaatgcattcatcctccctgacaaattcatcaatcccccggttcggcgtgaagacggaacaggaggacgttttggcgaaagagcttgaagatgtcaacaaatggggcctgcacgtatttagaattgccgaactgagtggcaataggcctctcaccgtcatcatgcacaccatattccaagagcgcgacttattaaagaccttcaagatccctgtggacaccttaatcacctacctaatgacattagaggatcattaccacgccgatgtcgcctaccacaataatatacacgcagctgacgttgtccaatctacccatgtgctcctctcgactcctgctcttgaagcagtgttcaccgacctggaaatccttgctgccatcttcgcttcagccatacacgacgtggaccatccaggtgtctccaatcaatttctgattaacaccaattccgagcttgcgctgatgtataatgatagctccgtgctggaaaaccaccatctggccgtaggctttaaactgctacaggaagagaactgtgacatctttcagaacttaacaaagaagcagagacagagtctgagaaaaatggttatagatatcgtcctagcaaccgacatgagtaaacacatgaacctgctcgcagacctgaagacaatggtggaaaccaaaaaggtaacgagctccggtgtcttactgctcgataattattccgatcgcattcaggtcctgcaaaatatggtccattgcgcagacctgtccaatcccacaaaacctctgcaactatatcgccagtggacagatcgaattatggaagaatttttccgccaaggcgatcgcgagagagagagaggcatggaaatttccccgatgtgcgacaaacacaacgcttccgtggagaaaagccaggtgggattcatcgactacatcgtgcatcctctatgggaaacctgggcagacctggtgcaccctgacgctcaggatattctagacacactggaggataatcgggagtggtaccagagcaccatcccccagtcgccatctcctgccccagacgaccccgaggaaggacggcagggccagaccgagaagttccagttcgaactcaccttggaagaggacggagagtcggataccgagaaggacagcggcagtcaggtcgaggaggatacatcctgtagcgatagcaaaacgttgtgtacacaggattctgaatccacggagatacccctggacgaacaggtcgaagaggaggcagtgggtgaggaagaggaatcacagccggaggcctgcgtgattgatgaccgctctcccgacacctag

SEQ ID NO: 199334 - DNA, 2064 bp, Artificial Sequence
  Description of Artificial Sequence: Synthetic coding sequence
atggccttcgtgtgggaccccctgggcgccaccgtgcccggcccctcgacacgcgccaaaagcaggctgagattctccaagagctactcctttgacgtcgacaatggaacctctgccggccgcagccctttggatccaatgacctcaccaggctcagggctgattcttcaggccaacttcgtgcactcacagcgtcgcgaaagcttcctctatcgtagcgattcagactatgacctgtcgcctaagtctatgtcacgcaatagctctattgcatccgatatccatggcgacgaccttatagtgacaccatttgcccaggttctggcctccttacgcaccgtgaggaacaactttgccgctcttactaatttacaggacagggctccgtctaagaggtctcccatgtgcaatcagccttccattaataaagctaccattactgaggaagcttaccaaaagttagcaagtgaaacgttggaagagttggattggtgtctggaccagctggagacgctccagacgagacattccgtctctgagatggccagcaataagttcaagagaatgctaaatcgggaactaacgcatctctctgaaatgtcgagatctgggaatcaggtgagcgagttcatctccaacacgttcttagacaagcagcatgaggttgagattcctagcccaactcaaaaggagaaggagaagaagaaaaggcctatgtctcaaatctccggagtcaagaaactaatgcatagcagttcactcacaaatagttcaatcccccgatttggggtgaagacagagcaagaggatgtgttggccaaagaactcgaggatgtgaacaagtgggggcttcacgttttcagaatcgctgagctgtcgggaaaccggcccctgaccgtcatcatgcacacaattttccaggagcgcgatctgttaaagaccttcaaaatcccagtcgatacactcatcacgtatcttatgaccctcgaagatcactaccacgctgatgtcgcatatcacaacaacatacatgctgctgacgtggtgcagtctacgcatgttctactatcaactcccgctcttgaggctgtctttacagatttggaaattctcgccgcaattttcgcaagcgcgattcatgatgtggaccaccccggtgtgtcgaatcagttccttatcaacacaaactctgaactggctctgatgtataacgactcttctgtacttgagaaccaccacttggctgtgggatttaaactgctgcaagaggagaattgcgatattttccaaaatctcactaaaaagcagcgtcagagtttgaggaaaatggtgattgatattgtgctggcaacagatatgagcaagcatatgaatctgctggcagacctgaagacaatggtggagaccaaaaaagttacatcgagtggtgtcttgcttctggacaactactccgatcgaatccaggtgcttcaaaacatggtccattgcgccgatttaagcaatcccacaaaacccctccaactgtaccgccagtggacagatcggatcatggaggaattctttagacagggggacagggaacgcgaacgtgggatggaaattagcccaatgtgcgacaaacataacgcttctgttgaaaaaagccaagtgggatttatcgattatattgtacacccactgtgggaaacttgggccgatcttgtacatcccgacgctcaggatatcctggatacgctggaagacaatcgtgaatggtaccagagcacgattccacagtctccatcacccgcccccgacgacccagaagaggggagacaggggcaaacagaaaagtttcaattcgaactcactttggaggaagacggtgaaagcgacactgagaaagattctgggtcccaggtggaggaggacactagttgcagcgattctaagactctgtgtacccaagatagtgagtccactgaaattccattggacgagcaggtcgaagaagaggctgtgggggaggaggaggagtctcaacccgaagcctgtgttatcgatgaccgcagtcccgatacctag

SEQ ID NO: 199335 - DNA, 2247 bp, Artificial Sequence
  Description of Artificial Sequence: Synthetic coding sequence
atgaagcggaacacctgcgacctgctgagccggagcaagagcgcctcagaggaaactctccactcaagcaacgaggaggaggacccgtttagggggatggagccatacctcgtgaggagactgtcctgtaggaatattcagcttcccccactcgcgtttcgccagctcgagcaggctgatttgaagtctgaatccgaaaacattcaaaggcccaccagtctgccacttaaaatcctccccctcattgcaatcaccagtgctgaaagcagcgggtttgacgtggataatggaacatctgccggacggtcccccctggacccaatgacgagccctggcagcggactcattctgcaagccaatttcgttcactcacagagacgcgaatcctttctttatcggtccgactccgactatgacctgtccccaaagagcatgtcccgcaactcgtccatagcctcagatatacatggtgacgaccttatagtgaccccctttgctcaggtcctggcatccctccgaacggtgcgcaacaattttgctgctctcactaacctgcaggaccgcgcacccagtaaaaggagcccgatgtgcaatcagccgagcattaacaaagcaaccattacggaggaggcctatcaaaaactggcttcagaaactctcgaagagttagattggtgtctcgaccaattggaaaccttgcagacccgccactcggtgagcgaaatggcctctaacaagttcaagcgcatgttaaatcgtgagctaacacacttatcagaaatgtccagatcaggcaaccaggtgtctgagttcatatcaaacacattcctcgacaagcagcatgaggtcgagataccatctcccacacaaaaggagaaggagaaaaagaaacgaccaatgtcgcaaatctccggagtgaaaaagcttatgcacagctcatccctgacaaactcctcaatccctcgctttggtgtgaagactgagcaggaggatgtgctcgccaaggaattggaagacgtcaacaagtgggggctgcacgtcttccggattgcagagctgtctgggaatcgcccacttacagtgattatgcatacaattttccaggagagggacttgctgaaaacattcaaaattcccgttgacacactaatcacatacctgatgacgctggaggatcattaccatgccgatgtggcataccataataatatacacgccgctgatgtcgtccagtctacccatgttctcctgtccacccccgccctcgaggcagtatttaccgacctggaaatcctcgccgctatattcgcttctgctattcatgatgttgaccacccaggagtgtccaaccaattcctaatcaacaccaacagtgagcttgccctgatgtataatgattcaagcgtgttagaaaatcaccacctggctgttgggttcaagctgctacaggaggaaaactgcgacatcttccagaacctcactaagaagcagaggcaatctctgcggaaaatggtgatcgacattgtcctagccacagatatgtcgaaacacatgaacctgctggccgacctaaagaccatggtggaaactaaaaaggtcacgtctagcggagtgctccttctggataattacagcgatcgtatccaagtccttcagaatatggtgcattgtgcagatctgtccaatcccacaaaaccccttcagctgtatcgccaatggacagacaggataatggaagagttctttaggcagggcgatcgggagcgcgagcgcgggatggagatctcccccatgtgcgataaacataacgctagcgtagaaaagagccaggtgggcttcatagattatatcgtgcatcccctgtgggagacctgggcggatctggtgcatcccgatgctcaggacattcttgatacgctagaggacaatagagaatggtatcagagcaccataccgcaatctccatcccctgccccagacgatccagaggagggaaggcagggccagactgaaaaatttcagttcgaactgacgctagaagaggacggagagagcgacacagaaaaggactccggctcccaggtcgaggaggacacatcctgctcagactcaaagaccctgtgcacccaagattctgagagcactgaaatccctctcgacgaacaggtcgaagaagaagccgtgggtgaagaagaggaatcacagcctgaggcctgtgtgattgatgaccggtcacccgacacctag

SEQ ID NO: 199336 - DNA, 660 bp, Artificial Sequence
  Description of Artificial Sequence: Synthetic coding sequence
atggcccagcagaccagccccgacaccctgaccgtgcccgaggtggataaccctcattgcccaaatccttggctcaatgaagaccttgtaaagagcctacgggagaacctactccagcatgagaagtcaaaaaccgccagaaagtccgtttctcccaaactgagccccgtgatttcccccagaaacagcccaagactcctcagacggatgctgcttagttcgaacatccccaaacaaagaaggttcactgtcgctcacacttgcttcgacgtggataacggcaccagtgctggccggagcccgttggaccctatgacaagccccgggtccggactgattctgcaagccaatttcgtgcactctcaacgcagagaaagctttctttacagaagtgacagcgattatgacctctctcccaagagcatgtcccgcaatagttctattgcttctgatatccatggggatgatttgatcgttacaccatttgcacaagtgcttgcatcactccgaactgttcggaacaacttcgcagcactgactaacttacaggaccgggcccccagcaaacgatccccaatgtgcaaccaaccttctattaacaaagccacaataactgggtcatggatggaacttaacccctacaccttgctggatatgtag

SEQ ID NO: 199337 - DNA, 2040 bp, Artificial Sequence
  Description of Artificial Sequence: Synthetic coding sequence
atgagcatcatcatgaagccccggagccggagcaccagcagcctgcggacggctgaggccgtgtgctttgatgttgataatgggacaagtgccggtcgtagtccactggacccaatgacctcacctggctccggcctcattctgcaggcaaattttgttcatagccagaggcgagaaagcttcttatacagatccgacagcgattacgacctatccccaaagagcatgtcccgtaactcctcaatcgcttcggatatccacggtgatgacttaatcgttactccctttgcccaggtgctggcatctctgaggaccgttcggaataatttcgcggccctcaccaatttgcaggaccgggccccttccaagagatcccctatgtgcaaccagccctcaataaataaggccactataacagaggaggcctaccaaaaactcgcttccgagaccttggaggagcttgattggtgtttagaccaactcgaaacgctacagacccgtcattctgtgtctgagatggccagtaacaagttcaagaggatgctgaatcgggagctgactcacctgtctgaaatgagcaggtcagggaatcaggtctcagaattcatcagcaacaccttcctcgacaagcagcatgaagtggaaattccttcacctacacagaaggaaaaggagaagaagaaaagaccaatgtcacaaatttccggagtaaaaaagttaatgcactctagttccctgacaaatagtagtattcctaggtttggagttaagactgagcaggaggacgtcttagctaaggaactggaggacgtcaataagtgggggttacacgtgtttaggatcgcggagttgtctggaaataggccactcactgtcattatgcacaccatctttcaagagcgggacctgcttaagacattcaaaattcctgttgacacgctgattacctacctaatgactttagaagaccattaccacgccgatgtcgcataccataataatatccatgccgcagatgtggttcaatcaacgcatgtgctcctgtctacacccgctctggaagcagtgtttaccgacttggagattctggctgcgatatttgcatccgccatacacgacgtggaccatcctggtgtaagcaatcagtttctgattaatactaacagcgagctcgctctcatgtataatgatagtagcgtcttggaaaaccaccatctggcagtcgggtttaagctattgcaggaggaaaactgtgacatcttccagaacttgactaagaagcagcggcagtccttgagaaaaatggtcatcgatattgtgttggcaacagacatgtcgaagcatatgaatctgctggccgacctcaaaaccatggtggagacgaaaaaggtgaccagctccggcgtgttacttttggacaactacagcgatcgcattcaagttctgcaaaatatggtgcactgtgcggacctgagtaacccaaccaaacctctgcagctgtatagacagtggaccgaccgcattatggaagagttctttaggcaaggcgacagagagcgggaaaggggtatggagataagtcctatgtgtgacaaacacaacgcgtccgtggaaaagagtcaagtggggttcatcgattatatcgtccaccctctgtgggagacatgggctgatttggtccatcctgacgcgcaggacatcctcgacacccttgaggataaccgcgagtggtatcagagcaccattccccagtcacctagccccgcccccgacgaccctgaggaagggcgacagggccagactgagaaattccagtttgagcttaccctagaagaggacggtgagtccgacaccgaaaaggacagcggcagccaggtggaggaggatacatcatgcagcgatagtaaaactctgtgtacacaggactctgaatctaccgagatcccgctggatgaacaggtcgaggaggaggccgtgggcgaggaggaagaatcccaaccagaggcctgtgtgatcgacgacaggtcgccagacacttag

SEQ ID NO: 199338 - DNA, 1269 bp, Artificial Sequence
  Description of Artificial Sequence: Synthetic coding sequence
atggccagcaacaagttcaagcggatgctgaaccgggagctgacccacctgtccgagatgagccgatctggaaaccaggtgtcagagttcatctccaacacgttcttggacaaacagcatgaggtagaaattccaagccccacccagaaagaaaaagagaaaaaaaagagaccgatgagtcagattagcggcgttaaaaagctcatgcattcctcttcattgacaaattcaagtataccgcgtttcggcgtaaaaacagagcaggaagatgtgctggcaaaagagctggaagatgtcaataagtgggggctacacgtatttagaatagcagagctgtccggaaatcggccactgaccgtcattatgcacacaatctttcaggagagagatcttctcaagaccttcaagatccctgtggatactcttatcacataccttatgaccctggaggatcactaccatgccgacgtagcataccataacaatatccacgcggcggatgtcgtgcagagcacacacgttctgctttccacccctgccttagaagccgtgtttactgacctggagatcttagctgctatcttcgccagcgctatccacgacgtcgaccatcccggcgtttctaaccagttccttattaataccaatagcgagcttgccctcatgtataacgatagctccgtgctggagaatcaccacctggccgttggcttcaaactgttgcaggaggaaaactgcgacatctttcagaacttgacgaaaaaacaacggcagagcctgagaaagatggtgatcgacattgttctcgccaccgatatgagtaagcacatgaacctcctggccgatctcaaaactatggttgagaccaagaaggttacctcctcgggagtgctccttttggacaactattctgatagaatccaggtcctgcagaatatggttcattgcgccgacctgtctaatccaaccaagccccttcaactgtaccgtcagtggaccgaccggatcatggaagaattctttaggcagggtgatcgtgagagagagcgcggtatggaaatttcgccgatgtgcgacaaacacaacgcaagcgtagagaaatcgcaggtcggcttcatcgattacattgtccaccccctgtgggagacttgggcagacctggtgcacccagatgcccaggacattctggacacactggaggacaatagggagtggtatcagtcaaccatcccccagtcccccagcccggctccagacgatccagagtag

SEQ ID NO: 199339 - DNA, 246 bp, Artificial Sequence
  Description of Artificial Sequence: Synthetic coding sequence
atgaagcggaacacctgcgacctgctgagccggagcaagagcgccagcgaggagacactgcattcctccaatgaagaagaagacccgtttcggggtatggagccttatctcgtacgacgcctgagctgcagaaatatccagcttccccctcttgctttccgccagctggagcaagctgacctaaaaagcgagtccgaaaatatccagcgccctacatccctgccgctgaagattctccctctctag

SEQ ID NO: 199340 - DNA, 2238 bp, Artificial Sequence
  Description of Artificial Sequence: Synthetic coding sequence
atggcccagcagaccagccccgacaccctgaccgtgcccgaggtggacaaccctcattgccccaacccatggctgaatgaggatctcgtgaaatcgctgagagaaaacctgctgcagcatgaaaagagcaagaccgcacgcaagagcgtgtctcctaagctgtctccagtaatctccccccggaattctccaaggcttctgaggcggatgttgctgagctctaatattcccaaacagcggcgcttcactgttgcccatacatgctttgacgtggacaacggtacaagcgctgggagatcccccctggacccgatgacaagccctggcagcggccttatactgcaggccaacttcgtccatagtcagcggagggagtcatttttgtacagatccgattccgactatgacctcagtcccaaatccatgtcaagaaactccagtatcgcaagcgacattcatggtgacgacctcatcgtgacgcccttcgctcaggtactcgcgtctctgagaacggtgcgcaataacttcgccgccttgacaaatttacaggatagagctccgtcaaaacgctcccccatgtgcaatcagccctctataaataaagccacaattacggaggaagcataccagaagctcgcctccgagacgctcgaagagttagactggtgcttagaccagttggagactctccagacacggcatagtgtgtctgagatggcctctaataagttcaagcgcatgcttaacagagaattaacacacctgtctgaaatgtcccgctctggtaaccaggtgtctgagttcatctccaatacctttctagataagcagcacgaagtggagattccttcaccgacccaaaaggaaaaagaaaagaaaaaacggcccatgtcccaaatcagtggcgtgaaaaaactgatgcacagctctagcttgaccaacagttccatccctcgctttggtgtgaagacagaacaggaggacgtgttggccaaggaattggaggatgtcaacaagtggggtctgcacgtcttcagaattgctgaattatcagggaacaggcccctaaccgttatcatgcacaccatttttcaggaacgggacctgctgaaaacatttaagattcctgtagatactctcatcacatatctgatgacgctggaggatcactaccacgcagatgtcgcttaccacaacaacatccatgctgcagacgtggtgcagagtacacacgttctgctcagcacacccgcgctcgaggccgtgttcaccgatttagaaatcctggccgccatatttgcaagcgccattcacgacgtcgaccacccaggagtaagcaatcagtttctgatcaacacaaactcagagttagctctgatgtacaacgactcctcagtcctggagaatcatcatctcgctgttggcttcaaattactccaggaagaaaactgtgatatcttccagaacctgactaaaaagcagcgccagtccctcaggaagatggttattgacattgtactggctacagacatgagcaagcacatgaacctgctggccgatctaaaaactatggttgagactaagaaagtcaccagttcaggtgtactgctgcttgacaattactctgaccggattcaggtgttacaaaacatggtacactgcgcggatcttagtaatccaaccaaaccactacaactgtaccgccagtggacagatcgtattatggaggaattcttccggcagggggatcgggagagggagaggggtatggagatttcaccaatgtgcgacaagcacaacgcgtccgttgagaaaagccaggtggggtttatcgattatatcgttcatccgttatgggaaacttgggctgatctcgttcatcccgatgcacaggacatcttagataccttagaggataatagggagtggtaccagtcgacgataccccagtctcctagtcctgcaccggatgacccagaagagggcagacagggtcagaccgagaagttccaattcgaattgacgctagaagaagacggcgagtctgataccgaaaaagacagtgggagtcaggtggaagaagacacatcatgctccgactcaaaaactctctgcacacaggatagtgagtctacggaaatccctttagatgagcaggttgaggaagaggccgtgggggaggaggaggagtctcagcccgaggcctgtgtgatcgacgacaggtcccctgacacttag

SEQ ID NO: 199341 - DNA, 228 bp, Artificial Sequence
  Description of Artificial Sequence: Synthetic coding sequence
atgaagcggaacacctgcgacctgctgagccggagcaagagcgcctcagaggagacactccactctagtaacgaggaagaagatcctttcagagggatggagccttatctcgtgaggagactgtcttgcagaaacattcagctccctccgctggccttccgccaactggaacaagcggatctcaagtccgagtctgaaaatatccagcgtcccactagccttccatag

SEQ ID NO: 199342 - DNA, 2247 bp, Artificial Sequence
  Description of Artificial Sequence: Synthetic coding sequence
atgaagcggaacacctgcgacctgctgagccggagcaagagcgcctctgaggagactctgcacagttccaacgaggaggaagaccccttccgaggaatggagccgtaccttgttagaagactgtcatgcagaaacatccagctccctccattagcttttagacagttggagcaggcagacctcaagtctgagtcagagaatattcagaggcccacaagcctgcccttaaagatcctgccgttaatcgccatcacctctgcagagtcatccggatttgacgtggacaatggtaccagtgcggggcgatccccactggaccccatgactagccccgggagtggactgatcttgcaagccaatttcgtgcattcgcagcggagggaatcatttttgtaccgtagcgattctgattacgatctgagccccaagagtatgtccaggaactcaagcatcgcatctgatatacatggggatgatcttattgtcaccccattcgcccaggtccttgctagcctcagaacggtacgcaacaacttcgcggcactgaccaacctgcaagaccgcgcccccagcaaaaggtctccaatgtgtaatcagccatctataaacaaggcaacaatcaccgaagaggcttaccaaaagttggcttcagaaacactagaagaactggactggtgtctggaccagctagagacattgcaaaccagacacagcgtaagtgaaatggctagcaacaaattcaagagaatgctcaaccgggagctgacccatctgtctgagatgtctaggtcaggtaaccaggtgagcgaattcatttctaacacattcctggacaaacagcacgaggtcgagattcccagtccaacccagaaagagaaggagaaaaagaaaaggccaatgtcacagattagcggtgttaagaaactgatgcatagctcctccctcacaaactccagtatccccaggttcggggtgaaaaccgagcaagaggacgttttggcaaaagaactggaggatgtgaacaaatggggcttacacgtgttccggattgcagagctctcaggcaacagacccctgactgtaattatgcataccatattccaggagcgcgacctgctgaaaacctttaaaattcccgtcgacacactgattacctatctgatgacgctggaggaccactaccacgccgacgtggcgtaccacaataatattcacgccgctgatgttgttcagagtacgcacgtcctgctgagcacaccggcactggaggccgtatttacagatctcgaaattcttgctgcaatcttcgcttcagccattcacgatgtcgatcatcctggcgtgtccaaccaattcctcatcaacacaaacagcgagctggctcttatgtacaatgattcttctgtcctagagaatcatcacctagctgtaggatttaagcttctacaagaggagaattgcgacatcttccagaacctcacaaaaaagcaacggcagtccctgcgaaaaatggttatcgacatagtgctggctaccgatatgtccaagcatatgaatttgctcgccgacttaaaaactatggttgaaactaagaaagtaacgtcttcaggagtgctgctccttgataattacagcgaccgcattcaggtgttgcaaaatatggtgcattgcgctgacctttccaacccaacaaagcccctacagctgtacaggcagtggacagacagaatcatggaagaattcttcaggcagggggacagggaaagggaacgggggatggaaatttcgccaatgtgtgataaacacaacgcctcagtcgaaaaaagccaagttggatttatagattacatcgtgcaccccttgtgggaaacttgggctgacttagtgcacccagatgctcaggacatcctggatacactcgaagacaatcgggagtggtaccagtccacaatccctcagtctccctccccagcacctgacgacccagaggagggtagacaaggccagacggaaaagttccagtttgagcttacgctggaagaggatggagagagcgacacagaaaaggacagcggctcccaggtggaagaggatacttcttgctctgattccaaaactctctgtacccaggactctgagagcaccgagattcctctggatgagcaggttgaggaagaagctgtcggggaggaagaggagtctcagcccgaagcatgtgttatagacgacaggagccctgacacttag

SEQ ID NO: 199343 - DNA, 2502 bp, Artificial Sequence
  Description of Artificial Sequence: Synthetic coding sequence
atgctgcccttcggcgacaagacccgggagatggtgaacgcctggtttgccgagagggtacacactatcccagtttgtaaggaggggatacgcgggcacaccgaatcctgttcttgtcccttacagcagtctcctcgagccgataattccgcgcccggtacgccgacacgtaaaatttccgcttctgagtttgatagaccccttcgacctatcgtcgtgaaggattcagaaggcacggtgtcctttttgtccgattccgagaaaaaagaacagatgccactgaccccccctagatttgatcatgacgaaggagatcagtgctctagactgctggagctagtgaaggatattagttcacacctagacgtgacagccctgtgccacaaaatcttcctacacatacacggactcatcagcgcagacagatatagcctgtttttggtttgtgaggattcctcaaacgataagttccttataagccgcctgttcgacgtcgccgaggggtccaccctcgaagaagtcagcaacaattgtattagactggagtggaacaaggggattgtgggtcatgtcgccgccctcggtgaacctctgaatatcaaggacgcctatgaagatccacggttcaacgcagaggtggaccaaataacgggctataaaacgcaatcaatactttgcatgcccatcaaaaaccacagggaagaggtggtgggcgtggcacaggccataaataagaaatctggtaatgggggcacctttaccgagaaagacgagaaagacttcgcagcctatctcgcattctgcggcatcgtgcttcacaacgctcagttatatgagacgagtctcctggagaacaaaaggaaccaggttctgctcgatttggcgagcctgatctttgaagaacagcaatcactggaggttatcctcaagaagatcgcagcgaccatcatcagcttcatgcaggttcagaaatgcacaatctttattgttgacgaggattgctctgattcattcagtagcgtgtttcacatggagtgcgaagaactcgaaaaatctagcgataccctcactcgtgaacacgatgctaacaaaataaactatatgtacgctcagtatgttaagaacacgatggagccactcaacatcccagatgtgtctaaagacaaaaggtttccatggacaaccgagaataccgggaatgtgaatcagcagtgcatccgctcgctgctttgcactcctataaaaaatggtaagaagaacaaggtcatcggcgtttgccaactggtaaataagatggaggagaatactggcaaagtcaagccgttcaataggaatgacgagcagttcctcgaggcctttgtgatcttctgcggcctggggattcagaacacccagatgtacgaggccgtggagagggcaatggcaaagcagatggtgactttggaggttcttagctatcacgcctctgctgcagaagaagaaaccagggaactacagtctcttgcggcagctgtggtcccttctgcccagacacttaaaatcacggatttctccttcagcgatttcgagttgagcgatttggagactgccctgtgcacaatcaggatgtttaccgacctcaaccttgtgcagaactttcaaatgaagcatgaagttctatgccggtggattctgtccgtcaagaagaattacagaaaaaatgtggcttatcataattggaggcacgcatttaacaccgcccaatgtatgttcgctgcgctgaaggctggaaagatccagaacaagttgaccgatctagagattctggctcttcttatcgcggcacttagccacgacttagatcacaggggcgtaaataatagttatatccagagaagtgagcatcctcttgcccagctgtactgccacagcattatggagcatcatcacttcgatcagtgccttatgatattgaactcccctggcaatcagatcctttccggactgtcaatagaggagtataaaaccacactcaagatcataaaacaggcaatactggccacagacctggccctctacatcaagcggaggggggaattctttgaactgatacggaagaaccagttcaatctggaggacccccaccagaaggagctcttcctcgcgatgctgatgaccgcctgcgacctgtccgccatcacaaagccttggcctatccagcagcgaatagctgagctggtggccacggaattcttcgaccagggagaccgtgaacggaaagagctcaacatcgagccaactgatctgatgaaccgggagaaaaaaaacaagattcccagcatgcaggttggctttatagatgcgatctgtttgcagctctacgaagccttgacccacgtgtctgaggactgcttcccgcttctcgacgggtgccgaaaaaataggcagaagtggcaggccctggccgagcagcaggaaaagatgctcattaacggtgagtcaggacaagccaaaagaaactag

SEQ ID NO: 199344 - DNA, 2628 bp, Artificial Sequence
  Description of Artificial Sequence: Synthetic coding sequence
atggagcgggccggccccagcttcggccagcagcggcagcagcagcagcctcaacaacagaagcaacagcaacgtgatcaagattccgtggaggcctggttagacgatcattgggattttactttttcatattttgtgcgaaaggcgacgagagagatggttaatgcatggtttgcggaacgtgtccacaccatccctgtttgtaaagaggggattagagggcataccgaatcctgtagttgccctctccagcagtcccctagagcggataactccgcccccggaacacctaccaggaagatctcggcatctgagttcgatagaccattgcgccctattgtggtgaaagactcagagggaaccgtgtcctttctctctgactctgaaaaaaaggagcagatgccccttactcctccacgctttgaccacgacgagggggaccagtgctctcggctcctggagctggttaaggatataagtagccacttggacgtgactgccctttgccacaagatctttcttcacattcacgggctgatatccgcggatcgctatagtctgtttttagtgtgtgaagattcctctaacgacaagtttctaattagtcgccttttcgacgtagcagaaggctccacactcgaagaggtgtctaacaactgtatccgcctggagtggaataaaggcatcgtcggccacgtcgccgctctcggagaacctctgaacatcaaagatgcctacgaggacccccgttttaatgcagaggtggaccaaatcacagggtataagacacagtccattctctgcatgccgattaagaaccaccgtgaagaggtggtcggggtggctcaagccatcaataaaaaatctggaaacggaggtactttcacagaaaaagatgagaaagatttcgcagcctacctggcattttgtggaatagtgcttcacaacgctcaactctacgagacaagtctcctggaaaataagcgcaaccaagttctgttggatctggcatctctaatttttgaagagcagcaatctctggaagtgattctgaagaaaatcgcagccacgattatctcttttatgcaggttcagaaatgtaccatcttcattgtcgatgaggactgcagcgacagtttctcgtccgtgttccatatggaatgtgaggagttggagaagagtagtgatacactgacgcgcgagcacgacgccaacaagatcaattacatgtacgcccagtacgtaaagaacacaatggagcccctgaatattcctgacgtctcaaaggacaagcggttcccatggaccactgagaataccggcaatgtgaatcagcaatgtattaggagcctgctgtgtaccccgataaaaaatggaaaaaagaataaagtgataggggtatgccagttggtgaataagatggaggaaaataccggaaaggttaagccttttaatagaaacgatgagcaattcctcgaagctttcgtgatcttttgcgggctgggcatacagaacacacaaatgtatgaagctgtggaacgagctatggctaagcagatggtgactctcgaagtccttagttaccacgcttccgctgcagaggaagaaacaagggaacttcagagcctggcagcggctgtggtgcccagcgcgcagacccttaagatcacagacttttccttttctgattttgagctgagcgatcttgaaactgcactatgtacaattcgaatgtttacagatctgaatcttgtccagaatttccagatgaagcatgaagtgctgtgtaggtggattctgtccgtcaaaaagaactatagaaagaacgtcgcttaccacaactggcggcacgccttcaacacggcgcagtgtatgttcgcggctctgaaggccggaaagatccagaacaagctcactgatctggaaatcctcgctctcctgatcgcggcccttagccatgatctggatcataggggcgtcaataactcttacattcagagaagcgagcatccattagctcagctttattgtcatagcatcatggaacatcaccacttcgaccaatgtttgatgattctgaacagtccgggtaatcagatcctgagcggtctgagtatcgaggaatataagaccacactgaaaatcattaagcaagcgattctggctacagatctcgctctgtatataaaacgacgcggtgaattcttcgagttaatccgcaaaaaccagttcaatctggaggacccgcaccaaaaagagctctttctggcaatgctcatgactgcatgcgatctgagtgctattacaaagccctggcccatccagcagagaattgcagagctcgtcgccaccgagtttttcgaccaaggtgaccgggagcgaaaggaactcaacatcgagcctacagacctgatgaaccgggaaaagaaaaataagatacctagcatgcaggtggggtttatagacgcaatatgtcttcagttgtacgaggcattgactcatgtgtctgaggactgctttcctttgctggacgggtgccgtaaaaatcgccagaagtggcaagctcttgctgagcagcaggagaaaatgctgatcaacggcgagagcgggcaggctaaacggaactag

SEQ ID NO: 199345 - DNA, 2472 bp, Artificial Sequence
  Description of Artificial Sequence: Synthetic coding sequence
atggtgaacgcctggttcgccgagcgggtgcacaccatccccgtgtgtaaagaagggatacgaggccacacagagagctgctcttgtccactgcagcagagccctagagcagacaactcggctccaggtacccccactcgaaagatatctgcctctgagtttgaccgtcccctccgcccgattgttgtgaaagactccgagggaactgtgtcattcttatcagacagtgagaagaaagagcagatgcctctgacgcctccacgctttgaccatgacgaaggtgatcagtgcagccgcctactggagcttgtaaaagacattagttctcatttggacgtgactgcactctgtcacaaaattttccttcacatacatgggctgatttctgccgacaggtatagcttgtttttagtgtgcgaagactcctctaatgacaaattcctgatttccaggctgtttgacgtagctgagggaagtactctcgaggaagtcagcaacaattgtatacgtctggagtggaacaagggaatcgtggggcatgtggctgccctcggggagcccctgaacataaaagatgcctacgaagaccctagatttaatgctgaggttgaccaaattacaggctacaagacccagagcatcctgtgtatgcctattaaaaaccaccgcgaagaagtggtgggcgtggcacaggccattaataagaagagcgggaatggaggcaccttcacagaaaaagacgagaaggactttgctgcatacctggcattctgtgggatcgttctgcacaacgcccagttatacgagacaagcttattagaaaataaaagaaatcaagtgcttctggacctcgcctctttgattttcgaagaacagcagtctctcgaggttatcctgaaaaagattgccgccacaatcatttcattcatgcaagtacagaagtgtaccatcttcatcgttgacgaggattgctctgactcattctcgtccgtgtttcacatggagtgcgaagagctggagaaaagctcagacactctaacacgggagcacgacgcaaacaagataaattacatgtacgcgcaatatgtcaaaaatacgatggaaccactgaatatccccgatgtgagtaaggacaagagattcccctggacgactgagaacacaggcaatgtgaatcaacagtgcatacgcagtctgttgtgtacccccatcaaaaacgggaaaaagaataaggtgatcggagtgtgccagctggttaacaagatggaagaaaacaccggaaaagtgaaacccttcaatcgtaacgatgagcagtttctggaggcctttgtgattttctgtggactcgggattcagaacactcagatgtacgaggcagtagagagagccatggccaagcagatggtgacgctggaagtcttgagctaccacgccagtgctgctgaagaggaaacacgagaattgcagagtctggccgccgcagtggtgccatccgctcagaccctgaagattacagatttctcgttctcagacttcgagctaagcgacctcgaaaccgctctgtgcacaattaggatgttcacagacctcaacctcgtccagaatttccagatgaagcatgaagtcctgtgcaggtggattctcagcgtgaagaagaactaccggaaaaacgttgcatatcacaactggaggcatgcattcaataccgcccagtgtatgttcgcggcgctaaaagccgggaagattcagaataaactgactgatttggagattctggcattgttaatcgccgccctctcccacgacttggatcaccggggtgtcaacaacagttacatccagcgtagtgaacatcctcttgcccagctttactgtcacagcattatggaacaccatcacttcgaccagtgcctcatgatcctgaactcacccggaaaccaaatcctgtccggactttccattgaggagtacaaaacaacactgaagataatcaagcaagctattcttgccaccgacttggccctgtatatcaaaagaaggggagagttcttcgagttgatccggaagaaccagtttaacttggaggacccccaccagaaggaactcttcctcgccatgctgatgacagcttgtgatctctcggccatcactaagccctggcccatccagcagcgcatcgccgagcttgtggccacagaattttttgatcagggagatagggaacggaaagagctaaacatcgagccgaccgatttaatgaacagagaaaaaaaaaataagattccgagtatgcaggtggggttcatagacgccatatgcttgcagctctatgaagcccttacccatgtttcagaagactgtttccccctcttggatggatgtcgcaaaaaccggcagaagtggcaggccctggccgagcagcaggagaagatgctgatcaatggagaaagcgggcaggccaaacggaattag

SEQ ID NO: 199346 - DNA, 2583 bp, Artificial Sequence
  Description of Artificial Sequence: Synthetic coding sequence
atgggcgaggtgaccgccgaggaggtggagaagttcctggacagcaatattgggtttgccaaacagtactacaacctccattaccgtgccaagctgatctcagacctgttaggcgcgaaggaggctgccgtggacttttctaactaccactcaccatcctctatggaggaaagtgaaatcatttttgatctcctgcgcgacttccaggagaacctacaaaccgaaaaatgcatttttaatgtgatgaagaaactttgttttcttctccaggctgaccggatgagcctgtttatgtatcgaacccggaacggtattgctgagctggcaacgaggctgtttaacgtgcataaagacgctgtactggaggactgtctggtgatgccggaccaggaaattgtcttccccctcgatatgggcatcgtcggccacgtcgctcatagcaaaaaaatagcaaacgtacctaataccgaggaagacgaacacttctgtgacttcgtggacatactcaccgaatataaaactaagaacatcctggcaagccccattatgaatggaaaggacgtggtggccataatcatggccgtgaacaaagtagacggttcacactttactaagagggatgaagaaattctcctgaagtatctgaacttcgctaatttgatcatgaaagtttaccacctgtcctatctacacaattgtgaaactagaagaggccagatcctcctctggagtggcagtaaagtgtttgaggaattgaccgatatcgaacgtcaatttcacaaagctctttatactgtgcgggcatttctgaactgcgaccggtacagtgttgggttgctcgacatgacaaaacagaaggagttttttgatgtatggcctgtgctaatgggtgaggtcccaccatatagcggtccccgtacacccgatggacgggaaattaatttttataaagtgattgactacatactccacggtaaagaagatattaaggtaatacccaaccctccacctgatcactgggctctggtcagtgggttgcccgcttacgtggcacagaacggactgatctgtaacataatgaacgccccagcggaggactttttcgccttccagaaagaaccactggatgaatcaggttggatgatcaagaatgtgctctcaatgcccatcgtcaacaaaaaagaagagatagtgggtgtagccacattctataataggaaggacgggaaaccttttgatgagatggatgagactttgatggagtcactcacgcagtttctcggttggtcagtgctcaaccctgatacctatgagtcgatgaacaagctggaaaatagaaaggacatcttccaagatatagtgaaatatcacgtgaaatgtgacaatgaagagatccaaaaaatcttgaagacgcgggaggtttacgggaaagagccctgggagtgcgaggaggaagagcttgccgagatccttcaggctgaattacctgacgcagacaagtacgaaattaataagtttcatttctccgatctcccactgactgagctcgaactggtgaaatgcggaattcagatgtactacgagctcaaggtagtggacaaattccacataccccaggaagcgcttgtgagatttatgtactccctgagcaaaggatatcgcaagattacataccacaattggcgccatggttttaatgttggacagactatgttcagcctcctggtcacaggaaagcttaaaaggtacttcactgacctcgaggccctcgccatggtgacggccgccttctgccacgacattgaccacagggggacaaacaatctgtaccagatgaaatcacaaaatccactagcaaagctgcacggtagctctattctggagcggcatcacctggaatttgggaaaaccctcctccgcgatgaatccctcaacattttccagaacctcaacagacgccagcatgaacacgccatacacatgatggatattgcaataattgctaccgatctagcgctgtacttcaagaagcgaaccatgttccagaaaattgttgaccagtcaaagacatacgaatccgagcaggaatggacccagtatatgatgctggagcaaacccgcaaggagatcgtgatggctatgatgatgactgcctgcgatctctctgcgatcaccaaaccgtgggaggtccagagtcaggttgccctgctggtggccgccgagttctgggagcagggagatctggagaggaccgtgctccagcagaacccgatcccgatgatggatagaaataaagccgatgagctccccaaattgcaggtcggatttattgacttcgtgtgtacgtttgtttataaggagttcagtagattccatgaagagatcacccctatgctggacggtattacaaataaccgaaaggagtggaaagctctggccgacgaatacgacgccaagatgaaggttcaggaggagaaaaaacagaagcaacaatccgccaagagtgccgctgcaggaaaccagccaggcgggaatcccagccccggcggcgccactacctccaaaagctgctgtattcagtag

SEQ ID NO: 199347 - DNA, 1728 bp, Artificial Sequence
  Description of Artificial Sequence: Synthetic coding sequence
atgaccaaggagaaggagttcttcgacgtgtggagcgtgctgatgggtgagtcccaaccatatagcggcccacgcacaccggatggccgcgaaatagttttctacaaggtcattgattatgtgttacacggtaaggaagagatcaaggtgatcccaacccctagcgccgaccattgggctctcgcctcaggcctccccagctatgttgccgaaagcggattcatctgtaatatcatgaacgctagcgcggatgaaatgttcaaatttcaagagggcgctctggatgattccggctggctgattaagaatgttctgtccatgccaatcgtgaacaagaaagaagaaattgtgggcgtggctaccttctataaccgaaaagatgggaaaccctttgacgagcaggatgaagtattgatggagagcctcacccagttcctcggctggagtgtgatgaatactgacacttacgacaagatgaataagttagagaataggaaggatatcgcccaagacatggttctataccacgttaagtgtgatcgcgatgaaatccagctaatactccctaccagggctcgtttaggcaaggagcctgcggactgcgacgaagacgaactaggtgagatcctcaaagaggagttaccaggaccaaccacattcgacatctacgagttccacttttctgacttggagtgcacggagcttgacttggtgaaatgcggcatccagatgtactatgagctcggtgtggtcagaaaatttcaaatcccccaggaggtcctggttcggttcctgttctccatcagcaagggctataggcggatcacatatcacaactggaggcatggatttaatgtggctcaaaccatgttcactctgttaatgaccggcaaactgaaatcctattataccgatctggaggcttttgccatggtgaccgccggtctttgtcacgacattgaccacagagggacaaataacctttatcagatgaagagccagaatcccctggccaaactgcatggttccagcattctcgagcgccatcatcttgaattcggtaagttcttgctctctgaagaaaccctcaatatttaccagaatttaaacagacggcaacatgaacatgtcatccacctgatggacatcgccatcatcgcgaccgatctggcactttatttcaagaaacgcgcaatgtttcagaaaattgtggatgagtcgaaaaactaccaggataagaaatcatgggttgagtacctgtcactcgagaccactagaaaggaaatcgtgatggctatgatgatgaccgcttgcgacttgagcgctatcacgaaaccatgggaagtgcagagcaaggtggcgctgctggtagcagccgagttttgggagcagggagacctggagcgcacagtactcgatcaacaacctatcccaatgatggaccggaacaaggccgccgaattgcctaagctacaggttggatttatcgattttgtctgtactttcgtctacaaagagtttagccgattccacgaggaaattctgccaatgtttgataggcttcagaataacaggaaggagtggaaagccctagcggatgaatacgaagctaaggtcaaagctctagaggaaaaagaagaagaagagcgtgttgcagcaaagaaagtgggtactgaaatttgcaatggtggtcctgcaccaaagagcagcacttgctgcatcctgtag

SEQ ID NO: 199348 - DNA, 2562 bp, Artificial Sequence
  Description of Artificial Sequence: Synthetic coding sequence
atgagcctgagcgaggagcaggcccggagcttcctggaccagaaccctgatttcgccagacagtacttcggaaagaagctttctcctgagaatgtagcagcggcctgcgaggatgggtgtcctcctgactgtgattcccttcgagatttatgccaggtggaagagtcaactgctctcttggaactcgtgcaggacatgcaggagtctattaacatggaacgtgttgtgtttaaggtgcttaggcgactttgcaccctacttcaggcagatcgatgcagcctgtttatgtacagacagcgtaatggcgtggccgagctggccacacgcctctttagcgtgcagccagattccgtcttggaagactgtttggtgcccccagactctgagatcgtgttccctttggacatcggggtggttggccatgtggctcagacaaagaagatggtgaatgtggaagatgttgcggagtgcccacactttagctccttcgccgacgaactgactgactacaagacaaagaatatgttggctacccccatcatgaacggtaaagacgtggtcgccgtgattatggctgtgaacaagctgaacggccccttctttacaagtgaagatgaggatgtgtttctcaagtatctcaatttcgctaccctttacttgaagatctatcacctgagctatctccacaactgcgaaacccggcgcggccaggtattgctgtggagtgctaataaagtctttgaagaactgactgacattgagcggcagttccacaaggcattctacactgtgcgtgcatatttgaactgtgagagatattcagtgggcctgttggacatgaccaaagagaaggagttcttcgacgtgtggtcggttctaatgggtgagagtcagccttattccggcccccgtactccagatggacgtgagatcgttttctataaagtgatcgactatgtgctccacggcaaggaggagataaaagtgatccctacaccatctgccgatcactgggcactggccagcggactcccttcctacgtggccgagtccggttttatttgcaacatcatgaatgcatcagcagatgaaatgtttaagtttcaggagggagctctggatgacagcggatggctgattaaaaatgtcctctccatgccaattgtcaacaaaaaagaggagatcgtcggagttgctactttctacaaccggaaggatggtaagcctttcgacgagcaggatgaggttctgatggaatccctcacccagttcttgggttggtctgtgatgaataccgacacctatgacaaaatgaataagttggaaaatcggaaagacattgctcaggacatggttttgtatcacgtgaaatgcgatcgcgatgaaatccagctgatcctgcccactcgagcacggctcggcaaagagcctgcagattgcgatgaggacgaacttggggagatcttgaaggaggagctccccggccctactacatttgatatttatgaattccactttagcgatttggagtgtacagagctcgatttagtgaagtgcggcatccagatgtactatgaattgggtgtggtgcgtaaattccagatcccccaagaggtgctagtaaggttcctgttttcgatttccaagggctacaggaggatcacgtatcacaattggcgccacggcttcaatgttgctcaaactatgttcactctgcttatgacagggaagctgaagtcatactataccgatctggaagcctttgcaatggtgacagcgggcctctgtcatgacattgatcaccgaggaacaaacaatctataccagatgaaaagtcaaaaccctcttgcaaagctacacgggtccagcattctagagcgccaccatctggagttcggaaagttcttactcagcgaagagactctgaatatataccagaatttaaatagaagacagcatgagcacgtgattcatttaatggatatcgcaatcatcgctaccgacctcgccctttacttcaagaaacgcgcgatgtttcaaaagatagttgatgagtccaagaactatcaggataaaaaatcatgggtcgagtacttatctctggagacgacacgaaaggagattgttatggccatgatgatgaccgcttgcgatctatcggctatcaccaaaccttgggaagtccagtctaaggtggctttacttgtggctgctgaattctgggagcagggggacctcgaacgtactgtgctggatcagcagccaatccctatgatggaccggaacaaggctgcagagctgcccaaactgcaagtcggctttatcgattttgtatgcacattcgtgtataaggaattcagccgattccatgaggagatcctgcctatgttcgatcgattacaaaataacagaaaagaatggaaggccctggccgatgagtacgaagcaaaagtgaaagctctagaagagaaagaagaagaagagagagtggcggcgaaaaaaggaaccgaaatctgcaatggcggtcctgcaccaaagagttctacttgctgtatcctttag

SEQ ID NO: 199349 - DNA, 2565 bp, Artificial Sequence
  Description of Artificial Sequence: Synthetic coding sequence
atgagcctgagcgaggagcaggcccggagcttcctggaccagaaccccgatttcgcccgccagtattttggcaagaaactttctccagagaatgtagcagctgcctgtgaagacggttgcccccctgattgcgactccctgcgcgacctgtgtcaagtcgaggagagtaccgccctgcttgagctggtgcaggacatgcaagagtccatcaatatggaaagagtggtctttaaggtactgcgccgcttatgtaccttactgcaggcagacaggtgctccctgttcatgtaccgtcaaaggaacggggtagccgaactcgcgactcgtctgttttcagtccagccggacagcgtgctcgaagactgtctcgtacccccggactctgagattgtgtttccactggacatcggagtcgttggccatgtagcgcaaacaaaaaagatggttaatgtagaagacgtcgcggagtgcccacatttctcctcattcgcggatgagttaactgattacaagacgaaaaacatgttagctacccccatcatgaacggtaaagacgtagtggctgtcattatggccgtaaataaactaaatgggcctttcttcacgagtgaggacgaggacgtcttcctgaaatacctgaatttcgccaccctgtaccttaagatctaccatctgtcatacttacacaattgtgagacaagaaggggacaagtcctgctttggtctgctaacaaggtctttgaggagctgactgacatcgagagacaatttcacaaggccttctataccgtgagagcttatttaaattgtgagcggtattcagtaggccttctggatatgacaaaagaaaaggagttcttcgatgtttggagcgtccttatgggagaaagtcagccctactcagggccccgcaccccagacgggcgggaaatagtgttttacaaggttatcgactacgtgctccatgggaaggaagagattaaagtgatcccaacaccaagcgcagatcactgggctttggccagtggcttgccaagctatgttgcggagtccggcttcatctgcaacatcatgaacgcatctgccgatgagatgttcaagtttcaagagggagcactggacgactcaggttggctgataaagaacgtactatccatgccaattgtgaataagaaagaagagatagtgggcgtggccaccttctataatcgcaaggacggcaaaccttttgacgagcaggacgaggtgctgatggagtccctgacacagtttcttggttggtctgtcatgaatacagacacctacgataaaatgaacaagctggagaatcgtaaggacatagcccaggacatggttttgtaccacgttaagtgcgatcgcgatgagatccagcttatccttcccaccagggccagactgggcaaggagccagccgattgtgatgaggatgaactcggagagatcctgaaagaggagctccctggcccgaccactttcgacatctacgaattccactttagtgatctcgagtgtacggagctagacctggttaagtgcggaatccagatgtactatgagctgggggtggtgcgcaaattccaaattcctcaggaagtgctggttcggtttctgttttctataagcaaggggtatagacgaattacctatcataactggaggcacggtttcaatgtcgctcagaccatgttcactctactgatgacgggcaaactgaagtcatactacaccgacctcgaggcattcgctatggtgacagcgggcctgtgccatgatatcgatcataggggtacaaataatctgtaccaaatgaaaagccagaatcctctcgctaaactgcacgggtctagcatactggaacgccatcaccttgaattcggtaaatttcttctctccgaagagacactgaacatatatcaaaaccttaacaggcgtcaacacgagcacgttattcacctgatggatattgccattatcgcaactgatttggccctgtattttaagaagcgtgctatgttccagaaaatcgtggatgagagcaaaaactaccaggataagaaatcatgggtcgaatatctgtctctagagaccacacgaaaggagattgtgatggccatgatgatgacagcttgtgacctttcagctatcaccaaaccctgggaggtacagagcaaggtggccttgctggtcgccgcggaattctgggagcagggggaccttgagaggactgtgctcgatcagcaacctattccaatgatggatagaaataaagccgctgagttgccaaagctgcaggtgggcttcattgactttgtgtgtacattcgtatacaaagagttcagtaggttccatgaggaaatactgccaatgttcgatcgcctgcagaacaataggaaggagtggaaggccctcgccgatgaatatgaggcaaaagtgaaagcccttgaagaaaaggaagaggaagagcgggtggccgcaaagaaggtcggaaccgagatatgcaatggaggaccggccccaaagagcagcacttgttgcatcctttag

SEQ ID NO: 199350 - DNA, 2577 bp, Artificial Sequence
  Description of Artificial Sequence: Synthetic coding sequence
atgggcgagatcaaccaggtggccgtggagaagtacctggaggagaacccgcagtttgcgaaggagtactttgatcgcaagttgcgtgtagaggtgctaggggaaatcttcaaaaacagccaggtgccagtgcaaagcagcatgagtttcagcgagctcacgcaggtcgaggagtccgcactgtgccttgagctcctttggacagtgcaggaggaaggaggtaccccggagcagggagtgcacagggctctccagcggttggctcacctccttcaagcggatcgctgcagcatgttcctctgcagatcccgcaatggtatccccgaggtggcaagcagactgctcgatgtgacgcccacctcaaagttcgaggataatcttgtaggccctgacaaagaggtggtgttcccccttgacataggcatcgttggctgggccgcgcacacaaagaagactcataacgtgcccgatgtgaagaaaaacagtcattttagcgactttatggacaagcagacaggatatgtaaccaagaaccttttggctacgccaatcgtagttggaaaagaggttttagctgtgatcatggccgttaacaaagtgaacgcttctgagtttagcaaacaggatgaagaagtcttttctaagtaccttaatttcgtgagcattattttaaggctacaccacaccagctatatgtataatatagagtcaaggcgctctcagatcttgatgtggtcagcgaacaaagtcttcgaggaactcaccgatgtagaacggcagtttcataaagctctatatacagtgcgcagttatctgaactgtgagcggtatagcattggccttctggatatgaccaaagagaaagagttttatgacgagtggcctatcaagctcggagaggttgaaccttacaagggcccgaagactcccgacggccgagaagttaacttttacaagatcatagattatattctgcacgggaaagaggagatcaaggtgattcctacgcccccagcggaccactggacacttatttctgggctccctacctatgtggcagaaaatggctttatctgtaatatgatgaacgcccccgccgatgaatacttcaccttccagaagggacccgtggatgaaaccggttgggttataaaaaacgtactgtcgcttcctattgttaataaaaaagaagatatagtgggtgtcgcaaccttctacaatcggaaggatggcaaacctttcgatgagcatgacgagtatatcaccgagactttaacacagtttttggggtggagcctcctgaacaccgatacttatgacaaaatgaacaagctcgagaaccgtaaggacatagctcaggaaatgctgatgaatcagacgaaagcgacccccgaagagatcaagtctatcctgaaatttcaggaaaagttgaatgtcgacgtgatcgatgactgcgaagaaaagcaactggttgccattctgaaggaagatctccccgatccgaggagcgctgagttgtatgaattcaggttcagcgacttcccactcaccgaacacggcctaattaagtgcgggatcagactgttctttgaaataaacgtcgtcgagaagtttaaggtgccagtggaggtccttacaagatggatgtatacggtccgaaagggttacagggcagttacctatcacaattggcggcatgggtttaatgtggggcagacaatgttcaccctcctgatgactggtcgcctaaaaaaatattatacagatttagaggcgtttgcgatgctggccgctgcattttgtcatgacatcgaccatagaggcacaaataatctgtatcagatgaagtctacttctccactggctaggctgcacggctccagcattcttgaaaggcatcatctggaatactctaagacattgttgcaggacgagagcctcaacatcttccagaacctgaataagagacagtttgagacagtaatccacctgttcgaagtggccataatcgccacagacctggccttgtattttaagaagaggacaatgtttcagaaaatagtcgacgcatgtgaacaaatgcaaacagaggaagaggctatcaaatacgtcaccgtggaccccactaaaaaggagattatcatggccatgatgatgaccgcctgcgatctgtccgcaatcaccaagccgtgggaggtccaaagtcaggtggctctgatggtggcaaacgaattttgggaacagggcgatctggagcgcactgtgctacaacaacagccaattcctatgatggaccgcaataaaagagacgaactgccgaagctgcaggtgggattcatcgatttcgtttgcactttcgtctataaggagtttagtcgctttcacaaggagataacccccatgctgtcgggacttcagaacaacagggtggagtggaaatcccttgccgacgaatacgatgcaaaaatgaaagtcatcgaagaggaagctaaaaagcaggaagggggggccgagaaagcagctgaggactccggcggaggcgatgacaagaaaagtaagacgtgcctgatgctttag

SEQ ID NO: 199351 - DNA, 453 bp, Artificial Sequence
  Description of Artificial Sequence: Synthetic coding sequence
atgagcgccaaggacgagcgggcccgggagatcctgcggggcttcaagttgaattggatgaatctgcgtgacgccgagaccgggaagatactatggcaggggaccgaggatttatccgtccccggggttgaacacgaagctagagtcccaaagaagattctaaagtgtaaggccgtgtctagggagcttaacttctcatccaccgaacagatggagaagtttcggttggagcagaaggtgtactttaaagggcaatgcctcgaggagtggtttttcgagttcgggtttgtcattccgaactctaccaatacctggcagtccctgattgaagccgcccctgagtcccaaatgatgccagcttctgtgttgaccggaaacgtgataattgagaccaagtttttcgacgacgatctgttagtttccactagccgggttagacttttctacgtgtag

SEQ ID NO: 199352 - DNA, 414 bp, Artificial Sequence
  Description of Artificial Sequence: Synthetic coding sequence
atgaagcagcgggacaagggccggggctggcaccccgccgagggcggccctgccctgactgcacagccccctgagacacgccccgccctggacaggagccggcgggaatccaggagtcagggctgtagaggcgtgtctgtcagcctcactatgaatctggagccccccaaagcagaatttcgatccgccacccgtgtagcgggcggaccagtgactcctaggaaggggcctccaaaattcaaacaaaggcaaactcgccagtttaagtctaagccaccgaaaaaaggggtgcaggggtttggcgacgacattcctggcatggagggtctcggcacagatatcactgttatttgtccatgggaggcttttaaccacctggaattgcacgaattggcacaatacggaatcatctag

SEQ ID NO: 199353 - DNA, 264 bp, Artificial Sequence
  Description of Artificial Sequence: Synthetic coding sequence
atgaacctggagccccccaaggccgagttccggagcgccacccgggtggccggaggacccgttacaccccgcaaggggccgcctaagttcaaacagagacagacaagacagttcaagtcaaagccacctaaaaagggcgtgcaggggtttggcgacgatatccccggcatggaaggactaggaacagacatcacagtcatctgcccatgggaggccttcaatcatctcgaactgcatgagctggcccagtatggaattatatag

SEQ ID NO: 199354 - DNA, 252 bp, Artificial Sequence
  Description of Artificial Sequence: Synthetic coding sequence
atgagcgacaacaccaccctgcccgcccccgccagcaaccagggccctacaacccctaggaaaggccccccgaagtttaaacagcggcagactcgccagtttaagagtaaaccacctaagaaaggtgtcaaaggatttggggatgatatccctgggatggagggactcggtaccgacatcactgtcatttgtccatgggaggccttttcccacctcgaattacacgagctcgcgcaattcggcatcatttag

SEQ ID NO: 199355 - DNA, 1371 bp, Artificial Sequence
  Description of Artificial Sequence: Synthetic coding sequence
atgggcatcaccctgatctggtgcctggccctggtgctgatcaagtggattacctctaagcgacgcggagccatatcctacgacagcagcgatcaaactgccctgtatattagaatgcttggagacgtgagggtccggagcagagcgggatttgagtccgagcggagaggctcacatccttacattgactttcgaatctttcattctcagagtgagatcgaggtgagtgtatcagcgagaaacatccggagattgttgtcttttcagcgctatttacggagttctcgcttttttaggggaaccgctgtgtccaacagcctgaacatcttggatgacgactataatggacaggccaagtgcatgctggagaaagttggcaactggaacttcgatatctttctattcgataggctgacgaatggaaattcactggtcagcctgacattccacctctttagcctccacgggcttattgagtacttccatttggacatgatgaagctcagaaggttcctggttatgatacaagaggattatcacagccagaacccataccataatgccgtgcatgccgcggatgtgacccaggccatgcactgttatctgaaggaacctaaacttgctaatagtgtaactccctgggacatactgctgtccctcattgcagcagctacccacgacctcgatcatcccggagtaaatcagccatttttgatcaaaactaatcactatctggccacactatataagaatacatctgtgcttgagaatcaccattggagaagcgctgtcggtctcctccgggagagtgggctcttcagccacctaccgctggagtcccggcagcagatggaaactcagatcggcgcattgatcctagccaccgacatttcccgacagaatgaatatctcagcttattccggtctcatctggacagaggcgacctttgtctagaggacacccgccaccgacatctggtgttacagatggctctcaaatgcgccgacatctgtaatccctgccgtacgtgggagctctcaaagcagtggtccgagaaggttaccgaggagttttttcaccagggagacattgagaaaaaataccacctgggggtttcccctctctgtgatcgtcacaccgagagcattgctaatatccagattggttttatgacctacctggtcgagcccttgttcacagaatgggcccgtttctctaacacgcggttgagccagacaatgttgggtcacgtcggcttaaacaaggcttcttggaagggcctccagcgagaacagagctccagtgaggatactgacgccgcctttgagctcaatagccaacttctgccccaagagaaccggctgtcctag

SEQ ID NO: 199356 - DNA, 1275 bp, Artificial Sequence
  Description of Artificial Sequence: Synthetic coding sequence
atggaggtgtgctaccagctgcccgtgctgcccctggaccggcccgtccctcagcatgttttgtcgcggaggggcgccatatcttttagttcctcctccgcattattcgggtgcccaaaccctcggcagttatctcaacgtcgcggcgccatctcctacgacagctctgaccaaacagccctctacattcgaatgctgggagatgtcagggtacgaagcagagctggatttgaatccgagagaagaggatctcacccatacatagactttaggatctttcactcccaatctgaaatcgaagttagcgtgagcgctagaaatatccgcaggctcctctcgtttcagagatatctcaggtcttctagattcttcagaggaacagccgtttcaaactcgctcaatatcctggatgatgactataacggtcaggcgaagtgcatgctggaaaaagtcgggaattggaatttcgatatctttcttttcgacaggctgactaacggcaattccttagtttctctaacattccacctgttcagcctacacggactcatagagtattttcatttggatatgatgaagctgaggcggtttcttgtgatgattcaggaggactatcatagccaaaacccataccataatgcagtccacgccgctgacgtcacacaagctatgcactgctatctgaaagagccaaagttggcgaatagcgtcacaccctgggatatcctcctgtccctcatcgcagctgccacacacgatctcgaccatcctggagtgaaccaacctttcctgatcaaaactaatcactatctggctacactatacaagaatacgtctgtcctggagaaccatcattggcgaagtgctgtcggcctcctgagggagtctggtctgttttcccacctccccctggagagtcgccagcaaatggagacacaaatcggcgcgctcatactggctaccgatatcagccgccagaatgagtacctgagcctgtttagaagccatctggatagaggagacctgtgcctagaggacacacgccatcgtcacctcgttcttcagatggcgttgaagtgcgccgacatttgtaatccctgtaggacatgggaactgagtaaacagtggtcagaaaaggtgaccgaggagttttttcatcagggggatattgagaaaaaataccatctcggagtgtctccactttgtgaccgccatactgaatccattgctaatatccagattggcaattatacgtacctggatatcgccggctag

SEQ ID NO: 199357 - DNA, 1449 bp, Artificial Sequence
  Description of Artificial Sequence: Synthetic coding sequence
atggaggtgtgctaccagctgcccgtgctgcccctggaccggcccgtgcctcaacacgtccttagtaggagaggtgctatttccttcagttcctcctccgccctatttggctgtccaaatcccagacagttatctcagcgtcgcggtgcaatcagctatgacagcagcgaccagacggcgctgtacatcagaatgctgggagacgtcagggtgcggtcccgggcaggattcgaatctgaaagacgcggctcccacccttacatcgatttccgaatttttcactcccagtctgagattgaagttagtgtgagcgcccggaacatccgccgcctgctcagcttccagcgatatttaaggtcatccagattcttccgtggtactgctgtctctaattccctgaacatattggatgacgattacaatggacaggctaaatgcatgctggagaaggtgggcaactggaactttgacatcttcttattcgatagacttaccaatggtaatagtttagtgtccctgaccttccacctgttctctctccatggcctcatagagtactttcatttggacatgatgaaacttcggcgtttcctcgtgatgatccaggaggactatcattcacagaacccctatcacaacgccgtgcatgctgctgatgtcacccaagctatgcactgctacctcaaagaacctaagctggcgaatagcgtgactccttgggatatattactgtccctgattgctgccgcaacccacgatttagaccatcccggggtgaaccagcctttcctgataaagaccaaccactatcttgccaccctttacaagaatacgagcgtgttggagaaccatcattggagatcagccgtgggcctcctgcgagagagtggcttgttctcgcatcttcctctggagtcaaggcagcagatggagactcaaattggcgcactaatactggctactgatatctcacggcagaatgaatacctctcactgttccgctcgcatcttgacagaggtgacctgtgcctggaggacaccaggcatcgtcatctggtactgcagatggcattaaagtgtgccgacatttgtaatccttgtagaacctgggagctctcaaaacagtggtccgaaaaggtgaccgaggaatttttccaccagggggacatagagaagaagtaccacctcggagtgagcccgctgtgtgacaggcataccgagtccattgccaacattcaaataggcttcatgacatacctcgtcgagccattgtttactgagtgggcaagattcagcaatactcggttgagccagaccatgctgggtcacgttggcctgaataaggcatcgtggaaggggctccaaagggaacaaagtagctccgaggacacggacgcagccttcgaattgaactcacagctcttaccacaagaaaaccgattatcatag

SEQ ID NO: 199358 - DNA, 2490 bp, Artificial Sequence
  Description of Artificial Sequence: Synthetic coding sequence
atgggctgcgcccccagcatccacatcagcgagcggctggtggccgaggacgcaccctcacctgcggctcctccgttatcctccggcggacctagactgccacaggggcagaagaccgcggctctgccacggactcggggagccggattgctggaatcagaacttcgcgatgggtccggaaagaaggtcgctgttgcagacgtgcagtttggccctatgagatttcaccaggatcagctacaagttcttctcgtgtttaccaaggaggataaccagtgcaacggcttctgtagagcctgtgaaaaagcaggattcaaatgcactgtgacaaaggaagcacaggccgtgctagcttgttttctggacaaacatcacgatataatcattatcgaccatagaaaccccaggcagttggacgcagaggccttgtgtcggtctattaggtcctccaaactgagcgagaacaccgtcatcgtcggggtcgtccgccgagtggatagagaagagctttccgtaatgccctttattagcgcaggctttacccggcgctatgtggagaatcccaatatcatggcttgctataatgaattgctccagctggaatttggagaggtgaggtcacagctcaagctcagagcctgtaattccgtctttaccgccttagagaactcagaagacgcgatcgaaatcacatcggaggacaggtttatccagtatgctaatcccgcattcgaaaccaccatggggtaccagagcggagaacttataggcaaagagttaggggaggtgccaatcaacgagaagaaggcagatctgctggacacaattaattcctgcatacgaatcgggaaggagtggcagggtatttactatgccaagaagaaaaacggagacaatattcagcagaacgtgaagattataccagttattggccagggcggcaaaatccggcactacgtctctattatcagagtttgcaatgggaacaataaagcagagaaaattagtgaatgtgtgcagagcgacacccatacagataatcaaaccgggaaacacaaggaccgacgcaaaggcagcttggacgtgaaggcagtcgcttcgcgagctactgaggtatcgtcacaacgtcggcacagctcaatggcgcgtatccactctatgacaatcgaggcacctattacaaaggttataaatatcatcaacgccgcacaggagagttcacccatgccagtgacagaagcgctcgaccgcgtcctcgagatcttgaggaccacagagctttatagccctcagtttggggccaaggacgacgatccacatgctaatgacttggtggggggattaatgagcgatggattaagaagactgtctggaaacgaatatgtcctgtcgaccaaaaatacgcagatggtgagctctaacattattacacctatctcgctggatgacgtgccgccgcggatagctcgggcgatggaaaatgaggaatactgggatttcgatatcttcgaacttgaagcagcaactcacaatagaccgctcatatatttaggactcaaaatgttcgctcggtttggaatttgtgagttcctccattgttcggagtccaccctaaggagctggttgcagatcattgaagccaactatcactctagcaatccttatcacaactctacccatagtgccgacgtgctgcatgctacggcatacttcctgagtaaagagaggattaaggaaacactcgatcccatcgatgaggtcgcggccctcatcgcggccacgatccacgacgtagatcaccctggaaggaccaacagcttcctttgtaatgcaggaagcgagctggctattctttataacgataccgccgtcctcgaatcacatcacgctgcgcttgcctttcagctgacaactggagacgacaaatgtaacatttttaagaatatggaacgcaatgattaccggaccttgcgtcagggcatcattgacatggtattggcgacagagatgactaagcactttgaacatgtgaataaatttgtgaattcaatcaataaaccactcgctaccttggaagaaaatggggagactgataagaatcaggaggttatcaacaccatgcttagaacacctgaaaaccggactttgataaagcggatgctcatcaaatgtgctgacgtatctaatccatgtcgcccacttcagtattgcattgaatgggctgcccgcataagcgaggagtatttttcccagaccgacgaggagaaacaacaaggattacctgtggtgatgcctgtgtttgataggaatacttgcagtattccaaaaagccagatttctttcatcgactatttcataaccgacatgtttgatgcctgggatgcgtttgttgatctgccagatctcatgcagcacctcgacaataatttcaaatattggaaggggctggacgagatgaaactgcgcaatttacgtcccccacctgaatag

SEQ ID NO: 199359 - DNA, 2352 bp, Artificial Sequence
  Description of Artificial Sequence: Synthetic coding sequence
atgggctgcgcccccagcatccacatcagcgagcggctggtggccgaagacgcgccaagcccagccgcccccccactgtcaagcgggggaccaaggctaccacagggacagaaaactgctgctctgcctcgcactcgaggcgcgggcctcctggaatcagagctccgcgatggctccggcaaaaaagttgctgtcgctgatgtacagttcgggcccatgagattccaccaggatcagctacaggttctgctcgtgttcaccaaggaggataatcagtgcaacgggttttgtagggcttgcgagaaggctgggtttaagtgtacagtcacaaaagaggcacaagcagtgctggcctgttttcttgacaagcaccacgatattattatcatcgaccaccggaatcctaggcagttggacgccgaggcactgtgccgaagcatacgcagtagcaagctcagtgaaaataccgtgatcgtgggtgtggtaagacgagttgatagagaggaactttccgtaatgccttttatctcggccggcttcactagaagatatgtggaaaaccccaacattatggcttgctataatgaactactgcagttagaattcggcgaggtgcggagtcagttgaaattgcgagcatgcaactctgtgtttacggcactagagaacagcgaggacgcaattgaaataacctccgaagatagatttatacaggaatggcaaggcatctactatgccaagaagaagaatggggataatatccagcagaacgttaagatcataccagtgatcggtcaggggggcaagatccgccactatgtgtctatcatccgggtgtgcaacggcaataacaaggccgagaaaatttcagagtgcgttcagtccgacacccacaccgacaaccagacagggaaacacaaggatcgccgcaaggggtccctggatgtgaaagcagtagctagcagggcaaccgaagtatcttcccagcgacgtcactccagtatggccagaatccactccatgaccatcgaagcaccgatcaccaaggttatcaatattatcaacgccgctcaggaatcttcgcctatgcctgtgacggaggccctggatcgggtgctggagatcctgagaacaaccgagctgtacagcccacagttcggagcgaaggacgatgatcctcacgcgaatgacttagtgggtggcctgatgagtgacggactccggcgtctgtctggaaatgagtatgtgctctccaccaaaaacactcagatggtcagtagcaacattatcacgcccatctctctagacgacgtgcctcctcggattgcaagggccatggagaatgaagaatattgggatttcgacattttcgagctcgaggccgcgacccacaaccggccactgatttacctggggttaaagatgtttgcacggttcggcatctgcgagtttttgcactgctctgagtcgacactcaggtcatggctgcagattatcgaggccaactatcacagtagcaacccttatcataactccacgcattcagcagatgtgctgcacgctacagcttattttcttagtaaagagagaataaaagagaccttggacccaatcgatgaagtggctgctctgattgcggctaccatccacgatgtggaccacccaggacgcaccaacagcttcctttgtaatgccgggtccgaactagccatcctgtacaacgataccgcggtgctggagtcacaccacgctgctttagcatttcagttgacaaccggagacgataagtgtaatatctttaaaaacatggaacgcaatgactacagaactctgcgccagggcattattgacatggttctggcaacggagatgacaaagcattttgagcacgtgaacaaattcgttaatagtatcaacaagccactggctacgctcgaggagaacggagagacagacaaaaatcaggaggttattaacacaatgctgaggactccagagaatcgcacacttatcaaacggatgcttattaagtgcgccgatgtttcaaacccttgtcgtcctctgcaatactgcattgagtgggcagccaggatttcggaggagtacttcagccaaacagacgaagagaagcaacaagggctgccagtcgtcatgcctgtattcgatcggaatacatgcagtatacctaagtctcaaatcagtttcatcgactattttatcaccgacatgtttgacgcctgggacgctttcgtggacttgcccgacctgatgcaacacctggataataacttcaagtactggaaggggctggacgaaatgaaacttcgaaacttacgcccccctcccgagtag

SEQ ID NO: 199360 - DNA, 2490 bp, Artificial Sequence
  Description of Artificial Sequence: Synthetic coding sequence
atgggctgcgcccccagcatccacatcagcgagcggctggtggccgaggacgctcctagcccagccgccccgcctttaagcagcggcggccctcgtcttccacagggtcagaagaccgccgccctgccgcgcaccagaggcgccgggctcctcgagagcgaattgcgtgacggcagtgggaaaaaggtagctgtggcagacgtccagtttgggccaatgcgcttccaccaggatcaactgcaggtgttactggtgtttactaaagaggataaccaatgcaacggcttctgccgggcctgcgagaaagcgggtttcaaatgcacagtgactaaagaagctcaagccgtgctggcctgctttctggacaagcaccatgacatcattattatagatcacagaaacccacgacagctggacgcagaagcactctgtagatccatacggagctctaagttgtccgaaaatactgttatcgtaggggtcgtgaggcgcgtggatagagaggagctgtcagtgatgccattcatttcggccggatttactaggagatatgtcgagaaccctaacatcatggcttgttacaatgagctgttgcaacttgaatttggcgaggtgcgcagccaactcaagctgagggcatgcaatagcgtttttactgcattagagaattctgaggatgccatcgaaattacctccgaagaccggtttatccaatacgcaaatcccgctttcgaaacgaccatgggctaccagtcaggagagcttattggtaaggagctcggggaggtccctatcaatgaaaaaaaggcggacttgttagatacaatcaactcttgtattagaattgggaaggagtggcagggcatttactatgcgaaaaaaaaaaatggtgacaacatccagcagaatgttaagattatccctgtaatcggacaaggaggcaagatacgacactatgtgtctataatccgagtgtgcaatggcaacaataaggcggaaaaaatctcagaatgtgtgcagtccgacacccatacggacaatcagaccgggaaacataaggatcgccgtaagggcagtcttgacgttaaggcagtagcaagtagagctacagaggtgagcagccagaggaggcactcatcaatggcaaggatacacagtatgacgattgaagcgcctatcaccaaagtgatcaatatcattaacgctgcccaggagtcatcccccatgcctgtcacagaagccctggaccgcgtcttggaaattctgaggacgaccgaattgtattcacctcagttcggagccaaagatgacgatccgcatgctaatgacctcgtgggagggcttatgtctgatggacttcggaggttgagtggtaacgaatatgtgctttctaccaagaatacccagatggtgagctcgaatattattacacctatcagtctggacgatgtgcccccaaggatagccagggcgatggagaacgaggagtactgggattttgacatttttgagctggaggccgctacacataacaggccactgatttatcttggactgaagatgtttgctagatttggaatctgtgagttcctacactgtagcgaatccaccttgagatcctggcttcagatcatcgaagccaactaccactccagcaatccctatcacaacagtactcactccgctgatgttctgcacgctaccgcttattttctaagcaaagagcgtatcaaagagacacttgatcccattgatgaggtcgcagccctcatagctgccaccattcatgatgtcgaccatccgggaaggaccaacagtttcttatgtaacgcaggttccgagctggcaatactctataacgataccgcggtactcgagtcgcaccatgcagcccttgccttccagctgaccacaggggacgataaatgcaatatcttcaagaatatggaacgcaacgactatcgaactctcaggcaggggattatcgacatggtgctggccactgagatgacaaaacacttcgagcatgtcaataaattcgtgaacagcatcaataagcccctggctacactcgaagagaacggtgagaccgacaagaatcaggaagtgattaacacaatgctgcgcacccccgaaaaccggacgctcatcaaaaggatgttaatcaagtgtgcagacgtctcaaacccctgtcggccattacagtattgtattgagtgggccgcccgcatctctgaagagtatttcagtcagaccgacgaggagaagcaacagggcttgcccgtggtgatgcccgtgttcgaccggaacacatgctctattcctaagtcccagatttccttcattgactatttcatcaccgatatgtttgatgcgtgggacgcctttgtcgatctgccagacctgatgcagcatctggacaataactttaagtattggaaaggtttggacgaaatgaaactacgcaacttgcgccccccgcccgaatag

SEQ ID NO: 199361 - DNA, 2274 bp, Artificial Sequence
  Description of Artificial Sequence: Synthetic coding sequence
atgcggttccaccaggaccagctgcaggtgctgctggtgttcaccaaggaagacaaccaatgcaacggcttttgccgagcttgtgagaaggctggctttaaatgtacagtgactaaggaggcccaagctgtgttggcctgcttcttggataaacaccatgacattattatcattgatcacagaaatccaaggcagttagatgctgaagccctatgtcgatcaataagaagctcaaaactgtccgaaaacaccgtgatcgtgggggttgtcaggagggtagatagggaggagctgtccgtaatgccgttcatcagcgctggcttcacaagaaggtatgtagagaatcctaacatcatggcgtgctataacgagctgctgcagttggaatttggagaagtgcggagccagctaaaactccgggcgtgcaactcagtatttaccgctctcgagaactcagaggacgccatcgaaattacatccgaggataggttcattcagtatgcaaaccccgcgttcgagaccacaatgggatatcaaagcggagagctgatcggcaaggagttgggggaggtgcctatcaacgagaagaaagccgatcttttggacactatcaattcgtgcattcggattggcaaagaatggcaaggcatatactatgcaaagaagaagaacggggacaatatccagcaaaatgtcaagatcatacccgtgatcgggcaggggggaaagattcggcactacgtctccattatcagggtatgcaatggaaataacaaggctgagaagatcagcgagtgtgttcagagcgacacccatactgataatcagaccggaaagcacaaagacagacgtaaggggtccctcgacgtgaaggcggtggcatccagggccacagaagtgtcctctcagaggcgccactcctctatggcccgcatccactcaatgaccatagaggcacccatcaccaaggtaattaacattatcaacgcggcccaagagagttccccgatgcccgtgactgaagccctggatcgcgtgctagagattttaagaacgaccgagctctattctcctcagttcggtgcgaaggacgatgaccctcatgccaacgacctcgtcggaggactgatgtcagacggccttcggaggttgtccggcaacgaatatgtcctgtccacaaagaacactcaaatggtcagttctaatataatcacaccaatttcgcttgatgacgtgcccccaaggattgctcgggccatggagaacgaggagtactgggactttgatatcttcgaacttgaggctgcaacccacaatagacctctaatatacctggggctgaagatgttcgcaagattcggaatctgcgaatttttgcactgtagcgagtctaccttaagaagttggttgcaaattattgaggcaaactaccattccagtaatccttaccacaattctactcattccgcagacgttctccacgccactgcctacttcctctccaaggagaggattaaagagaccctcgaccctatcgacgaggtcgcggcactcattgccgcaaccatacacgacgttgatcatcctggccgcaccaacagctttctatgcaatgcggggtcagaattagccatcttatataatgacacggcggtactcgagagccaccatgccgcattggctttccagctcacaaccggagatgataaatgcaatatctttaagaacatggaaagaaacgactaccggacactcaggcaggggattattgatatggtcctcgccactgagatgaccaagcatttcgagcacgtcaacaagttcgtaaacagtatcaataagccactggccacactcgaggaaaacggagaaacagataaaaatcaggaagtgataaacacaatgttgaggactcccgagaaccgcacactgataaagcgaatgcttataaagtgcgcagacgtgtctaatccgtgcagacccctgcagtattgcatcgaatgggcagcgcgaatctcagaagaatacttttcccagactgacgaggaaaagcagcaggggctgcccgttgtgatgcccgtttttgataggaacacatgcagcatacctaagagccagatctccttcatcgactacttcattactgacatgttcgatgcttgggacgcattcgtggacctcccagacctgatgcagcacttagataataacttcaagtattggaagggccttgacgaaatgaagctgcggaatctacgcccacctcctgaatag

SEQ ID NO: 199362 - DNA, 2658 bp, Artificial Sequence
  Description of Artificial Sequence: Synthetic coding sequence
atgggctgcgcccccagcatccacgtgagccagagcggcgtgatctactgtagggacagcgatgaaagttcaagccctcggcagactacaagcgtaagtcagggccctgcagcccccttacccggactgtttgtgcagaccgatgctgcagatgctatcccaccgagtcgagctagtggccccccgagtgttgcgagagttcggcgggcaagaactgagttggggtcgggttcaagcgccggctctgccgcccccgcagcaactacgagccgtggccgcaggcgccactgctgctctagcgcggaggctgagacccagacctgttatacaagcgtgaaacaggtttcctcagctgaggtgcggattggccccatgagactgacccaggatccaattcaggtacttctgatttttgctaaggaggattctcagtccgacgggttttggtgggcttgcgatcgggcgggctataggtgtaatattgctcggacccctgagtccgctctggaatgtttcctggacaaacaccacgaaattatcgtcatcgaccatagacagactcagaacttcgacgccgaagccgtgtgtaggtctattcgggctaccaatccttccgaacacacggtcattttagccgtggttagtcgcgtgtctgacgaccacgaagaggcgtccgtgttacccttgctgcatgccggctttaatcggcgatttatggaaaacagttccataattgcatgctacaatgaactaattcagattgaacatggagaggtgagaagccaatttaagttaagagcctgtaattcagtgtttaccgcgctggaccactgtcacgaggccatagagatcacatctgacgatcacgtaattcagtacgtcaacccagcattcgagcggatgatgggttaccacaagggcgagctcctcgggaaggaactcgccgaccttcctaagtcagacaagaacagagccgatctcctagacactatcaatacatgcatcaaaaagggtaaagagtggcaaggagtttattacgctcggaggaaaagcggggattctatacagcagcacgtcaagataaccccagttattggccaaggcggaaagatccgccatttcgtgtctctgaaaaagctgtgttgtactaccgacaataacaagcagatccacaagattcaccgcgactcaggggataatagtcagacagaaccccattcattccgctataaaaaccgacggaaggagtcaatagatgtgaaaagcatcagttctagagggagcgacgcgccttcattacagaatcgtcgatacccgagtatggctaggatccatagcatgaccatagaggccccaattactaaagtgatcaatatcattaatgctgcacaggagaacagtcctgtgacggtagccgaggccctggaccgggtgctggagatccttcgcaccacagaactgtattcaccacagctggggacgaaggatgaggacccgcatacttcagacctggtgggtggactgatgacagacgggttacgcagactgtcaggcaatgagtatgtgttcaccaagaatgtgcaccagagccacagccatttggcaatgcctattaccattaacgatgtgccgccctgcatttcacagctgctggataatgaggaaagttgggatttcaatatctttgagctggaagccattacacataaaagaccattagtgtatctggggctgaaagttttctctagattcggggtttgcgaattcctgaactgctctgaaaccaccttgagggcatggtttcaagtgattgaggcaaactatcatagtagcaacgcataccacaattctactcacgccgctgacgtgctccatgcgaccgcattctttctggggaaagaaagagtaaaaggctcactggatcaattagatgaggtggcggctctgatcgcagctaccgtccatgacgtcgatcatccaggcagaacaaactcatttctgtgtaacgcaggtagcgaattggctgttctgtacaacgacactgctgtcctcgagagccaccacacagccctcgcatttcaactcacagtaaaggatactaagtgcaatatctttaagaatattgaccgaaaccactaccgaactctgcggcaggcgattattgacatggtgttggccacagagatgaccaagcatttcgagcacgtaaacaaattcgttaattcaattaacaagcctatggccgccgagattgagggcagtgactgcgaatgtaatcctgccggcaagaacttccccgagaatcaaatcctgatcaagaggatgatgattaagtgcgccgacgtggctaatccatgcagacctctggatctgtgtatcgaatgggcaggaagaatcagcgaagaatactttgcacagacagatgaagaaaaacggcagggactccccgtagtcatgccagtgttcgatcgcaacacatgtagtatcccaaagagtcagatcagcttcatcgactacttcatcacagacatgtttgacgcctgggacgccttcgctcatctgccagcactgatgcagcacctagcagataactacaagcactggaagacgctggacgatcttaagtgtaagtccctcaggctgccaagcgactcgtag

SEQ ID NO: 199363 - DNA, 2493 bp, Artificial Sequence
  Description of Artificial Sequence: Synthetic coding sequence
atgggctgcgcccccagcatccacgtgagccagagcggcgtgatctactgccgcgactcagacgagtcctcgagcccaagacaaactacctctgtcagccagggtcctgccgccccattaccgggcttgtttgtgcagaccgacgctgccgatgcgataccaccctctcgcgcctccgggcccccttccgtcgccagagtcaggcgtgctcggacagagctcggaagcgggagcagtgccggaagtgccgctcccgccgcaaccacatctcggggccggcggcgccattgctgcagctctgccgaagcagaaacacagacatgttacacctctgtaaagcaagtatcctctgccgaggtgcgaatcggacccatgagactgacacaagaccccatacaggttctcctgatcttcgcaaaggaagactctcaaagcgatggattctggtgggcttgcgaccgagccggctaccgttgcaatatcgcacgcactcccgaatccgccttagagtgtttcttggataagcaccatgagattatcgtgatcgatcaccggcaaactcaaaacttcgacgccgaggctgtctgtcggtccatcagggctacaaatccttccgaacatacagtcatcctggccgtcgtaagccgggtgagtgacgaccacgaagaagcatcagtgttacccctgctgcatgcggggtttaatcgtcgcttcatggagaattcctctataatcgcatgctataacgagctaatccagattgaacacggcgaggttcgttcccagttcaagctacgcgcctgcaattcagtgttcactgcattagatcactgccacgaagctatcgagatcacatccgatgaccatgtgattcagtatgtgaatcctgcatttgaacggatgatgggttatcacaagggagaactgctaggcaaagagttggcggaccttccgaagtcggacaagaaccgcgccgacttactggacaccattaatacctgcattaaaaaaggaaaggaatggcagggggtgtattacgccagaagaaagtccggggatagcatccaacagcatgttaaaattacgccagttatcgggcaaggtggcaagatacgacattttgtctctttaaaaaaactgtgttgcacaactgataataataaacaaatccataagattcacagagattccggagataattcacagacagaaccccacagctttcggtacaaaaaccggaggaaggaatccatcgacgttaaaagtatctcaagcagagggagcgatgccccatctctgcagaacaggaggtacccatccatggcacgcatacacagcatgaccatagaggccccaataacgaaagacggattgaggagacttagcgggaacgagtacgtcttcactaagaacgttcatcagtctcactctcatctcgcaatgcctataaccattaatgacgttccgccctgcatctctcagctcttggataacgaagagagttgggattttaatattttcgaattggaagctatcacccacaagaggccattggtttatctcggtctcaaggtgttcagtcggttcggggtatgcgagtttctgaactgcagcgaaaccacgctccgtgcctggtttcaggttattgaggctaattaccactcaagcaacgcataccacaattccactcatgccgcagacgtgcttcatgcaaccgcttttttcttgggcaaggaaagagtaaagggaagtctggaccagcttgatgaagtcgccgcgctgatcgccgccactgtgcacgacgtggaccatcctggccgaacaaattcattcctgtgcaatgcagggagtgagttggccgtcctgtataacgataccgctgtactcgagtcccaccacactgcacttgcattccagctaaccgtaaaagacacaaaatgtaatattttcaagaatatagatcgcaaccactaccgtaccttgcgtcaggccatcattgacatggtattggcgaccgagatgactaagcactttgaacacgtcaacaagtttgtgaacagcattaataagccaatggccgctgagatcgaaggcagcgactgtgaatgcaatccagcgggaaaaaactttcctgaaaaccagattttgatcaaacgaatgatgatcaaatgcgccgatgtcgccaatccctgcagacctctggatctgtgcatagagtgggccgggcgcatctcagaagagtacttcgcacaaaccgacgaggaaaagcgtcagggtctacccgtcgtgatgccagtgttcgaccgtaacacctgcagcatcccaaagtctcagatttcatttatcgactatttcataaccgatatgttcgatgcttgggacgccttcgctcatcttccagccctgatgcagcatttagcagacaattacaagcattggaaaaccctggacgacttgaagtgcaagtcactcagactgcctagcgacagttag

SEQ ID NO: 199364 - DNA, 2517 bp, Artificial Sequence
  Description of Artificial Sequence: Synthetic coding sequence
atgggctgcgcccccagcatccacgtgagccagagcggcgtgatctattgtagagattccgatgagagcagttcaccaagacagaccaccagcgtttctcaagggccagctgcacccctaccaggactcttcgtgcagaccgatgccgccgacgctattcctccctcaagggcctcaggcccgccaagtgtggcaagggtacgaagagctcggactgagctgggcagcggtagctccgcaggctcagccgccccggccgcaacaaccagccgtggccgtcgccgacattgctgctcatcagccgaagccgaaactcagacctgctatacttctgtcaaacaggtttcttccgcagaagttcggattggacctatgaggttgactcaggacccaattcaggtacttttgattttcgccaaggaggatagtcagagcgatggattctggtgggcgtgtgatcgggcaggctatagatgtaacatcgcacgtacgccagagtctgccttagaatgtttcctggacaaacaccacgagatcattgtgattgatcaccgtcaaacccaaaatttcgacgcagaagccgtgtgcaggtctattcgagctaccaatccatccgaacacaccgtgatactcgccgtagtaagtagggtcagcgacgatcatgaagaagccagtgttctacctcttctgcatgccggcttcaataggcggttcatggaaaacagtagcattatcgcttgctacaatgagctgatacaaatagagcatggggaagtcaggtcacagtttaagctccgagcgtgtaacagtgtattcactgctctggaccactgccacgaagccatcgaaatcacctccgatgaccacgtgatacaagaatggcagggtgtgtactacgcgcgccgcaagtccggtgactcgatccagcagcacgtcaagattacacccgtgattgggcaaggaggtaagatcaggcacttcgtcagcctgaaaaagctgtgctgcactacagataacaacaagcagatccacaaaatacaccgcgacagtggagacaattcccagactgagccgcactccttccggtataaaaaccgacggaaggagtcgatcgacgtaaaaagtatttcgagtcgtggcagcgacgcacccagtctccaaaatcggcggtatccatcgatggccaggatacattctatgaccatcgaggctccaattaccaaagtgattaacattattaatgccgctcaggagaactcgcctgtaactgtggcggaggctcttgatagagtgctggagattcttcgtacaacagagctttattccccccagctcggaaccaaagacgaagacccccatacaagcgacctcgtcggaggtctgatgacagacggcctgagacggctgagcgggaatgagtatgtgtttactaagaacgtgcatcaatcgcattctcatttagccatgccaatcactatcaatgacgtgcccccctgcatctcacagctgctggataacgaagagagctgggacttcaacattttcgaactggaggccatcacacataagcgcccccttgtgtatttggggctgaaggtctttagccgcttcggcgtttgcgaatttctgaattgctctgagactaccctgagagcttggttccaggtaattgaagcaaactatcactcctccaacgcttaccacaactctacgcacgcagctgatgtgttgcacgcaaccgcctttttcctcggcaaggagcgagtcaagggctctctggatcagctcgatgaagtggctgccttgatcgccgcaacagtgcatgatgtcgaccatcctggaagaacaaactcctttttatgcaatgcagggtctgagttggctgtcttgtataatgatacagccgtgctcgaatctcaccacaccgccttggcctttcagctgacagttaaggataccaaatgcaacattttcaagaacatcgataggaaccattaccgcacactaaggcaggccataattgacatggttctggcaactgaaatgacaaagcattttgagcacgtgaataagttcgtgaactctatcaataagcctatggctgctgaaatcgaagggagcgattgcgaatgtaatcctgcaggaaaaaatttccctgaaaaccagatattgatcaaacgcatgatgattaagtgcgctgacgtggctaatccttgccggcctttagacctgtgcatcgaatgggcgggtcgcattagcgaggaatatttcgcacagacagatgaggagaagcggcagggtctccctgtagtgatgccagtgttcgacaggaacacatgctctatacctaagtcgcagatatcttttatcgattactttatcaccgacatgttcgacgcatgggacgccttcgcccacttacccgcccttatgcagcacttggcagacaattataagcactggaagactttggacgacctgaaatgcaaaagtctgagactgccgtcagattcttag

SEQ ID NO: 199365 - DNA, 2598 bp, Artificial Sequence
  Description of Artificial Sequence: Synthetic coding sequence
atgggctgcgcccccagcatccacgtgagccagagcggcgtgatctattgtcgcgattccgacgagtcttcatctcctcgacaaacaactagcgtgtctcaaggacctgccgcacctttgcccgggcttttcgttcaaaccgacgccgctgacgctataccaccatctagagcctctgggccccctagcgtagccagagtgcggcgagcccgtaccgagcttggatctggctcaagcgcagggagcgcggctcccgccgctacaacctccagaggaaggagacgccattgctgctccagcgcggaagcagaaactcagacctgctacacctcggtgaaggttctgctgatattcgcaaaggaggattctcaatccgacggtttctggtgggcttgcgatcgagccgggtatcgttgtaacatcgcacggaccccagaaagcgccttggaatgcttcttggacaagcatcatgagattatcgtgattgaccacagacaaacccaaaatttcgatgcggaggccgtctgccggtctattagggcaaccaatccctccgaacacactgtcatattagcggtggtcagccgtgtttctgatgatcacgaagaagcctctgtgctccccctactccacgctggctttaacaggcggttcatggaaaatagtagtattatcgcctgttataatgagctcattcagattgaacacggagaggtacgcagccagttcaagctcagggcatgtaacagtgttttcacagccctcgaccattgccacgaggctatcgagatcacttccgatgaccacgtgatccagtacgtgaaccctgcatttgaacgtatgatgggatatcataaaggtgaactgctgggtaaagaactggccgacctacccaagagcgataagaaccgtgcagatcttctcgataccataaacacatgtatcaagaaaggaaaagagtggcaaggggtttattatgctcggaggaaatctggtgactcaattcagcagcacgtgaaaataactcctgtgattggccagggcgggaagattcggcactttgtgtctttgaaaaagttatgttgtactactgataataacaagcagatccataagatacaccgcgactcaggagacaattctcagacagaaccacactcatttcgctataagaataggcgcaaagagagcatagacgttaaaagtatttcttcccggggtagtgatgctccaagcctgcagaacagacggtacccctccatggcccgaatccacagcatgacaatcgaggccccgatcaccaaggtgattaatatcatcaacgcagcccaggagaactcccctgtgaccgtcgctgaagccttggatagggttctcgaaatcctccgcacaactgagctttactccccgcagctggggactaaagacgaagatccacataccagcgacctggtgggagggttgatgactgacggcttacgcagactgtcgggaaatgaatatgtcttcacgaagaacgtgcaccagtcccattcacatctcgccatgccaatcaccattaatgacgttccaccgtgcatatcccaactgctggacaatgaggaaagctgggatttcaacatcttcgagctagaagccattacgcacaagaggcccctggtgtatctcgggcttaaggtgttttcacgtttcggcgtctgtgaatttctgaactgtagtgaaacaaccctccgcgcctggtttcaagtcatagaagctaactatcatagcagcaacgcctaccacaactcaacccacgccgccgacgtgctccatgctactgccttcttcctggggaaggaaagggtaaaaggaagcctggatcagctggatgaggtggccgccctaattgccgccacggtgcacgatgtggatcaccccggacgaactaattccttcctgtgcaatgctggctcagaactggctgtgctgtacaatgataccgccgtgctggaatcccaccacacggccctcgcatttcagttgactgtgaaagacacaaagtgtaacattttcaagaatatagatcgaaaccattacaggacactcagacaggccattattgacatggtgctcgccactgaaatgacaaaacactttgaacatgtgaataaatttgtcaactccatcaacaagcccatggcggctgagattgagggcagcgactgcgaatgtaaccccgctggcaagaactttcctgagaaccagatcctcattaaacgtatgatgataaagtgtgctgacgttgccaatccctgtcgcccattagacttgtgcatcgaatgggctggccggattagtgaggaatacttcgctcagaccgacgaggagaagaggcagggtttgcctgtggtgatgcctgttttcgacaggaatacctgtagcatcccaaaatcacagataagtttcatcgactacttcatcaccgacatgttcgatgcatgggatgccttcgcccacctaccagcactcatgcagcacctcgccgacaattacaagcattggaaaacactggacgacctaaagtgcaagtctttacgcctgccttcagacagctag

SEQ ID NO: 199366 - DNA, 2367 bp, Artificial Sequence
  Description of Artificial Sequence: Synthetic coding sequence
atgggctgcgcccccagcatccacgtgagccagagcggcgtgatctactgcagggatagtgacgagtccagctcacctaggcaaaccaccagtgtttcacaaggacctgcagcccctctgcccggattgttcgtccagactgatgcagctgacgctatccccccttctcgtgcatccggccctcctagtgtggcccgcgtgaggcgggccaggaccgaactgggcagtggcagctccgccggatcggctgcacccgcggccacaacaagcagaggacggcggagacactgttgtagctccgccgaagccgaaacacagacatgctacacctccgtgaaacaagtgtcaagcgctgaggtgcgcatcggcccaatgaggctcacacaggatcccattcaggtcttgctgatttttgcaaaggaagattcccagtccgatggcttctggtgggcctgcgacagggccggctatagatgcaatatcgctagaactcccgagtccgctctggaatgctttctggacaagcatcacgaaattattgtaatcgatcacaggcaaacacaaaactttgacgctgaagccgtgtgccgttctatacgagcaactaaccctagtgagcacactgtaattctggcagtagtgagccgcgtgagtgatgaccacgaggaagcaagcgtgctgcctctgctgcacgctggttttaatcggcggtttatggagaactcatctatcatcgcctgctataatgaacttatacagattgaacacggcgaagtgcggagtcagtttaagctgagggcttgcaatagtgttttcaccgccctggaccactgtcatgaggcaatcgaaattacaagcgatgaccacgtcatacagatccataaaatacatcgagactcaggagataacagccagaccgagccacactcctttcgatacaagaatagaagaaaggaatcaatcgatgtgaagtcaataagcagtcgcgggagcgatgctccttccctccagaaccgtcgctacccgagtatggcaaggattcattctatgaccatcgaggctccgatcaccaaggtgatcaacatcattaacgccgcacaggaaaatagcccagtcaccgtggcagaagcgttggaccgcgtgctcgagattttgagaactactgagctctactctccccagctggggactaaggatgaagatccccatacaagcgatctggtgggagggcttatgacagacgggcttcggcgcctgtccgggaatgaatacgtgtttaccaaaaacgtccaccagtctcactcccatctggccatgccaatcacaatcaacgatgtgcctccctgtattagccagttacttgacaatgaagaaagctgggatttcaatatattcgagctcgaagctatcactcataagaggcctctcgtatacctaggtctcaaagtcttcagccgctttggtgtgtgtgagtttttgaactgctcggaaacgacactaagggcctggttccaggttatagaggccaattaccacagtagcaatgcctaccacaacagtacacacgcagcggacgttctgcacgccactgcatttttcttggggaaagagcgcgtgaaaggtagcttagaccagttggacgaagttgcggcactgattgctgccacagtgcatgatgtggaccacccagggagaactaacagcttcctgtgtaatgccggatcggaactcgctgttttatataatgatacagctgtgctcgagtcacaccacacggcccttgctttccagctgacagtcaaggacacgaagtgtaacatcttcaagaatattgaccgcaaccactaccgcactctccggcaggcgatcatcgacatggttttagccacagagatgacaaagcatttcgagcacgtcaataagttcgtgaattcaatcaacaagccaatggccgctgaaattgaagggtccgattgcgaatgtaatcccgctggaaaaaatttccccgagaaccaaatcttgattaagcgcatgatgatcaagtgcgccgacgtggcaaacccttgtaggcctctggacctctgtattgagtgggccgggcgcatcagtgaagagtactttgcccaaaccgatgaagaaaaacgccagggactgcctgtagtaatgcctgtgtttgatcgcaacacatgcagcatcccaaagagccagataagttttatcgattactttatcaccgatatgtttgacgcttgggacgcattcgcccacttgcctgctctgatgcagcacttggctgacaactacaaacattggaagacactggacgatttgaaatgcaaatctctgcgcctgccatccgactcttag

SEQ ID NO: 199367 - DNA, 1053 bp, Artificial Sequence
  Description of Artificial Sequence: Synthetic coding sequence
atgcccatcaccatcaacgacgtgcccccctgcatcagccagctgctggacaacgaggagtcttgggatttcaatatatttgagttggaagccatcactcacaagcgcccactagtctacttaggattaaaggtgttctcacggtttggcgtgtgcgaatttctcaactgttccgaaacaacacttcgcgcctggtttcaggttattgaggccaattatcacagttccaatgcctaccacaacagcacccacgccgccgacgtactccacgcgacagccttcttcctcggaaaggagcgcgtaaagggaagcctggaccaactggacgaagtggctgctttgattgccgcgactgtccacgatgttgatcacccaggaagaactaattcttttctgtgtaacgcgggttccgaactggctgtcttgtataatgacacagccgtgttagaatcccaccatacagcactcgcgtttcagctaactgttaaagatactaagtgcaatatttttaagaatattgacaggaatcactacaggaccctgcgacaggctattattgacatggtgctggctaccgaaatgacgaagcactttgagcacgtaaataagttcgtgaactccattaataaaccgatggctgcagaaatagagggatcggactgtgaatgtaacccagcggggaagaactttcctgagaaccagatactgattaaacggatgatgattaagtgcgcagacgtggccaatccttgcagacctctggacctgtgcatcgagtgggctggtcggatctctgaggaatatttcgcccaaacagacgaggagaagcgacaaggccttcctgtggtgatgcccgtattcgacagaaacacatgtagcatccccaaaagtcagattagcttcatagattacttcataaccgacatgtttgacgcttgggacgctttcgcccacctcccagccctgatgcagcatctggcagataactacaagcactggaaaacccttgatgacctgaaatgcaagtctctgcggcttcctagcgactcctag

SEQ ID NO: 199368 - DNA, 1782 bp, Artificial Sequence
  Description of Artificial Sequence: Synthetic coding sequence
atgggcagcggcagcagcagctaccggcccaaggccatctacctggacattgatggtcgtatccagaaagttattttttccaagtactgcaattcgtccgatataatggacctcttttgtatcgcaaccggattgcctcggaatactactatttccctgttgacaactgacgatgccatggtaagcatcgacccaacaatgcccgccaactctgagagaacaccctacaaggtgaggccagtggcaattaagcagctgtccgcaggcgtggaggacaaaagaaccacatcaagagggcagtccgcagagcgtccactgcgcgaccgcagggttgtggggctggagcagccccgcagggagggggccttcgagagcggacaggtggagcctagacccagagaaccccagggatgctatcaagaaggccagcgcatacctccagagcgggaagaactcatccaaagcgttttagcacaggttgccgaacagttctccagagcttttaagatcaatgaattgaaggccgaagtggccaatcatctagccgtgctcgaaaagcgcgtggagctggagggactcaaggtggtcgagatcgagaaatgcaaaagcgacattaaaaagatgagagaagagctagcagccagatcttctcggacaaactgtccatgcaaatacagtttccttgataatcataaaaagctaaccccccgccgcgacgtgccgacttatcctaaatatctgctcagtcccgaaaccattgaagctctgaggaagcccacattcgacgtatggttgtgggagcctaatgaaatgctttcttgtcttgagcatatgtaccatgacttggggcttgtgcgtgatttttcaattaaccccgtgaccctgaggaggtggctgttctgtgtccacgataactacaggaacaaccccttccacaattttaggcattgtttctgcgtggcgcagatgatgtatagcatggtatggctgtgttctctacaggaaaaattttctcagaccgatattctcattttaatgacagcggccatctgtcacgacttggatcatccagggtacaacaatacctatcagatcaatgccaggacagagctggctgtcaggtataatgacatatcacctcttgagaatcaccactgcgcagtggcctttcagattttggctgagcccgagtgcaacattttttctaacattccccctgacggctttaagcagatccggcagggcatgatcaccctgattcttgcgacagacatggcccgtcatgcagagattatggactcgttcaaagagaagatggaaaacttcgactacagcaatgaggagcacatgaccctgctaaaaatgatcctcattaaatgctgtgacatttcaaacgaggtgcgtcctatggaggtggcagagccttgggtggattgtcttttggaggaatatttcatgcagtctgatcgggagaagtctgaggggctacctgtggctccttttatggaccgagacaaggtgacaaaggccactgctcagattggcttcattaaattcgtactgatcccaatgttcgagactgtcacaaagctttttcccatggtagaagaaattatgctccagcctctgtgggaaagccgggatcgctacgaggagttgaagaggatcgatgacgccatgaaggagctacagaaaaaaacagattctctcacctccggagccacggagaagagccgcgagagaagtagagatgtgaaaaactcagaaggagactgcgcgtag

SEQ ID NO: 199369 - DNA, 1704 bp, Artificial Sequence
  Description of Artificial Sequence: Synthetic coding sequence
atgggcagcggcagcagcagctaccggcccaaggccatctacctggacatcgacggcagaattcagaaggtcattttctccaaatactgcaactcctcggatattatggatctgttttgcatcgctaccggcttgccccgaacgccttataaggtgcggcccgttgccattaaacagttatctgcaggggttgaggacaaaaggacaacctctcgcggacagtctgctgaacgccccctgagagatcggagagttgtgggcctggaacagccaagacgagagggtgcatttgagtctggacaggttgaaccacgcccgagggagccacagggctgttaccaggagggccagagaatcccacccgagcgcgaagagctgatccaaagcgtcctcgcacaggtcgcggaacaattctctagggcctttaagattaatgagctgaaggcagaagtagcaaaccatctggcagtgctggaaaagcgcgtggagttggaggggctgaaggttgtggagatagagaagtgtaagtccgacataaaaaagatgcgagaagagttagctgcacgttctagcaggaccaactgcccctgtaagtatagtttcctggacaatcataagaagttgaccccccgccgggacgtaccgacgtacccaaaatacctcctatcaccagagacaatcgaagcactgagaaagcccactttcgacgtctggttgtgggaaccaaacgagatgctgtcctgcctggagcacatgtatcacgatcttggcctcgttagggactttagcatcaatcctgttacgctgcgccggtggcttttttgcgtgcatgataattaccgaaataaccctttccataactttcgccactgcttctgcgttgcccagatgatgtacagcatggtttggctgtgctcgttgcaggaaaagttctcccagacggatatcctcattcttatgactgctgctatctgccacgatctcgatcatcccgggtacaataacacataccaaataaatgccaggacagagctggccgtcaggtataacgatatatccccattggagaaccaccattgtgccgtcgcattccagatcctcgccgaacccgaatgcaacatttttagcaacatcccacccgatggcttcaagcagatcaggcagggtatgattaccctcattctggctactgacatggcaagacacgccgagatcatggactcgttcaaagagaagatggagaattttgattattccaatgaagagcatatgaccctcctaaagatgatcctgatcaaatgttgtgacatttctaatgaagtgcggcccatggaggttgccgaaccctgggttgactgcctcctggaggaatattttatgcaaagcgatagggagaagtctgaaggcctgcctgtggctccattcatggaccgggacaaggtgaccaaggcaaccgctcaaattggtttcattaaattcgtgctgattccaatgttcgagaccgtcacaaaactctttcccatggttgaagaaatcatgctccagcccctctgggaatcccgcgatcgatatgaggaactgaaaaggattgatgacgctatgaaggagttgcaaaaaaagaccgactcccttacttctggggcaaccgaaaaatctagagagcgttcgagggacgtgaaaaacagtgagggggattgcgcctag

SEQ ID NO: 199370 - DNA, 1476 bp, Artificial Sequence
  Description of Artificial Sequence: Synthetic coding sequence
atgggcagcggcagcagcagctaccggcccaaggccatctacctggacattgacggcagaattcaaaaggagcacgaccatctcccagccgatcatcgcaggcgccatgggcttcataggccgcatcatgctcgagagttcagaacccacagcgtacagagcgaaacctgcggtcaccaagccaccctccgggcattcaagattaacgaattgaaggccgaggtcgccaatcacctggctgtccttgagaagcgtgtggagctagaggggctcaaagtggtggagatcgagaaatgtaaaagcgatattaagaagatgcgtgaggagctggccgcccggagctctcgaaccaactgtccctgcaaatacagttttctggacaatcacaaaaaattgacccccaggcgagacgtgcccacatatccgaagtatcttttatctcctgagaccatcgaggccctgagaaagccaacatttgatgtctggctctgggagcctaacgaaatgctcagttgtctcgaacatatgtatcatgacttgggccttgtgagggacttctctatcaaccctgtcaccctgcggagatggcttttctgtgtgcacgataattacagaaataacccctttcataactttcgtcattgcttctgtgtcgctcagatgatgtactccatggtctggctgtgtagtttgcaggagaagtttagccagactgacatactgatactgatgaccgcagcaatctgtcatgacctcgatcatccaggctacaataacacataccagattaatgcacgcaccgaattagccgttcggtataatgatatctcaccactggaaaatcatcattgcgctgtcgccttccaaatcctagctgaacccgagtgtaacattttctccaacattccccccgacggattcaaacagattagacaaggcatgatcacacttattcttgctacagacatggcccggcacgctgagatcatggacagcttcaaggagaagatggaaaattttgattattctaatgaagaacacatgactctgctgaaaatgatcttaataaagtgttgcgacatttctaatgaggtcaggcctatggaagtcgccgagccgtgggttgactgcctgctggaggagtactttatgcaatccgaccgtgagaaatctgagggactgcccgtggcccccttcatggaccgggacaaggtgaccaaggccaccgcacagataggtttcatcaagttcgtattgattccaatgttcgagaccgttacaaaattgttcccgatggtcgaggaaatcatgctgcagccgttgtgggagagtcgagaccgatatgaggaactgaagaggatcgacgacgcgatgaaagaactgcaaaagaaaaccgactcgctcacctctggtgcaactgagaagtcccgagaaagatcaagggacgtaaaaaacagcgaaggcgactgcgcttag

SEQ ID NO: 199371 - DNA, 1602 bp, Artificial Sequence
  Description of Artificial Sequence: Synthetic coding sequence
atgggcagcggcagcagcagctaccggcccaaggccatctacctggacatcgacggtagaatacagaaagtgattttttcaaaatattgcaactccagcgatatcatggatctgttctgtatcgctaccgggctgccccgcaatacaaccatttctcttctaacaactgatgacgccatggtgagtatcgatcccactatgcctgccaattcagagcggacgccctataaggtgcgccccgtcgctataaaacagttgtcggagcgagaagaactgattcagtccgtgctggcccaggtggcagagcaatttagcagagcatttaaaatcaatgaattgaaggctgaggtcgccaaccacctcgccgtcctggaaaaacgggtggagctagagggactgaaagtcgtcgagatcgagaaatgtaagtctgatatcaagaagatgagggaagagcttgccgcccgcagtagccgaaccaattgtccatgcaaatatagctttctggataaccacaagaagcttaccccgagacgggacgtaccaacttatcctaaatacctgctgtcccccgaaaccatcgaagcccttcggaagccgactttcgatgtttggctgtgggagcccaatgagatgttatcttgcctagagcatatgtaccacgatcttggcctggtgcgggattttagcattaatccagtgacacttagaagatggttattctgcgtacacgacaactaccgaaataatccattccacaactttcggcattgtttttgtgtggcacagatgatgtattccatggtttggctgtgctctctgcaggagaagttctcccagacagatattctgatcctgatgaccgctgctatctgccacgaccttgaccacccaggttataataacacataccaaattaatgccaggaccgagctggctgtacgctacaatgacatcagccccctggaaaaccatcattgtgctgtggcctttcagatcctggccgagcccgagtgtaatatcttttccaacatcccccctgatggctttaagcagatcaggcagggcatgattacactgattttggccactgacatggcccgacacgccgagattatggattcgttcaaagagaagatggagaatttcgactactccaatgaggagcatatgactctgctcaaaatgattctgatcaagtgttgtgatattagcaacgaagttcgaccaatggaggtcgccgagccctgggttgactgcttactggaggaatatttcatgcaaagcgatcgggaaaagagcgaggggctgcctgtggccccgttcatggaccgagataaagttactaaggcgacagcgcagattggattcattaagttcgtgctgatcccaatgttcgagaccgtgactaaacttttccccatggtggaagaaattatgctacagcccctttgggagagccgggataggtatgaggaactgaagcggattgatgatgccatgaaagaactgcagaaaaaaacagattctttaacgagcggcgctacagaaaagtctcgcgaaagaagtcgggacgtgaagaactcagaaggagactgtgcttag

SEQ ID NO: 199372 - DNA, 1398 bp, Artificial Sequence
  Description of Artificial Sequence: Synthetic coding sequence
atgggcagcggcagcagcagctaccggcccaaggccatctacctggatatcgacggaaggattcagaaacatagtgtccagagtgagacctgcggccaccaagccactttgcgcgctttcaagattaatgaacttaaggccgaggtggcgaatcacctggctgtgctcgaaaagagagtggaactggagggcttgaaagtggtcgagattgaaaagtgcaaaagcgatattaagaagatgcgggaagagctagccgcgcggagcagccgaacgaactgtccttgtaaatacagtttcctggacaatcacaaaaagttgaccccgcggagagatgttccaacctacccaaaatacctactgtcacctgaaacaattgaggccctgcggaagcctacatttgatgtctggttatgggaacccaatgagatgcttagctgcctggagcacatgtaccacgacctggggctagtacgcgacttttcaatcaatcccgtgaccttaagaagatggctgttctgcgtgcatgacaattacaggaacaatccgttccacaactttagacattgcttctgcgtggcccagatgatgtactctatggtgtggctgtgctccttgcaggaaaagttctcccaaaccgacatcctgatcctaatgactgccgctatctgtcacgacctggaccaccccggctataacaatacgtaccagataaacgctcgtacagaacttgccgtgcgctataacgacatcagcccacttgaaaatcaccattgcgctgtggcgtttcagatcctggcagaaccagaatgtaatattttttccaatattccccccgatggatttaagcagatcaggcagggaatgattacactcattctcgcaactgatatggcaaggcacgccgagatcatggattctttcaaggagaagatggaaaatttcgactactcaaacgaggagcacatgacactcctcaagatgattttaatcaagtgctgtgatatctctaacgaagtccgtccgatggaagtcgcagaaccttgggtcgattgtctacttgaggagtatttcatgcagagcgaccgagaaaaaagcgagggacttccggttgcccccttcatggatagggacaaggtgacaaaagccacagcccaaattggattcattaaattcgtacttattccgatgttcgaaactgtcacgaaattgttccccatggtcgaagagattatgcttcagcccttgtgggaatcacgtgaccgatacgaagagctgaagcggattgacgacgcgatgaaggagctccaaaaaaagactgatagcctcacatcaggggcgactgagaaatctagagaaaggtcccgcgatgttaagaatagcgaaggggactgtgcatag

SEQ ID NO: 199373 - DNA, 1623 bp, Artificial Sequence
  Description of Artificial Sequence: Synthetic coding sequence
atgggcagcggcagcagcagctaccggcccaaggccatctacctggacatcgacggccgtatacagaaagtgattttttcaaagtactgcaattcatctgacatcatggatcttttttgtattgctactggtttgccacgtaatacaactattagcctgttgacaactgacgatgccatggtgtccattgaccctactatgccagccaactccgaacggaacgagctcatcttatatacatctttacgaaacctcttgttcctgccaagtaaggagtcatgggcctcccaccagcacagcgttcagagcgaaacgtgtgggcaccaagctactctgcgcgccttcaaaataaacgagctaaaagccgaggtcgccaaccaccttgcggtgctcgagaagcgcgtggaattggagggactgaaagtggtggaaatcgagaaatgtaaatcagacatcaaaaaaatgcgcgaagaactggctgcaaggtcctcaagaacaaactgcccatgcaagtatagctttctggacaaccacaagaagcttacgcctcgaagggatgtgcctacgtatccaaaatacttactttctcctgaaactattgaggctcttcggaaaccgacgttcgacgtatggttatgggagcctaacgagatgctgtcgtgcttggaacacatgtaccacgacctggggttggtgcgcgacttttctataaatccagtgactttacgtcggtggcttttctgcgttcacgataactaccgaaacaatccttttcacaactttaggcactgcttttgcgtggcccagatgatgtacagcatggtgtggttgtgctccctgcaggagaaattttcccagaccgatattttaatccttatgactgccgccatctgccacgatcttgatcacccaggatacaataatacttaccagataaacgcgcgaacagagctggcagtgaggtataacgacatatctccacttgaaaaccatcattgcgctgttgcctttcagattctggctgagcccgaatgcaacatattttctaatatcccccctgacggattcaaacagatacgtcagggcatgattacgttgattttggccacagacatggccaggcatgccgagattatggactccttcaaagaaaagatggagaatttcgattactcaaatgaggaacatatgaccctcctgaagatgatcctaatcaagtgctgcgacattagcaacgaagtcagaccaatggaggtagccgaaccgtgggtcgactgcctcctcgaagagtacttcatgcagtcggaccgcgagaagtcagaaggcttacctgttgcccccttcatggacagagataaggtgacaaaagctaccgcgcagatcggcttcattaaatttgtgctgattcccatgttcgagacagtgactaagctgttccctatggtggaggagataatgctgcagcccctgtgggagtctagggacaggtatgaggaactgaagcgaattgacgatgcgatgaaggagctgcagaaaaagactgatagcctcacaagcggcgcaaccgagaagagtagggagcgctcccgcgatgtgaaaaactccgaaggcgactgcgcttag

SEQ ID NO: 199374 - DNA, 1401 bp, Artificial Sequence
  Description of Artificial Sequence: Synthetic coding sequence
atggacgccttccggagcaccccctacaaggtgcggcccgtggccatcaaacaattgagcgagagggaggagcttatccaatcagtgttagcccaagtcgccgaacagttcagccgggcattcaaaatcaatgagctcaaagctgaggtcgccaaccatctcgccgtgctggaaaaacgggtggagctggaggggctcaaggtagtggagattgaaaagtgcaagagcgatattaagaaaatgcgagaggaattggcagcaaggagttctcggaccaactgtccctgcaagtacagtttccttgacaaccacaagaagctgacgccacgaagagacgttcctacttaccccaagtacctcctgtcccccgaaacaattgaagctcttcgcaagcccactttcgacgtctggctgtgggaacccaatgagatgttaagctgcctcgagcatatgtatcatgacttaggtttggttcgcgatttcagtataaacccagtgacacttcggcgttggctgttctgcgtacacgacaactatcgaaataaccccttccataactttagacattgtttttgtgtagcacaaatgatgtacagcatggtctggctctgttccctccaagaaaagtttagtcagacagacattttgattttgatgaccgctgctatttgccacgacctagatcatcctggctacaataatacatatcagatcaacgcaaggaccgaactcgcggtccgatacaatgatatctcacctctcgaaaaccaccactgcgccgtggcgtttcagattttagccgaacctgaatgtaatatcttcagcaatatcccccctgatggattcaagcagatccgacagggcatgataacgctcatcctggccaccgacatggctagacatgctgagattatggacagttttaaggaaaaaatggagaacttcgattactcaaacgaggaacacatgactctgctgaagatgatccttatcaagtgttgtgacatctccaatgaggtcagaccaatggaagtggcagaaccctgggtggattgtcttctggaggaatacttcatgcaatccgaccgggagaagtctgaaggcttgcccgtagcccccttcatggatcgggacaaagtaacaaaggctacagcccagatcggcttcataaaattcgtcctcattccaatgtttgagactgtcaccaaacttttcccaatggtggaagagatcatgttacagccactctgggaatcacgggatagatatgaggagttgaagaggatcgacgacgccatgaaggaacttcagaagaagaccgacagcctgacttcaggggctactgaaaagagtcgcgaaagatcgcgggatgttaaaaatagcgagggggattgcgcctag

SEQ ID NO: 199375 - DNA, 1659 bp, Artificial Sequence
  Description of Artificial Sequence: Synthetic coding sequence
atggacgccttccggcggaacaccaccatcagcctgctgaccaccgacgatgcaatggtttctatagatccgacgatgcccgcaaacagcgaaagaactccatacaaagtgagaccggttgcgatcaagcagctcagcgcaggggtagaggataaaagaacaacaagtcggggacagagcgccgaacgccccctgagggacagacgcgtcgtgggtcttgagcagcctcgcagggagggcgcctttgagtcaggtcaggtcgaaccccgcccccgtgagccacaggggtgttaccaagaggggcagcgaatcccccctgaacgggaagagctgattcagagcgtgctggcacaggttgcagaacaattcagccgtgccttcaagatcaacgaacttaaagcagaagtggctaatcatttggccgtcctagaaaagagggtcgaactggaaggcttgaaggtggtggaaatcgagaagtgcaagagcgatatcaagaagatgcgggaagagctggccgctcggtcctcaaggacgaattgcccttgtaagtactcgttcttggacaaccacaagaagctcacacctagacgcgatgtgcctacgtatccaaagtacttgttaagccccgagactatcgaagccctgcgaaaacctacctttgacgtgtggctgtgggagcccaatgagatgctcagctgtctggagcacatgtatcatgacctcggactagtccgagacttttctataaacccagtaactttaaggcgctggctgttctgtgttcacgacaattacagaaacaatccctttcataacttcaggcattgcttctgtgtagcccagatgatgtactctatggtgtggctctgcagtctgcaagagaaattctcccagacagatatactgatcctgatgaccgctgccatttgtcacgatctagatcaccccggatataataacacatatcaaataaatgccaggacggaattagctgtccgctacaacgacatatccccattggagaatcatcactgtgctgtggctttccagatcctggctgaaccagagtgcaatattttctccaacatccctccagacgggtttaagcagataagacagggtatgatcacactgatcctcgccaccgatatggcaagacacgctgaaataatggatagcttcaaagaaaagatggaaaacttcgattattctaacgaggagcatatgactttacttaagatgatcttaatcaaatgctgcgacatatccaacgaggtacgccccatggaagttgccgagccttgggtcgactgtttgttagaagaatacttcatgcaatcggaccgggagaaaagtgagggcctgccggttgcaccctttatggaccgcgataaggtgacaaaggccacagctcagatcggcttcattaaattcgtattgatcccaatgttcgagacagttacaaaattgttccctatggtggaggagattatgctgcagcccctgtgggaatcccgggatcgctatgaggaactgaagcgaattgacgatgccatgaaggaactgcagaaaaagactgatagtctgaccagtggggcaaccgagaagtcccgagagagatctagggatgtgaaaaattctgaaggcgattgcgcatag

SEQ ID NO: 199376 - DNA, 1302 bp, Artificial Sequence
  Description of Artificial Sequence: Synthetic coding sequence
atggacgccttccggcgggccttcaagatcaacgagctgaaggccgaggtggcgaatcacctggccgtgttggagaagagagtggaactcgaaggacttaaggtggtggagatcgagaaatgcaagtctgacataaaaaagatgcgagaggaactggctgctcgctctagcagaacgaattgcccctgtaagtattctttcttagataatcacaaaaagctaacacccagaagagacgtccctacatatcccaagtaccttctttctccagagaccatcgaggctctgcgtaagccaacttttgatgtgtggctgtgggaacccaacgaaatgctgtcatgtctggagcacatgtaccacgacttagggctggtgagggatttctcgatcaatccagtcaccttacgacggtggctgttctgtgtgcatgacaactaccggaataacccctttcacaacttccgccactgcttctgtgtcgctcagatgatgtattctatggtgtggctttgttccttgcaggagaagttttctcagaccgatatcctgattcttatgactgccgcaatctgtcacgatcttgaccatcctggatacaacaatacctatcagattaacgcaaggaccgaactggcagtgaggtataatgatatctcacccctggagaaccatcactgcgcggttgcctttcaaattctcgccgagccagaatgtaacattttttccaacattccaccggacgggtttaagcagattcgacaagggatgataactcttatactcgccaccgacatggcaagacacgcagagataatggacagcttcaaagaaaagatggagaattttgactacagtaatgaggaacatatgaccctcctgaaaatgatactgatcaagtgttgtgacatttctaacgaggttagacccatggaggttgctgaaccttgggtggattgtctgctggaagagtattttatgcagtctgatcgagaaaagagcgagggtttacccgttgcgccctttatggatcgcgataaagtaaccaaagcaaccgcgcaaattggatttatcaaatttgtgcttatcccaatgttcgagactgtgactaagctcttccctatggtggaggagatcatgctgcagcctctgtgggagtcccgcgatcgttatgaagaattgaaacgcattgatgatgccatgaaggagctgcaaaagaagactgattctctcacctccggtgcgaccgaaaagagccgggagaggtcgcgggatgtcaaaaactccgagggagattgcgcctag

SEQ ID NO: 199377 - DNA, 1380 bp, Artificial Sequence
  Description of Artificial Sequence: Synthetic coding sequence
atggacgccttccggcggaacaccaccatcagcctgctgaccaccgatgacgctatggtctcaatagaccctacaatgcccgctaattctgagcgcgcattcaaaattaatgagttgaaagccgaagtggctaaccacctggctgtgctcgaaaagagagtggagctggagggcctgaaggtggtggaaatcgaaaagtgtaagagtgatatcaagaaaatgcgagaagaacttgccgccagatcatccaggactaattgcccctgtaaatactctttccttgataaccacaagaaactgacacctcgccgggatgtaccaacctatcctaaatatttgctctcccctgagaccattgaggcactgagaaaaccaacattcgacgtctggctgtgggaacctaatgaaatgctgtcctgtctcgagcatatgtaccacgacttgggtctcgtgcgcgatttctcaatcaacccggtgacccttcgtcgctggctattctgtgttcacgacaactatcgtaataacccgttccataatttccggcattgcttctgtgttgctcagatgatgtacagtatggtttggctatgtagcttacaagaaaagttcagtcagaccgacatccttatcctgatgaccgcggcaatatgccacgacttagatcatccgggctataacaatacttatcagattaacgcccgaacggaactagccgtgcgctacaatgacataagtcctctcgaaaaccatcactgtgcagtggccttccagatattggctgagcccgaatgtaacatcttctctaatattccacccgacggattcaagcagattcgtcaagggatgataaccttgatcctggccactgacatggcaaggcacgccgaaatcatggacagtttcaaagagaaaatggaaaattttgactatagtaatgaagagcatatgacgctactgaaaatgatcttgataaaatgttgtgacattagtaacgaagtgaggcccatggaggtcgctgaaccctgggtcgattgcttacttgaagagtactttatgcagagcgatcgtgagaaatcggaggggctcccagtggccccctttatggatcgagacaaggtaactaaggccaccgctcaaattggattcatcaagtttgtcttaatcccgatgtttgaaaccgttacaaaactgtttccaatggtggaggagatcatgctgcagccgttatgggagtccagagatcgctacgaagagctgaagcgcatcgatgatgcaatgaaagaattacagaagaaaactgactctttaaccagtggcgctacagagaagagtcgagagcgttccagggacgtaaaaaattccgaaggggactgcgcatag

SEQ ID NO: 199378 - DNA, 1581 bp, Artificial Sequence
  Description of Artificial Sequence: Synthetic coding sequence
atggacgccttccggagcaccccctacaaggtgcggcccgtggccataaagcagctctccgccggggttgaagacaagagaaccacctctcgggggcagtcggctgagaggcctttgcgagataggcgtgtggtgggcctggaacaaccaagacgcgagggagcattcgagtctgggcaggtggaacctcggccccgtgaaccacagggctgctatcaggaagggcagagaattccccctgagcgcgaagagctgattcagagtgtcttggcccaggtcgccgagcagttctctcgcgcattcaagatcaacgaattgaaagccgaggtggctaatcacctggctgtgctcgagaagcgagtggaattggaaggcctcaaagtggtcgagattgaaaaatgtaaaagtgacatcaaaaagatgagggaggaacttgccgctcgatcaagccggaccaactgtccctgtaagtacagttttctcgataaccacaagaaactgacgccccggagggacgtgcccacctaccctaaatacttgctgtctccagaaactattgaggctctccggaagcccactttcgacgtgtggttgtgggagccaaatgaaatgctatcatgcctcgaacatatgtatcatgatctgggacttgtgagggacttctccatcaatccggttacattgagaaggtggttgttttgtgtccatgacaactaccggaacaacccttttcataattttaggcattgcttctgcgtcgcacagatgatgtacagcatggtgtggctgtgcagtctccaagaaaaattttctcagaccgacattctgattctaatgacagcagccatttgccacgatctggatcatcctgggtataacaatacatatcaaataaacgcacggacagagctggccgtccggtataacgacatcagccctttggagaaccaccactgcgcggtcgctttccaaatccttgcagaaccagaatgtaacatcttcagtaatatcccaccagacggtttcaagcagatcaggcagggcatgattacactgatcctcgccactgatatggccaggcatgcggagatcatggattcattcaaagagaagatggaaaatttcgattattccaatgaagaacatatgaccctcctcaaaatgatactaattaagtgttgcgacatttcaaatgaagtaaggccgatggaagtggcagagccgtgggtggactgtcttctcgaagaatactttatgcaaagcgaccgagaaaagtctgagggcttgccagtggctcccttcatggatagggataaggttaccaaggccaccgcccagatcggcttcatcaaatttgtgctcatccctatgttcgagacagttactaaactgtttccaatggtggaggagatcatgctgcagccactgtgggagagtcgagatcggtacgaggaattaaagcgcatcgacgatgcgatgaaggaactgcaaaagaagacagattcattgactagcggcgcaacagaaaagagtcgagaacgctccagggatgtgaagaacagcgagggcgactgcgcttag

SEQ ID NO: 199379 - DNA, 1479 bp, Artificial Sequence
  Description of Artificial Sequence: Synthetic coding sequence
atggacgccttccggcggaacaccaccatcagcctgctgaccaccgacgacgccatggtgagtattgaccccactatgcccgccaattctgagaggactccttacaaagttagacctgtggccattaaacaactttcggaaagagaagagctgattcagtcggttctcgcacaggtggctgagcagttcagtagagcttttaagataaacgaactgaaagctgaggtcgctaaccacctcgccgttcttgaaaagcgagtggagctggaaggtctgaaagtagtggaaattgagaagtgcaaatctgatattaagaaaatgcgggaggaactggcagcacgcagttccaggaccaattgcccatgcaaatatagtttcttggataatcacaaaaaattgacccccagaagggatgtccccacgtacccaaagtatctcctgagcccggaaaccatcgaggcccttcggaagccaacatttgatgtgtggctgtgggagccaaatgagatgctttcctgtctggagcacatgtaccatgatctcgggcttgtccgggacttctctatcaaccctgtcactctgcggcggtggcttttctgcgttcatgataactatagaaataatcccttccacaattttaggcactgtttttgcgtcgcccagatgatgtactccatggtgtggctctgtagtctccaggaaaagttcagccagacagatatcctgattctgatgactgccgctatctgtcatgacctggatcacccaggctacaacaatacctatcagattaatgctcgcaccgagctggccgttcgatataatgacatttcacccctggaaaaccatcattgcgctgtcgccttccagatcctggctgagcccgagtgtaacattttcagcaacatacctcctgatggcttcaagcaaatcagacaaggcatgatcacgctaattttggcaacggacatggcacgccacgcagagattatggattcttttaaggagaagatggaaaactttgattatagtaacgaggaacacatgaccctgctcaagatgattctcatcaaatgctgtgacatcagtaacgaagtacggccaatggaggttgccgaaccctgggtggattgccttctcgaggaatacttcatgcagagtgaccgagagaaaagcgaaggccttccggtggcgcctttcatggacagggacaaagtgacgaaggccactgcacagattggattcattaaattcgtactcattccaatgtttgaaacagtgaccaagttgtttcctatggtggaagagataatgttgcagcccctttgggagtcccgggatcgatacgaggagctgaaaaggatcgatgacgcaatgaaggagctgcagaaaaaaacggatagtttgacctctggcgccaccgagaagagccgggaacgctcgagagacgtgaagaattctgaaggtgactgcgcatag

SEQ ID NO: 199380 - DNA, 1524 bp, Artificial Sequence
  Description of Artificial Sequence: Synthetic coding sequence
atgggcagcggcagcagcagctaccggcccaaggccatctacctggacatagatggccgcatccagaaagtcatttttagcaaatactgtaattctagtgacatcatggacctcttttgtattgcaacagggctccctcggactccctacaaggtccggcctgtggcaatcaagcagctcagcgaacgggaagaactcatacagagcgtcctggcacaagtggcagaacagttttctcgcgctttcaaaatcaatgaacttaaagcagaggtagcgaatcatctggctgtactggagaaacgggtcgagctggaaggccttaaggtggtggagatcgaaaaatgtaaaagcgacatcaaaaaaatgcgagaggagctggcggcgcggagctctcgcactaactgcccttgcaagtattccttcctcgacaatcataaaaaattaactccccgccgcgatgtgcctacataccctaaatatctcctgtctccggagacaatcgaggccctgcggaaaccgacctttgatgtttggctttgggaaccgaacgagatgttaagctgcctggagcacatgtaccacgaccttgggcttgtaagggatttctctataaaccccgtcaccctgagacgttggctattctgtgtgcatgacaactacagaaacaacccctttcacaattttcgtcactgtttctgcgtcgcgcagatgatgtattcaatggtctggctctgctccctgcaggagaagttctcccagacagacattctgattctgatgacggctgctatctgccacgacctggatcaccccggctataacaacacataccaaattaatgcccgaactgaattggccgtacggtataacgacatttcccccttggagaatcaccactgtgccgtggccttccagatcctcgccgagcccgaatgcaacatcttctctaatatccctcctgacgggttcaagcagatacgtcaagggatgattacgttgatcctggcgactgacatggcaaggcacgctgagattatggactccttcaaagaaaagatggagaattttgattattccaacgaagaacatatgacattattgaaaatgattctgatcaagtgttgcgacataagcaatgaggtgagacccatggaagttgctgagccctgggtggattgtctgttggaggagtatttcatgcagtcagaccgcgaaaaaagcgaggggctccctgtggcgccattcatggatagagacaaggtgaccaaagccacagcacagatcggcttcattaaatttgtgctgatccctatgttcgaaaccgttaccaaactgttccctatggtagaagagatcatgctgcagccgctgtgggagtctcgagacaggtacgaagagctcaagaggattgacgatgccatgaaggagctgcaaaagaagactgacagcctcacaagcggtgcaaccgaaaaatcacgtgaacgctctagagacgtcaagaattccgaaggcgattgcgcgtag

SEQ ID NO: 199381 - DNA, 1398 bp, Artificial Sequence
  Description of Artificial Sequence: Synthetic coding sequence
atggacctgttctgcatcgccaccggcctgccccggaacaccaccatcagtttactgacgacagacgatgctatggtgagcatagaccccacaatgcccgcgaattccgagagagctttcaaaatcaacgagttgaaagcggaggtggctaaccatttagctgtgttggagaaaagggtcgagctggaggggcttaaagttgtcgagatagaaaaatgtaagtctgatattaagaaaatgcgcgaggaactagccgcaaggagctctcggactaactgcccctgcaaatacagcttcctggataatcacaagaagctgacacctagacgcgatgtgcccacctaccccaaataccttctgagtcccgagaccattgaggcactgcgcaagccaacctttgacgtctggctatgggagcccaatgaaatgttgtcgtgtctggagcacatgtatcacgatcttggtcttgtgcgagacttcagcataaacccagtaacactccggcggtggctgttttgtgttcacgacaattaccggaacaatcctttccacaattttaggcactgcttttgcgtggctcagatgatgtattctatggtgtggctttgcagcttgcaggaaaagttctcacagaccgacatcctcattttgatgaccgctgccatctgccatgacttggatcacccaggctacaacaatacctatcagatcaatgctagaaccgagctggctgtccgctacaatgatatttctcctctggaaaaccatcactgtgccgtcgccttccaaatcctggccgagcctgaatgtaatatttttagtaatatccccccggatggtttcaaacagattagacagggtatgatcactctgatactggccactgatatggcgcggcacgcggagattatggactccttcaaagaaaagatggagaacttcgactactctaatgaggagcatatgaccctattaaagatgatactaataaagtgttgtgatatcagcaacgaggtcagacctatggaggtcgctgagccatgggtagactgtttactggaagagtatttcatgcagagtgaccgtgagaagtccgaaggactacccgtcgcaccctttatggaccgagataaagtgacgaaggcgaccgcgcaaatcggtttcattaaattcgttctcattccgatgtttgaaactgtgaccaaactgttcccaatggtggaagaaatcatgctccagcccctatgggagtcccgtgataggtatgaagaattgaaaaggatcgacgatgccatgaaggagttgcagaaaaagaccgacagcttgacctctggggccactgaaaagtctcgagaacgatctcgcgatgttaaaaattctgagggggactgtgcgtag

SEQ ID NO: 199382 - DNA, 1869 bp, Artificial Sequence
  Description of Artificial Sequence: Synthetic coding sequence
atgcccccccagctgcagaacggcctgaacctgagcgccaaggtggtccagggctcactcgactctcttccccaggcagtgcgggagtttctggaaaacaacgctgagctgtgtcagccagaccacattcacatctgcgacgggagcgaagaggagaacgggcggctactgggacaaatggaagaagagggcatattgcggcggctcaaaaaatatgacaactgctggttagccctcaccgacccccgagacgtagcccgtatcgagagcaaaacagttatcgtgacacaggagcagcgagatacagtcccaattcctaagacagggctttcccaattgggccgatggatgtccgaggaggattttgaaaaggcttttaacgcacggtttcccggctgcatgaaagggcgcacgatgtacgtgatcccgttcagtatgggcccactgggctcacccctgtctaaaattgggattgaattaaccgactctccctacgtcgtcgcctccatgaggatcatgacccggatgggaactcctgtgctggaagctgttggcgacggcgagttcgtcaagtgcctgcacagtgttggctgtcccctccctcttcagaagccactcgttaacaactggccatgcaacccagaacttactcttatcgcccacctccctgatcgtagagagataatctccttcgggtccggttatggcggcaactccttacttggaaaaaagtgttttgcacttcgtatggcctcccgcctcgccaaggaggaaggttggctggctgaacacatgcttatcctggggattactaatccagaaggggagaaaaaatatctggctgcagccttccccagtgcgtgtggtaaaaccaatctggccatgatgaatccctcacttcctggctggaaagtggagtgcgttggggacgatattgcctggatgaagtttgacgctcaaggccacctgcgcgccataaatcccgaaaacggctttttcggagttgcacccggaacgtcagtgaagactaatcctaatgctatcaagactattcagaaaaacacaattttcaccaacgttgccgaaacttctgacggtggagtttactgggaggggatcgacgagcctctggcttctggcgtgaccatcacctcttggaaaaacaaggaatggagctcagaggacggggagccatgtgcacatcccaactctaggttttgtacaccagcctcccagtgtccaattatagacgcagcttgggagtctccagaaggggtacccatcgagggtattatatttggcggccgccggccggccggtgttcccctcgtgtacgaagcactgagttggcagcacggagtcttcgttggtgccgctatgcggagcgaagcgacagcagccgccgagcataaaggtaaaatcatcatgcatgatccattcgccatgcggcccttttttggctacaacttcggaaaatacctagctcattggctgtcaatggcacagcaccccgccgccaagctccctaagattttccacgttaattggttccggaaagataaagagggcaaatttctgtggccgggttttggggagaattctcgggtcctagagtggatgttcaaccgcattgatggaaaggcctctaccaagctgacacctattggctatatcccaaaagaagacgccctcaacctgaagggactaggccacatcaacatgatggaactgttctccatttcaaaggaattttgggaaaaggaggtggaggatatcgaaaagtaccttgaagatcaagttaatgccgaccttccatgcgaaatcgaacgtgaaattcttgccctaaagcagcgcatttcccagatgtag

SEQ ID NO: 199383 - DNA, 942 bp, Artificial Sequence
  Description of Artificial Sequence: Synthetic coding sequence
atgaccaccggccggaccatgtacgtgatccccttcagcatgggcccccttggttcccccctgagcaaaatagggattgaactgaccgattcaccctatgttgtggcctctatgcgcatcatgacacgaatgggtacacctgtgttggaagcagtgggcgacggcgaattcgtgaagtgcctgcacagtgttggctgtcccctacccctgcagaagcctttggttaataactggccatgcaaccctgagctgacccttatagctcatctgccggatcgcagggagataatttcattcggaagcgggtacggaggtaactcactgctgggtaaaaaatgttttgcactgcgcatggctagtcgcctcgccaaagaggagggctggctggcagagcacatgctcattcttggcattactaaccctgagggcgaaaagaaatatcttgcagccgccttcccaagcgcctgtgggaaaactaacctggctatgatgaaccccagcctcccaggctggaaagtagagtgtgtcggcgacgacatcgcctggatgaagtttgacgcccaagggcaccttcgcgcgataaatcctgaaaacggattcttcggtgtggcgccgggcacaagtgtgaagactaaccctaacgccatcaagaccatacaaaagaacacaatttttaccaatgtggccgagacttctgacggcggcgtctactgggaaggtatcgacgagccactcgcctctggcgttaccattacttcgtggaagaataaagagtggtcctctgaggacggggtaagtctgccagaagccttggtgtgtagggcggccggaactgcttgcttaagccaggccctcacttctctgtcactgtcatatcgaggtacactctgcccaccccagctcgaagtgctacatccgtgccagccagtcccccaccactag

SEQ ID NO: 199384 - DNA, 915 bp, Artificial Sequence
  Description of Artificial Sequence: Synthetic coding sequence
accaccggccacctgcgggccatcaaccccgagaacggcttcttcggtgttgcacccggcactagtgtaaagactaacccgaatgcaattaagactatacagaagaacaccatatttacgaacgtggcagagacttcagatggaggcgtgtactgggagggaatcgatgagcctctagccagtggtgtcacaattacttcatggaaaaataaggagtggtcatccgaagatggggaaccatgtgcccaccccaacagccgcttctgtacacctgcaagccagtgtccaatcattgatgcggcgtgggaatcaccagagggggttcccattgagggaattatatttgggggtaggcggcccgctggcgtaccactcgtgtatgaggcgctttcttggcagcacggggtattcgtgggtgctgcaatgaggtcagaggcgacagctgcagcagagcacaaaggtaagatcattatgcacgatccatttgctatgaggccttttttcgggtataacttcggcaagtaccttgcgcactggctgtccatggcccagcaccccgcggctaagctgcccaagatttttcatgttaactggtttaggaaggataaagaagggaagtttctttggccagggttcggagaaaatagtagagttctggagtggatgttcaatcggatcgatgggaaggcctccacaaagctgacccctattgggtacattcctaaggaggacgccctcaacctgaagggattgggacatattaatatgatggaattgttctccatttccaaggagttttgggagaaggaggtcgaggacattgagaagtatctcgaagaccaggtgaatgccgatttaccctgtgaaattgagcgggagatcctggctctcaagcaaaggattagccaaatgtag

SEQ ID NO: 199385 - DNA, 918 bp, Artificial Sequence
  Description of Artificial Sequence: Synthetic coding sequence
atgaccaccggccacctgcgggccatcaaccccgagaacggcttctttggcgtagcccccggcactagcgtgaagacgaatccaaatgccattaaaaccatccaaaaaaacacaatatttacaaatgtcgctgaaacttcagacggcggggtgtactgggagggcattgacgagccgctggcatcaggtgttaccatcaccagctggaagaataaagaatggagctctgaagacggagagccctgtgcccatccaaatagccggttttgcaccccagcatcacaatgccctattattgatgcagcctgggagagtcccgagggagtgccgatagagggcattatcttcggcgggagacgcccggcaggagtgcccttggtgtatgaagctttatcctggcagcacggcgtgtttgtgggagccgcaatgcgaagtgaggcaacagcagctgcagaacacaagggcaagataatcatgcatgatccgtttgccatgcgtccattcttcggatacaatttcggaaaatacctagcacattggctctcaatggcccaacatccagcagctaaactgcctaagatcttccacgtaaactggttcaggaaagacaaagagggcaaatttttatggccaggtttcggcgagaattcacgagtgcttgaatggatgtttaataggatcgacggcaaagcctctaccaagctgactccgatcgggtacatccccaaggaggatgccctgaacttgaagggcctggggcacattaatatgatggaattgttctccattagcaaggagttctgggagaaggaagtcgaggacatagaaaaatacctggaggatcaagtgaacgccgatctaccctgcgaaatcgaacgcgagattttagcgttgaagcagcggatatctcagatgtag

SEQ ID NO: 199386 - DNA, 1674 bp, Artificial Sequence
  Description of Artificial Sequence: Synthetic coding sequence
atgagcgaccccgagatgggctgggtgcccgagccccccaccatgaccctaggcgcgtctcgtgttgagctacgggtttcttgccacggcctactggatcgtgacacattaacaaaaccacacccgtgtgtcctgttgaagctgtacagcgacgaacaatgggtcgaagtagagcggacagaggttctgcgcagttgttcttccccggtcttctcacgggtcttagctctggagtattttttcgaggagaagcagcccctacagttccacgtattcgatgccgaggacggggccaccagcccccgcaatgacacatttctgggctccactgagtgtaccctgggtcaaatcgtctcccagaccaaagtgaccaagcctctcctgctgaagaatggaaagaccgcaggcaagtcgaccatcaccatagtagctgaagaagtctctggcactaatgactacgtccagttgacctttagggcctataagctcgataataaagacctgtttagtaaatccgacccctttatggagatctacaaaaccaacgaagatcagtcagaccaactggtatggcggacagaggtggtgaagaataacctgaacccctcttgggaaccatttcggttgtcactgcacagcctgtgctcctgcgatgtgcacaggcccctaaagttcctagtctacgattacgattcgagtggaaagcacgactttataggagagttcacaagcaccttccaggagatgcaggaaggcactgctaatcctggacaggaaatgcaatgggattgcatcaatcctaagtaccgagataaaaagaagaattataagtcctccggcaccgtagtcttagcccagtgtaccgtcgagaaggtccatactttcttagactacattatggggggatgccagatcagttttaccgtcgcaattgactttacggctagcaatggtgaccccagatcctctcagagcttgcactgtctgtccccaagacagcctaaccactacttgcaggctctcagagcagtgggaggaatatgccaggactacgactctgacaagcgattccctgcattcggtttcggtgcacggatcccccctaatttcgaggtgtcccatgacttcgccatcaactttgacccagagaatcctgagtgcgaagaaatcagtggggtgatcgcaagttaccggcgctgtctgccccagatccagctttacggtcccacaaacgtggcccctatcatcaatcgcgtggccgagccagcccagagggagcaaagcactgggcaggccacaaagtactctgtcttgcttgttctgacagacggagtcgttagcgatatggcggagacccgaacagctatcgtcagagcaagccggctccctatgagtatcatcattgtgggagtcgggaatgccgacttttccgacatgagactgctggacggggatgacggacctcttaggtgccctaggggcgtgcccgccgcacgagacattgtgcagtttgtgcccttccgggactttaaagatgccgcaccgagcgcactggccaaatgcgtgctggcagaggtgccaagacaggttgtcgagtattatgcctcccaaggcattagccctggtgctccaagaccttgcaccctggctacaacacctagccctagcccatag

SEQ ID NO: 199387 - DNA, 1326 bp, Artificial Sequence
  Description of Artificial Sequence: Synthetic coding sequence
atggccgccctgtaccggcccggcctgcggctgaactggcacggcctaagccctttgggctggccaagctgtcggagcatccagacacttcgcgtactgtctggcgacttgggacagctcccaacaggcatcagggatttcgtcgaacatagcgcccgtctctgtcagcctgaaggaattcacatatgcgatgggacagaagcggaaaataccgctactctgaccctgctggagcagcaaggacttatccggaagctgcccaagtataataactgctggctcgccaggactgaccctaaggatgtagcccgcgtggagagcaagacggtgattgtgacgccatctcagcgggataccgtccagttaccaccgggaggcgcacgggggcagctcggcaactggatgagccctgccgacttccagcgtgctgttgatgagcgcttccctggctgcatgcaagggagaaccatgtacgtgcttcctttttctatgggcccagtcggctccccactgagcagaatcggagtccagctgacagattcggcatacgttgtggctagtatgaggatcatgacacgactgggaacacccgtgctgcaggcattgggcgacggggattttgtcaaatgcctgcattccgtgggccagccactgactggacaaggcgaaccagtgtcccagtggccttgcaatcccgaaaaaacgctgattggtcatgtgcctgatcaaagagagatcatatcatttggatccgggtacggcggaaactcgctgctcggcaaaaaatgttttgccttgcggatcgccagtcggctagcacgagacgaaggctggttggccgaacacatgctgatattgggaatcacgagtccagctggcaagaagcgctatgtggcagcagcctttccctccgcatgtggtaagactaacctcgcaatgatgagacccgcacttccgggctggaaggtggaatgtgtaggtgatgacatcgcctggatgaggttcgactccgagggccggctgagggcgattaatccggagaacggattcttcggtgtggcgcccggcacaagtgccacaaccaatcctaacgccatggccacaatacagtcaaacacaattttcaccaatgtggccgagaccagcgatggcggagtgtactgggaggggatagaccagccattgccgccaggagtgaccgtgacttcatggcttggtaaaccttggaagcctggcatgtgtgggggagaaggggtggcacagccaccaggactgagcacccttatggttgagaagttgtccccccagccacctaccatcttttag

SEQ ID NO: 199388 - DNA, 1521 bp, Artificial Sequence
  Description of Artificial Sequence: Synthetic coding sequence
atgagccccgccgacttccagcgggccgtggacgagcggttccccgggtgtatgcagggccggaccatgtacgtgctgccattttcaatgggccccgtcggctcacctctgagtagaattggggtgcagctgactgacagtgcttatgtcgtggcgagcatgcgtattatgaccagactgggcacacctgtgctgcaggccctcggggatggtgatttcgttaaatgccttcactctgttggccagcccctgactggccagggtgagcctgtgtcacagtggccatgcaatcccgagaagaccctcatcggccacgtacctgaccaacgcgaaatcataagtttcggatcagggtatggtggcaacagtctgctgggcaaaaaatgctttgctttaagaatcgccagtcgacttgccagagatgaaggctggctcgccgagcacatgctgattctcggcataaccagcccagccgggaaaaagcgatatgtagctgccgcatttcccagcgcctgtgggaaaactaatctggctatgatgcggcctgccctgcccggctggaaggttgaatgcgtcggcgacgatattgcctggatgcgttttgattcggaggggcgcctgagagccattaatccagagaatggattcttcggggtggcgcccggcacctctgcaaccactaatcccaacgctatggctaccatccagagtaacaccatctttacaaatgtggctgaaactagcgatggcggtgtgtattgggaaggcatcgaccagcccctcccccccggagtcactgtaactagctggctaggtaagccgtggaagccaggggataaagagccctgcgctcatccaaactctcggttttgcgctcccgcccgccagtgtccaatcatggaccctgcctgggaggccccagagggtgtccccatcgacgcgattattttcggcggacgacggcctaagggcgtcccactagtgtacgaggccttcaattggaggcatggtgtatttgtcggaagcgcaatgcgaagcgagagtaccgcagctgctgagcacaaggggaagattattatgcatgacccttttgctatgcggcctttcttcggctataattttggacactacctcgaacattggctgtctatggaaggccgaaagggagcgcaactgccacgaatcttccacgttaattggttcaggagagatgaagcaggtcactttctttggcctggctttggcgagaatgcgcgcgtcctggactggatttgtagaagactggagggcgaagatagcgctagagagacccctataggtctggtgccaaaggagggcgctctcgatctgtcaggcctcagggcaattgacacaacccagctgttcagccttccaaaagacttctgggagcaggaggtcagagacatccgatcctacctgaccgagcaggtcaaccaggatctcccgaaagaagttctggcggagctggaggccctggaaaggcgggtccacaagatgtag

SEQ ID NO: 199389 - DNA, 1521 bp, Artificial Sequence
  Description of Artificial Sequence: Synthetic coding sequence
atgagccccgccgacttccagcgggccgtggacgagcggttccccggatgcatgcaaggtcggacaatgtacgtactgccgttcagtatggggccagtcggaagtccactgtcacgtatcggggttcagctgaccgattctgcctatgtagtcgccagcatgaggattatgacccgtctgggaacccccgtccttcaggctctgggagacggggatttcgtcaaatgcctgcactccgtcggacagcctcttacaggtcagggagagccggtgagtcaatggccctgtaaccccgaaaagacattgatcggccacgtgcctgaccagcgcgagattatttccttcggcagcggctacggcgggaacagcctgctgggcaaaaaatgttttgctttgaggattgcctcgaggctggcaagggatgagggctggctggctgaacacatgttaatacttggtataacatccccagctgggaaaaaaagatacgtggccgccgcattcccgtccgcttgcggcaagactaacctagctatgatgcggcctgccttgcctggctggaaggttgagtgtgtgggtgacgacatcgcttggatgaggtttgatagtgaaggtcggctgcgggcaatcaatcccgaaaatggattcttcggggttgcgccgggaactagtgccaccacaaatcctaatgccatggcaaccatacagagcaataccatatttaccaacgtcgctgagacaagcgacggcggcgtgtactgggagggtatcgatcagccgctgcctcctggggtcactgtcactagttggttaggtaagccatggaagccgggagataaagagccctgcgcccatccaaacagtcggttctgcgctccagcaagacagtgcccaataatggaccccgcctgggaagcgcctgaaggcgtgccaatagacgctattatctttgggggaaggagaccaaagggtgtgccgctagtgtatgaggccttcaactggcgccatggcgtgttcgtggggagtgctatgcgctctgaatccacagctgccgcagagcacaagggaaagatcataatgcatgatccgttcgcgatgcgaccctttttcggttacaatttcggtcattacttagagcattggctgtctatggaagggcgaaaaggtgcccagttgcccaggatcttccatgtcaactggtttagacgcgacgaagctggccatttcctttggccaggattcggagaaaacgccagggtcctagattggatttgccgtcgccttgagggggaagattcagcccgcgaaacgccaattggcctagtgcctaaagaaggtgcactcgacctgagtgggctcagggccatcgataccacccaactgtttagccttccgaaggatttttgggagcaggaagtaagagacatccggtcctacctgaccgagcaggtcaaccaggatttaccaaaagaagtgctggcggagctggaggccctggagagaagagttcataagatgtag

SEQ ID NO: 199390 - DNA, 2343 bp, Artificial Sequence
  Description of Artificial Sequence: Synthetic coding sequence
atggccgccgtggacctggagaagctgcgggccagcggcgccggcaaagcaattggcgtgcttacaagtggcggcgacgcccagggcatgaacgctgccgtgagggccgtcacccgcatgggcatttatgttggagccaaggtgtttctgatctacgaaggatacgagggcctagtcgaaggcggggagaacattaagcaggccaattggttgtctgtctccaatattatccagttgggcggaactattatcggcagtgccagatgtaaggcttttaccacccgagagggcagaagggcagctgcctacaatctagtgcaacacggcatcacgaacctctgtgttatcggcggggatggtagcttgaccggtgcaaacatctttcggtcagaatggggatcgttgttagaggagcttgtggctgagggaaaaatctcagagaccacagctagaacctactctcatctgaacattgctggactggttggttccattgacaatgacttctgcggcacggacatgaccattggcacagacagcgcccttcataggattatggaggtgatagatgccatcacaacaacggctcagagccatcagagaacttttgtcctggaggtcatgggaaggcattgtggatacttggcactcgtgtctgccctggccagcggtgctgactggctgttcattcccgaagcccccccggaggatgggtgggaaaactttatgtgcgagaggctaggggaaaccaggtccaggggctccaggcttaatattataattattgctgagggggcaattgatagaaacggcaagcccatcagcagcagctacgtcaaggacctggttgtgcagagactgggcttcgatactcgcgtgacggtcctcggacatgtgcagcgtgggggcacaccgtcagcctttgacaggattctgtcctccaaaatgggtatggaggccgtgatggctctcttagaggccacaccggacacaccagcatgcgtggtgacactcagcgggaatcagtccgtgcggctgcccttgatggaatgcgtgcaaatgacgaaggaagtacagaaagcgatggatgacaaacgattcgacgaggctacacaactgcgcggtggctcctttgagaacaactggaatatttacaaactgttggctcaccagaagcccccaaaagagaagtccaatttcagtctggccattctgaacgtgggagcccccgcggcaggaatgaacgcagccgtgaggagtgcagttaggacaggcatttcccatggtcacacagtttatgtagtgcatgatggtttcgagggcctagcaaaggggcaggtgcaggaagtgggatggcatgacgttgctggctggctgggacgcggtggatcaatgctgggaaccaagcggacgctgcccaagggccagctggagtccatcgttgagaatattcgtatctatgggattcatgcattacttgtggtgggagggttcgaggcttacgaaggggttttgcagctcgtagaggcccgcggcaggtacgaggaattatgcattgtcatgtgcgtcatacctgccacaatttcaaataatgttcctggtactgatttttcactggggtccgacacagccgtgaacgcagccatggagagttgcgatagaataaaacagtccgcctccggcaccaagcggagggtgtttattgtggagacgatgggcggttactgtggctacctagctaccgtgaccggcatcgctgtcggagcggatgccgcttatgtgtttgaggaccccttcaacattcacgacctcaaggtcaacgtggagcacatgacggagaagatgaagaccgacattcagcgggggctagtcctgaggaacgagaagtgtcacgactattacaccacagaattcctgtacaacctgtattcctcggaagggaagggcgtgttcgattgccgcactaatgtgttaggccacctgcagcaggggggtgcccccaccccttttgacagaaactatggcacaaaacttggggttaaagcgatgctctggctgtctgagaagctgcgggaggtgtacagaaaaggcagagtctttgcaaacgctcccgactctgcatgcgtcattggtctgaagaagaaggcggttgcattctcaccagtgacagagcttaagaaggacactgacttcgagcaccggatgccccgggagcagtggtggctgtctctccggctgatgctcaaaatgctagctcagtatcgcatttcaatggcagcatacgtctctggggagcttgaacacgtgactcgtcgtaccctgagtatggataagggcttctag

SEQ ID NO: 199391 - DNA, 762 bp, Artificial Sequence
  Description of Artificial Sequence: Synthetic coding sequence
atgcggagcatgtgcaaccagggccggggccgggagagcagccggggtggactgcatgtacaggggagctgcaggggattgtcccggtcgccccaacaggagacaggatttgccaaagctcccgcagggacggattgtttcttccactgttcccccggcagtcgggggcaaggggacagaaaggaggaggttacatctgagcctggcggcacgtccatcatgtctcgcctcggcggaatgaacgctgccgtgagagctgtaaccaggatgggtatctacgtcggagccaaggtgttcctgatctacgagggttacgaaggcctggtggaggggggagaaaacataaagcaggctaactggctctctgtctccaatatcatccagctcggcggcacgatcatcggtagcgcgaggtgtaaagcattcaccacaagagaaggtaggcgtgccgccgcatacaatctggtgcaacatggcattacaaacttatgcgtcatcggaggagacgggagtctgacgggggctaacatctttcgcagcgaatgggggagcctcctggaggaacttgttgccgaagggaagatttctgaaaccaccgctcggacctattcacacctcaatatcgcaggactggtgggttccattgacaacgacttctgtggcacggatatgaccatagggacagatagtgccctgcaccggattatggaagtcatagatgctataaccactagaggccgacttggtgagctgcacgtgtag

SEQ ID NO: 199392 - DNA, 2484 bp, Artificial Sequence
  Description of Artificial Sequence: Synthetic coding sequence
atgtgcaaccagggccggggccgggagagcagccggggcggcctgcatgtgcaaggatcttgccgaggtctctccaggtctcctcagcaggaaacaggatttgccaaagcaccagccggaactgactgttttttccactgcagccctggttcccgaggccagggggatcgaaaggaggaggtgacctctgaaccagggggaacatcaattatgagcaggctgggcggaatgaatgccgctgtgcgagctgtgacccggatgggcatctacgtgggggcaaaagtgttcctgatttacgaaggatacgagggtctggtggagggcggcgagaatattaaacaagcaaattggctctccgtgagcaacataattcagttggggggaacgatcattggaagcgccagatgcaaggcctttacgacacgggagggaaggagggcggctgcgtacaacctggtgcagcacggtataaccaacctctgtgtcatcgggggcgacgggagcttaacaggagctaacatctttaggagcgaatggggttcactgttggaggaacttgtggccgagggtaagataagtgaaacaaccgctcggacttacagccatttgaacattgctgggctggttggatcaatcgataatgacttctgtggtactgatatgacaatcggcacagatagcgcacttcacaggatcatggaagtcatagatgccattacgaccacggcccagtcccaccagagaaccttcgttctggaggtcatgggtagacattgcggctacctggccctggtgagtgctctggcatccggtgcggattggctctttatccccgaggcccctccggaggatggatgggagaacttcatgtgtgagcgccttggagagacccgaagcaggggaagtagattgaacatcattatcattgctgagggcgctattgataggaatggcaagccaatctcaagttcatacgtgaaggatctcgttgtgcagcgcctgggattcgatacacgggtcacagtactgggacacgtgcagaggggtggcaccccgtcggctttcgatcgcattttaagcagtaagatgggaatggaggcagtgatggctttactagaagcaacccctgatacacccgcctgtgttgtcaccctttcaggcaatcagtctgttaggctgcccctgatggaatgtgtgcaaatgactaaggaggttcagaaggcgatggacgataagagattcgacgaagctacccagctgaggggcggatcctttgaaaacaattggaacatctacaagctgctggcccatcagaagccacccaaagaaaaatctaatttctcgctggcaatcctgaacgtcggggccccagctgccgggatgaatgctgccgttcggagtgccgttcgcactggaattagccatggccatactgtgtatgtcgtgcacgacggctttgagggtcttgccaagggccaggtccaggaggttggctggcatgatgtagcagggtggctcggccgaggcgggtctatgcttggaacgaagagaactctgcccaaaggccaactcgagtccattgtggagaacatacgaatttacggaatccacgctcttctcgtggtgggaggattcgaagcttatgaaggtgttctgcagttggtggaggcacgcggccgatatgaggaactgtgcatcgttatgtgtgtcatccccgctactatttctaataatgtccctggcaccgacttttcactcgggtctgacactgctgtaaacgccgctatggagtcgtgtgatagaataaagcaatccgcgtccggcacaaagagaagagtattcattgtagaaacaatgggcggctattgtggttacctcgctaccgtgaccggaatcgcggtgggagcagacgccgcgtacgtctttgaagatccattcaatattcacgacctgaaggtcaacgtggagcacatgaccgaaaaaatgaagaccgatattcaaagaggactggtgttacgtaatgaaaagtgtcacgactactatacaactgagtttctgtacaacctgtattcttccgaggggaagggggtcttcgattgcagaacgaacgtacttggacacctgcagcagggaggggctcctaccccctttgataggaactacggaactaagttgggcgtgaaggccatgctttggctctccgagaaattgagagaggtttacagaaaaggcagagtctttgctaacgccccagactccgcttgcgttatcgggctgaaaaaaaaagctgttgccttcagccccgtgaccgagctaaagaaagacactgatttcgagcatcggatgccccgggagcagtggtggcttagtctgcgactcatgctgaaaatgctcgcccagtaccgcatcagcatggccgcctatgtttctggcgaactggagcacgtaacacgcagaaccctctcaatggataaaggattttag

SEQ ID NO: 199393 - DNA, 1722 bp, Artificial Sequence
  Description of Artificial Sequence: Synthetic coding sequence
atgggccggcactgcggctacctggccctggtgagcgccctggcctcaggggccgactggcttttcatccctgaagctccgccagaagacgggtgggaaaacttcatgtgcgaaaggttgggggagacacgttctcggggatcccgtctgaacataatcataattgccgagggcgccattgatagaaatggaaaaccaatttcgagttcatacgttaaggatctcgtggtgcagagacttggatttgatactcgtgttaccgtcctgggccacgtgcaaagaggcggaactccaagtgcattcgacagaatcctgagttctaagatgggtatggaggccgtcatggcccttctggaggctaccccagatacaccggcttgcgtggttaccctaagcggaaaccagagcgtccgtcttccgctcatggagtgcgtgcaaatgacgaaagaggtccaaaaagctatggacgacaagcggttcgacgaagcgacacagctgaggggcggatcatttgaaaacaactggaacatctacaagctgctggctcaccagaaaccccctaaagaaaagtcaaatttctcccttgctattctcaacgtcggcgctcccgctgccggaatgaatgccgccgtgcgatcagcagtgcggactggcatcagtcacggccataccgtttacgtcgtgcatgatggctttgagggcttagcaaaaggacaggtgcaggaagtcggatggcatgatgtggctggatggttaggtcgaggtggaagcatgctgggaacgaagcgtaccttgcctaaaggccagctggaatcgatagtcgaaaatatacgcatttatggaatccacgctctgctggtcgtgggcggcttcgaggcctatgagggcgtactgcaactggtcgaagccaggggacgttacgaagagctatgtattgttatgtgcgttatccccgcgaccataagtaataatgttcccggcaccgacttttctttgggctccgacaccgccgtgaatgctgctatggaatcttgtgaccgcataaagcaatccgccagtggtacaaagagacgggtctttatagttgagactatgggcggatactgtggatacctggccacagtgactggcatcgcagtgggagctgatgccgcatacgtgttcgaagatcctttcaatatccacgatctaaaagtgaatgtggagcacatgactgagaagatgaaaacagacatccagagagggctcgtgcttcggaatgaaaagtgccacgattactatacaacggaattcctatataacttgtactcctccgaagggaaaggtgttttcgactgccggacaaatgtacttgggcacctgcagcagggcggcgcacccacgccctttgacaggaattatggcaccaaattgggagtgaaggcaatgctgtggctcagtgagaaactgagagaggtgtatcgaaagggtagggtgttcgcgaatgccccagattctgcgtgtgtgatcggactaaaaaagaaggcagttgctttttccccagtcaccgaactcaagaaagatactgacttcgagcatcgaatgccgagggaacagtggtggctgagcctgagactaatgcttaagatgttggcccagtacagaatcagcatggcggcttacgtctccggcgagcttgagcacgtaacaagacgtactctcagcatggataaagggttctag

SEQ ID NO: 199394 - DNA, 2343 bp, Artificial Sequence
  Description of Artificial Sequence: Synthetic coding sequence
atgacccacgaggagcaccacgccgccaagaccctgggcatcggcaaggctatcgctgtcctgactagtggtggggacgcacaaggaatgaacgccgcagtacgggcagtcgtccgagtggggatcttcacgggagctcgggtgtttttcgtacatgaggggtaccagggcctcgtcgacgggggcgaccacataaaggaagcaacttgggaaagtgtgtcgatgatgctgcagctcggcggaacagttattggctccgctaggtgcaaagatttccgcgagagagaggggaggctgagggcggcttacaatctggtgaaacggggaattacaaatctgtgtgtcatcgggggagacggcagcctcaccggtgccgacacctttcgatcagagtggtctgatttactatcggacctgcagaaggccggcaagataacggatgaggaagctaccaaaagctcttacttgaacatagtcgggctcgtcgggtcaatcgacaatgatttctgtggtactgatatgacaatcgggactgacagtgctctgcatcgtattatggaaatcgtggacgctattacgaccaccgcccagtcacatcaaagaaccttcgtgcttgaggtcatggggagacactgcgggtacctagcgctggtcacctcgctctcttgtggagcagattgggtgttcatacctgagtgcccacctgatgatgactgggaagagcatctgtgtaggcgactgtccgagacccgaactcgagggtccaggctcaacataattatcgtggctgaaggcgccatcgacaagaacggaaagccaattacatctgaggacattaagaatctggtagtgaaacgcttgggttacgatacccgcgtgaccgtgttgggtcatgtccagcgcggaggaacaccctcggcgttcgaccgcattctgggcagtaggatgggtgtggaggcggtaatggctctccttgaggggacacctgatacgcccgcctgtgtcgtgagtctgagcggtaaccaggcagtgcgactccctctgatggagtgcgtgcaagtaactaaggatgtcacgaaggccatggatgagaaaaagtttgacgaggctctgaagctgcgtggccgctctttcatgaataactgggaggtgtataagcttctggctcacgtccggccacctgtatccaaaagtggatcgcacaccgttgcagtcatgaatgtcggtgcccccgccgctggcatgaatgccgccgtgcgcagtacagtgagaattggactcattcagggcaatagggtgcttgtggtgcacgatggctttgaaggccttgcaaaaggccagattgaagaggcaggctggtcctatgtgggcgggtggacaggacaaggcggaagcaagctagggaccaaaaggaccctgcctaaaaaatctttcgaacagatctcagccaacatcaccaagttcaacatccagggactcgtcataattggtggcttcgaggcttacactggcgggctcgaactgatggagggcaggaagcagtttgatgagttatgcatccctttcgtggtgattcccgcaacagtgagcaataacgtgccaggttcagactttagcgtgggtgctgacacagcccttaacacaatttgcaccacctgtgacaggatcaagcagtcggcagccggcaccaagagacgggtgttcatcattgaaaccatgggtggatactgtggatacctggccacgatggcgggacttgcagctggcgccgacgccgcctatatctttgaggagccttttaccattcgcgatctgcaggcaaacgtggaacacctagtgcagaaaatgaaaacgaccgtgaagaggggactggtgcttagaaatgaaaagtgcaacgagaattacacaacagactttatttttaatctctacagtgaagaaggaaagggaatctttgacagccggaagaatgtgttaggtcacatgcaacaaggcgggagccccaccccattcgacaggaattttgccacgaagatgggtgccaaggcgatgaattggatgtctggcaagatcaaagaaagctacagaaatggcagaatctttgcaaacactccggacagcgggtgcgtgctggggatgagaaaacgggctctggtgtttcagccagtggccgaattaaaggaccagacggacttcgaacaccgcatccccaaggaacagtggtggctgaaactgagacctatacttaagatcttagccaagtacgaaatcgatctggatacgtccgatcacgctcacttggagcacatcacccggaagaggagtggcgaggccgcggtttag

SEQ ID NO: 199395 - DNA, 2556 bp, Artificial Sequence
  Description of Artificial Sequence: Synthetic coding sequence
atgcacaaggacgagttccacctgaagttcttcatgtgcgtgatccaatcccgtcaactggttcggaccccccagagaacggccggcgaggcctccacatcgtccatgctaattcccaagcccccacctaaaaccgacatcctcaagtccctggataccatggatgaccctgataccgtcggtagcatcccggtctttaaaacagagtggattatgacgcacgaggagcatcatgccgctaagaccttgggcatcgggaaggctatcgctgtcctgacgtcggggggggacgctcagggtatgaacgcagctgtgagggcggtggtacgtgtcggcatctttaccggagcccgagtcttcttcgttcacgagggttatcaagggctggtggacgggggtgaccacattaaagaggccacgtgggagagtgtttctatgatgctccaattgggtggaacagttatcggcagcgcaagatgtaaagattttagggaaagagaaggccggctcagagcagcttataatctggttaagaggggcataacaaacctgtgcgtgattggcggggatggctccctaacaggggctgataccttcaggtccgaatggagcgatctgctgagtgacctacagaaggccggcaagataacagatgaagaggctacgaaaagtagctatttgaacattgtgggcctcgttggctcaatcgataacgacttttgtggcacagatatgactatcggcactgattccgcccttcacagaatcatggagatcgtggacgcgataactacaaccgcacagagccaccagagaacattcgtgctggaggtgatgggccgtcactgtggctacctggccctcgtgacaagcctgtcatgcggcgctgattgggtctttattcccgaatgccctccagacgacgattgggaggaacacctgtgccgccgtctatccgagactaggactcgcgggagcagacttaatattataatagtggcggagggagccattgataaaaacggaaagccaattacctcagaggacatcaaaaacctcgtggtgaagagactcggctacgacacacgcgtcacggtcttgggccacgtgcagagaggcggaaccccttccgctttcgataggattcttgggtcccgtatgggcgttgaagccgtcatggcgctgttggagggcacgccagatacgcctgcgtgtgtggttagcttatcaggcaaccaggcagtcaggctgcccctgatggagtgtgttcaagtcacaaaagacgtcaccaaggcaatggatgagaagaagtttgatgaagcactcaaactgagaggacgatcatttatgaacaactgggaggtgtataagttactagcgcatgtccggccaccagtgagcaagtccggatcacatactgtggccgtcatgaatgtcggcgcccccgcggccggcatgaacgccgccgttcgatcaacagtcagaatcgggttgattcaaggcaacagggtgctggtggtgcacgacggctttgagggtctggctaaggggcagatcgaggaagccggttggtcatatgtaggaggatggactggtcagggggggtccaaattgggtaccaaaaggaccttgcctaaaaaatccttcgagcagatcagcgctaatatcactaaattcaacatccagggtctggtgatcattgggggattcgaagcctatactggcggcttggagcttatggagggcagaaagcagtttgacgagctctgtattccatttgttgtgattcctgccacagtgtccaataatgtgccaggcagcgacttctcagtcggcgccgacacggcattgaataccatttgtactacgtgtgaccggattaaacaatcagcagccggcactaaacgccgggtgttcattatagaaacaatgggcggatactgtggatatctggccaccatggccgggctggctgccggcgcggacgccgcctacatattcgaggaacccttcacaatccgtgacctgcaggcgaatgtcgagcacctcgtgcaaaaaatgaagactactgtcaagagagggctggtcctgagaaatgagaagtgtaatgagaactacacaacagactttattttcaatctgtactctgaagaaggcaaggggatcttcgacagtcggaaaaatgtcctagggcacatgcagcaaggggggagcccaaccccctttgacaggaatttcgcaaccaagatgggcgccaaggcaatgaactggatgtccgggaaaattaaggagagttatcgcaacggccgtatatttgccaacacccctgattctggatgtgtcctgggtatgaggaagcgcgctcttgtgtttcaacccgtggccgaactgaaggatcaaacagactttgaacaccggatccctaaagagcagtggtggctgaagctgcggcccatcttgaagattctagccaagtacgaaattgacctggataccagcgatcatgctcacctggaacacattactcgaaaaagaagcggagaggctgccgtgtag

SEQ ID NO: 199396 - DNA, 2343 bp, Artificial Sequence
  Description of Artificial Sequence: Synthetic coding sequence
atgacccacgaggagcaccacgccgccaagaccctgggcatcggcaaagctattgcggtgctgacctctgggggtgatgcacaggggatgaacgctgccgtgagagcagttgtgagggtcggtatttttactggtgcacgggtgtttttcgtgcacgagggataccagggactcgtggacggaggggaccacattaaagaagcgacgtgggaaagtgttagtatgatgttgcagctcggcggaaccgtgatcgggtctgccaggtgtaaagattttagagaaagggaaggacggctgagagccgcttacaatctggtaaagcgcgggatcactaacctttgcgtgataggcggtgatggaagcctgaccggggcggatacattcaggtccgaatggagcgaccttctaagcgacttgcagaaagccggaaagataactgacgaagaggccacaaagagctcttatctgaacatcgtgggtcttgttgggagcatcgataatgatttctgcggcacagatatgactattggtacagactcggcacttcatcggatcatggaaatcgtagacgccattacgaccaccgcccaatcccatcagcgtacttttgtgctcgaggttatgggacgtcattgcggctatctggcgttggtaaccagtctgtcttgcggagccgactgggtctttatccccgagtgccctccagatgacgattgggaagagcacctatgtaggaggcttagtgaaacacgaacccgggggagccgcctgaacatcatcatcgtggccgagggtgcaatcgacaaaaatggtaaacccattactagcgaggatattaaaaatctggttgtgaagcgccttgggtatgatacccgcgtgacggtcctaggccacgtccagcgaggagggaccccatctgcattcgaccgcatcctaggctcaagaatgggtgtcgaagcagtaatggctctgctcgaaggtacccctgatacacccgcctgcgtagtcagtctgagcggcaaccaggcagtgagactgccactaatggaatgtgtacaagtaaccaaggatgttacgaaagctatggatgagaagaagttcgatgaggctctaaagctgagaggtagatcctttatgaataattgggaggtttacaagctgcttgcccacgtgcgcccccccgtatccaaatccggctcgcacacggtggccgtcatgaatgtaggcgcccccgccgcagggatgaatgcagcggtcaggtcaacggttcgtattgggctgatacagggaaatcgcgttttggtggtgcacgacgggtttgagggtcttgccaagggacagattgaggaggccggttggtcctacgtcggcggctggactgggcaaggcgggtctaagctgggaacaaagagaacgctgcccaaaaagtcctttgagcagatctccgccaatataacaaaatttaatatacagggcctggtgatcatcggcggttttgaagcatacacaggagggcttgagctcatggaaggtagaaaacaatttgatgagttatgtatccccttcgtcgtgatccctgccactgtgagtaacaacgtccccggatccgacttctcggtgggagctgataccgccttaaatactatatgtactacttgcgacagaataaaacagagcgccgcagggacaaaaagacgggtgttcattatcgagaccatgggcgggtattgtggctacttagctaccatggcagggctggccgcaggggcggacgcagcctacatcttcgaagaaccctttactatccgtgacctgcaagccaacgttgagcatctggtgcaaaaaatgaaaactacagtgaagagaggacttgtgctcaggaacgagaagtgcaatgagaactacacaaccgatttcatttttaacctgtactctgaagagggaaaagggatctttgatagtcgtaagaacgtcttagggcatatgcaacaaggaggtagcccgactccctttgatcgtaatttcgctaccaagatgggcgccaaggcaatgaattggatgtccggtaaaattaaagaaagttaccgcaacgggagaattttcgctaatacccccgactccgggtgcgtactcgggatgcgcaagcgggctctcgtgttccagcctgtcgccgaactgaaggatcagaccgattttgagcacagaattccaaaagaacagtggtggctcaagcttagacctatcttgaaaatcttagctaagtatgagattgatcttgacaccagtgaccatgcccatctggagcatattactcgaaagagaagcggtgaagcagcagtttag

SEQ ID NO: 199397 - DNA, 2250 bp, Artificial Sequence
  Description of Artificial Sequence: Synthetic coding sequence
atgacccacgaggagcaccacgccgccaagaccctgggcatcggcaaggctattgcagtcctgacttcaggaggcgacgcacaaggaatgaatgccgccgttcgagccgtggttcgggttggaatcttcacaggcgctcgcgtgttttttgttcacgagggctaccaggggctagtggatggtggagaccatatcaaggaggccacctgggaaagtgtgtcgatgatgctccagctggggggcaccgttataggaagcgctcgttgcaaagattttcgcgaacgagagggtcgattgagggctgcttataacttagtaaagagaggaataacaaatctgtgcgttattggtggtgatggctctcttacaggcgcagacacttttcgcagtgagtggtcagacctactgtcggatttgcaaaaggccggcaagataacagacgaggaagccacgaaatcttcttacttgaacatagtgggactcgtcggttccattgacaatgacttttgcggaactgatatgaccataggaactgacagtgccctgcatcggattatggaaattgtggatgctattactaccacagcacaatctcaccaacggacctttgtactcgaagtgatggggagacactgcgggtatctcgcacttgtgacttctcttagctgtggggccgattgggtctttatccccgagtgtccccctgacgacgactgggaggagcatctgtgtcgcagactaagcgagacgaggactcgtgggtccagactaaatatcattattgtggccgaaggcgctatagataagaacggtaaacccatcacttctgaagacataaaaaatggatctagaatgggagtcgaagctgtcatggctctgcttgagggaacacctgatacacccgcctgcgtagtcagtctttctggtaatcaggccgtgcgcctgcctctgatggagtgcgtgcaggtcactaaggacgtgactaaggcaatggacgagaagaaattcgacgaggcactgaaactgagagggcggtcgttcatgaataactgggaggtctataaactgcttgctcatgtgcggccaccagtgtccaaaagcggtagccatactgtagccgttatgaacgtaggcgccccggcagcaggtatgaatgccgctgtgcgttctacagtcagaattggcctgatccagggaaaccgtgtgcttgtggtgcacgacggctttgagggccttgctaagggccagatcgaagaggccgggtggagctacgtaggtggctggaccggccagggggggagtaagctgggcacaaaaaggacattgccgaaaaaatcttttgagcagatctccgccaacatcacgaagttcaatattcaaggcctagtcataattggggggtttgaagcctataccggcggcttagagctcatggaaggaagaaagcagttcgacgagctgtgcatcccctttgtggttatccctgccactgtgtcaaacaacgtgccaggaagcgacttctcggtaggcgccgacaccgcactcaacaccatctgcaccacatgcgacaggatcaagcagagcgccgccggaacgaagcgccgcgtgttcataattgagaccatgggaggctactgcggttatctcgccaccatggccggactggctgctggggcagacgctgcatacatctttgaggagcccttcactatccgggatctgcaagctaacgttgagcacctggtgcagaagatgaaaactaccgttaaaagaggtctcgttctgcgaaacgagaagtgcaacgagaattacaccacggatttcatttttaatctttattccgaggagggcaagggtatcttcgactctcggaaaaacgtcctgggccacatgcagcagggaggatcccctacaccttttgacaggaatttcgctaccaaaatgggggccaaggctatgaactggatgtctggtaaaattaaggaatcctacagaaatggccggatcttcgctaacactcccgattccggttgcgtgctcggaatgcgcaagcgggccttagttttccaacccgtcgcagagcttaaagatcagacagacttcgagcacagaatcccaaaggagcaatggtggttaaaactccggccgatcctgaagattctcgccaaatatgaaatcgacctggacacgagtgatcatgcccatctggaacacattacgcgcaaacgatccggagaagccgcagtctag

SEQ ID NO: 199398 - DNA, 534 bp, Artificial Sequence
  Description of Artificial Sequence: Synthetic coding sequence
atgacccacgaggagcaccacgccgccaagaccctgggcatcggcaaagccattgctgtcctgacctccggtggcgatgctcaaggtatgaatgctgcggtcaggtctaccgttcgcatcggccttattcagggcaatcgggttctggtagtgcatgacggctttgaggggctcgctaagggacaaattgaagaggctgggtggtcatacgtgggcggctggaccgggcagggtgggagcaagctcggcaccaaaagaaccctacctaagaaaagctttgaacagatttctgccaatataactaagttcaatattcaggggcttgtgatcattggcgggttcgaagcatacaccgggggactcgaacttatggaaggcagaaaacagtttgacgaactctgcatcccttttgtggtgattcctgccacagtatctaataacgtccccggttccgatttcagcgtcggtgccgataccgcactgaacaccatctgcacgacatgcgatagaataaaacagagcgcagcaggctag

SEQ ID NO: 199399 - DNA, 2343 bp, Artificial Sequence
  Description of Artificial Sequence: Synthetic coding sequence
atgacccacgaggagcaccacgccgccaagaccctgggcatcggcaaagcaattgcagtgctcacctcaggtggcgatgctcagggtatgaatgctgctgtacgggcagtcgtccgggtgggcatttttacgggagctagggtgttcttcgtccatgagggatatcaagggctcgtggacggcggagaccatattaaagaggccacctgggaaagcgtcagtatgatgctgcagttaggaggtacggtgatcggcagcgctcggtgtaaagacttccgggagagggagggcaggttgagggccgcctacaacctggtgaaacgggggatcacaaatctttgtgtcatcggaggggatgggagcctcactggggctgatacgttccgttccgagtggagcgatctgctctctgacctacagaaggcaggtaagattacggacgaagaggcaaccaaatcctcctacttgaacatcgttgggttggttgggtctatcgacaatgacttttgtgggacagatatgacaatcggcaccgattcagcgctgcacagaataatggaaattgtggatgcaatcaccaccacagcccaaagtcatcaacgaacctttgtgctggaggtaatgggccggcattgcgggtacctggcgctcgtaacatctttgagctgcggcgctgattgggtgttcatccccgagtgtccacccgatgatgactgggaggaacatctgtgtcgacgcctgtcagagacacgcacacgagggtctagattaaacatcatcatagttgccgaaggcgccatcgacaaaaatggcaagcccatcacaagtgaggacataaaaaatctggtggtgaagcggctgggatacgatacaagggtcaccgtgctgggtcacgtgcaaaggggcgggaccccatcagcctttgaccggattcttgggtctaggatgggagtggaggctgtcatggcactgcttgaggggacccccgatacacctgcctgcgtggtctcactcagcggcaatcaggcagtccgactcccgttaatggaatgtgttcaggtaacaaaagatgttacaaaagctatggacgaaaagaaattcgatgaagcactcaagctgcgtggtcggtctttcatgaataattgggaagtatacaagcttctggcccatgtaaggccacctgtctccaaatctggttcccacaccgtcgctgtgatgaatgtgggcgcccctgccgcaggtatgaatgccgccgtgagaagtaccgtcaggattggcctgatccaggggaaccgggtcctcgtcgtgcacgacggcttcgagggcctggcaaaaggacagatcgaagaggccgggtggagctacgtcggtggctggaccggacaagggggatccaagctaggaaccaagagaacactaccaaaaaagagctttgagcagatatccgcgaatattacaaaatttaacatacaggggctggtgataatcgggggttttgaagcctatacggggggcctagagctgatggaaggccggaagcaatttgatgaattgtgcatccctttcgtagtaattccagctactgtttccaacaacgttcccggctcagacttctctgttggcgccgatactgcactcaacaccatctgcacaacatgtgatagaattaagcagagcgctgccgggaccaagcggagagtgttcattattgaaacaatgggcggttactgtgggtatctggccaccatggccggcttagctgctggcgccgatgcagcatatatctttgaggagccattcacaattcgggaccttcaggcgaatgtggagcacctggttcagaaaatgaaaacaacagtgaaaagagggttggtgctgaggaacgaaaaatgtaacgagaactacacaacggatttcatcttcaacctctactctgaggaaggaaaagggatatttgacagtcgtaaaaatgttcttggccatatgcaacagggcggcagtcccacccccttcgatcgcaacttcgccacaaagatgggggcaaaagctatgaattggatgagcggcaagatcaaggaatcttatcgcaacggtcgtatcttcgccaatacacctgattcaggctgtgtgctaggcatgaggaaaagggctctagtgttccaaccagttgccgaactaaaggatcagacggatttcgagcataggatccccaaagagcagtggtggcttaagctccgccccatcctgaaaattttggccaaatacgagattgaccttgacacctcggatcatgcccacctggagcacattacccggaagcgcagcggcgaagcagctgtctag

SEQ ID NO: 199400 - DNA, 354 bp, Artificial Sequence
  Description of Artificial Sequence: Synthetic coding sequence
atgacccacgaggagcaccacgccgccaagaccctgggcatcggcaaggccatcgccgtactgacttccggtggagacgcccagggtatgaacgcagcggtacgggccgtcgtccgagtgggcatatttacaggggcccgtgtgttcttcgtccatgagggctaccaggggctggtggacggaggagatcatatcaaggaggccacttgggagagtgtctccatgatgctgcagctgggaggtacagtaattggcagcgcacggtgcaaggacttccgggagagagaaggtaggctcagggcagcatacaatctcgtgaaacgggggataactaatctgtgtgtgataggctag

SEQ ID NO: 199401 - DNA, 486 bp, Artificial Sequence
  Description of Artificial Sequence: Synthetic coding sequence
atgacccacgaggagcaccacgccgccaagaccctgggcatcggcaaagccatcgcggttctgacgagtggcggcgatgcccaagggatgaatgcggcagtccgtgcggtcgtgagggttgggatttttaccggcgctcgcgtgttttttgttcacgagggctaccaggggcttgtggacggaggagatcacattaaggaagctacgtgggagagcgtctccatgatgctccagcttggcggaacggtgattggaagcgcaagatgtaaggactttcgcgaaagagaggggcgattgagggccgcgtataacctggttaaacgcggcatcaccaacctgtgcgtgatagggggagacgggagtctgactggagccgacacctttcggtctgaatggagtgacctgctgtctgatctccagaaggcaggtaaaatcacagacgaagaagctaccaaaagcagttatttgaacattgttgggctgtag

SEQ ID NO: 199402 - DNA, 474 bp, Artificial Sequence
  Description of Artificial Sequence: Synthetic coding sequence
atgacccacgaggagcaccacgccgccaagaccctgggcatcggcaaggctatcgccgtactgacgagtggcggtgacgctcagggtatgaatgccgcagttcgcgccgttgttagagtggggatttttactggagcgagggtgttcttcgtgcacgaaggataccaaggtcttgtggatgggggcgaccatattaaagaagctacatgggaaagcgtgtcaatgatgttacagctcggcggtaccgtgataggctcagctcggtgcaaggacttccgggaacgcgaaggaaggctcagggcggcttacaacctggtcaagcgaggtattactaacctgtgcgtgatcgggggcgatgggtcactgactggtgccgacaccttcagatcagagtggagtgacttgctgtctgatctccaaaaggccggcaagataacggatgaggaggcgacaaaatctagctatctcaactag

SEQ ID NO: 199403 - DNA, 258 bp, Artificial Sequence
  Description of Artificial Sequence: Synthetic coding sequence
atgacccacgaggagcaccacgccgccaagaccctgggcatcggcaaagcaatcgccgtcctgactagcggaggggatgcccaaggcatgaacgcagcagtgcgagcagtcgtgcgggtgggtatatttacgggcgcgcgtgtgttcttcgttcacgagggttaccaggggctcgtagacggcggtgatcacatcaaggaggcaacctgggagtccgtttcaatgatgctccaactgggaggcactgtgatcggttag

SEQ ID NO: 199404 - DNA, 420 bp, Artificial Sequence
  Description of Artificial Sequence: Synthetic coding sequence
atgacccacgaggagcaccacgccgccaagaccctgggcatcggcaaggcgatcgccgtgctgacttccggcggggacgcgcaggggatgaatgctgccgtgagggctgtcgtcagagtcggaatctttacgggcgcccgtgtgttttttgtacatgagggctatcaaggtctcgtggacggaggagaccacatcaaagaggccacctgggagagcgtgtccatgatgctgcagctggggggcaccgtgatcgggagcgcacgctgcaaggattttcgcgaaagagaggggcggttacgggcggcgtacaatctcgtgaagaggggtattaccaatctttgcgttattgggggggatgggtccctgaccggtgctgatacttttaggtccgagtggtcggacttactttctgatctgtag

SEQ ID NO: 199405 - DNA, 2250 bp, Artificial Sequence
  Description of Artificial Sequence: Synthetic coding sequence
atgacccacgaggagcaccacgccgccaagaccctgggcatcggcaaagcaattgcggtccttacaagcggaggagacgcccaaggaatgaacgcggccgtcagagctgtggtccgggttggaatctttactggggcccgcgtgttctttgtgcatgaaggctaccagggcctcgtcgatggaggggatcacatcaaggaagccacctgggagagtgtgtcaatgatgctgcagctgggggggactgtgatcgggtctgccagatgtaaagatttccgcgagcgagaaggtaggttaagagctgcgtataacctagtcaagcggggtataactaacctctgtgttattgggggggacggttcccttactggggccgatacgttccgctccgagtggagcgacttactgtcagacttacagaaggctggtaagataactgatgaagaagccaccaaaagctcctatctcaacatcgtggggctcgtcggttctattgacaacgatttctgcggaacagacatgaccatcggaaccgactcggccctacatagaattatggagattgttgacgcaataactactaccgcacagtcacaccagcggacattcgttcttgaagtgatgggccgccattgcggatatctggctctggtgacaagtctcagctgcggtgccgactgggtgtttattcctgagtgtccaccggatgacgattgggaagaacatttgtgtcggagattgtccgagacaagaaccagagggtcacgcctgaatatcatcatcgttgctgaaggagcaattgacaagaatggaaaaccaattactagtgaggacatcaaaaacggtagtcggatgggagtggaggcagtaatggccctgctggagggcacccctgatactcctgcctgcgtggtatccctctccgggaaccaggcagtccggcttcccttaatggagtgtgtgcaggtgacaaaggacgttacaaaagcaatggacgaaaagaagtttgacgaagccctgaagctccgcggtcggagttttatgaacaattgggaggtgtacaagctcttagcccacgtcagaccaccagtgtccaagtccggatctcatacagtggctgtaatgaacgtgggcgcccctgctgcgggcatgaatgctgccgtgaggtccacggtgaggattgggctcatacagggtaacagggtattggtggtccatgacggtttcgaggggctggccaagggtcagatagaagaagcaggttggagctacgtgggaggctggacgggccagggcgggagcaaactgggaaccaaaaggacacttcctaagaaatcatttgagcagattagcgccaatatcactaagtttaacatccagggtctcgttatcatcggtgggttcgaggcctacacgggcggattggagctgatggagggcaggaaacagtttgatgaactgtgcatccccttcgtcgtcattcccgcaactgtcagcaacaacgtccccggatcagacttttctgttggggctgatacggccctgaatactatctgcacaacatgcgacaggattaagcagtccgccgcaggcaccaagaggagggtttttataatagaaactatgggcggatattgtgggtacttagcaactatggctggattggctgcaggagctgatgcagcttacattttcgaggaaccgttcacaatccgagatctgcaggctaacgtggaacacctcgtgcagaagatgaaaacaacagtcaaaagagggctagtactgaggaacgagaagtgtaacgaaaactacactacagatttcatttttaatctctattcagaggaggggaagggcattttcgacagtcggaaaaacgttttaggccatatgcagcagggtggaagccctacgcccttcgaccggaactttgctaccaaaatgggcgccaaagccatgaattggatgtccgggaaaatcaaggagtcttatcggaatggacggattttcgcaaacacgcctgactctgggtgcgtcctgggtatgagaaagcgggcactcgttttccagcccgtggccgaactgaaagatcagaccgatttcgagcatagaatcccgaaagagcagtggtggcttaaactgagaccaatcttgaaaattctggcaaaatacgagatcgacttggatacttccgatcacgcccaccttgagcatattacaagaaagagaagtggggaggcagctgtctag

SEQ ID NO: 199406 - DNA, 609 bp, Artificial Sequence
  Description of Artificial Sequence: Synthetic coding sequence
atgggcggctactgcggctacctggccaacatgggcggcctggccgccggcgctgacgcagcatacattttcgaagagccattcgacatccgtgacttgcagtcaaatgttgagcatttgaccgagaagatgaaaacaactattcagcgcggtcttgtgctcaggaatgaatcatgtagtgaaaactacaccactgattttatttatcagttatacagcgaagagggcaagggggtcttcgattgccgcaagaacgttctgggtcacatgcaacaaggaggcgcacccagtccttttgataggaatttcggaactaagatttctgccagggctatggaatggatcactgcgaagctgaaagaagcgagaggcaggggaaagaaatttaccactgacgattctatctgcgtactggggatatccaagcggaatgtcatctttcaacctgtggccgagttgaaaaaacagacagatttcgaacacagaataccaaaagagcaatggtggctgaagcttaggcctctcatgaaaattctcgctaagtataaggccagttacgatgtttcagacagcggacagcttgaacatgtgcagccctggtcggtgtag

SEQ ID NO: 199407 - DNA, 2331 bp, Artificial Sequence
  Description of Artificial Sequence: Synthetic coding sequence
atgtgcggctacgagcggtgccggccctgccggggcgcccacggctatcttcgaggaggccagggagtgctgcacctgcgtggtctccctgggcacgggggaagaagattgaaacaccgcaggggcagactgggggagtgcttgcagcacccagcttcgggcgcggtccggggcgattggagagagaagccaggctgttggtcccatcgctttccctgtccaggacgacacgctctcgtggggggcaccattatcgggtctgctaggtgtcaggcatttcggacccgggaaggccgtctgaaggctgcctgtaatctattacagcggggtatcacgaatttgtgtgtcataggcggcgacggctcactgacaggggccaacttgttccgtaaagagtggtctggtcttctggaagagcttgccaggaacggacagatagacaaagaggccgtacagaaatacgcatacttgaacgtagtaggcatggtggggtccatcgataatgatttctgtggcaccgatatgaccataggaactgacagcgcactacacaggatcattgaggtggtggatgcaatcatgacgacagcccagagccatcagcggacctttgtgctggaggtcatgggtcgccactgcggctatttagcattagtcagtgccctggcttgtggagctgattgggtgttccttccggaatcccctccagaggagggatgggaggagcagatgtgtgtcaagttgtctgaaaaccgagctcggaagaaaagactgaatatcattatcgtcgccgaaggggcaatcgacacccagaacaagcccattacctccgaaaagatcaaagaactcgtggtcacacagctgggctatgacactcgtgtcactattcttggacacgtccagcggggaggcactccttccgccttcgatagaatcctggcctctagaatgggagttgaagccgttatcgccctactagaggcgacacctgataccccagcttgcgtcgtgagtcttaacggcaaccatgccgtgagactaccactaatggagtgcgtgcagatgacccaggatgtccagaaggcaatggacgaacgaagatttcaggatgcggtgcgcctgcgaggtcgcagcttcgcaggaaatctgaatacctataaaagactcgcaatcaaacttcctgacgaccagatcccgaagacaaattgcaatgtagctgtcatcaatgtgggcgcccctgccgctggaatgaatgccgctgtccggtccgccgtgagggtagggattgcagatggccaccgcatgctggccatttacgatggatttgacggctttgcaaaaggtcagattaaagagattgggtggactgacgtcggaggatggaccggccagggcgggtccatcctcggcaccaagcgagttttaccaggaaaatatctggaggagatcgcgactcagatgcgcacccatagcattaatgccctgctaatcatcgggggcttcgaagcctatttgggactgttggagctctccgcagctagagagaagcacgaggagttttgtgtccccatggtaatggtgccggccaccgtatcaaataatgttccaggctcagacttttccattggcgctgataccgcccttaacactattacagacacttgtgaccgcattaaacagtcagcttctggtacaaagagaagggtgttcataatcgagactatgggcgggtactgcggctatcttgcaaatatgggcggcttagcagccggtgccgatgcagcttacatttttgaagaaccattcgacatccgcgatctccagagcaatgtagaacacctgaccgagaagatgaagaccacaattcagcggggactcgtacttcggaacgagtcatgcagtgaaaattacaccaccgactttatctatcagctctatagtgaggaaggcaaaggtgtatttgattgccgaaaaaatgtcctggggcacatgcaacagggtggagcgccatccccttttgatcggaactttggcaccaaaatttcagcgagagcaatggaatggattaccgctaagctaaaggaagcaaggggacgtggcaaaaaatttaccactgatgactctatttgcgtgctgggaatcagcaaacgaaatgtgatcttccagcccgtcgctgaactgaagaagcagacggacttcgaacatagaatcccaaaggagcagtggtggctcaagctgcgccctctcatgaaaatcctggcgaaatacaaagcatcctacgatgtatcagacagtggccagctggagcacgtgcagccatggtccgtgtag

SEQ ID NO: 199408 - DNA, 2355 bp, Artificial Sequence
  Description of Artificial Sequence: Synthetic coding sequence
atggacgccgacgacagccgggcccccaagggcagcctgcggaagttcttagagcatctgagcggagcaggaaaggctattggcgtgctcacttctggaggagatgctcaggggatgaatgccgcagtccgggcggtcgtgcgcatgggcatttacgttggagccaaagtgtacttcatctatgaggggtaccaaggaatggtcgacggaggatccaatattgctgaggcagattgggaaagtgtaagctccatcctccaggtaggcggcacgattattggcagtgcacggtgtcaggcctttcggacccgcgaaggtcgccttaaggcagcctgtaatctactgcagagaggcatcaccaatctgtgtgtcattgggggggacggttccctgacaggggctaacctattccgaaaagagtggtctgggcttctggaggagcttgctcgcaacgggcaaatcgacaaggaagcagtccaaaagtacgcatacctgaacgttgtgggtatggtcggcagcattgataatgatttttgtggcacagacatgactataggcacagactccgccttgcatcgaattatagaggttgtggacgccataatgacaaccgctcagtctcatcagaggacctttgtgctggaagtgatgggccgacactgcggctatcttgccctggtgtccgcactggcctgcggtgctgactgggtgtttctacctgagtctccaccagaggagggatgggaggaacagatgtgcgtaaagttgtccgaaaatcgggcgcgtaagaagcgtctcaatataataatcgtcgcggaaggtgcgatcgacacccagaataagccgattaccagtgagaagattaaggagttggtcgtgacgcagttgggctacgacacacgcgtcaccattctcggacacgtacaaagaggaggtacaccttccgccttcgatcggattttggccagtagaatgggagttgaggccgtgatcgccctgctcgaagcaacacccgatacccccgcatgtgtcgtgtcactcaatggaaatcacgcagtgcgtttgcccttaatggaatgcgtgcagatgacccaagatgtgcagaaagccatggatgaacgtcggtttcaggacgcagtcaggcttcgcggccggagtttcgctggaaacctgaacacttacaagcgcctggccattaagctgcccgacgaccagatcccaaaaacaaactgcaatgtggccgtgataaacgtcggggcccctgcagccggcatgaacgcagcagtgcgaagcgctgtaagggtgggaatcgctgacgggcatcggatgttagctatttacgacggctttgatgggttcgccaagggacagatcaaggagatcggctggaccgacgttggtggctggaccggccaggggggtagtatcctcggaaccaagagggtgctccccgggaagtacctggaggaaatcgccactcaaatgcgaacccactctatcaacgctctgctcattatcggcggattcgaggcatatttgggcttactggaattgtccgctgcacgggagaagcacgaagaattctgtgtccctatggtcatggtgccagccacagtcagcaataacgtcccagggtccgacttttctattggcgcagacacggccttaaacactatcacagatacatgcgatcggattaagcagtctgctagcggaactaagcgccgagtgttcatcatagaaacaatgggtggttactgtggttacctagccaacatgggtgggctggcggcaggcgctgacgccgcctacatcttcgaagagccctttgatatacgggatctccagtcaaacgtcgagcacctcacagagaagatgaaaacgaccattcagaggggccttgtcctccgaaacgaaagttgcagcgaaaactatacaactgattttatataccagttgtacagcgaggaaggcaaaggtgtgttcgactgccgcaagaatgtcctagggcacatgcagcagggaggagctccttcaccattcgaccggaattttgggactaagatctccgctagagcgatggaatggattaccgcaaaattaaaggaggcgaggggaaggggtaaaaaatttactaccgacgactccatctgtgtgctgggaatatcaaagcgcaatgtgatctttcagccggtggcggaacttaagaaacaaaccgatttcgagcatcggatccctaaggaacagtggtggctcaaacttcgcccacttatgaagatactggcaaagtacaaagcatcatatgacgtgtccgactctggccaattggaacacgtgcagccttggtctgtgtag

SEQ ID NO: 199409 - DNA, 2322 bp, Artificial Sequence
  Description of Artificial Sequence: Synthetic coding sequence
tacgagcggtgccggccctgccggggcgcccacggctacctgcggggcggtcaaggtgtcttgcatctcagagggctgcccgggcacgggggacggcgcctgaaacaccgcaggggccgccttggtgaatgtcttcaacatccggccagcggggccgtgcgaggcgattggcgggagaaacccggatgctggtcacatagattcccctgtcctggacgccacgctctggtgggagggacaatcatcggctccgccaggtgtcaggcctttaggaccagagagggacggctgaaagctgcgtgcaatctcctacagaggggcatcacgaatttatgtgtgataggaggggatggttccttgaccggagctaatctatttcggaaggagtggtcaggccttctcgaggaactcgcgcggaacggacagattgataaagaggccgtgcaaaaatacgcctacctaaacgtggtgggaatggtgggcagtatcgataatgatttctgcggtactgatatgacaatagggaccgactccgcacttcacagaataattgaggtggtcgacgctatcatgaccaccgctcagagccatcagcgcacattcgtgctagaagtgatgggcaggcattgtggctacctcgcccttgtgtcagccttggcttgcggagcagactgggtcttcttacccgagagtccccctgaggaggggtgggaagagcagatgtgtgtcaagttatccgagaatcgggctcggaagaagaggctgaacataatcatcgtggcggagggggctatcgatacccagaataagccaatcacctcggaaaaaatcaaagagctggtcgtaacccaactcgggtacgacacacgcgtgaccatcctcgggcatgtgcagagggggggcactccttctgcctttgaccggattttggcctccaggatgggcgttgaggcagttatagccttgctggaggctaccccggacacaccggcctgtgtggtgtctcttaacggtaaccatgctgtgcgcctgcccctgatggagtgcgtccagatgactcaggatgtccaaaaggcgatggatgaaaggcggtttcaggatgctgtgcggctccggggtagatcatttgccggcaatctgaacacgtacaagagactcgcaattaagctgcctgacgaccagattcctaagaccaactgcaatgtggccgtgatcaacgtgggcgccccggccgctggaatgaacgccgcagtgaggagtgcagtcagggtgggcattgcggacggtcacaggatgttagccatctacgatgggttcgacgggttcgctaaaggtcagatcaaagagataggatggacggatgtggggggctggacaggccaagggggttccattttagggaccaagagagtgttaccggggaagtacttggaagaaattgccacccaaatgcgaacccattcaattaacgccttgttaatcataggggggttcgaagcatatctcggcttgctggaattgtcagcggcccgggagaagcatgaggaattctgcgttcccatggtgatggtgccagccactgtctctaacaacgtgcccgggtctgacttttccataggtgccgacacagcactcaatacaatcaccgacacatgcgaccggattaaacagagtgcgtccggtacgaagcgcagggtgttcatcattgagactatggggggctactgcgggtacctcgccaatatgggaggactcgcagcaggggctgacgccgcttatatatttgaggagcccttcgacatcagggatcttcagtccaatgtggagcacctcactgaaaaaatgaaaactactatacaacgagggctggttctaaggaatgagtcgtgttctgagaattacacaacagatttcatttaccaactgtactccgaagaagggaagggcgtcttcgactgcagaaaaaatgtgttgggccacatgcagcagggcggcgctccctccccctttgacagaaactttggaactaagatatctgcccgggctatggagtggatcaccgccaagcttaaagaggctagaggtagaggcaagaaatttactaccgatgattcaatctgcgtactggggatcagcaagcgcaacgttatatttcagcctgttgcagaacttaagaagcagaccgactttgagcaccgaattcccaaagagcagtggtggctcaagttgcggccacttatgaagatcctcgccaaatacaaagccagctatgatgtgtcggacagcgggcagttggaacacgtgcaaccctggtccgtgtag

SEQ ID NO: 199410 - DNA, 633 bp, Artificial Sequence
  Description of Artificial Sequence: Synthetic coding sequence
atgaacgccgccgtgcgggccgtggtgcggatgggcatctacgtgggcgctaaggtctatttcatttacgagggctaccagggtatggttgatggaggatccaatatagccgaggcagactgggaatcagtaagttcgattctgcaggtcggaggcactattattggaagcgctcggtgccaggcgtttcgcacccgcgaaggcagacttaaggcggcttgcaatttgctccaacgaggaattacaaacttatgcgtgatcggaggcgatggatccctaacaggcgcgaatctgttccgtaaagagtggtccggactgctagaagaattagctcggaacgggcagattgacaaggaggcagtgcaaaagtacgcttaccttaacgtggttgggatggtgggctccattgacaatgatttctgtggcactgacatgaccattggcacagatagcgccttacatcggatcattgaggtcgtcgatgcaatcatgactacagcccagagtcatcagagaacattcgtgcttgaagtaatgggtcgccattgcggatatctggccttggtgtcagctctcgcctgtggtgcggactgggtgtttctccccgagtcccctcccgaggaaggttggtag

SEQ ID NO: 199411 - DNA, 501 bp, Artificial Sequence
  Description of Artificial Sequence: Synthetic coding sequence
tgagccgacggccaccggatgctggccatctacgacggcttcgacggttttgctaagggccaaatcaaagagatcggatggacagatgttggtggctggaccggccagggtggtagtatattaggtacaaaaagagtcttgcctggaaagtacctggaggagattgctacacaaatgcgcactcattctattaacgccctgctgatcatcggggggttcgaggcttacaaaagcgcttgtgatatggctgaagctcgcggaaggcaccaagagctgtgcattcccctgtgtgtggtccccgcaaccatctccaataacgttccgggcacagagataagcctgggatctgacacaggtctcaatgccgtagtggagacatgtgacagaatcaaacagagcgcgtcaggaaccaagaggagagtgtttatcattgagactatggggggatactgcgggtacttagctaacatgggagggcttgccgccggcgccgacgcgtag

SEQ ID NO: 199412 - DNA, 723 bp, Artificial Sequence
  Description of Artificial Sequence: Synthetic coding sequence
atgggccggcactgcggctacctggccctggtgagcgccctggcctgcggcgctgattgggttttccttccagaatctccaccagaagagggatgggaagagcagatgtgtgtcaaactatccgagaaccgtgccagaaaaaaaaggctgaatatcatcatagtggcagagggagctatagatacccagaacaagccaatcacttccgagaagattaaggagctggtagtgacccaacttggatatgatacccgggtcacgatcctgggacacgtccagagaggcggcaccccatctgctttcgacagaattcttgcatctcgcatgggtgtcgaggccgttatcgccctccttgaggcaaccccagatactccggcctgtgtggtgtctctgaacggcaaccacgcggtacgactcccacttatggagtgcgtccagatgacgcaagacgtccaaaaagctatggacgagaggagatttcaggacgcggtgaggttacggggacgttcctttgcaggcaatctgaacacctacaagcgactggctatcaaattgcctgacgatcaaatccctaaaactaactgcaatgtcgccgtgattaacgtaggggcccctgccgccggtatgaatgctgccgtgagatccgcagtgcgcgtcggaatcgcagacgggcataggatgttggctatctacgatggctttgacggatttgccaaaggatag

SEQ ID NO: 199413 - DNA, 501 bp, Artificial Sequence
  Description of Artificial Sequence: Synthetic coding sequence
atgaacgccgccgtgcgggccgtggtgcggatgggcatctacgtgggtgctaaggtatatttcatttatgagggctaccaggggatggtggatggcggctctaatatcgcagaagccgattgggaatctgtgtcctcaattcttcaggtgggcggtacgattatcggaagcgcgcggtgccaggcctttcggactcgcgaaggccggctcaaggccgcatgcaaccttctgcaacgtggcataaccaatctttgcgtcatcggtggggacggctcactgacaggtgccaatctttttcggaaggaatggtccggattgctggaagagttggcaaggaatgggcaaatcgataaggaggcagtgcagaagtacgcttatctcaacgtggtgggaatggtgggaagcatcgacaatgatttttgtgggactgacatgacaattgggaccgacagcgccctccacaggattatcgaggtggtcgatgcgatcatgaccacatag

SEQ ID NO: 199414 - DNA, 312 bp, Artificial Sequence
  Description of Artificial Sequence: Synthetic coding sequence
tgattcatctaccagctgtacagcgaggagggcaagggcgtgttcgattgtcgaaagaacgtgctgggccatatgcagcaggggggggctccgagcccattcgaccggaattttggcaccaaaatctccgctcgggctatggaatggatcactgctaaattaaaagaagcaagagggaggggtaaaaaatttactaccgatgactccatctgcgtgcttggaataagcaagcgaaatgttatcttccagccagtggcagagcttaaaaaacagacagatttcgaaaccgttagtatgcaaccaccacgatag

SEQ ID NO: 199415 - DNA, 1743 bp, Artificial Sequence
  Description of Artificial Sequence: Synthetic coding sequence
atgagcgacttcgaggagtggatcagcggcacctaccggaagatggaggaaggtcctttaccactgctgacgttcgccactgccccttaccacgaccagaagcctggcacgtccgggctcagaaaaaaaacctattattttgaagagaaaccgtgttacctggagaattttatccaatctatctttttttccattgatttaaaggacaggcaggggtcgagtctggtggtaggaggagacggtaggtatttcaataagtccgcaatcgagaccatcgttcaaatggctgccgcaaacggtataggccggctggtcattggccagaatggcatcctttcgacccccgctgtgtcatgcatcatacggaaaatcaaggccatcgggggaatcatattgactgcctctcacaatccaggcgggcctaatggagattttggtatcaaattcaatatttctaatggcggcccagctcccgaagctattactgacaagatattccaaattagcaaaacaatcgaagagtacgcggtgtgtcccgatcttaaagtcgacctgggcgtcttggggaagcagcagtttgacctggagaacaaattcaagcccttcaccgtggagatagtggactctgtggaagcgtacgctaccatgctcagatccatttttgacttctctgcactgaaagagctgttaagtggcccaaaccgcctgaaaatccgcattgatgccatgcatggagtcgtcggaccatatgtcaagaaaatactttgtgaagagctgggagctcccgcgaacagtgctgtgaactgcgtcccactcgaagactttggcgggcaccatccagatcctaacctcacgtatgcagccgatctggtcgagaccatgaagagtggggaacatgacttcggcgcagcattcgatggcgatggtgacaggaatatgatcctggggaagcatggattttttgtcaacccatctgacagtgtcgcagtaatcgccgccaatatatttagcatcccctattttcagcaaacaggggtaaggggattcgccaggagtatgccaacatccggcgccctcgatcgcgtcgcctccgcaaccaaaatcgccctgtatgagaccccaaccggctggaaattctttggaaatctgatggacgccagtaagctgagcctttgcggtgaggaaagctttggaaccggcagcgatcatattcgagaaaaagatggactgtgggccgtcctggcatggctttctattctggctaccagaaagcagagcgtcgaagatatccttaaagatcattggcaaaagtatggtaggaatttctttacacgatacgattatgaagaggtggaggccgagggcgcgaataaaatgatgaaggacctggaggccttaatgtttgacagatcctttgtaggaaaacagttctcggccaatgacaaggtgtatacggtcgagaaggcagataactttgaatacagcgatcccgtggatggaagcatctccagaaatcagggattgcggctgatcttcacggatgggtcaaggatagtttttcgtctctcaggcaccggctctgcgggcgccaccatccggctgtatatcgactcatatgaaaaggatgtcgcaaagatcaaccaggatccacaagtcatgctagcacctttaatcagcatcgccttgaaggtcagccagctgcaggaaagaacaggtcgtaccgcaccaactgtaataacttag

SEQ ID NO: 199416 - DNA, 1689 bp, Artificial Sequence
  Description of Artificial Sequence: Synthetic coding sequence
atggtgaagatcgtgaccgtgaagacccaggcctaccaggaccagaagcccggcactagcggtcttaggaaaagagttaaagttttccagagcagcgctaactatgccgagaacttcatccaaagtataatctctaccgtcgagcccgcccagagacaggaagccacattggttgtgggcggtgatggccggttttatatgaaggaggcgatccaactgatagccagaattgccgcagccaacggcataggccgactggtgattggtcagaatggcattctctctacacccgccgtttcatgtattatcaggaaaatcaaggcgattggcggaatcatactgaccgcttctcacaacccaggcggcccaaatggcgatttcggcataaagtttaacatcagtaatggggggcccgcaccagaagcaattacagacaaaatctttcagatcagcaaaaccattgaggaatacgcagtgtgtcccgatcttaaggtggacctcggcgtgctgggcaagcaacagttcgacctagaaaacaaatttaagcccttcacagtcgagatcgtggatagtgtggaagcttacgctaccatgctgcgaagtatttttgatttctcagccctgaaggaactactgtctggccctaatcgcctgaagatacgtatagatgcaatgcacggagtcgtgggcccttatgtaaagaaaatcctatgcgaagaactgggcgccccagccaattcagctgtaaattgcgtgcccctggaggactttggcggccaccatcctgaccccaacctaacttacgccgccgatctcgtggagaccatgaagtccggagaacacgatttcggcgccgcgttcgatggggacggagataggaatatgattctggggaaacacggcttttttgtgaacccgtccgactctgttgctgttattgccgccaatattttctcaattccgtatttccagcaaacaggtgtgcgcggatttgccagaagcatgcccacctccggggcgcttgatagggtcgcctcagccacaaagattgctctgtacgagacaccaactggatggaagttttttggaaatctaatggatgcctccaagctcagcttgtgcggtgaggagagttttgggacaggaagcgaccacatcagggagaaggatggactgtgggccgtgttagcttggctgtctatactggctactagaaagcaaagcgtcgaagacatactgaaggaccattggcagaaatacggccgtaacttcttcacccgttatgattacgaagaggtagaggcagagggcgctaataaaatgatgaaggatctcgaagccttgatgttcgatagatctttcgtggggaaacaattttccgcgaatgacaaggtgtatactgtggagaaagctgacaactttgagtactccgaccctgtggatggctctatctcccggaaccaaggtctcagattaatctttaccgatgggtctcggatcgtctttcgactgagtggcacaggctccgccggagctaccattagactttatatagattcatatgagaaggacgtcgcaaagatcaatcaagatcctcaggtgatgcttgcccctctgatttccatcgcactcaaggtatctcagttgcaagagagaaccggccgcacagcccccactgtgattacatag
